United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 33

SEQ ID NO: 1184505 - RNA, 17 nt, Mycobacterium bovis subsp bovis AF2122/97
cgcacugcgccggccgg

SEQ ID NO: 1184506 - RNA, 16 nt, Mycobacterium bovis subsp bovis AF2122/97
cgcacuggucaacacg

SEQ ID NO: 1184507 - RNA, 23 nt, Mycobacterium bovis subsp bovis AF2122/97
cgcagaauccggcaaccaccggc

SEQ ID NO: 1184508 - RNA, 15 nt, Mycobacterium bovis subsp bovis AF2122/97
cgcagaaucgcauga

SEQ ID NO: 1184509 - RNA, 16 nt, Mycobacterium bovis subsp bovis AF2122/97
cgcagaccugcaucac

SEQ ID NO: 1184510 - RNA, 16 nt, Mycobacterium bovis subsp bovis AF2122/97
cgcagacgcggcaggu

SEQ ID NO: 1184511 - RNA, 18 nt, Mycobacterium bovis subsp bovis AF2122/97
cgcagaccguccagcaac

SEQ ID NO: 1184512 - RNA, 19 nt, Mycobacterium bovis subsp bovis AF2122/97
cgcagaccguccagcaaca

SEQ ID NO: 1184513 - RNA, 22 nt, Mycobacterium bovis subsp bovis AF2122/97
cgcagaccguccagcaacagcg

SEQ ID NO: 1184514 - RNA, 12 nt, Mycobacterium bovis subsp bovis AF2122/97
cgcacccagccc

SEQ ID NO: 1184515 - RNA, 15 nt, Mycobacterium bovis subsp bovis AF2122/97
cgcacccguccgccg

SEQ ID NO: 1184516 - RNA, 18 nt, Mycobacterium bovis subsp bovis AF2122/97
cgcaccccggccgcgcgc

SEQ ID NO: 1184517 - RNA, 22 nt, Mycobacterium bovis subsp bovis AF2122/97
cgcacccauuuaaacgggccgg

SEQ ID NO: 1184518 - RNA, 14 nt, Mycobacterium bovis subsp bovis AF2122/97
cgcaccccgcccga

SEQ ID NO: 1184519 - RNA, 12 nt, Mycobacterium bovis subsp bovis AF2122/97
cgcaccaggcgg

SEQ ID NO: 1184520 - RNA, 12 nt, Mycobacterium bovis subsp bovis AF2122/97
cgcaccaggguu

SEQ ID NO: 1184521 - RNA, 16 nt, Mycobacterium bovis subsp bovis AF2122/97
cgcaccaguccagcgg

SEQ ID NO: 1184522 - RNA, 20 nt, Mycobacterium bovis subsp bovis AF2122/97
cgcaccagcugucgggcagc

SEQ ID NO: 1184523 - RNA, 14 nt, Mycobacterium bovis subsp bovis AF2122/97
cgcaaugcguugac

SEQ ID NO: 1184524 - RNA, 22 nt, Mycobacterium bovis subsp bovis AF2122/97
cgcaaugaccgcggauuccggc

SEQ ID NO: 1184525 - RNA, 16 nt, Mycobacterium bovis subsp bovis AF2122/97
cgcaagccauccccgg

SEQ ID NO: 1184526 - RNA, 24 nt, Mycobacterium bovis subsp bovis AF2122/97
cgcaagccucguggugagaucaug

SEQ ID NO: 1184527 - RNA, 16 nt, Mycobacterium bovis subsp bovis AF2122/97
cgauuucgaugacgaa

SEQ ID NO: 1184528 - RNA, 21 nt, Mycobacterium bovis subsp bovis AF2122/97
cgauuucgaugacgaacaaga

SEQ ID NO: 1184529 - RNA, 19 nt, Mycobacterium bovis subsp bovis AF2122/97
cgcaauauccuccagcagg

SEQ ID NO: 1184530 - RNA, 16 nt, Mycobacterium bovis subsp bovis AF2122/97
cgcaauaugccacaga

SEQ ID NO: 1184531 - RNA, 23 nt, Mycobacterium bovis subsp bovis AF2122/97
cgcaauaagggagaccgcggccg

SEQ ID NO: 1184532 - RNA, 17 nt, Mycobacterium bovis subsp bovis AF2122/97
cgcaagguugccaacgc

SEQ ID NO: 1184533 - RNA, 18 nt, Mycobacterium bovis subsp bovis AF2122/97
cgcaagguugccaacgcc

SEQ ID NO: 1184534 - RNA, 22 nt, Mycobacterium bovis subsp bovis AF2122/97
cgcagcgacgggaaagccaccu

SEQ ID NO: 1184535 - RNA, 23 nt, Mycobacterium bovis subsp bovis AF2122/97
cgcagcgaagaccagcggcggcg

SEQ ID NO: 1184536 - RNA, 16 nt, Mycobacterium bovis subsp bovis AF2122/97
cgcagcgaaucuccaa

SEQ ID NO: 1184537 - RNA, 15 nt, Mycobacterium bovis subsp bovis AF2122/97
cgcagcgaggagccc

SEQ ID NO: 1184538 - RNA, 14 nt, Mycobacterium bovis subsp bovis AF2122/97
cgcagcgaggagcc

SEQ ID NO: 1184539 - RNA, 18 nt, Mycobacterium bovis subsp bovis AF2122/97
cgcagccgggcaccaccc

SEQ ID NO: 1184540 - RNA, 21 nt, Mycobacterium bovis subsp bovis AF2122/97
cgcagccgguuaauggaauga

SEQ ID NO: 1184541 - RNA, 13 nt, Mycobacterium bovis subsp bovis AF2122/97
cgcagcccgccgg

SEQ ID NO: 1184542 - RNA, 19 nt, Mycobacterium bovis subsp bovis AF2122/97
cgcagcccgugacugguga

SEQ ID NO: 1184543 - RNA, 15 nt, Mycobacterium bovis subsp bovis AF2122/97
cgcagccggcccguc

SEQ ID NO: 1184544 - RNA, 14 nt, Mycobacterium bovis subsp bovis AF2122/97
cgcagccgccucaa

SEQ ID NO: 1184545 - RNA, 23 nt, Mycobacterium bovis subsp bovis AF2122/97
cgcagccgccucaaugaccaccg

SEQ ID NO: 1184546 - RNA, 22 nt, Mycobacterium bovis subsp bovis AF2122/97
cgcagcucgcugauaguggcgc

SEQ ID NO: 1184547 - RNA, 15 nt, Mycobacterium bovis subsp bovis AF2122/97
cgcagcuccucgccc

SEQ ID NO: 1184548 - RNA, 15 nt, Mycobacterium bovis subsp bovis AF2122/97
cgcagcggccagccc

SEQ ID NO: 1184549 - RNA, 22 nt, Mycobacterium bovis subsp bovis AF2122/97
cgcagcugacgucaccacgauc

SEQ ID NO: 1184550 - RNA, 12 nt, Mycobacterium bovis subsp bovis AF2122/97
cgcagcgcggcu

SEQ ID NO: 1184551 - RNA, 22 nt, Mycobacterium bovis subsp bovis AF2122/97
cgcagcgccugcggcagcaccc

SEQ ID NO: 1184552 - RNA, 14 nt, Mycobacterium bovis subsp bovis AF2122/97
cgcagcgccagcgg

SEQ ID NO: 1184553 - RNA, 13 nt, Mycobacterium bovis subsp bovis AF2122/97
cgcagcgccgcca

SEQ ID NO: 1184554 - RNA, 12 nt, Mycobacterium bovis subsp bovis AF2122/97
cgcagcagacca

SEQ ID NO: 1184555 - RNA, 20 nt, Mycobacterium bovis subsp bovis AF2122/97
cgcagcaccggcucgacugc

SEQ ID NO: 1184556 - RNA, 20 nt, Mycobacterium bovis subsp bovis AF2122/97
cgcagcacccugcgggccga

SEQ ID NO: 1184557 - RNA, 16 nt, Mycobacterium bovis subsp bovis AF2122/97
cgcagcaccggcucga

SEQ ID NO: 1184558 - RNA, 17 nt, Mycobacterium bovis subsp bovis AF2122/97
cgcagccagcugaacac

SEQ ID NO: 1184559 - RNA, 13 nt, Mycobacterium bovis subsp bovis AF2122/97
cgcagccagaucu

SEQ ID NO: 1184560 - RNA, 22 nt, Mycobacterium bovis subsp bovis AF2122/97
cgcagccagcaagucugcccga

SEQ ID NO: 1184561 - RNA, 14 nt, Mycobacterium bovis subsp bovis AF2122/97
cgcagccagcgcca

SEQ ID NO: 1184562 - RNA, 20 nt, Mycobacterium bovis subsp bovis AF2122/97
cgcagcauguggccgccguc

SEQ ID NO: 1184563 - RNA, 16 nt, Mycobacterium bovis subsp bovis AF2122/97
cgcagcaucuccgccg

SEQ ID NO: 1184564 - RNA, 21 nt, Mycobacterium bovis subsp bovis AF2122/97
cgcagcauguccgcagcggug

SEQ ID NO: 1184565 - RNA, 20 nt, Mycobacterium bovis subsp bovis AF2122/97
cgcagugcccgaucgcuucc

SEQ ID NO: 1184566 - RNA, 14 nt, Mycobacterium bovis subsp bovis AF2122/97
cgcagugagcagcc

SEQ ID NO: 1184567 - RNA, 22 nt, Mycobacterium bovis subsp bovis AF2122/97
cgcagugacguuccgcucgccg

SEQ ID NO: 1184568 - RNA, 19 nt, Mycobacterium bovis subsp bovis AF2122/97
cgcagucugauuccacauc

SEQ ID NO: 1184569 - RNA, 16 nt, Mycobacterium bovis subsp bovis AF2122/97
cgcaguucgucgugga

SEQ ID NO: 1184570 - RNA, 19 nt, Mycobacterium bovis subsp bovis AF2122/97
cgcaguuuggcggcgcgca

SEQ ID NO: 1184571 - RNA, 15 nt, Mycobacterium bovis subsp bovis AF2122/97
cgcaguuggcaccag

SEQ ID NO: 1184572 - RNA, 18 nt, Mycobacterium bovis subsp bovis AF2122/97
cgcaguuggcaccagccg

SEQ ID NO: 1184573 - RNA, 21 nt, Mycobacterium bovis subsp bovis AF2122/97
cgcaguccgguuacgcucgcg

SEQ ID NO: 1184574 - RNA, 23 nt, Mycobacterium bovis subsp bovis AF2122/97
cgcagucccgaacaauucacgca

SEQ ID NO: 1184575 - RNA, 20 nt, Mycobacterium bovis subsp bovis AF2122/97
cgcaggugccuuucggcaga

SEQ ID NO: 1184576 - RNA, 21 nt, Mycobacterium bovis subsp bovis AF2122/97
cgcagguuggcaagcacggcg

SEQ ID NO: 1184577 - RNA, 17 nt, Mycobacterium bovis subsp bovis AF2122/97
cgcagguggcuguucac

SEQ ID NO: 1184578 - RNA, 19 nt, Mycobacterium bovis subsp bovis AF2122/97
cgcagguggcuguucaccu

SEQ ID NO: 1184579 - RNA, 20 nt, Mycobacterium bovis subsp bovis AF2122/97
cgcagguggcuguucaccuc

SEQ ID NO: 1184580 - RNA, 16 nt, Mycobacterium bovis subsp bovis AF2122/97
cgcaggucgcuggccg

SEQ ID NO: 1184581 - RNA, 15 nt, Mycobacterium bovis subsp bovis AF2122/97
cgcagguagcggguu

SEQ ID NO: 1184582 - RNA, 18 nt, Mycobacterium bovis subsp bovis AF2122/97
cgcaggguucgucgggac

SEQ ID NO: 1184583 - RNA, 23 nt, Mycobacterium bovis subsp bovis AF2122/97
cgcaggggguggugucgcggccg

SEQ ID NO: 1184584 - RNA, 14 nt, Mycobacterium bovis subsp bovis AF2122/97
cgcaggggguggug

SEQ ID NO: 1184585 - RNA, 15 nt, Mycobacterium bovis subsp bovis AF2122/97
cgcagcugccgcacc

SEQ ID NO: 1184586 - RNA, 20 nt, Mycobacterium bovis subsp bovis AF2122/97
cgcagcugucccucgggauc

SEQ ID NO: 1184587 - RNA, 23 nt, Mycobacterium bovis subsp bovis AF2122/97
ccagugccgcccaccacacagcc

SEQ ID NO: 1184588 - RNA, 15 nt, Mycobacterium bovis subsp bovis AF2122/97
ccagugccgcccacc

SEQ ID NO: 1184589 - RNA, 13 nt, Mycobacterium bovis subsp bovis AF2122/97
ccagugccccgcc

SEQ ID NO: 1184590 - RNA, 15 nt, Mycobacterium bovis subsp bovis AF2122/97
ccagugccccgccga

SEQ ID NO: 1184591 - RNA, 15 nt, Mycobacterium bovis subsp bovis AF2122/97
ccagugccaccuggg

SEQ ID NO: 1184592 - RNA, 17 nt, Mycobacterium bovis subsp bovis AF2122/97
ccagugccaccugggcg

SEQ ID NO: 1184593 - RNA, 17 nt, Mycobacterium bovis subsp bovis AF2122/97
ccagugccagaacccgg

SEQ ID NO: 1184594 - RNA, 19 nt, Mycobacterium bovis subsp bovis AF2122/97
ccagugcgcaacccagccg

SEQ ID NO: 1184595 - RNA, 22 nt, Mycobacterium bovis subsp bovis AF2122/97
ccagugccguuucgaucugcac

SEQ ID NO: 1184596 - RNA, 20 nt, Mycobacterium bovis subsp bovis AF2122/97
ccagugcgcaacccagccgc

SEQ ID NO: 1184597 - RNA, 22 nt, Mycobacterium bovis subsp bovis AF2122/97
ccagugcgcagaacaccaccgc

SEQ ID NO: 1184598 - RNA, 15 nt, Mycobacterium bovis subsp bovis AF2122/97
ccagucgcgcagcgu

SEQ ID NO: 1184599 - RNA, 17 nt, Mycobacterium bovis subsp bovis AF2122/97
ccagucgaucgcggccc

SEQ ID NO: 1184600 - RNA, 18 nt, Mycobacterium bovis subsp bovis AF2122/97
ccagucgaugucaaggaa

SEQ ID NO: 1184601 - RNA, 19 nt, Mycobacterium bovis subsp bovis AF2122/97
ccaguccggcggacgugac

SEQ ID NO: 1184602 - RNA, 16 nt, Mycobacterium bovis subsp bovis AF2122/97
ccaguccguccagguc

SEQ ID NO: 1184603 - RNA, 14 nt, Mycobacterium bovis subsp bovis AF2122/97
ccaguccggacggc

SEQ ID NO: 1184604 - RNA, 17 nt, Mycobacterium bovis subsp bovis AF2122/97
ccaguccggacggcagc

SEQ ID NO: 1184605 - RNA, 17 nt, Mycobacterium bovis subsp bovis AF2122/97
ccaguccgaugggaauc

SEQ ID NO: 1184606 - RNA, 13 nt, Mycobacterium bovis subsp bovis AF2122/97
ccagucccaggug

SEQ ID NO: 1184607 - RNA, 14 nt, Mycobacterium bovis subsp bovis AF2122/97
ccaguccccgccgg

SEQ ID NO: 1184608 - RNA, 16 nt, Mycobacterium bovis subsp bovis AF2122/97
ccaguccccgccggcc

SEQ ID NO: 1184609 - RNA, 19 nt, Mycobacterium bovis subsp bovis AF2122/97
ccaguccccgccggccucc

SEQ ID NO: 1184610 - RNA, 13 nt, Mycobacterium bovis subsp bovis AF2122/97
ccagucggccacc

SEQ ID NO: 1184611 - RNA, 14 nt, Mycobacterium bovis subsp bovis AF2122/97
ccagucggccaccu

SEQ ID NO: 1184612 - RNA, 22 nt, Mycobacterium bovis subsp bovis AF2122/97
ccagugaacgcgcgugcagcca

SEQ ID NO: 1184613 - RNA, 19 nt, Mycobacterium bovis subsp bovis AF2122/97
ccagugaccguauuucguc

SEQ ID NO: 1184614 - RNA, 13 nt, Mycobacterium bovis subsp bovis AF2122/97
ccaguugcacauc

SEQ ID NO: 1184615 - RNA, 23 nt, Mycobacterium bovis subsp bovis AF2122/97
ccaguuggccggccagccauggc

SEQ ID NO: 1184616 - RNA, 17 nt, Mycobacterium bovis subsp bovis AF2122/97
ccauaauucgcccgcuc

SEQ ID NO: 1184617 - RNA, 16 nt, Mycobacterium bovis subsp bovis AF2122/97
ccauaggcguaaugcg

SEQ ID NO: 1184618 - RNA, 16 nt, Mycobacterium bovis subsp bovis AF2122/97
ccauagcgccgcgccc

SEQ ID NO: 1184619 - RNA, 23 nt, Mycobacterium bovis subsp bovis AF2122/97
ccauagcgccgcgcccaccauga

SEQ ID NO: 1184620 - RNA, 14 nt, Mycobacterium bovis subsp bovis AF2122/97
ccauagccugcgcc

SEQ ID NO: 1184621 - RNA, 15 nt, Mycobacterium bovis subsp bovis AF2122/97
ccagggucugcucau

SEQ ID NO: 1184622 - RNA, 18 nt, Mycobacterium bovis subsp bovis AF2122/97
ccagggucgaugucgucg

SEQ ID NO: 1184623 - RNA, 16 nt, Mycobacterium bovis subsp bovis AF2122/97
ccagggucugcucauc

SEQ ID NO: 1184624 - RNA, 15 nt, Mycobacterium bovis subsp bovis AF2122/97
ccagggucccgccgc

SEQ ID NO: 1184625 - RNA, 14 nt, Mycobacterium bovis subsp bovis AF2122/97
ccaggguggucagu

SEQ ID NO: 1184626 - RNA, 16 nt, Mycobacterium bovis subsp bovis AF2122/97
ccagggugucugugau

SEQ ID NO: 1184627 - RNA, 23 nt, Mycobacterium bovis subsp bovis AF2122/97
ccaggguuggcaccgucagacca

SEQ ID NO: 1184628 - RNA, 14 nt, Mycobacterium bovis subsp bovis AF2122/97
ccagguaaccccgc

SEQ ID NO: 1184629 - RNA, 21 nt, Mycobacterium bovis subsp bovis AF2122/97
ccagccgcgccagcuccgugu

SEQ ID NO: 1184630 - RNA, 15 nt, Mycobacterium bovis subsp bovis AF2122/97
ccagccgcccucggg

SEQ ID NO: 1184631 - RNA, 14 nt, Mycobacterium bovis subsp bovis AF2122/97
ccagccgccccggc

SEQ ID NO: 1184632 - RNA, 13 nt, Mycobacterium bovis subsp bovis AF2122/97
ccagccgcccucg

SEQ ID NO: 1184633 - RNA, 15 nt, Mycobacterium bovis subsp bovis AF2122/97
ccagccgccccggcu

SEQ ID NO: 1184634 - RNA, 15 nt, Mycobacterium bovis subsp bovis AF2122/97
ccagccgcagcaccu

SEQ ID NO: 1184635 - RNA, 17 nt, Mycobacterium bovis subsp bovis AF2122/97
ccagccgcugccacagg

SEQ ID NO: 1184636 - RNA, 13 nt, Mycobacterium bovis subsp bovis AF2122/97
ccagccggaccgc

SEQ ID NO: 1184637 - RNA, 14 nt, Mycobacterium bovis subsp bovis AF2122/97
ccagccggcagcag

SEQ ID NO: 1184638 - RNA, 16 nt, Mycobacterium bovis subsp bovis AF2122/97
ccagccgcggcccucg

SEQ ID NO: 1184639 - RNA, 14 nt, Mycobacterium bovis subsp bovis AF2122/97
ccagccgcgcgucc

SEQ ID NO: 1184640 - RNA, 16 nt, Mycobacterium bovis subsp bovis AF2122/97
ccagccgcgggccgcg

SEQ ID NO: 1184641 - RNA, 23 nt, Mycobacterium bovis subsp bovis AF2122/97
ccagguguucgccggagacccgg

SEQ ID NO: 1184642 - RNA, 13 nt, Mycobacterium bovis subsp bovis AF2122/97
ccaggugugcccc

SEQ ID NO: 1184643 - RNA, 20 nt, Mycobacterium bovis subsp bovis AF2122/97
ccagguggucaucgccacgc

SEQ ID NO: 1184644 - RNA, 13 nt, Mycobacterium bovis subsp bovis AF2122/97
ccagguggccgcu

SEQ ID NO: 1184645 - RNA, 14 nt, Mycobacterium bovis subsp bovis AF2122/97
ccaggugggcagca

SEQ ID NO: 1184646 - RNA, 18 nt, Mycobacterium bovis subsp bovis AF2122/97
ccaggugggcagcaggcc

SEQ ID NO: 1184647 - RNA, 21 nt, Mycobacterium bovis subsp bovis AF2122/97
ccaggugggccgagagcagcc

SEQ ID NO: 1184648 - RNA, 15 nt, Mycobacterium bovis subsp bovis AF2122/97
ccagguggccgcucu

SEQ ID NO: 1184649 - RNA, 22 nt, Mycobacterium bovis subsp bovis AF2122/97
ccaggugggcagcaggcccacc

SEQ ID NO: 1184650 - RNA, 16 nt, Mycobacterium bovis subsp bovis AF2122/97
ccagguugauccagug

SEQ ID NO: 1184651 - RNA, 14 nt, Mycobacterium bovis subsp bovis AF2122/97
ccagguugccaacc

SEQ ID NO: 1184652 - RNA, 23 nt, Mycobacterium bovis subsp bovis AF2122/97
ccagguuccgcugucgagccggu

SEQ ID NO: 1184653 - RNA, 17 nt, Mycobacterium bovis subsp bovis AF2122/97
ccagguucaugcaaaag

SEQ ID NO: 1184654 - RNA, 19 nt, Mycobacterium bovis subsp bovis AF2122/97
ccaggugcagcaccagcca

SEQ ID NO: 1184655 - RNA, 18 nt, Mycobacterium bovis subsp bovis AF2122/97
ccaggugcguccaggcca

SEQ ID NO: 1184656 - RNA, 15 nt, Mycobacterium bovis subsp bovis AF2122/97
ccagguggaccggcc

SEQ ID NO: 1184657 - RNA, 15 nt, Mycobacterium bovis subsp bovis AF2122/97
ccagguggccaggcc

SEQ ID NO: 1184658 - RNA, 19 nt, Mycobacterium bovis subsp bovis AF2122/97
ccagguacgggagcccgag

SEQ ID NO: 1184659 - RNA, 15 nt, Mycobacterium bovis subsp bovis AF2122/97
ccagguacucagugu

SEQ ID NO: 1184660 - RNA, 21 nt, Mycobacterium bovis subsp bovis AF2122/97
ccagguacgcgaucagcgcgc

SEQ ID NO: 1184661 - RNA, 15 nt, Mycobacterium bovis subsp bovis AF2122/97
ccagguagucgacca

SEQ ID NO: 1184662 - RNA, 19 nt, Mycobacterium bovis subsp bovis AF2122/97
ccagguagaccaggugcag

SEQ ID NO: 1184663 - RNA, 14 nt, Mycobacterium bovis subsp bovis AF2122/97
ccaguccaagcugu

SEQ ID NO: 1184664 - RNA, 18 nt, Mycobacterium bovis subsp bovis AF2122/97
ccaguauggccgccaccg

SEQ ID NO: 1184665 - RNA, 13 nt, Mycobacterium bovis subsp bovis AF2122/97
ccaguaggcuucg

SEQ ID NO: 1184666 - RNA, 20 nt, Mycobacterium bovis subsp bovis AF2122/97
ccaguagccggugccggcgc

SEQ ID NO: 1184667 - RNA, 15 nt, Mycobacterium bovis subsp bovis AF2122/97
ccaguaaugcccaug

SEQ ID NO: 1184668 - RNA, 19 nt, Mycobacterium bovis subsp bovis AF2122/97
ccagguugugugacagccc

SEQ ID NO: 1184669 - RNA, 22 nt, Mycobacterium bovis subsp bovis AF2122/97
ccagguugugugacagcccgcu

SEQ ID NO: 1184670 - RNA, 16 nt, Mycobacterium bovis subsp bovis AF2122/97
ccagguuuugccgcgu

SEQ ID NO: 1184671 - RNA, 16 nt, Mycobacterium bovis subsp bovis AF2122/97
ccaucgucgagccgcc

SEQ ID NO: 1184672 - RNA, 18 nt, Mycobacterium bovis subsp bovis AF2122/97
ccaucuucggacgccagc

SEQ ID NO: 1184673 - RNA, 19 nt, Mycobacterium bovis subsp bovis AF2122/97
ccaucgggcgcgguaacca

SEQ ID NO: 1184674 - RNA, 15 nt, Mycobacterium bovis subsp bovis AF2122/97
ccaucgggucacccc

SEQ ID NO: 1184675 - RNA, 13 nt, Mycobacterium bovis subsp bovis AF2122/97
ccaucgggaccgg

SEQ ID NO: 1184676 - RNA, 22 nt, Mycobacterium bovis subsp bovis AF2122/97
ccaucgguaucgagggcagccg

SEQ ID NO: 1184677 - RNA, 21 nt, Mycobacterium bovis subsp bovis AF2122/97
ccaucgcgucgucuucuucgc

SEQ ID NO: 1184678 - RNA, 13 nt, Mycobacterium bovis subsp bovis AF2122/97
ccaugaaaucacc

SEQ ID NO: 1184679 - RNA, 21 nt, Mycobacterium bovis subsp bovis AF2122/97
ccaugagcgcgcccaaccugg

SEQ ID NO: 1184680 - RNA, 14 nt, Mycobacterium bovis subsp bovis AF2122/97
ccauggcgccgcgc

SEQ ID NO: 1184681 - RNA, 14 nt, Mycobacterium bovis subsp bovis AF2122/97
ccauggccagcgcu

SEQ ID NO: 1184682 - RNA, 18 nt, Mycobacterium bovis subsp bovis AF2122/97
ccauggcacugccggcac

SEQ ID NO: 1184683 - RNA, 12 nt, Mycobacterium bovis subsp bovis AF2122/97
ccaucgccgccg

SEQ ID NO: 1184684 - RNA, 12 nt, Mycobacterium bovis subsp bovis AF2122/97
ccaucgccucca

SEQ ID NO: 1184685 - RNA, 16 nt, Mycobacterium bovis subsp bovis AF2122/97
ccaucgccuccagccg

SEQ ID NO: 1184686 - RNA, 17 nt, Mycobacterium bovis subsp bovis AF2122/97
ccaucgcgacggcccga

SEQ ID NO: 1184687 - RNA, 18 nt, Mycobacterium bovis subsp bovis AF2122/97
ccauccgggccgcggcca

SEQ ID NO: 1184688 - RNA, 23 nt, Mycobacterium bovis subsp bovis AF2122/97
ccaucgccacuguugaagaagcc

SEQ ID NO: 1184689 - RNA, 22 nt, Mycobacterium bovis subsp bovis AF2122/97
ccaucgccaccgcgucacuucc

SEQ ID NO: 1184690 - RNA, 16 nt, Mycobacterium bovis subsp bovis AF2122/97
ccauccggcggcggcc

SEQ ID NO: 1184691 - RNA, 21 nt, Mycobacterium bovis subsp bovis AF2122/97
ccauccacaucgaugucggcu

SEQ ID NO: 1184692 - RNA, 17 nt, Mycobacterium bovis subsp bovis AF2122/97
ccauaugggggaaagcu

SEQ ID NO: 1184693 - RNA, 22 nt, Mycobacterium bovis subsp bovis AF2122/97
ccauaugggggaaagcuugacc

SEQ ID NO: 1184694 - RNA, 15 nt, Mycobacterium bovis subsp bovis AF2122/97
ccaugucggccaccc

SEQ ID NO: 1184695 - RNA, 21 nt, Mycobacterium bovis subsp bovis AF2122/97
ccauguauuucucccagccca

SEQ ID NO: 1184696 - RNA, 12 nt, Mycobacterium bovis subsp bovis AF2122/97
ccaugucaagcg

SEQ ID NO: 1184697 - RNA, 14 nt, Mycobacterium bovis subsp bovis AF2122/97
ccaugugcccaggu

SEQ ID NO: 1184698 - RNA, 17 nt, Mycobacterium bovis subsp bovis AF2122/97
ccauguguuugaucacc

SEQ ID NO: 1184699 - RNA, 18 nt, Mycobacterium bovis subsp bovis AF2122/97
ccauguugaaaaggcgcu

SEQ ID NO: 1184700 - RNA, 17 nt, Mycobacterium bovis subsp bovis AF2122/97
ccauggcgugccccagu

SEQ ID NO: 1184701 - RNA, 24 nt, Mycobacterium bovis subsp bovis AF2122/97
ccauggucggucaagucugucugg

SEQ ID NO: 1184702 - RNA, 16 nt, Mycobacterium bovis subsp bovis AF2122/97
ccaugguggcgccgac

SEQ ID NO: 1184703 - RNA, 16 nt, Mycobacterium bovis subsp bovis AF2122/97
ccauggucgauucguc

SEQ ID NO: 1184704 - RNA, 22 nt, Mycobacterium bovis subsp bovis AF2122/97
ccaugggcaauuaggucgacca

SEQ ID NO: 1184705 - RNA, 23 nt, Mycobacterium bovis subsp bovis AF2122/97
ccaugggcgauaaggaccgcgcc

SEQ ID NO: 1184706 - RNA, 20 nt, Mycobacterium bovis subsp bovis AF2122/97
ccaugguguucggcagcgcg

SEQ ID NO: 1184707 - RNA, 18 nt, Mycobacterium bovis subsp bovis AF2122/97
ccauggugguauccaugu

SEQ ID NO: 1184708 - RNA, 18 nt, Mycobacterium bovis subsp bovis AF2122/97
ccauguuuugcugcaugc

SEQ ID NO: 1184709 - RNA, 15 nt, Mycobacterium bovis subsp bovis AF2122/97
ccauguuggcgaaug

SEQ ID NO: 1184710 - RNA, 18 nt, Mycobacterium bovis subsp bovis AF2122/97
ccauucccggacccacca

SEQ ID NO: 1184711 - RNA, 15 nt, Mycobacterium bovis subsp bovis AF2122/97
ccauuagcagcaccc

SEQ ID NO: 1184712 - RNA, 17 nt, Mycobacterium bovis subsp bovis AF2122/97
ccauuagcagcacccgg

SEQ ID NO: 1184713 - RNA, 20 nt, Mycobacterium bovis subsp bovis AF2122/97
cccaacgcgguaaagccccg

SEQ ID NO: 1184714 - RNA, 20 nt, Mycobacterium bovis subsp bovis AF2122/97
cccaagcgccugagcggccu

SEQ ID NO: 1184715 - RNA, 15 nt, Mycobacterium bovis subsp bovis AF2122/97
cccaagcgugcugcc

SEQ ID NO: 1184716 - RNA, 16 nt, Mycobacterium bovis subsp bovis AF2122/97
cccaagcucagggugg

SEQ ID NO: 1184717 - RNA, 12 nt, Mycobacterium bovis subsp bovis AF2122/97
cccaagaucucg

SEQ ID NO: 1184718 - RNA, 14 nt, Mycobacterium bovis subsp bovis AF2122/97
cccaagcaguccac

SEQ ID NO: 1184719 - RNA, 21 nt, Mycobacterium bovis subsp bovis AF2122/97
cccaagccauguggcgucgcu

SEQ ID NO: 1184720 - RNA, 17 nt, Mycobacterium bovis subsp bovis AF2122/97
cccaagcccgauucagc

SEQ ID NO: 1184721 - RNA, 15 nt, Mycobacterium bovis subsp bovis AF2122/97
cccaagccgccggcg

SEQ ID NO: 1184722 - RNA, 14 nt, Mycobacterium bovis subsp bovis AF2122/97
cccaacgccacugc

SEQ ID NO: 1184723 - RNA, 14 nt, Mycobacterium bovis subsp bovis AF2122/97
cccaacgaccacca

SEQ ID NO: 1184724 - RNA, 17 nt, Mycobacterium bovis subsp bovis AF2122/97
ccauucgcgggccgagg

SEQ ID NO: 1184725 - RNA, 11 nt, Mycobacterium bovis subsp bovis AF2122/97
ccauugccaua

SEQ ID NO: 1184726 - RNA, 20 nt, Mycobacterium bovis subsp bovis AF2122/97
ccauugccgccggcgccgcc

SEQ ID NO: 1184727 - RNA, 23 nt, Mycobacterium bovis subsp bovis AF2122/97
ccauugccauacagcaccccgcc

SEQ ID NO: 1184728 - RNA, 19 nt, Mycobacterium bovis subsp bovis AF2122/97
ccauugccggauuuguauu

SEQ ID NO: 1184729 - RNA, 16 nt, Mycobacterium bovis subsp bovis AF2122/97
ccauuuucgccaacuu

SEQ ID NO: 1184730 - RNA, 17 nt, Mycobacterium bovis subsp bovis AF2122/97
ccauuucucguacccgg

SEQ ID NO: 1184731 - RNA, 22 nt, Mycobacterium bovis subsp bovis AF2122/97
cccaggugcguccaggccaggg

SEQ ID NO: 1184732 - RNA, 16 nt, Mycobacterium bovis subsp bovis AF2122/97
cccaggucguaggcgc

SEQ ID NO: 1184733 - RNA, 16 nt, Mycobacterium bovis subsp bovis AF2122/97
cccagggugucuguga

SEQ ID NO: 1184734 - RNA, 16 nt, Mycobacterium bovis subsp bovis AF2122/97
cccaggggagcugacc

SEQ ID NO: 1184735 - RNA, 13 nt, Mycobacterium bovis subsp bovis AF2122/97
cccaggggcaccg

SEQ ID NO: 1184736 - RNA, 12 nt, Mycobacterium bovis subsp bovis AF2122/97
cccagggcugcc

SEQ ID NO: 1184737 - RNA, 17 nt, Mycobacterium bovis subsp bovis AF2122/97
cccagggcguuggcggc

SEQ ID NO: 1184738 - RNA, 22 nt, Mycobacterium bovis subsp bovis AF2122/97
cccagggcacaucgggcguggu

SEQ ID NO: 1184739 - RNA, 18 nt, Mycobacterium bovis subsp bovis AF2122/97
cccaggccgcuugccccg

SEQ ID NO: 1184740 - RNA, 19 nt, Mycobacterium bovis subsp bovis AF2122/97
cccaggccgcuugccccgc

SEQ ID NO: 1184741 - RNA, 15 nt, Mycobacterium bovis subsp bovis AF2122/97
cccaggccgucgcgc

SEQ ID NO: 1184742 - RNA, 17 nt, Mycobacterium bovis subsp bovis AF2122/97
cccaggcgaacagggcu

SEQ ID NO: 1184743 - RNA, 19 nt, Mycobacterium bovis subsp bovis AF2122/97
cccaggcgaacagggcugc

SEQ ID NO: 1184744 - RNA, 14 nt, Mycobacterium bovis subsp bovis AF2122/97
cccaggcgaacagg

SEQ ID NO: 1184745 - RNA, 19 nt, Mycobacterium bovis subsp bovis AF2122/97
cccaggcguuuggcgugcc

SEQ ID NO: 1184746 - RNA, 20 nt, Mycobacterium bovis subsp bovis AF2122/97
cccaggcugguccgggugcc

SEQ ID NO: 1184747 - RNA, 20 nt, Mycobacterium bovis subsp bovis AF2122/97
cccaggcgaucgcccggccc

SEQ ID NO: 1184748 - RNA, 21 nt, Mycobacterium bovis subsp bovis AF2122/97
cccaggcgcucagcgcggcca

SEQ ID NO: 1184749 - RNA, 20 nt, Mycobacterium bovis subsp bovis AF2122/97
cccaggcgcucaucacccag

SEQ ID NO: 1184750 - RNA, 21 nt, Mycobacterium bovis subsp bovis AF2122/97
cccaggcgcucaucacccagc

SEQ ID NO: 1184751 - RNA, 14 nt, Mycobacterium bovis subsp bovis AF2122/97
cccaggcgcugccg

SEQ ID NO: 1184752 - RNA, 19 nt, Mycobacterium bovis subsp bovis AF2122/97
cccagugaaucggaccgac

SEQ ID NO: 1184753 - RNA, 19 nt, Mycobacterium bovis subsp bovis AF2122/97
cccagugcacgcucggcgc

SEQ ID NO: 1184754 - RNA, 20 nt, Mycobacterium bovis subsp bovis AF2122/97
cccagucguuccgccgccuc

SEQ ID NO: 1184755 - RNA, 13 nt, Mycobacterium bovis subsp bovis AF2122/97
cccagugucagca

SEQ ID NO: 1184756 - RNA, 15 nt, Mycobacterium bovis subsp bovis AF2122/97
cccaguucggcgucu

SEQ ID NO: 1184757 - RNA, 17 nt, Mycobacterium bovis subsp bovis AF2122/97
cccaguccgaagcugcu

SEQ ID NO: 1184758 - RNA, 21 nt, Mycobacterium bovis subsp bovis AF2122/97
cccagguuucauuccugguua

SEQ ID NO: 1184759 - RNA, 21 nt, Mycobacterium bovis subsp bovis AF2122/97
cccaggugggccgagagcagc

SEQ ID NO: 1184760 - RNA, 21 nt, Mycobacterium bovis subsp bovis AF2122/97
cccagguugccuuggcggcca

SEQ ID NO: 1184761 - RNA, 21 nt, Mycobacterium bovis subsp bovis AF2122/97
cccagguuggagcccgagcuc

SEQ ID NO: 1184762 - RNA, 14 nt, Mycobacterium bovis subsp bovis AF2122/97
cccaguucugcagg

SEQ ID NO: 1184763 - RNA, 15 nt, Mycobacterium bovis subsp bovis AF2122/97
cccaguugggccuca

SEQ ID NO: 1184764 - RNA, 23 nt, Mycobacterium bovis subsp bovis AF2122/97
cccauaccuucggcgaucuugac

SEQ ID NO: 1184765 - RNA, 21 nt, Mycobacterium bovis subsp bovis AF2122/97
cccauacggcaauacccgccg

SEQ ID NO: 1184766 - RNA, 20 nt, Mycobacterium bovis subsp bovis AF2122/97
aaacaccagcgaggccagcg

SEQ ID NO: 1184767 - RNA, 13 nt, Mycobacterium bovis subsp bovis AF2122/97
cccaucaccagcg

SEQ ID NO: 1184768 - RNA, 20 nt, Mycobacterium bovis subsp bovis AF2122/97
cccaucagaaugccuggccc

SEQ ID NO: 1184769 - RNA, 13 nt, Mycobacterium bovis subsp bovis AF2122/97
cccaucacccugu

SEQ ID NO: 1184770 - RNA, 19 nt, Mycobacterium bovis subsp bovis AF2122/97
cccaucaacaucggcccgc

SEQ ID NO: 1184771 - RNA, 15 nt, Mycobacterium bovis subsp bovis AF2122/97
cccauagcaccucga

SEQ ID NO: 1184772 - RNA, 22 nt, Mycobacterium bovis subsp bovis AF2122/97
cccauagccgguggucgcgccc

SEQ ID NO: 1184773 - RNA, 22 nt, Mycobacterium bovis subsp bovis AF2122/97
cccauccccgguucugcgccca

SEQ ID NO: 1184774 - RNA, 18 nt, Mycobacterium bovis subsp bovis AF2122/97
cccaucccgauccugccc

SEQ ID NO: 1184775 - RNA, 22 nt, Mycobacterium bovis subsp bovis AF2122/97
cccaucccgauccugcccacca

SEQ ID NO: 1184776 - RNA, 17 nt, Mycobacterium bovis subsp bovis AF2122/97
cccaucaucgccaccac

SEQ ID NO: 1184777 - RNA, 16 nt, Mycobacterium bovis subsp bovis AF2122/97
cccaucgccacaccca

SEQ ID NO: 1184778 - RNA, 23 nt, Mycobacterium bovis subsp bovis AF2122/97
cccaucgcgacuagacgccgccg

SEQ ID NO: 1184779 - RNA, 16 nt, Mycobacterium bovis subsp bovis AF2122/97
cccaucgccuggaugc

SEQ ID NO: 1184780 - RNA, 14 nt, Mycobacterium bovis subsp bovis AF2122/97
cccaucgaccgccc

SEQ ID NO: 1184781 - RNA, 18 nt, Mycobacterium bovis subsp bovis AF2122/97
cccaucgaccgcccgcca

SEQ ID NO: 1184782 - RNA, 23 nt, Mycobacterium bovis subsp bovis AF2122/97
cccagcgcacggaccaucgccag

SEQ ID NO: 1184783 - RNA, 21 nt, Mycobacterium bovis subsp bovis AF2122/97
cccagcgaugcgcucacugca

SEQ ID NO: 1184784 - RNA, 19 nt, Mycobacterium bovis subsp bovis AF2122/97
cccagcgacucggccagga

SEQ ID NO: 1184785 - RNA, 14 nt, Mycobacterium bovis subsp bovis AF2122/97
cccagcgagcgcca

SEQ ID NO: 1184786 - RNA, 21 nt, Mycobacterium bovis subsp bovis AF2122/97
cccagcgagcgccaggucagc

SEQ ID NO: 1184787 - RNA, 13 nt, Mycobacterium bovis subsp bovis AF2122/97
cccagcgccaccg

SEQ ID NO: 1184788 - RNA, 12 nt, Mycobacterium bovis subsp bovis AF2122/97
cccagcgcagcg

SEQ ID NO: 1184789 - RNA, 15 nt, Mycobacterium bovis subsp bovis AF2122/97
cccagcgcccggcca

SEQ ID NO: 1184790 - RNA, 17 nt, Mycobacterium bovis subsp bovis AF2122/97
cccagcgcccggccacu

SEQ ID NO: 1184791 - RNA, 14 nt, Mycobacterium bovis subsp bovis AF2122/97
cccagcgcccccag

SEQ ID NO: 1184792 - RNA, 16 nt, Mycobacterium bovis subsp bovis AF2122/97
cccagcgcccccagca

SEQ ID NO: 1184793 - RNA, 21 nt, Mycobacterium bovis subsp bovis AF2122/97
cccagcgccgcaguggaugca

SEQ ID NO: 1184794 - RNA, 23 nt, Mycobacterium bovis subsp bovis AF2122/97
cccagcgcccggccacuccagua

SEQ ID NO: 1184795 - RNA, 15 nt, Mycobacterium bovis subsp bovis AF2122/97
cccagcgccuccagc

SEQ ID NO: 1184796 - RNA, 18 nt, Mycobacterium bovis subsp bovis AF2122/97
cccagcgccuccagcacc

SEQ ID NO: 1184797 - RNA, 23 nt, Mycobacterium bovis subsp bovis AF2122/97
cccagcggagccacucggcccgg

SEQ ID NO: 1184798 - RNA, 15 nt, Mycobacterium bovis subsp bovis AF2122/97
cccagcggaaucacc

SEQ ID NO: 1184799 - RNA, 14 nt, Mycobacterium bovis subsp bovis AF2122/97
cccagcgcuagccg

SEQ ID NO: 1184800 - RNA, 23 nt, Mycobacterium bovis subsp bovis AF2122/97
cccagcgcuagccgggcgcgccg

SEQ ID NO: 1184801 - RNA, 22 nt, Mycobacterium bovis subsp bovis AF2122/97
cccagcuugcggugaucccacg

SEQ ID NO: 1184802 - RNA, 23 nt, Mycobacterium bovis subsp bovis AF2122/97
cccaggacuccggccgcacgccg

SEQ ID NO: 1184803 - RNA, 16 nt, Mycobacterium bovis subsp bovis AF2122/97
cccaggacagcagccg

SEQ ID NO: 1184804 - RNA, 23 nt, Mycobacterium bovis subsp bovis AF2122/97
cccaggacagcagccgccggccg

SEQ ID NO: 1184805 - RNA, 22 nt, Mycobacterium bovis subsp bovis AF2122/97
cccaggcacaacaucgccgcag

SEQ ID NO: 1184806 - RNA, 15 nt, Mycobacterium bovis subsp bovis AF2122/97
cccagcugggucccg

SEQ ID NO: 1184807 - RNA, 14 nt, Mycobacterium bovis subsp bovis AF2122/97
cccagcucgcgcac

SEQ ID NO: 1184808 - RNA, 21 nt, Mycobacterium bovis subsp bovis AF2122/97
cccagcuagguccgaacuuga

SEQ ID NO: 1184809 - RNA, 18 nt, Mycobacterium bovis subsp bovis AF2122/97
cccagcgugcccgccacc

SEQ ID NO: 1184810 - RNA, 19 nt, Mycobacterium bovis subsp bovis AF2122/97
cccagcgugcccgccaccg

SEQ ID NO: 1184811 - RNA, 14 nt, Mycobacterium bovis subsp bovis AF2122/97
cccagccgcgccag

SEQ ID NO: 1184812 - RNA, 19 nt, Mycobacterium bovis subsp bovis AF2122/97
cccagccgcgccagcuccg

SEQ ID NO: 1184813 - RNA, 12 nt, Mycobacterium bovis subsp bovis AF2122/97
cccagccgcagc

SEQ ID NO: 1184814 - RNA, 19 nt, Mycobacterium bovis subsp bovis AF2122/97
cccagccgcagcaccucgg

SEQ ID NO: 1184815 - RNA, 16 nt, Mycobacterium bovis subsp bovis AF2122/97
cccagccgcggcgcca

SEQ ID NO: 1184816 - RNA, 17 nt, Mycobacterium bovis subsp bovis AF2122/97
cccagccgcgggccgcg

SEQ ID NO: 1184817 - RNA, 18 nt, Mycobacterium bovis subsp bovis AF2122/97
cccagccgccagcccguc

SEQ ID NO: 1184818 - RNA, 18 nt, Mycobacterium bovis subsp bovis AF2122/97
cccagccgagcggcggca

SEQ ID NO: 1184819 - RNA, 15 nt, Mycobacterium bovis subsp bovis AF2122/97
cccagccgagcggcg

SEQ ID NO: 1184820 - RNA, 18 nt, Mycobacterium bovis subsp bovis AF2122/97
cccagcccuuggcgcgca

SEQ ID NO: 1184821 - RNA, 19 nt, Mycobacterium bovis subsp bovis AF2122/97
cccagcgaaucacccgcga

SEQ ID NO: 1184822 - RNA, 19 nt, Mycobacterium bovis subsp bovis AF2122/97
cccagccggguggacaccu

SEQ ID NO: 1184823 - RNA, 17 nt, Mycobacterium bovis subsp bovis AF2122/97
cccagccgugcccaagc

SEQ ID NO: 1184824 - RNA, 13 nt, Mycobacterium bovis subsp bovis AF2122/97
cccagcccauguc

SEQ ID NO: 1184825 - RNA, 14 nt, Mycobacterium bovis subsp bovis AF2122/97
cccagcccggccca

SEQ ID NO: 1184826 - RNA, 18 nt, Mycobacterium bovis subsp bovis AF2122/97
cccagcccggcccagugg

SEQ ID NO: 1184827 - RNA, 12 nt, Mycobacterium bovis subsp bovis AF2122/97
cccagcccaugu

SEQ ID NO: 1184828 - RNA, 18 nt, Mycobacterium bovis subsp bovis AF2122/97
cccagcagcaccugcacc

SEQ ID NO: 1184829 - RNA, 20 nt, Mycobacterium bovis subsp bovis AF2122/97
cccagcagcaccugcaccgc

SEQ ID NO: 1184830 - RNA, 13 nt, Mycobacterium bovis subsp bovis AF2122/97
cccagcacgguca

SEQ ID NO: 1184831 - RNA, 19 nt, Mycobacterium bovis subsp bovis AF2122/97
cccagaugcaggcuuucau

SEQ ID NO: 1184832 - RNA, 15 nt, Mycobacterium bovis subsp bovis AF2122/97
cccagauugcccaac

SEQ ID NO: 1184833 - RNA, 18 nt, Mycobacterium bovis subsp bovis AF2122/97
cccagauugcccaacacc

SEQ ID NO: 1184834 - RNA, 24 nt, Mycobacterium bovis subsp bovis AF2122/97
cccagcacauucugcagcgucucc

SEQ ID NO: 1184835 - RNA, 14 nt, Mycobacterium bovis subsp bovis AF2122/97
cccagcacccggcu

SEQ ID NO: 1184836 - RNA, 17 nt, Mycobacterium bovis subsp bovis AF2122/97
cccagcacgcuggcguu

SEQ ID NO: 1184837 - RNA, 22 nt, Mycobacterium bovis subsp bovis AF2122/97
cccagcaccaccgcggugugcg

SEQ ID NO: 1184838 - RNA, 21 nt, Mycobacterium bovis subsp bovis AF2122/97
cccagcacccccugcaccguc

SEQ ID NO: 1184839 - RNA, 15 nt, Mycobacterium bovis subsp bovis AF2122/97
cccagcaccacggug

SEQ ID NO: 1184840 - RNA, 17 nt, Mycobacterium bovis subsp bovis AF2122/97
cccagaauuccggcgga

SEQ ID NO: 1184841 - RNA, 19 nt, Mycobacterium bovis subsp bovis AF2122/97
cccagacaauccgccgccg

SEQ ID NO: 1184842 - RNA, 15 nt, Mycobacterium bovis subsp bovis AF2122/97
cccccggggcgcucg

SEQ ID NO: 1184843 - RNA, 16 nt, Mycobacterium bovis subsp bovis AF2122/97
cccccggguccgccgu

SEQ ID NO: 1184844 - RNA, 17 nt, Mycobacterium bovis subsp bovis AF2122/97
cccccggugccgcccgc

SEQ ID NO: 1184845 - RNA, 16 nt, Mycobacterium bovis subsp bovis AF2122/97
cccccguugccgccgu

SEQ ID NO: 1184846 - RNA, 18 nt, Mycobacterium bovis subsp bovis AF2122/97
cccccguuuacggcccgg

SEQ ID NO: 1184847 - RNA, 18 nt, Mycobacterium bovis subsp bovis AF2122/97
cccccuagaccgggcggu

SEQ ID NO: 1184848 - RNA, 17 nt, Mycobacterium bovis subsp bovis AF2122/97
ccccgagcggagccgcc

SEQ ID NO: 1184849 - RNA, 19 nt, Mycobacterium bovis subsp bovis AF2122/97
ccccgagcggagccgccga

SEQ ID NO: 1184850 - RNA, 17 nt, Mycobacterium bovis subsp bovis AF2122/97
ccccgacugcgcccaua

SEQ ID NO: 1184851 - RNA, 16 nt, Mycobacterium bovis subsp bovis AF2122/97
ccccgccggcgccacc

SEQ ID NO: 1184852 - RNA, 17 nt, Mycobacterium bovis subsp bovis AF2122/97
ccccgccggcgccgccc

SEQ ID NO: 1184853 - RNA, 15 nt, Mycobacterium bovis subsp bovis AF2122/97
ccccgcacgcucgcc

SEQ ID NO: 1184854 - RNA, 15 nt, Mycobacterium bovis subsp bovis AF2122/97
ccccgccguugccgc

SEQ ID NO: 1184855 - RNA, 15 nt, Mycobacterium bovis subsp bovis AF2122/97
ccccgcgccugccuc

SEQ ID NO: 1184856 - RNA, 20 nt, Mycobacterium bovis subsp bovis AF2122/97
ccccgcgcggugcccugccg

SEQ ID NO: 1184857 - RNA, 15 nt, Mycobacterium bovis subsp bovis AF2122/97
ccccgcgccggccgc

SEQ ID NO: 1184858 - RNA, 13 nt, Mycobacterium bovis subsp bovis AF2122/97
ccccgcgccugcc

SEQ ID NO: 1184859 - RNA, 15 nt, Mycobacterium bovis subsp bovis AF2122/97
ccccgcgggggcggc

SEQ ID NO: 1184860 - RNA, 11 nt, Mycobacterium bovis subsp bovis AF2122/97
ccccgcggcgg

SEQ ID NO: 1184861 - RNA, 12 nt, Mycobacterium bovis subsp bovis AF2122/97
ccccgcggcggu

SEQ ID NO: 1184862 - RNA, 18 nt, Mycobacterium bovis subsp bovis AF2122/97
ccccgagauccguccgcu

SEQ ID NO: 1184863 - RNA, 12 nt, Mycobacterium bovis subsp bovis AF2122/97
ccccgaucaggc

SEQ ID NO: 1184864 - RNA, 15 nt, Mycobacterium bovis subsp bovis AF2122/97
ccccgaucaggccga

SEQ ID NO: 1184865 - RNA, 22 nt, Mycobacterium bovis subsp bovis AF2122/97
ccccgauagcgaccgcggcccc

SEQ ID NO: 1184866 - RNA, 21 nt, Mycobacterium bovis subsp bovis AF2122/97
ccccgauggcgucgccggccc

SEQ ID NO: 1184867 - RNA, 12 nt, Mycobacterium bovis subsp bovis AF2122/97
cccccgggcccg

SEQ ID NO: 1184868 - RNA, 14 nt, Mycobacterium bovis subsp bovis AF2122/97
cccccggccauggc

SEQ ID NO: 1184869 - RNA, 23 nt, Mycobacterium bovis subsp bovis AF2122/97
cccccagugcacgcucggcgccg

SEQ ID NO: 1184870 - RNA, 15 nt, Mycobacterium bovis subsp bovis AF2122/97
cccccagcacccggc

SEQ ID NO: 1184871 - RNA, 14 nt, Mycobacterium bovis subsp bovis AF2122/97
cccccagccgcggc

SEQ ID NO: 1184872 - RNA, 12 nt, Mycobacterium bovis subsp bovis AF2122/97
cccccagcgccc

SEQ ID NO: 1184873 - RNA, 14 nt, Mycobacterium bovis subsp bovis AF2122/97
cccccagcgcccgc

SEQ ID NO: 1184874 - RNA, 12 nt, Mycobacterium bovis subsp bovis AF2122/97
cccccagcagcu

SEQ ID NO: 1184875 - RNA, 12 nt, Mycobacterium bovis subsp bovis AF2122/97
cccccaggcgaa

SEQ ID NO: 1184876 - RNA, 16 nt, Mycobacterium bovis subsp bovis AF2122/97
cccccagcacccggcu

SEQ ID NO: 1184877 - RNA, 14 nt, Mycobacterium bovis subsp bovis AF2122/97
cccccacggcccgu

SEQ ID NO: 1184878 - RNA, 13 nt, Mycobacterium bovis subsp bovis AF2122/97
ccccagcgccgcc

SEQ ID NO: 1184879 - RNA, 17 nt, Mycobacterium bovis subsp bovis AF2122/97
ccccagccggcagcagc

SEQ ID NO: 1184880 - RNA, 18 nt, Mycobacterium bovis subsp bovis AF2122/97
ccccagccggcagcagcg

SEQ ID NO: 1184881 - RNA, 11 nt, Mycobacterium bovis subsp bovis AF2122/97
ccccagugcuc

SEQ ID NO: 1184882 - RNA, 15 nt, Mycobacterium bovis subsp bovis AF2122/97
ccccagcgacggcaa

SEQ ID NO: 1184883 - RNA, 23 nt, Mycobacterium bovis subsp bovis AF2122/97
ccccagugcagacaggcggcggc

SEQ ID NO: 1184884 - RNA, 20 nt, Mycobacterium bovis subsp bovis AF2122/97
ccccaccauucgcgggccga

SEQ ID NO: 1184885 - RNA, 17 nt, Mycobacterium bovis subsp bovis AF2122/97
ccccacccaccacagga

SEQ ID NO: 1184886 - RNA, 15 nt, Mycobacterium bovis subsp bovis AF2122/97
ccccaacagggcggc

SEQ ID NO: 1184887 - RNA, 22 nt, Mycobacterium bovis subsp bovis AF2122/97
ccccaacccuaaaccagccacc

SEQ ID NO: 1184888 - RNA, 21 nt, Mycobacterium bovis subsp bovis AF2122/97
cccauuuugaacgcugcccaa

SEQ ID NO: 1184889 - RNA, 22 nt, Mycobacterium bovis subsp bovis AF2122/97
ccccagcaucuuuggcggccgc

SEQ ID NO: 1184890 - RNA, 13 nt, Mycobacterium bovis subsp bovis AF2122/97
ccccagcagcugc

SEQ ID NO: 1184891 - RNA, 19 nt, Mycobacterium bovis subsp bovis AF2122/97
ccccagcacaaccagcugu

SEQ ID NO: 1184892 - RNA, 13 nt, Mycobacterium bovis subsp bovis AF2122/97
ccccaccggcccg

SEQ ID NO: 1184893 - RNA, 16 nt, Mycobacterium bovis subsp bovis AF2122/97
ccccaccgguaccgcc

SEQ ID NO: 1184894 - RNA, 17 nt, Mycobacterium bovis subsp bovis AF2122/97
cccaugggguauggugu

SEQ ID NO: 1184895 - RNA, 15 nt, Mycobacterium bovis subsp bovis AF2122/97
cccauggugagcugu

SEQ ID NO: 1184896 - RNA, 20 nt, Mycobacterium bovis subsp bovis AF2122/97
cccauuugccuugagccgcc

SEQ ID NO: 1184897 - RNA, 17 nt, Mycobacterium bovis subsp bovis AF2122/97
cccauggccaccgaacg

SEQ ID NO: 1184898 - RNA, 12 nt, Mycobacterium bovis subsp bovis AF2122/97
cccauggcauuc

SEQ ID NO: 1184899 - RNA, 18 nt, Mycobacterium bovis subsp bovis AF2122/97
cccaugcgccagcgagcg

SEQ ID NO: 1184900 - RNA, 23 nt, Mycobacterium bovis subsp bovis AF2122/97
cccaugcgguuuggaucacccgc

SEQ ID NO: 1184901 - RNA, 16 nt, Mycobacterium bovis subsp bovis AF2122/97
cccaucucgucgucgg

SEQ ID NO: 1184902 - RNA, 13 nt, Mycobacterium bovis subsp bovis AF2122/97
cccaucgggcgcc

SEQ ID NO: 1184903 - RNA, 16 nt, Mycobacterium bovis subsp bovis AF2122/97
cccaucugcucagggc

SEQ ID NO: 1184904 - RNA, 14 nt, Mycobacterium bovis subsp bovis AF2122/97
cccaugaaggagau

SEQ ID NO: 1184905 - RNA, 22 nt, Mycobacterium bovis subsp bovis AF2122/97
cccaugaucccgcugaccuggg

SEQ ID NO: 1184906 - RNA, 17 nt, Mycobacterium bovis subsp bovis AF2122/97
cccaugaccuucaugcc

SEQ ID NO: 1184907 - RNA, 16 nt, Mycobacterium bovis subsp bovis AF2122/97
cccaugauggccgcgg

SEQ ID NO: 1184908 - RNA, 17 nt, Mycobacterium bovis subsp bovis AF2122/97
cccaugauggccgcggc

SEQ ID NO: 1184909 - RNA, 12 nt, Mycobacterium bovis subsp bovis AF2122/97
cccaugccucca

SEQ ID NO: 1184910 - RNA, 15 nt, Mycobacterium bovis subsp bovis AF2122/97
cccaugccgucgggu

SEQ ID NO: 1184911 - RNA, 19 nt, Mycobacterium bovis subsp bovis AF2122/97
cccaugcaaucggauaggu

SEQ ID NO: 1184912 - RNA, 18 nt, Mycobacterium bovis subsp bovis AF2122/97
cccgaaaacugacccccu

SEQ ID NO: 1184913 - RNA, 13 nt, Mycobacterium bovis subsp bovis AF2122/97
ccccugccacagc

SEQ ID NO: 1184914 - RNA, 19 nt, Mycobacterium bovis subsp bovis AF2122/97
ccccuuuugccgcagcauc

SEQ ID NO: 1184915 - RNA, 19 nt, Mycobacterium bovis subsp bovis AF2122/97
ccccuuggcgccaccggcg

SEQ ID NO: 1184916 - RNA, 21 nt, Mycobacterium bovis subsp bovis AF2122/97
cccgaggcgcccaacaggcgg

SEQ ID NO: 1184917 - RNA, 12 nt, Mycobacterium bovis subsp bovis AF2122/97
cccgaggcaacg

SEQ ID NO: 1184918 - RNA, 14 nt, Mycobacterium bovis subsp bovis AF2122/97
cccgaggcaacaag

SEQ ID NO: 1184919 - RNA, 20 nt, Mycobacterium bovis subsp bovis AF2122/97
cccgagcuccgcggcgagcu

SEQ ID NO: 1184920 - RNA, 13 nt, Mycobacterium bovis subsp bovis AF2122/97
cccgagcucgccg

SEQ ID NO: 1184921 - RNA, 16 nt, Mycobacterium bovis subsp bovis AF2122/97
cccgagcucgccgcag

SEQ ID NO: 1184922 - RNA, 21 nt, Mycobacterium bovis subsp bovis AF2122/97
cccgagcgaugcgaccgacuu

SEQ ID NO: 1184923 - RNA, 16 nt, Mycobacterium bovis subsp bovis AF2122/97
cccgagccgcugcgac

SEQ ID NO: 1184924 - RNA, 20 nt, Mycobacterium bovis subsp bovis AF2122/97
cccgacgagauacggccacc

SEQ ID NO: 1184925 - RNA, 12 nt, Mycobacterium bovis subsp bovis AF2122/97
cccgacgagauu

SEQ ID NO: 1184926 - RNA, 17 nt, Mycobacterium bovis subsp bovis AF2122/97
cccgacgccagcugccc

SEQ ID NO: 1184927 - RNA, 22 nt, Mycobacterium bovis subsp bovis AF2122/97
cccgacgaccauucgagagccu

SEQ ID NO: 1184928 - RNA, 21 nt, Mycobacterium bovis subsp bovis AF2122/97
cccgacgacggcaccgaugca

SEQ ID NO: 1184929 - RNA, 17 nt, Mycobacterium bovis subsp bovis AF2122/97
cccgaccgccgagcggg

SEQ ID NO: 1184930 - RNA, 12 nt, Mycobacterium bovis subsp bovis AF2122/97
cccgaccgccac

SEQ ID NO: 1184931 - RNA, 20 nt, Mycobacterium bovis subsp bovis AF2122/97
cccgacccgccgacgccgcc

SEQ ID NO: 1184932 - RNA, 13 nt, Mycobacterium bovis subsp bovis AF2122/97
cccgaccacugau

SEQ ID NO: 1184933 - RNA, 16 nt, Mycobacterium bovis subsp bovis AF2122/97
ccccucggccgcccgu

SEQ ID NO: 1184934 - RNA, 14 nt, Mycobacterium bovis subsp bovis AF2122/97
ccccucggccgccc

SEQ ID NO: 1184935 - RNA, 21 nt, Mycobacterium bovis subsp bovis AF2122/97
ccccucgucgucaucgagcgg

SEQ ID NO: 1184936 - RNA, 18 nt, Mycobacterium bovis subsp bovis AF2122/97
ccccucuagcgccucgcc

SEQ ID NO: 1184937 - RNA, 13 nt, Mycobacterium bovis subsp bovis AF2122/97
ccccucggccgcc

SEQ ID NO: 1184938 - RNA, 15 nt, Mycobacterium bovis subsp bovis AF2122/97
ccccuccgggcgcac

SEQ ID NO: 1184939 - RNA, 16 nt, Mycobacterium bovis subsp bovis AF2122/97
ccccgucgccaccgau

SEQ ID NO: 1184940 - RNA, 13 nt, Mycobacterium bovis subsp bovis AF2122/97
ccccgucugcgug

SEQ ID NO: 1184941 - RNA, 13 nt, Mycobacterium bovis subsp bovis AF2122/97
ccccgucgccacc

SEQ ID NO: 1184942 - RNA, 14 nt, Mycobacterium bovis subsp bovis AF2122/97
ccccgucgaccucc

SEQ ID NO: 1184943 - RNA, 23 nt, Mycobacterium bovis subsp bovis AF2122/97
ccccggugccguuggagccgcca

SEQ ID NO: 1184944 - RNA, 21 nt, Mycobacterium bovis subsp bovis AF2122/97
ccccguaaauaucggggccac

SEQ ID NO: 1184945 - RNA, 22 nt, Mycobacterium bovis subsp bovis AF2122/97
ccccgguugacucgcuccgacc

SEQ ID NO: 1184946 - RNA, 15 nt, Mycobacterium bovis subsp bovis AF2122/97
ccccgcuacgcgcgc

SEQ ID NO: 1184947 - RNA, 13 nt, Mycobacterium bovis subsp bovis AF2122/97
ccccggucgccgc

SEQ ID NO: 1184948 - RNA, 18 nt, Mycobacterium bovis subsp bovis AF2122/97
ccccggugcagaugcggc

SEQ ID NO: 1184949 - RNA, 20 nt, Mycobacterium bovis subsp bovis AF2122/97
cccgccagcgauccaccaag

SEQ ID NO: 1184950 - RNA, 17 nt, Mycobacterium bovis subsp bovis AF2122/97
cccgccagcagggccag

SEQ ID NO: 1184951 - RNA, 14 nt, Mycobacterium bovis subsp bovis AF2122/97
cccgccagcccagc

SEQ ID NO: 1184952 - RNA, 23 nt, Mycobacterium bovis subsp bovis AF2122/97
cccgcagaccgguuucuucggcc

SEQ ID NO: 1184953 - RNA, 17 nt, Mycobacterium bovis subsp bovis AF2122/97
cccgccagcgccgccgc

SEQ ID NO: 1184954 - RNA, 17 nt, Mycobacterium bovis subsp bovis AF2122/97
cccgccagggcggcauc

SEQ ID NO: 1184955 - RNA, 21 nt, Mycobacterium bovis subsp bovis AF2122/97
cccgccagggcggcaucccca

SEQ ID NO: 1184956 - RNA, 14 nt, Mycobacterium bovis subsp bovis AF2122/97
cccgccaccggguu

SEQ ID NO: 1184957 - RNA, 16 nt, Mycobacterium bovis subsp bovis AF2122/97
cccgccacgaugucgu

SEQ ID NO: 1184958 - RNA, 20 nt, Mycobacterium bovis subsp bovis AF2122/97
cccgccacguacuccaccgc

SEQ ID NO: 1184959 - RNA, 20 nt, Mycobacterium bovis subsp bovis AF2122/97
cccgccacgguucgggcagc

SEQ ID NO: 1184960 - RNA, 18 nt, Mycobacterium bovis subsp bovis AF2122/97
cccgccacguacuccacc

SEQ ID NO: 1184961 - RNA, 20 nt, Mycobacterium bovis subsp bovis AF2122/97
cccgccaccgcgacaccccg

SEQ ID NO: 1184962 - RNA, 17 nt, Mycobacterium bovis subsp bovis AF2122/97
cccgccgccaccagcug

SEQ ID NO: 1184963 - RNA, 23 nt, Mycobacterium bovis subsp bovis AF2122/97
cccgccgaugaugcggcgcagcg

SEQ ID NO: 1184964 - RNA, 19 nt, Mycobacterium bovis subsp bovis AF2122/97
cccgccgaugcugccgccg

SEQ ID NO: 1184965 - RNA, 20 nt, Mycobacterium bovis subsp bovis AF2122/97
cccgccgaugcugccgccgc

SEQ ID NO: 1184966 - RNA, 22 nt, Mycobacterium bovis subsp bovis AF2122/97
cccgccgagcggugccggcgua

SEQ ID NO: 1184967 - RNA, 16 nt, Mycobacterium bovis subsp bovis AF2122/97
cccgccgacgccgccg

SEQ ID NO: 1184968 - RNA, 18 nt, Mycobacterium bovis subsp bovis AF2122/97
cccgccgacgccgccggc

SEQ ID NO: 1184969 - RNA, 20 nt, Mycobacterium bovis subsp bovis AF2122/97
cccgccgacgccgccggccc

SEQ ID NO: 1184970 - RNA, 16 nt, Mycobacterium bovis subsp bovis AF2122/97
cccgccgaucacuguc

SEQ ID NO: 1184971 - RNA, 22 nt, Mycobacterium bovis subsp bovis AF2122/97
cccgccgacgccgccggccccg

SEQ ID NO: 1184972 - RNA, 19 nt, Mycobacterium bovis subsp bovis AF2122/97
cccgccgaugaugcggcgc

SEQ ID NO: 1184973 - RNA, 12 nt, Mycobacterium bovis subsp bovis AF2122/97
cccgcccaccuc

SEQ ID NO: 1184974 - RNA, 21 nt, Mycobacterium bovis subsp bovis AF2122/97
cccgccauugccgccgucgcc

SEQ ID NO: 1184975 - RNA, 23 nt, Mycobacterium bovis subsp bovis AF2122/97
cccgccauugccgccggcgccgc

SEQ ID NO: 1184976 - RNA, 16 nt, Mycobacterium bovis subsp bovis AF2122/97
cccgccauugccgccg

SEQ ID NO: 1184977 - RNA, 15 nt, Mycobacterium bovis subsp bovis AF2122/97
cccgcagcccgccgg

SEQ ID NO: 1184978 - RNA, 14 nt, Mycobacterium bovis subsp bovis AF2122/97
cccgcagccgcgag

SEQ ID NO: 1184979 - RNA, 23 nt, Mycobacterium bovis subsp bovis AF2122/97
cccgcagccgcgaguccaggcug

SEQ ID NO: 1184980 - RNA, 23 nt, Mycobacterium bovis subsp bovis AF2122/97
cccgcaccggaucggcuaccuaa

SEQ ID NO: 1184981 - RNA, 14 nt, Mycobacterium bovis subsp bovis AF2122/97
cccgcauggcagcg

SEQ ID NO: 1184982 - RNA, 18 nt, Mycobacterium bovis subsp bovis AF2122/97
cccgcauugccaacgccc

SEQ ID NO: 1184983 - RNA, 14 nt, Mycobacterium bovis subsp bovis AF2122/97
cccgccacaccaac

SEQ ID NO: 1184984 - RNA, 23 nt, Mycobacterium bovis subsp bovis AF2122/97
cccgcacgaguuaccgguggugc

SEQ ID NO: 1184985 - RNA, 18 nt, Mycobacterium bovis subsp bovis AF2122/97
cccgcacgaagccggcuu

SEQ ID NO: 1184986 - RNA, 13 nt, Mycobacterium bovis subsp bovis AF2122/97
cccgcaccgccgg

SEQ ID NO: 1184987 - RNA, 13 nt, Mycobacterium bovis subsp bovis AF2122/97
cccgcagcagcau

SEQ ID NO: 1184988 - RNA, 14 nt, Mycobacterium bovis subsp bovis AF2122/97
cccgcacugccgcc

SEQ ID NO: 1184989 - RNA, 12 nt, Mycobacterium bovis subsp bovis AF2122/97
cccgcacgcggg

SEQ ID NO: 1184990 - RNA, 14 nt, Mycobacterium bovis subsp bovis AF2122/97
cccgcacgcucgcc

SEQ ID NO: 1184991 - RNA, 16 nt, Mycobacterium bovis subsp bovis AF2122/97
cccgagucugcgagca

SEQ ID NO: 1184992 - RNA, 20 nt, Mycobacterium bovis subsp bovis AF2122/97
cccgaggugccggggcccca

SEQ ID NO: 1184993 - RNA, 17 nt, Mycobacterium bovis subsp bovis AF2122/97
cccgaguuaaacgcagc

SEQ ID NO: 1184994 - RNA, 17 nt, Mycobacterium bovis subsp bovis AF2122/97
cccgaguucgcaaugcc

SEQ ID NO: 1184995 - RNA, 23 nt, Mycobacterium bovis subsp bovis AF2122/97
cccgcaaaaucgucagcgccgcc

SEQ ID NO: 1184996 - RNA, 22 nt, Mycobacterium bovis subsp bovis AF2122/97
cccgaguugaaggugccggcgu

SEQ ID NO: 1184997 - RNA, 15 nt, Mycobacterium bovis subsp bovis AF2122/97
cccgcacccggccca

SEQ ID NO: 1184998 - RNA, 14 nt, Mycobacterium bovis subsp bovis AF2122/97
cccgcaccccggcc

SEQ ID NO: 1184999 - RNA, 18 nt, Mycobacterium bovis subsp bovis AF2122/97
cccgcaccaccggcccca

SEQ ID NO: 1185000 - RNA, 23 nt, Mycobacterium bovis subsp bovis AF2122/97
cccgcaacaucgggucgcugccg

SEQ ID NO: 1185001 - RNA, 20 nt, Mycobacterium bovis subsp bovis AF2122/97
cccgcaacccguauggcggc

SEQ ID NO: 1185002 - RNA, 13 nt, Mycobacterium bovis subsp bovis AF2122/97
cccugagcucccg

SEQ ID NO: 1185003 - RNA, 18 nt, Mycobacterium bovis subsp bovis AF2122/97
cccugacggcaucugaaa

SEQ ID NO: 1185004 - RNA, 14 nt, Mycobacterium bovis subsp bovis AF2122/97
cccugacgguggug

SEQ ID NO: 1185005 - RNA, 16 nt, Mycobacterium bovis subsp bovis AF2122/97
cccugauugaagcccc

SEQ ID NO: 1185006 - RNA, 20 nt, Mycobacterium bovis subsp bovis AF2122/97
cccugaugugaguccagccg

SEQ ID NO: 1185007 - RNA, 21 nt, Mycobacterium bovis subsp bovis AF2122/97
cccugaugugaguccagccgg

SEQ ID NO: 1185008 - RNA, 21 nt, Mycobacterium bovis subsp bovis AF2122/97
cccugacacccaucgaccgcc

SEQ ID NO: 1185009 - RNA, 17 nt, Mycobacterium bovis subsp bovis AF2122/97
cccugacccggagccgc

SEQ ID NO: 1185010 - RNA, 16 nt, Mycobacterium bovis subsp bovis AF2122/97
cccugaagggccgccu

SEQ ID NO: 1185011 - RNA, 20 nt, Mycobacterium bovis subsp bovis AF2122/97
cccugaagggccgccucgcg

SEQ ID NO: 1185012 - RNA, 22 nt, Mycobacterium bovis subsp bovis AF2122/97
cccugaaauaccaguccggcgg

SEQ ID NO: 1185013 - RNA, 17 nt, Mycobacterium bovis subsp bovis AF2122/97
cccugcucgaacgcuga

SEQ ID NO: 1185014 - RNA, 20 nt, Mycobacterium bovis subsp bovis AF2122/97
cccugcgguccgcugccauc

SEQ ID NO: 1185015 - RNA, 13 nt, Mycobacterium bovis subsp bovis AF2122/97
cccugggcuggcu

SEQ ID NO: 1185016 - RNA, 21 nt, Mycobacterium bovis subsp bovis AF2122/97
cccugggcaaacugggcaccg

SEQ ID NO: 1185017 - RNA, 22 nt, Mycobacterium bovis subsp bovis AF2122/97
cccugggcccuuugcugucccc

SEQ ID NO: 1185018 - RNA, 21 nt, Mycobacterium bovis subsp bovis AF2122/97
cccugcugcagggccuggcca

SEQ ID NO: 1185019 - RNA, 12 nt, Mycobacterium bovis subsp bovis AF2122/97
cccugcccggcc

SEQ ID NO: 1185020 - RNA, 14 nt, Mycobacterium bovis subsp bovis AF2122/97
cccugcccggcccg

SEQ ID NO: 1185021 - RNA, 16 nt, Mycobacterium bovis subsp bovis AF2122/97
cccugcggccacggug

SEQ ID NO: 1185022 - RNA, 14 nt, Mycobacterium bovis subsp bovis AF2122/97
cccugccggcagcg

SEQ ID NO: 1185023 - RNA, 12 nt, Mycobacterium bovis subsp bovis AF2122/97
cccugccggcag

SEQ ID NO: 1185024 - RNA, 20 nt, Mycobacterium bovis subsp bovis AF2122/97
cccugcccagcacccccugc

SEQ ID NO: 1185025 - RNA, 19 nt, Mycobacterium bovis subsp bovis AF2122/97
cccucagcuagcgcgggcu

SEQ ID NO: 1185026 - RNA, 12 nt, Mycobacterium bovis subsp bovis AF2122/97
cccucagccgcg

SEQ ID NO: 1185027 - RNA, 15 nt, Mycobacterium bovis subsp bovis AF2122/97
cccucagccgcgccg

SEQ ID NO: 1185028 - RNA, 22 nt, Mycobacterium bovis subsp bovis AF2122/97
cccucaaggucuuuagccgccg

SEQ ID NO: 1185029 - RNA, 22 nt, Mycobacterium bovis subsp bovis AF2122/97
cccuccggacccacccgcaccg

SEQ ID NO: 1185030 - RNA, 12 nt, Mycobacterium bovis subsp bovis AF2122/97
cccuccgcagcu

SEQ ID NO: 1185031 - RNA, 16 nt, Mycobacterium bovis subsp bovis AF2122/97
cccuccgagcacagga

SEQ ID NO: 1185032 - RNA, 23 nt, Mycobacterium bovis subsp bovis AF2122/97
cccuccgagcacaggaucaccca

SEQ ID NO: 1185033 - RNA, 19 nt, Mycobacterium bovis subsp bovis AF2122/97
cccuccagauaccaccgcc

SEQ ID NO: 1185034 - RNA, 14 nt, Mycobacterium bovis subsp bovis AF2122/97
cccuccacagcggc

SEQ ID NO: 1185035 - RNA, 18 nt, Mycobacterium bovis subsp bovis AF2122/97
cccucguaauccacgccg

SEQ ID NO: 1185036 - RNA, 18 nt, Mycobacterium bovis subsp bovis AF2122/97
cccucguuaucgaccgcc

SEQ ID NO: 1185037 - RNA, 20 nt, Mycobacterium bovis subsp bovis AF2122/97
cccucuagcgccucgccggc

SEQ ID NO: 1185038 - RNA, 13 nt, Mycobacterium bovis subsp bovis AF2122/97
cccucggccgccc

SEQ ID NO: 1185039 - RNA, 19 nt, Mycobacterium bovis subsp bovis AF2122/97
cccucgggacugcgcggcu

SEQ ID NO: 1185040 - RNA, 13 nt, Mycobacterium bovis subsp bovis AF2122/97
cccucgcaaccgg

SEQ ID NO: 1185041 - RNA, 20 nt, Mycobacterium bovis subsp bovis AF2122/97
cccucgaucacggcggcccc

SEQ ID NO: 1185042 - RNA, 15 nt, Mycobacterium bovis subsp bovis AF2122/97
cccuccgugggcagc

SEQ ID NO: 1185043 - RNA, 23 nt, Mycobacterium bovis subsp bovis AF2122/97
cccuccgugggcagcgcgcccga

SEQ ID NO: 1185044 - RNA, 16 nt, Mycobacterium bovis subsp bovis AF2122/97
cccuccucgaccgcgg

SEQ ID NO: 1185045 - RNA, 18 nt, Mycobacterium bovis subsp bovis AF2122/97
cccucgaauucggccggc

SEQ ID NO: 1185046 - RNA, 19 nt, Mycobacterium bovis subsp bovis AF2122/97
cccucgaauucggccggcg

SEQ ID NO: 1185047 - RNA, 20 nt, Mycobacterium bovis subsp bovis AF2122/97
cccucgaauucggccggcgc

SEQ ID NO: 1185048 - RNA, 16 nt, Mycobacterium bovis subsp bovis AF2122/97
cccggcuggggccgcu

SEQ ID NO: 1185049 - RNA, 14 nt, Mycobacterium bovis subsp bovis AF2122/97
cccggcugggaucg

SEQ ID NO: 1185050 - RNA, 17 nt, Mycobacterium bovis subsp bovis AF2122/97
cccggcugccagcgccg

SEQ ID NO: 1185051 - RNA, 20 nt, Mycobacterium bovis subsp bovis AF2122/97
cccggcugccagcgccgccg

SEQ ID NO: 1185052 - RNA, 21 nt, Mycobacterium bovis subsp bovis AF2122/97
cccggcucucuucgcgcgcug

SEQ ID NO: 1185053 - RNA, 13 nt, Mycobacterium bovis subsp bovis AF2122/97
cccggcucggcag

SEQ ID NO: 1185054 - RNA, 15 nt, Mycobacterium bovis subsp bovis AF2122/97
cccggcucggccagc

SEQ ID NO: 1185055 - RNA, 18 nt, Mycobacterium bovis subsp bovis AF2122/97
cccggcucggccagccag

SEQ ID NO: 1185056 - RNA, 18 nt, Mycobacterium bovis subsp bovis AF2122/97
cccggcucggugcgccag

SEQ ID NO: 1185057 - RNA, 12 nt, Mycobacterium bovis subsp bovis AF2122/97
cccggcuccagc

SEQ ID NO: 1185058 - RNA, 15 nt, Mycobacterium bovis subsp bovis AF2122/97
cccggcuucgccgcg

SEQ ID NO: 1185059 - RNA, 17 nt, Mycobacterium bovis subsp bovis AF2122/97
cccgggcagccugcugc

SEQ ID NO: 1185060 - RNA, 18 nt, Mycobacterium bovis subsp bovis AF2122/97
cccgggcagccugcugca

SEQ ID NO: 1185061 - RNA, 16 nt, Mycobacterium bovis subsp bovis AF2122/97
cccgggaucagcuccu

SEQ ID NO: 1185062 - RNA, 21 nt, Mycobacterium bovis subsp bovis AF2122/97
cccgggaucagcuccuccgac

SEQ ID NO: 1185063 - RNA, 13 nt, Mycobacterium bovis subsp bovis AF2122/97
cccgccguagacc

SEQ ID NO: 1185064 - RNA, 14 nt, Mycobacterium bovis subsp bovis AF2122/97
cccgccgucacccc

SEQ ID NO: 1185065 - RNA, 15 nt, Mycobacterium bovis subsp bovis AF2122/97
cccgccgucaccgcc

SEQ ID NO: 1185066 - RNA, 18 nt, Mycobacterium bovis subsp bovis AF2122/97
cccgccggguuggucuuc

SEQ ID NO: 1185067 - RNA, 22 nt, Mycobacterium bovis subsp bovis AF2122/97
cccgccggugaucggcggcaac

SEQ ID NO: 1185068 - RNA, 18 nt, Mycobacterium bovis subsp bovis AF2122/97
cccgccgucaccgccguu

SEQ ID NO: 1185069 - RNA, 16 nt, Mycobacterium bovis subsp bovis AF2122/97
cccgccgucgccgccg

SEQ ID NO: 1185070 - RNA, 20 nt, Mycobacterium bovis subsp bovis AF2122/97
cccgccgucuuggcccgguc

SEQ ID NO: 1185071 - RNA, 14 nt, Mycobacterium bovis subsp bovis AF2122/97
cccggcucacagca

SEQ ID NO: 1185072 - RNA, 12 nt, Mycobacterium bovis subsp bovis AF2122/97
cccgccgugccg

SEQ ID NO: 1185073 - RNA, 15 nt, Mycobacterium bovis subsp bovis AF2122/97
cccgccgugccgcgg

SEQ ID NO: 1185074 - RNA, 17 nt, Mycobacterium bovis subsp bovis AF2122/97
cccgccgggaugccucg

SEQ ID NO: 1185075 - RNA, 15 nt, Mycobacterium bovis subsp bovis AF2122/97
cccgccggguccgcc

SEQ ID NO: 1185076 - RNA, 21 nt, Mycobacterium bovis subsp bovis AF2122/97
cccgccggccgcgccggcccc

SEQ ID NO: 1185077 - RNA, 13 nt, Mycobacterium bovis subsp bovis AF2122/97
cccgccggcgccg

SEQ ID NO: 1185078 - RNA, 16 nt, Mycobacterium bovis subsp bovis AF2122/97
cccgccggcgccgccc

SEQ ID NO: 1185079 - RNA, 17 nt, Mycobacterium bovis subsp bovis AF2122/97
cccgccggcgccgccca

SEQ ID NO: 1185080 - RNA, 20 nt, Mycobacterium bovis subsp bovis AF2122/97
cccgccggcgcgagccggcu

SEQ ID NO: 1185081 - RNA, 14 nt, Mycobacterium bovis subsp bovis AF2122/97
cccggucaacguga

SEQ ID NO: 1185082 - RNA, 19 nt, Mycobacterium bovis subsp bovis AF2122/97
cccgguacgucgaggguga

SEQ ID NO: 1185083 - RNA, 15 nt, Mycobacterium bovis subsp bovis AF2122/97
cccgguagccccguc

SEQ ID NO: 1185084 - RNA, 14 nt, Mycobacterium bovis subsp bovis AF2122/97
cccgggccgccgcg

SEQ ID NO: 1185085 - RNA, 14 nt, Mycobacterium bovis subsp bovis AF2122/97
cccgguacgccgcg

SEQ ID NO: 1185086 - RNA, 15 nt, Mycobacterium bovis subsp bovis AF2122/97
cccgguacgccgcgc

SEQ ID NO: 1185087 - RNA, 13 nt, Mycobacterium bovis subsp bovis AF2122/97
cccgggccgccag

SEQ ID NO: 1185088 - RNA, 22 nt, Mycobacterium bovis subsp bovis AF2122/97
cccgggccgccagggcccuagc

SEQ ID NO: 1185089 - RNA, 13 nt, Mycobacterium bovis subsp bovis AF2122/97
cccgggugcugug

SEQ ID NO: 1185090 - RNA, 15 nt, Mycobacterium bovis subsp bovis AF2122/97
cccggguggcccgga

SEQ ID NO: 1185091 - RNA, 13 nt, Mycobacterium bovis subsp bovis AF2122/97
cccgggcagcccc

SEQ ID NO: 1185092 - RNA, 17 nt, Mycobacterium bovis subsp bovis AF2122/97
cccgggugcgcucuucu

SEQ ID NO: 1185093 - RNA, 20 nt, Mycobacterium bovis subsp bovis AF2122/97
cccgguaauccacuccagcg

SEQ ID NO: 1185094 - RNA, 15 nt, Mycobacterium bovis subsp bovis AF2122/97
cccggugagaagaag

SEQ ID NO: 1185095 - RNA, 17 nt, Mycobacterium bovis subsp bovis AF2122/97
cccggugaugaagcgcg

SEQ ID NO: 1185096 - RNA, 14 nt, Mycobacterium bovis subsp bovis AF2122/97
cccggugccgcagc

SEQ ID NO: 1185097 - RNA, 14 nt, Mycobacterium bovis subsp bovis AF2122/97
cccgguguccagcc

SEQ ID NO: 1185098 - RNA, 14 nt, Mycobacterium bovis subsp bovis AF2122/97
cccgguguccagug

SEQ ID NO: 1185099 - RNA, 18 nt, Mycobacterium bovis subsp bovis AF2122/97
cccggugucgaugcgcag

SEQ ID NO: 1185100 - RNA, 19 nt, Mycobacterium bovis subsp bovis AF2122/97
cccggugucgaugcgcagc

SEQ ID NO: 1185101 - RNA, 21 nt, Mycobacterium bovis subsp bovis AF2122/97
cccgguguguauucgccgacg

SEQ ID NO: 1185102 - RNA, 16 nt, Mycobacterium bovis subsp bovis AF2122/97
cccgguggacagaauc

SEQ ID NO: 1185103 - RNA, 15 nt, Mycobacterium bovis subsp bovis AF2122/97
cccgguggugcugcc

SEQ ID NO: 1185104 - RNA, 13 nt, Mycobacterium bovis subsp bovis AF2122/97
cccgucacucacc

SEQ ID NO: 1185105 - RNA, 18 nt, Mycobacterium bovis subsp bovis AF2122/97
cccguauugaugcugccc

SEQ ID NO: 1185106 - RNA, 16 nt, Mycobacterium bovis subsp bovis AF2122/97
cccguauaaccggcca

SEQ ID NO: 1185107 - RNA, 17 nt, Mycobacterium bovis subsp bovis AF2122/97
cccguccaacuacgcca

SEQ ID NO: 1185108 - RNA, 21 nt, Mycobacterium bovis subsp bovis AF2122/97
cccguccaacuacgccagccg

SEQ ID NO: 1185109 - RNA, 22 nt, Mycobacterium bovis subsp bovis AF2122/97
cccguccaacuacgccagccgc

SEQ ID NO: 1185110 - RNA, 13 nt, Mycobacterium bovis subsp bovis AF2122/97
cccgucacgcccg

SEQ ID NO: 1185111 - RNA, 22 nt, Mycobacterium bovis subsp bovis AF2122/97
cccgucgucggcaaccaaccgc

SEQ ID NO: 1185112 - RNA, 13 nt, Mycobacterium bovis subsp bovis AF2122/97
cccgugccacagc

SEQ ID NO: 1185113 - RNA, 21 nt, Mycobacterium bovis subsp bovis AF2122/97
cccgugccgcccgcgccgccc

SEQ ID NO: 1185114 - RNA, 22 nt, Mycobacterium bovis subsp bovis AF2122/97
cccgugagauccuccaauugcg

SEQ ID NO: 1185115 - RNA, 14 nt, Mycobacterium bovis subsp bovis AF2122/97
cccgugcgcgcgca

SEQ ID NO: 1185116 - RNA, 22 nt, Mycobacterium bovis subsp bovis AF2122/97
cccgugccgucaacgauggugg

SEQ ID NO: 1185117 - RNA, 15 nt, Mycobacterium bovis subsp bovis AF2122/97
cccgugccgucgccc

SEQ ID NO: 1185118 - RNA, 15 nt, Mycobacterium bovis subsp bovis AF2122/97
cccgugcggcucgcc

SEQ ID NO: 1185119 - RNA, 16 nt, Mycobacterium bovis subsp bovis AF2122/97
cccgugcggcucgccg

SEQ ID NO: 1185120 - RNA, 15 nt, Mycobacterium bovis subsp bovis AF2122/97
cccgugauccgccga

SEQ ID NO: 1185121 - RNA, 13 nt, Mycobacterium bovis subsp bovis AF2122/97
cccgugccuggcc

SEQ ID NO: 1185122 - RNA, 18 nt, Mycobacterium bovis subsp bovis AF2122/97
cccgugcgcgcgcagcug

SEQ ID NO: 1185123 - RNA, 22 nt, Mycobacterium bovis subsp bovis AF2122/97
cccgugcuuuccuugcgcgcca

SEQ ID NO: 1185124 - RNA, 16 nt, Mycobacterium bovis subsp bovis AF2122/97
cccguuaugcgccgcc

SEQ ID NO: 1185125 - RNA, 14 nt, Mycobacterium bovis subsp bovis AF2122/97
cccguuccacgauc

SEQ ID NO: 1185126 - RNA, 23 nt, Mycobacterium bovis subsp bovis AF2122/97
cccguuguccagaacggcgauca

SEQ ID NO: 1185127 - RNA, 20 nt, Mycobacterium bovis subsp bovis AF2122/97
cccguuucaagucccuucau

SEQ ID NO: 1185128 - RNA, 19 nt, Mycobacterium bovis subsp bovis AF2122/97
cccuagcuggugcgcccga

SEQ ID NO: 1185129 - RNA, 13 nt, Mycobacterium bovis subsp bovis AF2122/97
cccuauacgcaac

SEQ ID NO: 1185130 - RNA, 21 nt, Mycobacterium bovis subsp bovis AF2122/97
cccuagggcggugccgccgga

SEQ ID NO: 1185131 - RNA, 15 nt, Mycobacterium bovis subsp bovis AF2122/97
cccuucaccagccac

SEQ ID NO: 1185132 - RNA, 12 nt, Mycobacterium bovis subsp bovis AF2122/97
aaacagcaccca

SEQ ID NO: 1185133 - RNA, 15 nt, Mycobacterium bovis subsp bovis AF2122/97
cccugguccaggccc

SEQ ID NO: 1185134 - RNA, 18 nt, Mycobacterium bovis subsp bovis AF2122/97
cccuggggccguccggcu

SEQ ID NO: 1185135 - RNA, 22 nt, Mycobacterium bovis subsp bovis AF2122/97
aaacagcauggcgaagaacaac

SEQ ID NO: 1185136 - RNA, 19 nt, Mycobacterium bovis subsp bovis AF2122/97
ccgaaaaacaccagcgagg

SEQ ID NO: 1185137 - RNA, 16 nt, Mycobacterium bovis subsp bovis AF2122/97
aaacagguaagcagcc

SEQ ID NO: 1185138 - RNA, 15 nt, Mycobacterium bovis subsp bovis AF2122/97
ccgaagccgggcccc

SEQ ID NO: 1185139 - RNA, 22 nt, Mycobacterium bovis subsp bovis AF2122/97
ccgaagcgcccguuggccaaga

SEQ ID NO: 1185140 - RNA, 14 nt, Mycobacterium bovis subsp bovis AF2122/97
ccgaagcgcccguu

SEQ ID NO: 1185141 - RNA, 19 nt, Mycobacterium bovis subsp bovis AF2122/97
ccgaagccgaccggguuga

SEQ ID NO: 1185142 - RNA, 14 nt, Mycobacterium bovis subsp bovis AF2122/97
ccgaagcccgagcu

SEQ ID NO: 1185143 - RNA, 11 nt, Mycobacterium bovis subsp bovis AF2122/97
ccgaagccccc

SEQ ID NO: 1185144 - RNA, 15 nt, Mycobacterium bovis subsp bovis AF2122/97
ccgaagaugaccgcu

SEQ ID NO: 1185145 - RNA, 21 nt, Mycobacterium bovis subsp bovis AF2122/97
ccgaagaaugggauggcacca

SEQ ID NO: 1185146 - RNA, 17 nt, Mycobacterium bovis subsp bovis AF2122/97
ccgaauaccgccgcgca

SEQ ID NO: 1185147 - RNA, 16 nt, Mycobacterium bovis subsp bovis AF2122/97
ccgaauaccgccgcgc

SEQ ID NO: 1185148 - RNA, 14 nt, Mycobacterium bovis subsp bovis AF2122/97
ccgaagcggaucug

SEQ ID NO: 1185149 - RNA, 20 nt, Mycobacterium bovis subsp bovis AF2122/97
aaacaugugggugaacaccg

SEQ ID NO: 1185150 - RNA, 19 nt, Mycobacterium bovis subsp bovis AF2122/97
ccgaaacuucgcccgggcc

SEQ ID NO: 1185151 - RNA, 13 nt, Mycobacterium bovis subsp bovis AF2122/97
ccgaaagccaggc

SEQ ID NO: 1185152 - RNA, 16 nt, Mycobacterium bovis subsp bovis AF2122/97
ccgaaaccaugccgcc

SEQ ID NO: 1185153 - RNA, 18 nt, Mycobacterium bovis subsp bovis AF2122/97
ccgaaaaguccgccgccu

SEQ ID NO: 1185154 - RNA, 14 nt, Mycobacterium bovis subsp bovis AF2122/97
ccgaaaaugccgcc

SEQ ID NO: 1185155 - RNA, 18 nt, Mycobacterium bovis subsp bovis AF2122/97
ccgaacguguugaccagg

SEQ ID NO: 1185156 - RNA, 14 nt, Mycobacterium bovis subsp bovis AF2122/97
ccgaacgcuccagg

SEQ ID NO: 1185157 - RNA, 21 nt, Mycobacterium bovis subsp bovis AF2122/97
ccgaacggguagacccacauc

SEQ ID NO: 1185158 - RNA, 11 nt, Mycobacterium bovis subsp bovis AF2122/97
ccgaacauggc

SEQ ID NO: 1185159 - RNA, 19 nt, Mycobacterium bovis subsp bovis AF2122/97
ccgaacauugcgcccagcg

SEQ ID NO: 1185160 - RNA, 20 nt, Mycobacterium bovis subsp bovis AF2122/97
ccgaccgguacccguagcac

SEQ ID NO: 1185161 - RNA, 22 nt, Mycobacterium bovis subsp bovis AF2122/97
ccgaccgguacccguagcacca

SEQ ID NO: 1185162 - RNA, 23 nt, Mycobacterium bovis subsp bovis AF2122/97
ccgaccgggcucuggccaguccg

SEQ ID NO: 1185163 - RNA, 15 nt, Mycobacterium bovis subsp bovis AF2122/97
ccgaccggcacccgc

SEQ ID NO: 1185164 - RNA, 17 nt, Mycobacterium bovis subsp bovis AF2122/97
ccgaccggucuggcgau

SEQ ID NO: 1185165 - RNA, 17 nt, Mycobacterium bovis subsp bovis AF2122/97
ccgaccugcaagacgcc

SEQ ID NO: 1185166 - RNA, 11 nt, Mycobacterium bovis subsp bovis AF2122/97
ccgaccuggac

SEQ ID NO: 1185167 - RNA, 21 nt, Mycobacterium bovis subsp bovis AF2122/97
ccgaccucguucgucaccacg

SEQ ID NO: 1185168 - RNA, 17 nt, Mycobacterium bovis subsp bovis AF2122/97
ccgacgacaccagagcg

SEQ ID NO: 1185169 - RNA, 15 nt, Mycobacterium bovis subsp bovis AF2122/97
ccgacgaccagcaga

SEQ ID NO: 1185170 - RNA, 20 nt, Mycobacterium bovis subsp bovis AF2122/97
ccgacgaacgaaccgccgcc

SEQ ID NO: 1185171 - RNA, 21 nt, Mycobacterium bovis subsp bovis AF2122/97
ccgacgaacgaaccgccgccg

SEQ ID NO: 1185172 - RNA, 21 nt, Mycobacterium bovis subsp bovis AF2122/97
ccgacgacggcgacggcgccc

SEQ ID NO: 1185173 - RNA, 16 nt, Mycobacterium bovis subsp bovis AF2122/97
ccgacgccaacgccag

SEQ ID NO: 1185174 - RNA, 19 nt, Mycobacterium bovis subsp bovis AF2122/97
ccgacgccaacgccagcgg

SEQ ID NO: 1185175 - RNA, 12 nt, Mycobacterium bovis subsp bovis AF2122/97
ccgacgccgcca

SEQ ID NO: 1185176 - RNA, 13 nt, Mycobacterium bovis subsp bovis AF2122/97
ccgacgccgccag

SEQ ID NO: 1185177 - RNA, 16 nt, Mycobacterium bovis subsp bovis AF2122/97
ccgacgccgccggccc

SEQ ID NO: 1185178 - RNA, 18 nt, Mycobacterium bovis subsp bovis AF2122/97
ccgacgccgccggccccg

SEQ ID NO: 1185179 - RNA, 17 nt, Mycobacterium bovis subsp bovis AF2122/97
ccgacgcgggccgcgaa

SEQ ID NO: 1185180 - RNA, 17 nt, Mycobacterium bovis subsp bovis AF2122/97
ccgacgcgcggccagcc

SEQ ID NO: 1185181 - RNA, 18 nt, Mycobacterium bovis subsp bovis AF2122/97
ccgacgcgcggccagccc

SEQ ID NO: 1185182 - RNA, 17 nt, Mycobacterium bovis subsp bovis AF2122/97
ccgacgccuuccagccc

SEQ ID NO: 1185183 - RNA, 18 nt, Mycobacterium bovis subsp bovis AF2122/97
ccgacgauuaccagcggc

SEQ ID NO: 1185184 - RNA, 13 nt, Mycobacterium bovis subsp bovis AF2122/97
ccgacgcagguga

SEQ ID NO: 1185185 - RNA, 18 nt, Mycobacterium bovis subsp bovis AF2122/97
ccgacgaguacacgaucu

SEQ ID NO: 1185186 - RNA, 14 nt, Mycobacterium bovis subsp bovis AF2122/97
ccgagccacgaccc

SEQ ID NO: 1185187 - RNA, 21 nt, Mycobacterium bovis subsp bovis AF2122/97
ccgagcagcuccuugagguca

SEQ ID NO: 1185188 - RNA, 13 nt, Mycobacterium bovis subsp bovis AF2122/97
ccgagcagcuccu

SEQ ID NO: 1185189 - RNA, 15 nt, Mycobacterium bovis subsp bovis AF2122/97
ccgagccgcacagca

SEQ ID NO: 1185190 - RNA, 18 nt, Mycobacterium bovis subsp bovis AF2122/97
ccgagccgaccggcggca

SEQ ID NO: 1185191 - RNA, 22 nt, Mycobacterium bovis subsp bovis AF2122/97
ccgagccgauauaccagggcau

SEQ ID NO: 1185192 - RNA, 17 nt, Mycobacterium bovis subsp bovis AF2122/97
ccgagcccgggccguac

SEQ ID NO: 1185193 - RNA, 15 nt, Mycobacterium bovis subsp bovis AF2122/97
ccgagccgcccgccc

SEQ ID NO: 1185194 - RNA, 12 nt, Mycobacterium bovis subsp bovis AF2122/97
ccgagccgcagc

SEQ ID NO: 1185195 - RNA, 15 nt, Mycobacterium bovis subsp bovis AF2122/97
ccgagcccgcugcgc

SEQ ID NO: 1185196 - RNA, 18 nt, Mycobacterium bovis subsp bovis AF2122/97
ccgagcccgaugguggug

SEQ ID NO: 1185197 - RNA, 20 nt, Mycobacterium bovis subsp bovis AF2122/97
ccgagcccagcgccuccagc

SEQ ID NO: 1185198 - RNA, 14 nt, Mycobacterium bovis subsp bovis AF2122/97
ccgagccagcuccg

SEQ ID NO: 1185199 - RNA, 14 nt, Mycobacterium bovis subsp bovis AF2122/97
ccgagcccaggugg

SEQ ID NO: 1185200 - RNA, 18 nt, Mycobacterium bovis subsp bovis AF2122/97
ccgagcacgccgagcccg

SEQ ID NO: 1185201 - RNA, 16 nt, Mycobacterium bovis subsp bovis AF2122/97
ccgagcacgggcagau

SEQ ID NO: 1185202 - RNA, 22 nt, Mycobacterium bovis subsp bovis AF2122/97
ccgagcacggguagcguccagg

SEQ ID NO: 1185203 - RNA, 18 nt, Mycobacterium bovis subsp bovis AF2122/97
ccgagcaacggcggcagg

SEQ ID NO: 1185204 - RNA, 23 nt, Mycobacterium bovis subsp bovis AF2122/97
ccgagcaacggcggcaggccggc

SEQ ID NO: 1185205 - RNA, 22 nt, Mycobacterium bovis subsp bovis AF2122/97
ccgagaagcguugcacugcugg

SEQ ID NO: 1185206 - RNA, 14 nt, Mycobacterium bovis subsp bovis AF2122/97
ccgagaacggcggg

SEQ ID NO: 1185207 - RNA, 17 nt, Mycobacterium bovis subsp bovis AF2122/97
ccgagaagacgcaaaag

SEQ ID NO: 1185208 - RNA, 18 nt, Mycobacterium bovis subsp bovis AF2122/97
ccgacuucuccaggcuga

SEQ ID NO: 1185209 - RNA, 22 nt, Mycobacterium bovis subsp bovis AF2122/97
ccgacuugauuucgaucgcggc

SEQ ID NO: 1185210 - RNA, 13 nt, Mycobacterium bovis subsp bovis AF2122/97
ccgagaacaccac

SEQ ID NO: 1185211 - RNA, 15 nt, Mycobacterium bovis subsp bovis AF2122/97
ccgagaacgcccgag

SEQ ID NO: 1185212 - RNA, 21 nt, Mycobacterium bovis subsp bovis AF2122/97
ccgacuuugucgcggagucug

SEQ ID NO: 1185213 - RNA, 15 nt, Mycobacterium bovis subsp bovis AF2122/97
ccgacccaacgacca

SEQ ID NO: 1185214 - RNA, 20 nt, Mycobacterium bovis subsp bovis AF2122/97
ccgaccaucucaccgggccc

SEQ ID NO: 1185215 - RNA, 14 nt, Mycobacterium bovis subsp bovis AF2122/97
ccgacccgccgcgc

SEQ ID NO: 1185216 - RNA, 16 nt, Mycobacterium bovis subsp bovis AF2122/97
ccgacccgccgcgccc

SEQ ID NO: 1185217 - RNA, 19 nt, Mycobacterium bovis subsp bovis AF2122/97
ccgaccccgccgagcgcgc

SEQ ID NO: 1185218 - RNA, 14 nt, Mycobacterium bovis subsp bovis AF2122/97
ccgaccccgacggc

SEQ ID NO: 1185219 - RNA, 18 nt, Mycobacterium bovis subsp bovis AF2122/97
ccgacccgcugccaccca

SEQ ID NO: 1185220 - RNA, 17 nt, Mycobacterium bovis subsp bovis AF2122/97
ccgacccgcgcgccggc

SEQ ID NO: 1185221 - RNA, 14 nt, Mycobacterium bovis subsp bovis AF2122/97
ccgacccgggcgag

SEQ ID NO: 1185222 - RNA, 16 nt, Mycobacterium bovis subsp bovis AF2122/97
ccgaccgacaccacca

SEQ ID NO: 1185223 - RNA, 20 nt, Mycobacterium bovis subsp bovis AF2122/97
ccgaccgaaagccgcaccag

SEQ ID NO: 1185224 - RNA, 13 nt, Mycobacterium bovis subsp bovis AF2122/97
ccgaccgccaccg

SEQ ID NO: 1185225 - RNA, 14 nt, Mycobacterium bovis subsp bovis AF2122/97
ccgaccgccauccu

SEQ ID NO: 1185226 - RNA, 14 nt, Mycobacterium bovis subsp bovis AF2122/97
ccgaccgcgcccgc

SEQ ID NO: 1185227 - RNA, 20 nt, Mycobacterium bovis subsp bovis AF2122/97
ccgaccgcguuguccgcggc

SEQ ID NO: 1185228 - RNA, 19 nt, Mycobacterium bovis subsp bovis AF2122/97
ccgaccagcggccgaccgc

SEQ ID NO: 1185229 - RNA, 20 nt, Mycobacterium bovis subsp bovis AF2122/97
ccgaccagcuugaccgacca

SEQ ID NO: 1185230 - RNA, 12 nt, Mycobacterium bovis subsp bovis AF2122/97
ccgaccaccaga

SEQ ID NO: 1185231 - RNA, 15 nt, Mycobacterium bovis subsp bovis AF2122/97
ccgaccagcacccgc

SEQ ID NO: 1185232 - RNA, 12 nt, Mycobacterium bovis subsp bovis AF2122/97
ccgaccagcaga

SEQ ID NO: 1185233 - RNA, 14 nt, Mycobacterium bovis subsp bovis AF2122/97
ccgacaguccgcgc

SEQ ID NO: 1185234 - RNA, 21 nt, Mycobacterium bovis subsp bovis AF2122/97
ccgacaugguccgaccagcgg

SEQ ID NO: 1185235 - RNA, 18 nt, Mycobacterium bovis subsp bovis AF2122/97
ccgacauggcggugcgca

SEQ ID NO: 1185236 - RNA, 20 nt, Mycobacterium bovis subsp bovis AF2122/97
ccgaccaauucgcaaucggc

SEQ ID NO: 1185237 - RNA, 14 nt, Mycobacterium bovis subsp bovis AF2122/97
ccgacaggccggcc

SEQ ID NO: 1185238 - RNA, 18 nt, Mycobacterium bovis subsp bovis AF2122/97
ccgacaggccggccacca

SEQ ID NO: 1185239 - RNA, 21 nt, Mycobacterium bovis subsp bovis AF2122/97
ccgacaggccggccaccaguc

SEQ ID NO: 1185240 - RNA, 17 nt, Mycobacterium bovis subsp bovis AF2122/97
ccgacaguggucccggu

SEQ ID NO: 1185241 - RNA, 22 nt, Mycobacterium bovis subsp bovis AF2122/97
ccgacagggacccgagaucacc

SEQ ID NO: 1185242 - RNA, 15 nt, Mycobacterium bovis subsp bovis AF2122/97
ccgacacguugcagc

SEQ ID NO: 1185243 - RNA, 23 nt, Mycobacterium bovis subsp bovis AF2122/97
ccgacacguugcagcucgauccg

SEQ ID NO: 1185244 - RNA, 21 nt, Mycobacterium bovis subsp bovis AF2122/97
ccgacacggugcugccguugg

SEQ ID NO: 1185245 - RNA, 23 nt, Mycobacterium bovis subsp bovis AF2122/97
ccgacaccggcugaccgacccgg

SEQ ID NO: 1185246 - RNA, 15 nt, Mycobacterium bovis subsp bovis AF2122/97
ccgacacgccguugg

SEQ ID NO: 1185247 - RNA, 13 nt, Mycobacterium bovis subsp bovis AF2122/97
ccgacacggcucg

SEQ ID NO: 1185248 - RNA, 14 nt, Mycobacterium bovis subsp bovis AF2122/97
ccgacagcagccgg

SEQ ID NO: 1185249 - RNA, 12 nt, Mycobacterium bovis subsp bovis AF2122/97
aaacauugcuag

SEQ ID NO: 1185250 - RNA, 21 nt, Mycobacterium bovis subsp bovis AF2122/97
ccgccguucgggaugcaagga

SEQ ID NO: 1185251 - RNA, 21 nt, Mycobacterium bovis subsp bovis AF2122/97
ccgccguucccaccaccaccg

SEQ ID NO: 1185252 - RNA, 21 nt, Mycobacterium bovis subsp bovis AF2122/97
ccgccguugccaccggugccg

SEQ ID NO: 1185253 - RNA, 22 nt, Mycobacterium bovis subsp bovis AF2122/97
ccgccguugccauugccucccg

SEQ ID NO: 1185254 - RNA, 21 nt, Mycobacterium bovis subsp bovis AF2122/97
ccgccguugccgaucagcccg

SEQ ID NO: 1185255 - RNA, 21 nt, Mycobacterium bovis subsp bovis AF2122/97
ccgccguugccgccggcgccg

SEQ ID NO: 1185256 - RNA, 15 nt, Mycobacterium bovis subsp bovis AF2122/97
ccgccguugccgucg

SEQ ID NO: 1185257 - RNA, 23 nt, Mycobacterium bovis subsp bovis AF2122/97
ccgccguugccauugccucccgc

SEQ ID NO: 1185258 - RNA, 16 nt, Mycobacterium bovis subsp bovis AF2122/97
ccgccguugccgccgc

SEQ ID NO: 1185259 - RNA, 21 nt, Mycobacterium bovis subsp bovis AF2122/97
ccgccguugccgccgccuccg

SEQ ID NO: 1185260 - RNA, 23 nt, Mycobacterium bovis subsp bovis AF2122/97
ccgccuccgccugccccacccgc

SEQ ID NO: 1185261 - RNA, 13 nt, Mycobacterium bovis subsp bovis AF2122/97
ccgccuccaccgc

SEQ ID NO: 1185262 - RNA, 17 nt, Mycobacterium bovis subsp bovis AF2122/97
ccgccuccaccgccgcg

SEQ ID NO: 1185263 - RNA, 23 nt, Mycobacterium bovis subsp bovis AF2122/97
ccgccguuggcucgagccgcccg

SEQ ID NO: 1185264 - RNA, 16 nt, Mycobacterium bovis subsp bovis AF2122/97
ccgccguugggccgcg

SEQ ID NO: 1185265 - RNA, 16 nt, Mycobacterium bovis subsp bovis AF2122/97
ccgccguuuccgccgc

SEQ ID NO: 1185266 - RNA, 19 nt, Mycobacterium bovis subsp bovis AF2122/97
ccgccuaaucggccugccg

SEQ ID NO: 1185267 - RNA, 14 nt, Mycobacterium bovis subsp bovis AF2122/97
ccgccgugcccccg

SEQ ID NO: 1185268 - RNA, 14 nt, Mycobacterium bovis subsp bovis AF2122/97
ccgccgugccgcgg

SEQ ID NO: 1185269 - RNA, 21 nt, Mycobacterium bovis subsp bovis AF2122/97
ccgccguuaccgagcccgaag

SEQ ID NO: 1185270 - RNA, 16 nt, Mycobacterium bovis subsp bovis AF2122/97
ccgccguuaccgccgc

SEQ ID NO: 1185271 - RNA, 16 nt, Mycobacterium bovis subsp bovis AF2122/97
ccgccguuaccgccgu

SEQ ID NO: 1185272 - RNA, 22 nt, Mycobacterium bovis subsp bovis AF2122/97
ccgccgugcggguucacugccg

SEQ ID NO: 1185273 - RNA, 22 nt, Mycobacterium bovis subsp bovis AF2122/97
ccgccgucguugcccgacccgc

SEQ ID NO: 1185274 - RNA, 17 nt, Mycobacterium bovis subsp bovis AF2122/97
ccgccgucgccacgccc

SEQ ID NO: 1185275 - RNA, 16 nt, Mycobacterium bovis subsp bovis AF2122/97
ccgccgucgccgccgc

SEQ ID NO: 1185276 - RNA, 18 nt, Mycobacterium bovis subsp bovis AF2122/97
ccgccgucgccggugccg

SEQ ID NO: 1185277 - RNA, 13 nt, Mycobacterium bovis subsp bovis AF2122/97
ccgccguccagcg

SEQ ID NO: 1185278 - RNA, 17 nt, Mycobacterium bovis subsp bovis AF2122/97
ccgccguccagcgccgc

SEQ ID NO: 1185279 - RNA, 14 nt, Mycobacterium bovis subsp bovis AF2122/97
ccgccguccccgcc

SEQ ID NO: 1185280 - RNA, 16 nt, Mycobacterium bovis subsp bovis AF2122/97
ccgccgucaccgccgu

SEQ ID NO: 1185281 - RNA, 18 nt, Mycobacterium bovis subsp bovis AF2122/97
ccgccggcgcuggcgggc

SEQ ID NO: 1185282 - RNA, 14 nt, Mycobacterium bovis subsp bovis AF2122/97
ccgccgggccaggc

SEQ ID NO: 1185283 - RNA, 19 nt, Mycobacterium bovis subsp bovis AF2122/97
ccgccgggauaacccagca

SEQ ID NO: 1185284 - RNA, 15 nt, Mycobacterium bovis subsp bovis AF2122/97
ccgccggcuccggcg

SEQ ID NO: 1185285 - RNA, 14 nt, Mycobacterium bovis subsp bovis AF2122/97
ccgccggcucgccg

SEQ ID NO: 1185286 - RNA, 16 nt, Mycobacterium bovis subsp bovis AF2122/97
ccgccggcucgccggc

SEQ ID NO: 1185287 - RNA, 13 nt, Mycobacterium bovis subsp bovis AF2122/97
ccgccgggccccg

SEQ ID NO: 1185288 - RNA, 13 nt, Mycobacterium bovis subsp bovis AF2122/97
ccgccgggcccuc

SEQ ID NO: 1185289 - RNA, 23 nt, Mycobacterium bovis subsp bovis AF2122/97
ccgccggcuccgccacuggcgcc

SEQ ID NO: 1185290 - RNA, 21 nt, Mycobacterium bovis subsp bovis AF2122/97
ccgccggcgcugaucgcgaag

SEQ ID NO: 1185291 - RNA, 15 nt, Mycobacterium bovis subsp bovis AF2122/97
ccgccggcgccgccc

SEQ ID NO: 1185292 - RNA, 16 nt, Mycobacterium bovis subsp bovis AF2122/97
ccgccggcgccgcccg

SEQ ID NO: 1185293 - RNA, 13 nt, Mycobacterium bovis subsp bovis AF2122/97
ccgccggcgccca

SEQ ID NO: 1185294 - RNA, 17 nt, Mycobacterium bovis subsp bovis AF2122/97
ccgccggcgccgcccgc

SEQ ID NO: 1185295 - RNA, 15 nt, Mycobacterium bovis subsp bovis AF2122/97
ccgccggcgccggag

SEQ ID NO: 1185296 - RNA, 14 nt, Mycobacterium bovis subsp bovis AF2122/97
ccgccggcgcgagc

SEQ ID NO: 1185297 - RNA, 16 nt, Mycobacterium bovis subsp bovis AF2122/97
ccgccgggccaggccg

SEQ ID NO: 1185298 - RNA, 15 nt, Mycobacterium bovis subsp bovis AF2122/97
ccgccgggcuccacg

SEQ ID NO: 1185299 - RNA, 17 nt, Mycobacterium bovis subsp bovis AF2122/97
ccgccggggcagcucac

SEQ ID NO: 1185300 - RNA, 20 nt, Mycobacterium bovis subsp bovis AF2122/97
ccgccggguccgccgggccc

SEQ ID NO: 1185301 - RNA, 15 nt, Mycobacterium bovis subsp bovis AF2122/97
ccgccgggggcaccg

SEQ ID NO: 1185302 - RNA, 15 nt, Mycobacterium bovis subsp bovis AF2122/97
ccgccggguuggcgc

SEQ ID NO: 1185303 - RNA, 14 nt, Mycobacterium bovis subsp bovis AF2122/97
ccgccgguccaugg

SEQ ID NO: 1185304 - RNA, 15 nt, Mycobacterium bovis subsp bovis AF2122/97
ccgccgguggcgccg

SEQ ID NO: 1185305 - RNA, 18 nt, Mycobacterium bovis subsp bovis AF2122/97
ccgccggucccgcgugcc

SEQ ID NO: 1185306 - RNA, 13 nt, Mycobacterium bovis subsp bovis AF2122/97
ccgccggugaucg

SEQ ID NO: 1185307 - RNA, 19 nt, Mycobacterium bovis subsp bovis AF2122/97
ccgccggugccaccgacgc

SEQ ID NO: 1185308 - RNA, 16 nt, Mycobacterium bovis subsp bovis AF2122/97
ccgccggugccgcccg

SEQ ID NO: 1185309 - RNA, 21 nt, Mycobacterium bovis subsp bovis AF2122/97
ccgccggugccgccggugccg

SEQ ID NO: 1185310 - RNA, 20 nt, Mycobacterium bovis subsp bovis AF2122/97
ccgccgguuccgccggcccc

SEQ ID NO: 1185311 - RNA, 21 nt, Mycobacterium bovis subsp bovis AF2122/97
ccgccgguggugccggcgccg

SEQ ID NO: 1185312 - RNA, 15 nt, Mycobacterium bovis subsp bovis AF2122/97
ccgccggugucgggc

SEQ ID NO: 1185313 - RNA, 16 nt, Mycobacterium bovis subsp bovis AF2122/97
ccgccgguuugggggc

SEQ ID NO: 1185314 - RNA, 21 nt, Mycobacterium bovis subsp bovis AF2122/97
ccgccgcacgcuagccgacag

SEQ ID NO: 1185315 - RNA, 21 nt, Mycobacterium bovis subsp bovis AF2122/97
ccgccgcagacgccgacuccg

SEQ ID NO: 1185316 - RNA, 21 nt, Mycobacterium bovis subsp bovis AF2122/97
ccgccgaugaugcggcgcagc

SEQ ID NO: 1185317 - RNA, 12 nt, Mycobacterium bovis subsp bovis AF2122/97
ccgccgccaccg

SEQ ID NO: 1185318 - RNA, 16 nt, Mycobacterium bovis subsp bovis AF2122/97
ccgccgccaccggcgc

SEQ ID NO: 1185319 - RNA, 13 nt, Mycobacterium bovis subsp bovis AF2122/97
ccgccgcccagcg

SEQ ID NO: 1185320 - RNA, 13 nt, Mycobacterium bovis subsp bovis AF2122/97
ccgccgcccccgc

SEQ ID NO: 1185321 - RNA, 14 nt, Mycobacterium bovis subsp bovis AF2122/97
ccgccgcccccgcc

SEQ ID NO: 1185322 - RNA, 23 nt, Mycobacterium bovis subsp bovis AF2122/97
ccgccgccaguccggacggcagc

SEQ ID NO: 1185323 - RNA, 12 nt, Mycobacterium bovis subsp bovis AF2122/97
ccgccgccgaag

SEQ ID NO: 1185324 - RNA, 14 nt, Mycobacterium bovis subsp bovis AF2122/97
ccgccgcgaccacg

SEQ ID NO: 1185325 - RNA, 22 nt, Mycobacterium bovis subsp bovis AF2122/97
ccgccgcgaccacgcaccgccc

SEQ ID NO: 1185326 - RNA, 15 nt, Mycobacterium bovis subsp bovis AF2122/97
ccgccgcgagcagaa

SEQ ID NO: 1185327 - RNA, 21 nt, Mycobacterium bovis subsp bovis AF2122/97
ccgccgcgacgcacugccccg

SEQ ID NO: 1185328 - RNA, 13 nt, Mycobacterium bovis subsp bovis AF2122/97
ccgccgcgccccg

SEQ ID NO: 1185329 - RNA, 15 nt, Mycobacterium bovis subsp bovis AF2122/97
ccgccgcgcagccgc

SEQ ID NO: 1185330 - RNA, 12 nt, Mycobacterium bovis subsp bovis AF2122/97
ccgccgcgcagc

SEQ ID NO: 1185331 - RNA, 16 nt, Mycobacterium bovis subsp bovis AF2122/97
ccgccgccgucggcga

SEQ ID NO: 1185332 - RNA, 23 nt, Mycobacterium bovis subsp bovis AF2122/97
ccgccgccgucggcgagcagacg

SEQ ID NO: 1185333 - RNA, 16 nt, Mycobacterium bovis subsp bovis AF2122/97
ccgccgccugcccggc

SEQ ID NO: 1185334 - RNA, 21 nt, Mycobacterium bovis subsp bovis AF2122/97
ccgccgccgaagcgaugccgu

SEQ ID NO: 1185335 - RNA, 14 nt, Mycobacterium bovis subsp bovis AF2122/97
ccgccgccgcccgg

SEQ ID NO: 1185336 - RNA, 13 nt, Mycobacterium bovis subsp bovis AF2122/97
ccgccgccgccgc

SEQ ID NO: 1185337 - RNA, 16 nt, Mycobacterium bovis subsp bovis AF2122/97
ccgccgccgccgccau

SEQ ID NO: 1185338 - RNA, 16 nt, Mycobacterium bovis subsp bovis AF2122/97
ccgccgccgccgcgua

SEQ ID NO: 1185339 - RNA, 16 nt, Mycobacterium bovis subsp bovis AF2122/97
ccgccgccgccggcgc

SEQ ID NO: 1185340 - RNA, 14 nt, Mycobacterium bovis subsp bovis AF2122/97
ccgccgccggcggu

SEQ ID NO: 1185341 - RNA, 14 nt, Mycobacterium bovis subsp bovis AF2122/97
ccgccggccgccag

SEQ ID NO: 1185342 - RNA, 15 nt, Mycobacterium bovis subsp bovis AF2122/97
ccgccggcgccaccg

SEQ ID NO: 1185343 - RNA, 17 nt, Mycobacterium bovis subsp bovis AF2122/97
ccgccggccggaacgcc

SEQ ID NO: 1185344 - RNA, 13 nt, Mycobacterium bovis subsp bovis AF2122/97
ccgccggccccgc

SEQ ID NO: 1185345 - RNA, 18 nt, Mycobacterium bovis subsp bovis AF2122/97
ccgccggccccgccagcg

SEQ ID NO: 1185346 - RNA, 20 nt, Mycobacterium bovis subsp bovis AF2122/97
ccgccggccccgccagcgcc

SEQ ID NO: 1185347 - RNA, 22 nt, Mycobacterium bovis subsp bovis AF2122/97
ccgccggccccgccagcgccgc

SEQ ID NO: 1185348 - RNA, 16 nt, Mycobacterium bovis subsp bovis AF2122/97
ccgccggccccgccgc

SEQ ID NO: 1185349 - RNA, 20 nt, Mycobacterium bovis subsp bovis AF2122/97
ccgccggccccgccggcccc

SEQ ID NO: 1185350 - RNA, 23 nt, Mycobacterium bovis subsp bovis AF2122/97
ccgccggcaccgccggcaccgcc

SEQ ID NO: 1185351 - RNA, 14 nt, Mycobacterium bovis subsp bovis AF2122/97
ccgccggacccgcc

SEQ ID NO: 1185352 - RNA, 15 nt, Mycobacterium bovis subsp bovis AF2122/97
ccgccggacccgccc

SEQ ID NO: 1185353 - RNA, 14 nt, Mycobacterium bovis subsp bovis AF2122/97
ccgccggcaccgcc

SEQ ID NO: 1185354 - RNA, 16 nt, Mycobacterium bovis subsp bovis AF2122/97
ccgccggcaccgccgg

SEQ ID NO: 1185355 - RNA, 19 nt, Mycobacterium bovis subsp bovis AF2122/97
ccgccggauagcaccggca

SEQ ID NO: 1185356 - RNA, 15 nt, Mycobacterium bovis subsp bovis AF2122/97
ccgccggaacugcgc

SEQ ID NO: 1185357 - RNA, 17 nt, Mycobacterium bovis subsp bovis AF2122/97
ccgccgcugccgccugc

SEQ ID NO: 1185358 - RNA, 14 nt, Mycobacterium bovis subsp bovis AF2122/97
ccgccgcgcccggc

SEQ ID NO: 1185359 - RNA, 13 nt, Mycobacterium bovis subsp bovis AF2122/97
ccgccgcgccggc

SEQ ID NO: 1185360 - RNA, 17 nt, Mycobacterium bovis subsp bovis AF2122/97
ccgccgcggccggcgcu

SEQ ID NO: 1185361 - RNA, 14 nt, Mycobacterium bovis subsp bovis AF2122/97
ccgccgcggccacc

SEQ ID NO: 1185362 - RNA, 19 nt, Mycobacterium bovis subsp bovis AF2122/97
ccgccgcggccaccaccgc

SEQ ID NO: 1185363 - RNA, 22 nt, Mycobacterium bovis subsp bovis AF2122/97
ccgccgcggccaccaccgccgc

SEQ ID NO: 1185364 - RNA, 20 nt, Mycobacterium bovis subsp bovis AF2122/97
ccgccgcgggacaccaccgc

SEQ ID NO: 1185365 - RNA, 12 nt, Mycobacterium bovis subsp bovis AF2122/97
ccgccgcggcgc

SEQ ID NO: 1185366 - RNA, 19 nt, Mycobacterium bovis subsp bovis AF2122/97
ccgccgcgggucgcgcgaa

SEQ ID NO: 1185367 - RNA, 17 nt, Mycobacterium bovis subsp bovis AF2122/97
ccgccgcuaccgcccgc

SEQ ID NO: 1185368 - RNA, 16 nt, Mycobacterium bovis subsp bovis AF2122/97
ccgccgcugccggugg

SEQ ID NO: 1185369 - RNA, 16 nt, Mycobacterium bovis subsp bovis AF2122/97
ccgccgcugccgccgg

SEQ ID NO: 1185370 - RNA, 17 nt, Mycobacterium bovis subsp bovis AF2122/97
ccgccgcggacaccagg

SEQ ID NO: 1185371 - RNA, 21 nt, Mycobacterium bovis subsp bovis AF2122/97
ccgccgcugccgaucaguccg

SEQ ID NO: 1185372 - RNA, 13 nt, Mycobacterium bovis subsp bovis AF2122/97
ccgcccagccgca

SEQ ID NO: 1185373 - RNA, 21 nt, Mycobacterium bovis subsp bovis AF2122/97
ccgcccagcggaaucaccgaa

SEQ ID NO: 1185374 - RNA, 16 nt, Mycobacterium bovis subsp bovis AF2122/97
ccgcccagcgaggugg

SEQ ID NO: 1185375 - RNA, 15 nt, Mycobacterium bovis subsp bovis AF2122/97
ccgcccagcccggcg

SEQ ID NO: 1185376 - RNA, 16 nt, Mycobacterium bovis subsp bovis AF2122/97
ccgcccaggagcaccu

SEQ ID NO: 1185377 - RNA, 20 nt, Mycobacterium bovis subsp bovis AF2122/97
ccgcccaccacacagccgcg

SEQ ID NO: 1185378 - RNA, 17 nt, Mycobacterium bovis subsp bovis AF2122/97
ccgcccaccggucgccg

SEQ ID NO: 1185379 - RNA, 19 nt, Mycobacterium bovis subsp bovis AF2122/97
ccgcccagcagcaccugca

SEQ ID NO: 1185380 - RNA, 18 nt, Mycobacterium bovis subsp bovis AF2122/97
ccgcccagaccgccgacg

SEQ ID NO: 1185381 - RNA, 13 nt, Mycobacterium bovis subsp bovis AF2122/97
ccgcccagcagca

SEQ ID NO: 1185382 - RNA, 13 nt, Mycobacterium bovis subsp bovis AF2122/97
ccgccaucugccu

SEQ ID NO: 1185383 - RNA, 17 nt, Mycobacterium bovis subsp bovis AF2122/97
ccgccaucugccugccu

SEQ ID NO: 1185384 - RNA, 18 nt, Mycobacterium bovis subsp bovis AF2122/97
ccgccaugcggcgcgucg

SEQ ID NO: 1185385 - RNA, 18 nt, Mycobacterium bovis subsp bovis AF2122/97
ccgccauguacaggcccc

SEQ ID NO: 1185386 - RNA, 15 nt, Mycobacterium bovis subsp bovis AF2122/97
ccgccauuggcgccg

SEQ ID NO: 1185387 - RNA, 16 nt, Mycobacterium bovis subsp bovis AF2122/97
ccgccauugccguccg

SEQ ID NO: 1185388 - RNA, 19 nt, Mycobacterium bovis subsp bovis AF2122/97
ccgccauugccgccggcgc

SEQ ID NO: 1185389 - RNA, 21 nt, Mycobacterium bovis subsp bovis AF2122/97
ccgccauugccgccggugccg

SEQ ID NO: 1185390 - RNA, 22 nt, Mycobacterium bovis subsp bovis AF2122/97
ccgccauugccgccgucgccgc

SEQ ID NO: 1185391 - RNA, 20 nt, Mycobacterium bovis subsp bovis AF2122/97
ccgccauguacaggccccac

SEQ ID NO: 1185392 - RNA, 16 nt, Mycobacterium bovis subsp bovis AF2122/97
ccgccauugccgccgg

SEQ ID NO: 1185393 - RNA, 15 nt, Mycobacterium bovis subsp bovis AF2122/97
ccgcccgcgccgccc

SEQ ID NO: 1185394 - RNA, 15 nt, Mycobacterium bovis subsp bovis AF2122/97
ccgcccgcgccuccg

SEQ ID NO: 1185395 - RNA, 16 nt, Mycobacterium bovis subsp bovis AF2122/97
ccgcccgcgccuccgu

SEQ ID NO: 1185396 - RNA, 23 nt, Mycobacterium bovis subsp bovis AF2122/97
ccgcccgaguuguggacgcccga

SEQ ID NO: 1185397 - RNA, 17 nt, Mycobacterium bovis subsp bovis AF2122/97
ccgcccgcagggccgcc

SEQ ID NO: 1185398 - RNA, 19 nt, Mycobacterium bovis subsp bovis AF2122/97
ccgcccgcaucgcggcauc

SEQ ID NO: 1185399 - RNA, 13 nt, Mycobacterium bovis subsp bovis AF2122/97
ccgcccgccagcg

SEQ ID NO: 1185400 - RNA, 23 nt, Mycobacterium bovis subsp bovis AF2122/97
ccgccccguaaucgguggugugc

SEQ ID NO: 1185401 - RNA, 14 nt, Mycobacterium bovis subsp bovis AF2122/97
ccgcccgcccaccu

SEQ ID NO: 1185402 - RNA, 15 nt, Mycobacterium bovis subsp bovis AF2122/97
ccgcccgcgccacca

SEQ ID NO: 1185403 - RNA, 17 nt, Mycobacterium bovis subsp bovis AF2122/97
ccgcccgcgccgcccgc

SEQ ID NO: 1185404 - RNA, 17 nt, Mycobacterium bovis subsp bovis AF2122/97
ccgcccgcgccgccgcu

SEQ ID NO: 1185405 - RNA, 14 nt, Mycobacterium bovis subsp bovis AF2122/97
ccgcccccgugggg

SEQ ID NO: 1185406 - RNA, 22 nt, Mycobacterium bovis subsp bovis AF2122/97
ccgcccccguuuacggcccggc

SEQ ID NO: 1185407 - RNA, 18 nt, Mycobacterium bovis subsp bovis AF2122/97
ccgcccccgccggccgcg

SEQ ID NO: 1185408 - RNA, 18 nt, Mycobacterium bovis subsp bovis AF2122/97
ccgcccccgucggccuug

SEQ ID NO: 1185409 - RNA, 21 nt, Mycobacterium bovis subsp bovis AF2122/97
ccgccccacaacaugcuggag

SEQ ID NO: 1185410 - RNA, 13 nt, Mycobacterium bovis subsp bovis AF2122/97
ccgccccgcccgc

SEQ ID NO: 1185411 - RNA, 20 nt, Mycobacterium bovis subsp bovis AF2122/97
ccgccccguugugucaccgg

SEQ ID NO: 1185412 - RNA, 14 nt, Mycobacterium bovis subsp bovis AF2122/97
ccgccccgggccac

SEQ ID NO: 1185413 - RNA, 12 nt, Mycobacterium bovis subsp bovis AF2122/97
ccgcccaugccg

SEQ ID NO: 1185414 - RNA, 22 nt, Mycobacterium bovis subsp bovis AF2122/97
ccgcccaguugggccucagcua

SEQ ID NO: 1185415 - RNA, 13 nt, Mycobacterium bovis subsp bovis AF2122/97
ccgcccagugcca

SEQ ID NO: 1185416 - RNA, 22 nt, Mycobacterium bovis subsp bovis AF2122/97
ccgcccauucccagaggcccgc

SEQ ID NO: 1185417 - RNA, 14 nt, Mycobacterium bovis subsp bovis AF2122/97
ccgcccccagcggu

SEQ ID NO: 1185418 - RNA, 18 nt, Mycobacterium bovis subsp bovis AF2122/97
ccgcccguaucggcuucg

SEQ ID NO: 1185419 - RNA, 22 nt, Mycobacterium bovis subsp bovis AF2122/97
ccgcccucccuggggccguccg

SEQ ID NO: 1185420 - RNA, 15 nt, Mycobacterium bovis subsp bovis AF2122/97
ccgcccgcuccuccg

SEQ ID NO: 1185421 - RNA, 17 nt, Mycobacterium bovis subsp bovis AF2122/97
ccgcccgcugcggcggc

SEQ ID NO: 1185422 - RNA, 17 nt, Mycobacterium bovis subsp bovis AF2122/97
ccgcccgcugggcucgc

SEQ ID NO: 1185423 - RNA, 12 nt, Mycobacterium bovis subsp bovis AF2122/97
ccgcccggcccg

SEQ ID NO: 1185424 - RNA, 18 nt, Mycobacterium bovis subsp bovis AF2122/97
ccgcccgugaucaccacg

SEQ ID NO: 1185425 - RNA, 17 nt, Mycobacterium bovis subsp bovis AF2122/97
ccgccgacaaccccgcc

SEQ ID NO: 1185426 - RNA, 15 nt, Mycobacterium bovis subsp bovis AF2122/97
ccgccgacaccaccg

SEQ ID NO: 1185427 - RNA, 17 nt, Mycobacterium bovis subsp bovis AF2122/97
ccgccgacaccaccggc

SEQ ID NO: 1185428 - RNA, 14 nt, Mycobacterium bovis subsp bovis AF2122/97
ccgccgacaggccg

SEQ ID NO: 1185429 - RNA, 13 nt, Mycobacterium bovis subsp bovis AF2122/97
ccgccgacgccgc

SEQ ID NO: 1185430 - RNA, 19 nt, Mycobacterium bovis subsp bovis AF2122/97
ccgccgaagccgcgcaucu

SEQ ID NO: 1185431 - RNA, 16 nt, Mycobacterium bovis subsp bovis AF2122/97
ccgccgaacagcugga

SEQ ID NO: 1185432 - RNA, 14 nt, Mycobacterium bovis subsp bovis AF2122/97
ccgccgaaaaccuc

SEQ ID NO: 1185433 - RNA, 22 nt, Mycobacterium bovis subsp bovis AF2122/97
ccgccgaaaaccucgaaaccgu

SEQ ID NO: 1185434 - RNA, 17 nt, Mycobacterium bovis subsp bovis AF2122/97
ccgcccuugccgcccgc

SEQ ID NO: 1185435 - RNA, 16 nt, Mycobacterium bovis subsp bovis AF2122/97
ccgcccuugccgccgg

SEQ ID NO: 1185436 - RNA, 21 nt, Mycobacterium bovis subsp bovis AF2122/97
ccgcccuugccgccggccccg

SEQ ID NO: 1185437 - RNA, 17 nt, Mycobacterium bovis subsp bovis AF2122/97
ccgcccuggccgccggc

SEQ ID NO: 1185438 - RNA, 19 nt, Mycobacterium bovis subsp bovis AF2122/97
ccgcccuggccgccggccc

SEQ ID NO: 1185439 - RNA, 21 nt, Mycobacterium bovis subsp bovis AF2122/97
ccgcccuggccgccggccccg

SEQ ID NO: 1185440 - RNA, 18 nt, Mycobacterium bovis subsp bovis AF2122/97
ccgcccuugccgccagcc

SEQ ID NO: 1185441 - RNA, 21 nt, Mycobacterium bovis subsp bovis AF2122/97
ccgcccuugccgccagcccca

SEQ ID NO: 1185442 - RNA, 19 nt, Mycobacterium bovis subsp bovis AF2122/97
ccgccgaugcugccgccgc

SEQ ID NO: 1185443 - RNA, 21 nt, Mycobacterium bovis subsp bovis AF2122/97
ccgccgaugcugccgccgccg

SEQ ID NO: 1185444 - RNA, 19 nt, Mycobacterium bovis subsp bovis AF2122/97
ccgccgaucugcugcagcg

SEQ ID NO: 1185445 - RNA, 18 nt, Mycobacterium bovis subsp bovis AF2122/97
ccgccgaugccaccgcuu

SEQ ID NO: 1185446 - RNA, 16 nt, Mycobacterium bovis subsp bovis AF2122/97
ccgccgauaccgccgg

SEQ ID NO: 1185447 - RNA, 22 nt, Mycobacterium bovis subsp bovis AF2122/97
ccgccgauaccgccggccccac

SEQ ID NO: 1185448 - RNA, 18 nt, Mycobacterium bovis subsp bovis AF2122/97
ccgccgaucccgucgggc

SEQ ID NO: 1185449 - RNA, 22 nt, Mycobacterium bovis subsp bovis AF2122/97
ccgccgaucccgucgggcacac

SEQ ID NO: 1185450 - RNA, 15 nt, Mycobacterium bovis subsp bovis AF2122/97
aaaccccggccacca

SEQ ID NO: 1185451 - RNA, 18 nt, Mycobacterium bovis subsp bovis AF2122/97
aaacccgaugacuacucc

SEQ ID NO: 1185452 - RNA, 13 nt, Mycobacterium bovis subsp bovis AF2122/97
ccgccgagcuggc

SEQ ID NO: 1185453 - RNA, 19 nt, Mycobacterium bovis subsp bovis AF2122/97
ccgccgagcggaccaccgc

SEQ ID NO: 1185454 - RNA, 14 nt, Mycobacterium bovis subsp bovis AF2122/97
ccgccgacuccccg

SEQ ID NO: 1185455 - RNA, 20 nt, Mycobacterium bovis subsp bovis AF2122/97
ccgccgagggcuugcaccug

SEQ ID NO: 1185456 - RNA, 13 nt, Mycobacterium bovis subsp bovis AF2122/97
ccgccgacuugau

SEQ ID NO: 1185457 - RNA, 20 nt, Mycobacterium bovis subsp bovis AF2122/97
aaacccagcgacgcggccag

SEQ ID NO: 1185458 - RNA, 14 nt, Mycobacterium bovis subsp bovis AF2122/97
aaacccaacaccag

SEQ ID NO: 1185459 - RNA, 14 nt, Mycobacterium bovis subsp bovis AF2122/97
ccgccacgggcggc

SEQ ID NO: 1185460 - RNA, 21 nt, Mycobacterium bovis subsp bovis AF2122/97
ccgccacgggcggccaccgca

SEQ ID NO: 1185461 - RNA, 13 nt, Mycobacterium bovis subsp bovis AF2122/97
ccgccacgggcgg

SEQ ID NO: 1185462 - RNA, 15 nt, Mycobacterium bovis subsp bovis AF2122/97
ccgccacgucgccgg

SEQ ID NO: 1185463 - RNA, 15 nt, Mycobacterium bovis subsp bovis AF2122/97
ccgccacucgcccgc

SEQ ID NO: 1185464 - RNA, 18 nt, Mycobacterium bovis subsp bovis AF2122/97
ccgccaccucccagggcu

SEQ ID NO: 1185465 - RNA, 22 nt, Mycobacterium bovis subsp bovis AF2122/97
ccgccaccuuggcugggcccgc

SEQ ID NO: 1185466 - RNA, 18 nt, Mycobacterium bovis subsp bovis AF2122/97
ccgccagaccgcggcggc

SEQ ID NO: 1185467 - RNA, 18 nt, Mycobacterium bovis subsp bovis AF2122/97
ccgccagaucucgcgcgc

SEQ ID NO: 1185468 - RNA, 15 nt, Mycobacterium bovis subsp bovis AF2122/97
ccgccagcaccaccg

SEQ ID NO: 1185469 - RNA, 13 nt, Mycobacterium bovis subsp bovis AF2122/97
ccgccagcccagc

SEQ ID NO: 1185470 - RNA, 15 nt, Mycobacterium bovis subsp bovis AF2122/97
ccgccagccccagcg

SEQ ID NO: 1185471 - RNA, 16 nt, Mycobacterium bovis subsp bovis AF2122/97
ccgccagccccagcgu

SEQ ID NO: 1185472 - RNA, 14 nt, Mycobacterium bovis subsp bovis AF2122/97
ccgccagcagcuuc

SEQ ID NO: 1185473 - RNA, 15 nt, Mycobacterium bovis subsp bovis AF2122/97
ccgccagcagggcca

SEQ ID NO: 1185474 - RNA, 16 nt, Mycobacterium bovis subsp bovis AF2122/97
ccgccagcaugacacc

SEQ ID NO: 1185475 - RNA, 20 nt, Mycobacterium bovis subsp bovis AF2122/97
ccgccagcaugacaccggcc

SEQ ID NO: 1185476 - RNA, 16 nt, Mycobacterium bovis subsp bovis AF2122/97
ccgccaccgcggccug

SEQ ID NO: 1185477 - RNA, 16 nt, Mycobacterium bovis subsp bovis AF2122/97
ccgccaccggaggugc

SEQ ID NO: 1185478 - RNA, 18 nt, Mycobacterium bovis subsp bovis AF2122/97
ccgccaccgucauggcgg

SEQ ID NO: 1185479 - RNA, 14 nt, Mycobacterium bovis subsp bovis AF2122/97
ccgccaccccgcgc

SEQ ID NO: 1185480 - RNA, 19 nt, Mycobacterium bovis subsp bovis AF2122/97
ccgccaccccggucggagc

SEQ ID NO: 1185481 - RNA, 12 nt, Mycobacterium bovis subsp bovis AF2122/97
ccgccacccgca

SEQ ID NO: 1185482 - RNA, 12 nt, Mycobacterium bovis subsp bovis AF2122/97
ccgccacccgcc

SEQ ID NO: 1185483 - RNA, 13 nt, Mycobacterium bovis subsp bovis AF2122/97
ccgccacccggcg

SEQ ID NO: 1185484 - RNA, 20 nt, Mycobacterium bovis subsp bovis AF2122/97
ccgccacccuuggcccggug

SEQ ID NO: 1185485 - RNA, 19 nt, Mycobacterium bovis subsp bovis AF2122/97
ccgccaccgaagccgccgg

SEQ ID NO: 1185486 - RNA, 14 nt, Mycobacterium bovis subsp bovis AF2122/97
ccgccaccgcacgc

SEQ ID NO: 1185487 - RNA, 14 nt, Mycobacterium bovis subsp bovis AF2122/97
ccgccaccgccacc

SEQ ID NO: 1185488 - RNA, 16 nt, Mycobacterium bovis subsp bovis AF2122/97
ccgccaccgccaccgc

SEQ ID NO: 1185489 - RNA, 18 nt, Mycobacterium bovis subsp bovis AF2122/97
ccgccaccaccagggcaa

SEQ ID NO: 1185490 - RNA, 15 nt, Mycobacterium bovis subsp bovis AF2122/97
ccgccacacggggcc

SEQ ID NO: 1185491 - RNA, 14 nt, Mycobacterium bovis subsp bovis AF2122/97
ccgccaccaccggc

SEQ ID NO: 1185492 - RNA, 17 nt, Mycobacterium bovis subsp bovis AF2122/97
ccgccaccacgccgucg

SEQ ID NO: 1185493 - RNA, 12 nt, Mycobacterium bovis subsp bovis AF2122/97
ccgccaccccgc

SEQ ID NO: 1185494 - RNA, 20 nt, Mycobacterium bovis subsp bovis AF2122/97
ccgccaacuccagcacccgc

SEQ ID NO: 1185495 - RNA, 18 nt, Mycobacterium bovis subsp bovis AF2122/97
ccgccaacuccucagccg

SEQ ID NO: 1185496 - RNA, 22 nt, Mycobacterium bovis subsp bovis AF2122/97
ccgccaaguacugggccaaagc

SEQ ID NO: 1185497 - RNA, 14 nt, Mycobacterium bovis subsp bovis AF2122/97
ccgccaaggaggcc

SEQ ID NO: 1185498 - RNA, 15 nt, Mycobacterium bovis subsp bovis AF2122/97
ccgccaauccaccgg

SEQ ID NO: 1185499 - RNA, 23 nt, Mycobacterium bovis subsp bovis AF2122/97
ccgccaauuacagcuugcgcagc

SEQ ID NO: 1185500 - RNA, 18 nt, Mycobacterium bovis subsp bovis AF2122/97
ccgccacaacggcggcgc

SEQ ID NO: 1185501 - RNA, 15 nt, Mycobacterium bovis subsp bovis AF2122/97
ccgccacaccgccgc

SEQ ID NO: 1185502 - RNA, 13 nt, Mycobacterium bovis subsp bovis AF2122/97
ccgcauugccaac

SEQ ID NO: 1185503 - RNA, 17 nt, Mycobacterium bovis subsp bovis AF2122/97
aaaccagauugccgagc

SEQ ID NO: 1185504 - RNA, 15 nt, Mycobacterium bovis subsp bovis AF2122/97
ccgccagcgccaccg

SEQ ID NO: 1185505 - RNA, 23 nt, Mycobacterium bovis subsp bovis AF2122/97
ccgccagcgcacgauagccaccg

SEQ ID NO: 1185506 - RNA, 17 nt, Mycobacterium bovis subsp bovis AF2122/97
aaaccagguggccaggc

SEQ ID NO: 1185507 - RNA, 14 nt, Mycobacterium bovis subsp bovis AF2122/97
ccgccagcggcagc

SEQ ID NO: 1185508 - RNA, 21 nt, Mycobacterium bovis subsp bovis AF2122/97
ccgccagcgcggugucggggc

SEQ ID NO: 1185509 - RNA, 15 nt, Mycobacterium bovis subsp bovis AF2122/97
ccgccagcgccgguc

SEQ ID NO: 1185510 - RNA, 22 nt, Mycobacterium bovis subsp bovis AF2122/97
ccgccagcgccggucagggacg

SEQ ID NO: 1185511 - RNA, 17 nt, Mycobacterium bovis subsp bovis AF2122/97
ccgccagcgccgccgag

SEQ ID NO: 1185512 - RNA, 16 nt, Mycobacterium bovis subsp bovis AF2122/97
ccgccagcgccgccgc

SEQ ID NO: 1185513 - RNA, 17 nt, Mycobacterium bovis subsp bovis AF2122/97
ccgccagcgccgccgcg

SEQ ID NO: 1185514 - RNA, 18 nt, Mycobacterium bovis subsp bovis AF2122/97
ccgccagcgccgccggag

SEQ ID NO: 1185515 - RNA, 19 nt, Mycobacterium bovis subsp bovis AF2122/97
ccgccagcgccgccggcgc

SEQ ID NO: 1185516 - RNA, 21 nt, Mycobacterium bovis subsp bovis AF2122/97
ccgccagguccgccggugccg

SEQ ID NO: 1185517 - RNA, 21 nt, Mycobacterium bovis subsp bovis AF2122/97
ccgccaggucgaggcaggccu

SEQ ID NO: 1185518 - RNA, 15 nt, Mycobacterium bovis subsp bovis AF2122/97
ccgccagucccccgc

SEQ ID NO: 1185519 - RNA, 18 nt, Mycobacterium bovis subsp bovis AF2122/97
ccgccagguguucgccgg

SEQ ID NO: 1185520 - RNA, 16 nt, Mycobacterium bovis subsp bovis AF2122/97
ccgccaucgccgccgg

SEQ ID NO: 1185521 - RNA, 13 nt, Mycobacterium bovis subsp bovis AF2122/97
ccgccaucgccgc

SEQ ID NO: 1185522 - RNA, 11 nt, Mycobacterium bovis subsp bovis AF2122/97
ccgccaucccc

SEQ ID NO: 1185523 - RNA, 21 nt, Mycobacterium bovis subsp bovis AF2122/97
ccgccauccgauggcccggcu

SEQ ID NO: 1185524 - RNA, 14 nt, Mycobacterium bovis subsp bovis AF2122/97
ccgccaucagcccg

SEQ ID NO: 1185525 - RNA, 16 nt, Mycobacterium bovis subsp bovis AF2122/97
ccgccaucaccgccgu

SEQ ID NO: 1185526 - RNA, 18 nt, Mycobacterium bovis subsp bovis AF2122/97
ccgcaccaccggccccac

SEQ ID NO: 1185527 - RNA, 19 nt, Mycobacterium bovis subsp bovis AF2122/97
ccgcaccaccggccccacc

SEQ ID NO: 1185528 - RNA, 14 nt, Mycobacterium bovis subsp bovis AF2122/97
ccgcaccaccggcc

SEQ ID NO: 1185529 - RNA, 16 nt, Mycobacterium bovis subsp bovis AF2122/97
ccgcaccaccggcccc

SEQ ID NO: 1185530 - RNA, 15 nt, Mycobacterium bovis subsp bovis AF2122/97
ccgcaccaagcagcg

SEQ ID NO: 1185531 - RNA, 20 nt, Mycobacterium bovis subsp bovis AF2122/97
ccgcaccaagcagcgaccag

SEQ ID NO: 1185532 - RNA, 12 nt, Mycobacterium bovis subsp bovis AF2122/97
ccgcacagcgac

SEQ ID NO: 1185533 - RNA, 18 nt, Mycobacterium bovis subsp bovis AF2122/97
ccgcaccagcugucgggc

SEQ ID NO: 1185534 - RNA, 21 nt, Mycobacterium bovis subsp bovis AF2122/97
ccgcaccagcugucgggcagc

SEQ ID NO: 1185535 - RNA, 13 nt, Mycobacterium bovis subsp bovis AF2122/97
ccgcaccccgccc

SEQ ID NO: 1185536 - RNA, 15 nt, Mycobacterium bovis subsp bovis AF2122/97
ccgcaccccggccgc

SEQ ID NO: 1185537 - RNA, 19 nt, Mycobacterium bovis subsp bovis AF2122/97
ccgcaccagucgcgcagcg

SEQ ID NO: 1185538 - RNA, 15 nt, Mycobacterium bovis subsp bovis AF2122/97
ccgcaccaguggcgc

SEQ ID NO: 1185539 - RNA, 21 nt, Mycobacterium bovis subsp bovis AF2122/97
ccgcacccccgucgaucagcg

SEQ ID NO: 1185540 - RNA, 15 nt, Mycobacterium bovis subsp bovis AF2122/97
ccgcacugccgccgg

SEQ ID NO: 1185541 - RNA, 17 nt, Mycobacterium bovis subsp bovis AF2122/97
ccgcaccccggccgcgc

SEQ ID NO: 1185542 - RNA, 20 nt, Mycobacterium bovis subsp bovis AF2122/97
ccgcacuccacgaucggccc

SEQ ID NO: 1185543 - RNA, 17 nt, Mycobacterium bovis subsp bovis AF2122/97
ccgcaauggcggccuug

SEQ ID NO: 1185544 - RNA, 17 nt, Mycobacterium bovis subsp bovis AF2122/97
ccgcacaagcccagccc

SEQ ID NO: 1185545 - RNA, 18 nt, Mycobacterium bovis subsp bovis AF2122/97
ccgcaaucaugucagcgc

SEQ ID NO: 1185546 - RNA, 20 nt, Mycobacterium bovis subsp bovis AF2122/97
ccgcaaugacgucgucggcc

SEQ ID NO: 1185547 - RNA, 20 nt, Mycobacterium bovis subsp bovis AF2122/97
ccgcaaaaucgucagcgccg

SEQ ID NO: 1185548 - RNA, 18 nt, Mycobacterium bovis subsp bovis AF2122/97
ccgcaaaaucgucagcgc

SEQ ID NO: 1185549 - RNA, 15 nt, Mycobacterium bovis subsp bovis AF2122/97
ccgagcucgccgcag

SEQ ID NO: 1185550 - RNA, 20 nt, Mycobacterium bovis subsp bovis AF2122/97
ccgagcugccaacgcccgug

SEQ ID NO: 1185551 - RNA, 14 nt, Mycobacterium bovis subsp bovis AF2122/97
ccgagcugccgucg

SEQ ID NO: 1185552 - RNA, 20 nt, Mycobacterium bovis subsp bovis AF2122/97
ccgagcuggcaacgccgcgc

SEQ ID NO: 1185553 - RNA, 15 nt, Mycobacterium bovis subsp bovis AF2122/97
ccgagcugagcggcc

SEQ ID NO: 1185554 - RNA, 16 nt, Mycobacterium bovis subsp bovis AF2122/97
ccgagcucggcgccca

SEQ ID NO: 1185555 - RNA, 22 nt, Mycobacterium bovis subsp bovis AF2122/97
ccgagcucguugcuggcggcca

SEQ ID NO: 1185556 - RNA, 23 nt, Mycobacterium bovis subsp bovis AF2122/97
ccgagcucuuggagcuuggccca

SEQ ID NO: 1185557 - RNA, 16 nt, Mycobacterium bovis subsp bovis AF2122/97
ccgagcugguuggcgc

SEQ ID NO: 1185558 - RNA, 16 nt, Mycobacterium bovis subsp bovis AF2122/97
ccgagcuggccgucag

SEQ ID NO: 1185559 - RNA, 15 nt, Mycobacterium bovis subsp bovis AF2122/97
ccgagcuggcgcgcg

SEQ ID NO: 1185560 - RNA, 17 nt, Mycobacterium bovis subsp bovis AF2122/97
ccgagcggucgaucuga

SEQ ID NO: 1185561 - RNA, 14 nt, Mycobacterium bovis subsp bovis AF2122/97
ccgagcggugguga

SEQ ID NO: 1185562 - RNA, 19 nt, Mycobacterium bovis subsp bovis AF2122/97
ccgagcguaaugcugcugc

SEQ ID NO: 1185563 - RNA, 23 nt, Mycobacterium bovis subsp bovis AF2122/97
ccgagcggucaacgaguugcgga

SEQ ID NO: 1185564 - RNA, 24 nt, Mycobacterium bovis subsp bovis AF2122/97
ccgagcucaggucgacaggugcca

SEQ ID NO: 1185565 - RNA, 22 nt, Mycobacterium bovis subsp bovis AF2122/97
ccgagcuccgcggcgagcuccg

SEQ ID NO: 1185566 - RNA, 15 nt, Mycobacterium bovis subsp bovis AF2122/97
ccgagcuccuccacc

SEQ ID NO: 1185567 - RNA, 18 nt, Mycobacterium bovis subsp bovis AF2122/97
ccgagcuccuccaccaac

SEQ ID NO: 1185568 - RNA, 13 nt, Mycobacterium bovis subsp bovis AF2122/97
ccgagcgugaagu

SEQ ID NO: 1185569 - RNA, 17 nt, Mycobacterium bovis subsp bovis AF2122/97
ccgauuuggccgucauc

SEQ ID NO: 1185570 - RNA, 12 nt, Mycobacterium bovis subsp bovis AF2122/97
ccgauuggccaa

SEQ ID NO: 1185571 - RNA, 16 nt, Mycobacterium bovis subsp bovis AF2122/97
ccgauuggccaacccc

SEQ ID NO: 1185572 - RNA, 16 nt, Mycobacterium bovis subsp bovis AF2122/97
ccgauguuggcagggc

SEQ ID NO: 1185573 - RNA, 14 nt, Mycobacterium bovis subsp bovis AF2122/97
ccgauuccagcgga

SEQ ID NO: 1185574 - RNA, 15 nt, Mycobacterium bovis subsp bovis AF2122/97
ccgauucggccagcg

SEQ ID NO: 1185575 - RNA, 20 nt, Mycobacterium bovis subsp bovis AF2122/97
ccgauucggccagcgcccgc

SEQ ID NO: 1185576 - RNA, 14 nt, Mycobacterium bovis subsp bovis AF2122/97
ccgcaugcccugga

SEQ ID NO: 1185577 - RNA, 19 nt, Mycobacterium bovis subsp bovis AF2122/97
ccgcaucgguggggcgccg

SEQ ID NO: 1185578 - RNA, 14 nt, Mycobacterium bovis subsp bovis AF2122/97
ccgcaucgccucac

SEQ ID NO: 1185579 - RNA, 19 nt, Mycobacterium bovis subsp bovis AF2122/97
ccgcaucggaaucgcgagc

SEQ ID NO: 1185580 - RNA, 15 nt, Mycobacterium bovis subsp bovis AF2122/97
ccgcauggcagcggc

SEQ ID NO: 1185581 - RNA, 21 nt, Mycobacterium bovis subsp bovis AF2122/97
ccgcauggcgcggguccagcc

SEQ ID NO: 1185582 - RNA, 19 nt, Mycobacterium bovis subsp bovis AF2122/97
ccgcaugccacggcaagcc

SEQ ID NO: 1185583 - RNA, 17 nt, Mycobacterium bovis subsp bovis AF2122/97
ccgcaugcgcuccggcg

SEQ ID NO: 1185584 - RNA, 15 nt, Mycobacterium bovis subsp bovis AF2122/97
ccgcauucggacgcc

SEQ ID NO: 1185585 - RNA, 19 nt, Mycobacterium bovis subsp bovis AF2122/97
ccgcauugagcuggcgccc

SEQ ID NO: 1185586 - RNA, 20 nt, Mycobacterium bovis subsp bovis AF2122/97
ccgcauucguggagccggcc

SEQ ID NO: 1185587 - RNA, 15 nt, Mycobacterium bovis subsp bovis AF2122/97
ccgcaugggcuuaau

SEQ ID NO: 1185588 - RNA, 20 nt, Mycobacterium bovis subsp bovis AF2122/97
ccgcaucauagacagggccg

SEQ ID NO: 1185589 - RNA, 12 nt, Mycobacterium bovis subsp bovis AF2122/97
ccgcauccacgu

SEQ ID NO: 1185590 - RNA, 20 nt, Mycobacterium bovis subsp bovis AF2122/97
ccgcauccacgucgcccagg

SEQ ID NO: 1185591 - RNA, 13 nt, Mycobacterium bovis subsp bovis AF2122/97
ccgcaucacccgg

SEQ ID NO: 1185592 - RNA, 19 nt, Mycobacterium bovis subsp bovis AF2122/97
ccgcauaggccccgccagc

SEQ ID NO: 1185593 - RNA, 23 nt, Mycobacterium bovis subsp bovis AF2122/97
ccgcauaaggcccaugccgucgg

SEQ ID NO: 1185594 - RNA, 21 nt, Mycobacterium bovis subsp bovis AF2122/97
ccgcauaggccccgccagcgc

SEQ ID NO: 1185595 - RNA, 21 nt, Mycobacterium bovis subsp bovis AF2122/97
ccgcauaccaguaccgucauc

SEQ ID NO: 1185596 - RNA, 22 nt, Mycobacterium bovis subsp bovis AF2122/97
ccgcagaugcaguuccuugaga

SEQ ID NO: 1185597 - RNA, 15 nt, Mycobacterium bovis subsp bovis AF2122/97
ccgcagaucaccgcc

SEQ ID NO: 1185598 - RNA, 14 nt, Mycobacterium bovis subsp bovis AF2122/97
ccgcagagaccaag

SEQ ID NO: 1185599 - RNA, 14 nt, Mycobacterium bovis subsp bovis AF2122/97
ccgcacuuggcugc

SEQ ID NO: 1185600 - RNA, 17 nt, Mycobacterium bovis subsp bovis AF2122/97
ccgcagacgccgucuga

SEQ ID NO: 1185601 - RNA, 21 nt, Mycobacterium bovis subsp bovis AF2122/97
ccgcagagcaccgcgaacagc

SEQ ID NO: 1185602 - RNA, 23 nt, Mycobacterium bovis subsp bovis AF2122/97
ccgcagagcaccgcgaacagcac

SEQ ID NO: 1185603 - RNA, 15 nt, Mycobacterium bovis subsp bovis AF2122/97
ccgcacuuucuuccu

SEQ ID NO: 1185604 - RNA, 21 nt, Mycobacterium bovis subsp bovis AF2122/97
ccgcagaaugucguaggcgcc

SEQ ID NO: 1185605 - RNA, 19 nt, Mycobacterium bovis subsp bovis AF2122/97
ccgcaggucgaucugcgcc

SEQ ID NO: 1185606 - RNA, 15 nt, Mycobacterium bovis subsp bovis AF2122/97
ccgcaguucuugauu

SEQ ID NO: 1185607 - RNA, 23 nt, Mycobacterium bovis subsp bovis AF2122/97
ccgcaguggcaagcugucgucgc

SEQ ID NO: 1185608 - RNA, 13 nt, Mycobacterium bovis subsp bovis AF2122/97
ccgcagucccagc

SEQ ID NO: 1185609 - RNA, 23 nt, Mycobacterium bovis subsp bovis AF2122/97
ccgcaguccggggcgcaggucgu

SEQ ID NO: 1185610 - RNA, 13 nt, Mycobacterium bovis subsp bovis AF2122/97
ccgcaggcccgcc

SEQ ID NO: 1185611 - RNA, 18 nt, Mycobacterium bovis subsp bovis AF2122/97
ccgcagggucccgucauc

SEQ ID NO: 1185612 - RNA, 13 nt, Mycobacterium bovis subsp bovis AF2122/97
ccgcagggccgcc

SEQ ID NO: 1185613 - RNA, 15 nt, Mycobacterium bovis subsp bovis AF2122/97
ccgcagggccgccgc

SEQ ID NO: 1185614 - RNA, 17 nt, Mycobacterium bovis subsp bovis AF2122/97
ccgcaggcucaccgagc

SEQ ID NO: 1185615 - RNA, 21 nt, Mycobacterium bovis subsp bovis AF2122/97
ccgcaggcgaacaccagaugg

SEQ ID NO: 1185616 - RNA, 16 nt, Mycobacterium bovis subsp bovis AF2122/97
ccgguaugcgccaucu

SEQ ID NO: 1185617 - RNA, 16 nt, Mycobacterium bovis subsp bovis AF2122/97
ccgguauuaccgccgu

SEQ ID NO: 1185618 - RNA, 16 nt, Mycobacterium bovis subsp bovis AF2122/97
ccgguauacccggccc

SEQ ID NO: 1185619 - RNA, 16 nt, Mycobacterium bovis subsp bovis AF2122/97
ccgguaguagcugacc

SEQ ID NO: 1185620 - RNA, 22 nt, Mycobacterium bovis subsp bovis AF2122/97
ccgguacgcaaccaaccgucgg

SEQ ID NO: 1185621 - RNA, 16 nt, Mycobacterium bovis subsp bovis AF2122/97
ccgguacacguccagu

SEQ ID NO: 1185622 - RNA, 14 nt, Mycobacterium bovis subsp bovis AF2122/97
ccgguagcacagca

SEQ ID NO: 1185623 - RNA, 18 nt, Mycobacterium bovis subsp bovis AF2122/97
ccggucauggucagcaga

SEQ ID NO: 1185624 - RNA, 17 nt, Mycobacterium bovis subsp bovis AF2122/97
ccggucgaugucggcga

SEQ ID NO: 1185625 - RNA, 17 nt, Mycobacterium bovis subsp bovis AF2122/97
ccggucgccucaccggc

SEQ ID NO: 1185626 - RNA, 13 nt, Mycobacterium bovis subsp bovis AF2122/97
ccggucgccgcgu

SEQ ID NO: 1185627 - RNA, 15 nt, Mycobacterium bovis subsp bovis AF2122/97
ccggucgccgcgucu

SEQ ID NO: 1185628 - RNA, 16 nt, Mycobacterium bovis subsp bovis AF2122/97
ccggucgccggcuggg

SEQ ID NO: 1185629 - RNA, 17 nt, Mycobacterium bovis subsp bovis AF2122/97
ccggucaucccaagcgu

SEQ ID NO: 1185630 - RNA, 15 nt, Mycobacterium bovis subsp bovis AF2122/97
ccggucaggccgccg

SEQ ID NO: 1185631 - RNA, 17 nt, Mycobacterium bovis subsp bovis AF2122/97
ccggucagcgcggcgca

SEQ ID NO: 1185632 - RNA, 16 nt, Mycobacterium bovis subsp bovis AF2122/97
ccggucaccgcgcagc

SEQ ID NO: 1185633 - RNA, 19 nt, Mycobacterium bovis subsp bovis AF2122/97
ccggucaccucgccggcgg

SEQ ID NO: 1185634 - RNA, 22 nt, Mycobacterium bovis subsp bovis AF2122/97
ccggugagcgcagcuugauccc

SEQ ID NO: 1185635 - RNA, 15 nt, Mycobacterium bovis subsp bovis AF2122/97
ccggucggugagccg

SEQ ID NO: 1185636 - RNA, 15 nt, Mycobacterium bovis subsp bovis AF2122/97
ccggucggccaggcc

SEQ ID NO: 1185637 - RNA, 19 nt, Mycobacterium bovis subsp bovis AF2122/97
ccggucggccauccaccgc

SEQ ID NO: 1185638 - RNA, 13 nt, Mycobacterium bovis subsp bovis AF2122/97
ccggucggcggca

SEQ ID NO: 1185639 - RNA, 21 nt, Mycobacterium bovis subsp bovis AF2122/97
ccggucggcgggcaccuccgc

SEQ ID NO: 1185640 - RNA, 22 nt, Mycobacterium bovis subsp bovis AF2122/97
ccggugccacccuugccgccgg

SEQ ID NO: 1185641 - RNA, 17 nt, Mycobacterium bovis subsp bovis AF2122/97
ccggugccacccuugcc

SEQ ID NO: 1185642 - RNA, 14 nt, Mycobacterium bovis subsp bovis AF2122/97
ccggugauggccga

SEQ ID NO: 1185643 - RNA, 14 nt, Mycobacterium bovis subsp bovis AF2122/97
ccgguggcccgccg

SEQ ID NO: 1185644 - RNA, 21 nt, Mycobacterium bovis subsp bovis AF2122/97
ccgguggcgccggggccgccg

SEQ ID NO: 1185645 - RNA, 19 nt, Mycobacterium bovis subsp bovis AF2122/97
ccgguggcagccugcugca

SEQ ID NO: 1185646 - RNA, 16 nt, Mycobacterium bovis subsp bovis AF2122/97
ccgguggcagggaacc

SEQ ID NO: 1185647 - RNA, 22 nt, Mycobacterium bovis subsp bovis AF2122/97
ccgguggcagggaaccauugcc

SEQ ID NO: 1185648 - RNA, 15 nt, Mycobacterium bovis subsp bovis AF2122/97
ccgguggccaacacc

SEQ ID NO: 1185649 - RNA, 21 nt, Mycobacterium bovis subsp bovis AF2122/97
ccgguggccaacaccgccagc

SEQ ID NO: 1185650 - RNA, 18 nt, Mycobacterium bovis subsp bovis AF2122/97
ccggugcgguggugcgca

SEQ ID NO: 1185651 - RNA, 17 nt, Mycobacterium bovis subsp bovis AF2122/97
ccgguggacgugcacga

SEQ ID NO: 1185652 - RNA, 20 nt, Mycobacterium bovis subsp bovis AF2122/97
ccgguggcacggccccugcc

SEQ ID NO: 1185653 - RNA, 18 nt, Mycobacterium bovis subsp bovis AF2122/97
ccgguggcagagccgccg

SEQ ID NO: 1185654 - RNA, 15 nt, Mycobacterium bovis subsp bovis AF2122/97
ccggugccgcccgcg

SEQ ID NO: 1185655 - RNA, 21 nt, Mycobacterium bovis subsp bovis AF2122/97
ccggugccgcccgcgccgccg

SEQ ID NO: 1185656 - RNA, 19 nt, Mycobacterium bovis subsp bovis AF2122/97
ccggugcccgcaccacacc

SEQ ID NO: 1185657 - RNA, 18 nt, Mycobacterium bovis subsp bovis AF2122/97
ccggugccgacggcgccg

SEQ ID NO: 1185658 - RNA, 17 nt, Mycobacterium bovis subsp bovis AF2122/97
ccgguggaauccaccag

SEQ ID NO: 1185659 - RNA, 23 nt, Mycobacterium bovis subsp bovis AF2122/97
ccgguggacagaugcauccagcu

SEQ ID NO: 1185660 - RNA, 22 nt, Mycobacterium bovis subsp bovis AF2122/97
ccggugcugcgggaauccggug

SEQ ID NO: 1185661 - RNA, 18 nt, Mycobacterium bovis subsp bovis AF2122/97
ccggugcgucacagccgg

SEQ ID NO: 1185662 - RNA, 20 nt, Mycobacterium bovis subsp bovis AF2122/97
ccgggucgacgacgucgcgc

SEQ ID NO: 1185663 - RNA, 22 nt, Mycobacterium bovis subsp bovis AF2122/97
ccgggucccauuugccuugagc

SEQ ID NO: 1185664 - RNA, 22 nt, Mycobacterium bovis subsp bovis AF2122/97
ccgggucgaacaggccggccgc

SEQ ID NO: 1185665 - RNA, 22 nt, Mycobacterium bovis subsp bovis AF2122/97
ccgggucgaugucggggccguc

SEQ ID NO: 1185666 - RNA, 19 nt, Mycobacterium bovis subsp bovis AF2122/97
ccgggucgcaaccgccgcc

SEQ ID NO: 1185667 - RNA, 19 nt, Mycobacterium bovis subsp bovis AF2122/97
ccgggucagcccggcgcga

SEQ ID NO: 1185668 - RNA, 20 nt, Mycobacterium bovis subsp bovis AF2122/97
ccgggucagcccggcgcgau

SEQ ID NO: 1185669 - RNA, 17 nt, Mycobacterium bovis subsp bovis AF2122/97
ccgggucaacgccauca

SEQ ID NO: 1185670 - RNA, 19 nt, Mycobacterium bovis subsp bovis AF2122/97
ccgggucaacgccaucacc

SEQ ID NO: 1185671 - RNA, 17 nt, Mycobacterium bovis subsp bovis AF2122/97
ccgggucacgugggcca

SEQ ID NO: 1185672 - RNA, 19 nt, Mycobacterium bovis subsp bovis AF2122/97
ccgggucacgugggccaug

SEQ ID NO: 1185673 - RNA, 13 nt, Mycobacterium bovis subsp bovis AF2122/97
ccggguccgccgg

SEQ ID NO: 1185674 - RNA, 13 nt, Mycobacterium bovis subsp bovis AF2122/97
ccggguccaccgc

SEQ ID NO: 1185675 - RNA, 14 nt, Mycobacterium bovis subsp bovis AF2122/97
ccgggcguuucccu

SEQ ID NO: 1185676 - RNA, 20 nt, Mycobacterium bovis subsp bovis AF2122/97
ccgggcucggcgaaggccgc

SEQ ID NO: 1185677 - RNA, 19 nt, Mycobacterium bovis subsp bovis AF2122/97
ccgggcucggcgucgccgc

SEQ ID NO: 1185678 - RNA, 20 nt, Mycobacterium bovis subsp bovis AF2122/97
ccgggcucggcgucgccgcc

SEQ ID NO: 1185679 - RNA, 22 nt, Mycobacterium bovis subsp bovis AF2122/97
ccgggcucggcgucgccgccau

SEQ ID NO: 1185680 - RNA, 19 nt, Mycobacterium bovis subsp bovis AF2122/97
ccgggcugccaaggccuuc

SEQ ID NO: 1185681 - RNA, 19 nt, Mycobacterium bovis subsp bovis AF2122/97
ccgggcucggugacccccg

SEQ ID NO: 1185682 - RNA, 17 nt, Mycobacterium bovis subsp bovis AF2122/97
ccgggcucuggccaguc

SEQ ID NO: 1185683 - RNA, 22 nt, Mycobacterium bovis subsp bovis AF2122/97
ccgggcgaccaccaccgccgcc

SEQ ID NO: 1185684 - RNA, 14 nt, Mycobacterium bovis subsp bovis AF2122/97
ccgggcgugggugu

SEQ ID NO: 1185685 - RNA, 17 nt, Mycobacterium bovis subsp bovis AF2122/97
ccgggcgaugcugggcg

SEQ ID NO: 1185686 - RNA, 15 nt, Mycobacterium bovis subsp bovis AF2122/97
ccgggcgcaagcagc

SEQ ID NO: 1185687 - RNA, 21 nt, Mycobacterium bovis subsp bovis AF2122/97
ccgggugcgccguugccgccg

SEQ ID NO: 1185688 - RNA, 15 nt, Mycobacterium bovis subsp bovis AF2122/97
ccggguggaacaugu

SEQ ID NO: 1185689 - RNA, 22 nt, Mycobacterium bovis subsp bovis AF2122/97
ccggguguagcucggacccuca

SEQ ID NO: 1185690 - RNA, 13 nt, Mycobacterium bovis subsp bovis AF2122/97
ccggguucgccgg

SEQ ID NO: 1185691 - RNA, 23 nt, Mycobacterium bovis subsp bovis AF2122/97
ccggguccgccguugccgauccc

SEQ ID NO: 1185692 - RNA, 22 nt, Mycobacterium bovis subsp bovis AF2122/97
ccgggugcaacggcguuggcgc

SEQ ID NO: 1185693 - RNA, 20 nt, Mycobacterium bovis subsp bovis AF2122/97
ccgggugaaguuggcguggu

SEQ ID NO: 1185694 - RNA, 21 nt, Mycobacterium bovis subsp bovis AF2122/97
ccgguaccgccggcuccgccg

SEQ ID NO: 1185695 - RNA, 18 nt, Mycobacterium bovis subsp bovis AF2122/97
ccgguacaacccccaggc

SEQ ID NO: 1185696 - RNA, 17 nt, Mycobacterium bovis subsp bovis AF2122/97
ccgguaacgccaucguc

SEQ ID NO: 1185697 - RNA, 16 nt, Mycobacterium bovis subsp bovis AF2122/97
ccggguugagccgccg

SEQ ID NO: 1185698 - RNA, 16 nt, Mycobacterium bovis subsp bovis AF2122/97
ccggguuggccggcgc

SEQ ID NO: 1185699 - RNA, 17 nt, Mycobacterium bovis subsp bovis AF2122/97
ccggguuggccggcgcu

SEQ ID NO: 1185700 - RNA, 13 nt, Mycobacterium bovis subsp bovis AF2122/97
ccggguuggcgcc

SEQ ID NO: 1185701 - RNA, 20 nt, Mycobacterium bovis subsp bovis AF2122/97
ccggguugguacccaccagg

SEQ ID NO: 1185702 - RNA, 22 nt, Mycobacterium bovis subsp bovis AF2122/97
ccgggccagaucgaagcgcagc

SEQ ID NO: 1185703 - RNA, 15 nt, Mycobacterium bovis subsp bovis AF2122/97
ccgggccaaugccgu

SEQ ID NO: 1185704 - RNA, 17 nt, Mycobacterium bovis subsp bovis AF2122/97
ccgggccaucgcauccc

SEQ ID NO: 1185705 - RNA, 21 nt, Mycobacterium bovis subsp bovis AF2122/97
ccgggccaucgcauccccagc

SEQ ID NO: 1185706 - RNA, 21 nt, Mycobacterium bovis subsp bovis AF2122/97
ccgggccccggggugcccccg

SEQ ID NO: 1185707 - RNA, 14 nt, Mycobacterium bovis subsp bovis AF2122/97
ccgggcccgccggc

SEQ ID NO: 1185708 - RNA, 18 nt, Mycobacterium bovis subsp bovis AF2122/97
ccgggcccgccggccccg

SEQ ID NO: 1185709 - RNA, 16 nt, Mycobacterium bovis subsp bovis AF2122/97
ccgggcccgucggaca

SEQ ID NO: 1185710 - RNA, 21 nt, Mycobacterium bovis subsp bovis AF2122/97
ccgggcgaguacaggcgcagc

SEQ ID NO: 1185711 - RNA, 20 nt, Mycobacterium bovis subsp bovis AF2122/97
ccgggcgaguacaggcgcag

SEQ ID NO: 1185712 - RNA, 16 nt, Mycobacterium bovis subsp bovis AF2122/97
ccgggcgaccaccacc

SEQ ID NO: 1185713 - RNA, 20 nt, Mycobacterium bovis subsp bovis AF2122/97
ccgggccugggacggcggca

SEQ ID NO: 1185714 - RNA, 22 nt, Mycobacterium bovis subsp bovis AF2122/97
ccgggccugggacggcggcagu

SEQ ID NO: 1185715 - RNA, 13 nt, Mycobacterium bovis subsp bovis AF2122/97
ccgggccuggccu

SEQ ID NO: 1185716 - RNA, 15 nt, Mycobacterium bovis subsp bovis AF2122/97
ccgggccuggccugc

SEQ ID NO: 1185717 - RNA, 16 nt, Mycobacterium bovis subsp bovis AF2122/97
ccgggccugggacggc

SEQ ID NO: 1185718 - RNA, 17 nt, Mycobacterium bovis subsp bovis AF2122/97
ccgggcagucaggccua

SEQ ID NO: 1185719 - RNA, 17 nt, Mycobacterium bovis subsp bovis AF2122/97
ccgggcaguccaggcac

SEQ ID NO: 1185720 - RNA, 14 nt, Mycobacterium bovis subsp bovis AF2122/97
ccgggcagcugggc

SEQ ID NO: 1185721 - RNA, 17 nt, Mycobacterium bovis subsp bovis AF2122/97
ccgggcaguuuggcggc

SEQ ID NO: 1185722 - RNA, 20 nt, Mycobacterium bovis subsp bovis AF2122/97
ccgggcaguuuggcggcagg

SEQ ID NO: 1185723 - RNA, 12 nt, Mycobacterium bovis subsp bovis AF2122/97
ccgggccaaugc

SEQ ID NO: 1185724 - RNA, 18 nt, Mycobacterium bovis subsp bovis AF2122/97
ccgggcagcugggcagga

SEQ ID NO: 1185725 - RNA, 17 nt, Mycobacterium bovis subsp bovis AF2122/97
ccgggcaugaucacacu

SEQ ID NO: 1185726 - RNA, 15 nt, Mycobacterium bovis subsp bovis AF2122/97
ccgggcagccccucc

SEQ ID NO: 1185727 - RNA, 19 nt, Mycobacterium bovis subsp bovis AF2122/97
ccgggcagccccuccgcgc

SEQ ID NO: 1185728 - RNA, 16 nt, Mycobacterium bovis subsp bovis AF2122/97
ccgggcagccgcgccg

SEQ ID NO: 1185729 - RNA, 16 nt, Mycobacterium bovis subsp bovis AF2122/97
ccgggcaccgucggaa

SEQ ID NO: 1185730 - RNA, 23 nt, Mycobacterium bovis subsp bovis AF2122/97
ccgggcacgaacaucagaucgcc

SEQ ID NO: 1185731 - RNA, 15 nt, Mycobacterium bovis subsp bovis AF2122/97
ccggcugccacacag

SEQ ID NO: 1185732 - RNA, 20 nt, Mycobacterium bovis subsp bovis AF2122/97
ccggcugccagcgccgccgc

SEQ ID NO: 1185733 - RNA, 21 nt, Mycobacterium bovis subsp bovis AF2122/97
ccggcugcgggaagacgucgg

SEQ ID NO: 1185734 - RNA, 19 nt, Mycobacterium bovis subsp bovis AF2122/97
ccggcugccgucagcugac

SEQ ID NO: 1185735 - RNA, 14 nt, Mycobacterium bovis subsp bovis AF2122/97
ccggcuggccaggu

SEQ ID NO: 1185736 - RNA, 16 nt, Mycobacterium bovis subsp bovis AF2122/97
ccggcucgacugccac

SEQ ID NO: 1185737 - RNA, 18 nt, Mycobacterium bovis subsp bovis AF2122/97
ccggcugcaaccagcggc

SEQ ID NO: 1185738 - RNA, 21 nt, Mycobacterium bovis subsp bovis AF2122/97
ccggcuccggcggugccgucg

SEQ ID NO: 1185739 - RNA, 23 nt, Mycobacterium bovis subsp bovis AF2122/97
ccggcucaggggcuacuaggccc

SEQ ID NO: 1185740 - RNA, 12 nt, Mycobacterium bovis subsp bovis AF2122/97
ccgggcaccacc

SEQ ID NO: 1185741 - RNA, 21 nt, Mycobacterium bovis subsp bovis AF2122/97
ccgggcaacggcggggccggc

SEQ ID NO: 1185742 - RNA, 23 nt, Mycobacterium bovis subsp bovis AF2122/97
ccgggcaccaauaccgcacccgc

SEQ ID NO: 1185743 - RNA, 13 nt, Mycobacterium bovis subsp bovis AF2122/97
ccgggcaaccagc

SEQ ID NO: 1185744 - RNA, 21 nt, Mycobacterium bovis subsp bovis AF2122/97
ccggcuggugccaacugcgcc

SEQ ID NO: 1185745 - RNA, 18 nt, Mycobacterium bovis subsp bovis AF2122/97
ccgggaugugcggcugca

SEQ ID NO: 1185746 - RNA, 20 nt, Mycobacterium bovis subsp bovis AF2122/97
ccggcgguggggccggcguc

SEQ ID NO: 1185747 - RNA, 19 nt, Mycobacterium bovis subsp bovis AF2122/97
ccggcgguucugcggccgc

SEQ ID NO: 1185748 - RNA, 14 nt, Mycobacterium bovis subsp bovis AF2122/97
ccggcgucagcccc

SEQ ID NO: 1185749 - RNA, 17 nt, Mycobacterium bovis subsp bovis AF2122/97
ccggcgguggggccggc

SEQ ID NO: 1185750 - RNA, 12 nt, Mycobacterium bovis subsp bovis AF2122/97
ccggcgguguug

SEQ ID NO: 1185751 - RNA, 21 nt, Mycobacterium bovis subsp bovis AF2122/97
ccggcgggcucuacucgcggc

SEQ ID NO: 1185752 - RNA, 16 nt, Mycobacterium bovis subsp bovis AF2122/97
ccggcggugccgucag

SEQ ID NO: 1185753 - RNA, 18 nt, Mycobacterium bovis subsp bovis AF2122/97
ccggcggugacggcggca

SEQ ID NO: 1185754 - RNA, 17 nt, Mycobacterium bovis subsp bovis AF2122/97
ccggcgguagucggcca

SEQ ID NO: 1185755 - RNA, 20 nt, Mycobacterium bovis subsp bovis AF2122/97
ccggcgguagucggccagcu

SEQ ID NO: 1185756 - RNA, 20 nt, Mycobacterium bovis subsp bovis AF2122/97
ccggcgggugccgagcuggc

SEQ ID NO: 1185757 - RNA, 15 nt, Mycobacterium bovis subsp bovis AF2122/97
ccggcgggccugccc

SEQ ID NO: 1185758 - RNA, 21 nt, Mycobacterium bovis subsp bovis AF2122/97
ccggcgggcgagugucagcag

SEQ ID NO: 1185759 - RNA, 22 nt, Mycobacterium bovis subsp bovis AF2122/97
ccggcggcggugguaccggcgc

SEQ ID NO: 1185760 - RNA, 19 nt, Mycobacterium bovis subsp bovis AF2122/97
ccggcggcggugcgccccg

SEQ ID NO: 1185761 - RNA, 22 nt, Mycobacterium bovis subsp bovis AF2122/97
ccggcgggaccgagaacugcuc

SEQ ID NO: 1185762 - RNA, 23 nt, Mycobacterium bovis subsp bovis AF2122/97
ccggcgcacgaaaccgcagcgcg

SEQ ID NO: 1185763 - RNA, 21 nt, Mycobacterium bovis subsp bovis AF2122/97
ccggcggcgcaucaccuccgc

SEQ ID NO: 1185764 - RNA, 16 nt, Mycobacterium bovis subsp bovis AF2122/97
ccggcggcgcgcccgg

SEQ ID NO: 1185765 - RNA, 21 nt, Mycobacterium bovis subsp bovis AF2122/97
ccggcggcgaccagcucagcu

SEQ ID NO: 1185766 - RNA, 18 nt, Mycobacterium bovis subsp bovis AF2122/97
ccggcggcgacggcggca

SEQ ID NO: 1185767 - RNA, 16 nt, Mycobacterium bovis subsp bovis AF2122/97
ccggcggcgacggugc

SEQ ID NO: 1185768 - RNA, 16 nt, Mycobacterium bovis subsp bovis AF2122/97
ccggcgcaagcgccgc

SEQ ID NO: 1185769 - RNA, 21 nt, Mycobacterium bovis subsp bovis AF2122/97
ccggcgcaccaucgcggccgc

SEQ ID NO: 1185770 - RNA, 15 nt, Mycobacterium bovis subsp bovis AF2122/97
ccggcgcaacaaccg

SEQ ID NO: 1185771 - RNA, 23 nt, Mycobacterium bovis subsp bovis AF2122/97
ccggcgucggcgcccagcucgau

SEQ ID NO: 1185772 - RNA, 18 nt, Mycobacterium bovis subsp bovis AF2122/97
ccggcgucggcgcggccg

SEQ ID NO: 1185773 - RNA, 17 nt, Mycobacterium bovis subsp bovis AF2122/97
ccggcgucggucgucgg

SEQ ID NO: 1185774 - RNA, 13 nt, Mycobacterium bovis subsp bovis AF2122/97
ccggcgucggcgc

SEQ ID NO: 1185775 - RNA, 18 nt, Mycobacterium bovis subsp bovis AF2122/97
ccggcgucggcgcccagc

SEQ ID NO: 1185776 - RNA, 17 nt, Mycobacterium bovis subsp bovis AF2122/97
ccggcgucugcccgccc

SEQ ID NO: 1185777 - RNA, 20 nt, Mycobacterium bovis subsp bovis AF2122/97
ccggcgucugcccgcccagc

SEQ ID NO: 1185778 - RNA, 18 nt, Mycobacterium bovis subsp bovis AF2122/97
ccggcgucgacgucggcc

SEQ ID NO: 1185779 - RNA, 13 nt, Mycobacterium bovis subsp bovis AF2122/97
ccggcgugcauga

SEQ ID NO: 1185780 - RNA, 13 nt, Mycobacterium bovis subsp bovis AF2122/97
ccggcgugcagua

SEQ ID NO: 1185781 - RNA, 21 nt, Mycobacterium bovis subsp bovis AF2122/97
ccggcgucugcccgcccagcc

SEQ ID NO: 1185782 - RNA, 23 nt, Mycobacterium bovis subsp bovis AF2122/97
ccggcucaaggacgcaccgccag

SEQ ID NO: 1185783 - RNA, 22 nt, Mycobacterium bovis subsp bovis AF2122/97
ccggcucacagcacagcgcagc

SEQ ID NO: 1185784 - RNA, 17 nt, Mycobacterium bovis subsp bovis AF2122/97
ccggcuauuagcggcuu

SEQ ID NO: 1185785 - RNA, 23 nt, Mycobacterium bovis subsp bovis AF2122/97
ccggcuagggcagcagcccgggc

SEQ ID NO: 1185786 - RNA, 18 nt, Mycobacterium bovis subsp bovis AF2122/97
ccggcuauaucccgcccc

SEQ ID NO: 1185787 - RNA, 19 nt, Mycobacterium bovis subsp bovis AF2122/97
ccggcuaugcuggcgcagc

SEQ ID NO: 1185788 - RNA, 19 nt, Mycobacterium bovis subsp bovis AF2122/97
ccggcguuugggcaucauc

SEQ ID NO: 1185789 - RNA, 21 nt, Mycobacterium bovis subsp bovis AF2122/97
ccggcguugccgccguccccg

SEQ ID NO: 1185790 - RNA, 21 nt, Mycobacterium bovis subsp bovis AF2122/97
ccggcguugcguagacgaagg

SEQ ID NO: 1185791 - RNA, 22 nt, Mycobacterium bovis subsp bovis AF2122/97
ccggcuaccgccuugucggcga

SEQ ID NO: 1185792 - RNA, 14 nt, Mycobacterium bovis subsp bovis AF2122/97
ccggcuaccgcgcu

SEQ ID NO: 1185793 - RNA, 15 nt, Mycobacterium bovis subsp bovis AF2122/97
ccggcgugucgccgc

SEQ ID NO: 1185794 - RNA, 18 nt, Mycobacterium bovis subsp bovis AF2122/97
ccggcguucccacuggag

SEQ ID NO: 1185795 - RNA, 17 nt, Mycobacterium bovis subsp bovis AF2122/97
ccggcguucccccacuc

SEQ ID NO: 1185796 - RNA, 23 nt, Mycobacterium bovis subsp bovis AF2122/97
ccggcguggcuuguucggacuca

SEQ ID NO: 1185797 - RNA, 16 nt, Mycobacterium bovis subsp bovis AF2122/97
ccggcguggccccacc

SEQ ID NO: 1185798 - RNA, 16 nt, Mycobacterium bovis subsp bovis AF2122/97
ccggcacacggccuug

SEQ ID NO: 1185799 - RNA, 18 nt, Mycobacterium bovis subsp bovis AF2122/97
ccggcaauuuucugcugc

SEQ ID NO: 1185800 - RNA, 19 nt, Mycobacterium bovis subsp bovis AF2122/97
ccggcaauuuucugcugcu

SEQ ID NO: 1185801 - RNA, 19 nt, Mycobacterium bovis subsp bovis AF2122/97
ccggcaauaccgccagcgc

SEQ ID NO: 1185802 - RNA, 23 nt, Mycobacterium bovis subsp bovis AF2122/97
ccggcaacauuggccuguucaac

SEQ ID NO: 1185803 - RNA, 17 nt, Mycobacterium bovis subsp bovis AF2122/97
ccggcaaucggcggcac

SEQ ID NO: 1185804 - RNA, 21 nt, Mycobacterium bovis subsp bovis AF2122/97
ccggcaaucggcggcacccgg

SEQ ID NO: 1185805 - RNA, 21 nt, Mycobacterium bovis subsp bovis AF2122/97
ccggcaccgccggcgcccagg

SEQ ID NO: 1185806 - RNA, 18 nt, Mycobacterium bovis subsp bovis AF2122/97
ccggcacccaccagugca

SEQ ID NO: 1185807 - RNA, 23 nt, Mycobacterium bovis subsp bovis AF2122/97
ccggcacccgcggcgaaccgucu

SEQ ID NO: 1185808 - RNA, 14 nt, Mycobacterium bovis subsp bovis AF2122/97
ccggcacccgcugg

SEQ ID NO: 1185809 - RNA, 14 nt, Mycobacterium bovis subsp bovis AF2122/97
ccggcacccaccag

SEQ ID NO: 1185810 - RNA, 16 nt, Mycobacterium bovis subsp bovis AF2122/97
ccggcaccccacggcc

SEQ ID NO: 1185811 - RNA, 23 nt, Mycobacterium bovis subsp bovis AF2122/97
ccggcacauugaucgacggccag

SEQ ID NO: 1185812 - RNA, 12 nt, Mycobacterium bovis subsp bovis AF2122/97
ccggcacugccg

SEQ ID NO: 1185813 - RNA, 18 nt, Mycobacterium bovis subsp bovis AF2122/97
ccggcacugcggccaguc

SEQ ID NO: 1185814 - RNA, 20 nt, Mycobacterium bovis subsp bovis AF2122/97
ccggcacgucgcccccggcc

SEQ ID NO: 1185815 - RNA, 19 nt, Mycobacterium bovis subsp bovis AF2122/97
ccggcacgggcgucgucgg

SEQ ID NO: 1185816 - RNA, 13 nt, Mycobacterium bovis subsp bovis AF2122/97
ccggcacgggcgu

SEQ ID NO: 1185817 - RNA, 13 nt, Mycobacterium bovis subsp bovis AF2122/97
ccggcaccgccug

SEQ ID NO: 1185818 - RNA, 12 nt, Mycobacterium bovis subsp bovis AF2122/97
ccggcaccggcc

SEQ ID NO: 1185819 - RNA, 14 nt, Mycobacterium bovis subsp bovis AF2122/97
ccggcaccggggcu

SEQ ID NO: 1185820 - RNA, 17 nt, Mycobacterium bovis subsp bovis AF2122/97
ccggcaccuccagcacc

SEQ ID NO: 1185821 - RNA, 20 nt, Mycobacterium bovis subsp bovis AF2122/97
ccggcacgaccgcucccggu

SEQ ID NO: 1185822 - RNA, 20 nt, Mycobacterium bovis subsp bovis AF2122/97
ccggcaccggggcugcccgc

SEQ ID NO: 1185823 - RNA, 21 nt, Mycobacterium bovis subsp bovis AF2122/97
ccggcaccguagagcaugccg

SEQ ID NO: 1185824 - RNA, 19 nt, Mycobacterium bovis subsp bovis AF2122/97
ccggcagcaucggcacccc

SEQ ID NO: 1185825 - RNA, 22 nt, Mycobacterium bovis subsp bovis AF2122/97
ccggcagcaucggcaccccggc

SEQ ID NO: 1185826 - RNA, 20 nt, Mycobacterium bovis subsp bovis AF2122/97
ccggcagcgcgaucgauucc

SEQ ID NO: 1185827 - RNA, 17 nt, Mycobacterium bovis subsp bovis AF2122/97
ccggcagcagccggcgg

SEQ ID NO: 1185828 - RNA, 22 nt, Mycobacterium bovis subsp bovis AF2122/97
ccggcagaugcagcgggucgcc

SEQ ID NO: 1185829 - RNA, 17 nt, Mycobacterium bovis subsp bovis AF2122/97
ccggcaggccggcgucg

SEQ ID NO: 1185830 - RNA, 21 nt, Mycobacterium bovis subsp bovis AF2122/97
ccggcagcguccgaaccaccu

SEQ ID NO: 1185831 - RNA, 17 nt, Mycobacterium bovis subsp bovis AF2122/97
ccggcauacaucgccuu

SEQ ID NO: 1185832 - RNA, 20 nt, Mycobacterium bovis subsp bovis AF2122/97
ccggcaguucgcggccaucg

SEQ ID NO: 1185833 - RNA, 22 nt, Mycobacterium bovis subsp bovis AF2122/97
ccggcauaaaccgcguccgcgc

SEQ ID NO: 1185834 - RNA, 22 nt, Mycobacterium bovis subsp bovis AF2122/97
ccggcaggcccgacggcgccca

SEQ ID NO: 1185835 - RNA, 23 nt, Mycobacterium bovis subsp bovis AF2122/97
ccggcccggguaucgccaguggu

SEQ ID NO: 1185836 - RNA, 23 nt, Mycobacterium bovis subsp bovis AF2122/97
ccggcccguagcguccgcgcccg

SEQ ID NO: 1185837 - RNA, 19 nt, Mycobacterium bovis subsp bovis AF2122/97
ccggcccguagcugcgcag

SEQ ID NO: 1185838 - RNA, 20 nt, Mycobacterium bovis subsp bovis AF2122/97
ccggcccggggacgcccucg

SEQ ID NO: 1185839 - RNA, 16 nt, Mycobacterium bovis subsp bovis AF2122/97
ccggcccuccgggccc

SEQ ID NO: 1185840 - RNA, 21 nt, Mycobacterium bovis subsp bovis AF2122/97
ccggcccugccgccggccccg

SEQ ID NO: 1185841 - RNA, 12 nt, Mycobacterium bovis subsp bovis AF2122/97
ccggcccugcuc

SEQ ID NO: 1185842 - RNA, 15 nt, Mycobacterium bovis subsp bovis AF2122/97
ccggccggccuagcc

SEQ ID NO: 1185843 - RNA, 23 nt, Mycobacterium bovis subsp bovis AF2122/97
ccggccggguguagcucggaccc

SEQ ID NO: 1185844 - RNA, 20 nt, Mycobacterium bovis subsp bovis AF2122/97
ccggccgucccgcgagcagc

SEQ ID NO: 1185845 - RNA, 20 nt, Mycobacterium bovis subsp bovis AF2122/97
ccggccgucgacgcaugggu

SEQ ID NO: 1185846 - RNA, 17 nt, Mycobacterium bovis subsp bovis AF2122/97
ccggccgguggccagca

SEQ ID NO: 1185847 - RNA, 22 nt, Mycobacterium bovis subsp bovis AF2122/97
ccggccgguucuuggcguugau

SEQ ID NO: 1185848 - RNA, 18 nt, Mycobacterium bovis subsp bovis AF2122/97
ccggccgguuggccagcc

SEQ ID NO: 1185849 - RNA, 22 nt, Mycobacterium bovis subsp bovis AF2122/97
ccggccgguuggccagccacag

SEQ ID NO: 1185850 - RNA, 16 nt, Mycobacterium bovis subsp bovis AF2122/97
ccggcgaaggccagca

SEQ ID NO: 1185851 - RNA, 15 nt, Mycobacterium bovis subsp bovis AF2122/97
ccggcgaagccggcc

SEQ ID NO: 1185852 - RNA, 22 nt, Mycobacterium bovis subsp bovis AF2122/97
ccggcgaauacgaccgucgcgc

SEQ ID NO: 1185853 - RNA, 22 nt, Mycobacterium bovis subsp bovis AF2122/97
ccggcgagugguccagccagau

SEQ ID NO: 1185854 - RNA, 16 nt, Mycobacterium bovis subsp bovis AF2122/97
ccggccguugggaaac

SEQ ID NO: 1185855 - RNA, 16 nt, Mycobacterium bovis subsp bovis AF2122/97
ccggccuugccgccgg

SEQ ID NO: 1185856 - RNA, 18 nt, Mycobacterium bovis subsp bovis AF2122/97
ccggccuugccgccggcc

SEQ ID NO: 1185857 - RNA, 21 nt, Mycobacterium bovis subsp bovis AF2122/97
ccggccuugccgccggccccg

SEQ ID NO: 1185858 - RNA, 18 nt, Mycobacterium bovis subsp bovis AF2122/97
ccggccuucaaggaagcc

SEQ ID NO: 1185859 - RNA, 17 nt, Mycobacterium bovis subsp bovis AF2122/97
ccggccuuggcggcggc

SEQ ID NO: 1185860 - RNA, 21 nt, Mycobacterium bovis subsp bovis AF2122/97
ccggccuuuacccgggcggcg

SEQ ID NO: 1185861 - RNA, 23 nt, Mycobacterium bovis subsp bovis AF2122/97
ccggccuuuacccgggcggcggc

SEQ ID NO: 1185862 - RNA, 17 nt, Mycobacterium bovis subsp bovis AF2122/97
ccggccuuuccagcacc

SEQ ID NO: 1185863 - RNA, 22 nt, Mycobacterium bovis subsp bovis AF2122/97
ccggcgaaaagacugcgccgcc

SEQ ID NO: 1185864 - RNA, 15 nt, Mycobacterium bovis subsp bovis AF2122/97
ccggcaucggucagc

SEQ ID NO: 1185865 - RNA, 17 nt, Mycobacterium bovis subsp bovis AF2122/97
ccggcaucggucagcgc

SEQ ID NO: 1185866 - RNA, 16 nt, Mycobacterium bovis subsp bovis AF2122/97
ccggcaucgucgacgc

SEQ ID NO: 1185867 - RNA, 19 nt, Mycobacterium bovis subsp bovis AF2122/97
ccggcaucggucagcgcgg

SEQ ID NO: 1185868 - RNA, 12 nt, Mycobacterium bovis subsp bovis AF2122/97
ccggcaugccag

SEQ ID NO: 1185869 - RNA, 22 nt, Mycobacterium bovis subsp bovis AF2122/97
ccggcauuccguaggccacagc

SEQ ID NO: 1185870 - RNA, 23 nt, Mycobacterium bovis subsp bovis AF2122/97
ccggccaaaacauaucggugccg

SEQ ID NO: 1185871 - RNA, 13 nt, Mycobacterium bovis subsp bovis AF2122/97
ccggccaaccacc

SEQ ID NO: 1185872 - RNA, 14 nt, Mycobacterium bovis subsp bovis AF2122/97
ccggccaacugggc

SEQ ID NO: 1185873 - RNA, 19 nt, Mycobacterium bovis subsp bovis AF2122/97
ccggccaacgccgccgcaa

SEQ ID NO: 1185874 - RNA, 18 nt, Mycobacterium bovis subsp bovis AF2122/97
ccggccaacggcacccug

SEQ ID NO: 1185875 - RNA, 15 nt, Mycobacterium bovis subsp bovis AF2122/97
ccggccagcggcagg

SEQ ID NO: 1185876 - RNA, 16 nt, Mycobacterium bovis subsp bovis AF2122/97
ccggccaggccggcgg

SEQ ID NO: 1185877 - RNA, 17 nt, Mycobacterium bovis subsp bovis AF2122/97
ccggccaggucgacacc

SEQ ID NO: 1185878 - RNA, 17 nt, Mycobacterium bovis subsp bovis AF2122/97
ccggccaggggcgcagc

SEQ ID NO: 1185879 - RNA, 20 nt, Mycobacterium bovis subsp bovis AF2122/97
ccggccaggccggcggcggc

SEQ ID NO: 1185880 - RNA, 15 nt, Mycobacterium bovis subsp bovis AF2122/97
ccggcccgcauccgc

SEQ ID NO: 1185881 - RNA, 19 nt, Mycobacterium bovis subsp bovis AF2122/97
ccggcccgcauccgcaccg

SEQ ID NO: 1185882 - RNA, 15 nt, Mycobacterium bovis subsp bovis AF2122/97
ccggcccgccacccc

SEQ ID NO: 1185883 - RNA, 16 nt, Mycobacterium bovis subsp bovis AF2122/97
ccggcccgccaccccg

SEQ ID NO: 1185884 - RNA, 12 nt, Mycobacterium bovis subsp bovis AF2122/97
ccggccagcggc

SEQ ID NO: 1185885 - RNA, 22 nt, Mycobacterium bovis subsp bovis AF2122/97
ccggccaggucgacaccgcggu

SEQ ID NO: 1185886 - RNA, 18 nt, Mycobacterium bovis subsp bovis AF2122/97
ccggacacgaucagucca

SEQ ID NO: 1185887 - RNA, 21 nt, Mycobacterium bovis subsp bovis AF2122/97
ccggacaaagcugcucgucgg

SEQ ID NO: 1185888 - RNA, 13 nt, Mycobacterium bovis subsp bovis AF2122/97
ccgcuuucuuggc

SEQ ID NO: 1185889 - RNA, 18 nt, Mycobacterium bovis subsp bovis AF2122/97
ccgcuuugcgcggucagc

SEQ ID NO: 1185890 - RNA, 17 nt, Mycobacterium bovis subsp bovis AF2122/97
ccggacauagccgcgcu

SEQ ID NO: 1185891 - RNA, 17 nt, Mycobacterium bovis subsp bovis AF2122/97
ccggacaugcgggcagc

SEQ ID NO: 1185892 - RNA, 20 nt, Mycobacterium bovis subsp bovis AF2122/97
ccggacccgccggguccgcc

SEQ ID NO: 1185893 - RNA, 18 nt, Mycobacterium bovis subsp bovis AF2122/97
ccggacccaaagcacuuc

SEQ ID NO: 1185894 - RNA, 21 nt, Mycobacterium bovis subsp bovis AF2122/97
ccggaccaucgacaacgccuu

SEQ ID NO: 1185895 - RNA, 18 nt, Mycobacterium bovis subsp bovis AF2122/97
ccggacccacccgcaccg

SEQ ID NO: 1185896 - RNA, 23 nt, Mycobacterium bovis subsp bovis AF2122/97
ccggaccgcggauuccagcgcgu

SEQ ID NO: 1185897 - RNA, 15 nt, Mycobacterium bovis subsp bovis AF2122/97
ccggaccuuguuggc

SEQ ID NO: 1185898 - RNA, 14 nt, Mycobacterium bovis subsp bovis AF2122/97
ccggaccgaccacc

SEQ ID NO: 1185899 - RNA, 16 nt, Mycobacterium bovis subsp bovis AF2122/97
ccggaccgaccaccgc

SEQ ID NO: 1185900 - RNA, 22 nt, Mycobacterium bovis subsp bovis AF2122/97
ccggaccgggggaagcgguagc

SEQ ID NO: 1185901 - RNA, 13 nt, Mycobacterium bovis subsp bovis AF2122/97
ccgccuccgccug

SEQ ID NO: 1185902 - RNA, 17 nt, Mycobacterium bovis subsp bovis AF2122/97
ccgccucgaccgccagc

SEQ ID NO: 1185903 - RNA, 22 nt, Mycobacterium bovis subsp bovis AF2122/97
ccgccucgcggaugagcucggc

SEQ ID NO: 1185904 - RNA, 21 nt, Mycobacterium bovis subsp bovis AF2122/97
ccgccucguacggaccgucgc

SEQ ID NO: 1185905 - RNA, 23 nt, Mycobacterium bovis subsp bovis AF2122/97
ccgcugugauagcgccguacagc

SEQ ID NO: 1185906 - RNA, 15 nt, Mycobacterium bovis subsp bovis AF2122/97
ccgcuguaccuccag

SEQ ID NO: 1185907 - RNA, 19 nt, Mycobacterium bovis subsp bovis AF2122/97
ccgcugucaccccugggcg

SEQ ID NO: 1185908 - RNA, 14 nt, Mycobacterium bovis subsp bovis AF2122/97
ccggauacgggcgu

SEQ ID NO: 1185909 - RNA, 20 nt, Mycobacterium bovis subsp bovis AF2122/97
ccggacgauggcgucggcca

SEQ ID NO: 1185910 - RNA, 16 nt, Mycobacterium bovis subsp bovis AF2122/97
ccggacgaucagggug

SEQ ID NO: 1185911 - RNA, 15 nt, Mycobacterium bovis subsp bovis AF2122/97
ccggacgccaugccc

SEQ ID NO: 1185912 - RNA, 17 nt, Mycobacterium bovis subsp bovis AF2122/97
ccggauccgccagaccg

SEQ ID NO: 1185913 - RNA, 15 nt, Mycobacterium bovis subsp bovis AF2122/97
ccggaucgccgucgg

SEQ ID NO: 1185914 - RNA, 14 nt, Mycobacterium bovis subsp bovis AF2122/97
ccggauaucgacca

SEQ ID NO: 1185915 - RNA, 14 nt, Mycobacterium bovis subsp bovis AF2122/97
ccggaucccaccac

SEQ ID NO: 1185916 - RNA, 17 nt, Mycobacterium bovis subsp bovis AF2122/97
ccggaucccaccaccgc

SEQ ID NO: 1185917 - RNA, 18 nt, Mycobacterium bovis subsp bovis AF2122/97
ccggaucccaccaccgcu

SEQ ID NO: 1185918 - RNA, 18 nt, Mycobacterium bovis subsp bovis AF2122/97
ccggaucgcucccgucuc

SEQ ID NO: 1185919 - RNA, 14 nt, Mycobacterium bovis subsp bovis AF2122/97
ccggaucgcucccg

SEQ ID NO: 1185920 - RNA, 18 nt, Mycobacterium bovis subsp bovis AF2122/97
ccggaucggucggcacca

SEQ ID NO: 1185921 - RNA, 21 nt, Mycobacterium bovis subsp bovis AF2122/97
ccggaucggucggcaccaggu

SEQ ID NO: 1185922 - RNA, 21 nt, Mycobacterium bovis subsp bovis AF2122/97
ccggaucggcuaccuaacccg

SEQ ID NO: 1185923 - RNA, 16 nt, Mycobacterium bovis subsp bovis AF2122/97
ccggaucggucggcac

SEQ ID NO: 1185924 - RNA, 21 nt, Mycobacterium bovis subsp bovis AF2122/97
ccggaucugacggcgccgucg

SEQ ID NO: 1185925 - RNA, 22 nt, Mycobacterium bovis subsp bovis AF2122/97
ccggaucgucgaacagcaccgc

SEQ ID NO: 1185926 - RNA, 14 nt, Mycobacterium bovis subsp bovis AF2122/97
ccggauucgcccgg

SEQ ID NO: 1185927 - RNA, 17 nt, Mycobacterium bovis subsp bovis AF2122/97
ccggauucgcccgggcg

SEQ ID NO: 1185928 - RNA, 20 nt, Mycobacterium bovis subsp bovis AF2122/97
ccggaugucgugcgggcgca

SEQ ID NO: 1185929 - RNA, 18 nt, Mycobacterium bovis subsp bovis AF2122/97
ccggauggguggccagca

SEQ ID NO: 1185930 - RNA, 15 nt, Mycobacterium bovis subsp bovis AF2122/97
ccggauucuccgccc

SEQ ID NO: 1185931 - RNA, 17 nt, Mycobacterium bovis subsp bovis AF2122/97
ccggauuugggucagug

SEQ ID NO: 1185932 - RNA, 18 nt, Mycobacterium bovis subsp bovis AF2122/97
ccggauuuguauuagacu

SEQ ID NO: 1185933 - RNA, 16 nt, Mycobacterium bovis subsp bovis AF2122/97
ccggauuucgucgggc

SEQ ID NO: 1185934 - RNA, 13 nt, Mycobacterium bovis subsp bovis AF2122/97
ccggaugcggucc

SEQ ID NO: 1185935 - RNA, 17 nt, Mycobacterium bovis subsp bovis AF2122/97
ccggcaacagcucgccu

SEQ ID NO: 1185936 - RNA, 21 nt, Mycobacterium bovis subsp bovis AF2122/97
ccggcaaccgggaucugcucc

SEQ ID NO: 1185937 - RNA, 23 nt, Mycobacterium bovis subsp bovis AF2122/97
ccggcaacggcgcgccgaccacc

SEQ ID NO: 1185938 - RNA, 21 nt, Mycobacterium bovis subsp bovis AF2122/97
ccggcaaccaccggccgcgca

SEQ ID NO: 1185939 - RNA, 16 nt, Mycobacterium bovis subsp bovis AF2122/97
ccggcaacgugcggug

SEQ ID NO: 1185940 - RNA, 20 nt, Mycobacterium bovis subsp bovis AF2122/97
ccguugauaaaaaccuggcc

SEQ ID NO: 1185941 - RNA, 24 nt, Mycobacterium bovis subsp bovis AF2122/97
ccguugccgaaccacgcgcccgca

SEQ ID NO: 1185942 - RNA, 12 nt, Mycobacterium bovis subsp bovis AF2122/97
ccguugcccccg

SEQ ID NO: 1185943 - RNA, 20 nt, Mycobacterium bovis subsp bovis AF2122/97
ccguugccgauccccaggcc

SEQ ID NO: 1185944 - RNA, 23 nt, Mycobacterium bovis subsp bovis AF2122/97
ccguugccgccguuaccgagccc

SEQ ID NO: 1185945 - RNA, 21 nt, Mycobacterium bovis subsp bovis AF2122/97
ccguugccgccgacgccgccg

SEQ ID NO: 1185946 - RNA, 20 nt, Mycobacterium bovis subsp bovis AF2122/97
ccguucgugggcauugcggc

SEQ ID NO: 1185947 - RNA, 16 nt, Mycobacterium bovis subsp bovis AF2122/97
ccguugaacggcacca

SEQ ID NO: 1185948 - RNA, 21 nt, Mycobacterium bovis subsp bovis AF2122/97
ccguugaacggcaccagcggg

SEQ ID NO: 1185949 - RNA, 14 nt, Mycobacterium bovis subsp bovis AF2122/97
ccguugggccgacu

SEQ ID NO: 1185950 - RNA, 15 nt, Mycobacterium bovis subsp bovis AF2122/97
ccguuggggccguuc

SEQ ID NO: 1185951 - RNA, 20 nt, Mycobacterium bovis subsp bovis AF2122/97
ccguugcucccacggcaccc

SEQ ID NO: 1185952 - RNA, 19 nt, Mycobacterium bovis subsp bovis AF2122/97
ccguugucgaccuccucga

SEQ ID NO: 1185953 - RNA, 15 nt, Mycobacterium bovis subsp bovis AF2122/97
ccguuguccagcgcg

SEQ ID NO: 1185954 - RNA, 15 nt, Mycobacterium bovis subsp bovis AF2122/97
ccguuccggcugcuu

SEQ ID NO: 1185955 - RNA, 20 nt, Mycobacterium bovis subsp bovis AF2122/97
ccguucggcugccgcgcgcu

SEQ ID NO: 1185956 - RNA, 16 nt, Mycobacterium bovis subsp bovis AF2122/97
ccguucgcccgcccgu

SEQ ID NO: 1185957 - RNA, 17 nt, Mycobacterium bovis subsp bovis AF2122/97
ccguucgcucagggugu

SEQ ID NO: 1185958 - RNA, 14 nt, Mycobacterium bovis subsp bovis AF2122/97
ccguucgcuccccc

SEQ ID NO: 1185959 - RNA, 15 nt, Mycobacterium bovis subsp bovis AF2122/97
ccguucgcucccccg

SEQ ID NO: 1185960 - RNA, 17 nt, Mycobacterium bovis subsp bovis AF2122/97
ccguucgcucccccgcu

SEQ ID NO: 1185961 - RNA, 21 nt, Mycobacterium bovis subsp bovis AF2122/97
ccguucacccagcggaaccga

SEQ ID NO: 1185962 - RNA, 22 nt, Mycobacterium bovis subsp bovis AF2122/97
ccguucagcgacggccgccagc

SEQ ID NO: 1185963 - RNA, 13 nt, Mycobacterium bovis subsp bovis AF2122/97
ccguuagccaggu

SEQ ID NO: 1185964 - RNA, 18 nt, Mycobacterium bovis subsp bovis AF2122/97
ccuaaggcucaccaggcg

SEQ ID NO: 1185965 - RNA, 14 nt, Mycobacterium bovis subsp bovis AF2122/97
ccuaaguucgccac

SEQ ID NO: 1185966 - RNA, 20 nt, Mycobacterium bovis subsp bovis AF2122/97
ccguuucgaucucgagcagg

SEQ ID NO: 1185967 - RNA, 15 nt, Mycobacterium bovis subsp bovis AF2122/97
ccguuuccgccgccg

SEQ ID NO: 1185968 - RNA, 18 nt, Mycobacterium bovis subsp bovis AF2122/97
ccguuugagcggccaccg

SEQ ID NO: 1185969 - RNA, 13 nt, Mycobacterium bovis subsp bovis AF2122/97
ccgucucgccccc

SEQ ID NO: 1185970 - RNA, 14 nt, Mycobacterium bovis subsp bovis AF2122/97
ccgucucgccgugg

SEQ ID NO: 1185971 - RNA, 19 nt, Mycobacterium bovis subsp bovis AF2122/97
ccgucuccggcgccaccgc

SEQ ID NO: 1185972 - RNA, 12 nt, Mycobacterium bovis subsp bovis AF2122/97
ccgucucugcca

SEQ ID NO: 1185973 - RNA, 22 nt, Mycobacterium bovis subsp bovis AF2122/97
ccgucgucguuucgccagccgg

SEQ ID NO: 1185974 - RNA, 21 nt, Mycobacterium bovis subsp bovis AF2122/97
ccgucguugccggcgaccaug

SEQ ID NO: 1185975 - RNA, 16 nt, Mycobacterium bovis subsp bovis AF2122/97
ccgugcacgucagcgg

SEQ ID NO: 1185976 - RNA, 23 nt, Mycobacterium bovis subsp bovis AF2122/97
ccgugcaccagcgaccaggucgc

SEQ ID NO: 1185977 - RNA, 20 nt, Mycobacterium bovis subsp bovis AF2122/97
ccgugcaccagcucacccgg

SEQ ID NO: 1185978 - RNA, 15 nt, Mycobacterium bovis subsp bovis AF2122/97
ccgucugcgacccgg

SEQ ID NO: 1185979 - RNA, 18 nt, Mycobacterium bovis subsp bovis AF2122/97
ccgucugcgacccgggcc

SEQ ID NO: 1185980 - RNA, 14 nt, Mycobacterium bovis subsp bovis AF2122/97
ccgucugacagcau

SEQ ID NO: 1185981 - RNA, 16 nt, Mycobacterium bovis subsp bovis AF2122/97
ccgucugacagcaucc

SEQ ID NO: 1185982 - RNA, 23 nt, Mycobacterium bovis subsp bovis AF2122/97
ccgucugacagcauccuucgcgu

SEQ ID NO: 1185983 - RNA, 14 nt, Mycobacterium bovis subsp bovis AF2122/97
ccgugcccaggcca

SEQ ID NO: 1185984 - RNA, 21 nt, Mycobacterium bovis subsp bovis AF2122/97
ccgugccgaaaaucgcagcca

SEQ ID NO: 1185985 - RNA, 13 nt, Mycobacterium bovis subsp bovis AF2122/97
ccgugccagccca

SEQ ID NO: 1185986 - RNA, 18 nt, Mycobacterium bovis subsp bovis AF2122/97
ccguggccgcacugcugg

SEQ ID NO: 1185987 - RNA, 21 nt, Mycobacterium bovis subsp bovis AF2122/97
ccguggccggacccauuggac

SEQ ID NO: 1185988 - RNA, 18 nt, Mycobacterium bovis subsp bovis AF2122/97
ccguggcggccuccuccc

SEQ ID NO: 1185989 - RNA, 17 nt, Mycobacterium bovis subsp bovis AF2122/97
ccgugcugggccgacgg

SEQ ID NO: 1185990 - RNA, 20 nt, Mycobacterium bovis subsp bovis AF2122/97
ccgugcgucgauggcgucgg

SEQ ID NO: 1185991 - RNA, 22 nt, Mycobacterium bovis subsp bovis AF2122/97
ccguggaagauguugccgccgg

SEQ ID NO: 1185992 - RNA, 18 nt, Mycobacterium bovis subsp bovis AF2122/97
ccguggacaagcacagcg

SEQ ID NO: 1185993 - RNA, 20 nt, Mycobacterium bovis subsp bovis AF2122/97
ccgugcugcccaucccggcc

SEQ ID NO: 1185994 - RNA, 21 nt, Mycobacterium bovis subsp bovis AF2122/97
ccguggacgaucaacccgguc

SEQ ID NO: 1185995 - RNA, 13 nt, Mycobacterium bovis subsp bovis AF2122/97
ccguguccagcau

SEQ ID NO: 1185996 - RNA, 12 nt, Mycobacterium bovis subsp bovis AF2122/97
ccgugucgccgg

SEQ ID NO: 1185997 - RNA, 15 nt, Mycobacterium bovis subsp bovis AF2122/97
ccgugugccacgggg

SEQ ID NO: 1185998 - RNA, 21 nt, Mycobacterium bovis subsp bovis AF2122/97
ccgugucacgcgaccaccgcc

SEQ ID NO: 1185999 - RNA, 21 nt, Mycobacterium bovis subsp bovis AF2122/97
ccguggugguugaucagccag

SEQ ID NO: 1186000 - RNA, 23 nt, Mycobacterium bovis subsp bovis AF2122/97
ccguggugguugaucagccagac

SEQ ID NO: 1186001 - RNA, 16 nt, Mycobacterium bovis subsp bovis AF2122/97
ccgugguguacccgcc

SEQ ID NO: 1186002 - RNA, 18 nt, Mycobacterium bovis subsp bovis AF2122/97
ccgugggccugcccggcg

SEQ ID NO: 1186003 - RNA, 20 nt, Mycobacterium bovis subsp bovis AF2122/97
ccgugggcagcgcgcccgac

SEQ ID NO: 1186004 - RNA, 20 nt, Mycobacterium bovis subsp bovis AF2122/97
ccgugggguaucgccagcca

SEQ ID NO: 1186005 - RNA, 20 nt, Mycobacterium bovis subsp bovis AF2122/97
ccgugggguguggcggcggg

SEQ ID NO: 1186006 - RNA, 18 nt, Mycobacterium bovis subsp bovis AF2122/97
ccgugguggaugagccgg

SEQ ID NO: 1186007 - RNA, 12 nt, Mycobacterium bovis subsp bovis AF2122/97
ccguggugauca

SEQ ID NO: 1186008 - RNA, 18 nt, Mycobacterium bovis subsp bovis AF2122/97
ccgguugccaccugugcg

SEQ ID NO: 1186009 - RNA, 14 nt, Mycobacterium bovis subsp bovis AF2122/97
ccgguucgccgccg

SEQ ID NO: 1186010 - RNA, 16 nt, Mycobacterium bovis subsp bovis AF2122/97
ccgguuccgccggccc

SEQ ID NO: 1186011 - RNA, 20 nt, Mycobacterium bovis subsp bovis AF2122/97
ccgguuccgccggccccacc

SEQ ID NO: 1186012 - RNA, 13 nt, Mycobacterium bovis subsp bovis AF2122/97
ccgguucagcgcu

SEQ ID NO: 1186013 - RNA, 19 nt, Mycobacterium bovis subsp bovis AF2122/97
ccgguguuagugaggcccg

SEQ ID NO: 1186014 - RNA, 22 nt, Mycobacterium bovis subsp bovis AF2122/97
ccgguguucaucacgccgccgg

SEQ ID NO: 1186015 - RNA, 21 nt, Mycobacterium bovis subsp bovis AF2122/97
ccgguguugagcgaacccgcg

SEQ ID NO: 1186016 - RNA, 15 nt, Mycobacterium bovis subsp bovis AF2122/97
ccgguguugccgccg

SEQ ID NO: 1186017 - RNA, 23 nt, Mycobacterium bovis subsp bovis AF2122/97
ccgguguuguaggccgggccggc

SEQ ID NO: 1186018 - RNA, 18 nt, Mycobacterium bovis subsp bovis AF2122/97
ccgguuggcgcgggcgag

SEQ ID NO: 1186019 - RNA, 17 nt, Mycobacterium bovis subsp bovis AF2122/97
ccgguugucgcagcgca

SEQ ID NO: 1186020 - RNA, 18 nt, Mycobacterium bovis subsp bovis AF2122/97
ccgguugugcgcgcgccc

SEQ ID NO: 1186021 - RNA, 20 nt, Mycobacterium bovis subsp bovis AF2122/97
ccgguugugcgcgcgcccga

SEQ ID NO: 1186022 - RNA, 19 nt, Mycobacterium bovis subsp bovis AF2122/97
ccgguuguggaaccacggc

SEQ ID NO: 1186023 - RNA, 14 nt, Mycobacterium bovis subsp bovis AF2122/97
ccgucgacgcggcc

SEQ ID NO: 1186024 - RNA, 13 nt, Mycobacterium bovis subsp bovis AF2122/97
ccgucgagcgucu

SEQ ID NO: 1186025 - RNA, 23 nt, Mycobacterium bovis subsp bovis AF2122/97
ccgucgacagucaacagggccag

SEQ ID NO: 1186026 - RNA, 16 nt, Mycobacterium bovis subsp bovis AF2122/97
ccgucgucgugcacga

SEQ ID NO: 1186027 - RNA, 21 nt, Mycobacterium bovis subsp bovis AF2122/97
ccgucgucgagcaccacccgg

SEQ ID NO: 1186028 - RNA, 23 nt, Mycobacterium bovis subsp bovis AF2122/97
ccgucgucgagcaccacccgggc

SEQ ID NO: 1186029 - RNA, 15 nt, Mycobacterium bovis subsp bovis AF2122/97
ccgucgucgaccacg

SEQ ID NO: 1186030 - RNA, 16 nt, Mycobacterium bovis subsp bovis AF2122/97
ccgucgucgagcacca

SEQ ID NO: 1186031 - RNA, 14 nt, Mycobacterium bovis subsp bovis AF2122/97
ccgucggcccgcuc

SEQ ID NO: 1186032 - RNA, 23 nt, Mycobacterium bovis subsp bovis AF2122/97
ccgucggauggaaggcggccagg

SEQ ID NO: 1186033 - RNA, 15 nt, Mycobacterium bovis subsp bovis AF2122/97
ccgucggccaggcca

SEQ ID NO: 1186034 - RNA, 15 nt, Mycobacterium bovis subsp bovis AF2122/97
ccgucgcugggaggc

SEQ ID NO: 1186035 - RNA, 15 nt, Mycobacterium bovis subsp bovis AF2122/97
ccgucggagccggcc

SEQ ID NO: 1186036 - RNA, 17 nt, Mycobacterium bovis subsp bovis AF2122/97
ccgucgcgacgucggcc

SEQ ID NO: 1186037 - RNA, 18 nt, Mycobacterium bovis subsp bovis AF2122/97
ccgucgcgacgucggccg

SEQ ID NO: 1186038 - RNA, 12 nt, Mycobacterium bovis subsp bovis AF2122/97
ccgucgccgguc

SEQ ID NO: 1186039 - RNA, 14 nt, Mycobacterium bovis subsp bovis AF2122/97
ccgucgccgccgcu

SEQ ID NO: 1186040 - RNA, 15 nt, Mycobacterium bovis subsp bovis AF2122/97
ccgucgcuggccggc

SEQ ID NO: 1186041 - RNA, 16 nt, Mycobacterium bovis subsp bovis AF2122/97
ccgucgcuggccggca

SEQ ID NO: 1186042 - RNA, 18 nt, Mycobacterium bovis subsp bovis AF2122/97
ccgucgcgcgggcgagcg

SEQ ID NO: 1186043 - RNA, 16 nt, Mycobacterium bovis subsp bovis AF2122/97
ccgucgaucaagugcg

SEQ ID NO: 1186044 - RNA, 19 nt, Mycobacterium bovis subsp bovis AF2122/97
ccgucgaguuccggccggu

SEQ ID NO: 1186045 - RNA, 15 nt, Mycobacterium bovis subsp bovis AF2122/97
ccgucgaucccgguc

SEQ ID NO: 1186046 - RNA, 14 nt, Mycobacterium bovis subsp bovis AF2122/97
ccgucgccgcccgu

SEQ ID NO: 1186047 - RNA, 16 nt, Mycobacterium bovis subsp bovis AF2122/97
ccucacaugcccggac

SEQ ID NO: 1186048 - RNA, 19 nt, Mycobacterium bovis subsp bovis AF2122/97
ccucaccgaucucgaccag

SEQ ID NO: 1186049 - RNA, 21 nt, Mycobacterium bovis subsp bovis AF2122/97
ccucaccgaucucgaccagcg

SEQ ID NO: 1186050 - RNA, 18 nt, Mycobacterium bovis subsp bovis AF2122/97
ccucaccgaacggcaggg

SEQ ID NO: 1186051 - RNA, 13 nt, Mycobacterium bovis subsp bovis AF2122/97
ccucagccgccug

SEQ ID NO: 1186052 - RNA, 20 nt, Mycobacterium bovis subsp bovis AF2122/97
ccucagccaccgcggucagc

SEQ ID NO: 1186053 - RNA, 17 nt, Mycobacterium bovis subsp bovis AF2122/97
ccucaaggucggccagg

SEQ ID NO: 1186054 - RNA, 14 nt, Mycobacterium bovis subsp bovis AF2122/97
ccuagucgcggccg

SEQ ID NO: 1186055 - RNA, 15 nt, Mycobacterium bovis subsp bovis AF2122/97
ccuaggucgacgccg

SEQ ID NO: 1186056 - RNA, 16 nt, Mycobacterium bovis subsp bovis AF2122/97
ccuagggaaaggcgcc

SEQ ID NO: 1186057 - RNA, 22 nt, Mycobacterium bovis subsp bovis AF2122/97
ccuaggccgaggccgcugccag

SEQ ID NO: 1186058 - RNA, 14 nt, Mycobacterium bovis subsp bovis AF2122/97
ccuauaccgcuggg

SEQ ID NO: 1186059 - RNA, 16 nt, Mycobacterium bovis subsp bovis AF2122/97
ccuauugaacccgugu

SEQ ID NO: 1186060 - RNA, 21 nt, Mycobacterium bovis subsp bovis AF2122/97
ccuaucagccgagacaccacg

SEQ ID NO: 1186061 - RNA, 18 nt, Mycobacterium bovis subsp bovis AF2122/97
ccuaucagugagccgcca

SEQ ID NO: 1186062 - RNA, 15 nt, Mycobacterium bovis subsp bovis AF2122/97
ccucaucggacagcg

SEQ ID NO: 1186063 - RNA, 23 nt, Mycobacterium bovis subsp bovis AF2122/97
ccucaucggacagcgccuggccg

SEQ ID NO: 1186064 - RNA, 20 nt, Mycobacterium bovis subsp bovis AF2122/97
ccucaucgcagacggcugcc

SEQ ID NO: 1186065 - RNA, 14 nt, Mycobacterium bovis subsp bovis AF2122/97
ccucaucgagcgcg

SEQ ID NO: 1186066 - RNA, 21 nt, Mycobacterium bovis subsp bovis AF2122/97
ccucagcuagcgcgggcucac

SEQ ID NO: 1186067 - RNA, 21 nt, Mycobacterium bovis subsp bovis AF2122/97
ccucagcgcgguccaucccga

SEQ ID NO: 1186068 - RNA, 19 nt, Mycobacterium bovis subsp bovis AF2122/97
ccucagccgccugucgggc

SEQ ID NO: 1186069 - RNA, 21 nt, Mycobacterium bovis subsp bovis AF2122/97
ccuccagauaccaccgccgcu

SEQ ID NO: 1186070 - RNA, 12 nt, Mycobacterium bovis subsp bovis AF2122/97
ccuccacccgcc

SEQ ID NO: 1186071 - RNA, 18 nt, Mycobacterium bovis subsp bovis AF2122/97
ccuccacccgccacgguu

SEQ ID NO: 1186072 - RNA, 15 nt, Mycobacterium bovis subsp bovis AF2122/97
ccuccacgcccuggc

SEQ ID NO: 1186073 - RNA, 17 nt, Mycobacterium bovis subsp bovis AF2122/97
ccuccacgcuggcgccc

SEQ ID NO: 1186074 - RNA, 22 nt, Mycobacterium bovis subsp bovis AF2122/97
ccuccacgcuggcgcccccgac

SEQ ID NO: 1186075 - RNA, 19 nt, Mycobacterium bovis subsp bovis AF2122/97
ccuccacucuucgggcggc

SEQ ID NO: 1186076 - RNA, 19 nt, Mycobacterium bovis subsp bovis AF2122/97
ccuccacuuuuccgccggc

SEQ ID NO: 1186077 - RNA, 23 nt, Mycobacterium bovis subsp bovis AF2122/97
ccuccacugcgagcgccggcuuc

SEQ ID NO: 1186078 - RNA, 22 nt, Mycobacterium bovis subsp bovis AF2122/97
ccuccagauacaggaacaacgc

SEQ ID NO: 1186079 - RNA, 24 nt, Mycobacterium bovis subsp bovis AF2122/97
ccuccaauugcgaaccggccgucg

SEQ ID NO: 1186080 - RNA, 17 nt, Mycobacterium bovis subsp bovis AF2122/97
ccuccaccagugccccg

SEQ ID NO: 1186081 - RNA, 14 nt, Mycobacterium bovis subsp bovis AF2122/97
ccuccaagcccgcc

SEQ ID NO: 1186082 - RNA, 15 nt, Mycobacterium bovis subsp bovis AF2122/97
ccuccaagcccgccg

SEQ ID NO: 1186083 - RNA, 20 nt, Mycobacterium bovis subsp bovis AF2122/97
ccuccaagcccgccggaccc

SEQ ID NO: 1186084 - RNA, 22 nt, Mycobacterium bovis subsp bovis AF2122/97
ccuccaagcccgccggacccgc

SEQ ID NO: 1186085 - RNA, 16 nt, Mycobacterium bovis subsp bovis AF2122/97
ccuccgcugccgcccg

SEQ ID NO: 1186086 - RNA, 23 nt, Mycobacterium bovis subsp bovis AF2122/97
ccuccggaaagcucucggcaccc

SEQ ID NO: 1186087 - RNA, 21 nt, Mycobacterium bovis subsp bovis AF2122/97
ccuccggaaucgcccgggcgg

SEQ ID NO: 1186088 - RNA, 15 nt, Mycobacterium bovis subsp bovis AF2122/97
ccuccgcugccgccc

SEQ ID NO: 1186089 - RNA, 17 nt, Mycobacterium bovis subsp bovis AF2122/97
ccuccagugcggccuug

SEQ ID NO: 1186090 - RNA, 20 nt, Mycobacterium bovis subsp bovis AF2122/97
ccuccgguaucggcgaccag

SEQ ID NO: 1186091 - RNA, 11 nt, Mycobacterium bovis subsp bovis AF2122/97
ccuccgggcca

SEQ ID NO: 1186092 - RNA, 13 nt, Mycobacterium bovis subsp bovis AF2122/97
ccuccugccgccg

SEQ ID NO: 1186093 - RNA, 14 nt, Mycobacterium bovis subsp bovis AF2122/97
ccuccugcgccgca

SEQ ID NO: 1186094 - RNA, 19 nt, Mycobacterium bovis subsp bovis AF2122/97
ccuccugccgccgcuccau

SEQ ID NO: 1186095 - RNA, 15 nt, Mycobacterium bovis subsp bovis AF2122/97
ccucgaugccgcccg

SEQ ID NO: 1186096 - RNA, 21 nt, Mycobacterium bovis subsp bovis AF2122/97
ccucgaugaggcgcagcgcca

SEQ ID NO: 1186097 - RNA, 17 nt, Mycobacterium bovis subsp bovis AF2122/97
ccucgaugccgcccgug

SEQ ID NO: 1186098 - RNA, 21 nt, Mycobacterium bovis subsp bovis AF2122/97
ccucgcccucccgggcccgcu

SEQ ID NO: 1186099 - RNA, 16 nt, Mycobacterium bovis subsp bovis AF2122/97
ccucgauggcguccau

SEQ ID NO: 1186100 - RNA, 16 nt, Mycobacterium bovis subsp bovis AF2122/97
ccucgauggucucccg

SEQ ID NO: 1186101 - RNA, 18 nt, Mycobacterium bovis subsp bovis AF2122/97
ccucgauggucucccggc

SEQ ID NO: 1186102 - RNA, 12 nt, Mycobacterium bovis subsp bovis AF2122/97
ccucgaugaccg

SEQ ID NO: 1186103 - RNA, 22 nt, Mycobacterium bovis subsp bovis AF2122/97
ccucgaugaggcgcagcgccag

SEQ ID NO: 1186104 - RNA, 19 nt, Mycobacterium bovis subsp bovis AF2122/97
ccucgccugcacgcccggc

SEQ ID NO: 1186105 - RNA, 23 nt, Mycobacterium bovis subsp bovis AF2122/97
ccucgccugcccgaaccaccacc

SEQ ID NO: 1186106 - RNA, 19 nt, Mycobacterium bovis subsp bovis AF2122/97
ccucgccggucagcgugca

SEQ ID NO: 1186107 - RNA, 14 nt, Mycobacterium bovis subsp bovis AF2122/97
ccucgccggcgcgc

SEQ ID NO: 1186108 - RNA, 16 nt, Mycobacterium bovis subsp bovis AF2122/97
ccucgcccuggccgcu

SEQ ID NO: 1186109 - RNA, 14 nt, Mycobacterium bovis subsp bovis AF2122/97
ccucgccgcggcgg

SEQ ID NO: 1186110 - RNA, 14 nt, Mycobacterium bovis subsp bovis AF2122/97
ccucggcaaccacc

SEQ ID NO: 1186111 - RNA, 23 nt, Mycobacterium bovis subsp bovis AF2122/97
ccucggcacggaccgcgucgcgg

SEQ ID NO: 1186112 - RNA, 15 nt, Mycobacterium bovis subsp bovis AF2122/97
ccucggcaugcagcc

SEQ ID NO: 1186113 - RNA, 13 nt, Mycobacterium bovis subsp bovis AF2122/97
ccucggccacccg

SEQ ID NO: 1186114 - RNA, 21 nt, Mycobacterium bovis subsp bovis AF2122/97
ccucggccagcgucagcuguu

SEQ ID NO: 1186115 - RNA, 16 nt, Mycobacterium bovis subsp bovis AF2122/97
ccucgccggccaccag

SEQ ID NO: 1186116 - RNA, 22 nt, Mycobacterium bovis subsp bovis AF2122/97
ccucgcgaaauaacggagcggc

SEQ ID NO: 1186117 - RNA, 18 nt, Mycobacterium bovis subsp bovis AF2122/97
ccucgaguugcgcggcag

SEQ ID NO: 1186118 - RNA, 19 nt, Mycobacterium bovis subsp bovis AF2122/97
ccucgaguacccaaccggu

SEQ ID NO: 1186119 - RNA, 14 nt, Mycobacterium bovis subsp bovis AF2122/97
ccucgagugccgcc

SEQ ID NO: 1186120 - RNA, 15 nt, Mycobacterium bovis subsp bovis AF2122/97
ccucgagugccgccg

SEQ ID NO: 1186121 - RNA, 22 nt, Mycobacterium bovis subsp bovis AF2122/97
ccucgauaaccgcaguucuuga

SEQ ID NO: 1186122 - RNA, 16 nt, Mycobacterium bovis subsp bovis AF2122/97
ccucgacuucggcggg

SEQ ID NO: 1186123 - RNA, 14 nt, Mycobacterium bovis subsp bovis AF2122/97
ccucgagcggcaga

SEQ ID NO: 1186124 - RNA, 17 nt, Mycobacterium bovis subsp bovis AF2122/97
ccucgagcuugccgucg

SEQ ID NO: 1186125 - RNA, 16 nt, Mycobacterium bovis subsp bovis AF2122/97
ccucgagguccucguc

SEQ ID NO: 1186126 - RNA, 19 nt, Mycobacterium bovis subsp bovis AF2122/97
ccucgacguccaucccggc

SEQ ID NO: 1186127 - RNA, 16 nt, Mycobacterium bovis subsp bovis AF2122/97
ccucgacgcccgcccu

SEQ ID NO: 1186128 - RNA, 18 nt, Mycobacterium bovis subsp bovis AF2122/97
ccucgacgagucggcggg

SEQ ID NO: 1186129 - RNA, 22 nt, Mycobacterium bovis subsp bovis AF2122/97
ccucgacgagucggcgggcgac

SEQ ID NO: 1186130 - RNA, 16 nt, Mycobacterium bovis subsp bovis AF2122/97
ccucgacgaucagcac

SEQ ID NO: 1186131 - RNA, 15 nt, Mycobacterium bovis subsp bovis AF2122/97
ccucgagcagugccg

SEQ ID NO: 1186132 - RNA, 14 nt, Mycobacterium bovis subsp bovis AF2122/97
ccucgacgcggcag

SEQ ID NO: 1186133 - RNA, 17 nt, Mycobacterium bovis subsp bovis AF2122/97
ccucgacgcggcaggcc

SEQ ID NO: 1186134 - RNA, 20 nt, Mycobacterium bovis subsp bovis AF2122/97
ccucgacgcggcaggccggu

SEQ ID NO: 1186135 - RNA, 15 nt, Mycobacterium bovis subsp bovis AF2122/97
ccucgacgucggcga

SEQ ID NO: 1186136 - RNA, 13 nt, Mycobacterium bovis subsp bovis AF2122/97
ccucgacacccag

SEQ ID NO: 1186137 - RNA, 18 nt, Mycobacterium bovis subsp bovis AF2122/97
ccucgacacccagccgca

SEQ ID NO: 1186138 - RNA, 13 nt, Mycobacterium bovis subsp bovis AF2122/97
ccucgaccgccag

SEQ ID NO: 1186139 - RNA, 22 nt, Mycobacterium bovis subsp bovis AF2122/97
ccucgaccuggauugccaccag

SEQ ID NO: 1186140 - RNA, 15 nt, Mycobacterium bovis subsp bovis AF2122/97
ccucgaagaacuggu

SEQ ID NO: 1186141 - RNA, 17 nt, Mycobacterium bovis subsp bovis AF2122/97
ccugcacgacccgcugg

SEQ ID NO: 1186142 - RNA, 22 nt, Mycobacterium bovis subsp bovis AF2122/97
ccugcaccgucacgucguuugg

SEQ ID NO: 1186143 - RNA, 15 nt, Mycobacterium bovis subsp bovis AF2122/97
ccugcacccgacccg

SEQ ID NO: 1186144 - RNA, 12 nt, Mycobacterium bovis subsp bovis AF2122/97
ccugcacccggc

SEQ ID NO: 1186145 - RNA, 15 nt, Mycobacterium bovis subsp bovis AF2122/97
ccugcacgccggcgc

SEQ ID NO: 1186146 - RNA, 16 nt, Mycobacterium bovis subsp bovis AF2122/97
ccugcacgccggcgcu

SEQ ID NO: 1186147 - RNA, 19 nt, Mycobacterium bovis subsp bovis AF2122/97
ccucggcguaggcgauggc

SEQ ID NO: 1186148 - RNA, 22 nt, Mycobacterium bovis subsp bovis AF2122/97
ccucggcguaggcgauggcggc

SEQ ID NO: 1186149 - RNA, 16 nt, Mycobacterium bovis subsp bovis AF2122/97
ccucgggaggcagcgc

SEQ ID NO: 1186150 - RNA, 19 nt, Mycobacterium bovis subsp bovis AF2122/97
ccucggcuuugccgcugug

SEQ ID NO: 1186151 - RNA, 15 nt, Mycobacterium bovis subsp bovis AF2122/97
ccucgggacugcgcg

SEQ ID NO: 1186152 - RNA, 18 nt, Mycobacterium bovis subsp bovis AF2122/97
ccucgggcaggcggccag

SEQ ID NO: 1186153 - RNA, 16 nt, Mycobacterium bovis subsp bovis AF2122/97
ccucgggguagccaac

SEQ ID NO: 1186154 - RNA, 12 nt, Mycobacterium bovis subsp bovis AF2122/97
ccugcacagcag

SEQ ID NO: 1186155 - RNA, 13 nt, Mycobacterium bovis subsp bovis AF2122/97
ccugcacagcagc

SEQ ID NO: 1186156 - RNA, 23 nt, Mycobacterium bovis subsp bovis AF2122/97
ccugcaccacggcggccaccugc

SEQ ID NO: 1186157 - RNA, 19 nt, Mycobacterium bovis subsp bovis AF2122/97
ccugcagguuuccggccug

SEQ ID NO: 1186158 - RNA, 13 nt, Mycobacterium bovis subsp bovis AF2122/97
ccugccagugggc

SEQ ID NO: 1186159 - RNA, 17 nt, Mycobacterium bovis subsp bovis AF2122/97
ccugccagugggccgac

SEQ ID NO: 1186160 - RNA, 21 nt, Mycobacterium bovis subsp bovis AF2122/97
ccugccagugggccgacguga

SEQ ID NO: 1186161 - RNA, 13 nt, Mycobacterium bovis subsp bovis AF2122/97
ccugccaguccug

SEQ ID NO: 1186162 - RNA, 20 nt, Mycobacterium bovis subsp bovis AF2122/97
ccugcccggcccgcucagcc

SEQ ID NO: 1186163 - RNA, 19 nt, Mycobacterium bovis subsp bovis AF2122/97
ccugcccggcccgcccgua

SEQ ID NO: 1186164 - RNA, 13 nt, Mycobacterium bovis subsp bovis AF2122/97
ccugcccggcccg

SEQ ID NO: 1186165 - RNA, 16 nt, Mycobacterium bovis subsp bovis AF2122/97
ccugccgacgcuccag

SEQ ID NO: 1186166 - RNA, 18 nt, Mycobacterium bovis subsp bovis AF2122/97
ccugccgacgcuccaggg

SEQ ID NO: 1186167 - RNA, 16 nt, Mycobacterium bovis subsp bovis AF2122/97
ccugcccaacccauau

SEQ ID NO: 1186168 - RNA, 17 nt, Mycobacterium bovis subsp bovis AF2122/97
ccugcccaccaucccgc

SEQ ID NO: 1186169 - RNA, 14 nt, Mycobacterium bovis subsp bovis AF2122/97
ccugcccccggcgc

SEQ ID NO: 1186170 - RNA, 15 nt, Mycobacterium bovis subsp bovis AF2122/97
ccugccauaggccca

SEQ ID NO: 1186171 - RNA, 23 nt, Mycobacterium bovis subsp bovis AF2122/97
ccugcgacuaagggcacuccacc

SEQ ID NO: 1186172 - RNA, 19 nt, Mycobacterium bovis subsp bovis AF2122/97
ccugcggcaggugcgguca

SEQ ID NO: 1186173 - RNA, 14 nt, Mycobacterium bovis subsp bovis AF2122/97
ccugccgaucccgu

SEQ ID NO: 1186174 - RNA, 17 nt, Mycobacterium bovis subsp bovis AF2122/97
ccugccgaacccggcgg

SEQ ID NO: 1186175 - RNA, 16 nt, Mycobacterium bovis subsp bovis AF2122/97
ccugccucaccgccgc

SEQ ID NO: 1186176 - RNA, 20 nt, Mycobacterium bovis subsp bovis AF2122/97
ccugcucgcacagcaccacg

SEQ ID NO: 1186177 - RNA, 19 nt, Mycobacterium bovis subsp bovis AF2122/97
ccugcucgcagcgggcgaa

SEQ ID NO: 1186178 - RNA, 14 nt, Mycobacterium bovis subsp bovis AF2122/97
ccugcugcugcagc

SEQ ID NO: 1186179 - RNA, 16 nt, Mycobacterium bovis subsp bovis AF2122/97
ccugcucauccaccuc

SEQ ID NO: 1186180 - RNA, 20 nt, Mycobacterium bovis subsp bovis AF2122/97
ccugcucgaaaucgcacagc

SEQ ID NO: 1186181 - RNA, 17 nt, Mycobacterium bovis subsp bovis AF2122/97
ccugcuggugucggcuc

SEQ ID NO: 1186182 - RNA, 14 nt, Mycobacterium bovis subsp bovis AF2122/97
ccugcugggaggga

SEQ ID NO: 1186183 - RNA, 14 nt, Mycobacterium bovis subsp bovis AF2122/97
ccugcuggccgcgg

SEQ ID NO: 1186184 - RNA, 14 nt, Mycobacterium bovis subsp bovis AF2122/97
ccugcuggcccugc

SEQ ID NO: 1186185 - RNA, 15 nt, Mycobacterium bovis subsp bovis AF2122/97
ccugcuggaucucgg

SEQ ID NO: 1186186 - RNA, 13 nt, Mycobacterium bovis subsp bovis AF2122/97
ccugguggcagac

SEQ ID NO: 1186187 - RNA, 21 nt, Mycobacterium bovis subsp bovis AF2122/97
ccugguguacacacccgccuc

SEQ ID NO: 1186188 - RNA, 15 nt, Mycobacterium bovis subsp bovis AF2122/97
ccuggggugcucggg

SEQ ID NO: 1186189 - RNA, 17 nt, Mycobacterium bovis subsp bovis AF2122/97
ccugggcugccggccag

SEQ ID NO: 1186190 - RNA, 19 nt, Mycobacterium bovis subsp bovis AF2122/97
ccugggugauggccgcgcc

SEQ ID NO: 1186191 - RNA, 17 nt, Mycobacterium bovis subsp bovis AF2122/97
ccuggugcaaccgugcc

SEQ ID NO: 1186192 - RNA, 18 nt, Mycobacterium bovis subsp bovis AF2122/97
ccuggggguggcagcgcg

SEQ ID NO: 1186193 - RNA, 12 nt, Mycobacterium bovis subsp bovis AF2122/97
ccuggggcagcc

SEQ ID NO: 1186194 - RNA, 13 nt, Mycobacterium bovis subsp bovis AF2122/97
ccuggggcagccg

SEQ ID NO: 1186195 - RNA, 19 nt, Mycobacterium bovis subsp bovis AF2122/97
ccuggggccaccagaacca

SEQ ID NO: 1186196 - RNA, 12 nt, Mycobacterium bovis subsp bovis AF2122/97
ccuggggccgca

SEQ ID NO: 1186197 - RNA, 12 nt, Mycobacterium bovis subsp bovis AF2122/97
ccugggcgcgcu

SEQ ID NO: 1186198 - RNA, 15 nt, Mycobacterium bovis subsp bovis AF2122/97
ccugggccgccgccc

SEQ ID NO: 1186199 - RNA, 16 nt, Mycobacterium bovis subsp bovis AF2122/97
ccugggccgccgcccu

SEQ ID NO: 1186200 - RNA, 19 nt, Mycobacterium bovis subsp bovis AF2122/97
ccugggacaguucgcgccg

SEQ ID NO: 1186201 - RNA, 14 nt, Mycobacterium bovis subsp bovis AF2122/97
ccugggaaacuggg

SEQ ID NO: 1186202 - RNA, 13 nt, Mycobacterium bovis subsp bovis AF2122/97
ccuggcggcccgg

SEQ ID NO: 1186203 - RNA, 17 nt, Mycobacterium bovis subsp bovis AF2122/97
ccuggcggcugcagccg

SEQ ID NO: 1186204 - RNA, 12 nt, Mycobacterium bovis subsp bovis AF2122/97
ccuggcgggcgc

SEQ ID NO: 1186205 - RNA, 16 nt, Mycobacterium bovis subsp bovis AF2122/97
ccuggcggcgccgcag

SEQ ID NO: 1186206 - RNA, 23 nt, Mycobacterium bovis subsp bovis AF2122/97
ccuggcgacgcgacacacgccgc

SEQ ID NO: 1186207 - RNA, 18 nt, Mycobacterium bovis subsp bovis AF2122/97
ccuggcgugucgccgcca

SEQ ID NO: 1186208 - RNA, 17 nt, Mycobacterium bovis subsp bovis AF2122/97
ccuggcguagugcagcu

SEQ ID NO: 1186209 - RNA, 19 nt, Mycobacterium bovis subsp bovis AF2122/97
ccuggccgccggcgccgcc

SEQ ID NO: 1186210 - RNA, 12 nt, Mycobacterium bovis subsp bovis AF2122/97
ccuggccgcgcc

SEQ ID NO: 1186211 - RNA, 18 nt, Mycobacterium bovis subsp bovis AF2122/97
ccuggcgaacucgcgcag

SEQ ID NO: 1186212 - RNA, 14 nt, Mycobacterium bovis subsp bovis AF2122/97
ccuggccgcccgcu

SEQ ID NO: 1186213 - RNA, 19 nt, Mycobacterium bovis subsp bovis AF2122/97
ccuggccgcccuggccgcc

SEQ ID NO: 1186214 - RNA, 14 nt, Mycobacterium bovis subsp bovis AF2122/97
ccuggccgccgccc

SEQ ID NO: 1186215 - RNA, 15 nt, Mycobacterium bovis subsp bovis AF2122/97
ccuggccgccgcccc

SEQ ID NO: 1186216 - RNA, 16 nt, Mycobacterium bovis subsp bovis AF2122/97
ccuggccgccgccccg

SEQ ID NO: 1186217 - RNA, 14 nt, Mycobacterium bovis subsp bovis AF2122/97
ccuggccgccgccg

SEQ ID NO: 1186218 - RNA, 16 nt, Mycobacterium bovis subsp bovis AF2122/97
ccuggccgccggcccc

SEQ ID NO: 1186219 - RNA, 17 nt, Mycobacterium bovis subsp bovis AF2122/97
ccuggccgccggcgccg

SEQ ID NO: 1186220 - RNA, 14 nt, Mycobacterium bovis subsp bovis AF2122/97
ccuggccaccuggu

SEQ ID NO: 1186221 - RNA, 17 nt, Mycobacterium bovis subsp bovis AF2122/97
ccuggccacacucagca

SEQ ID NO: 1186222 - RNA, 18 nt, Mycobacterium bovis subsp bovis AF2122/97
ccuggccacacucagcac

SEQ ID NO: 1186223 - RNA, 17 nt, Mycobacterium bovis subsp bovis AF2122/97
ccuggccaccugguuua

SEQ ID NO: 1186224 - RNA, 19 nt, Mycobacterium bovis subsp bovis AF2122/97
ccuggcaccucgcccuccc

SEQ ID NO: 1186225 - RNA, 22 nt, Mycobacterium bovis subsp bovis AF2122/97
ccuggcagacgcccuugccuug

SEQ ID NO: 1186226 - RNA, 13 nt, Mycobacterium bovis subsp bovis AF2122/97
ccuggauggcgcc

SEQ ID NO: 1186227 - RNA, 16 nt, Mycobacterium bovis subsp bovis AF2122/97
ccuggaugggcucgac

SEQ ID NO: 1186228 - RNA, 16 nt, Mycobacterium bovis subsp bovis AF2122/97
ccuggacugcagcgcc

SEQ ID NO: 1186229 - RNA, 16 nt, Mycobacterium bovis subsp bovis AF2122/97
ccuggaauccaggagc

SEQ ID NO: 1186230 - RNA, 16 nt, Mycobacterium bovis subsp bovis AF2122/97
ccuggauccaccagau

SEQ ID NO: 1186231 - RNA, 19 nt, Mycobacterium bovis subsp bovis AF2122/97
ccuggaucagccaguugau

SEQ ID NO: 1186232 - RNA, 20 nt, Mycobacterium bovis subsp bovis AF2122/97
ccugcuuguagcgcaucgcc

SEQ ID NO: 1186233 - RNA, 15 nt, Mycobacterium bovis subsp bovis AF2122/97
ccuggaagacggugc

SEQ ID NO: 1186234 - RNA, 14 nt, Mycobacterium bovis subsp bovis AF2122/97
ccuggaaggaggcc

SEQ ID NO: 1186235 - RNA, 23 nt, Mycobacterium bovis subsp bovis AF2122/97
ccuucacgcuggccuccagcuug

SEQ ID NO: 1186236 - RNA, 21 nt, Mycobacterium bovis subsp bovis AF2122/97
ccuucaaagcggccucgaccu

SEQ ID NO: 1186237 - RNA, 13 nt, Mycobacterium bovis subsp bovis AF2122/97
ccuuauuggacug

SEQ ID NO: 1186238 - RNA, 18 nt, Mycobacterium bovis subsp bovis AF2122/97
ccuguaccgccacggcgg

SEQ ID NO: 1186239 - RNA, 17 nt, Mycobacterium bovis subsp bovis AF2122/97
ccuguacggcggcuagg

SEQ ID NO: 1186240 - RNA, 19 nt, Mycobacterium bovis subsp bovis AF2122/97
ccuuaccccgcagcucacc

SEQ ID NO: 1186241 - RNA, 11 nt, Mycobacterium bovis subsp bovis AF2122/97
ccuucuuggcg

SEQ ID NO: 1186242 - RNA, 11 nt, Mycobacterium bovis subsp bovis AF2122/97
ccuucuuggca

SEQ ID NO: 1186243 - RNA, 20 nt, Mycobacterium bovis subsp bovis AF2122/97
ccuucuucgcuaccuucuug

SEQ ID NO: 1186244 - RNA, 13 nt, Mycobacterium bovis subsp bovis AF2122/97
ccuucuucucggc

SEQ ID NO: 1186245 - RNA, 19 nt, Mycobacterium bovis subsp bovis AF2122/97
ccuucgaguuuggugucga

SEQ ID NO: 1186246 - RNA, 22 nt, Mycobacterium bovis subsp bovis AF2122/97
ccuucgaaugccgugccgaagu

SEQ ID NO: 1186247 - RNA, 23 nt, Mycobacterium bovis subsp bovis AF2122/97
ccuucgcagcauguggccgccgu

SEQ ID NO: 1186248 - RNA, 23 nt, Mycobacterium bovis subsp bovis AF2122/97
ccuucagcacggugaucagcagc

SEQ ID NO: 1186249 - RNA, 19 nt, Mycobacterium bovis subsp bovis AF2122/97
ccuuggccaggaagucccg

SEQ ID NO: 1186250 - RNA, 21 nt, Mycobacterium bovis subsp bovis AF2122/97
ccuuggccaccaucgccgccg

SEQ ID NO: 1186251 - RNA, 12 nt, Mycobacterium bovis subsp bovis AF2122/97
ccuuggccagca

SEQ ID NO: 1186252 - RNA, 22 nt, Mycobacterium bovis subsp bovis AF2122/97
ccuuggccgccacucgcccgcu

SEQ ID NO: 1186253 - RNA, 15 nt, Mycobacterium bovis subsp bovis AF2122/97
ccuuggcccagcggu

SEQ ID NO: 1186254 - RNA, 14 nt, Mycobacterium bovis subsp bovis AF2122/97
ccuuggcacccucc

SEQ ID NO: 1186255 - RNA, 18 nt, Mycobacterium bovis subsp bovis AF2122/97
ccuuggcaguccagccgg

SEQ ID NO: 1186256 - RNA, 15 nt, Mycobacterium bovis subsp bovis AF2122/97
ccuugcucguccagg

SEQ ID NO: 1186257 - RNA, 17 nt, Mycobacterium bovis subsp bovis AF2122/97
ccuugcucagccggccc

SEQ ID NO: 1186258 - RNA, 16 nt, Mycobacterium bovis subsp bovis AF2122/97
ccuugcucagcacgcc

SEQ ID NO: 1186259 - RNA, 16 nt, Mycobacterium bovis subsp bovis AF2122/97
ccuugcucagccggcc

SEQ ID NO: 1186260 - RNA, 13 nt, Mycobacterium bovis subsp bovis AF2122/97
ccuugcugcgcga

SEQ ID NO: 1186261 - RNA, 17 nt, Mycobacterium bovis subsp bovis AF2122/97
ccuuggacugucccacc

SEQ ID NO: 1186262 - RNA, 21 nt, Mycobacterium bovis subsp bovis AF2122/97
ccuugcgguccaggccggcac

SEQ ID NO: 1186263 - RNA, 20 nt, Mycobacterium bovis subsp bovis AF2122/97
ccuugcgguccaggccggca

SEQ ID NO: 1186264 - RNA, 16 nt, Mycobacterium bovis subsp bovis AF2122/97
ccuugagcaaaauggc

SEQ ID NO: 1186265 - RNA, 14 nt, Mycobacterium bovis subsp bovis AF2122/97
ccuugacgcggcca

SEQ ID NO: 1186266 - RNA, 19 nt, Mycobacterium bovis subsp bovis AF2122/97
ccuugacgcggccacauac

SEQ ID NO: 1186267 - RNA, 13 nt, Mycobacterium bovis subsp bovis AF2122/97
ccuugacccgcaa

SEQ ID NO: 1186268 - RNA, 21 nt, Mycobacterium bovis subsp bovis AF2122/97
ccuugaccacagcggagacga

SEQ ID NO: 1186269 - RNA, 17 nt, Mycobacterium bovis subsp bovis AF2122/97
ccuugacagcuuucuug

SEQ ID NO: 1186270 - RNA, 20 nt, Mycobacterium bovis subsp bovis AF2122/97
ccuugacagcuuucuuggcg

SEQ ID NO: 1186271 - RNA, 21 nt, Mycobacterium bovis subsp bovis AF2122/97
ccuugucuaguugacgcagcc

SEQ ID NO: 1186272 - RNA, 19 nt, Mycobacterium bovis subsp bovis AF2122/97
ccuugucaaaggugcacug

SEQ ID NO: 1186273 - RNA, 14 nt, Mycobacterium bovis subsp bovis AF2122/97
ccuuggcgcggcac

SEQ ID NO: 1186274 - RNA, 23 nt, Mycobacterium bovis subsp bovis AF2122/97
ccuugguugccaacgaaccgcuc

SEQ ID NO: 1186275 - RNA, 16 nt, Mycobacterium bovis subsp bovis AF2122/97
ccuuggcgcggcaccc

SEQ ID NO: 1186276 - RNA, 12 nt, Mycobacterium bovis subsp bovis AF2122/97
ccuuggugggca

SEQ ID NO: 1186277 - RNA, 20 nt, Mycobacterium bovis subsp bovis AF2122/97
ccuugguuagccgcggcccg

SEQ ID NO: 1186278 - RNA, 21 nt, Mycobacterium bovis subsp bovis AF2122/97
ccuuguuggcgcccgggccca

SEQ ID NO: 1186279 - RNA, 20 nt, Mycobacterium bovis subsp bovis AF2122/97
ccuuguuguccuucagccag

SEQ ID NO: 1186280 - RNA, 18 nt, Mycobacterium bovis subsp bovis AF2122/97
ccuuguuggccugcaacg

SEQ ID NO: 1186281 - RNA, 20 nt, Mycobacterium bovis subsp bovis AF2122/97
ccuuguuggcgcccgggccc

SEQ ID NO: 1186282 - RNA, 14 nt, Mycobacterium bovis subsp bovis AF2122/97
ccuuguugccgccg

SEQ ID NO: 1186283 - RNA, 17 nt, Mycobacterium bovis subsp bovis AF2122/97
ccuuguugaacguucug

SEQ ID NO: 1186284 - RNA, 17 nt, Mycobacterium bovis subsp bovis AF2122/97
ccuuguugaccaccacc

SEQ ID NO: 1186285 - RNA, 18 nt, Mycobacterium bovis subsp bovis AF2122/97
ccuuguucccgaaacccg

SEQ ID NO: 1186286 - RNA, 13 nt, Mycobacterium bovis subsp bovis AF2122/97
ccuuguggacccg

SEQ ID NO: 1186287 - RNA, 14 nt, Mycobacterium bovis subsp bovis AF2122/97
ccuugugaccccgg

SEQ ID NO: 1186288 - RNA, 16 nt, Mycobacterium bovis subsp bovis AF2122/97
ccuuugcacgguggca

SEQ ID NO: 1186289 - RNA, 16 nt, Mycobacterium bovis subsp bovis AF2122/97
ccuuuggccgcgaccg

SEQ ID NO: 1186290 - RNA, 15 nt, Mycobacterium bovis subsp bovis AF2122/97
ccuuuccggccgccu

SEQ ID NO: 1186291 - RNA, 15 nt, Mycobacterium bovis subsp bovis AF2122/97
cgacgccggccuggc

SEQ ID NO: 1186292 - RNA, 17 nt, Mycobacterium bovis subsp bovis AF2122/97
cgacgccuugucggcgu

SEQ ID NO: 1186293 - RNA, 13 nt, Mycobacterium bovis subsp bovis AF2122/97
cgacgccgcgcag

SEQ ID NO: 1186294 - RNA, 16 nt, Mycobacterium bovis subsp bovis AF2122/97
cgacgccgccggcccc

SEQ ID NO: 1186295 - RNA, 14 nt, Mycobacterium bovis subsp bovis AF2122/97
cgacgccgccggcg

SEQ ID NO: 1186296 - RNA, 14 nt, Mycobacterium bovis subsp bovis AF2122/97
cgacgccgcgcagc

SEQ ID NO: 1186297 - RNA, 18 nt, Mycobacterium bovis subsp bovis AF2122/97
cgacgccgagaccgccgc

SEQ ID NO: 1186298 - RNA, 17 nt, Mycobacterium bovis subsp bovis AF2122/97
cgacgccgccacccggc

SEQ ID NO: 1186299 - RNA, 21 nt, Mycobacterium bovis subsp bovis AF2122/97
cgacgccgccacccggcgggc

SEQ ID NO: 1186300 - RNA, 22 nt, Mycobacterium bovis subsp bovis AF2122/97
cgacgccgccacccggcgggcg

SEQ ID NO: 1186301 - RNA, 19 nt, Mycobacterium bovis subsp bovis AF2122/97
cgacgcccgauacgccacc

SEQ ID NO: 1186302 - RNA, 17 nt, Mycobacterium bovis subsp bovis AF2122/97
cgacgcgucgccggccg

SEQ ID NO: 1186303 - RNA, 22 nt, Mycobacterium bovis subsp bovis AF2122/97
cgacgcguggcauccagcagcg

SEQ ID NO: 1186304 - RNA, 16 nt, Mycobacterium bovis subsp bovis AF2122/97
cgacgcggccggccgc

SEQ ID NO: 1186305 - RNA, 15 nt, Mycobacterium bovis subsp bovis AF2122/97
cgacgcucgcugcag

SEQ ID NO: 1186306 - RNA, 22 nt, Mycobacterium bovis subsp bovis AF2122/97
cgacgcgcgcuugggguugggc

SEQ ID NO: 1186307 - RNA, 15 nt, Mycobacterium bovis subsp bovis AF2122/97
cgacgcgacacacgc

SEQ ID NO: 1186308 - RNA, 15 nt, Mycobacterium bovis subsp bovis AF2122/97
cgacgcugccgccag

SEQ ID NO: 1186309 - RNA, 23 nt, Mycobacterium bovis subsp bovis AF2122/97
cgacgcugccgccaggcucgagg

SEQ ID NO: 1186310 - RNA, 12 nt, Mycobacterium bovis subsp bovis AF2122/97
cgacggcggccg

SEQ ID NO: 1186311 - RNA, 12 nt, Mycobacterium bovis subsp bovis AF2122/97
cgacggcugacc

SEQ ID NO: 1186312 - RNA, 23 nt, Mycobacterium bovis subsp bovis AF2122/97
cgacggccuggggcagccgggcg

SEQ ID NO: 1186313 - RNA, 14 nt, Mycobacterium bovis subsp bovis AF2122/97
cgacggccgcggcg

SEQ ID NO: 1186314 - RNA, 15 nt, Mycobacterium bovis subsp bovis AF2122/97
cgacggccggcaagc

SEQ ID NO: 1186315 - RNA, 19 nt, Mycobacterium bovis subsp bovis AF2122/97
cgacggccaucgugcggca

SEQ ID NO: 1186316 - RNA, 14 nt, Mycobacterium bovis subsp bovis AF2122/97
cgacggccgccagc

SEQ ID NO: 1186317 - RNA, 16 nt, Mycobacterium bovis subsp bovis AF2122/97
cgacggccgccagcag

SEQ ID NO: 1186318 - RNA, 17 nt, Mycobacterium bovis subsp bovis AF2122/97
cgacggcccucgagcag

SEQ ID NO: 1186319 - RNA, 13 nt, Mycobacterium bovis subsp bovis AF2122/97
cgacggccaagau

SEQ ID NO: 1186320 - RNA, 13 nt, Mycobacterium bovis subsp bovis AF2122/97
cgacggccacccc

SEQ ID NO: 1186321 - RNA, 18 nt, Mycobacterium bovis subsp bovis AF2122/97
cgacggcaaugcggggca

SEQ ID NO: 1186322 - RNA, 16 nt, Mycobacterium bovis subsp bovis AF2122/97
cgacggcagugcugca

SEQ ID NO: 1186323 - RNA, 20 nt, Mycobacterium bovis subsp bovis AF2122/97
cgacggcauguaccgaccgc

SEQ ID NO: 1186324 - RNA, 16 nt, Mycobacterium bovis subsp bovis AF2122/97
cgacgggggucgggcg

SEQ ID NO: 1186325 - RNA, 13 nt, Mycobacterium bovis subsp bovis AF2122/97
cgacggucggcgg

SEQ ID NO: 1186326 - RNA, 20 nt, Mycobacterium bovis subsp bovis AF2122/97
cgacggucaaggugcgccgc

SEQ ID NO: 1186327 - RNA, 18 nt, Mycobacterium bovis subsp bovis AF2122/97
cgacggucagguccuggg

SEQ ID NO: 1186328 - RNA, 17 nt, Mycobacterium bovis subsp bovis AF2122/97
cgacggucuggcccgcg

SEQ ID NO: 1186329 - RNA, 17 nt, Mycobacterium bovis subsp bovis AF2122/97
cgacggugaaccaccac

SEQ ID NO: 1186330 - RNA, 14 nt, Mycobacterium bovis subsp bovis AF2122/97
cgacgguguccgga

SEQ ID NO: 1186331 - RNA, 15 nt, Mycobacterium bovis subsp bovis AF2122/97
cgacggugccaccgc

SEQ ID NO: 1186332 - RNA, 18 nt, Mycobacterium bovis subsp bovis AF2122/97
cgacggugaccggaucca

SEQ ID NO: 1186333 - RNA, 22 nt, Mycobacterium bovis subsp bovis AF2122/97
cgacgguuacccagccgugcuu

SEQ ID NO: 1186334 - RNA, 18 nt, Mycobacterium bovis subsp bovis AF2122/97
cgacgguucccagcuucc

SEQ ID NO: 1186335 - RNA, 11 nt, Mycobacterium bovis subsp bovis AF2122/97
cgacgacugga

SEQ ID NO: 1186336 - RNA, 14 nt, Mycobacterium bovis subsp bovis AF2122/97
cgacgagauccagc

SEQ ID NO: 1186337 - RNA, 21 nt, Mycobacterium bovis subsp bovis AF2122/97
cgacgagauacggccaccagg

SEQ ID NO: 1186338 - RNA, 14 nt, Mycobacterium bovis subsp bovis AF2122/97
cgacgaccagcaga

SEQ ID NO: 1186339 - RNA, 12 nt, Mycobacterium bovis subsp bovis AF2122/97
cgacgaccaccu

SEQ ID NO: 1186340 - RNA, 23 nt, Mycobacterium bovis subsp bovis AF2122/97
cgacgaccaccuucugacgcggc

SEQ ID NO: 1186341 - RNA, 13 nt, Mycobacterium bovis subsp bovis AF2122/97
cgacgaccagcag

SEQ ID NO: 1186342 - RNA, 22 nt, Mycobacterium bovis subsp bovis AF2122/97
cgacgacgccaaugccgcggag

SEQ ID NO: 1186343 - RNA, 15 nt, Mycobacterium bovis subsp bovis AF2122/97
cgacgauccacggcg

SEQ ID NO: 1186344 - RNA, 16 nt, Mycobacterium bovis subsp bovis AF2122/97
cgacgaucagcgagua

SEQ ID NO: 1186345 - RNA, 15 nt, Mycobacterium bovis subsp bovis AF2122/97
cgacgaucagcgagu

SEQ ID NO: 1186346 - RNA, 14 nt, Mycobacterium bovis subsp bovis AF2122/97
cgacgagucggcgg

SEQ ID NO: 1186347 - RNA, 17 nt, Mycobacterium bovis subsp bovis AF2122/97
cgacgagucggcgggcg

SEQ ID NO: 1186348 - RNA, 20 nt, Mycobacterium bovis subsp bovis AF2122/97
cgacgagcaucuucgcgcag

SEQ ID NO: 1186349 - RNA, 18 nt, Mycobacterium bovis subsp bovis AF2122/97
cgacgagauugccgggcc

SEQ ID NO: 1186350 - RNA, 17 nt, Mycobacterium bovis subsp bovis AF2122/97
cgacgccagcugcccga

SEQ ID NO: 1186351 - RNA, 16 nt, Mycobacterium bovis subsp bovis AF2122/97
cgacgccaugagcgcg

SEQ ID NO: 1186352 - RNA, 15 nt, Mycobacterium bovis subsp bovis AF2122/97
cgacgccaacgccag

SEQ ID NO: 1186353 - RNA, 14 nt, Mycobacterium bovis subsp bovis AF2122/97
cgacgaugcgggcg

SEQ ID NO: 1186354 - RNA, 14 nt, Mycobacterium bovis subsp bovis AF2122/97
cgacgaugaugccg

SEQ ID NO: 1186355 - RNA, 14 nt, Mycobacterium bovis subsp bovis AF2122/97
cgacgaugacgcgc

SEQ ID NO: 1186356 - RNA, 17 nt, Mycobacterium bovis subsp bovis AF2122/97
cgacgaucucgccggcg

SEQ ID NO: 1186357 - RNA, 21 nt, Mycobacterium bovis subsp bovis AF2122/97
cgacgcacaggcgacggcccu

SEQ ID NO: 1186358 - RNA, 14 nt, Mycobacterium bovis subsp bovis AF2122/97
cgacgcaccaacgc

SEQ ID NO: 1186359 - RNA, 20 nt, Mycobacterium bovis subsp bovis AF2122/97
cgacgauuuuggcugcaguc

SEQ ID NO: 1186360 - RNA, 17 nt, Mycobacterium bovis subsp bovis AF2122/97
cgaccucacccacccgc

SEQ ID NO: 1186361 - RNA, 21 nt, Mycobacterium bovis subsp bovis AF2122/97
cgaccuccaccaaugcuccug

SEQ ID NO: 1186362 - RNA, 14 nt, Mycobacterium bovis subsp bovis AF2122/97
cgaccuccacgccc

SEQ ID NO: 1186363 - RNA, 18 nt, Mycobacterium bovis subsp bovis AF2122/97
cgaccuccacgcccuggc

SEQ ID NO: 1186364 - RNA, 17 nt, Mycobacterium bovis subsp bovis AF2122/97
cgaccuccacgcgccac

SEQ ID NO: 1186365 - RNA, 15 nt, Mycobacterium bovis subsp bovis AF2122/97
cgaccuccaccaaug

SEQ ID NO: 1186366 - RNA, 21 nt, Mycobacterium bovis subsp bovis AF2122/97
cgaccuccggaaucgcccggg

SEQ ID NO: 1186367 - RNA, 21 nt, Mycobacterium bovis subsp bovis AF2122/97
cgaccuccucgaugaccggcg

SEQ ID NO: 1186368 - RNA, 22 nt, Mycobacterium bovis subsp bovis AF2122/97
cgaccuccucgaugaccggcga

SEQ ID NO: 1186369 - RNA, 16 nt, Mycobacterium bovis subsp bovis AF2122/97
cgaccucgcgggcgau

SEQ ID NO: 1186370 - RNA, 16 nt, Mycobacterium bovis subsp bovis AF2122/97
cgaccucgucggccga

SEQ ID NO: 1186371 - RNA, 21 nt, Mycobacterium bovis subsp bovis AF2122/97
cgaccugcucgauacggcccu

SEQ ID NO: 1186372 - RNA, 16 nt, Mycobacterium bovis subsp bovis AF2122/97
cgaccugcucauccac

SEQ ID NO: 1186373 - RNA, 20 nt, Mycobacterium bovis subsp bovis AF2122/97
cgaccucguucgucaccacg

SEQ ID NO: 1186374 - RNA, 19 nt, Mycobacterium bovis subsp bovis AF2122/97
cgacgacaaggugugguga

SEQ ID NO: 1186375 - RNA, 22 nt, Mycobacterium bovis subsp bovis AF2122/97
cgacgaccacaccacgauggcg

SEQ ID NO: 1186376 - RNA, 17 nt, Mycobacterium bovis subsp bovis AF2122/97
cgacgaacugcagccau

SEQ ID NO: 1186377 - RNA, 22 nt, Mycobacterium bovis subsp bovis AF2122/97
cgaccuuggacacuugaagugu

SEQ ID NO: 1186378 - RNA, 15 nt, Mycobacterium bovis subsp bovis AF2122/97
cgacgaacaccagcg

SEQ ID NO: 1186379 - RNA, 16 nt, Mycobacterium bovis subsp bovis AF2122/97
cgaccagcggccgacc

SEQ ID NO: 1186380 - RNA, 22 nt, Mycobacterium bovis subsp bovis AF2122/97
cgaccagccccgcuggucgacc

SEQ ID NO: 1186381 - RNA, 20 nt, Mycobacterium bovis subsp bovis AF2122/97
cgaccagcucagcugcggau

SEQ ID NO: 1186382 - RNA, 20 nt, Mycobacterium bovis subsp bovis AF2122/97
cgaccaggaccggcugcagg

SEQ ID NO: 1186383 - RNA, 22 nt, Mycobacterium bovis subsp bovis AF2122/97
cgaccagaggcgugucgacucc

SEQ ID NO: 1186384 - RNA, 11 nt, Mycobacterium bovis subsp bovis AF2122/97
cgaccagcaga

SEQ ID NO: 1186385 - RNA, 13 nt, Mycobacterium bovis subsp bovis AF2122/97
cgaccaggccacu

SEQ ID NO: 1186386 - RNA, 12 nt, Mycobacterium bovis subsp bovis AF2122/97
cgaccagggccg

SEQ ID NO: 1186387 - RNA, 14 nt, Mycobacterium bovis subsp bovis AF2122/97
cgaccagugguggc

SEQ ID NO: 1186388 - RNA, 16 nt, Mycobacterium bovis subsp bovis AF2122/97
cgaccaucgggacgcc

SEQ ID NO: 1186389 - RNA, 16 nt, Mycobacterium bovis subsp bovis AF2122/97
cgaccaugguagcgcc

SEQ ID NO: 1186390 - RNA, 18 nt, Mycobacterium bovis subsp bovis AF2122/97
cgaccacuccacgcagcc

SEQ ID NO: 1186391 - RNA, 16 nt, Mycobacterium bovis subsp bovis AF2122/97
cgaccacgccgccggc

SEQ ID NO: 1186392 - RNA, 18 nt, Mycobacterium bovis subsp bovis AF2122/97
cgaccacgccgccggcgc

SEQ ID NO: 1186393 - RNA, 13 nt, Mycobacterium bovis subsp bovis AF2122/97
cgaccaccgccga

SEQ ID NO: 1186394 - RNA, 16 nt, Mycobacterium bovis subsp bovis AF2122/97
cgaccaccggaucgcc

SEQ ID NO: 1186395 - RNA, 19 nt, Mycobacterium bovis subsp bovis AF2122/97
cgaccaccucagcugcgga

SEQ ID NO: 1186396 - RNA, 16 nt, Mycobacterium bovis subsp bovis AF2122/97
cgaccacgcaccgccc

SEQ ID NO: 1186397 - RNA, 22 nt, Mycobacterium bovis subsp bovis AF2122/97
cgaccaccugcugcacggucau

SEQ ID NO: 1186398 - RNA, 15 nt, Mycobacterium bovis subsp bovis AF2122/97
cgaccaccagcgccg

SEQ ID NO: 1186399 - RNA, 18 nt, Mycobacterium bovis subsp bovis AF2122/97
cgaccaccagcgccgacc

SEQ ID NO: 1186400 - RNA, 22 nt, Mycobacterium bovis subsp bovis AF2122/97
cgaccacaucaugccagccguc

SEQ ID NO: 1186401 - RNA, 12 nt, Mycobacterium bovis subsp bovis AF2122/97
cgaccaccaccg

SEQ ID NO: 1186402 - RNA, 19 nt, Mycobacterium bovis subsp bovis AF2122/97
cgaccaaggccgaccugua

SEQ ID NO: 1186403 - RNA, 23 nt, Mycobacterium bovis subsp bovis AF2122/97
cgaccaaguugaccuucaccugg

SEQ ID NO: 1186404 - RNA, 16 nt, Mycobacterium bovis subsp bovis AF2122/97
cgacauugccacggcg

SEQ ID NO: 1186405 - RNA, 20 nt, Mycobacterium bovis subsp bovis AF2122/97
cgaccaaaccgacgcgggcc

SEQ ID NO: 1186406 - RNA, 12 nt, Mycobacterium bovis subsp bovis AF2122/97
cgaccccgcgcu

SEQ ID NO: 1186407 - RNA, 20 nt, Mycobacterium bovis subsp bovis AF2122/97
cgaccccgaacauccgccgc

SEQ ID NO: 1186408 - RNA, 13 nt, Mycobacterium bovis subsp bovis AF2122/97
cgaccccggcccc

SEQ ID NO: 1186409 - RNA, 14 nt, Mycobacterium bovis subsp bovis AF2122/97
cgaccccggccccg

SEQ ID NO: 1186410 - RNA, 17 nt, Mycobacterium bovis subsp bovis AF2122/97
cgaccccgccgagcggu

SEQ ID NO: 1186411 - RNA, 12 nt, Mycobacterium bovis subsp bovis AF2122/97
cgacccagcggu

SEQ ID NO: 1186412 - RNA, 22 nt, Mycobacterium bovis subsp bovis AF2122/97
cgacccgccgacgccgccggcc

SEQ ID NO: 1186413 - RNA, 15 nt, Mycobacterium bovis subsp bovis AF2122/97
cgacccgccgcgccc

SEQ ID NO: 1186414 - RNA, 18 nt, Mycobacterium bovis subsp bovis AF2122/97
cgacccgccgcgcccggc

SEQ ID NO: 1186415 - RNA, 18 nt, Mycobacterium bovis subsp bovis AF2122/97
cgacccgcagaccgccac

SEQ ID NO: 1186416 - RNA, 15 nt, Mycobacterium bovis subsp bovis AF2122/97
cgacccgaugaccca

SEQ ID NO: 1186417 - RNA, 18 nt, Mycobacterium bovis subsp bovis AF2122/97
cgacccgcgcgccggcga

SEQ ID NO: 1186418 - RNA, 13 nt, Mycobacterium bovis subsp bovis AF2122/97
cgacccgacgcug

SEQ ID NO: 1186419 - RNA, 22 nt, Mycobacterium bovis subsp bovis AF2122/97
cgacccgaucaccuucggccga

SEQ ID NO: 1186420 - RNA, 21 nt, Mycobacterium bovis subsp bovis AF2122/97
cgaccccggcgguaccgccgc

SEQ ID NO: 1186421 - RNA, 19 nt, Mycobacterium bovis subsp bovis AF2122/97
cgaccccucacccagcugg

SEQ ID NO: 1186422 - RNA, 15 nt, Mycobacterium bovis subsp bovis AF2122/97
cgaccgccaccgcca

SEQ ID NO: 1186423 - RNA, 23 nt, Mycobacterium bovis subsp bovis AF2122/97
cgaccgcauccggucucggccga

SEQ ID NO: 1186424 - RNA, 15 nt, Mycobacterium bovis subsp bovis AF2122/97
cgaccgccagcgugg

SEQ ID NO: 1186425 - RNA, 17 nt, Mycobacterium bovis subsp bovis AF2122/97
cgaccgauacaccgacg

SEQ ID NO: 1186426 - RNA, 18 nt, Mycobacterium bovis subsp bovis AF2122/97
cgaccgauagcuggccga

SEQ ID NO: 1186427 - RNA, 17 nt, Mycobacterium bovis subsp bovis AF2122/97
cgaccgcaccgugccga

SEQ ID NO: 1186428 - RNA, 14 nt, Mycobacterium bovis subsp bovis AF2122/97
cgaccgagacggcg

SEQ ID NO: 1186429 - RNA, 24 nt, Mycobacterium bovis subsp bovis AF2122/97
cgaccgaaacggggcgacguccgc

SEQ ID NO: 1186430 - RNA, 16 nt, Mycobacterium bovis subsp bovis AF2122/97
cgaccgaaagccgcac

SEQ ID NO: 1186431 - RNA, 13 nt, Mycobacterium bovis subsp bovis AF2122/97
cgacccgggccgc

SEQ ID NO: 1186432 - RNA, 20 nt, Mycobacterium bovis subsp bovis AF2122/97
cgacccgggucggcacgacc

SEQ ID NO: 1186433 - RNA, 19 nt, Mycobacterium bovis subsp bovis AF2122/97
cgacccgucgaacgcgcgc

SEQ ID NO: 1186434 - RNA, 20 nt, Mycobacterium bovis subsp bovis AF2122/97
cgacccuagauaugcacccg

SEQ ID NO: 1186435 - RNA, 22 nt, Mycobacterium bovis subsp bovis AF2122/97
cgacccuagauaugcacccgca

SEQ ID NO: 1186436 - RNA, 23 nt, Mycobacterium bovis subsp bovis AF2122/97
cgacccuagauaugcacccgcac

SEQ ID NO: 1186437 - RNA, 15 nt, Mycobacterium bovis subsp bovis AF2122/97
cgaccgcggccccgc

SEQ ID NO: 1186438 - RNA, 16 nt, Mycobacterium bovis subsp bovis AF2122/97
cgaccgcggccccgcc

SEQ ID NO: 1186439 - RNA, 14 nt, Mycobacterium bovis subsp bovis AF2122/97
cgaccgcggucgcu

SEQ ID NO: 1186440 - RNA, 11 nt, Mycobacterium bovis subsp bovis AF2122/97
cgaccgcccgc

SEQ ID NO: 1186441 - RNA, 15 nt, Mycobacterium bovis subsp bovis AF2122/97
cgaccgccgagcggg

SEQ ID NO: 1186442 - RNA, 16 nt, Mycobacterium bovis subsp bovis AF2122/97
cgaccgcgagcaucug

SEQ ID NO: 1186443 - RNA, 18 nt, Mycobacterium bovis subsp bovis AF2122/97
cgaccgccggaccgccgc

SEQ ID NO: 1186444 - RNA, 16 nt, Mycobacterium bovis subsp bovis AF2122/97
cgaccggcacccgcgg

SEQ ID NO: 1186445 - RNA, 20 nt, Mycobacterium bovis subsp bovis AF2122/97
cgaccggcccgcauccgcac

SEQ ID NO: 1186446 - RNA, 13 nt, Mycobacterium bovis subsp bovis AF2122/97
cgaccggccggcc

SEQ ID NO: 1186447 - RNA, 16 nt, Mycobacterium bovis subsp bovis AF2122/97
cgaccggcgaccggcg

SEQ ID NO: 1186448 - RNA, 21 nt, Mycobacterium bovis subsp bovis AF2122/97
cgaccgcguacaggccggcca

SEQ ID NO: 1186449 - RNA, 15 nt, Mycobacterium bovis subsp bovis AF2122/97
cgaccggaccggggg

SEQ ID NO: 1186450 - RNA, 15 nt, Mycobacterium bovis subsp bovis AF2122/97
cgaccggacgaucag

SEQ ID NO: 1186451 - RNA, 12 nt, Mycobacterium bovis subsp bovis AF2122/97
cgaccgcugagg

SEQ ID NO: 1186452 - RNA, 14 nt, Mycobacterium bovis subsp bovis AF2122/97
cgaccgcucccggu

SEQ ID NO: 1186453 - RNA, 15 nt, Mycobacterium bovis subsp bovis AF2122/97
cgaccggcuaccggc

SEQ ID NO: 1186454 - RNA, 17 nt, Mycobacterium bovis subsp bovis AF2122/97
cgaccgggcccccaggu

SEQ ID NO: 1186455 - RNA, 18 nt, Mycobacterium bovis subsp bovis AF2122/97
cgaccggucuggcgauga

SEQ ID NO: 1186456 - RNA, 15 nt, Mycobacterium bovis subsp bovis AF2122/97
cgaccgguggcaccg

SEQ ID NO: 1186457 - RNA, 21 nt, Mycobacterium bovis subsp bovis AF2122/97
cgaccgguggcaccggcggcg

SEQ ID NO: 1186458 - RNA, 16 nt, Mycobacterium bovis subsp bovis AF2122/97
cgaccguauugaccag

SEQ ID NO: 1186459 - RNA, 16 nt, Mycobacterium bovis subsp bovis AF2122/97
cgaccgucgcgcugcc

SEQ ID NO: 1186460 - RNA, 17 nt, Mycobacterium bovis subsp bovis AF2122/97
cgaccgucgucgugcag

SEQ ID NO: 1186461 - RNA, 22 nt, Mycobacterium bovis subsp bovis AF2122/97
cgaccgucguccagacgccacu

SEQ ID NO: 1186462 - RNA, 21 nt, Mycobacterium bovis subsp bovis AF2122/97
cgaccguccgggucaccagcg

SEQ ID NO: 1186463 - RNA, 19 nt, Mycobacterium bovis subsp bovis AF2122/97
cgaccgugguggucgggcg

SEQ ID NO: 1186464 - RNA, 17 nt, Mycobacterium bovis subsp bovis AF2122/97
cgaccgugcugggcgcc

SEQ ID NO: 1186465 - RNA, 18 nt, Mycobacterium bovis subsp bovis AF2122/97
cgaccgugguggucgggc

SEQ ID NO: 1186466 - RNA, 17 nt, Mycobacterium bovis subsp bovis AF2122/97
cgaagcggugacccacu

SEQ ID NO: 1186467 - RNA, 21 nt, Mycobacterium bovis subsp bovis AF2122/97
cgaagcgggcggaaacaagca

SEQ ID NO: 1186468 - RNA, 22 nt, Mycobacterium bovis subsp bovis AF2122/97
cgaagcccggacaacuucuuua

SEQ ID NO: 1186469 - RNA, 16 nt, Mycobacterium bovis subsp bovis AF2122/97
cgaagcgugcgccgac

SEQ ID NO: 1186470 - RNA, 18 nt, Mycobacterium bovis subsp bovis AF2122/97
cgaagcguucccgguccu

SEQ ID NO: 1186471 - RNA, 14 nt, Mycobacterium bovis subsp bovis AF2122/97
cgaagcccacguuu

SEQ ID NO: 1186472 - RNA, 19 nt, Mycobacterium bovis subsp bovis AF2122/97
cgaagccccgguggcaggg

SEQ ID NO: 1186473 - RNA, 12 nt, Mycobacterium bovis subsp bovis AF2122/97
cgaagcccgaca

SEQ ID NO: 1186474 - RNA, 17 nt, Mycobacterium bovis subsp bovis AF2122/97
cgaagcccgaguugaag

SEQ ID NO: 1186475 - RNA, 15 nt, Mycobacterium bovis subsp bovis AF2122/97
cgaagcaccucccga

SEQ ID NO: 1186476 - RNA, 19 nt, Mycobacterium bovis subsp bovis AF2122/97
cgaagcaucgcguuguagg

SEQ ID NO: 1186477 - RNA, 18 nt, Mycobacterium bovis subsp bovis AF2122/97
cgaagccagaucagccgc

SEQ ID NO: 1186478 - RNA, 17 nt, Mycobacterium bovis subsp bovis AF2122/97
cgaagaagaacucggcg

SEQ ID NO: 1186479 - RNA, 22 nt, Mycobacterium bovis subsp bovis AF2122/97
cgaagaaugggauggcaccacc

SEQ ID NO: 1186480 - RNA, 17 nt, Mycobacterium bovis subsp bovis AF2122/97
cgaacugggggccggca

SEQ ID NO: 1186481 - RNA, 21 nt, Mycobacterium bovis subsp bovis AF2122/97
cgaacugguuucgcaccgugu

SEQ ID NO: 1186482 - RNA, 20 nt, Mycobacterium bovis subsp bovis AF2122/97
cgaaccgguguagcagcgcc

SEQ ID NO: 1186483 - RNA, 22 nt, Mycobacterium bovis subsp bovis AF2122/97
cgaaccugucgaucacggccgu

SEQ ID NO: 1186484 - RNA, 22 nt, Mycobacterium bovis subsp bovis AF2122/97
cgaacgcaccgaaacgccgacc

SEQ ID NO: 1186485 - RNA, 17 nt, Mycobacterium bovis subsp bovis AF2122/97
cgaacgauuucggccca

SEQ ID NO: 1186486 - RNA, 14 nt, Mycobacterium bovis subsp bovis AF2122/97
cgaacgacagcaga

SEQ ID NO: 1186487 - RNA, 18 nt, Mycobacterium bovis subsp bovis AF2122/97
ccuuuugccgcagcaucc

SEQ ID NO: 1186488 - RNA, 19 nt, Mycobacterium bovis subsp bovis AF2122/97
cgaacgggucggcgaccac

SEQ ID NO: 1186489 - RNA, 18 nt, Mycobacterium bovis subsp bovis AF2122/97
cgaacgguagcacggucu

SEQ ID NO: 1186490 - RNA, 18 nt, Mycobacterium bovis subsp bovis AF2122/97
cgaacgucgcggccagca

SEQ ID NO: 1186491 - RNA, 21 nt, Mycobacterium bovis subsp bovis AF2122/97
cgaacgccacggcaucggcca

SEQ ID NO: 1186492 - RNA, 15 nt, Mycobacterium bovis subsp bovis AF2122/97
cgaacgccagcagcu

SEQ ID NO: 1186493 - RNA, 15 nt, Mycobacterium bovis subsp bovis AF2122/97
cgaacgcagccagcg

SEQ ID NO: 1186494 - RNA, 14 nt, Mycobacterium bovis subsp bovis AF2122/97
cgaacgccaccacc

SEQ ID NO: 1186495 - RNA, 14 nt, Mycobacterium bovis subsp bovis AF2122/97
cgaacucgccccgc

SEQ ID NO: 1186496 - RNA, 19 nt, Mycobacterium bovis subsp bovis AF2122/97
cgaacgugcaaccauggcg

SEQ ID NO: 1186497 - RNA, 13 nt, Mycobacterium bovis subsp bovis AF2122/97
cgaaggccgccaa

SEQ ID NO: 1186498 - RNA, 12 nt, Mycobacterium bovis subsp bovis AF2122/97
cgaaggcacugc

SEQ ID NO: 1186499 - RNA, 22 nt, Mycobacterium bovis subsp bovis AF2122/97
cgaaggaugcugucagacggcg

SEQ ID NO: 1186500 - RNA, 20 nt, Mycobacterium bovis subsp bovis AF2122/97
cgaagcuggcgugcagcagg

SEQ ID NO: 1186501 - RNA, 23 nt, Mycobacterium bovis subsp bovis AF2122/97
cgaagcuugacguugccgggcuu

SEQ ID NO: 1186502 - RNA, 15 nt, Mycobacterium bovis subsp bovis AF2122/97
cgaaguuggcuuucg

SEQ ID NO: 1186503 - RNA, 17 nt, Mycobacterium bovis subsp bovis AF2122/97
cgaaucccgcgcccggc

SEQ ID NO: 1186504 - RNA, 17 nt, Mycobacterium bovis subsp bovis AF2122/97
cgaaucccacagcagga

SEQ ID NO: 1186505 - RNA, 16 nt, Mycobacterium bovis subsp bovis AF2122/97
cgaaucaacaggaccg

SEQ ID NO: 1186506 - RNA, 18 nt, Mycobacterium bovis subsp bovis AF2122/97
cgaaugcgggccuccugc

SEQ ID NO: 1186507 - RNA, 14 nt, Mycobacterium bovis subsp bovis AF2122/97
cgaaugcgggugga

SEQ ID NO: 1186508 - RNA, 18 nt, Mycobacterium bovis subsp bovis AF2122/97
cgaaugaucgucccgcgg

SEQ ID NO: 1186509 - RNA, 14 nt, Mycobacterium bovis subsp bovis AF2122/97
cgaaugcugacaug

SEQ ID NO: 1186510 - RNA, 15 nt, Mycobacterium bovis subsp bovis AF2122/97
cgaauucagcugcac

SEQ ID NO: 1186511 - RNA, 23 nt, Mycobacterium bovis subsp bovis AF2122/97
cgaaucggcaguugaacucgacc

SEQ ID NO: 1186512 - RNA, 23 nt, Mycobacterium bovis subsp bovis AF2122/97
cgaaucgugucgccucgaugcca

SEQ ID NO: 1186513 - RNA, 16 nt, Mycobacterium bovis subsp bovis AF2122/97
cgaaucgucaucccga

SEQ ID NO: 1186514 - RNA, 19 nt, Mycobacterium bovis subsp bovis AF2122/97
cgaaucuucugagacugcc

SEQ ID NO: 1186515 - RNA, 21 nt, Mycobacterium bovis subsp bovis AF2122/97
cgaauccucgcgaaaccgccg

SEQ ID NO: 1186516 - RNA, 17 nt, Mycobacterium bovis subsp bovis AF2122/97
cgaaucgagacggccac

SEQ ID NO: 1186517 - RNA, 21 nt, Mycobacterium bovis subsp bovis AF2122/97
cgaaucgcgucgagcgccggc

SEQ ID NO: 1186518 - RNA, 18 nt, Mycobacterium bovis subsp bovis AF2122/97
cgacaggugccagaccag

SEQ ID NO: 1186519 - RNA, 14 nt, Mycobacterium bovis subsp bovis AF2122/97
cgacaggccggcca

SEQ ID NO: 1186520 - RNA, 19 nt, Mycobacterium bovis subsp bovis AF2122/97
cgacaggccggccaccagu

SEQ ID NO: 1186521 - RNA, 18 nt, Mycobacterium bovis subsp bovis AF2122/97
cgacaggcgcccacaaau

SEQ ID NO: 1186522 - RNA, 17 nt, Mycobacterium bovis subsp bovis AF2122/97
cgacaucacucgcgcca

SEQ ID NO: 1186523 - RNA, 15 nt, Mycobacterium bovis subsp bovis AF2122/97
cgacaucaccgaacg

SEQ ID NO: 1186524 - RNA, 16 nt, Mycobacterium bovis subsp bovis AF2122/97
cgacauaggccaccuc

SEQ ID NO: 1186525 - RNA, 23 nt, Mycobacterium bovis subsp bovis AF2122/97
cgacaguuuaccgugccgcccgg

SEQ ID NO: 1186526 - RNA, 20 nt, Mycobacterium bovis subsp bovis AF2122/97
cgacaucgguggcggccucc

SEQ ID NO: 1186527 - RNA, 22 nt, Mycobacterium bovis subsp bovis AF2122/97
cgacaucgguggcggccuccga

SEQ ID NO: 1186528 - RNA, 16 nt, Mycobacterium bovis subsp bovis AF2122/97
cgacaucgucaucagc

SEQ ID NO: 1186529 - RNA, 18 nt, Mycobacterium bovis subsp bovis AF2122/97
cgacaucgugauccccgc

SEQ ID NO: 1186530 - RNA, 20 nt, Mycobacterium bovis subsp bovis AF2122/97
cgacaucauggugaaggcaa

SEQ ID NO: 1186531 - RNA, 19 nt, Mycobacterium bovis subsp bovis AF2122/97
cgacagcggcgacaugauc

SEQ ID NO: 1186532 - RNA, 14 nt, Mycobacterium bovis subsp bovis AF2122/97
cgacagcgcggcgc

SEQ ID NO: 1186533 - RNA, 12 nt, Mycobacterium bovis subsp bovis AF2122/97
cgacagccaccu

SEQ ID NO: 1186534 - RNA, 16 nt, Mycobacterium bovis subsp bovis AF2122/97
cgacagcaucacgccc

SEQ ID NO: 1186535 - RNA, 17 nt, Mycobacterium bovis subsp bovis AF2122/97
cgacagccccaucacca

SEQ ID NO: 1186536 - RNA, 21 nt, Mycobacterium bovis subsp bovis AF2122/97
cgacagcccuaucagccgaga

SEQ ID NO: 1186537 - RNA, 18 nt, Mycobacterium bovis subsp bovis AF2122/97
cgacacgugcaucuguga

SEQ ID NO: 1186538 - RNA, 19 nt, Mycobacterium bovis subsp bovis AF2122/97
cgacacggcucgccggcuc

SEQ ID NO: 1186539 - RNA, 15 nt, Mycobacterium bovis subsp bovis AF2122/97
cgacacgcggcccga

SEQ ID NO: 1186540 - RNA, 15 nt, Mycobacterium bovis subsp bovis AF2122/97
cgacacgccagguga

SEQ ID NO: 1186541 - RNA, 20 nt, Mycobacterium bovis subsp bovis AF2122/97
cgacagcacccggccaccgg

SEQ ID NO: 1186542 - RNA, 12 nt, Mycobacterium bovis subsp bovis AF2122/97
cgacagcagccg

SEQ ID NO: 1186543 - RNA, 23 nt, Mycobacterium bovis subsp bovis AF2122/97
cgacagcagccggugccggucga

SEQ ID NO: 1186544 - RNA, 14 nt, Mycobacterium bovis subsp bovis AF2122/97
cgacaacagccagc

SEQ ID NO: 1186545 - RNA, 13 nt, Mycobacterium bovis subsp bovis AF2122/97
cgacaacacgccg

SEQ ID NO: 1186546 - RNA, 13 nt, Mycobacterium bovis subsp bovis AF2122/97
cgacaacaccacg

SEQ ID NO: 1186547 - RNA, 15 nt, Mycobacterium bovis subsp bovis AF2122/97
cgacaacaccacggu

SEQ ID NO: 1186548 - RNA, 14 nt, Mycobacterium bovis subsp bovis AF2122/97
cgacaacacccacg

SEQ ID NO: 1186549 - RNA, 18 nt, Mycobacterium bovis subsp bovis AF2122/97
cgacaaaccgggcgugcc

SEQ ID NO: 1186550 - RNA, 18 nt, Mycobacterium bovis subsp bovis AF2122/97
cgaauuggcggaacugua

SEQ ID NO: 1186551 - RNA, 16 nt, Mycobacterium bovis subsp bovis AF2122/97
cgacaccgcggugccc

SEQ ID NO: 1186552 - RNA, 19 nt, Mycobacterium bovis subsp bovis AF2122/97
cgacaccgcggugccccgg

SEQ ID NO: 1186553 - RNA, 20 nt, Mycobacterium bovis subsp bovis AF2122/97
cgacaccgcaggugccgugg

SEQ ID NO: 1186554 - RNA, 16 nt, Mycobacterium bovis subsp bovis AF2122/97
cgacaccgccaccacg

SEQ ID NO: 1186555 - RNA, 16 nt, Mycobacterium bovis subsp bovis AF2122/97
cgacaccgcccgaccc

SEQ ID NO: 1186556 - RNA, 14 nt, Mycobacterium bovis subsp bovis AF2122/97
cgacaccggccgcg

SEQ ID NO: 1186557 - RNA, 16 nt, Mycobacterium bovis subsp bovis AF2122/97
cgacaccggccgcgac

SEQ ID NO: 1186558 - RNA, 18 nt, Mycobacterium bovis subsp bovis AF2122/97
cgacaccguccagcagcu

SEQ ID NO: 1186559 - RNA, 15 nt, Mycobacterium bovis subsp bovis AF2122/97
cgacaccguguugcu

SEQ ID NO: 1186560 - RNA, 16 nt, Mycobacterium bovis subsp bovis AF2122/97
cgacaccguguugcug

SEQ ID NO: 1186561 - RNA, 17 nt, Mycobacterium bovis subsp bovis AF2122/97
cgacacccgcauggcag

SEQ ID NO: 1186562 - RNA, 22 nt, Mycobacterium bovis subsp bovis AF2122/97
cgacacccgcauggcagcggcg

SEQ ID NO: 1186563 - RNA, 14 nt, Mycobacterium bovis subsp bovis AF2122/97
cgacacccugggug

SEQ ID NO: 1186564 - RNA, 23 nt, Mycobacterium bovis subsp bovis AF2122/97
cgacacccugggugccggcagcg

SEQ ID NO: 1186565 - RNA, 20 nt, Mycobacterium bovis subsp bovis AF2122/97
cgacaccgagccacgaccca

SEQ ID NO: 1186566 - RNA, 21 nt, Mycobacterium bovis subsp bovis AF2122/97
cgacaccagaucguuccaggc

SEQ ID NO: 1186567 - RNA, 13 nt, Mycobacterium bovis subsp bovis AF2122/97
cgacaccaccauu

SEQ ID NO: 1186568 - RNA, 14 nt, Mycobacterium bovis subsp bovis AF2122/97
cgacaccaccggcg

SEQ ID NO: 1186569 - RNA, 12 nt, Mycobacterium bovis subsp bovis AF2122/97
cgacaccaccag

SEQ ID NO: 1186570 - RNA, 12 nt, Mycobacterium bovis subsp bovis AF2122/97
cgacacacccac

SEQ ID NO: 1186571 - RNA, 15 nt, Mycobacterium bovis subsp bovis AF2122/97
cgacaaucaccaacg

SEQ ID NO: 1186572 - RNA, 22 nt, Mycobacterium bovis subsp bovis AF2122/97
cgacaagugcacgaaguccugg

SEQ ID NO: 1186573 - RNA, 17 nt, Mycobacterium bovis subsp bovis AF2122/97
cgacaagaauggccgcc

SEQ ID NO: 1186574 - RNA, 19 nt, Mycobacterium bovis subsp bovis AF2122/97
cauacucugcgacaccacg

SEQ ID NO: 1186575 - RNA, 19 nt, Mycobacterium bovis subsp bovis AF2122/97
cagugccaauuccagcccc

SEQ ID NO: 1186576 - RNA, 15 nt, Mycobacterium bovis subsp bovis AF2122/97
cagugccacgccuga

SEQ ID NO: 1186577 - RNA, 12 nt, Mycobacterium bovis subsp bovis AF2122/97
cagugcaggcgg

SEQ ID NO: 1186578 - RNA, 22 nt, Mycobacterium bovis subsp bovis AF2122/97
cauagcaccucgaugaugcgcu

SEQ ID NO: 1186579 - RNA, 19 nt, Mycobacterium bovis subsp bovis AF2122/97
cauagcaauccgcacagcg

SEQ ID NO: 1186580 - RNA, 16 nt, Mycobacterium bovis subsp bovis AF2122/97
cauagacagggccgcu

SEQ ID NO: 1186581 - RNA, 18 nt, Mycobacterium bovis subsp bovis AF2122/97
cauaggccgacggguugg

SEQ ID NO: 1186582 - RNA, 16 nt, Mycobacterium bovis subsp bovis AF2122/97
cauaggccugcagccg

SEQ ID NO: 1186583 - RNA, 16 nt, Mycobacterium bovis subsp bovis AF2122/97
cauagguaugcccgga

SEQ ID NO: 1186584 - RNA, 16 nt, Mycobacterium bovis subsp bovis AF2122/97
cauaggugcggggccg

SEQ ID NO: 1186585 - RNA, 22 nt, Mycobacterium bovis subsp bovis AF2122/97
cauagguuugggcacggaacgc

SEQ ID NO: 1186586 - RNA, 18 nt, Mycobacterium bovis subsp bovis AF2122/97
cauagccguugcgggcca

SEQ ID NO: 1186587 - RNA, 11 nt, Mycobacterium bovis subsp bovis AF2122/97
cauagcugccg

SEQ ID NO: 1186588 - RNA, 17 nt, Mycobacterium bovis subsp bovis AF2122/97
cauagcgccgcgcccac

SEQ ID NO: 1186589 - RNA, 17 nt, Mycobacterium bovis subsp bovis AF2122/97
cauauccgccccagcug

SEQ ID NO: 1186590 - RNA, 13 nt, Mycobacterium bovis subsp bovis AF2122/97
cauaucaaccccg

SEQ ID NO: 1186591 - RNA, 15 nt, Mycobacterium bovis subsp bovis AF2122/97
caucaacaucggccc

SEQ ID NO: 1186592 - RNA, 17 nt, Mycobacterium bovis subsp bovis AF2122/97
caucaacaucggcccgc

SEQ ID NO: 1186593 - RNA, 19 nt, Mycobacterium bovis subsp bovis AF2122/97
caucaacaucggcccgcug

SEQ ID NO: 1186594 - RNA, 11 nt, Mycobacterium bovis subsp bovis AF2122/97
caucaccagcg

SEQ ID NO: 1186595 - RNA, 20 nt, Mycobacterium bovis subsp bovis AF2122/97
caucaccacuggacccgccc

SEQ ID NO: 1186596 - RNA, 14 nt, Mycobacterium bovis subsp bovis AF2122/97
caucaccaccggca

SEQ ID NO: 1186597 - RNA, 20 nt, Mycobacterium bovis subsp bovis AF2122/97
caucaccaccggcaccgcug

SEQ ID NO: 1186598 - RNA, 17 nt, Mycobacterium bovis subsp bovis AF2122/97
caucaccccggccuugg

SEQ ID NO: 1186599 - RNA, 15 nt, Mycobacterium bovis subsp bovis AF2122/97
caucacacccaucac

SEQ ID NO: 1186600 - RNA, 14 nt, Mycobacterium bovis subsp bovis AF2122/97
caucaccuccgcga

SEQ ID NO: 1186601 - RNA, 20 nt, Mycobacterium bovis subsp bovis AF2122/97
caucaccggcggccccaggg

SEQ ID NO: 1186602 - RNA, 14 nt, Mycobacterium bovis subsp bovis AF2122/97
caucaccgucgccc

SEQ ID NO: 1186603 - RNA, 15 nt, Mycobacterium bovis subsp bovis AF2122/97
caucaccgaccaacg

SEQ ID NO: 1186604 - RNA, 14 nt, Mycobacterium bovis subsp bovis AF2122/97
caucagcagagccc

SEQ ID NO: 1186605 - RNA, 16 nt, Mycobacterium bovis subsp bovis AF2122/97
caucagcagagccccg

SEQ ID NO: 1186606 - RNA, 14 nt, Mycobacterium bovis subsp bovis AF2122/97
caucacucgcgcca

SEQ ID NO: 1186607 - RNA, 19 nt, Mycobacterium bovis subsp bovis AF2122/97
caucgggcgcgguaaccac

SEQ ID NO: 1186608 - RNA, 20 nt, Mycobacterium bovis subsp bovis AF2122/97
caucggcuuugaggcgugca

SEQ ID NO: 1186609 - RNA, 13 nt, Mycobacterium bovis subsp bovis AF2122/97
caucgggagccgc

SEQ ID NO: 1186610 - RNA, 14 nt, Mycobacterium bovis subsp bovis AF2122/97
caucgggagccgca

SEQ ID NO: 1186611 - RNA, 11 nt, Mycobacterium bovis subsp bovis AF2122/97
caucggcgcca

SEQ ID NO: 1186612 - RNA, 21 nt, Mycobacterium bovis subsp bovis AF2122/97
caucggcggcgucgacgucca

SEQ ID NO: 1186613 - RNA, 18 nt, Mycobacterium bovis subsp bovis AF2122/97
caucggcggggcccacac

SEQ ID NO: 1186614 - RNA, 19 nt, Mycobacterium bovis subsp bovis AF2122/97
caucggcgggucuggguca

SEQ ID NO: 1186615 - RNA, 15 nt, Mycobacterium bovis subsp bovis AF2122/97
caucggcucugaugg

SEQ ID NO: 1186616 - RNA, 21 nt, Mycobacterium bovis subsp bovis AF2122/97
caucggcgugcuugcccaggu

SEQ ID NO: 1186617 - RNA, 17 nt, Mycobacterium bovis subsp bovis AF2122/97
caucggucccacugccg

SEQ ID NO: 1186618 - RNA, 18 nt, Mycobacterium bovis subsp bovis AF2122/97
caucggucagcgccgacu

SEQ ID NO: 1186619 - RNA, 14 nt, Mycobacterium bovis subsp bovis AF2122/97
caucggucccacug

SEQ ID NO: 1186620 - RNA, 17 nt, Mycobacterium bovis subsp bovis AF2122/97
caucggugcgggcgcca

SEQ ID NO: 1186621 - RNA, 22 nt, Mycobacterium bovis subsp bovis AF2122/97
caucggugaauguugccgccgc

SEQ ID NO: 1186622 - RNA, 17 nt, Mycobacterium bovis subsp bovis AF2122/97
caucggucagcgcggca

SEQ ID NO: 1186623 - RNA, 21 nt, Mycobacterium bovis subsp bovis AF2122/97
caucggugucuuccuccucga

SEQ ID NO: 1186624 - RNA, 19 nt, Mycobacterium bovis subsp bovis AF2122/97
caucgguguggcccaacac

SEQ ID NO: 1186625 - RNA, 23 nt, Mycobacterium bovis subsp bovis AF2122/97
caucggugaucaaaccggcggcg

SEQ ID NO: 1186626 - RNA, 20 nt, Mycobacterium bovis subsp bovis AF2122/97
caucgguguggcccaacacc

SEQ ID NO: 1186627 - RNA, 15 nt, Mycobacterium bovis subsp bovis AF2122/97
caucgucugguggca

SEQ ID NO: 1186628 - RNA, 19 nt, Mycobacterium bovis subsp bovis AF2122/97
caucggcaucgacugccag

SEQ ID NO: 1186629 - RNA, 16 nt, Mycobacterium bovis subsp bovis AF2122/97
caucggcagcagcgca

SEQ ID NO: 1186630 - RNA, 19 nt, Mycobacterium bovis subsp bovis AF2122/97
caucggcacaggcggccag

SEQ ID NO: 1186631 - RNA, 16 nt, Mycobacterium bovis subsp bovis AF2122/97
caucggcgaccgccug

SEQ ID NO: 1186632 - RNA, 13 nt, Mycobacterium bovis subsp bovis AF2122/97
caucggccucuga

SEQ ID NO: 1186633 - RNA, 16 nt, Mycobacterium bovis subsp bovis AF2122/97
caucggccucugacca

SEQ ID NO: 1186634 - RNA, 17 nt, Mycobacterium bovis subsp bovis AF2122/97
caucggcgaccgccugc

SEQ ID NO: 1186635 - RNA, 23 nt, Mycobacterium bovis subsp bovis AF2122/97
caucggccggcgucagccccgac

SEQ ID NO: 1186636 - RNA, 14 nt, Mycobacterium bovis subsp bovis AF2122/97
caucggccagccgu

SEQ ID NO: 1186637 - RNA, 20 nt, Mycobacterium bovis subsp bovis AF2122/97
caucggccagcuugaggucc

SEQ ID NO: 1186638 - RNA, 18 nt, Mycobacterium bovis subsp bovis AF2122/97
caucggccaucucgucga

SEQ ID NO: 1186639 - RNA, 18 nt, Mycobacterium bovis subsp bovis AF2122/97
caucggcccgaucaccau

SEQ ID NO: 1186640 - RNA, 17 nt, Mycobacterium bovis subsp bovis AF2122/97
caucggcccgcugacca

SEQ ID NO: 1186641 - RNA, 17 nt, Mycobacterium bovis subsp bovis AF2122/97
caucgccgacagcgccu

SEQ ID NO: 1186642 - RNA, 14 nt, Mycobacterium bovis subsp bovis AF2122/97
caucgcccgaugcg

SEQ ID NO: 1186643 - RNA, 20 nt, Mycobacterium bovis subsp bovis AF2122/97
caucgcccgaugcgccagcg

SEQ ID NO: 1186644 - RNA, 23 nt, Mycobacterium bovis subsp bovis AF2122/97
caucgcccugggcgccggcgucc

SEQ ID NO: 1186645 - RNA, 21 nt, Mycobacterium bovis subsp bovis AF2122/97
caucgcuguaggcagccucuc

SEQ ID NO: 1186646 - RNA, 20 nt, Mycobacterium bovis subsp bovis AF2122/97
caucggacagcauguucccc

SEQ ID NO: 1186647 - RNA, 11 nt, Mycobacterium bovis subsp bovis AF2122/97
caucggacagg

SEQ ID NO: 1186648 - RNA, 21 nt, Mycobacterium bovis subsp bovis AF2122/97
caucggaaccguuugacgcgc

SEQ ID NO: 1186649 - RNA, 16 nt, Mycobacterium bovis subsp bovis AF2122/97
caucggaacgugaccg

SEQ ID NO: 1186650 - RNA, 15 nt, Mycobacterium bovis subsp bovis AF2122/97
caucggaucaaagcc

SEQ ID NO: 1186651 - RNA, 20 nt, Mycobacterium bovis subsp bovis AF2122/97
caucggaugaccagugauca

SEQ ID NO: 1186652 - RNA, 20 nt, Mycobacterium bovis subsp bovis AF2122/97
caucgccaaugcgggaaacc

SEQ ID NO: 1186653 - RNA, 13 nt, Mycobacterium bovis subsp bovis AF2122/97
caucgccaccacc

SEQ ID NO: 1186654 - RNA, 15 nt, Mycobacterium bovis subsp bovis AF2122/97
caucgccagccugug

SEQ ID NO: 1186655 - RNA, 13 nt, Mycobacterium bovis subsp bovis AF2122/97
caucgccaccgcg

SEQ ID NO: 1186656 - RNA, 16 nt, Mycobacterium bovis subsp bovis AF2122/97
caucgcccaccgcaac

SEQ ID NO: 1186657 - RNA, 16 nt, Mycobacterium bovis subsp bovis AF2122/97
caucgcccaacaacgc

SEQ ID NO: 1186658 - RNA, 19 nt, Mycobacterium bovis subsp bovis AF2122/97
caucgccagcgccggccag

SEQ ID NO: 1186659 - RNA, 13 nt, Mycobacterium bovis subsp bovis AF2122/97
caucgccagcggc

SEQ ID NO: 1186660 - RNA, 18 nt, Mycobacterium bovis subsp bovis AF2122/97
caucgacguuccagcagu

SEQ ID NO: 1186661 - RNA, 15 nt, Mycobacterium bovis subsp bovis AF2122/97
caucgaaggugcugg

SEQ ID NO: 1186662 - RNA, 16 nt, Mycobacterium bovis subsp bovis AF2122/97
caucgacguuccagca

SEQ ID NO: 1186663 - RNA, 20 nt, Mycobacterium bovis subsp bovis AF2122/97
caucgagcccggacgagugc

SEQ ID NO: 1186664 - RNA, 23 nt, Mycobacterium bovis subsp bovis AF2122/97
caucgagcaccuccacugggucg

SEQ ID NO: 1186665 - RNA, 18 nt, Mycobacterium bovis subsp bovis AF2122/97
caucgagacgagccacgg

SEQ ID NO: 1186666 - RNA, 17 nt, Mycobacterium bovis subsp bovis AF2122/97
caucgacuugccgccgc

SEQ ID NO: 1186667 - RNA, 19 nt, Mycobacterium bovis subsp bovis AF2122/97
caucgagcugaccugguuc

SEQ ID NO: 1186668 - RNA, 20 nt, Mycobacterium bovis subsp bovis AF2122/97
caucgaguccaccaccuggc

SEQ ID NO: 1186669 - RNA, 23 nt, Mycobacterium bovis subsp bovis AF2122/97
caucgagucgaagaaccugagca

SEQ ID NO: 1186670 - RNA, 14 nt, Mycobacterium bovis subsp bovis AF2122/97
caucgaacucugga

SEQ ID NO: 1186671 - RNA, 19 nt, Mycobacterium bovis subsp bovis AF2122/97
caucgaacuucgauucugg

SEQ ID NO: 1186672 - RNA, 21 nt, Mycobacterium bovis subsp bovis AF2122/97
caucgaaaaaccucgacgccc

SEQ ID NO: 1186673 - RNA, 20 nt, Mycobacterium bovis subsp bovis AF2122/97
cauccggccgucggcgggca

SEQ ID NO: 1186674 - RNA, 16 nt, Mycobacterium bovis subsp bovis AF2122/97
cauccgcgacggcgcc

SEQ ID NO: 1186675 - RNA, 18 nt, Mycobacterium bovis subsp bovis AF2122/97
cauccgcgacggcgcccu

SEQ ID NO: 1186676 - RNA, 13 nt, Mycobacterium bovis subsp bovis AF2122/97
caucccgaccagc

SEQ ID NO: 1186677 - RNA, 13 nt, Mycobacterium bovis subsp bovis AF2122/97
cauccgccccgcc

SEQ ID NO: 1186678 - RNA, 14 nt, Mycobacterium bovis subsp bovis AF2122/97
cauccgccccgccc

SEQ ID NO: 1186679 - RNA, 23 nt, Mycobacterium bovis subsp bovis AF2122/97
cauccaggggcgcaacucaucgu

SEQ ID NO: 1186680 - RNA, 14 nt, Mycobacterium bovis subsp bovis AF2122/97
caucccaacccaug

SEQ ID NO: 1186681 - RNA, 15 nt, Mycobacterium bovis subsp bovis AF2122/97
caucccaacgagaug

SEQ ID NO: 1186682 - RNA, 22 nt, Mycobacterium bovis subsp bovis AF2122/97
caucccaacgagaugugagcac

SEQ ID NO: 1186683 - RNA, 20 nt, Mycobacterium bovis subsp bovis AF2122/97
cauccauucggcggcggcgu

SEQ ID NO: 1186684 - RNA, 21 nt, Mycobacterium bovis subsp bovis AF2122/97
cauccauccgggccgcggcca

SEQ ID NO: 1186685 - RNA, 13 nt, Mycobacterium bovis subsp bovis AF2122/97
cauccccgccggc

SEQ ID NO: 1186686 - RNA, 19 nt, Mycobacterium bovis subsp bovis AF2122/97
cauccccagcacaaccagc

SEQ ID NO: 1186687 - RNA, 13 nt, Mycobacterium bovis subsp bovis AF2122/97
caucccagcgaau

SEQ ID NO: 1186688 - RNA, 22 nt, Mycobacterium bovis subsp bovis AF2122/97
caucccagcgaaugcugacaug

SEQ ID NO: 1186689 - RNA, 17 nt, Mycobacterium bovis subsp bovis AF2122/97
cauccgaucgccgcgaa

SEQ ID NO: 1186690 - RNA, 22 nt, Mycobacterium bovis subsp bovis AF2122/97
caucccgcucagcauucaccaa

SEQ ID NO: 1186691 - RNA, 14 nt, Mycobacterium bovis subsp bovis AF2122/97
cauccgaucgccgc

SEQ ID NO: 1186692 - RNA, 19 nt, Mycobacterium bovis subsp bovis AF2122/97
cauccccgguucugcgccc

SEQ ID NO: 1186693 - RNA, 23 nt, Mycobacterium bovis subsp bovis AF2122/97
caucccgaaguagaagcccagga

SEQ ID NO: 1186694 - RNA, 19 nt, Mycobacterium bovis subsp bovis AF2122/97
cauccccuggccagcagag

SEQ ID NO: 1186695 - RNA, 14 nt, Mycobacterium bovis subsp bovis AF2122/97
caucccgagcucua

SEQ ID NO: 1186696 - RNA, 14 nt, Mycobacterium bovis subsp bovis AF2122/97
caucccgccacacc

SEQ ID NO: 1186697 - RNA, 16 nt, Mycobacterium bovis subsp bovis AF2122/97
caucccgaucccggcc

SEQ ID NO: 1186698 - RNA, 16 nt, Mycobacterium bovis subsp bovis AF2122/97
caucccgauccugccc

SEQ ID NO: 1186699 - RNA, 17 nt, Mycobacterium bovis subsp bovis AF2122/97
caucccgauccugccca

SEQ ID NO: 1186700 - RNA, 23 nt, Mycobacterium bovis subsp bovis AF2122/97
caucccgauccugcccaccaucc

SEQ ID NO: 1186701 - RNA, 20 nt, Mycobacterium bovis subsp bovis AF2122/97
caucauggccggaucccagu

SEQ ID NO: 1186702 - RNA, 21 nt, Mycobacterium bovis subsp bovis AF2122/97
cauccaacgaccuccacgccc

SEQ ID NO: 1186703 - RNA, 18 nt, Mycobacterium bovis subsp bovis AF2122/97
cauccagaugcccagcag

SEQ ID NO: 1186704 - RNA, 17 nt, Mycobacterium bovis subsp bovis AF2122/97
cauccagaagccggcca

SEQ ID NO: 1186705 - RNA, 19 nt, Mycobacterium bovis subsp bovis AF2122/97
cauccagagacaugucgcu

SEQ ID NO: 1186706 - RNA, 22 nt, Mycobacterium bovis subsp bovis AF2122/97
cauccagaucggauugccuccg

SEQ ID NO: 1186707 - RNA, 11 nt, Mycobacterium bovis subsp bovis AF2122/97
cauccagccgu

SEQ ID NO: 1186708 - RNA, 20 nt, Mycobacterium bovis subsp bovis AF2122/97
cauccagcgcgcgcugagcc

SEQ ID NO: 1186709 - RNA, 16 nt, Mycobacterium bovis subsp bovis AF2122/97
cauccacuccgccaac

SEQ ID NO: 1186710 - RNA, 18 nt, Mycobacterium bovis subsp bovis AF2122/97
cauccacgcacucacuac

SEQ ID NO: 1186711 - RNA, 13 nt, Mycobacterium bovis subsp bovis AF2122/97
cauccaccgaugg

SEQ ID NO: 1186712 - RNA, 23 nt, Mycobacterium bovis subsp bovis AF2122/97
cauccaccgcagauccccgccac

SEQ ID NO: 1186713 - RNA, 18 nt, Mycobacterium bovis subsp bovis AF2122/97
cauccacaccgcggcggc

SEQ ID NO: 1186714 - RNA, 21 nt, Mycobacterium bovis subsp bovis AF2122/97
caugagcgaccgcgagggcca

SEQ ID NO: 1186715 - RNA, 16 nt, Mycobacterium bovis subsp bovis AF2122/97
caugagcguucagcac

SEQ ID NO: 1186716 - RNA, 14 nt, Mycobacterium bovis subsp bovis AF2122/97
caugaggugagcug

SEQ ID NO: 1186717 - RNA, 21 nt, Mycobacterium bovis subsp bovis AF2122/97
caugaguacaaaccucgguuu

SEQ ID NO: 1186718 - RNA, 13 nt, Mycobacterium bovis subsp bovis AF2122/97
caugaagauccag

SEQ ID NO: 1186719 - RNA, 23 nt, Mycobacterium bovis subsp bovis AF2122/97
caugaaggagaucccccaggcga

SEQ ID NO: 1186720 - RNA, 23 nt, Mycobacterium bovis subsp bovis AF2122/97
caugaccgggcuggccagcgcgc

SEQ ID NO: 1186721 - RNA, 19 nt, Mycobacterium bovis subsp bovis AF2122/97
caugacaccggccaccagc

SEQ ID NO: 1186722 - RNA, 18 nt, Mycobacterium bovis subsp bovis AF2122/97
caugaacaucggccgggu

SEQ ID NO: 1186723 - RNA, 15 nt, Mycobacterium bovis subsp bovis AF2122/97
caugaacaucggccg

SEQ ID NO: 1186724 - RNA, 17 nt, Mycobacterium bovis subsp bovis AF2122/97
caugaacaucggccggg

SEQ ID NO: 1186725 - RNA, 14 nt, Mycobacterium bovis subsp bovis AF2122/97
caucgugcugaagc

SEQ ID NO: 1186726 - RNA, 21 nt, Mycobacterium bovis subsp bovis AF2122/97
caucuugucgagcaccucgaa

SEQ ID NO: 1186727 - RNA, 20 nt, Mycobacterium bovis subsp bovis AF2122/97
caugccuucggccaaccaug

SEQ ID NO: 1186728 - RNA, 22 nt, Mycobacterium bovis subsp bovis AF2122/97
caugccuucggccaaccaugcu

SEQ ID NO: 1186729 - RNA, 17 nt, Mycobacterium bovis subsp bovis AF2122/97
caugcgcaccaguccag

SEQ ID NO: 1186730 - RNA, 20 nt, Mycobacterium bovis subsp bovis AF2122/97
caugcgauucugcguccugc

SEQ ID NO: 1186731 - RNA, 19 nt, Mycobacterium bovis subsp bovis AF2122/97
caugcgauacacggcggcg

SEQ ID NO: 1186732 - RNA, 19 nt, Mycobacterium bovis subsp bovis AF2122/97
caugccggcgcaccacacc

SEQ ID NO: 1186733 - RNA, 17 nt, Mycobacterium bovis subsp bovis AF2122/97
caugccggacugcgauc

SEQ ID NO: 1186734 - RNA, 19 nt, Mycobacterium bovis subsp bovis AF2122/97
caugccgccgaagccgcgc

SEQ ID NO: 1186735 - RNA, 21 nt, Mycobacterium bovis subsp bovis AF2122/97
caugccgccaugcgcaccagu

SEQ ID NO: 1186736 - RNA, 18 nt, Mycobacterium bovis subsp bovis AF2122/97
caugccgcccgcgccgcc

SEQ ID NO: 1186737 - RNA, 17 nt, Mycobacterium bovis subsp bovis AF2122/97
caugccgacgacaacag

SEQ ID NO: 1186738 - RNA, 14 nt, Mycobacterium bovis subsp bovis AF2122/97
caugcccucggcgc

SEQ ID NO: 1186739 - RNA, 22 nt, Mycobacterium bovis subsp bovis AF2122/97
caugcccaggugcguccaggcc

SEQ ID NO: 1186740 - RNA, 18 nt, Mycobacterium bovis subsp bovis AF2122/97
caugcccaucuccaacag

SEQ ID NO: 1186741 - RNA, 18 nt, Mycobacterium bovis subsp bovis AF2122/97
caugccaagcuccaacca

SEQ ID NO: 1186742 - RNA, 24 nt, Mycobacterium bovis subsp bovis AF2122/97
caugccacaacgccucgauggcgg

SEQ ID NO: 1186743 - RNA, 13 nt, Mycobacterium bovis subsp bovis AF2122/97
caugccacacacu

SEQ ID NO: 1186744 - RNA, 14 nt, Mycobacterium bovis subsp bovis AF2122/97
caugccacacacug

SEQ ID NO: 1186745 - RNA, 15 nt, Mycobacterium bovis subsp bovis AF2122/97
caugccacacacugc

SEQ ID NO: 1186746 - RNA, 13 nt, Mycobacterium bovis subsp bovis AF2122/97
caugccagccguc

SEQ ID NO: 1186747 - RNA, 13 nt, Mycobacterium bovis subsp bovis AF2122/97
caugaucggcaga

SEQ ID NO: 1186748 - RNA, 18 nt, Mycobacterium bovis subsp bovis AF2122/97
caugaucacaccgcugcu

SEQ ID NO: 1186749 - RNA, 18 nt, Mycobacterium bovis subsp bovis AF2122/97
caugaucccgcugaccug

SEQ ID NO: 1186750 - RNA, 21 nt, Mycobacterium bovis subsp bovis AF2122/97
caugauggccgucagccaggu

SEQ ID NO: 1186751 - RNA, 15 nt, Mycobacterium bovis subsp bovis AF2122/97
caugaugaugacauc

SEQ ID NO: 1186752 - RNA, 17 nt, Mycobacterium bovis subsp bovis AF2122/97
caugaugugcagcgagu

SEQ ID NO: 1186753 - RNA, 17 nt, Mycobacterium bovis subsp bovis AF2122/97
caugauugccaggaccg

SEQ ID NO: 1186754 - RNA, 15 nt, Mycobacterium bovis subsp bovis AF2122/97
caugcaccucgagcg

SEQ ID NO: 1186755 - RNA, 20 nt, Mycobacterium bovis subsp bovis AF2122/97
caugcacgucaucggcuggc

SEQ ID NO: 1186756 - RNA, 16 nt, Mycobacterium bovis subsp bovis AF2122/97
caugcacgccguagca

SEQ ID NO: 1186757 - RNA, 21 nt, Mycobacterium bovis subsp bovis AF2122/97
caugcacgucaucggcuggcc

SEQ ID NO: 1186758 - RNA, 21 nt, Mycobacterium bovis subsp bovis AF2122/97
caugggccaggucagccgcgc

SEQ ID NO: 1186759 - RNA, 16 nt, Mycobacterium bovis subsp bovis AF2122/97
caugggcgcugccaau

SEQ ID NO: 1186760 - RNA, 17 nt, Mycobacterium bovis subsp bovis AF2122/97
caugggccggcgccgca

SEQ ID NO: 1186761 - RNA, 20 nt, Mycobacterium bovis subsp bovis AF2122/97
caugggaaccgacaucccaa

SEQ ID NO: 1186762 - RNA, 14 nt, Mycobacterium bovis subsp bovis AF2122/97
cauggcggcccggu

SEQ ID NO: 1186763 - RNA, 21 nt, Mycobacterium bovis subsp bovis AF2122/97
caugggaucaggcugggcaga

SEQ ID NO: 1186764 - RNA, 16 nt, Mycobacterium bovis subsp bovis AF2122/97
cauggcgcugggaugu

SEQ ID NO: 1186765 - RNA, 16 nt, Mycobacterium bovis subsp bovis AF2122/97
cauggcgcggguccag

SEQ ID NO: 1186766 - RNA, 21 nt, Mycobacterium bovis subsp bovis AF2122/97
cauggcgcggguccagccacc

SEQ ID NO: 1186767 - RNA, 14 nt, Mycobacterium bovis subsp bovis AF2122/97
cauggcgccgcgcc

SEQ ID NO: 1186768 - RNA, 19 nt, Mycobacterium bovis subsp bovis AF2122/97
cauggugggaaaugaagug

SEQ ID NO: 1186769 - RNA, 19 nt, Mycobacterium bovis subsp bovis AF2122/97
caugguggcgccgaccugg

SEQ ID NO: 1186770 - RNA, 18 nt, Mycobacterium bovis subsp bovis AF2122/97
caugggccggcgccgcac

SEQ ID NO: 1186771 - RNA, 19 nt, Mycobacterium bovis subsp bovis AF2122/97
caugggggcguuggcgggc

SEQ ID NO: 1186772 - RNA, 12 nt, Mycobacterium bovis subsp bovis AF2122/97
caugggguagau

SEQ ID NO: 1186773 - RNA, 17 nt, Mycobacterium bovis subsp bovis AF2122/97
cauggugggccuuccuc

SEQ ID NO: 1186774 - RNA, 18 nt, Mycobacterium bovis subsp bovis AF2122/97
cauggccucccacucacc

SEQ ID NO: 1186775 - RNA, 22 nt, Mycobacterium bovis subsp bovis AF2122/97
caugcuaggaccaccagcgcuc

SEQ ID NO: 1186776 - RNA, 15 nt, Mycobacterium bovis subsp bovis AF2122/97
caugcuaggccaccg

SEQ ID NO: 1186777 - RNA, 13 nt, Mycobacterium bovis subsp bovis AF2122/97
caugcgcuccggc

SEQ ID NO: 1186778 - RNA, 18 nt, Mycobacterium bovis subsp bovis AF2122/97
caugcgcguccagcuggc

SEQ ID NO: 1186779 - RNA, 18 nt, Mycobacterium bovis subsp bovis AF2122/97
caugcgcgcgccggugcu

SEQ ID NO: 1186780 - RNA, 13 nt, Mycobacterium bovis subsp bovis AF2122/97
caugcggccaugg

SEQ ID NO: 1186781 - RNA, 22 nt, Mycobacterium bovis subsp bovis AF2122/97
caugcggcugccucccuuccgc

SEQ ID NO: 1186782 - RNA, 16 nt, Mycobacterium bovis subsp bovis AF2122/97
caugcgggcagcacuc

SEQ ID NO: 1186783 - RNA, 20 nt, Mycobacterium bovis subsp bovis AF2122/97
caugucaaguucgccagcaa

SEQ ID NO: 1186784 - RNA, 13 nt, Mycobacterium bovis subsp bovis AF2122/97
caugucacaccca

SEQ ID NO: 1186785 - RNA, 20 nt, Mycobacterium bovis subsp bovis AF2122/97
caugucagcgcugagccgcu

SEQ ID NO: 1186786 - RNA, 19 nt, Mycobacterium bovis subsp bovis AF2122/97
cauguuuucgagcccaagg

SEQ ID NO: 1186787 - RNA, 19 nt, Mycobacterium bovis subsp bovis AF2122/97
cauguugucgucgccgccg

SEQ ID NO: 1186788 - RNA, 20 nt, Mycobacterium bovis subsp bovis AF2122/97
cauguucuccacgccgaucu

SEQ ID NO: 1186789 - RNA, 22 nt, Mycobacterium bovis subsp bovis AF2122/97
cauguucuuuugcgucugcugg

SEQ ID NO: 1186790 - RNA, 22 nt, Mycobacterium bovis subsp bovis AF2122/97
cauguugaagcgaagccagauc

SEQ ID NO: 1186791 - RNA, 21 nt, Mycobacterium bovis subsp bovis AF2122/97
cauuccagcaggccacugcgu

SEQ ID NO: 1186792 - RNA, 19 nt, Mycobacterium bovis subsp bovis AF2122/97
cauuaaugcggccccgcgc

SEQ ID NO: 1186793 - RNA, 19 nt, Mycobacterium bovis subsp bovis AF2122/97
cauucugcagcgucuccuu

SEQ ID NO: 1186794 - RNA, 20 nt, Mycobacterium bovis subsp bovis AF2122/97
cauucucggccggcggcgcc

SEQ ID NO: 1186795 - RNA, 18 nt, Mycobacterium bovis subsp bovis AF2122/97
cauucccggacccaccaa

SEQ ID NO: 1186796 - RNA, 16 nt, Mycobacterium bovis subsp bovis AF2122/97
cauucccaacacagcc

SEQ ID NO: 1186797 - RNA, 18 nt, Mycobacterium bovis subsp bovis AF2122/97
cauucuucgaucagcggc

SEQ ID NO: 1186798 - RNA, 21 nt, Mycobacterium bovis subsp bovis AF2122/97
cauugaucgacggccagccca

SEQ ID NO: 1186799 - RNA, 14 nt, Mycobacterium bovis subsp bovis AF2122/97
ccaaaaacggcagc

SEQ ID NO: 1186800 - RNA, 15 nt, Mycobacterium bovis subsp bovis AF2122/97
ccaaacuacccgccc

SEQ ID NO: 1186801 - RNA, 17 nt, Mycobacterium bovis subsp bovis AF2122/97
ccaaacuaacggcagcc

SEQ ID NO: 1186802 - RNA, 22 nt, Mycobacterium bovis subsp bovis AF2122/97
ccaaaccggcccgcagcagcau

SEQ ID NO: 1186803 - RNA, 15 nt, Mycobacterium bovis subsp bovis AF2122/97
ccaaaccgucaacuu

SEQ ID NO: 1186804 - RNA, 15 nt, Mycobacterium bovis subsp bovis AF2122/97
ccaaacgccgcccgc

SEQ ID NO: 1186805 - RNA, 16 nt, Mycobacterium bovis subsp bovis AF2122/97
ccaaacgcugcuggca

SEQ ID NO: 1186806 - RNA, 21 nt, Mycobacterium bovis subsp bovis AF2122/97
ccaaacccggcgggcccgccg

SEQ ID NO: 1186807 - RNA, 21 nt, Mycobacterium bovis subsp bovis AF2122/97
ccaaacacccuugcccacggc

SEQ ID NO: 1186808 - RNA, 18 nt, Mycobacterium bovis subsp bovis AF2122/97
ccaaacaccccggccuug

SEQ ID NO: 1186809 - RNA, 23 nt, Mycobacterium bovis subsp bovis AF2122/97
ccaacauguugucgucgccgccg

SEQ ID NO: 1186810 - RNA, 21 nt, Mycobacterium bovis subsp bovis AF2122/97
ccaacaccuguuugagcgcac

SEQ ID NO: 1186811 - RNA, 15 nt, Mycobacterium bovis subsp bovis AF2122/97
ccaacccacccccca

SEQ ID NO: 1186812 - RNA, 15 nt, Mycobacterium bovis subsp bovis AF2122/97
ccaaccagugcagcu

SEQ ID NO: 1186813 - RNA, 13 nt, Mycobacterium bovis subsp bovis AF2122/97
ccaacaccgccag

SEQ ID NO: 1186814 - RNA, 16 nt, Mycobacterium bovis subsp bovis AF2122/97
ccaacaccagcagcac

SEQ ID NO: 1186815 - RNA, 15 nt, Mycobacterium bovis subsp bovis AF2122/97
ccaacaccaggucau

SEQ ID NO: 1186816 - RNA, 16 nt, Mycobacterium bovis subsp bovis AF2122/97
ccaacacgucgagcag

SEQ ID NO: 1186817 - RNA, 22 nt, Mycobacterium bovis subsp bovis AF2122/97
ccaaagcacuucacgaguagcg

SEQ ID NO: 1186818 - RNA, 20 nt, Mycobacterium bovis subsp bovis AF2122/97
ccaaagcgccagcagccacc

SEQ ID NO: 1186819 - RNA, 20 nt, Mycobacterium bovis subsp bovis AF2122/97
ccaaggucuucaggccgcgc

SEQ ID NO: 1186820 - RNA, 21 nt, Mycobacterium bovis subsp bovis AF2122/97
ccaaggugagcagcaagaccg

SEQ ID NO: 1186821 - RNA, 15 nt, Mycobacterium bovis subsp bovis AF2122/97
ccaagguaguucgac

SEQ ID NO: 1186822 - RNA, 20 nt, Mycobacterium bovis subsp bovis AF2122/97
ccaagggauccgaagagcca

SEQ ID NO: 1186823 - RNA, 21 nt, Mycobacterium bovis subsp bovis AF2122/97
ccaaggggcagcgacggcagc

SEQ ID NO: 1186824 - RNA, 15 nt, Mycobacterium bovis subsp bovis AF2122/97
ccaagcucggcccag

SEQ ID NO: 1186825 - RNA, 16 nt, Mycobacterium bovis subsp bovis AF2122/97
ccaagcucggccagca

SEQ ID NO: 1186826 - RNA, 13 nt, Mycobacterium bovis subsp bovis AF2122/97
ccaaggcucagca

SEQ ID NO: 1186827 - RNA, 18 nt, Mycobacterium bovis subsp bovis AF2122/97
ccaaggcucagcagcgcc

SEQ ID NO: 1186828 - RNA, 23 nt, Mycobacterium bovis subsp bovis AF2122/97
ccaagcuaccccgacggcgacca

SEQ ID NO: 1186829 - RNA, 14 nt, Mycobacterium bovis subsp bovis AF2122/97
ccaagcucagggug

SEQ ID NO: 1186830 - RNA, 14 nt, Mycobacterium bovis subsp bovis AF2122/97
ccaagcguccgcug

SEQ ID NO: 1186831 - RNA, 21 nt, Mycobacterium bovis subsp bovis AF2122/97
ccaagccgggugggagcagcc

SEQ ID NO: 1186832 - RNA, 12 nt, Mycobacterium bovis subsp bovis AF2122/97
ccaagccgcggc

SEQ ID NO: 1186833 - RNA, 15 nt, Mycobacterium bovis subsp bovis AF2122/97
ccaagccggagcccg

SEQ ID NO: 1186834 - RNA, 16 nt, Mycobacterium bovis subsp bovis AF2122/97
ccaagccggagcccgg

SEQ ID NO: 1186835 - RNA, 13 nt, Mycobacterium bovis subsp bovis AF2122/97
ccaagcccgccgg

SEQ ID NO: 1186836 - RNA, 15 nt, Mycobacterium bovis subsp bovis AF2122/97
ccaagacgucggcgu

SEQ ID NO: 1186837 - RNA, 21 nt, Mycobacterium bovis subsp bovis AF2122/97
ccaacuuggcggccagccgcu

SEQ ID NO: 1186838 - RNA, 18 nt, Mycobacterium bovis subsp bovis AF2122/97
ccaacucgguucgccccu

SEQ ID NO: 1186839 - RNA, 12 nt, Mycobacterium bovis subsp bovis AF2122/97
ccaacucggcca

SEQ ID NO: 1186840 - RNA, 18 nt, Mycobacterium bovis subsp bovis AF2122/97
ccaacuccucagccgccu

SEQ ID NO: 1186841 - RNA, 21 nt, Mycobacterium bovis subsp bovis AF2122/97
ccaacuccaagaugccgcccc

SEQ ID NO: 1186842 - RNA, 13 nt, Mycobacterium bovis subsp bovis AF2122/97
ccaacuccaccca

SEQ ID NO: 1186843 - RNA, 20 nt, Mycobacterium bovis subsp bovis AF2122/97
ccaacuccagcacccgcugc

SEQ ID NO: 1186844 - RNA, 19 nt, Mycobacterium bovis subsp bovis AF2122/97
ccaacucaagcaauggugc

SEQ ID NO: 1186845 - RNA, 18 nt, Mycobacterium bovis subsp bovis AF2122/97
ccaacucaugggccaacu

SEQ ID NO: 1186846 - RNA, 14 nt, Mycobacterium bovis subsp bovis AF2122/97
ccaaccuacccuga

SEQ ID NO: 1186847 - RNA, 14 nt, Mycobacterium bovis subsp bovis AF2122/97
ccaaccgggccggc

SEQ ID NO: 1186848 - RNA, 15 nt, Mycobacterium bovis subsp bovis AF2122/97
ccaaccgggccggcu

SEQ ID NO: 1186849 - RNA, 19 nt, Mycobacterium bovis subsp bovis AF2122/97
ccaaccgguacuccugggu

SEQ ID NO: 1186850 - RNA, 17 nt, Mycobacterium bovis subsp bovis AF2122/97
ccaaccgguagccaggc

SEQ ID NO: 1186851 - RNA, 14 nt, Mycobacterium bovis subsp bovis AF2122/97
ccaacccggcucgg

SEQ ID NO: 1186852 - RNA, 15 nt, Mycobacterium bovis subsp bovis AF2122/97
ccaacccgggccgcc

SEQ ID NO: 1186853 - RNA, 16 nt, Mycobacterium bovis subsp bovis AF2122/97
ccaacccgggccgcca

SEQ ID NO: 1186854 - RNA, 19 nt, Mycobacterium bovis subsp bovis AF2122/97
ccaccgcggucaccgacgc

SEQ ID NO: 1186855 - RNA, 14 nt, Mycobacterium bovis subsp bovis AF2122/97
ccaccgcggccgcg

SEQ ID NO: 1186856 - RNA, 15 nt, Mycobacterium bovis subsp bovis AF2122/97
ccaccgcgcggcgca

SEQ ID NO: 1186857 - RNA, 21 nt, Mycobacterium bovis subsp bovis AF2122/97
ccaccgcucgucguccggcca

SEQ ID NO: 1186858 - RNA, 21 nt, Mycobacterium bovis subsp bovis AF2122/97
ccaccgcggucaccgacgcag

SEQ ID NO: 1186859 - RNA, 16 nt, Mycobacterium bovis subsp bovis AF2122/97
ccaccgcuugaccccu

SEQ ID NO: 1186860 - RNA, 21 nt, Mycobacterium bovis subsp bovis AF2122/97
ccaccgcugccggcagcgucc

SEQ ID NO: 1186861 - RNA, 12 nt, Mycobacterium bovis subsp bovis AF2122/97
ccaccggccacc

SEQ ID NO: 1186862 - RNA, 20 nt, Mycobacterium bovis subsp bovis AF2122/97
ccaccggcaccgccugcgcc

SEQ ID NO: 1186863 - RNA, 17 nt, Mycobacterium bovis subsp bovis AF2122/97
ccaccggcaccggccgu

SEQ ID NO: 1186864 - RNA, 20 nt, Mycobacterium bovis subsp bovis AF2122/97
ccaccggaauccuggccgcc

SEQ ID NO: 1186865 - RNA, 20 nt, Mycobacterium bovis subsp bovis AF2122/97
ccaccgugaagcccuggcca

SEQ ID NO: 1186866 - RNA, 20 nt, Mycobacterium bovis subsp bovis AF2122/97
ccaccgugaccgagaagccc

SEQ ID NO: 1186867 - RNA, 22 nt, Mycobacterium bovis subsp bovis AF2122/97
ccaccgugguggacgaccgcgc

SEQ ID NO: 1186868 - RNA, 20 nt, Mycobacterium bovis subsp bovis AF2122/97
ccaccguugggccgacuggg

SEQ ID NO: 1186869 - RNA, 15 nt, Mycobacterium bovis subsp bovis AF2122/97
ccaccggcgccgccc

SEQ ID NO: 1186870 - RNA, 18 nt, Mycobacterium bovis subsp bovis AF2122/97
ccaccggcgccgccggca

SEQ ID NO: 1186871 - RNA, 19 nt, Mycobacterium bovis subsp bovis AF2122/97
ccaccggcgccgccggcac

SEQ ID NO: 1186872 - RNA, 16 nt, Mycobacterium bovis subsp bovis AF2122/97
ccaccggcgccgccgu

SEQ ID NO: 1186873 - RNA, 15 nt, Mycobacterium bovis subsp bovis AF2122/97
ccaccggcguccagu

SEQ ID NO: 1186874 - RNA, 16 nt, Mycobacterium bovis subsp bovis AF2122/97
ccaccgucgccgccgg

SEQ ID NO: 1186875 - RNA, 19 nt, Mycobacterium bovis subsp bovis AF2122/97
ccaccgucgccgccggucc

SEQ ID NO: 1186876 - RNA, 21 nt, Mycobacterium bovis subsp bovis AF2122/97
ccaccggcgccggaguugaag

SEQ ID NO: 1186877 - RNA, 15 nt, Mycobacterium bovis subsp bovis AF2122/97
ccaccggcgccuccg

SEQ ID NO: 1186878 - RNA, 22 nt, Mycobacterium bovis subsp bovis AF2122/97
ccaccggcgucgacgucggccc

SEQ ID NO: 1186879 - RNA, 20 nt, Mycobacterium bovis subsp bovis AF2122/97
ccaccggcgucugcccgccc

SEQ ID NO: 1186880 - RNA, 16 nt, Mycobacterium bovis subsp bovis AF2122/97
ccaccgucaccgccgg

SEQ ID NO: 1186881 - RNA, 12 nt, Mycobacterium bovis subsp bovis AF2122/97
ccaccugggcgg

SEQ ID NO: 1186882 - RNA, 20 nt, Mycobacterium bovis subsp bovis AF2122/97
ccaccuggugcaaccgugcc

SEQ ID NO: 1186883 - RNA, 23 nt, Mycobacterium bovis subsp bovis AF2122/97
ccaccuguuggcaugccgcccgc

SEQ ID NO: 1186884 - RNA, 16 nt, Mycobacterium bovis subsp bovis AF2122/97
ccacgcagaaguugau

SEQ ID NO: 1186885 - RNA, 14 nt, Mycobacterium bovis subsp bovis AF2122/97
ccacgcaugggcca

SEQ ID NO: 1186886 - RNA, 17 nt, Mycobacterium bovis subsp bovis AF2122/97
ccaccuugugcaggccc

SEQ ID NO: 1186887 - RNA, 22 nt, Mycobacterium bovis subsp bovis AF2122/97
ccaccuuggucuucgccgucgg

SEQ ID NO: 1186888 - RNA, 20 nt, Mycobacterium bovis subsp bovis AF2122/97
ccaccuuggcugggcccgcc

SEQ ID NO: 1186889 - RNA, 20 nt, Mycobacterium bovis subsp bovis AF2122/97
ccaccuuggaugcccugccc

SEQ ID NO: 1186890 - RNA, 13 nt, Mycobacterium bovis subsp bovis AF2122/97
ccaccgcgaccuc

SEQ ID NO: 1186891 - RNA, 15 nt, Mycobacterium bovis subsp bovis AF2122/97
ccaccgcgacuuugc

SEQ ID NO: 1186892 - RNA, 21 nt, Mycobacterium bovis subsp bovis AF2122/97
ccaccgcauaacgccaguccc

SEQ ID NO: 1186893 - RNA, 23 nt, Mycobacterium bovis subsp bovis AF2122/97
ccaccgcaucggugucuuccucc

SEQ ID NO: 1186894 - RNA, 21 nt, Mycobacterium bovis subsp bovis AF2122/97
ccaccgauucggcgacgaacu

SEQ ID NO: 1186895 - RNA, 13 nt, Mycobacterium bovis subsp bovis AF2122/97
ccaccgcaccugc

SEQ ID NO: 1186896 - RNA, 16 nt, Mycobacterium bovis subsp bovis AF2122/97
ccaccgcaagaaucag

SEQ ID NO: 1186897 - RNA, 23 nt, Mycobacterium bovis subsp bovis AF2122/97
ccaccgacggaaugucagccggu

SEQ ID NO: 1186898 - RNA, 17 nt, Mycobacterium bovis subsp bovis AF2122/97
ccaccgacguggccagc

SEQ ID NO: 1186899 - RNA, 14 nt, Mycobacterium bovis subsp bovis AF2122/97
ccaccgacagcccc

SEQ ID NO: 1186900 - RNA, 13 nt, Mycobacterium bovis subsp bovis AF2122/97
ccacccggccgcg

SEQ ID NO: 1186901 - RNA, 22 nt, Mycobacterium bovis subsp bovis AF2122/97
ccacccggccucaacacccggc

SEQ ID NO: 1186902 - RNA, 20 nt, Mycobacterium bovis subsp bovis AF2122/97
ccaccgaccgcguaaaggcc

SEQ ID NO: 1186903 - RNA, 17 nt, Mycobacterium bovis subsp bovis AF2122/97
ccaccgagaucaugccg

SEQ ID NO: 1186904 - RNA, 14 nt, Mycobacterium bovis subsp bovis AF2122/97
ccaccgacuccugu

SEQ ID NO: 1186905 - RNA, 18 nt, Mycobacterium bovis subsp bovis AF2122/97
ccaccgagcccuccaggg

SEQ ID NO: 1186906 - RNA, 16 nt, Mycobacterium bovis subsp bovis AF2122/97
ccaccgauaccgucag

SEQ ID NO: 1186907 - RNA, 21 nt, Mycobacterium bovis subsp bovis AF2122/97
ccaccgauaccgucagcgccg

SEQ ID NO: 1186908 - RNA, 22 nt, Mycobacterium bovis subsp bovis AF2122/97
ccaccgauaccgucagcgccgc

SEQ ID NO: 1186909 - RNA, 23 nt, Mycobacterium bovis subsp bovis AF2122/97
ccaccgauauggccggguccagc

SEQ ID NO: 1186910 - RNA, 16 nt, Mycobacterium bovis subsp bovis AF2122/97
ccacccgccgccgccc

SEQ ID NO: 1186911 - RNA, 13 nt, Mycobacterium bovis subsp bovis AF2122/97
ccacccgcggcgc

SEQ ID NO: 1186912 - RNA, 14 nt, Mycobacterium bovis subsp bovis AF2122/97
ccacccgccacggu

SEQ ID NO: 1186913 - RNA, 19 nt, Mycobacterium bovis subsp bovis AF2122/97
ccacccgcaccaccggccc

SEQ ID NO: 1186914 - RNA, 16 nt, Mycobacterium bovis subsp bovis AF2122/97
ccacccgcaccgccgg

SEQ ID NO: 1186915 - RNA, 23 nt, Mycobacterium bovis subsp bovis AF2122/97
ccacccgcacuccaagucacagc

SEQ ID NO: 1186916 - RNA, 23 nt, Mycobacterium bovis subsp bovis AF2122/97
ccaccccggucggagcggugccg

SEQ ID NO: 1186917 - RNA, 19 nt, Mycobacterium bovis subsp bovis AF2122/97
ccaccccgcguaugccagg

SEQ ID NO: 1186918 - RNA, 20 nt, Mycobacterium bovis subsp bovis AF2122/97
ccaccccgcguaugccagga

SEQ ID NO: 1186919 - RNA, 19 nt, Mycobacterium bovis subsp bovis AF2122/97
ccacccgacaugcgccgag

SEQ ID NO: 1186920 - RNA, 13 nt, Mycobacterium bovis subsp bovis AF2122/97
ccacccccgguuc

SEQ ID NO: 1186921 - RNA, 20 nt, Mycobacterium bovis subsp bovis AF2122/97
ccaccccgaggccgaccucg

SEQ ID NO: 1186922 - RNA, 20 nt, Mycobacterium bovis subsp bovis AF2122/97
ccaccccgauccgccacgaa

SEQ ID NO: 1186923 - RNA, 22 nt, Mycobacterium bovis subsp bovis AF2122/97
ccacccauggccucccacucac

SEQ ID NO: 1186924 - RNA, 12 nt, Mycobacterium bovis subsp bovis AF2122/97
ccacccaggccg

SEQ ID NO: 1186925 - RNA, 13 nt, Mycobacterium bovis subsp bovis AF2122/97
ccacccagugcca

SEQ ID NO: 1186926 - RNA, 13 nt, Mycobacterium bovis subsp bovis AF2122/97
ccacccacccgca

SEQ ID NO: 1186927 - RNA, 16 nt, Mycobacterium bovis subsp bovis AF2122/97
ccacccacccgcacca

SEQ ID NO: 1186928 - RNA, 19 nt, Mycobacterium bovis subsp bovis AF2122/97
ccacccacauggcggcccg

SEQ ID NO: 1186929 - RNA, 16 nt, Mycobacterium bovis subsp bovis AF2122/97
ccaccagcgccuugac

SEQ ID NO: 1186930 - RNA, 18 nt, Mycobacterium bovis subsp bovis AF2122/97
ccaccaggacguggucgg

SEQ ID NO: 1186931 - RNA, 15 nt, Mycobacterium bovis subsp bovis AF2122/97
ccaccagcgcuccag

SEQ ID NO: 1186932 - RNA, 17 nt, Mycobacterium bovis subsp bovis AF2122/97
ccaccagcgcccggccc

SEQ ID NO: 1186933 - RNA, 18 nt, Mycobacterium bovis subsp bovis AF2122/97
ccaccagcgcccggcccg

SEQ ID NO: 1186934 - RNA, 12 nt, Mycobacterium bovis subsp bovis AF2122/97
ccaccagcgccu

SEQ ID NO: 1186935 - RNA, 22 nt, Mycobacterium bovis subsp bovis AF2122/97
ccaccacaucgcgggcgugccg

SEQ ID NO: 1186936 - RNA, 12 nt, Mycobacterium bovis subsp bovis AF2122/97
ccaccacacagc

SEQ ID NO: 1186937 - RNA, 23 nt, Mycobacterium bovis subsp bovis AF2122/97
ccaccacaacgccaggaacccgu

SEQ ID NO: 1186938 - RNA, 15 nt, Mycobacterium bovis subsp bovis AF2122/97
ccaccacacagccgc

SEQ ID NO: 1186939 - RNA, 15 nt, Mycobacterium bovis subsp bovis AF2122/97
ccaccaaggugagca

SEQ ID NO: 1186940 - RNA, 16 nt, Mycobacterium bovis subsp bovis AF2122/97
ccaccaacgagucagu

SEQ ID NO: 1186941 - RNA, 20 nt, Mycobacterium bovis subsp bovis AF2122/97
ccaccaacgagucagugcca

SEQ ID NO: 1186942 - RNA, 23 nt, Mycobacterium bovis subsp bovis AF2122/97
ccaccaaauccgcaaggaccugu

SEQ ID NO: 1186943 - RNA, 14 nt, Mycobacterium bovis subsp bovis AF2122/97
ccaccaaaccccaa

SEQ ID NO: 1186944 - RNA, 17 nt, Mycobacterium bovis subsp bovis AF2122/97
ccaaugccaccgcggcc

SEQ ID NO: 1186945 - RNA, 20 nt, Mycobacterium bovis subsp bovis AF2122/97
ccaaugcccuuggccagcag

SEQ ID NO: 1186946 - RNA, 22 nt, Mycobacterium bovis subsp bovis AF2122/97
ccaaugccgcggaggcggccag

SEQ ID NO: 1186947 - RNA, 19 nt, Mycobacterium bovis subsp bovis AF2122/97
ccaaucuucucgagccgcc

SEQ ID NO: 1186948 - RNA, 17 nt, Mycobacterium bovis subsp bovis AF2122/97
ccacaaccgaauccauc

SEQ ID NO: 1186949 - RNA, 13 nt, Mycobacterium bovis subsp bovis AF2122/97
ccacaacgccucg

SEQ ID NO: 1186950 - RNA, 16 nt, Mycobacterium bovis subsp bovis AF2122/97
ccacaaauccaaaccu

SEQ ID NO: 1186951 - RNA, 17 nt, Mycobacterium bovis subsp bovis AF2122/97
ccacaaggguuggccga

SEQ ID NO: 1186952 - RNA, 19 nt, Mycobacterium bovis subsp bovis AF2122/97
ccacaaucagcccgacacc

SEQ ID NO: 1186953 - RNA, 13 nt, Mycobacterium bovis subsp bovis AF2122/97
ccacaauccacgc

SEQ ID NO: 1186954 - RNA, 17 nt, Mycobacterium bovis subsp bovis AF2122/97
ccaauucgacugcaacu

SEQ ID NO: 1186955 - RNA, 23 nt, Mycobacterium bovis subsp bovis AF2122/97
ccaauucgacugcaacucuuccc

SEQ ID NO: 1186956 - RNA, 21 nt, Mycobacterium bovis subsp bovis AF2122/97
ccaauucuggcuccgacgaaa

SEQ ID NO: 1186957 - RNA, 20 nt, Mycobacterium bovis subsp bovis AF2122/97
ccacauuccguagccggcgg

SEQ ID NO: 1186958 - RNA, 21 nt, Mycobacterium bovis subsp bovis AF2122/97
ccacauuggcgaucagcagcc

SEQ ID NO: 1186959 - RNA, 18 nt, Mycobacterium bovis subsp bovis AF2122/97
ccacauuccgcagucccg

SEQ ID NO: 1186960 - RNA, 17 nt, Mycobacterium bovis subsp bovis AF2122/97
ccacaugacgaucgcgg

SEQ ID NO: 1186961 - RNA, 19 nt, Mycobacterium bovis subsp bovis AF2122/97
ccacaugggagccguucgg

SEQ ID NO: 1186962 - RNA, 21 nt, Mycobacterium bovis subsp bovis AF2122/97
ccacaugaucgagcaguucca

SEQ ID NO: 1186963 - RNA, 19 nt, Mycobacterium bovis subsp bovis AF2122/97
ccacaucgaugucggcucg

SEQ ID NO: 1186964 - RNA, 24 nt, Mycobacterium bovis subsp bovis AF2122/97
ccacauccuggcggcugcagccga

SEQ ID NO: 1186965 - RNA, 19 nt, Mycobacterium bovis subsp bovis AF2122/97
ccacaucgccagcagcaaa

SEQ ID NO: 1186966 - RNA, 15 nt, Mycobacterium bovis subsp bovis AF2122/97
ccacaucagccgcac

SEQ ID NO: 1186967 - RNA, 19 nt, Mycobacterium bovis subsp bovis AF2122/97
ccacaucagccgcaccagu

SEQ ID NO: 1186968 - RNA, 15 nt, Mycobacterium bovis subsp bovis AF2122/97
ccacaucaugccagc

SEQ ID NO: 1186969 - RNA, 20 nt, Mycobacterium bovis subsp bovis AF2122/97
ccacauccaacgaccuccac

SEQ ID NO: 1186970 - RNA, 18 nt, Mycobacterium bovis subsp bovis AF2122/97
ccacauccaucuccaugu

SEQ ID NO: 1186971 - RNA, 16 nt, Mycobacterium bovis subsp bovis AF2122/97
ccacaccggggcggcc

SEQ ID NO: 1186972 - RNA, 18 nt, Mycobacterium bovis subsp bovis AF2122/97
ccacaccgggaugggagc

SEQ ID NO: 1186973 - RNA, 15 nt, Mycobacterium bovis subsp bovis AF2122/97
ccacaccggagccga

SEQ ID NO: 1186974 - RNA, 22 nt, Mycobacterium bovis subsp bovis AF2122/97
ccacaccuaccguacgcagcgu

SEQ ID NO: 1186975 - RNA, 17 nt, Mycobacterium bovis subsp bovis AF2122/97
ccacacggggccgccag

SEQ ID NO: 1186976 - RNA, 16 nt, Mycobacterium bovis subsp bovis AF2122/97
ccacaccuuggccgcc

SEQ ID NO: 1186977 - RNA, 23 nt, Mycobacterium bovis subsp bovis AF2122/97
ccacacucgccagggccaucugg

SEQ ID NO: 1186978 - RNA, 16 nt, Mycobacterium bovis subsp bovis AF2122/97
ccacagucgugagcca

SEQ ID NO: 1186979 - RNA, 22 nt, Mycobacterium bovis subsp bovis AF2122/97
ccacagugaaauccgagccgcg

SEQ ID NO: 1186980 - RNA, 14 nt, Mycobacterium bovis subsp bovis AF2122/97
ccacaggugaccuu

SEQ ID NO: 1186981 - RNA, 15 nt, Mycobacterium bovis subsp bovis AF2122/97
ccacagguuugcgcc

SEQ ID NO: 1186982 - RNA, 17 nt, Mycobacterium bovis subsp bovis AF2122/97
ccacauacaggcccgcc

SEQ ID NO: 1186983 - RNA, 18 nt, Mycobacterium bovis subsp bovis AF2122/97
ccacaucaacuugccgcc

SEQ ID NO: 1186984 - RNA, 23 nt, Mycobacterium bovis subsp bovis AF2122/97
ccacagugccaauuccagccccc

SEQ ID NO: 1186985 - RNA, 16 nt, Mycobacterium bovis subsp bovis AF2122/97
ccacugccgcgcgccc

SEQ ID NO: 1186986 - RNA, 19 nt, Mycobacterium bovis subsp bovis AF2122/97
ccacugccgcgcgcccgcc

SEQ ID NO: 1186987 - RNA, 21 nt, Mycobacterium bovis subsp bovis AF2122/97
ccacugccgcgcgcccgccuc

SEQ ID NO: 1186988 - RNA, 12 nt, Mycobacterium bovis subsp bovis AF2122/97
ccacugcccgcc

SEQ ID NO: 1186989 - RNA, 15 nt, Mycobacterium bovis subsp bovis AF2122/97
ccacgccacguccaa

SEQ ID NO: 1186990 - RNA, 22 nt, Mycobacterium bovis subsp bovis AF2122/97
ccacgccacguccaacucggcc

SEQ ID NO: 1186991 - RNA, 11 nt, Mycobacterium bovis subsp bovis AF2122/97
ccacgccaccg

SEQ ID NO: 1186992 - RNA, 22 nt, Mycobacterium bovis subsp bovis AF2122/97
ccacgcaugggccaggucagcc

SEQ ID NO: 1186993 - RNA, 21 nt, Mycobacterium bovis subsp bovis AF2122/97
ccacuggcacacggucaccgg

SEQ ID NO: 1186994 - RNA, 12 nt, Mycobacterium bovis subsp bovis AF2122/97
ccacuggauggc

SEQ ID NO: 1186995 - RNA, 13 nt, Mycobacterium bovis subsp bovis AF2122/97
ccacugcgcgucg

SEQ ID NO: 1186996 - RNA, 18 nt, Mycobacterium bovis subsp bovis AF2122/97
ccacugcuuccggaacaa

SEQ ID NO: 1186997 - RNA, 17 nt, Mycobacterium bovis subsp bovis AF2122/97
ccacuggauggcucgcc

SEQ ID NO: 1186998 - RNA, 14 nt, Mycobacterium bovis subsp bovis AF2122/97
ccacugggccugcc

SEQ ID NO: 1186999 - RNA, 16 nt, Mycobacterium bovis subsp bovis AF2122/97
ccacuggugcagcgcc

SEQ ID NO: 1187000 - RNA, 19 nt, Mycobacterium bovis subsp bovis AF2122/97
ccacuguuggugccgccac

SEQ ID NO: 1187001 - RNA, 20 nt, Mycobacterium bovis subsp bovis AF2122/97
ccacuguuucugagcgcgcu

SEQ ID NO: 1187002 - RNA, 17 nt, Mycobacterium bovis subsp bovis AF2122/97
ccacuucccgcuugagc

SEQ ID NO: 1187003 - RNA, 13 nt, Mycobacterium bovis subsp bovis AF2122/97
ccacuuccgggcg

SEQ ID NO: 1187004 - RNA, 18 nt, Mycobacterium bovis subsp bovis AF2122/97
ccacuucuucacuggcga

SEQ ID NO: 1187005 - RNA, 13 nt, Mycobacterium bovis subsp bovis AF2122/97
ccacuugcagcac

SEQ ID NO: 1187006 - RNA, 19 nt, Mycobacterium bovis subsp bovis AF2122/97
ccagacacaaccgcuuuga

SEQ ID NO: 1187007 - RNA, 18 nt, Mycobacterium bovis subsp bovis AF2122/97
ccagaaucucgccgggcu

SEQ ID NO: 1187008 - RNA, 23 nt, Mycobacterium bovis subsp bovis AF2122/97
ccagaaugacaucgucgccaggg

SEQ ID NO: 1187009 - RNA, 12 nt, Mycobacterium bovis subsp bovis AF2122/97
ccagaaccggcu

SEQ ID NO: 1187010 - RNA, 15 nt, Mycobacterium bovis subsp bovis AF2122/97
ccagaacggcgucga

SEQ ID NO: 1187011 - RNA, 19 nt, Mycobacterium bovis subsp bovis AF2122/97
ccagaacggcgaucaccga

SEQ ID NO: 1187012 - RNA, 22 nt, Mycobacterium bovis subsp bovis AF2122/97
ccagaaaacauugcggcccucg

SEQ ID NO: 1187013 - RNA, 17 nt, Mycobacterium bovis subsp bovis AF2122/97
ccacuuucgacccgcgg

SEQ ID NO: 1187014 - RNA, 21 nt, Mycobacterium bovis subsp bovis AF2122/97
ccagaugccgguaacgaacag

SEQ ID NO: 1187015 - RNA, 18 nt, Mycobacterium bovis subsp bovis AF2122/97
ccagaugcugguguugau

SEQ ID NO: 1187016 - RNA, 12 nt, Mycobacterium bovis subsp bovis AF2122/97
ccagaugcacgu

SEQ ID NO: 1187017 - RNA, 14 nt, Mycobacterium bovis subsp bovis AF2122/97
ccagaugcagcggu

SEQ ID NO: 1187018 - RNA, 13 nt, Mycobacterium bovis subsp bovis AF2122/97
ccagaugcaggcu

SEQ ID NO: 1187019 - RNA, 14 nt, Mycobacterium bovis subsp bovis AF2122/97
ccagaugaaccccg

SEQ ID NO: 1187020 - RNA, 18 nt, Mycobacterium bovis subsp bovis AF2122/97
ccagaucguuccaggccg

SEQ ID NO: 1187021 - RNA, 22 nt, Mycobacterium bovis subsp bovis AF2122/97
ccagaucgguugaucggccacg

SEQ ID NO: 1187022 - RNA, 18 nt, Mycobacterium bovis subsp bovis AF2122/97
ccagaucgcuaggaccgc

SEQ ID NO: 1187023 - RNA, 16 nt, Mycobacterium bovis subsp bovis AF2122/97
ccagauugccugggcg

SEQ ID NO: 1187024 - RNA, 17 nt, Mycobacterium bovis subsp bovis AF2122/97
ccagauuggcgcugccc

SEQ ID NO: 1187025 - RNA, 14 nt, Mycobacterium bovis subsp bovis AF2122/97
ccagauccacgccg

SEQ ID NO: 1187026 - RNA, 22 nt, Mycobacterium bovis subsp bovis AF2122/97
ccagauccgucagcuuggaccc

SEQ ID NO: 1187027 - RNA, 16 nt, Mycobacterium bovis subsp bovis AF2122/97
ccagaucgcacaccaa

SEQ ID NO: 1187028 - RNA, 21 nt, Mycobacterium bovis subsp bovis AF2122/97
ccagaucgaacgcagccagcg

SEQ ID NO: 1187029 - RNA, 17 nt, Mycobacterium bovis subsp bovis AF2122/97
ccagaucgcacaccaac

SEQ ID NO: 1187030 - RNA, 13 nt, Mycobacterium bovis subsp bovis AF2122/97
ccagaucagcacc

SEQ ID NO: 1187031 - RNA, 15 nt, Mycobacterium bovis subsp bovis AF2122/97
ccagauaauccuggu

SEQ ID NO: 1187032 - RNA, 13 nt, Mycobacterium bovis subsp bovis AF2122/97
ccagauacccgcg

SEQ ID NO: 1187033 - RNA, 12 nt, Mycobacterium bovis subsp bovis AF2122/97
ccagaguggugg

SEQ ID NO: 1187034 - RNA, 16 nt, Mycobacterium bovis subsp bovis AF2122/97
ccagaguucccgaaac

SEQ ID NO: 1187035 - RNA, 19 nt, Mycobacterium bovis subsp bovis AF2122/97
ccagaguucccgaaacccg

SEQ ID NO: 1187036 - RNA, 16 nt, Mycobacterium bovis subsp bovis AF2122/97
ccagaguucggccagc

SEQ ID NO: 1187037 - RNA, 13 nt, Mycobacterium bovis subsp bovis AF2122/97
ccagaccggcggc

SEQ ID NO: 1187038 - RNA, 14 nt, Mycobacterium bovis subsp bovis AF2122/97
ccagaccggcggcu

SEQ ID NO: 1187039 - RNA, 19 nt, Mycobacterium bovis subsp bovis AF2122/97
ccagaccggccgacgugac

SEQ ID NO: 1187040 - RNA, 19 nt, Mycobacterium bovis subsp bovis AF2122/97
ccagacgauggccagguug

SEQ ID NO: 1187041 - RNA, 19 nt, Mycobacterium bovis subsp bovis AF2122/97
ccagacgccacugccagcc

SEQ ID NO: 1187042 - RNA, 20 nt, Mycobacterium bovis subsp bovis AF2122/97
ccagacccgaauccaccagc

SEQ ID NO: 1187043 - RNA, 14 nt, Mycobacterium bovis subsp bovis AF2122/97
ccagacccaccacc

SEQ ID NO: 1187044 - RNA, 15 nt, Mycobacterium bovis subsp bovis AF2122/97
ccagaccgacccgca

SEQ ID NO: 1187045 - RNA, 16 nt, Mycobacterium bovis subsp bovis AF2122/97
ccagacccaccaccgc

SEQ ID NO: 1187046 - RNA, 14 nt, Mycobacterium bovis subsp bovis AF2122/97
ccagacccagcucg

SEQ ID NO: 1187047 - RNA, 20 nt, Mycobacterium bovis subsp bovis AF2122/97
ccagaggucacgcagcaccc

SEQ ID NO: 1187048 - RNA, 15 nt, Mycobacterium bovis subsp bovis AF2122/97
ccagaggucgagcgc

SEQ ID NO: 1187049 - RNA, 16 nt, Mycobacterium bovis subsp bovis AF2122/97
ccagagucggagaccc

SEQ ID NO: 1187050 - RNA, 22 nt, Mycobacterium bovis subsp bovis AF2122/97
ccagagcuggcuacgggccgcu

SEQ ID NO: 1187051 - RNA, 21 nt, Mycobacterium bovis subsp bovis AF2122/97
ccagaggccggcgggcucgcc

SEQ ID NO: 1187052 - RNA, 21 nt, Mycobacterium bovis subsp bovis AF2122/97
ccagaggcgcuucgccacacc

SEQ ID NO: 1187053 - RNA, 17 nt, Mycobacterium bovis subsp bovis AF2122/97
ccagacggugcagcucc

SEQ ID NO: 1187054 - RNA, 18 nt, Mycobacterium bovis subsp bovis AF2122/97
ccagacggugcagcuccc

SEQ ID NO: 1187055 - RNA, 20 nt, Mycobacterium bovis subsp bovis AF2122/97
ccagacucgcggucgacagc

SEQ ID NO: 1187056 - RNA, 22 nt, Mycobacterium bovis subsp bovis AF2122/97
ccagagacagcgccaugcccuc

SEQ ID NO: 1187057 - RNA, 24 nt, Mycobacterium bovis subsp bovis AF2122/97
ccagcagcucgccggcacgcagcc

SEQ ID NO: 1187058 - RNA, 18 nt, Mycobacterium bovis subsp bovis AF2122/97
ccagcagcugaaaauagg

SEQ ID NO: 1187059 - RNA, 18 nt, Mycobacterium bovis subsp bovis AF2122/97
ccagcagcgcgggaucug

SEQ ID NO: 1187060 - RNA, 14 nt, Mycobacterium bovis subsp bovis AF2122/97
ccagcagccaggag

SEQ ID NO: 1187061 - RNA, 19 nt, Mycobacterium bovis subsp bovis AF2122/97
ccagcagcgacuccagcgc

SEQ ID NO: 1187062 - RNA, 23 nt, Mycobacterium bovis subsp bovis AF2122/97
ccagcagccacccgacaacgcug

SEQ ID NO: 1187063 - RNA, 16 nt, Mycobacterium bovis subsp bovis AF2122/97
ccagcagccagcccag

SEQ ID NO: 1187064 - RNA, 16 nt, Mycobacterium bovis subsp bovis AF2122/97
ccagcagcagcgcuuc

SEQ ID NO: 1187065 - RNA, 16 nt, Mycobacterium bovis subsp bovis AF2122/97
ccagcagcagcgccgc

SEQ ID NO: 1187066 - RNA, 15 nt, Mycobacterium bovis subsp bovis AF2122/97
ccagcagcagcgccg

SEQ ID NO: 1187067 - RNA, 14 nt, Mycobacterium bovis subsp bovis AF2122/97
ccagcagcagcgcc

SEQ ID NO: 1187068 - RNA, 12 nt, Mycobacterium bovis subsp bovis AF2122/97
ccagcagcaacc

SEQ ID NO: 1187069 - RNA, 23 nt, Mycobacterium bovis subsp bovis AF2122/97
ccagcaccucggccagcuccgcc

SEQ ID NO: 1187070 - RNA, 16 nt, Mycobacterium bovis subsp bovis AF2122/97
ccagcacccggucgau

SEQ ID NO: 1187071 - RNA, 16 nt, Mycobacterium bovis subsp bovis AF2122/97
ccagcacccgcagccg

SEQ ID NO: 1187072 - RNA, 13 nt, Mycobacterium bovis subsp bovis AF2122/97
ccagcacccgcgc

SEQ ID NO: 1187073 - RNA, 20 nt, Mycobacterium bovis subsp bovis AF2122/97
ccagcacccgcuccagcucg

SEQ ID NO: 1187074 - RNA, 19 nt, Mycobacterium bovis subsp bovis AF2122/97
ccagcagaucagguccuag

SEQ ID NO: 1187075 - RNA, 22 nt, Mycobacterium bovis subsp bovis AF2122/97
ccagcagacgccguagccggcc

SEQ ID NO: 1187076 - RNA, 16 nt, Mycobacterium bovis subsp bovis AF2122/97
ccagcaagacgaugac

SEQ ID NO: 1187077 - RNA, 15 nt, Mycobacterium bovis subsp bovis AF2122/97
ccagcaacaccagau

SEQ ID NO: 1187078 - RNA, 22 nt, Mycobacterium bovis subsp bovis AF2122/97
ccagcaaccucgguugguccuc

SEQ ID NO: 1187079 - RNA, 19 nt, Mycobacterium bovis subsp bovis AF2122/97
ccagcaaccaccccagggc

SEQ ID NO: 1187080 - RNA, 19 nt, Mycobacterium bovis subsp bovis AF2122/97
ccagauuuaggagcuuuug

SEQ ID NO: 1187081 - RNA, 14 nt, Mycobacterium bovis subsp bovis AF2122/97
ccagauugguugau

SEQ ID NO: 1187082 - RNA, 16 nt, Mycobacterium bovis subsp bovis AF2122/97
ccagcaaaugcggcgc

SEQ ID NO: 1187083 - RNA, 17 nt, Mycobacterium bovis subsp bovis AF2122/97
ccagcaccaccacccga

SEQ ID NO: 1187084 - RNA, 19 nt, Mycobacterium bovis subsp bovis AF2122/97
ccagcaccacggccagcgg

SEQ ID NO: 1187085 - RNA, 19 nt, Mycobacterium bovis subsp bovis AF2122/97
ccagcaccacggcgcgcgc

SEQ ID NO: 1187086 - RNA, 22 nt, Mycobacterium bovis subsp bovis AF2122/97
ccagcacauucugcagcgucuc

SEQ ID NO: 1187087 - RNA, 13 nt, Mycobacterium bovis subsp bovis AF2122/97
ccagcacaaccag

SEQ ID NO: 1187088 - RNA, 12 nt, Mycobacterium bovis subsp bovis AF2122/97
ccagcacaccgu

SEQ ID NO: 1187089 - RNA, 16 nt, Mycobacterium bovis subsp bovis AF2122/97
ccagcaaggcccgaaa

SEQ ID NO: 1187090 - RNA, 14 nt, Mycobacterium bovis subsp bovis AF2122/97
ccagccaccccugc

SEQ ID NO: 1187091 - RNA, 14 nt, Mycobacterium bovis subsp bovis AF2122/97
ccagccaccgaccc

SEQ ID NO: 1187092 - RNA, 15 nt, Mycobacterium bovis subsp bovis AF2122/97
ccagccaccaccagg

SEQ ID NO: 1187093 - RNA, 19 nt, Mycobacterium bovis subsp bovis AF2122/97
ccagccacagccgaccucg

SEQ ID NO: 1187094 - RNA, 20 nt, Mycobacterium bovis subsp bovis AF2122/97
ccagccaaccguccggggcc

SEQ ID NO: 1187095 - RNA, 17 nt, Mycobacterium bovis subsp bovis AF2122/97
ccagccaaaucagccag

SEQ ID NO: 1187096 - RNA, 14 nt, Mycobacterium bovis subsp bovis AF2122/97
ccagccagaugccg

SEQ ID NO: 1187097 - RNA, 20 nt, Mycobacterium bovis subsp bovis AF2122/97
ccagccacgcugucccgcgg

SEQ ID NO: 1187098 - RNA, 16 nt, Mycobacterium bovis subsp bovis AF2122/97
ccagccagccugcugg

SEQ ID NO: 1187099 - RNA, 17 nt, Mycobacterium bovis subsp bovis AF2122/97
ccagccccgacugacag

SEQ ID NO: 1187100 - RNA, 14 nt, Mycobacterium bovis subsp bovis AF2122/97
ccagcccgagcaga

SEQ ID NO: 1187101 - RNA, 18 nt, Mycobacterium bovis subsp bovis AF2122/97
ccagcccagccgccagcc

SEQ ID NO: 1187102 - RNA, 15 nt, Mycobacterium bovis subsp bovis AF2122/97
ccagcccaccggcgc

SEQ ID NO: 1187103 - RNA, 19 nt, Mycobacterium bovis subsp bovis AF2122/97
ccagcccaacucggccagc

SEQ ID NO: 1187104 - RNA, 17 nt, Mycobacterium bovis subsp bovis AF2122/97
ccagcccagauccagca

SEQ ID NO: 1187105 - RNA, 13 nt, Mycobacterium bovis subsp bovis AF2122/97
ccagcccggccgc

SEQ ID NO: 1187106 - RNA, 20 nt, Mycobacterium bovis subsp bovis AF2122/97
ccagcccgcccgguguguuc

SEQ ID NO: 1187107 - RNA, 17 nt, Mycobacterium bovis subsp bovis AF2122/97
ccagcccggcccagugg

SEQ ID NO: 1187108 - RNA, 20 nt, Mycobacterium bovis subsp bovis AF2122/97
ccagcccguugcaggacgcc

SEQ ID NO: 1187109 - RNA, 24 nt, Mycobacterium bovis subsp bovis AF2122/97
ccagcccguccggcccccgaggcu

SEQ ID NO: 1187110 - RNA, 16 nt, Mycobacterium bovis subsp bovis AF2122/97
ccagccgcaucgggca

SEQ ID NO: 1187111 - RNA, 13 nt, Mycobacterium bovis subsp bovis AF2122/97
ccagcaucagccc

SEQ ID NO: 1187112 - RNA, 22 nt, Mycobacterium bovis subsp bovis AF2122/97
ccagcaucagcgccagcgagca

SEQ ID NO: 1187113 - RNA, 16 nt, Mycobacterium bovis subsp bovis AF2122/97
ccagcaugaagucccg

SEQ ID NO: 1187114 - RNA, 20 nt, Mycobacterium bovis subsp bovis AF2122/97
ccagcaugacaccggccacc

SEQ ID NO: 1187115 - RNA, 21 nt, Mycobacterium bovis subsp bovis AF2122/97
ccagcaugacaccggccacca

SEQ ID NO: 1187116 - RNA, 23 nt, Mycobacterium bovis subsp bovis AF2122/97
ccagcaugacaccggccaccagc

SEQ ID NO: 1187117 - RNA, 17 nt, Mycobacterium bovis subsp bovis AF2122/97
ccagcauuagccaggcc

SEQ ID NO: 1187118 - RNA, 17 nt, Mycobacterium bovis subsp bovis AF2122/97
ccagcauugaagaagcc

SEQ ID NO: 1187119 - RNA, 14 nt, Mycobacterium bovis subsp bovis AF2122/97
ccagcauugacccg

SEQ ID NO: 1187120 - RNA, 23 nt, Mycobacterium bovis subsp bovis AF2122/97
ccagcauggcggaacagcaauuu

SEQ ID NO: 1187121 - RNA, 15 nt, Mycobacterium bovis subsp bovis AF2122/97
ccagcaugcccgcca

SEQ ID NO: 1187122 - RNA, 17 nt, Mycobacterium bovis subsp bovis AF2122/97
ccagcaugcccgccauc

SEQ ID NO: 1187123 - RNA, 20 nt, Mycobacterium bovis subsp bovis AF2122/97
ccagcaggucgucggcgucg

SEQ ID NO: 1187124 - RNA, 20 nt, Mycobacterium bovis subsp bovis AF2122/97
ccagcagguaguuaccauau

SEQ ID NO: 1187125 - RNA, 16 nt, Mycobacterium bovis subsp bovis AF2122/97
ccagcagguccgcggc

SEQ ID NO: 1187126 - RNA, 16 nt, Mycobacterium bovis subsp bovis AF2122/97
ccagcaguacaccgcc

SEQ ID NO: 1187127 - RNA, 17 nt, Mycobacterium bovis subsp bovis AF2122/97
ccagcaguacaccgccc

SEQ ID NO: 1187128 - RNA, 21 nt, Mycobacterium bovis subsp bovis AF2122/97
ccagcagguuggucaccaccu

SEQ ID NO: 1187129 - RNA, 21 nt, Mycobacterium bovis subsp bovis AF2122/97
ccagcaggcccuggccaccca

SEQ ID NO: 1187130 - RNA, 23 nt, Mycobacterium bovis subsp bovis AF2122/97
ccagcaggaugaugaccgccauc

SEQ ID NO: 1187131 - RNA, 19 nt, Mycobacterium bovis subsp bovis AF2122/97
ccagcaggcccuggccacc

SEQ ID NO: 1187132 - RNA, 15 nt, Mycobacterium bovis subsp bovis AF2122/97
ccagcaggccacugc

SEQ ID NO: 1187133 - RNA, 17 nt, Mycobacterium bovis subsp bovis AF2122/97
ccagcagggccaccacc

SEQ ID NO: 1187134 - RNA, 14 nt, Mycobacterium bovis subsp bovis AF2122/97
ccagcagggccaga

SEQ ID NO: 1187135 - RNA, 21 nt, Mycobacterium bovis subsp bovis AF2122/97
cagcucggaucgguuccggcc

SEQ ID NO: 1187136 - RNA, 14 nt, Mycobacterium bovis subsp bovis AF2122/97
cagcucggccaggc

SEQ ID NO: 1187137 - RNA, 17 nt, Mycobacterium bovis subsp bovis AF2122/97
cagcucggccaggcugg

SEQ ID NO: 1187138 - RNA, 14 nt, Mycobacterium bovis subsp bovis AF2122/97
cagcucgccgugac

SEQ ID NO: 1187139 - RNA, 16 nt, Mycobacterium bovis subsp bovis AF2122/97
cagcucgccgugacca

SEQ ID NO: 1187140 - RNA, 16 nt, Mycobacterium bovis subsp bovis AF2122/97
cagcucgcgcacccag

SEQ ID NO: 1187141 - RNA, 19 nt, Mycobacterium bovis subsp bovis AF2122/97
cagcucgcgcacccagccc

SEQ ID NO: 1187142 - RNA, 23 nt, Mycobacterium bovis subsp bovis AF2122/97
cagcucgcgcacccagcccagcc

SEQ ID NO: 1187143 - RNA, 17 nt, Mycobacterium bovis subsp bovis AF2122/97
cagcucgaacagcucga

SEQ ID NO: 1187144 - RNA, 18 nt, Mycobacterium bovis subsp bovis AF2122/97
cagcucgagcgccucggg

SEQ ID NO: 1187145 - RNA, 19 nt, Mycobacterium bovis subsp bovis AF2122/97
cagcucgagguccucagcg

SEQ ID NO: 1187146 - RNA, 18 nt, Mycobacterium bovis subsp bovis AF2122/97
cagcucgaucacgccggc

SEQ ID NO: 1187147 - RNA, 16 nt, Mycobacterium bovis subsp bovis AF2122/97
cagcucgaucagccgg

SEQ ID NO: 1187148 - RNA, 16 nt, Mycobacterium bovis subsp bovis AF2122/97
cagcucgcacucguug

SEQ ID NO: 1187149 - RNA, 20 nt, Mycobacterium bovis subsp bovis AF2122/97
cagcuccucgugcucggcca

SEQ ID NO: 1187150 - RNA, 21 nt, Mycobacterium bovis subsp bovis AF2122/97
cagcuccgcgcagccagggau

SEQ ID NO: 1187151 - RNA, 19 nt, Mycobacterium bovis subsp bovis AF2122/97
cagcuccggcgcuccacug

SEQ ID NO: 1187152 - RNA, 12 nt, Mycobacterium bovis subsp bovis AF2122/97
cagcuccuccga

SEQ ID NO: 1187153 - RNA, 18 nt, Mycobacterium bovis subsp bovis AF2122/97
cagcuccgugacaccggg

SEQ ID NO: 1187154 - RNA, 22 nt, Mycobacterium bovis subsp bovis AF2122/97
cagcucccggcuucuugaccac

SEQ ID NO: 1187155 - RNA, 14 nt, Mycobacterium bovis subsp bovis AF2122/97
cagcuccgccgccg

SEQ ID NO: 1187156 - RNA, 13 nt, Mycobacterium bovis subsp bovis AF2122/97
cagcuccgccugc

SEQ ID NO: 1187157 - RNA, 17 nt, Mycobacterium bovis subsp bovis AF2122/97
cagcuccacuggcgucu

SEQ ID NO: 1187158 - RNA, 12 nt, Mycobacterium bovis subsp bovis AF2122/97
cagcuccaccag

SEQ ID NO: 1187159 - RNA, 23 nt, Mycobacterium bovis subsp bovis AF2122/97
cagcuccagcaaaacccgcucca

SEQ ID NO: 1187160 - RNA, 19 nt, Mycobacterium bovis subsp bovis AF2122/97
cagcuccacacacugugcu

SEQ ID NO: 1187161 - RNA, 17 nt, Mycobacterium bovis subsp bovis AF2122/97
cagcucacggacgcugg

SEQ ID NO: 1187162 - RNA, 22 nt, Mycobacterium bovis subsp bovis AF2122/97
cagcucagugaugcgccccgga

SEQ ID NO: 1187163 - RNA, 17 nt, Mycobacterium bovis subsp bovis AF2122/97
cagcuagcccggcagca

SEQ ID NO: 1187164 - RNA, 20 nt, Mycobacterium bovis subsp bovis AF2122/97
cagcuagcccggcagcacgu

SEQ ID NO: 1187165 - RNA, 21 nt, Mycobacterium bovis subsp bovis AF2122/97
cagcuagaccaggaugagcgc

SEQ ID NO: 1187166 - RNA, 20 nt, Mycobacterium bovis subsp bovis AF2122/97
cagcuaucccaggggcaccg

SEQ ID NO: 1187167 - RNA, 20 nt, Mycobacterium bovis subsp bovis AF2122/97
cagcuaccccggcggucagg

SEQ ID NO: 1187168 - RNA, 20 nt, Mycobacterium bovis subsp bovis AF2122/97
cagcgcguacuugguggugg

SEQ ID NO: 1187169 - RNA, 16 nt, Mycobacterium bovis subsp bovis AF2122/97
cagcgcuccagcaccc

SEQ ID NO: 1187170 - RNA, 13 nt, Mycobacterium bovis subsp bovis AF2122/97
cagcgcuccagcc

SEQ ID NO: 1187171 - RNA, 18 nt, Mycobacterium bovis subsp bovis AF2122/97
cagcgcguaguccgcauc

SEQ ID NO: 1187172 - RNA, 14 nt, Mycobacterium bovis subsp bovis AF2122/97
cagcgcgggaucug

SEQ ID NO: 1187173 - RNA, 20 nt, Mycobacterium bovis subsp bovis AF2122/97
cagcgcggcuggggccccgc

SEQ ID NO: 1187174 - RNA, 21 nt, Mycobacterium bovis subsp bovis AF2122/97
cagcgcugccaccgcgguggc

SEQ ID NO: 1187175 - RNA, 20 nt, Mycobacterium bovis subsp bovis AF2122/97
cagcgcuggcaggccgggca

SEQ ID NO: 1187176 - RNA, 17 nt, Mycobacterium bovis subsp bovis AF2122/97
cagcuaacccgccacgu

SEQ ID NO: 1187177 - RNA, 15 nt, Mycobacterium bovis subsp bovis AF2122/97
cagcuaacccgccac

SEQ ID NO: 1187178 - RNA, 16 nt, Mycobacterium bovis subsp bovis AF2122/97
cagcuguucgagccgc

SEQ ID NO: 1187179 - RNA, 22 nt, Mycobacterium bovis subsp bovis AF2122/97
cagcugugaacaggccgaggcg

SEQ ID NO: 1187180 - RNA, 13 nt, Mycobacterium bovis subsp bovis AF2122/97
cagcugucauccc

SEQ ID NO: 1187181 - RNA, 18 nt, Mycobacterium bovis subsp bovis AF2122/97
cagcugucauccccggcc

SEQ ID NO: 1187182 - RNA, 16 nt, Mycobacterium bovis subsp bovis AF2122/97
cagcugguugugcugg

SEQ ID NO: 1187183 - RNA, 15 nt, Mycobacterium bovis subsp bovis AF2122/97
cagcugguugugcug

SEQ ID NO: 1187184 - RNA, 21 nt, Mycobacterium bovis subsp bovis AF2122/97
cagcuugcagugccgccggcc

SEQ ID NO: 1187185 - RNA, 20 nt, Mycobacterium bovis subsp bovis AF2122/97
cagcuugcccgagcccagcc

SEQ ID NO: 1187186 - RNA, 20 nt, Mycobacterium bovis subsp bovis AF2122/97
cagcuugcggagccgccgcu

SEQ ID NO: 1187187 - RNA, 20 nt, Mycobacterium bovis subsp bovis AF2122/97
caggaacaaguagccgucgu

SEQ ID NO: 1187188 - RNA, 17 nt, Mycobacterium bovis subsp bovis AF2122/97
cagcuuucuuggcgggc

SEQ ID NO: 1187189 - RNA, 17 nt, Mycobacterium bovis subsp bovis AF2122/97
cagcuuuguucccuuca

SEQ ID NO: 1187190 - RNA, 18 nt, Mycobacterium bovis subsp bovis AF2122/97
caggacgcccacaugcuc

SEQ ID NO: 1187191 - RNA, 13 nt, Mycobacterium bovis subsp bovis AF2122/97
caggacgacugga

SEQ ID NO: 1187192 - RNA, 22 nt, Mycobacterium bovis subsp bovis AF2122/97
caggacgacuggaaggcgggca

SEQ ID NO: 1187193 - RNA, 19 nt, Mycobacterium bovis subsp bovis AF2122/97
caggacucgcguccucggg

SEQ ID NO: 1187194 - RNA, 22 nt, Mycobacterium bovis subsp bovis AF2122/97
caggacuggcaccgccagccac

SEQ ID NO: 1187195 - RNA, 21 nt, Mycobacterium bovis subsp bovis AF2122/97
caggacguuugagaccccaac

SEQ ID NO: 1187196 - RNA, 21 nt, Mycobacterium bovis subsp bovis AF2122/97
caggauaccgaaaucaccuca

SEQ ID NO: 1187197 - RNA, 21 nt, Mycobacterium bovis subsp bovis AF2122/97
caggagauccaccgguccagg

SEQ ID NO: 1187198 - RNA, 11 nt, Mycobacterium bovis subsp bovis AF2122/97
caggagcagca

SEQ ID NO: 1187199 - RNA, 15 nt, Mycobacterium bovis subsp bovis AF2122/97
caggagccggcaacc

SEQ ID NO: 1187200 - RNA, 15 nt, Mycobacterium bovis subsp bovis AF2122/97
caggagccuccagcg

SEQ ID NO: 1187201 - RNA, 18 nt, Mycobacterium bovis subsp bovis AF2122/97
caggagccuccagcgcac

SEQ ID NO: 1187202 - RNA, 14 nt, Mycobacterium bovis subsp bovis AF2122/97
caggaagucccggg

SEQ ID NO: 1187203 - RNA, 23 nt, Mycobacterium bovis subsp bovis AF2122/97
caggaaguacgcgacgggccgcg

SEQ ID NO: 1187204 - RNA, 22 nt, Mycobacterium bovis subsp bovis AF2122/97
caggaacacucgcgaauaaccu

SEQ ID NO: 1187205 - RNA, 12 nt, Mycobacterium bovis subsp bovis AF2122/97
caggaacgccgu

SEQ ID NO: 1187206 - RNA, 19 nt, Mycobacterium bovis subsp bovis AF2122/97
caggaaucccucggccgca

SEQ ID NO: 1187207 - RNA, 22 nt, Mycobacterium bovis subsp bovis AF2122/97
caggaaucccucggccgcaggc

SEQ ID NO: 1187208 - RNA, 18 nt, Mycobacterium bovis subsp bovis AF2122/97
caggcucauccgccgggc

SEQ ID NO: 1187209 - RNA, 19 nt, Mycobacterium bovis subsp bovis AF2122/97
caggcuccggccggccagc

SEQ ID NO: 1187210 - RNA, 23 nt, Mycobacterium bovis subsp bovis AF2122/97
caggcuccggccggccagcaccc

SEQ ID NO: 1187211 - RNA, 16 nt, Mycobacterium bovis subsp bovis AF2122/97
caggcguccaucagag

SEQ ID NO: 1187212 - RNA, 14 nt, Mycobacterium bovis subsp bovis AF2122/97
caggcgucccagcc

SEQ ID NO: 1187213 - RNA, 16 nt, Mycobacterium bovis subsp bovis AF2122/97
caggcgucccagccga

SEQ ID NO: 1187214 - RNA, 19 nt, Mycobacterium bovis subsp bovis AF2122/97
caggcgcauagggccaccg

SEQ ID NO: 1187215 - RNA, 13 nt, Mycobacterium bovis subsp bovis AF2122/97
caggcguaucccg

SEQ ID NO: 1187216 - RNA, 14 nt, Mycobacterium bovis subsp bovis AF2122/97
caggcgcaccaggc

SEQ ID NO: 1187217 - RNA, 14 nt, Mycobacterium bovis subsp bovis AF2122/97
caggcgcagcuggg

SEQ ID NO: 1187218 - RNA, 16 nt, Mycobacterium bovis subsp bovis AF2122/97
caggcuuccccgaucg

SEQ ID NO: 1187219 - RNA, 15 nt, Mycobacterium bovis subsp bovis AF2122/97
caggcuugacugcac

SEQ ID NO: 1187220 - RNA, 16 nt, Mycobacterium bovis subsp bovis AF2122/97
caggcuugacugcaca

SEQ ID NO: 1187221 - RNA, 21 nt, Mycobacterium bovis subsp bovis AF2122/97
caggcuugacugcacaccacc

SEQ ID NO: 1187222 - RNA, 15 nt, Mycobacterium bovis subsp bovis AF2122/97
caggcuuagcuuccg

SEQ ID NO: 1187223 - RNA, 18 nt, Mycobacterium bovis subsp bovis AF2122/97
caggcuguggccagcauc

SEQ ID NO: 1187224 - RNA, 19 nt, Mycobacterium bovis subsp bovis AF2122/97
caggcugccuccggaaggc

SEQ ID NO: 1187225 - RNA, 22 nt, Mycobacterium bovis subsp bovis AF2122/97
caggcugcggcuuggccaucac

SEQ ID NO: 1187226 - RNA, 20 nt, Mycobacterium bovis subsp bovis AF2122/97
caggcugcggauacuguucu

SEQ ID NO: 1187227 - RNA, 21 nt, Mycobacterium bovis subsp bovis AF2122/97
caggcugcggauacuguucug

SEQ ID NO: 1187228 - RNA, 17 nt, Mycobacterium bovis subsp bovis AF2122/97
cagggccacuggccggu

SEQ ID NO: 1187229 - RNA, 14 nt, Mycobacterium bovis subsp bovis AF2122/97
cagggccagcggca

SEQ ID NO: 1187230 - RNA, 18 nt, Mycobacterium bovis subsp bovis AF2122/97
cagggccaccaccacggc

SEQ ID NO: 1187231 - RNA, 22 nt, Mycobacterium bovis subsp bovis AF2122/97
cagggcccuagccggcgcgccc

SEQ ID NO: 1187232 - RNA, 15 nt, Mycobacterium bovis subsp bovis AF2122/97
cagggccagcggcag

SEQ ID NO: 1187233 - RNA, 16 nt, Mycobacterium bovis subsp bovis AF2122/97
cagggccagcggcagc

SEQ ID NO: 1187234 - RNA, 23 nt, Mycobacterium bovis subsp bovis AF2122/97
cagggccaauuccaugacgggua

SEQ ID NO: 1187235 - RNA, 14 nt, Mycobacterium bovis subsp bovis AF2122/97
cagggccaccacca

SEQ ID NO: 1187236 - RNA, 20 nt, Mycobacterium bovis subsp bovis AF2122/97
cagggcagcccggcgaugag

SEQ ID NO: 1187237 - RNA, 17 nt, Mycobacterium bovis subsp bovis AF2122/97
cagggcagcggccaggg

SEQ ID NO: 1187238 - RNA, 18 nt, Mycobacterium bovis subsp bovis AF2122/97
cagggacccgagaucacc

SEQ ID NO: 1187239 - RNA, 17 nt, Mycobacterium bovis subsp bovis AF2122/97
cagggcacaucgggcgu

SEQ ID NO: 1187240 - RNA, 14 nt, Mycobacterium bovis subsp bovis AF2122/97
cagggcagcggcca

SEQ ID NO: 1187241 - RNA, 21 nt, Mycobacterium bovis subsp bovis AF2122/97
cagggagccguucaacgugga

SEQ ID NO: 1187242 - RNA, 22 nt, Mycobacterium bovis subsp bovis AF2122/97
cagggccgcaguggcaagcugu

SEQ ID NO: 1187243 - RNA, 23 nt, Mycobacterium bovis subsp bovis AF2122/97
cagggcccugcuggcccaacauc

SEQ ID NO: 1187244 - RNA, 16 nt, Mycobacterium bovis subsp bovis AF2122/97
cagggccuccacccgc

SEQ ID NO: 1187245 - RNA, 20 nt, Mycobacterium bovis subsp bovis AF2122/97
cagggccuccacccgccacg

SEQ ID NO: 1187246 - RNA, 22 nt, Mycobacterium bovis subsp bovis AF2122/97
cagggccucgaccgccagccgc

SEQ ID NO: 1187247 - RNA, 20 nt, Mycobacterium bovis subsp bovis AF2122/97
caggggccagcgcgccacga

SEQ ID NO: 1187248 - RNA, 17 nt, Mycobacterium bovis subsp bovis AF2122/97
caggggcagcgcggcca

SEQ ID NO: 1187249 - RNA, 21 nt, Mycobacterium bovis subsp bovis AF2122/97
cagggcgguggccacccggcc

SEQ ID NO: 1187250 - RNA, 16 nt, Mycobacterium bovis subsp bovis AF2122/97
cagggcggcaacggcg

SEQ ID NO: 1187251 - RNA, 17 nt, Mycobacterium bovis subsp bovis AF2122/97
cagggcggccuccccga

SEQ ID NO: 1187252 - RNA, 19 nt, Mycobacterium bovis subsp bovis AF2122/97
cagggcggccuccccgacc

SEQ ID NO: 1187253 - RNA, 15 nt, Mycobacterium bovis subsp bovis AF2122/97
caggccucggcgccg

SEQ ID NO: 1187254 - RNA, 18 nt, Mycobacterium bovis subsp bovis AF2122/97
caggccucggcgccgccc

SEQ ID NO: 1187255 - RNA, 21 nt, Mycobacterium bovis subsp bovis AF2122/97
caggccgguuugcacgcacca

SEQ ID NO: 1187256 - RNA, 16 nt, Mycobacterium bovis subsp bovis AF2122/97
caggccggccaccgag

SEQ ID NO: 1187257 - RNA, 14 nt, Mycobacterium bovis subsp bovis AF2122/97
caggccggccacca

SEQ ID NO: 1187258 - RNA, 18 nt, Mycobacterium bovis subsp bovis AF2122/97
caggccggccaccaccgc

SEQ ID NO: 1187259 - RNA, 15 nt, Mycobacterium bovis subsp bovis AF2122/97
caggccggcucgccg

SEQ ID NO: 1187260 - RNA, 18 nt, Mycobacterium bovis subsp bovis AF2122/97
caggccggcucgccgacc

SEQ ID NO: 1187261 - RNA, 15 nt, Mycobacterium bovis subsp bovis AF2122/97
caggccgggacagcg

SEQ ID NO: 1187262 - RNA, 18 nt, Mycobacterium bovis subsp bovis AF2122/97
caggccgggacagcgccg

SEQ ID NO: 1187263 - RNA, 19 nt, Mycobacterium bovis subsp bovis AF2122/97
caggccuugaccucgggua

SEQ ID NO: 1187264 - RNA, 18 nt, Mycobacterium bovis subsp bovis AF2122/97
caggcgaucgcccggccc

SEQ ID NO: 1187265 - RNA, 14 nt, Mycobacterium bovis subsp bovis AF2122/97
caggcgaugcgcca

SEQ ID NO: 1187266 - RNA, 14 nt, Mycobacterium bovis subsp bovis AF2122/97
caggccgccugggg

SEQ ID NO: 1187267 - RNA, 22 nt, Mycobacterium bovis subsp bovis AF2122/97
caggccgcgcgacaacccggcg

SEQ ID NO: 1187268 - RNA, 16 nt, Mycobacterium bovis subsp bovis AF2122/97
caggccgaugcggguc

SEQ ID NO: 1187269 - RNA, 17 nt, Mycobacterium bovis subsp bovis AF2122/97
caggcccgguggcggcu

SEQ ID NO: 1187270 - RNA, 20 nt, Mycobacterium bovis subsp bovis AF2122/97
caggcccggcggugugcgca

SEQ ID NO: 1187271 - RNA, 23 nt, Mycobacterium bovis subsp bovis AF2122/97
caggcccgugccuggccggugcg

SEQ ID NO: 1187272 - RNA, 16 nt, Mycobacterium bovis subsp bovis AF2122/97
caggcccuggccaccc

SEQ ID NO: 1187273 - RNA, 17 nt, Mycobacterium bovis subsp bovis AF2122/97
caggcccuggccaccca

SEQ ID NO: 1187274 - RNA, 14 nt, Mycobacterium bovis subsp bovis AF2122/97
caggccgagcagau

SEQ ID NO: 1187275 - RNA, 14 nt, Mycobacterium bovis subsp bovis AF2122/97
caggccgagcucgu

SEQ ID NO: 1187276 - RNA, 13 nt, Mycobacterium bovis subsp bovis AF2122/97
caggccgaggcga

SEQ ID NO: 1187277 - RNA, 16 nt, Mycobacterium bovis subsp bovis AF2122/97
caggccagugccaccu

SEQ ID NO: 1187278 - RNA, 21 nt, Mycobacterium bovis subsp bovis AF2122/97
caggccagugccaccugggcg

SEQ ID NO: 1187279 - RNA, 23 nt, Mycobacterium bovis subsp bovis AF2122/97
caggccagaguuugcgaugccca

SEQ ID NO: 1187280 - RNA, 21 nt, Mycobacterium bovis subsp bovis AF2122/97
caggccagggcgguggccacc

SEQ ID NO: 1187281 - RNA, 18 nt, Mycobacterium bovis subsp bovis AF2122/97
caggccagcggauuugcc

SEQ ID NO: 1187282 - RNA, 13 nt, Mycobacterium bovis subsp bovis AF2122/97
caggcccagcgga

SEQ ID NO: 1187283 - RNA, 17 nt, Mycobacterium bovis subsp bovis AF2122/97
caggcccagccgagcgg

SEQ ID NO: 1187284 - RNA, 12 nt, Mycobacterium bovis subsp bovis AF2122/97
caggcccacccg

SEQ ID NO: 1187285 - RNA, 14 nt, Mycobacterium bovis subsp bovis AF2122/97
caggcccacccggg

SEQ ID NO: 1187286 - RNA, 17 nt, Mycobacterium bovis subsp bovis AF2122/97
caggcccgacggcgccc

SEQ ID NO: 1187287 - RNA, 18 nt, Mycobacterium bovis subsp bovis AF2122/97
caggcccgccagcagggc

SEQ ID NO: 1187288 - RNA, 20 nt, Mycobacterium bovis subsp bovis AF2122/97
caggcccgccagcagggcca

SEQ ID NO: 1187289 - RNA, 16 nt, Mycobacterium bovis subsp bovis AF2122/97
caggcccggcaccgcg

SEQ ID NO: 1187290 - RNA, 19 nt, Mycobacterium bovis subsp bovis AF2122/97
caggccccacaccuuggcg

SEQ ID NO: 1187291 - RNA, 19 nt, Mycobacterium bovis subsp bovis AF2122/97
caggaugaugaccgccauc

SEQ ID NO: 1187292 - RNA, 22 nt, Mycobacterium bovis subsp bovis AF2122/97
caggcaucaccggaacccccag

SEQ ID NO: 1187293 - RNA, 20 nt, Mycobacterium bovis subsp bovis AF2122/97
caggcaucggaggaaccccg

SEQ ID NO: 1187294 - RNA, 21 nt, Mycobacterium bovis subsp bovis AF2122/97
caggcaucggaggaaccccgc

SEQ ID NO: 1187295 - RNA, 19 nt, Mycobacterium bovis subsp bovis AF2122/97
caggcauucccgcggcaac

SEQ ID NO: 1187296 - RNA, 13 nt, Mycobacterium bovis subsp bovis AF2122/97
caggcauggcgcc

SEQ ID NO: 1187297 - RNA, 16 nt, Mycobacterium bovis subsp bovis AF2122/97
caggaucacacuggcc

SEQ ID NO: 1187298 - RNA, 14 nt, Mycobacterium bovis subsp bovis AF2122/97
caguacaccggcgu

SEQ ID NO: 1187299 - RNA, 18 nt, Mycobacterium bovis subsp bovis AF2122/97
caguacaccgcccggccc

SEQ ID NO: 1187300 - RNA, 15 nt, Mycobacterium bovis subsp bovis AF2122/97
cagguucuucuccac

SEQ ID NO: 1187301 - RNA, 20 nt, Mycobacterium bovis subsp bovis AF2122/97
cagguucuucuccaccaccg

SEQ ID NO: 1187302 - RNA, 20 nt, Mycobacterium bovis subsp bovis AF2122/97
cagguuccacgcguugacga

SEQ ID NO: 1187303 - RNA, 22 nt, Mycobacterium bovis subsp bovis AF2122/97
cagguugaagaaugccgucuga

SEQ ID NO: 1187304 - RNA, 17 nt, Mycobacterium bovis subsp bovis AF2122/97
cagguuggccccggccc

SEQ ID NO: 1187305 - RNA, 13 nt, Mycobacterium bovis subsp bovis AF2122/97
cagguuggcacgc

SEQ ID NO: 1187306 - RNA, 14 nt, Mycobacterium bovis subsp bovis AF2122/97
cagguuggcacgcu

SEQ ID NO: 1187307 - RNA, 14 nt, Mycobacterium bovis subsp bovis AF2122/97
cagguuuccggccu

SEQ ID NO: 1187308 - RNA, 17 nt, Mycobacterium bovis subsp bovis AF2122/97
caggucggugggcggcg

SEQ ID NO: 1187309 - RNA, 23 nt, Mycobacterium bovis subsp bovis AF2122/97
caggucggcgaacaaccgccgcu

SEQ ID NO: 1187310 - RNA, 22 nt, Mycobacterium bovis subsp bovis AF2122/97
caggucguuugugaacaccccu

SEQ ID NO: 1187311 - RNA, 15 nt, Mycobacterium bovis subsp bovis AF2122/97
caggucggugacgaa

SEQ ID NO: 1187312 - RNA, 22 nt, Mycobacterium bovis subsp bovis AF2122/97
caggucggcgaacaaccgccgc

SEQ ID NO: 1187313 - RNA, 14 nt, Mycobacterium bovis subsp bovis AF2122/97
caggucggccaccg

SEQ ID NO: 1187314 - RNA, 16 nt, Mycobacterium bovis subsp bovis AF2122/97
caggucggccgccucg

SEQ ID NO: 1187315 - RNA, 19 nt, Mycobacterium bovis subsp bovis AF2122/97
caggucggaacuagccagu

SEQ ID NO: 1187316 - RNA, 16 nt, Mycobacterium bovis subsp bovis AF2122/97
caggucgcccaacacc

SEQ ID NO: 1187317 - RNA, 14 nt, Mycobacterium bovis subsp bovis AF2122/97
caggucgaugcugc

SEQ ID NO: 1187318 - RNA, 23 nt, Mycobacterium bovis subsp bovis AF2122/97
caggucgaugcugccagccaugg

SEQ ID NO: 1187319 - RNA, 14 nt, Mycobacterium bovis subsp bovis AF2122/97
caggucgcagacca

SEQ ID NO: 1187320 - RNA, 16 nt, Mycobacterium bovis subsp bovis AF2122/97
caggucgcagaccaga

SEQ ID NO: 1187321 - RNA, 23 nt, Mycobacterium bovis subsp bovis AF2122/97
caggucgcagaccagacugcagu

SEQ ID NO: 1187322 - RNA, 21 nt, Mycobacterium bovis subsp bovis AF2122/97
caggucgacauaggccaccuc

SEQ ID NO: 1187323 - RNA, 16 nt, Mycobacterium bovis subsp bovis AF2122/97
caggucgacggccacg

SEQ ID NO: 1187324 - RNA, 15 nt, Mycobacterium bovis subsp bovis AF2122/97
caggucgaucugcgc

SEQ ID NO: 1187325 - RNA, 21 nt, Mycobacterium bovis subsp bovis AF2122/97
caggucacuacuccggucccg

SEQ ID NO: 1187326 - RNA, 20 nt, Mycobacterium bovis subsp bovis AF2122/97
cagguauuugccgugcucac

SEQ ID NO: 1187327 - RNA, 18 nt, Mycobacterium bovis subsp bovis AF2122/97
caggggcgcagcgcggca

SEQ ID NO: 1187328 - RNA, 16 nt, Mycobacterium bovis subsp bovis AF2122/97
cagguccaccgcugcc

SEQ ID NO: 1187329 - RNA, 21 nt, Mycobacterium bovis subsp bovis AF2122/97
caggucaucggcggcggggac

SEQ ID NO: 1187330 - RNA, 18 nt, Mycobacterium bovis subsp bovis AF2122/97
caggucauugcacgccug

SEQ ID NO: 1187331 - RNA, 14 nt, Mycobacterium bovis subsp bovis AF2122/97
caggucagccgcgc

SEQ ID NO: 1187332 - RNA, 17 nt, Mycobacterium bovis subsp bovis AF2122/97
cagguccgcgugcugcc

SEQ ID NO: 1187333 - RNA, 18 nt, Mycobacterium bovis subsp bovis AF2122/97
cagguccggguuggccac

SEQ ID NO: 1187334 - RNA, 16 nt, Mycobacterium bovis subsp bovis AF2122/97
caggugauucgcgcag

SEQ ID NO: 1187335 - RNA, 16 nt, Mycobacterium bovis subsp bovis AF2122/97
caggucuucgcugucg

SEQ ID NO: 1187336 - RNA, 14 nt, Mycobacterium bovis subsp bovis AF2122/97
caggugcccgcccc

SEQ ID NO: 1187337 - RNA, 18 nt, Mycobacterium bovis subsp bovis AF2122/97
caggugcccggccaaaau

SEQ ID NO: 1187338 - RNA, 20 nt, Mycobacterium bovis subsp bovis AF2122/97
caggugccagaccagggcag

SEQ ID NO: 1187339 - RNA, 15 nt, Mycobacterium bovis subsp bovis AF2122/97
caggugcccaagcag

SEQ ID NO: 1187340 - RNA, 14 nt, Mycobacterium bovis subsp bovis AF2122/97
caggugccaaacgc

SEQ ID NO: 1187341 - RNA, 14 nt, Mycobacterium bovis subsp bovis AF2122/97
caggugccaaccgc

SEQ ID NO: 1187342 - RNA, 18 nt, Mycobacterium bovis subsp bovis AF2122/97
caggugccagaccagggc

SEQ ID NO: 1187343 - RNA, 15 nt, Mycobacterium bovis subsp bovis AF2122/97
caggugccuucuucg

SEQ ID NO: 1187344 - RNA, 20 nt, Mycobacterium bovis subsp bovis AF2122/97
caggugcccggccaaaaugg

SEQ ID NO: 1187345 - RNA, 21 nt, Mycobacterium bovis subsp bovis AF2122/97
caggugcugggcgaggugagg

SEQ ID NO: 1187346 - RNA, 19 nt, Mycobacterium bovis subsp bovis AF2122/97
caggugcguccaggccagg

SEQ ID NO: 1187347 - RNA, 17 nt, Mycobacterium bovis subsp bovis AF2122/97
caggugcgcgaccagga

SEQ ID NO: 1187348 - RNA, 15 nt, Mycobacterium bovis subsp bovis AF2122/97
caggugcgggccggu

SEQ ID NO: 1187349 - RNA, 18 nt, Mycobacterium bovis subsp bovis AF2122/97
cagguggccgcaucgccu

SEQ ID NO: 1187350 - RNA, 14 nt, Mycobacterium bovis subsp bovis AF2122/97
cagguggccgucgc

SEQ ID NO: 1187351 - RNA, 13 nt, Mycobacterium bovis subsp bovis AF2122/97
cagguggccaggc

SEQ ID NO: 1187352 - RNA, 17 nt, Mycobacterium bovis subsp bovis AF2122/97
cagguggaagugcaccu

SEQ ID NO: 1187353 - RNA, 20 nt, Mycobacterium bovis subsp bovis AF2122/97
caggugggggucaggcagga

SEQ ID NO: 1187354 - RNA, 20 nt, Mycobacterium bovis subsp bovis AF2122/97
cagguguaggugccccacuc

SEQ ID NO: 1187355 - RNA, 20 nt, Mycobacterium bovis subsp bovis AF2122/97
caggugucgcugcugaacaa

SEQ ID NO: 1187356 - RNA, 22 nt, Mycobacterium bovis subsp bovis AF2122/97
caggugucgcugcugaacaacc

SEQ ID NO: 1187357 - RNA, 15 nt, Mycobacterium bovis subsp bovis AF2122/97
caggugugccccgcu

SEQ ID NO: 1187358 - RNA, 20 nt, Mycobacterium bovis subsp bovis AF2122/97
cagguguuggacgccuugca

SEQ ID NO: 1187359 - RNA, 17 nt, Mycobacterium bovis subsp bovis AF2122/97
cagguuaggguccaggu

SEQ ID NO: 1187360 - RNA, 15 nt, Mycobacterium bovis subsp bovis AF2122/97
cagugaccgcagucc

SEQ ID NO: 1187361 - RNA, 19 nt, Mycobacterium bovis subsp bovis AF2122/97
cagugaccgcagucccagc

SEQ ID NO: 1187362 - RNA, 16 nt, Mycobacterium bovis subsp bovis AF2122/97
cagugaccgcuggugu

SEQ ID NO: 1187363 - RNA, 14 nt, Mycobacterium bovis subsp bovis AF2122/97
cagugacgccucga

SEQ ID NO: 1187364 - RNA, 21 nt, Mycobacterium bovis subsp bovis AF2122/97
cagugacgccucgacacccag

SEQ ID NO: 1187365 - RNA, 13 nt, Mycobacterium bovis subsp bovis AF2122/97
cagugagcccgcu

SEQ ID NO: 1187366 - RNA, 15 nt, Mycobacterium bovis subsp bovis AF2122/97
cagugagcaugcgac

SEQ ID NO: 1187367 - RNA, 15 nt, Mycobacterium bovis subsp bovis AF2122/97
cagugagccgccauu

SEQ ID NO: 1187368 - RNA, 15 nt, Mycobacterium bovis subsp bovis AF2122/97
cagugaugcgccccg

SEQ ID NO: 1187369 - RNA, 22 nt, Mycobacterium bovis subsp bovis AF2122/97
cagugauugagcagcaagccgc

SEQ ID NO: 1187370 - RNA, 23 nt, Mycobacterium bovis subsp bovis AF2122/97
cagugauucggccugagcggcca

SEQ ID NO: 1187371 - RNA, 16 nt, Mycobacterium bovis subsp bovis AF2122/97
cagugauugagcagca

SEQ ID NO: 1187372 - RNA, 16 nt, Mycobacterium bovis subsp bovis AF2122/97
cagugaauugcccaag

SEQ ID NO: 1187373 - RNA, 15 nt, Mycobacterium bovis subsp bovis AF2122/97
cagugaagacaccag

SEQ ID NO: 1187374 - RNA, 14 nt, Mycobacterium bovis subsp bovis AF2122/97
cagugaacgcgcgu

SEQ ID NO: 1187375 - RNA, 20 nt, Mycobacterium bovis subsp bovis AF2122/97
cagugaaauugccgccgccg

SEQ ID NO: 1187376 - RNA, 19 nt, Mycobacterium bovis subsp bovis AF2122/97
cagugaacauuggguaccu

SEQ ID NO: 1187377 - RNA, 18 nt, Mycobacterium bovis subsp bovis AF2122/97
cagucugauuccacauca

SEQ ID NO: 1187378 - RNA, 14 nt, Mycobacterium bovis subsp bovis AF2122/97
cagucugcgacugg

SEQ ID NO: 1187379 - RNA, 12 nt, Mycobacterium bovis subsp bovis AF2122/97
cagucgcggcgc

SEQ ID NO: 1187380 - RNA, 12 nt, Mycobacterium bovis subsp bovis AF2122/97
cagucgcggcgu

SEQ ID NO: 1187381 - RNA, 12 nt, Mycobacterium bovis subsp bovis AF2122/97
cagucgggcagc

SEQ ID NO: 1187382 - RNA, 14 nt, Mycobacterium bovis subsp bovis AF2122/97
cagucgcugggugg

SEQ ID NO: 1187383 - RNA, 17 nt, Mycobacterium bovis subsp bovis AF2122/97
cagucgugggcugugcg

SEQ ID NO: 1187384 - RNA, 14 nt, Mycobacterium bovis subsp bovis AF2122/97
cagucgggcagcgc

SEQ ID NO: 1187385 - RNA, 15 nt, Mycobacterium bovis subsp bovis AF2122/97
cagucgggcagcgcu

SEQ ID NO: 1187386 - RNA, 20 nt, Mycobacterium bovis subsp bovis AF2122/97
caguccggacggcagccggg

SEQ ID NO: 1187387 - RNA, 15 nt, Mycobacterium bovis subsp bovis AF2122/97
caguccgcagcgucc

SEQ ID NO: 1187388 - RNA, 17 nt, Mycobacterium bovis subsp bovis AF2122/97
caguccggcccccgacu

SEQ ID NO: 1187389 - RNA, 22 nt, Mycobacterium bovis subsp bovis AF2122/97
caguccggcccccgacuccggc

SEQ ID NO: 1187390 - RNA, 17 nt, Mycobacterium bovis subsp bovis AF2122/97
caguccccgccggccuc

SEQ ID NO: 1187391 - RNA, 18 nt, Mycobacterium bovis subsp bovis AF2122/97
caguccgaagcugcugcu

SEQ ID NO: 1187392 - RNA, 22 nt, Mycobacterium bovis subsp bovis AF2122/97
caguccgaugggaaucagugaa

SEQ ID NO: 1187393 - RNA, 21 nt, Mycobacterium bovis subsp bovis AF2122/97
cagucgaccggacacuccugc

SEQ ID NO: 1187394 - RNA, 15 nt, Mycobacterium bovis subsp bovis AF2122/97
cagucgaagaagacc

SEQ ID NO: 1187395 - RNA, 16 nt, Mycobacterium bovis subsp bovis AF2122/97
cagucgagcaucucgu

SEQ ID NO: 1187396 - RNA, 14 nt, Mycobacterium bovis subsp bovis AF2122/97
caguccucgggcag

SEQ ID NO: 1187397 - RNA, 16 nt, Mycobacterium bovis subsp bovis AF2122/97
caguccucaucgagcg

SEQ ID NO: 1187398 - RNA, 19 nt, Mycobacterium bovis subsp bovis AF2122/97
caguccucaucgagcgcgc

SEQ ID NO: 1187399 - RNA, 15 nt, Mycobacterium bovis subsp bovis AF2122/97
cagucccaguucguu

SEQ ID NO: 1187400 - RNA, 23 nt, Mycobacterium bovis subsp bovis AF2122/97
cagucccagcgccgcacagaaaa

SEQ ID NO: 1187401 - RNA, 18 nt, Mycobacterium bovis subsp bovis AF2122/97
cagucccacugggccggu

SEQ ID NO: 1187402 - RNA, 24 nt, Mycobacterium bovis subsp bovis AF2122/97
caguccaccgcgcggcgcagcacc

SEQ ID NO: 1187403 - RNA, 15 nt, Mycobacterium bovis subsp bovis AF2122/97
caguccagcgggcau

SEQ ID NO: 1187404 - RNA, 13 nt, Mycobacterium bovis subsp bovis AF2122/97
cagucaggaaacc

SEQ ID NO: 1187405 - RNA, 17 nt, Mycobacterium bovis subsp bovis AF2122/97
caguaugaggucuacuu

SEQ ID NO: 1187406 - RNA, 13 nt, Mycobacterium bovis subsp bovis AF2122/97
cagucaacagggc

SEQ ID NO: 1187407 - RNA, 15 nt, Mycobacterium bovis subsp bovis AF2122/97
cagucaacagggcca

SEQ ID NO: 1187408 - RNA, 13 nt, Mycobacterium bovis subsp bovis AF2122/97
cagucacgcccac

SEQ ID NO: 1187409 - RNA, 17 nt, Mycobacterium bovis subsp bovis AF2122/97
cagucacgcccaccacu

SEQ ID NO: 1187410 - RNA, 18 nt, Mycobacterium bovis subsp bovis AF2122/97
cagucacgcccaccacug

SEQ ID NO: 1187411 - RNA, 14 nt, Mycobacterium bovis subsp bovis AF2122/97
caguagccacgccc

SEQ ID NO: 1187412 - RNA, 20 nt, Mycobacterium bovis subsp bovis AF2122/97
caguagcacguugacgucca

SEQ ID NO: 1187413 - RNA, 16 nt, Mycobacterium bovis subsp bovis AF2122/97
caguagcuguggcccg

SEQ ID NO: 1187414 - RNA, 23 nt, Mycobacterium bovis subsp bovis AF2122/97
caguacgaucucauccuccugcg

SEQ ID NO: 1187415 - RNA, 13 nt, Mycobacterium bovis subsp bovis AF2122/97
caguacgcgcuga

SEQ ID NO: 1187416 - RNA, 19 nt, Mycobacterium bovis subsp bovis AF2122/97
caguacuaacaacaccacc

SEQ ID NO: 1187417 - RNA, 16 nt, Mycobacterium bovis subsp bovis AF2122/97
caguacgguccggcgu

SEQ ID NO: 1187418 - RNA, 19 nt, Mycobacterium bovis subsp bovis AF2122/97
cagcgccgcugacuccugc

SEQ ID NO: 1187419 - RNA, 20 nt, Mycobacterium bovis subsp bovis AF2122/97
cagcgccgcugacuccugcg

SEQ ID NO: 1187420 - RNA, 22 nt, Mycobacterium bovis subsp bovis AF2122/97
cagcgccgcugacuccugcggc

SEQ ID NO: 1187421 - RNA, 19 nt, Mycobacterium bovis subsp bovis AF2122/97
cagcgccggaagcuucggg

SEQ ID NO: 1187422 - RNA, 18 nt, Mycobacterium bovis subsp bovis AF2122/97
cagcgccggauccacacc

SEQ ID NO: 1187423 - RNA, 17 nt, Mycobacterium bovis subsp bovis AF2122/97
cagcgccuccagcacca

SEQ ID NO: 1187424 - RNA, 18 nt, Mycobacterium bovis subsp bovis AF2122/97
cagcgccuccagcaccac

SEQ ID NO: 1187425 - RNA, 14 nt, Mycobacterium bovis subsp bovis AF2122/97
cagcgccuccagca

SEQ ID NO: 1187426 - RNA, 17 nt, Mycobacterium bovis subsp bovis AF2122/97
cagcgccuccacucuuc

SEQ ID NO: 1187427 - RNA, 12 nt, Mycobacterium bovis subsp bovis AF2122/97
cagcgccuccag

SEQ ID NO: 1187428 - RNA, 18 nt, Mycobacterium bovis subsp bovis AF2122/97
cagcgccuaccagcaccg

SEQ ID NO: 1187429 - RNA, 11 nt, Mycobacterium bovis subsp bovis AF2122/97
cagcgccucca

SEQ ID NO: 1187430 - RNA, 16 nt, Mycobacterium bovis subsp bovis AF2122/97
cagcgccgccggcgcc

SEQ ID NO: 1187431 - RNA, 13 nt, Mycobacterium bovis subsp bovis AF2122/97
cagcgccgcgcgc

SEQ ID NO: 1187432 - RNA, 15 nt, Mycobacterium bovis subsp bovis AF2122/97
cagcgccgcgcccca

SEQ ID NO: 1187433 - RNA, 17 nt, Mycobacterium bovis subsp bovis AF2122/97
cagcgcccggcccgcca

SEQ ID NO: 1187434 - RNA, 20 nt, Mycobacterium bovis subsp bovis AF2122/97
cagcgcccggcccgccaccc

SEQ ID NO: 1187435 - RNA, 16 nt, Mycobacterium bovis subsp bovis AF2122/97
cagcgcccgcaggugg

SEQ ID NO: 1187436 - RNA, 18 nt, Mycobacterium bovis subsp bovis AF2122/97
cagcgccgagagcaccgc

SEQ ID NO: 1187437 - RNA, 16 nt, Mycobacterium bovis subsp bovis AF2122/97
cagcgcgcgcugagcc

SEQ ID NO: 1187438 - RNA, 15 nt, Mycobacterium bovis subsp bovis AF2122/97
cagcgcggcgcgaca

SEQ ID NO: 1187439 - RNA, 14 nt, Mycobacterium bovis subsp bovis AF2122/97
cagcgcggcgcgca

SEQ ID NO: 1187440 - RNA, 14 nt, Mycobacterium bovis subsp bovis AF2122/97
cagcgcggcgcgcg

SEQ ID NO: 1187441 - RNA, 16 nt, Mycobacterium bovis subsp bovis AF2122/97
cagcgcgaucaacgcg

SEQ ID NO: 1187442 - RNA, 14 nt, Mycobacterium bovis subsp bovis AF2122/97
cagcgcgcgcgggu

SEQ ID NO: 1187443 - RNA, 12 nt, Mycobacterium bovis subsp bovis AF2122/97
cagcgcgccgcg

SEQ ID NO: 1187444 - RNA, 13 nt, Mycobacterium bovis subsp bovis AF2122/97
cagcgcgccggcg

SEQ ID NO: 1187445 - RNA, 14 nt, Mycobacterium bovis subsp bovis AF2122/97
cagcgcgccgcguu

SEQ ID NO: 1187446 - RNA, 19 nt, Mycobacterium bovis subsp bovis AF2122/97
cagcgcgcccgacacccgu

SEQ ID NO: 1187447 - RNA, 20 nt, Mycobacterium bovis subsp bovis AF2122/97
cagcgcgaucugcucgcccc

SEQ ID NO: 1187448 - RNA, 22 nt, Mycobacterium bovis subsp bovis AF2122/97
cagcgcgaacaccaugaucagg

SEQ ID NO: 1187449 - RNA, 22 nt, Mycobacterium bovis subsp bovis AF2122/97
cagcgccuuguggcacacccgc

SEQ ID NO: 1187450 - RNA, 16 nt, Mycobacterium bovis subsp bovis AF2122/97
cagcgcgaccaaugcg

SEQ ID NO: 1187451 - RNA, 14 nt, Mycobacterium bovis subsp bovis AF2122/97
cagcgccuccucga

SEQ ID NO: 1187452 - RNA, 19 nt, Mycobacterium bovis subsp bovis AF2122/97
cagcgccuccagcaccacg

SEQ ID NO: 1187453 - RNA, 19 nt, Mycobacterium bovis subsp bovis AF2122/97
cagcgcccggccacuccag

SEQ ID NO: 1187454 - RNA, 13 nt, Mycobacterium bovis subsp bovis AF2122/97
cagcgcccggccc

SEQ ID NO: 1187455 - RNA, 17 nt, Mycobacterium bovis subsp bovis AF2122/97
cagcgcccccagcagcu

SEQ ID NO: 1187456 - RNA, 14 nt, Mycobacterium bovis subsp bovis AF2122/97
cagcgcccccggac

SEQ ID NO: 1187457 - RNA, 21 nt, Mycobacterium bovis subsp bovis AF2122/97
cagcgccccaugcaacacacc

SEQ ID NO: 1187458 - RNA, 22 nt, Mycobacterium bovis subsp bovis AF2122/97
cagcgccagugccucgcggggu

SEQ ID NO: 1187459 - RNA, 16 nt, Mycobacterium bovis subsp bovis AF2122/97
cagcgccagcgccugc

SEQ ID NO: 1187460 - RNA, 12 nt, Mycobacterium bovis subsp bovis AF2122/97
cagcgccacccg

SEQ ID NO: 1187461 - RNA, 13 nt, Mycobacterium bovis subsp bovis AF2122/97
cagcgccacccgg

SEQ ID NO: 1187462 - RNA, 23 nt, Mycobacterium bovis subsp bovis AF2122/97
cagcgccacuggaagccaagcua

SEQ ID NO: 1187463 - RNA, 17 nt, Mycobacterium bovis subsp bovis AF2122/97
cagcgacuccagcgccc

SEQ ID NO: 1187464 - RNA, 22 nt, Mycobacterium bovis subsp bovis AF2122/97
cagcgacgucgcaauaugccac

SEQ ID NO: 1187465 - RNA, 13 nt, Mycobacterium bovis subsp bovis AF2122/97
cagcgacggccgc

SEQ ID NO: 1187466 - RNA, 15 nt, Mycobacterium bovis subsp bovis AF2122/97
cagcgacggccgcca

SEQ ID NO: 1187467 - RNA, 17 nt, Mycobacterium bovis subsp bovis AF2122/97
cagcgacgcugccgcca

SEQ ID NO: 1187468 - RNA, 20 nt, Mycobacterium bovis subsp bovis AF2122/97
cagcgacgcugccgccaggc

SEQ ID NO: 1187469 - RNA, 14 nt, Mycobacterium bovis subsp bovis AF2122/97
cagcgacuugcugg

SEQ ID NO: 1187470 - RNA, 21 nt, Mycobacterium bovis subsp bovis AF2122/97
cagcgacuuggcaucgcgagc

SEQ ID NO: 1187471 - RNA, 19 nt, Mycobacterium bovis subsp bovis AF2122/97
cagcgaaucgcuggugaag

SEQ ID NO: 1187472 - RNA, 16 nt, Mycobacterium bovis subsp bovis AF2122/97
cagcgagaccucucug

SEQ ID NO: 1187473 - RNA, 18 nt, Mycobacterium bovis subsp bovis AF2122/97
cagcgccaacgcccccau

SEQ ID NO: 1187474 - RNA, 18 nt, Mycobacterium bovis subsp bovis AF2122/97
cagcgcagcagcggcauc

SEQ ID NO: 1187475 - RNA, 14 nt, Mycobacterium bovis subsp bovis AF2122/97
cagcgcacugcccg

SEQ ID NO: 1187476 - RNA, 20 nt, Mycobacterium bovis subsp bovis AF2122/97
cagcgccacauacaccggcc

SEQ ID NO: 1187477 - RNA, 12 nt, Mycobacterium bovis subsp bovis AF2122/97
cagcgcacccgg

SEQ ID NO: 1187478 - RNA, 22 nt, Mycobacterium bovis subsp bovis AF2122/97
cagcgcacuacucgaacaaccc

SEQ ID NO: 1187479 - RNA, 22 nt, Mycobacterium bovis subsp bovis AF2122/97
cagcgcaaugcaucgcggcggc

SEQ ID NO: 1187480 - RNA, 14 nt, Mycobacterium bovis subsp bovis AF2122/97
cagccgaagcgccc

SEQ ID NO: 1187481 - RNA, 16 nt, Mycobacterium bovis subsp bovis AF2122/97
cagccgaaccggcacc

SEQ ID NO: 1187482 - RNA, 17 nt, Mycobacterium bovis subsp bovis AF2122/97
cagccgaaccggcacca

SEQ ID NO: 1187483 - RNA, 16 nt, Mycobacterium bovis subsp bovis AF2122/97
cagccgacagaugguc

SEQ ID NO: 1187484 - RNA, 18 nt, Mycobacterium bovis subsp bovis AF2122/97
cagccgacaacuguccug

SEQ ID NO: 1187485 - RNA, 16 nt, Mycobacterium bovis subsp bovis AF2122/97
cagcccuaucagccga

SEQ ID NO: 1187486 - RNA, 22 nt, Mycobacterium bovis subsp bovis AF2122/97
cagcccucugguggcgcugaag

SEQ ID NO: 1187487 - RNA, 15 nt, Mycobacterium bovis subsp bovis AF2122/97
cagcccguugcagga

SEQ ID NO: 1187488 - RNA, 15 nt, Mycobacterium bovis subsp bovis AF2122/97
cagcccgugacuggu

SEQ ID NO: 1187489 - RNA, 20 nt, Mycobacterium bovis subsp bovis AF2122/97
cagccaugcucgucuugggc

SEQ ID NO: 1187490 - RNA, 19 nt, Mycobacterium bovis subsp bovis AF2122/97
cagccauggcagcgccgca

SEQ ID NO: 1187491 - RNA, 23 nt, Mycobacterium bovis subsp bovis AF2122/97
cagccaugcgguuugccggugcg

SEQ ID NO: 1187492 - RNA, 14 nt, Mycobacterium bovis subsp bovis AF2122/97
cagccgcagcggcc

SEQ ID NO: 1187493 - RNA, 14 nt, Mycobacterium bovis subsp bovis AF2122/97
cagccgccaaccgc

SEQ ID NO: 1187494 - RNA, 20 nt, Mycobacterium bovis subsp bovis AF2122/97
cagccgcccgcccaccucga

SEQ ID NO: 1187495 - RNA, 14 nt, Mycobacterium bovis subsp bovis AF2122/97
cagccgcgagccgg

SEQ ID NO: 1187496 - RNA, 17 nt, Mycobacterium bovis subsp bovis AF2122/97
cagccgcgacgcggcgu

SEQ ID NO: 1187497 - RNA, 21 nt, Mycobacterium bovis subsp bovis AF2122/97
cagccgcgacacgugcaucug

SEQ ID NO: 1187498 - RNA, 15 nt, Mycobacterium bovis subsp bovis AF2122/97
cagccgccggccggc

SEQ ID NO: 1187499 - RNA, 13 nt, Mycobacterium bovis subsp bovis AF2122/97
cagccgccgccug

SEQ ID NO: 1187500 - RNA, 14 nt, Mycobacterium bovis subsp bovis AF2122/97
cagccgccgcgccc

SEQ ID NO: 1187501 - RNA, 17 nt, Mycobacterium bovis subsp bovis AF2122/97
cagccgccgcgccccgc

SEQ ID NO: 1187502 - RNA, 21 nt, Mycobacterium bovis subsp bovis AF2122/97
cagccgaucgucucggccacg

SEQ ID NO: 1187503 - RNA, 15 nt, Mycobacterium bovis subsp bovis AF2122/97
cagccgacgcggcgg

SEQ ID NO: 1187504 - RNA, 16 nt, Mycobacterium bovis subsp bovis AF2122/97
cagccgagacaccacg

SEQ ID NO: 1187505 - RNA, 16 nt, Mycobacterium bovis subsp bovis AF2122/97
cagccgagcguggcgu

SEQ ID NO: 1187506 - RNA, 23 nt, Mycobacterium bovis subsp bovis AF2122/97
cagccgagcucacuucacgccgc

SEQ ID NO: 1187507 - RNA, 14 nt, Mycobacterium bovis subsp bovis AF2122/97
cagccgcaccccgc

SEQ ID NO: 1187508 - RNA, 15 nt, Mycobacterium bovis subsp bovis AF2122/97
cagccgcaccccgcc

SEQ ID NO: 1187509 - RNA, 21 nt, Mycobacterium bovis subsp bovis AF2122/97
cagccgcaacaccccccgucc

SEQ ID NO: 1187510 - RNA, 13 nt, Mycobacterium bovis subsp bovis AF2122/97
cagccgaugcucg

SEQ ID NO: 1187511 - RNA, 12 nt, Mycobacterium bovis subsp bovis AF2122/97
cagccgaugcug

SEQ ID NO: 1187512 - RNA, 13 nt, Mycobacterium bovis subsp bovis AF2122/97
cagcgacaagugc

SEQ ID NO: 1187513 - RNA, 13 nt, Mycobacterium bovis subsp bovis AF2122/97
cagcgaauccagc

SEQ ID NO: 1187514 - RNA, 19 nt, Mycobacterium bovis subsp bovis AF2122/97
cagcgaaccgccggcaccg

SEQ ID NO: 1187515 - RNA, 21 nt, Mycobacterium bovis subsp bovis AF2122/97
cagcgaaccggcugggcgcca

SEQ ID NO: 1187516 - RNA, 14 nt, Mycobacterium bovis subsp bovis AF2122/97
cagccuggccaucg

SEQ ID NO: 1187517 - RNA, 12 nt, Mycobacterium bovis subsp bovis AF2122/97
cagccugcugca

SEQ ID NO: 1187518 - RNA, 20 nt, Mycobacterium bovis subsp bovis AF2122/97
cagccugcuggccgcggccu

SEQ ID NO: 1187519 - RNA, 24 nt, Mycobacterium bovis subsp bovis AF2122/97
cagccugcuggccgcggccucgua

SEQ ID NO: 1187520 - RNA, 17 nt, Mycobacterium bovis subsp bovis AF2122/97
cagcgaaacgagccggu

SEQ ID NO: 1187521 - RNA, 13 nt, Mycobacterium bovis subsp bovis AF2122/97
cagccggcccugc

SEQ ID NO: 1187522 - RNA, 13 nt, Mycobacterium bovis subsp bovis AF2122/97
cagccuccaccag

SEQ ID NO: 1187523 - RNA, 15 nt, Mycobacterium bovis subsp bovis AF2122/97
cagccggcagcagcg

SEQ ID NO: 1187524 - RNA, 14 nt, Mycobacterium bovis subsp bovis AF2122/97
cagccugcgccgcg

SEQ ID NO: 1187525 - RNA, 23 nt, Mycobacterium bovis subsp bovis AF2122/97
cagccugcaacgucuugcugguc

SEQ ID NO: 1187526 - RNA, 20 nt, Mycobacterium bovis subsp bovis AF2122/97
cagccugcaacgucuugcug

SEQ ID NO: 1187527 - RNA, 13 nt, Mycobacterium bovis subsp bovis AF2122/97
cagccugcagcga

SEQ ID NO: 1187528 - RNA, 17 nt, Mycobacterium bovis subsp bovis AF2122/97
cagcagcgggcgcgcua

SEQ ID NO: 1187529 - RNA, 16 nt, Mycobacterium bovis subsp bovis AF2122/97
cagcagcggcgagcca

SEQ ID NO: 1187530 - RNA, 22 nt, Mycobacterium bovis subsp bovis AF2122/97
cagcagcggcggaaggacggca

SEQ ID NO: 1187531 - RNA, 20 nt, Mycobacterium bovis subsp bovis AF2122/97
cagcagcguugacggcuucg

SEQ ID NO: 1187532 - RNA, 15 nt, Mycobacterium bovis subsp bovis AF2122/97
cagcagcgucggugc

SEQ ID NO: 1187533 - RNA, 14 nt, Mycobacterium bovis subsp bovis AF2122/97
cagcagcgguugau

SEQ ID NO: 1187534 - RNA, 18 nt, Mycobacterium bovis subsp bovis AF2122/97
cagcagcgguugaugcgg

SEQ ID NO: 1187535 - RNA, 13 nt, Mycobacterium bovis subsp bovis AF2122/97
cagcagcgcgaca

SEQ ID NO: 1187536 - RNA, 15 nt, Mycobacterium bovis subsp bovis AF2122/97
cagcagaccaagucc

SEQ ID NO: 1187537 - RNA, 14 nt, Mycobacterium bovis subsp bovis AF2122/97
cagcagcgccaccc

SEQ ID NO: 1187538 - RNA, 15 nt, Mycobacterium bovis subsp bovis AF2122/97
cagcagcgccacccg

SEQ ID NO: 1187539 - RNA, 19 nt, Mycobacterium bovis subsp bovis AF2122/97
cagcagcgcacugcccggg

SEQ ID NO: 1187540 - RNA, 13 nt, Mycobacterium bovis subsp bovis AF2122/97
cagcagagcggca

SEQ ID NO: 1187541 - RNA, 14 nt, Mycobacterium bovis subsp bovis AF2122/97
cagcaggcccuggc

SEQ ID NO: 1187542 - RNA, 19 nt, Mycobacterium bovis subsp bovis AF2122/97
cagcaggcccuggccaccc

SEQ ID NO: 1187543 - RNA, 20 nt, Mycobacterium bovis subsp bovis AF2122/97
cagcaggccgcgcucgucga

SEQ ID NO: 1187544 - RNA, 15 nt, Mycobacterium bovis subsp bovis AF2122/97
cagcaggcccagcgg

SEQ ID NO: 1187545 - RNA, 15 nt, Mycobacterium bovis subsp bovis AF2122/97
cagcaggccgggcgc

SEQ ID NO: 1187546 - RNA, 16 nt, Mycobacterium bovis subsp bovis AF2122/97
cagcaggccgggcgca

SEQ ID NO: 1187547 - RNA, 17 nt, Mycobacterium bovis subsp bovis AF2122/97
cagcaggccgggcgcaa

SEQ ID NO: 1187548 - RNA, 22 nt, Mycobacterium bovis subsp bovis AF2122/97
cagcaggccgggcgcaagcagc

SEQ ID NO: 1187549 - RNA, 14 nt, Mycobacterium bovis subsp bovis AF2122/97
cagcaggccuccaa

SEQ ID NO: 1187550 - RNA, 14 nt, Mycobacterium bovis subsp bovis AF2122/97
cagcaggcccaccc

SEQ ID NO: 1187551 - RNA, 18 nt, Mycobacterium bovis subsp bovis AF2122/97
cagcaggcccuucaguuc

SEQ ID NO: 1187552 - RNA, 14 nt, Mycobacterium bovis subsp bovis AF2122/97
cagcaggaugauga

SEQ ID NO: 1187553 - RNA, 23 nt, Mycobacterium bovis subsp bovis AF2122/97
cagcagcuuguuuuccaccagcg

SEQ ID NO: 1187554 - RNA, 20 nt, Mycobacterium bovis subsp bovis AF2122/97
cagcagcuugacaucgguca

SEQ ID NO: 1187555 - RNA, 14 nt, Mycobacterium bovis subsp bovis AF2122/97
cagcagcuccacug

SEQ ID NO: 1187556 - RNA, 20 nt, Mycobacterium bovis subsp bovis AF2122/97
cagcaggugccaaccgcggc

SEQ ID NO: 1187557 - RNA, 17 nt, Mycobacterium bovis subsp bovis AF2122/97
cagcaggucgucggcgu

SEQ ID NO: 1187558 - RNA, 20 nt, Mycobacterium bovis subsp bovis AF2122/97
cagcagguuggucaccaccu

SEQ ID NO: 1187559 - RNA, 16 nt, Mycobacterium bovis subsp bovis AF2122/97
cagcagguuggcgagc

SEQ ID NO: 1187560 - RNA, 20 nt, Mycobacterium bovis subsp bovis AF2122/97
cagcaggugagccaguuggc

SEQ ID NO: 1187561 - RNA, 18 nt, Mycobacterium bovis subsp bovis AF2122/97
cagcagguuccacggcca

SEQ ID NO: 1187562 - RNA, 20 nt, Mycobacterium bovis subsp bovis AF2122/97
cagcaggggacgggcggcca

SEQ ID NO: 1187563 - RNA, 20 nt, Mycobacterium bovis subsp bovis AF2122/97
cagcagggcuucgugcacca

SEQ ID NO: 1187564 - RNA, 14 nt, Mycobacterium bovis subsp bovis AF2122/97
cagcagggcgcgca

SEQ ID NO: 1187565 - RNA, 22 nt, Mycobacterium bovis subsp bovis AF2122/97
cagcaggggaucguccggccgg

SEQ ID NO: 1187566 - RNA, 20 nt, Mycobacterium bovis subsp bovis AF2122/97
cagcaggcucgaaccgacgc

SEQ ID NO: 1187567 - RNA, 17 nt, Mycobacterium bovis subsp bovis AF2122/97
cagcagggccaccacca

SEQ ID NO: 1187568 - RNA, 16 nt, Mycobacterium bovis subsp bovis AF2122/97
cagcaguacaccgccc

SEQ ID NO: 1187569 - RNA, 15 nt, Mycobacterium bovis subsp bovis AF2122/97
cagcagugccgugcu

SEQ ID NO: 1187570 - RNA, 19 nt, Mycobacterium bovis subsp bovis AF2122/97
cagcagugccgugcugaac

SEQ ID NO: 1187571 - RNA, 23 nt, Mycobacterium bovis subsp bovis AF2122/97
cagcaguucggcgaugcgcgggu

SEQ ID NO: 1187572 - RNA, 20 nt, Mycobacterium bovis subsp bovis AF2122/97
cagcauaucgauucgggcgu

SEQ ID NO: 1187573 - RNA, 14 nt, Mycobacterium bovis subsp bovis AF2122/97
cagccacgucuccu

SEQ ID NO: 1187574 - RNA, 20 nt, Mycobacterium bovis subsp bovis AF2122/97
cagccacguagacaaggcca

SEQ ID NO: 1187575 - RNA, 21 nt, Mycobacterium bovis subsp bovis AF2122/97
cagccacguagacaaggccaa

SEQ ID NO: 1187576 - RNA, 14 nt, Mycobacterium bovis subsp bovis AF2122/97
cagccagccugcug

SEQ ID NO: 1187577 - RNA, 22 nt, Mycobacterium bovis subsp bovis AF2122/97
cagccagccugcuggccgcggc

SEQ ID NO: 1187578 - RNA, 15 nt, Mycobacterium bovis subsp bovis AF2122/97
cagccaggugcccaa

SEQ ID NO: 1187579 - RNA, 23 nt, Mycobacterium bovis subsp bovis AF2122/97
cagccagggucccgccgccugga

SEQ ID NO: 1187580 - RNA, 21 nt, Mycobacterium bovis subsp bovis AF2122/97
cagccaggugcccaagcaguc

SEQ ID NO: 1187581 - RNA, 17 nt, Mycobacterium bovis subsp bovis AF2122/97
cagccaggcgugcacag

SEQ ID NO: 1187582 - RNA, 16 nt, Mycobacterium bovis subsp bovis AF2122/97
cagccaggagccgauc

SEQ ID NO: 1187583 - RNA, 14 nt, Mycobacterium bovis subsp bovis AF2122/97
cagccagcuggacu

SEQ ID NO: 1187584 - RNA, 23 nt, Mycobacterium bovis subsp bovis AF2122/97
cagccaggagccgaucacgcugc

SEQ ID NO: 1187585 - RNA, 17 nt, Mycobacterium bovis subsp bovis AF2122/97
cagccacagccgaccuc

SEQ ID NO: 1187586 - RNA, 15 nt, Mycobacterium bovis subsp bovis AF2122/97
cagccacagcccggc

SEQ ID NO: 1187587 - RNA, 12 nt, Mycobacterium bovis subsp bovis AF2122/97
cagccaccacca

SEQ ID NO: 1187588 - RNA, 13 nt, Mycobacterium bovis subsp bovis AF2122/97
cagccaccaccag

SEQ ID NO: 1187589 - RNA, 15 nt, Mycobacterium bovis subsp bovis AF2122/97
cagccaccagcgacg

SEQ ID NO: 1187590 - RNA, 21 nt, Mycobacterium bovis subsp bovis AF2122/97
cagccaccagcgacgaccaca

SEQ ID NO: 1187591 - RNA, 15 nt, Mycobacterium bovis subsp bovis AF2122/97
cagccacgccacguc

SEQ ID NO: 1187592 - RNA, 23 nt, Mycobacterium bovis subsp bovis AF2122/97
cagccaccugccgacucaucggc

SEQ ID NO: 1187593 - RNA, 15 nt, Mycobacterium bovis subsp bovis AF2122/97
cagccacgcacaaua

SEQ ID NO: 1187594 - RNA, 18 nt, Mycobacterium bovis subsp bovis AF2122/97
cagccacgauccuuggcg

SEQ ID NO: 1187595 - RNA, 17 nt, Mycobacterium bovis subsp bovis AF2122/97
cagccacccgacaacgc

SEQ ID NO: 1187596 - RNA, 17 nt, Mycobacterium bovis subsp bovis AF2122/97
cagccaccgcggucagc

SEQ ID NO: 1187597 - RNA, 19 nt, Mycobacterium bovis subsp bovis AF2122/97
cagccaccgcggucagcuc

SEQ ID NO: 1187598 - RNA, 14 nt, Mycobacterium bovis subsp bovis AF2122/97
cagccaccgggcgu

SEQ ID NO: 1187599 - RNA, 21 nt, Mycobacterium bovis subsp bovis AF2122/97
cagccaaaacgagcagauggu

SEQ ID NO: 1187600 - RNA, 20 nt, Mycobacterium bovis subsp bovis AF2122/97
cagccaaaaacgcugccgcc

SEQ ID NO: 1187601 - RNA, 14 nt, Mycobacterium bovis subsp bovis AF2122/97
cagcauugaagaag

SEQ ID NO: 1187602 - RNA, 23 nt, Mycobacterium bovis subsp bovis AF2122/97
cagcaucgcggugguuggggcug

SEQ ID NO: 1187603 - RNA, 17 nt, Mycobacterium bovis subsp bovis AF2122/97
cagcaucggcaccccgg

SEQ ID NO: 1187604 - RNA, 17 nt, Mycobacterium bovis subsp bovis AF2122/97
cagcaucggcagcagcg

SEQ ID NO: 1187605 - RNA, 15 nt, Mycobacterium bovis subsp bovis AF2122/97
cagcaucuccgucgg

SEQ ID NO: 1187606 - RNA, 20 nt, Mycobacterium bovis subsp bovis AF2122/97
cagcaucuccgucggccagg

SEQ ID NO: 1187607 - RNA, 13 nt, Mycobacterium bovis subsp bovis AF2122/97
cagcauccggccg

SEQ ID NO: 1187608 - RNA, 23 nt, Mycobacterium bovis subsp bovis AF2122/97
cagcauccggccgucaucuggaa

SEQ ID NO: 1187609 - RNA, 20 nt, Mycobacterium bovis subsp bovis AF2122/97
cagcaucaaccguccccggc

SEQ ID NO: 1187610 - RNA, 17 nt, Mycobacterium bovis subsp bovis AF2122/97
cagcaucagcgccagcg

SEQ ID NO: 1187611 - RNA, 20 nt, Mycobacterium bovis subsp bovis AF2122/97
cagcaucacguccgcggugu

SEQ ID NO: 1187612 - RNA, 14 nt, Mycobacterium bovis subsp bovis AF2122/97
cagcaugccuucgg

SEQ ID NO: 1187613 - RNA, 14 nt, Mycobacterium bovis subsp bovis AF2122/97
cagcaugcccgcca

SEQ ID NO: 1187614 - RNA, 23 nt, Mycobacterium bovis subsp bovis AF2122/97
cagcaugacaccggccaccagcc

SEQ ID NO: 1187615 - RNA, 13 nt, Mycobacterium bovis subsp bovis AF2122/97
cagcaugacaccg

SEQ ID NO: 1187616 - RNA, 17 nt, Mycobacterium bovis subsp bovis AF2122/97
cagcaugacaccggcca

SEQ ID NO: 1187617 - RNA, 21 nt, Mycobacterium bovis subsp bovis AF2122/97
cagcaugucucgggcgcgggu

SEQ ID NO: 1187618 - RNA, 18 nt, Mycobacterium bovis subsp bovis AF2122/97
cagcauuagccaggcccg

SEQ ID NO: 1187619 - RNA, 13 nt, Mycobacterium bovis subsp bovis AF2122/97
cagcauggcccug

SEQ ID NO: 1187620 - RNA, 17 nt, Mycobacterium bovis subsp bovis AF2122/97
cagcaugguccacagcc

SEQ ID NO: 1187621 - RNA, 19 nt, Mycobacterium bovis subsp bovis AF2122/97
cagcauggugcggcggcgu

SEQ ID NO: 1187622 - RNA, 15 nt, Mycobacterium bovis subsp bovis AF2122/97
cagcaugguggacga

SEQ ID NO: 1187623 - RNA, 20 nt, Mycobacterium bovis subsp bovis AF2122/97
cagcauggcuuuugcgccga

SEQ ID NO: 1187624 - RNA, 21 nt, Mycobacterium bovis subsp bovis AF2122/97
cacgucgagguccaccacccu

SEQ ID NO: 1187625 - RNA, 18 nt, Mycobacterium bovis subsp bovis AF2122/97
cacgucgcccaggguguc

SEQ ID NO: 1187626 - RNA, 16 nt, Mycobacterium bovis subsp bovis AF2122/97
cacgucgcccccggcc

SEQ ID NO: 1187627 - RNA, 16 nt, Mycobacterium bovis subsp bovis AF2122/97
cacgucgucgcccagg

SEQ ID NO: 1187628 - RNA, 18 nt, Mycobacterium bovis subsp bovis AF2122/97
cacgucgggaugcccgcu

SEQ ID NO: 1187629 - RNA, 12 nt, Mycobacterium bovis subsp bovis AF2122/97
cacgucgggccc

SEQ ID NO: 1187630 - RNA, 21 nt, Mycobacterium bovis subsp bovis AF2122/97
cacgucgucgucccagggcug

SEQ ID NO: 1187631 - RNA, 19 nt, Mycobacterium bovis subsp bovis AF2122/97
cacgucguuuggccucagc

SEQ ID NO: 1187632 - RNA, 17 nt, Mycobacterium bovis subsp bovis AF2122/97
cacgucuaacacgcggu

SEQ ID NO: 1187633 - RNA, 22 nt, Mycobacterium bovis subsp bovis AF2122/97
cacuuucagaucgaucugcggg

SEQ ID NO: 1187634 - RNA, 12 nt, Mycobacterium bovis subsp bovis AF2122/97
cacuuucuuccu

SEQ ID NO: 1187635 - RNA, 19 nt, Mycobacterium bovis subsp bovis AF2122/97
cagaaaccccaaacaaccc

SEQ ID NO: 1187636 - RNA, 23 nt, Mycobacterium bovis subsp bovis AF2122/97
cagaaaccaggacccaucgccag

SEQ ID NO: 1187637 - RNA, 17 nt, Mycobacterium bovis subsp bovis AF2122/97
cagaaacgcgauggugg

SEQ ID NO: 1187638 - RNA, 14 nt, Mycobacterium bovis subsp bovis AF2122/97
cagacaggauugcc

SEQ ID NO: 1187639 - RNA, 18 nt, Mycobacterium bovis subsp bovis AF2122/97
cagacacuaaagcccucg

SEQ ID NO: 1187640 - RNA, 23 nt, Mycobacterium bovis subsp bovis AF2122/97
cagacaccggcuauaucccgccc

SEQ ID NO: 1187641 - RNA, 17 nt, Mycobacterium bovis subsp bovis AF2122/97
cagacacuggccgucgg

SEQ ID NO: 1187642 - RNA, 21 nt, Mycobacterium bovis subsp bovis AF2122/97
cagaauucggcgcgacagccg

SEQ ID NO: 1187643 - RNA, 13 nt, Mycobacterium bovis subsp bovis AF2122/97
cagaacaccaccg

SEQ ID NO: 1187644 - RNA, 14 nt, Mycobacterium bovis subsp bovis AF2122/97
cagaacaccaccgc

SEQ ID NO: 1187645 - RNA, 15 nt, Mycobacterium bovis subsp bovis AF2122/97
cagaauguucuccac

SEQ ID NO: 1187646 - RNA, 13 nt, Mycobacterium bovis subsp bovis AF2122/97
cagacgauucggc

SEQ ID NO: 1187647 - RNA, 17 nt, Mycobacterium bovis subsp bovis AF2122/97
cagacgcauaagccccc

SEQ ID NO: 1187648 - RNA, 16 nt, Mycobacterium bovis subsp bovis AF2122/97
cagacgccccuucccu

SEQ ID NO: 1187649 - RNA, 18 nt, Mycobacterium bovis subsp bovis AF2122/97
cagacgccgcguuucccg

SEQ ID NO: 1187650 - RNA, 15 nt, Mycobacterium bovis subsp bovis AF2122/97
cagacgcggaaucgc

SEQ ID NO: 1187651 - RNA, 22 nt, Mycobacterium bovis subsp bovis AF2122/97
cagacgcggaaucgcaccgugu

SEQ ID NO: 1187652 - RNA, 16 nt, Mycobacterium bovis subsp bovis AF2122/97
cagacgauggccaggu

SEQ ID NO: 1187653 - RNA, 18 nt, Mycobacterium bovis subsp bovis AF2122/97
cagacgcaaaaucgccca

SEQ ID NO: 1187654 - RNA, 16 nt, Mycobacterium bovis subsp bovis AF2122/97
cagaccauccagguug

SEQ ID NO: 1187655 - RNA, 12 nt, Mycobacterium bovis subsp bovis AF2122/97
cagaccagacug

SEQ ID NO: 1187656 - RNA, 12 nt, Mycobacterium bovis subsp bovis AF2122/97
cagaccaccgug

SEQ ID NO: 1187657 - RNA, 13 nt, Mycobacterium bovis subsp bovis AF2122/97
cagaccacaacgc

SEQ ID NO: 1187658 - RNA, 12 nt, Mycobacterium bovis subsp bovis AF2122/97
cagaccacaacg

SEQ ID NO: 1187659 - RNA, 13 nt, Mycobacterium bovis subsp bovis AF2122/97
cagaccaccgccu

SEQ ID NO: 1187660 - RNA, 16 nt, Mycobacterium bovis subsp bovis AF2122/97
cagaccaccgccugga

SEQ ID NO: 1187661 - RNA, 20 nt, Mycobacterium bovis subsp bovis AF2122/97
cagagaacuccgccaccauc

SEQ ID NO: 1187662 - RNA, 17 nt, Mycobacterium bovis subsp bovis AF2122/97
cagagcacgcgcggcgu

SEQ ID NO: 1187663 - RNA, 23 nt, Mycobacterium bovis subsp bovis AF2122/97
cagagcacgggcucgcugcacca

SEQ ID NO: 1187664 - RNA, 19 nt, Mycobacterium bovis subsp bovis AF2122/97
aaaaucaucugcacauuca

SEQ ID NO: 1187665 - RNA, 17 nt, Mycobacterium bovis subsp bovis AF2122/97
cagagcuucgccgcgca

SEQ ID NO: 1187666 - RNA, 18 nt, Mycobacterium bovis subsp bovis AF2122/97
cagagccccggcaagcgc

SEQ ID NO: 1187667 - RNA, 22 nt, Mycobacterium bovis subsp bovis AF2122/97
cagagcucgaaguuggcuuucg

SEQ ID NO: 1187668 - RNA, 17 nt, Mycobacterium bovis subsp bovis AF2122/97
cagaguucccgaaaccc

SEQ ID NO: 1187669 - RNA, 18 nt, Mycobacterium bovis subsp bovis AF2122/97
cagaguucccgaaacccg

SEQ ID NO: 1187670 - RNA, 14 nt, Mycobacterium bovis subsp bovis AF2122/97
cagaguucccugau

SEQ ID NO: 1187671 - RNA, 21 nt, Mycobacterium bovis subsp bovis AF2122/97
cagcaacgacaaaccgggcgu

SEQ ID NO: 1187672 - RNA, 21 nt, Mycobacterium bovis subsp bovis AF2122/97
cagcaacgacccgaagccgac

SEQ ID NO: 1187673 - RNA, 20 nt, Mycobacterium bovis subsp bovis AF2122/97
aaaaugacccacacaccgag

SEQ ID NO: 1187674 - RNA, 17 nt, Mycobacterium bovis subsp bovis AF2122/97
cagcaaccaccccaggg

SEQ ID NO: 1187675 - RNA, 21 nt, Mycobacterium bovis subsp bovis AF2122/97
cagcaacgcauuguccugaaa

SEQ ID NO: 1187676 - RNA, 18 nt, Mycobacterium bovis subsp bovis AF2122/97
cagcaacgcggugccggg

SEQ ID NO: 1187677 - RNA, 16 nt, Mycobacterium bovis subsp bovis AF2122/97
cagcacaaacccaguu

SEQ ID NO: 1187678 - RNA, 14 nt, Mycobacterium bovis subsp bovis AF2122/97
cagcaauccgcaaa

SEQ ID NO: 1187679 - RNA, 16 nt, Mycobacterium bovis subsp bovis AF2122/97
cagcaaucagccgccu

SEQ ID NO: 1187680 - RNA, 18 nt, Mycobacterium bovis subsp bovis AF2122/97
cagcaauccaaggcucag

SEQ ID NO: 1187681 - RNA, 15 nt, Mycobacterium bovis subsp bovis AF2122/97
cagcacauccagccc

SEQ ID NO: 1187682 - RNA, 14 nt, Mycobacterium bovis subsp bovis AF2122/97
cagcacaucggcga

SEQ ID NO: 1187683 - RNA, 19 nt, Mycobacterium bovis subsp bovis AF2122/97
cagcacacccgucaugccc

SEQ ID NO: 1187684 - RNA, 21 nt, Mycobacterium bovis subsp bovis AF2122/97
cagcacagcauuguccggcgu

SEQ ID NO: 1187685 - RNA, 20 nt, Mycobacterium bovis subsp bovis AF2122/97
cagcacacugucgauuugau

SEQ ID NO: 1187686 - RNA, 16 nt, Mycobacterium bovis subsp bovis AF2122/97
cagcacccggccaccg

SEQ ID NO: 1187687 - RNA, 16 nt, Mycobacterium bovis subsp bovis AF2122/97
cagcacccgggccacg

SEQ ID NO: 1187688 - RNA, 19 nt, Mycobacterium bovis subsp bovis AF2122/97
cagcaccccauggccaccg

SEQ ID NO: 1187689 - RNA, 13 nt, Mycobacterium bovis subsp bovis AF2122/97
cagcacccgagcg

SEQ ID NO: 1187690 - RNA, 13 nt, Mycobacterium bovis subsp bovis AF2122/97
cagcacccgcagc

SEQ ID NO: 1187691 - RNA, 16 nt, Mycobacterium bovis subsp bovis AF2122/97
cagcacccgcuccagc

SEQ ID NO: 1187692 - RNA, 17 nt, Mycobacterium bovis subsp bovis AF2122/97
cagcacccgcuccagcu

SEQ ID NO: 1187693 - RNA, 19 nt, Mycobacterium bovis subsp bovis AF2122/97
cagcacccccucggcuucg

SEQ ID NO: 1187694 - RNA, 13 nt, Mycobacterium bovis subsp bovis AF2122/97
cagcacccgcgcc

SEQ ID NO: 1187695 - RNA, 14 nt, Mycobacterium bovis subsp bovis AF2122/97
cagcacgcccucga

SEQ ID NO: 1187696 - RNA, 16 nt, Mycobacterium bovis subsp bovis AF2122/97
cagcacgauccagcug

SEQ ID NO: 1187697 - RNA, 22 nt, Mycobacterium bovis subsp bovis AF2122/97
cagcaccggcgcgggcacgccc

SEQ ID NO: 1187698 - RNA, 22 nt, Mycobacterium bovis subsp bovis AF2122/97
cagcaccgggaugugcggcugc

SEQ ID NO: 1187699 - RNA, 14 nt, Mycobacterium bovis subsp bovis AF2122/97
cagcaccguccucg

SEQ ID NO: 1187700 - RNA, 22 nt, Mycobacterium bovis subsp bovis AF2122/97
cagcaccgucgggcccagccgg

SEQ ID NO: 1187701 - RNA, 22 nt, Mycobacterium bovis subsp bovis AF2122/97
cagcaccgucggcaccagcagc

SEQ ID NO: 1187702 - RNA, 16 nt, Mycobacterium bovis subsp bovis AF2122/97
cagcacgcgcgcgacc

SEQ ID NO: 1187703 - RNA, 15 nt, Mycobacterium bovis subsp bovis AF2122/97
cagcagaaacaucga

SEQ ID NO: 1187704 - RNA, 22 nt, Mycobacterium bovis subsp bovis AF2122/97
cagaucggccggauacgggcug

SEQ ID NO: 1187705 - RNA, 17 nt, Mycobacterium bovis subsp bovis AF2122/97
cagaucgucacucccga

SEQ ID NO: 1187706 - RNA, 14 nt, Mycobacterium bovis subsp bovis AF2122/97
cagaucgaggggga

SEQ ID NO: 1187707 - RNA, 14 nt, Mycobacterium bovis subsp bovis AF2122/97
cagaucgccccagc

SEQ ID NO: 1187708 - RNA, 20 nt, Mycobacterium bovis subsp bovis AF2122/97
cagaucgacgcauuccucga

SEQ ID NO: 1187709 - RNA, 15 nt, Mycobacterium bovis subsp bovis AF2122/97
cagaugccgggcuga

SEQ ID NO: 1187710 - RNA, 18 nt, Mycobacterium bovis subsp bovis AF2122/97
cagaugccgggcugaggc

SEQ ID NO: 1187711 - RNA, 15 nt, Mycobacterium bovis subsp bovis AF2122/97
cagaugcccagcagg

SEQ ID NO: 1187712 - RNA, 15 nt, Mycobacterium bovis subsp bovis AF2122/97
cagaugcagcggucc

SEQ ID NO: 1187713 - RNA, 22 nt, Mycobacterium bovis subsp bovis AF2122/97
cagaugcaccucgcccugcaga

SEQ ID NO: 1187714 - RNA, 14 nt, Mycobacterium bovis subsp bovis AF2122/97
cagaugagucaaaa

SEQ ID NO: 1187715 - RNA, 19 nt, Mycobacterium bovis subsp bovis AF2122/97
cagaucgugcacaaucggu

SEQ ID NO: 1187716 - RNA, 21 nt, Mycobacterium bovis subsp bovis AF2122/97
cagaucuggguucccgaugug

SEQ ID NO: 1187717 - RNA, 17 nt, Mycobacterium bovis subsp bovis AF2122/97
cagaucuuucuugcugu

SEQ ID NO: 1187718 - RNA, 12 nt, Mycobacterium bovis subsp bovis AF2122/97
cagauggugaag

SEQ ID NO: 1187719 - RNA, 15 nt, Mycobacterium bovis subsp bovis AF2122/97
cagaugggccuccac

SEQ ID NO: 1187720 - RNA, 21 nt, Mycobacterium bovis subsp bovis AF2122/97
cagauggcauugcgcccaccg

SEQ ID NO: 1187721 - RNA, 20 nt, Mycobacterium bovis subsp bovis AF2122/97
cagcaaaacccgagccugga

SEQ ID NO: 1187722 - RNA, 21 nt, Mycobacterium bovis subsp bovis AF2122/97
cagcaaaacccgagccuggau

SEQ ID NO: 1187723 - RNA, 14 nt, Mycobacterium bovis subsp bovis AF2122/97
cagcaaaacccgcu

SEQ ID NO: 1187724 - RNA, 16 nt, Mycobacterium bovis subsp bovis AF2122/97
cagauuugcuccagcg

SEQ ID NO: 1187725 - RNA, 14 nt, Mycobacterium bovis subsp bovis AF2122/97
uuugucgccuucuu

SEQ ID NO: 1187726 - RNA, 15 nt, Mycobacterium bovis subsp bovis AF2122/97
uuugucgccuucuug

SEQ ID NO: 1187727 - RNA, 16 nt, Mycobacterium bovis subsp bovis AF2122/97
uuugucgccuucuugg

SEQ ID NO: 1187728 - RNA, 13 nt, Mycobacterium bovis subsp bovis AF2122/97
uuugugucugcuc

SEQ ID NO: 1187729 - RNA, 19 nt, Mycobacterium bovis subsp bovis AF2122/97
uuugcgucugcucgccagg

SEQ ID NO: 1187730 - RNA, 23 nt, Mycobacterium bovis subsp bovis AF2122/97
uuugcuucucccgccacugcugg

SEQ ID NO: 1187731 - RNA, 19 nt, Mycobacterium bovis subsp bovis AF2122/97
uuuggcaacauccuccggg

SEQ ID NO: 1187732 - RNA, 12 nt, Mycobacterium bovis subsp bovis AF2122/97
uuuggccgccgu

SEQ ID NO: 1187733 - RNA, 15 nt, Mycobacterium bovis subsp bovis AF2122/97
uuuggccgccguggc

SEQ ID NO: 1187734 - RNA, 21 nt, Mycobacterium bovis subsp bovis AF2122/97
uuuggcggcgcgcagcuugga

SEQ ID NO: 1187735 - RNA, 23 nt, Mycobacterium bovis subsp bovis AF2122/97
uuuggugguuucacauuuuuguu

SEQ ID NO: 1187736 - RNA, 15 nt, Mycobacterium bovis subsp bovis AF2122/97
uuuucggcggcucua

SEQ ID NO: 1187737 - RNA, 15 nt, Mycobacterium bovis subsp bovis AF2122/97
uuuuacgucugcucg

SEQ ID NO: 1187738 - RNA, 15 nt, Mycobacterium bovis subsp bovis AF2122/97
uuucgucgucgcagu

SEQ ID NO: 1187739 - RNA, 23 nt, Mycobacterium bovis subsp bovis AF2122/97
uuucguugggagaguguugaucu

SEQ ID NO: 1187740 - RNA, 21 nt, Mycobacterium bovis subsp bovis AF2122/97
uuucggaugcaacccggugau

SEQ ID NO: 1187741 - RNA, 16 nt, Mycobacterium bovis subsp bovis AF2122/97
uuuccccgcccuugcc

SEQ ID NO: 1187742 - RNA, 14 nt, Mycobacterium bovis subsp bovis AF2122/97
uuucccuggccgcc

SEQ ID NO: 1187743 - RNA, 19 nt, Mycobacterium bovis subsp bovis AF2122/97
uuuccgccggccaggugac

SEQ ID NO: 1187744 - RNA, 20 nt, Mycobacterium bovis subsp bovis AF2122/97
uuucgccagcugacacccgc

SEQ ID NO: 1187745 - RNA, 18 nt, Mycobacterium bovis subsp bovis AF2122/97
uuucgauauagccgccgg

SEQ ID NO: 1187746 - RNA, 22 nt, Mycobacterium bovis subsp bovis AF2122/97
uuucgauauagccgccggugcc

SEQ ID NO: 1187747 - RNA, 14 nt, Mycobacterium bovis subsp bovis AF2122/97
uuuccuugcgcgcc

SEQ ID NO: 1187748 - RNA, 16 nt, Mycobacterium bovis subsp bovis AF2122/97
uuuccuugcgcgccau

SEQ ID NO: 1187749 - RNA, 20 nt, Mycobacterium bovis subsp bovis AF2122/97
uuugcgaaucggcccgugcc

SEQ ID NO: 1187750 - RNA, 14 nt, Mycobacterium bovis subsp bovis AF2122/97
uuugagaccccaac

SEQ ID NO: 1187751 - RNA, 20 nt, Mycobacterium bovis subsp bovis AF2122/97
uuugagcagaaggccagcga

SEQ ID NO: 1187752 - RNA, 17 nt, Mycobacterium bovis subsp bovis AF2122/97
uuugauccuggcucagg

SEQ ID NO: 1187753 - RNA, 14 nt, Mycobacterium bovis subsp bovis AF2122/97
uuugaucaccgugg

SEQ ID NO: 1187754 - RNA, 20 nt, Mycobacterium bovis subsp bovis AF2122/97
uuucugggccgcuccaccac

SEQ ID NO: 1187755 - RNA, 15 nt, Mycobacterium bovis subsp bovis AF2122/97
uuugacgggauagcc

SEQ ID NO: 1187756 - RNA, 16 nt, Mycobacterium bovis subsp bovis AF2122/97
uuucaccaccguggcc

SEQ ID NO: 1187757 - RNA, 17 nt, Mycobacterium bovis subsp bovis AF2122/97
uuuccaccguuagccag

SEQ ID NO: 1187758 - RNA, 23 nt, Mycobacterium bovis subsp bovis AF2122/97
uuuagggugcccgcguugccaaa

SEQ ID NO: 1187759 - RNA, 15 nt, Mycobacterium bovis subsp bovis AF2122/97
uugcgcgcugagcuc

SEQ ID NO: 1187760 - RNA, 16 nt, Mycobacterium bovis subsp bovis AF2122/97
uugcgcggcaguggcc

SEQ ID NO: 1187761 - RNA, 21 nt, Mycobacterium bovis subsp bovis AF2122/97
uugcgcuacuacugcaguccc

SEQ ID NO: 1187762 - RNA, 18 nt, Mycobacterium bovis subsp bovis AF2122/97
uugcgucgcgccugcccg

SEQ ID NO: 1187763 - RNA, 15 nt, Mycobacterium bovis subsp bovis AF2122/97
uugcguccauccgca

SEQ ID NO: 1187764 - RNA, 12 nt, Mycobacterium bovis subsp bovis AF2122/97
uugcgccgccaa

SEQ ID NO: 1187765 - RNA, 19 nt, Mycobacterium bovis subsp bovis AF2122/97
uugcgagugagcucagcaa

SEQ ID NO: 1187766 - RNA, 17 nt, Mycobacterium bovis subsp bovis AF2122/97
uugccuuguuccagcgc

SEQ ID NO: 1187767 - RNA, 12 nt, Mycobacterium bovis subsp bovis AF2122/97
uugcgaagccca

SEQ ID NO: 1187768 - RNA, 23 nt, Mycobacterium bovis subsp bovis AF2122/97
uugccggaguugucgacggccac

SEQ ID NO: 1187769 - RNA, 21 nt, Mycobacterium bovis subsp bovis AF2122/97
uugccuucuuggcgggagccu

SEQ ID NO: 1187770 - RNA, 20 nt, Mycobacterium bovis subsp bovis AF2122/97
uugccgccguuaccgccgcu

SEQ ID NO: 1187771 - RNA, 17 nt, Mycobacterium bovis subsp bovis AF2122/97
uugccgccaucaccgcc

SEQ ID NO: 1187772 - RNA, 20 nt, Mycobacterium bovis subsp bovis AF2122/97
uugccgcaggccuguuccau

SEQ ID NO: 1187773 - RNA, 10 nt, Mycobacterium bovis subsp bovis AF2122/97
uugccgccga

SEQ ID NO: 1187774 - RNA, 22 nt, Mycobacterium bovis subsp bovis AF2122/97
uugccgccgaacgccucugcga

SEQ ID NO: 1187775 - RNA, 18 nt, Mycobacterium bovis subsp bovis AF2122/97
uugccgccaucaccgccg

SEQ ID NO: 1187776 - RNA, 11 nt, Mycobacterium bovis subsp bovis AF2122/97
uugccgcccac

SEQ ID NO: 1187777 - RNA, 10 nt, Mycobacterium bovis subsp bovis AF2122/97
uugccgccgc

SEQ ID NO: 1187778 - RNA, 23 nt, Mycobacterium bovis subsp bovis AF2122/97
uugccgccgccuccgccgaggcc

SEQ ID NO: 1187779 - RNA, 13 nt, Mycobacterium bovis subsp bovis AF2122/97
uugccgccggccc

SEQ ID NO: 1187780 - RNA, 13 nt, Mycobacterium bovis subsp bovis AF2122/97
uugccgccguccc

SEQ ID NO: 1187781 - RNA, 20 nt, Mycobacterium bovis subsp bovis AF2122/97
uugccgccgucgccgccgcu

SEQ ID NO: 1187782 - RNA, 20 nt, Mycobacterium bovis subsp bovis AF2122/97
uugccaacgaaccgcucagc

SEQ ID NO: 1187783 - RNA, 14 nt, Mycobacterium bovis subsp bovis AF2122/97
uugccaaagcccac

SEQ ID NO: 1187784 - RNA, 13 nt, Mycobacterium bovis subsp bovis AF2122/97
uugccccgccuug

SEQ ID NO: 1187785 - RNA, 12 nt, Mycobacterium bovis subsp bovis AF2122/97
uugccaccgccg

SEQ ID NO: 1187786 - RNA, 13 nt, Mycobacterium bovis subsp bovis AF2122/97
uugccaacgccca

SEQ ID NO: 1187787 - RNA, 17 nt, Mycobacterium bovis subsp bovis AF2122/97
uugccgagcccaggugg

SEQ ID NO: 1187788 - RNA, 22 nt, Mycobacterium bovis subsp bovis AF2122/97
uugccgaaguuuuggaagcccg

SEQ ID NO: 1187789 - RNA, 13 nt, Mycobacterium bovis subsp bovis AF2122/97
uugccgaagcccg

SEQ ID NO: 1187790 - RNA, 21 nt, Mycobacterium bovis subsp bovis AF2122/97
uugccgcaccagucgcgcagc

SEQ ID NO: 1187791 - RNA, 15 nt, Mycobacterium bovis subsp bovis AF2122/97
uugccgauccccagg

SEQ ID NO: 1187792 - RNA, 13 nt, Mycobacterium bovis subsp bovis AF2122/97
uugccgaucaacc

SEQ ID NO: 1187793 - RNA, 22 nt, Mycobacterium bovis subsp bovis AF2122/97
uugccgaucaaccccccgggcc

SEQ ID NO: 1187794 - RNA, 23 nt, Mycobacterium bovis subsp bovis AF2122/97
uugcccguguuaaagaagccuga

SEQ ID NO: 1187795 - RNA, 16 nt, Mycobacterium bovis subsp bovis AF2122/97
uugcacugcugguuga

SEQ ID NO: 1187796 - RNA, 22 nt, Mycobacterium bovis subsp bovis AF2122/97
uugcugaucagagcguucuuca

SEQ ID NO: 1187797 - RNA, 12 nt, Mycobacterium bovis subsp bovis AF2122/97
uuggcagcacag

SEQ ID NO: 1187798 - RNA, 18 nt, Mycobacterium bovis subsp bovis AF2122/97
uuggcagggccagcggca

SEQ ID NO: 1187799 - RNA, 18 nt, Mycobacterium bovis subsp bovis AF2122/97
uuggaccgagacuugcug

SEQ ID NO: 1187800 - RNA, 14 nt, Mycobacterium bovis subsp bovis AF2122/97
uuggcgaagcccga

SEQ ID NO: 1187801 - RNA, 13 nt, Mycobacterium bovis subsp bovis AF2122/97
uuggccaccgccc

SEQ ID NO: 1187802 - RNA, 13 nt, Mycobacterium bovis subsp bovis AF2122/97
uuggcgaucucga

SEQ ID NO: 1187803 - RNA, 14 nt, Mycobacterium bovis subsp bovis AF2122/97
uuggcgacugucug

SEQ ID NO: 1187804 - RNA, 15 nt, Mycobacterium bovis subsp bovis AF2122/97
uuggcgacgaggcga

SEQ ID NO: 1187805 - RNA, 14 nt, Mycobacterium bovis subsp bovis AF2122/97
uuggcggccagcgu

SEQ ID NO: 1187806 - RNA, 22 nt, Mycobacterium bovis subsp bovis AF2122/97
uuggcggcggugcagcagggcg

SEQ ID NO: 1187807 - RNA, 19 nt, Mycobacterium bovis subsp bovis AF2122/97
uuggcgguaaaccacucgc

SEQ ID NO: 1187808 - RNA, 18 nt, Mycobacterium bovis subsp bovis AF2122/97
uuggcgggagcaccgacc

SEQ ID NO: 1187809 - RNA, 19 nt, Mycobacterium bovis subsp bovis AF2122/97
uuggcguagcaacccagga

SEQ ID NO: 1187810 - RNA, 18 nt, Mycobacterium bovis subsp bovis AF2122/97
uuggcucccuuuuccaaa

SEQ ID NO: 1187811 - RNA, 15 nt, Mycobacterium bovis subsp bovis AF2122/97
uuggcucgcugggac

SEQ ID NO: 1187812 - RNA, 13 nt, Mycobacterium bovis subsp bovis AF2122/97
uugggcguccuuc

SEQ ID NO: 1187813 - RNA, 15 nt, Mycobacterium bovis subsp bovis AF2122/97
uugggccgccagcgg

SEQ ID NO: 1187814 - RNA, 12 nt, Mycobacterium bovis subsp bovis AF2122/97
uugggccagcgc

SEQ ID NO: 1187815 - RNA, 14 nt, Mycobacterium bovis subsp bovis AF2122/97
uugguaguccugcu

SEQ ID NO: 1187816 - RNA, 18 nt, Mycobacterium bovis subsp bovis AF2122/97
uuggugggccagcagcaa

SEQ ID NO: 1187817 - RNA, 14 nt, Mycobacterium bovis subsp bovis AF2122/97
uuguggccagcgcu

SEQ ID NO: 1187818 - RNA, 15 nt, Mycobacterium bovis subsp bovis AF2122/97
uuguggcguguggcu

SEQ ID NO: 1187819 - RNA, 17 nt, Mycobacterium bovis subsp bovis AF2122/97
uuguuccguccccgacg

SEQ ID NO: 1187820 - RNA, 18 nt, Mycobacterium bovis subsp bovis AF2122/97
uugugcgcacucuuuccu

SEQ ID NO: 1187821 - RNA, 20 nt, Mycobacterium bovis subsp bovis AF2122/97
uugucgguaggugucaauga

SEQ ID NO: 1187822 - RNA, 23 nt, Mycobacterium bovis subsp bovis AF2122/97
uugucagcgaacggccaggacaa

SEQ ID NO: 1187823 - RNA, 19 nt, Mycobacterium bovis subsp bovis AF2122/97
uugucaggauauuucuaaa

SEQ ID NO: 1187824 - RNA, 13 nt, Mycobacterium bovis subsp bovis AF2122/97
uuguccagcgucu

SEQ ID NO: 1187825 - RNA, 16 nt, Mycobacterium bovis subsp bovis AF2122/97
uuguccagggugguca

SEQ ID NO: 1187826 - RNA, 12 nt, Mycobacterium bovis subsp bovis AF2122/97
uugaccaggcuc

SEQ ID NO: 1187827 - RNA, 11 nt, Mycobacterium bovis subsp bovis AF2122/97
uugaccaccag

SEQ ID NO: 1187828 - RNA, 20 nt, Mycobacterium bovis subsp bovis AF2122/97
uugaccaaugugccggucac

SEQ ID NO: 1187829 - RNA, 15 nt, Mycobacterium bovis subsp bovis AF2122/97
uugacagcuuucuug

SEQ ID NO: 1187830 - RNA, 17 nt, Mycobacterium bovis subsp bovis AF2122/97
uugaaaacgcccggcac

SEQ ID NO: 1187831 - RNA, 15 nt, Mycobacterium bovis subsp bovis AF2122/97
uugaccgauacgcgg

SEQ ID NO: 1187832 - RNA, 14 nt, Mycobacterium bovis subsp bovis AF2122/97
uugaccgcggugac

SEQ ID NO: 1187833 - RNA, 11 nt, Mycobacterium bovis subsp bovis AF2122/97
uugacugaacu

SEQ ID NO: 1187834 - RNA, 21 nt, Mycobacterium bovis subsp bovis AF2122/97
uugaggauccgcaccacgccc

SEQ ID NO: 1187835 - RNA, 13 nt, Mycobacterium bovis subsp bovis AF2122/97
uugaggaagcccg

SEQ ID NO: 1187836 - RNA, 19 nt, Mycobacterium bovis subsp bovis AF2122/97
uugcacaccggcacugccc

SEQ ID NO: 1187837 - RNA, 16 nt, Mycobacterium bovis subsp bovis AF2122/97
uugaucaccguggugg

SEQ ID NO: 1187838 - RNA, 14 nt, Mycobacterium bovis subsp bovis AF2122/97
uugauccccagcuc

SEQ ID NO: 1187839 - RNA, 18 nt, Mycobacterium bovis subsp bovis AF2122/97
uucugcgucugcucgcca

SEQ ID NO: 1187840 - RNA, 24 nt, Mycobacterium bovis subsp bovis AF2122/97
uucuucgcgaagaacgacgccacc

SEQ ID NO: 1187841 - RNA, 23 nt, Mycobacterium bovis subsp bovis AF2122/97
uucuucggugaagaacaugcuca

SEQ ID NO: 1187842 - RNA, 17 nt, Mycobacterium bovis subsp bovis AF2122/97
uucuucggccagcuccc

SEQ ID NO: 1187843 - RNA, 13 nt, Mycobacterium bovis subsp bovis AF2122/97
uucuccaggcuga

SEQ ID NO: 1187844 - RNA, 12 nt, Mycobacterium bovis subsp bovis AF2122/97
uucuccaggcug

SEQ ID NO: 1187845 - RNA, 22 nt, Mycobacterium bovis subsp bovis AF2122/97
uucggcgaccggccggccgcgg

SEQ ID NO: 1187846 - RNA, 17 nt, Mycobacterium bovis subsp bovis AF2122/97
uucggcgccucguugcc

SEQ ID NO: 1187847 - RNA, 14 nt, Mycobacterium bovis subsp bovis AF2122/97
uucggcggcugcca

SEQ ID NO: 1187848 - RNA, 14 nt, Mycobacterium bovis subsp bovis AF2122/97
uuaucagcaagagc

SEQ ID NO: 1187849 - RNA, 14 nt, Mycobacterium bovis subsp bovis AF2122/97
uucgggugcagcca

SEQ ID NO: 1187850 - RNA, 22 nt, Mycobacterium bovis subsp bovis AF2122/97
uucggucagggugggcucguug

SEQ ID NO: 1187851 - RNA, 13 nt, Mycobacterium bovis subsp bovis AF2122/97
uucggcgucgucg

SEQ ID NO: 1187852 - RNA, 14 nt, Mycobacterium bovis subsp bovis AF2122/97
uucguugagaacau

SEQ ID NO: 1187853 - RNA, 21 nt, Mycobacterium bovis subsp bovis AF2122/97
uucguauggacgaggagcuca

SEQ ID NO: 1187854 - RNA, 14 nt, Mycobacterium bovis subsp bovis AF2122/97
uucguagucucgac

SEQ ID NO: 1187855 - RNA, 12 nt, Mycobacterium bovis subsp bovis AF2122/97
uucggucggccu

SEQ ID NO: 1187856 - RNA, 20 nt, Mycobacterium bovis subsp bovis AF2122/97
uucggucgggggcagcgccu

SEQ ID NO: 1187857 - RNA, 13 nt, Mycobacterium bovis subsp bovis AF2122/97
uucggucuugccg

SEQ ID NO: 1187858 - RNA, 16 nt, Mycobacterium bovis subsp bovis AF2122/97
uucggugcuguugucg

SEQ ID NO: 1187859 - RNA, 16 nt, Mycobacterium bovis subsp bovis AF2122/97
ugaauucgcuugcagc

SEQ ID NO: 1187860 - RNA, 14 nt, Mycobacterium bovis subsp bovis AF2122/97
ugacacccaccucg

SEQ ID NO: 1187861 - RNA, 18 nt, Mycobacterium bovis subsp bovis AF2122/97
ugaaucucacgacgccuu

SEQ ID NO: 1187862 - RNA, 18 nt, Mycobacterium bovis subsp bovis AF2122/97
ugaaucggaccgaccggc

SEQ ID NO: 1187863 - RNA, 21 nt, Mycobacterium bovis subsp bovis AF2122/97
ugaaucgcgucgagagaacgu

SEQ ID NO: 1187864 - RNA, 17 nt, Mycobacterium bovis subsp bovis AF2122/97
ugaccagaaccuggagc

SEQ ID NO: 1187865 - RNA, 20 nt, Mycobacterium bovis subsp bovis AF2122/97
ugaccaccgggcgcugcuug

SEQ ID NO: 1187866 - RNA, 21 nt, Mycobacterium bovis subsp bovis AF2122/97
ugaccacaaccgugagcacca

SEQ ID NO: 1187867 - RNA, 23 nt, Mycobacterium bovis subsp bovis AF2122/97
ugacagggcggcaaccucaugca

SEQ ID NO: 1187868 - RNA, 17 nt, Mycobacterium bovis subsp bovis AF2122/97
ugacagcccgcuggccg

SEQ ID NO: 1187869 - RNA, 20 nt, Mycobacterium bovis subsp bovis AF2122/97
ugacacgacgugcaggaaca

SEQ ID NO: 1187870 - RNA, 17 nt, Mycobacterium bovis subsp bovis AF2122/97
ugacaccgaccgggucg

SEQ ID NO: 1187871 - RNA, 20 nt, Mycobacterium bovis subsp bovis AF2122/97
ugacaccgaggucggccagc

SEQ ID NO: 1187872 - RNA, 20 nt, Mycobacterium bovis subsp bovis AF2122/97
ugaccccccgaccccgacgg

SEQ ID NO: 1187873 - RNA, 22 nt, Mycobacterium bovis subsp bovis AF2122/97
ugaccggggcgcccggccaggu

SEQ ID NO: 1187874 - RNA, 20 nt, Mycobacterium bovis subsp bovis AF2122/97
ugaccgggucgaucaccgac

SEQ ID NO: 1187875 - RNA, 18 nt, Mycobacterium bovis subsp bovis AF2122/97
ugaccgguucccgggcag

SEQ ID NO: 1187876 - RNA, 22 nt, Mycobacterium bovis subsp bovis AF2122/97
ugaccgguauuaccgccguggc

SEQ ID NO: 1187877 - RNA, 22 nt, Mycobacterium bovis subsp bovis AF2122/97
ugaccccgccggcugcggaggc

SEQ ID NO: 1187878 - RNA, 21 nt, Mycobacterium bovis subsp bovis AF2122/97
ugacccgacgaugccggcccg

SEQ ID NO: 1187879 - RNA, 13 nt, Mycobacterium bovis subsp bovis AF2122/97
ugaccccggcguu

SEQ ID NO: 1187880 - RNA, 18 nt, Mycobacterium bovis subsp bovis AF2122/97
ugaccccggcguugccgc

SEQ ID NO: 1187881 - RNA, 17 nt, Mycobacterium bovis subsp bovis AF2122/97
ugaccaucacacccauc

SEQ ID NO: 1187882 - RNA, 21 nt, Mycobacterium bovis subsp bovis AF2122/97
ugaccaucguguacuggucug

SEQ ID NO: 1187883 - RNA, 22 nt, Mycobacterium bovis subsp bovis AF2122/97
ugaccaucguguacuggucugg

SEQ ID NO: 1187884 - RNA, 23 nt, Mycobacterium bovis subsp bovis AF2122/97
ugaccaucguguacuggucugga

SEQ ID NO: 1187885 - RNA, 21 nt, Mycobacterium bovis subsp bovis AF2122/97
ugacccacgagagcgcugucc

SEQ ID NO: 1187886 - RNA, 15 nt, Mycobacterium bovis subsp bovis AF2122/97
ugacccacugcaggc

SEQ ID NO: 1187887 - RNA, 17 nt, Mycobacterium bovis subsp bovis AF2122/97
ugacccauucucggccg

SEQ ID NO: 1187888 - RNA, 22 nt, Mycobacterium bovis subsp bovis AF2122/97
ugacccaucaugguccgggccu

SEQ ID NO: 1187889 - RNA, 15 nt, Mycobacterium bovis subsp bovis AF2122/97
ugaccucgcgcaccg

SEQ ID NO: 1187890 - RNA, 18 nt, Mycobacterium bovis subsp bovis AF2122/97
ugaccucggcgaccagaa

SEQ ID NO: 1187891 - RNA, 15 nt, Mycobacterium bovis subsp bovis AF2122/97
ugaccucggugaaga

SEQ ID NO: 1187892 - RNA, 16 nt, Mycobacterium bovis subsp bovis AF2122/97
ugaccugauccggccg

SEQ ID NO: 1187893 - RNA, 15 nt, Mycobacterium bovis subsp bovis AF2122/97
ugaccugcagcgcau

SEQ ID NO: 1187894 - RNA, 15 nt, Mycobacterium bovis subsp bovis AF2122/97
ugacgagccaccacc

SEQ ID NO: 1187895 - RNA, 16 nt, Mycobacterium bovis subsp bovis AF2122/97
ugacgcucugcgaguu

SEQ ID NO: 1187896 - RNA, 21 nt, Mycobacterium bovis subsp bovis AF2122/97
ugacgaugguguacugcugcu

SEQ ID NO: 1187897 - RNA, 17 nt, Mycobacterium bovis subsp bovis AF2122/97
ugacgaucggcggcgcg

SEQ ID NO: 1187898 - RNA, 15 nt, Mycobacterium bovis subsp bovis AF2122/97
ugacgaucaggucgc

SEQ ID NO: 1187899 - RNA, 15 nt, Mycobacterium bovis subsp bovis AF2122/97
ugacggcgccaggca

SEQ ID NO: 1187900 - RNA, 17 nt, Mycobacterium bovis subsp bovis AF2122/97
ugacucgcuccgaccgg

SEQ ID NO: 1187901 - RNA, 15 nt, Mycobacterium bovis subsp bovis AF2122/97
ugacugcacaccacc

SEQ ID NO: 1187902 - RNA, 16 nt, Mycobacterium bovis subsp bovis AF2122/97
ugagcagaaggccagc

SEQ ID NO: 1187903 - RNA, 19 nt, Mycobacterium bovis subsp bovis AF2122/97
ugagcagcgggacauccag

SEQ ID NO: 1187904 - RNA, 14 nt, Mycobacterium bovis subsp bovis AF2122/97
ugagcaccugggcg

SEQ ID NO: 1187905 - RNA, 16 nt, Mycobacterium bovis subsp bovis AF2122/97
ugagcaccagcagcac

SEQ ID NO: 1187906 - RNA, 22 nt, Mycobacterium bovis subsp bovis AF2122/97
ugagcacgcgcaacucgccacg

SEQ ID NO: 1187907 - RNA, 23 nt, Mycobacterium bovis subsp bovis AF2122/97
ugagcacccgauaguucuggccc

SEQ ID NO: 1187908 - RNA, 13 nt, Mycobacterium bovis subsp bovis AF2122/97
ugagccugccgga

SEQ ID NO: 1187909 - RNA, 17 nt, Mycobacterium bovis subsp bovis AF2122/97
ugagccggucuugcauc

SEQ ID NO: 1187910 - RNA, 20 nt, Mycobacterium bovis subsp bovis AF2122/97
ugagcccguugaccugcgca

SEQ ID NO: 1187911 - RNA, 23 nt, Mycobacterium bovis subsp bovis AF2122/97
ugagccggaccggcuuccccagc

SEQ ID NO: 1187912 - RNA, 15 nt, Mycobacterium bovis subsp bovis AF2122/97
ugagccgcagcaccu

SEQ ID NO: 1187913 - RNA, 19 nt, Mycobacterium bovis subsp bovis AF2122/97
ugagcccagccgcgggccg

SEQ ID NO: 1187914 - RNA, 21 nt, Mycobacterium bovis subsp bovis AF2122/97
ugagcagcuuagucagggccg

SEQ ID NO: 1187915 - RNA, 17 nt, Mycobacterium bovis subsp bovis AF2122/97
ugagcagcuuagucagg

SEQ ID NO: 1187916 - RNA, 20 nt, Mycobacterium bovis subsp bovis AF2122/97
ugagaucgcccgaguugaag

SEQ ID NO: 1187917 - RNA, 18 nt, Mycobacterium bovis subsp bovis AF2122/97
ugagauugguggcccggg

SEQ ID NO: 1187918 - RNA, 19 nt, Mycobacterium bovis subsp bovis AF2122/97
ugagauggcggugagcacu

SEQ ID NO: 1187919 - RNA, 19 nt, Mycobacterium bovis subsp bovis AF2122/97
ugagaucaugaggugagcu

SEQ ID NO: 1187920 - RNA, 13 nt, Mycobacterium bovis subsp bovis AF2122/97
ugagaagaagccc

SEQ ID NO: 1187921 - RNA, 18 nt, Mycobacterium bovis subsp bovis AF2122/97
ugagguagccgaggucgc

SEQ ID NO: 1187922 - RNA, 16 nt, Mycobacterium bovis subsp bovis AF2122/97
ugagguaggggcaggc

SEQ ID NO: 1187923 - RNA, 18 nt, Mycobacterium bovis subsp bovis AF2122/97
ugagguaggugagcgcgc

SEQ ID NO: 1187924 - RNA, 20 nt, Mycobacterium bovis subsp bovis AF2122/97
ugagggugagccgagccagc

SEQ ID NO: 1187925 - RNA, 16 nt, Mycobacterium bovis subsp bovis AF2122/97
ugaggcuuccagcucg

SEQ ID NO: 1187926 - RNA, 17 nt, Mycobacterium bovis subsp bovis AF2122/97
ugaggucccggcuggga

SEQ ID NO: 1187927 - RNA, 17 nt, Mycobacterium bovis subsp bovis AF2122/97
ugagguuggagcgccag

SEQ ID NO: 1187928 - RNA, 15 nt, Mycobacterium bovis subsp bovis AF2122/97
ugagguggccgcgca

SEQ ID NO: 1187929 - RNA, 22 nt, Mycobacterium bovis subsp bovis AF2122/97
ugaggucuuugcucucggucug

SEQ ID NO: 1187930 - RNA, 17 nt, Mycobacterium bovis subsp bovis AF2122/97
ugaggugaucggaagaa

SEQ ID NO: 1187931 - RNA, 21 nt, Mycobacterium bovis subsp bovis AF2122/97
ugagucuuucccgccaccaaa

SEQ ID NO: 1187932 - RNA, 22 nt, Mycobacterium bovis subsp bovis AF2122/97
ugagucuuucccgccaccaaac

SEQ ID NO: 1187933 - RNA, 14 nt, Mycobacterium bovis subsp bovis AF2122/97
ugaggaucagcgug

SEQ ID NO: 1187934 - RNA, 14 nt, Mycobacterium bovis subsp bovis AF2122/97
ugaggaucaugucc

SEQ ID NO: 1187935 - RNA, 19 nt, Mycobacterium bovis subsp bovis AF2122/97
ugaggaucccggccggguc

SEQ ID NO: 1187936 - RNA, 20 nt, Mycobacterium bovis subsp bovis AF2122/97
ugagcucuucggacacagcc

SEQ ID NO: 1187937 - RNA, 16 nt, Mycobacterium bovis subsp bovis AF2122/97
ugagcuuuaucugcau

SEQ ID NO: 1187938 - RNA, 13 nt, Mycobacterium bovis subsp bovis AF2122/97
ugagcuggcagcu

SEQ ID NO: 1187939 - RNA, 13 nt, Mycobacterium bovis subsp bovis AF2122/97
ugagcgcgcucag

SEQ ID NO: 1187940 - RNA, 16 nt, Mycobacterium bovis subsp bovis AF2122/97
ugagcgcgcuggccag

SEQ ID NO: 1187941 - RNA, 17 nt, Mycobacterium bovis subsp bovis AF2122/97
ugagcgcgcuggccagc

SEQ ID NO: 1187942 - RNA, 23 nt, Mycobacterium bovis subsp bovis AF2122/97
ugagcgcggcuacggucgcagua

SEQ ID NO: 1187943 - RNA, 14 nt, Mycobacterium bovis subsp bovis AF2122/97
ugagcgcgcccaac

SEQ ID NO: 1187944 - RNA, 12 nt, Mycobacterium bovis subsp bovis AF2122/97
ugagcggccagc

SEQ ID NO: 1187945 - RNA, 24 nt, Mycobacterium bovis subsp bovis AF2122/97
ugagcggccggcaugcuggcgauc

SEQ ID NO: 1187946 - RNA, 15 nt, Mycobacterium bovis subsp bovis AF2122/97
ugagcgagcgcgcgu

SEQ ID NO: 1187947 - RNA, 21 nt, Mycobacterium bovis subsp bovis AF2122/97
ugagcgaccgcgagggccagc

SEQ ID NO: 1187948 - RNA, 13 nt, Mycobacterium bovis subsp bovis AF2122/97
ugagcgaccuggg

SEQ ID NO: 1187949 - RNA, 19 nt, Mycobacterium bovis subsp bovis AF2122/97
ugagcgccaggccgcacag

SEQ ID NO: 1187950 - RNA, 18 nt, Mycobacterium bovis subsp bovis AF2122/97
ugagcgccacgccgaggc

SEQ ID NO: 1187951 - RNA, 19 nt, Mycobacterium bovis subsp bovis AF2122/97
ugagcgccgauguggccgg

SEQ ID NO: 1187952 - RNA, 16 nt, Mycobacterium bovis subsp bovis AF2122/97
ugauccgguggugggc

SEQ ID NO: 1187953 - RNA, 19 nt, Mycobacterium bovis subsp bovis AF2122/97
ugauccccguugacccaga

SEQ ID NO: 1187954 - RNA, 18 nt, Mycobacterium bovis subsp bovis AF2122/97
ugaucccgccaccgaaca

SEQ ID NO: 1187955 - RNA, 12 nt, Mycobacterium bovis subsp bovis AF2122/97
ugaucagcgcau

SEQ ID NO: 1187956 - RNA, 17 nt, Mycobacterium bovis subsp bovis AF2122/97
ugaucacucacccgggc

SEQ ID NO: 1187957 - RNA, 23 nt, Mycobacterium bovis subsp bovis AF2122/97
ugaucaccgcguaguccaggccg

SEQ ID NO: 1187958 - RNA, 23 nt, Mycobacterium bovis subsp bovis AF2122/97
ugagugcgucucgguggcugcgc

SEQ ID NO: 1187959 - RNA, 21 nt, Mycobacterium bovis subsp bovis AF2122/97
ugagugacgguccguucgaug

SEQ ID NO: 1187960 - RNA, 21 nt, Mycobacterium bovis subsp bovis AF2122/97
ugagugccggcgugcgcgaga

SEQ ID NO: 1187961 - RNA, 19 nt, Mycobacterium bovis subsp bovis AF2122/97
ugaguguggagacguuuug

SEQ ID NO: 1187962 - RNA, 12 nt, Mycobacterium bovis subsp bovis AF2122/97
ugauauccgcgg

SEQ ID NO: 1187963 - RNA, 21 nt, Mycobacterium bovis subsp bovis AF2122/97
ugaugcucgacaaccacggca

SEQ ID NO: 1187964 - RNA, 14 nt, Mycobacterium bovis subsp bovis AF2122/97
ugauggacagcugc

SEQ ID NO: 1187965 - RNA, 14 nt, Mycobacterium bovis subsp bovis AF2122/97
ugaugcggccgcgg

SEQ ID NO: 1187966 - RNA, 14 nt, Mycobacterium bovis subsp bovis AF2122/97
ugaugcggcgcagc

SEQ ID NO: 1187967 - RNA, 21 nt, Mycobacterium bovis subsp bovis AF2122/97
ugaugcagugauugagcagca

SEQ ID NO: 1187968 - RNA, 16 nt, Mycobacterium bovis subsp bovis AF2122/97
ugaugcaacgccaaaa

SEQ ID NO: 1187969 - RNA, 19 nt, Mycobacterium bovis subsp bovis AF2122/97
ugaugcaacgccaaaaugg

SEQ ID NO: 1187970 - RNA, 23 nt, Mycobacterium bovis subsp bovis AF2122/97
ugaugcaacgccaaaauggugcc

SEQ ID NO: 1187971 - RNA, 21 nt, Mycobacterium bovis subsp bovis AF2122/97
ugaugcaagcgggcaugaucc

SEQ ID NO: 1187972 - RNA, 19 nt, Mycobacterium bovis subsp bovis AF2122/97
ugauccgcgcaacuuccau

SEQ ID NO: 1187973 - RNA, 14 nt, Mycobacterium bovis subsp bovis AF2122/97
ugaucgaccggaca

SEQ ID NO: 1187974 - RNA, 16 nt, Mycobacterium bovis subsp bovis AF2122/97
ugaugacguugcagcc

SEQ ID NO: 1187975 - RNA, 19 nt, Mycobacterium bovis subsp bovis AF2122/97
ugauucuaacggucagcuu

SEQ ID NO: 1187976 - RNA, 19 nt, Mycobacterium bovis subsp bovis AF2122/97
ugauuguguuccaccagcg

SEQ ID NO: 1187977 - RNA, 13 nt, Mycobacterium bovis subsp bovis AF2122/97
ugauugugcccag

SEQ ID NO: 1187978 - RNA, 16 nt, Mycobacterium bovis subsp bovis AF2122/97
ugauggccgucagcca

SEQ ID NO: 1187979 - RNA, 18 nt, Mycobacterium bovis subsp bovis AF2122/97
ugauggccaucuggccgc

SEQ ID NO: 1187980 - RNA, 15 nt, Mycobacterium bovis subsp bovis AF2122/97
ugauggacggugcgc

SEQ ID NO: 1187981 - RNA, 16 nt, Mycobacterium bovis subsp bovis AF2122/97
ugauggagccggugac

SEQ ID NO: 1187982 - RNA, 14 nt, Mycobacterium bovis subsp bovis AF2122/97
ugauggaguggcug

SEQ ID NO: 1187983 - RNA, 18 nt, Mycobacterium bovis subsp bovis AF2122/97
ugauggcuccggccgcgu

SEQ ID NO: 1187984 - RNA, 16 nt, Mycobacterium bovis subsp bovis AF2122/97
ugauguaaccguagcc

SEQ ID NO: 1187985 - RNA, 17 nt, Mycobacterium bovis subsp bovis AF2122/97
ugauguagggcugcucc

SEQ ID NO: 1187986 - RNA, 19 nt, Mycobacterium bovis subsp bovis AF2122/97
ugaugggggagccggugac

SEQ ID NO: 1187987 - RNA, 15 nt, Mycobacterium bovis subsp bovis AF2122/97
ugaugggcagccgcc

SEQ ID NO: 1187988 - RNA, 19 nt, Mycobacterium bovis subsp bovis AF2122/97
ugaugggcauggugguggc

SEQ ID NO: 1187989 - RNA, 20 nt, Mycobacterium bovis subsp bovis AF2122/97
ugauggucaaugccggccgc

SEQ ID NO: 1187990 - RNA, 22 nt, Mycobacterium bovis subsp bovis AF2122/97
ugauggucaaugccggccgcgg

SEQ ID NO: 1187991 - RNA, 21 nt, Mycobacterium bovis subsp bovis AF2122/97
ugauguccucccaucccaugu

SEQ ID NO: 1187992 - RNA, 22 nt, Mycobacterium bovis subsp bovis AF2122/97
ugauguuuuccccgcccuugcc

SEQ ID NO: 1187993 - RNA, 19 nt, Mycobacterium bovis subsp bovis AF2122/97
ugcaggaucggcuugggaa

SEQ ID NO: 1187994 - RNA, 22 nt, Mycobacterium bovis subsp bovis AF2122/97
ugcaggacgcccacaugcucag

SEQ ID NO: 1187995 - RNA, 23 nt, Mycobacterium bovis subsp bovis AF2122/97
ugcaggacgcccacaugcucagg

SEQ ID NO: 1187996 - RNA, 13 nt, Mycobacterium bovis subsp bovis AF2122/97
ugcaggccagagu

SEQ ID NO: 1187997 - RNA, 14 nt, Mycobacterium bovis subsp bovis AF2122/97
ugcaggcgcagcug

SEQ ID NO: 1187998 - RNA, 23 nt, Mycobacterium bovis subsp bovis AF2122/97
ugcaggcggccuugccgggccgc

SEQ ID NO: 1187999 - RNA, 21 nt, Mycobacterium bovis subsp bovis AF2122/97
ugcagggcccgcaacaucggg

SEQ ID NO: 1188000 - RNA, 17 nt, Mycobacterium bovis subsp bovis AF2122/97
ugcagggccuggccaca

SEQ ID NO: 1188001 - RNA, 16 nt, Mycobacterium bovis subsp bovis AF2122/97
ugcagcgauaucacaa

SEQ ID NO: 1188002 - RNA, 19 nt, Mycobacterium bovis subsp bovis AF2122/97
ugcagcgauaucacaacug

SEQ ID NO: 1188003 - RNA, 17 nt, Mycobacterium bovis subsp bovis AF2122/97
ugcagcgaucccggcaa

SEQ ID NO: 1188004 - RNA, 15 nt, Mycobacterium bovis subsp bovis AF2122/97
ugcagcgcacgcagc

SEQ ID NO: 1188005 - RNA, 19 nt, Mycobacterium bovis subsp bovis AF2122/97
ugcagcgcacgcagccgau

SEQ ID NO: 1188006 - RNA, 21 nt, Mycobacterium bovis subsp bovis AF2122/97
ugcagcggcgccgccaagggc

SEQ ID NO: 1188007 - RNA, 14 nt, Mycobacterium bovis subsp bovis AF2122/97
ugcagcgggaucau

SEQ ID NO: 1188008 - RNA, 22 nt, Mycobacterium bovis subsp bovis AF2122/97
ugcagcgggccacugagccaca

SEQ ID NO: 1188009 - RNA, 18 nt, Mycobacterium bovis subsp bovis AF2122/97
ugcagcgcgauggccugg

SEQ ID NO: 1188010 - RNA, 17 nt, Mycobacterium bovis subsp bovis AF2122/97
ugcagcgcguucggcac

SEQ ID NO: 1188011 - RNA, 15 nt, Mycobacterium bovis subsp bovis AF2122/97
ugcagcucgggcagg

SEQ ID NO: 1188012 - RNA, 19 nt, Mycobacterium bovis subsp bovis AF2122/97
ugcagcucgggcagggacc

SEQ ID NO: 1188013 - RNA, 21 nt, Mycobacterium bovis subsp bovis AF2122/97
ugcagcgucuccuugagcuuc

SEQ ID NO: 1188014 - RNA, 16 nt, Mycobacterium bovis subsp bovis AF2122/97
ugcagcuuggcauuga

SEQ ID NO: 1188015 - RNA, 15 nt, Mycobacterium bovis subsp bovis AF2122/97
ugcaggaccagcacc

SEQ ID NO: 1188016 - RNA, 16 nt, Mycobacterium bovis subsp bovis AF2122/97
ugcaggaccagcaccg

SEQ ID NO: 1188017 - RNA, 14 nt, Mycobacterium bovis subsp bovis AF2122/97
ugcaggaacaccca

SEQ ID NO: 1188018 - RNA, 12 nt, Mycobacterium bovis subsp bovis AF2122/97
ugcagccgggaa

SEQ ID NO: 1188019 - RNA, 19 nt, Mycobacterium bovis subsp bovis AF2122/97
ugcagcccgggcagcacca

SEQ ID NO: 1188020 - RNA, 17 nt, Mycobacterium bovis subsp bovis AF2122/97
ugcagccgcaggugggc

SEQ ID NO: 1188021 - RNA, 21 nt, Mycobacterium bovis subsp bovis AF2122/97
ugcagcccgggcagcaccagc

SEQ ID NO: 1188022 - RNA, 14 nt, Mycobacterium bovis subsp bovis AF2122/97
ugcagcccugcgca

SEQ ID NO: 1188023 - RNA, 23 nt, Mycobacterium bovis subsp bovis AF2122/97
ugcagcgaaaugccggugccggg

SEQ ID NO: 1188024 - RNA, 21 nt, Mycobacterium bovis subsp bovis AF2122/97
ugcagcgaaacaccggccagc

SEQ ID NO: 1188025 - RNA, 14 nt, Mycobacterium bovis subsp bovis AF2122/97
ugcagcccgccgcu

SEQ ID NO: 1188026 - RNA, 23 nt, Mycobacterium bovis subsp bovis AF2122/97
ugcagcccgccggauccgccaga

SEQ ID NO: 1188027 - RNA, 13 nt, Mycobacterium bovis subsp bovis AF2122/97
ugcagccccacuu

SEQ ID NO: 1188028 - RNA, 23 nt, Mycobacterium bovis subsp bovis AF2122/97
ugcagccagauucauuggccugg

SEQ ID NO: 1188029 - RNA, 16 nt, Mycobacterium bovis subsp bovis AF2122/97
ugcagcacgauccagc

SEQ ID NO: 1188030 - RNA, 12 nt, Mycobacterium bovis subsp bovis AF2122/97
ugcagcacgcgu

SEQ ID NO: 1188031 - RNA, 14 nt, Mycobacterium bovis subsp bovis AF2122/97
ugcagcagggcuuc

SEQ ID NO: 1188032 - RNA, 17 nt, Mycobacterium bovis subsp bovis AF2122/97
ugcagccaaaucagaug

SEQ ID NO: 1188033 - RNA, 15 nt, Mycobacterium bovis subsp bovis AF2122/97
ugcagaucacgggug

SEQ ID NO: 1188034 - RNA, 21 nt, Mycobacterium bovis subsp bovis AF2122/97
ugcagauaggacccagccagc

SEQ ID NO: 1188035 - RNA, 18 nt, Mycobacterium bovis subsp bovis AF2122/97
ugcagaucgccccagcca

SEQ ID NO: 1188036 - RNA, 19 nt, Mycobacterium bovis subsp bovis AF2122/97
ugcagaucgccccagccau

SEQ ID NO: 1188037 - RNA, 12 nt, Mycobacterium bovis subsp bovis AF2122/97
ugcagaucggcc

SEQ ID NO: 1188038 - RNA, 15 nt, Mycobacterium bovis subsp bovis AF2122/97
ugcagaucggccgga

SEQ ID NO: 1188039 - RNA, 13 nt, Mycobacterium bovis subsp bovis AF2122/97
ugcagaucggcuc

SEQ ID NO: 1188040 - RNA, 16 nt, Mycobacterium bovis subsp bovis AF2122/97
ugcagaucguagugcg

SEQ ID NO: 1188041 - RNA, 20 nt, Mycobacterium bovis subsp bovis AF2122/97
ugcagaucguagugcgcgcc

SEQ ID NO: 1188042 - RNA, 13 nt, Mycobacterium bovis subsp bovis AF2122/97
ugcagacgggugg

SEQ ID NO: 1188043 - RNA, 13 nt, Mycobacterium bovis subsp bovis AF2122/97
ugcagaccgggug

SEQ ID NO: 1188044 - RNA, 13 nt, Mycobacterium bovis subsp bovis AF2122/97
ugcacacaggacu

SEQ ID NO: 1188045 - RNA, 19 nt, Mycobacterium bovis subsp bovis AF2122/97
ugcacaccgggcaccaguc

SEQ ID NO: 1188046 - RNA, 13 nt, Mycobacterium bovis subsp bovis AF2122/97
ugcacaccgucgc

SEQ ID NO: 1188047 - RNA, 19 nt, Mycobacterium bovis subsp bovis AF2122/97
ugcacaaucgguugcaccc

SEQ ID NO: 1188048 - RNA, 22 nt, Mycobacterium bovis subsp bovis AF2122/97
ugcacaaucgguugcacccgcg

SEQ ID NO: 1188049 - RNA, 15 nt, Mycobacterium bovis subsp bovis AF2122/97
ugcacaacgcccacc

SEQ ID NO: 1188050 - RNA, 18 nt, Mycobacterium bovis subsp bovis AF2122/97
ugcacaaccgcugcugcu

SEQ ID NO: 1188051 - RNA, 17 nt, Mycobacterium bovis subsp bovis AF2122/97
ugcacaacgcccaccac

SEQ ID NO: 1188052 - RNA, 17 nt, Mycobacterium bovis subsp bovis AF2122/97
ugcaaucgcgugcugga

SEQ ID NO: 1188053 - RNA, 14 nt, Mycobacterium bovis subsp bovis AF2122/97
ugcaaugacuggac

SEQ ID NO: 1188054 - RNA, 14 nt, Mycobacterium bovis subsp bovis AF2122/97
ugcaaugcuggcgg

SEQ ID NO: 1188055 - RNA, 14 nt, Mycobacterium bovis subsp bovis AF2122/97
ugcacaggauuggc

SEQ ID NO: 1188056 - RNA, 20 nt, Mycobacterium bovis subsp bovis AF2122/97
ugcacacucaacccgccguc

SEQ ID NO: 1188057 - RNA, 20 nt, Mycobacterium bovis subsp bovis AF2122/97
ugcacagcagcgucaucagg

SEQ ID NO: 1188058 - RNA, 18 nt, Mycobacterium bovis subsp bovis AF2122/97
ugcacagcagugaacgua

SEQ ID NO: 1188059 - RNA, 22 nt, Mycobacterium bovis subsp bovis AF2122/97
ugcacaucggugguuagguggc

SEQ ID NO: 1188060 - RNA, 21 nt, Mycobacterium bovis subsp bovis AF2122/97
ugcacagcggcaucgcgggcg

SEQ ID NO: 1188061 - RNA, 20 nt, Mycobacterium bovis subsp bovis AF2122/97
ugcacggccgagcagguucc

SEQ ID NO: 1188062 - RNA, 16 nt, Mycobacterium bovis subsp bovis AF2122/97
ugcacggucaugccgc

SEQ ID NO: 1188063 - RNA, 18 nt, Mycobacterium bovis subsp bovis AF2122/97
ugcacggucaugccgccg

SEQ ID NO: 1188064 - RNA, 19 nt, Mycobacterium bovis subsp bovis AF2122/97
ugcacggggaccuuggcga

SEQ ID NO: 1188065 - RNA, 15 nt, Mycobacterium bovis subsp bovis AF2122/97
ugcacggugcccagg

SEQ ID NO: 1188066 - RNA, 21 nt, Mycobacterium bovis subsp bovis AF2122/97
ugcacgguaucggugcugguc

SEQ ID NO: 1188067 - RNA, 12 nt, Mycobacterium bovis subsp bovis AF2122/97
ugcacgugaccc

SEQ ID NO: 1188068 - RNA, 15 nt, Mycobacterium bovis subsp bovis AF2122/97
ugcacgucgagcagg

SEQ ID NO: 1188069 - RNA, 15 nt, Mycobacterium bovis subsp bovis AF2122/97
ugcacuguggaagaa

SEQ ID NO: 1188070 - RNA, 20 nt, Mycobacterium bovis subsp bovis AF2122/97
ugcagaaacagccgcagcgg

SEQ ID NO: 1188071 - RNA, 15 nt, Mycobacterium bovis subsp bovis AF2122/97
ugccacuuggacgaa

SEQ ID NO: 1188072 - RNA, 21 nt, Mycobacterium bovis subsp bovis AF2122/97
ugccacuccaggagccgagga

SEQ ID NO: 1188073 - RNA, 14 nt, Mycobacterium bovis subsp bovis AF2122/97
ugccacccagcacg

SEQ ID NO: 1188074 - RNA, 15 nt, Mycobacterium bovis subsp bovis AF2122/97
ugccacccaucgcac

SEQ ID NO: 1188075 - RNA, 17 nt, Mycobacterium bovis subsp bovis AF2122/97
ugccacccaacagcgcu

SEQ ID NO: 1188076 - RNA, 15 nt, Mycobacterium bovis subsp bovis AF2122/97
ugccaccagaaacac

SEQ ID NO: 1188077 - RNA, 12 nt, Mycobacterium bovis subsp bovis AF2122/97
ugccacaggcgu

SEQ ID NO: 1188078 - RNA, 23 nt, Mycobacterium bovis subsp bovis AF2122/97
ugccacagcucgccgugaccagg

SEQ ID NO: 1188079 - RNA, 14 nt, Mycobacterium bovis subsp bovis AF2122/97
ugccacaggugacc

SEQ ID NO: 1188080 - RNA, 15 nt, Mycobacterium bovis subsp bovis AF2122/97
ugccaaggccuucag

SEQ ID NO: 1188081 - RNA, 19 nt, Mycobacterium bovis subsp bovis AF2122/97
ugccaagggccggaugggc

SEQ ID NO: 1188082 - RNA, 23 nt, Mycobacterium bovis subsp bovis AF2122/97
ugccaacgcccguguugaagaag

SEQ ID NO: 1188083 - RNA, 21 nt, Mycobacterium bovis subsp bovis AF2122/97
ugccaaucgccgucagcaccg

SEQ ID NO: 1188084 - RNA, 13 nt, Mycobacterium bovis subsp bovis AF2122/97
ugccaaucugcac

SEQ ID NO: 1188085 - RNA, 22 nt, Mycobacterium bovis subsp bovis AF2122/97
ugccacagaccgaacagcaccg

SEQ ID NO: 1188086 - RNA, 18 nt, Mycobacterium bovis subsp bovis AF2122/97
ugcaggucggcccagguu

SEQ ID NO: 1188087 - RNA, 19 nt, Mycobacterium bovis subsp bovis AF2122/97
ugcaggucguccaucgcgu

SEQ ID NO: 1188088 - RNA, 16 nt, Mycobacterium bovis subsp bovis AF2122/97
ugcaggucggcccagg

SEQ ID NO: 1188089 - RNA, 17 nt, Mycobacterium bovis subsp bovis AF2122/97
ugcaggugaugagugcg

SEQ ID NO: 1188090 - RNA, 16 nt, Mycobacterium bovis subsp bovis AF2122/97
ugcaggugaugcaugc

SEQ ID NO: 1188091 - RNA, 16 nt, Mycobacterium bovis subsp bovis AF2122/97
ugcaggugcgggccgg

SEQ ID NO: 1188092 - RNA, 21 nt, Mycobacterium bovis subsp bovis AF2122/97
ugcaggugcccggccaaaaug

SEQ ID NO: 1188093 - RNA, 17 nt, Mycobacterium bovis subsp bovis AF2122/97
ugcagguuuccggccug

SEQ ID NO: 1188094 - RNA, 23 nt, Mycobacterium bovis subsp bovis AF2122/97
ugccaagcagcugggcaucaccg

SEQ ID NO: 1188095 - RNA, 22 nt, Mycobacterium bovis subsp bovis AF2122/97
ugccaacugcgccguucgcucc

SEQ ID NO: 1188096 - RNA, 14 nt, Mycobacterium bovis subsp bovis AF2122/97
ugccaaccgcggcg

SEQ ID NO: 1188097 - RNA, 16 nt, Mycobacterium bovis subsp bovis AF2122/97
ugcaguaguagcgcaa

SEQ ID NO: 1188098 - RNA, 22 nt, Mycobacterium bovis subsp bovis AF2122/97
ugcagucggugcggugcacacu

SEQ ID NO: 1188099 - RNA, 16 nt, Mycobacterium bovis subsp bovis AF2122/97
ugccaggaccgcgccg

SEQ ID NO: 1188100 - RNA, 16 nt, Mycobacterium bovis subsp bovis AF2122/97
ugccaggaucgcggcg

SEQ ID NO: 1188101 - RNA, 16 nt, Mycobacterium bovis subsp bovis AF2122/97
ugccagcuguugcggg

SEQ ID NO: 1188102 - RNA, 23 nt, Mycobacterium bovis subsp bovis AF2122/97
ugccagcggccgggcggccaggc

SEQ ID NO: 1188103 - RNA, 14 nt, Mycobacterium bovis subsp bovis AF2122/97
ugccagcagcagcg

SEQ ID NO: 1188104 - RNA, 17 nt, Mycobacterium bovis subsp bovis AF2122/97
ugccagccacgaacuga

SEQ ID NO: 1188105 - RNA, 11 nt, Mycobacterium bovis subsp bovis AF2122/97
ugccagcacca

SEQ ID NO: 1188106 - RNA, 19 nt, Mycobacterium bovis subsp bovis AF2122/97
ugcccaccaucccgcucag

SEQ ID NO: 1188107 - RNA, 15 nt, Mycobacterium bovis subsp bovis AF2122/97
ugcccaaggccagga

SEQ ID NO: 1188108 - RNA, 20 nt, Mycobacterium bovis subsp bovis AF2122/97
ugcccaccuucgaguuuggu

SEQ ID NO: 1188109 - RNA, 18 nt, Mycobacterium bovis subsp bovis AF2122/97
ugcccacgcacagcaacg

SEQ ID NO: 1188110 - RNA, 19 nt, Mycobacterium bovis subsp bovis AF2122/97
ugcccaaaaggaagaccuc

SEQ ID NO: 1188111 - RNA, 21 nt, Mycobacterium bovis subsp bovis AF2122/97
ugccauacagcaccccgccgg

SEQ ID NO: 1188112 - RNA, 20 nt, Mycobacterium bovis subsp bovis AF2122/97
ugccagugccgcccaccaca

SEQ ID NO: 1188113 - RNA, 14 nt, Mycobacterium bovis subsp bovis AF2122/97
ugcccaggccaccg

SEQ ID NO: 1188114 - RNA, 17 nt, Mycobacterium bovis subsp bovis AF2122/97
ugcccaggcucgcaccg

SEQ ID NO: 1188115 - RNA, 18 nt, Mycobacterium bovis subsp bovis AF2122/97
ugcccaggugcguccagg

SEQ ID NO: 1188116 - RNA, 23 nt, Mycobacterium bovis subsp bovis AF2122/97
ugcccaggugcguccaggccagg

SEQ ID NO: 1188117 - RNA, 14 nt, Mycobacterium bovis subsp bovis AF2122/97
ugcccauccggccg

SEQ ID NO: 1188118 - RNA, 13 nt, Mycobacterium bovis subsp bovis AF2122/97
ugcccaucaccag

SEQ ID NO: 1188119 - RNA, 13 nt, Mycobacterium bovis subsp bovis AF2122/97
ugcccaucuccaa

SEQ ID NO: 1188120 - RNA, 14 nt, Mycobacterium bovis subsp bovis AF2122/97
ugcccaucuccaac

SEQ ID NO: 1188121 - RNA, 18 nt, Mycobacterium bovis subsp bovis AF2122/97
ugcccagcaugaaguccc

SEQ ID NO: 1188122 - RNA, 13 nt, Mycobacterium bovis subsp bovis AF2122/97
ugcccagcaccac

SEQ ID NO: 1188123 - RNA, 12 nt, Mycobacterium bovis subsp bovis AF2122/97
ugcccagcaccc

SEQ ID NO: 1188124 - RNA, 23 nt, Mycobacterium bovis subsp bovis AF2122/97
ugcccacggcgaccacgccgccg

SEQ ID NO: 1188125 - RNA, 13 nt, Mycobacterium bovis subsp bovis AF2122/97
ugcccacgggccg

SEQ ID NO: 1188126 - RNA, 16 nt, Mycobacterium bovis subsp bovis AF2122/97
ugcccacgggccggcc

SEQ ID NO: 1188127 - RNA, 21 nt, Mycobacterium bovis subsp bovis AF2122/97
ugcccacgggccggccgagcg

SEQ ID NO: 1188128 - RNA, 22 nt, Mycobacterium bovis subsp bovis AF2122/97
ugcccacggugccggcacccga

SEQ ID NO: 1188129 - RNA, 22 nt, Mycobacterium bovis subsp bovis AF2122/97
ugcccgcaacgccaacacgcgu

SEQ ID NO: 1188130 - RNA, 17 nt, Mycobacterium bovis subsp bovis AF2122/97
ugcccgaaccaccaccg

SEQ ID NO: 1188131 - RNA, 13 nt, Mycobacterium bovis subsp bovis AF2122/97
ugcccgccgcguc

SEQ ID NO: 1188132 - RNA, 12 nt, Mycobacterium bovis subsp bovis AF2122/97
ugcccgccggcc

SEQ ID NO: 1188133 - RNA, 18 nt, Mycobacterium bovis subsp bovis AF2122/97
ugcccgccguagaccagc

SEQ ID NO: 1188134 - RNA, 15 nt, Mycobacterium bovis subsp bovis AF2122/97
ugcccgccagcgccg

SEQ ID NO: 1188135 - RNA, 18 nt, Mycobacterium bovis subsp bovis AF2122/97
ugcccgcauugccaacgc

SEQ ID NO: 1188136 - RNA, 13 nt, Mycobacterium bovis subsp bovis AF2122/97
ugcccgcccagcc

SEQ ID NO: 1188137 - RNA, 21 nt, Mycobacterium bovis subsp bovis AF2122/97
ugcccgccaccggcgcgaccg

SEQ ID NO: 1188138 - RNA, 14 nt, Mycobacterium bovis subsp bovis AF2122/97
ugcccgcccagccc

SEQ ID NO: 1188139 - RNA, 13 nt, Mycobacterium bovis subsp bovis AF2122/97
ugcccgccagucc

SEQ ID NO: 1188140 - RNA, 18 nt, Mycobacterium bovis subsp bovis AF2122/97
ugccccguugagcagcac

SEQ ID NO: 1188141 - RNA, 20 nt, Mycobacterium bovis subsp bovis AF2122/97
ugccccgguugaucuugucc

SEQ ID NO: 1188142 - RNA, 14 nt, Mycobacterium bovis subsp bovis AF2122/97
ugccccgcagcacu

SEQ ID NO: 1188143 - RNA, 16 nt, Mycobacterium bovis subsp bovis AF2122/97
ugccccgcagcacucg

SEQ ID NO: 1188144 - RNA, 12 nt, Mycobacterium bovis subsp bovis AF2122/97
ugccccaagcca

SEQ ID NO: 1188145 - RNA, 14 nt, Mycobacterium bovis subsp bovis AF2122/97
ugcccccggugccg

SEQ ID NO: 1188146 - RNA, 18 nt, Mycobacterium bovis subsp bovis AF2122/97
ugcccaugcggcaggugc

SEQ ID NO: 1188147 - RNA, 20 nt, Mycobacterium bovis subsp bovis AF2122/97
ugcccaugauggccgcggcu

SEQ ID NO: 1188148 - RNA, 20 nt, Mycobacterium bovis subsp bovis AF2122/97
ugcccaugauggucacggcg

SEQ ID NO: 1188149 - RNA, 18 nt, Mycobacterium bovis subsp bovis AF2122/97
ugccgacggcgccgaacc

SEQ ID NO: 1188150 - RNA, 23 nt, Mycobacterium bovis subsp bovis AF2122/97
ugccgacucaucggccgcggucg

SEQ ID NO: 1188151 - RNA, 18 nt, Mycobacterium bovis subsp bovis AF2122/97
ugccgacgccccgaucgg

SEQ ID NO: 1188152 - RNA, 16 nt, Mycobacterium bovis subsp bovis AF2122/97
ugccgacgcgcggcca

SEQ ID NO: 1188153 - RNA, 19 nt, Mycobacterium bovis subsp bovis AF2122/97
ugccgacgcgcggccagcc

SEQ ID NO: 1188154 - RNA, 13 nt, Mycobacterium bovis subsp bovis AF2122/97
ugccgaaguugaa

SEQ ID NO: 1188155 - RNA, 20 nt, Mycobacterium bovis subsp bovis AF2122/97
ugccgaagcugcccaaccgg

SEQ ID NO: 1188156 - RNA, 17 nt, Mycobacterium bovis subsp bovis AF2122/97
ugccgaaguugaagaag

SEQ ID NO: 1188157 - RNA, 18 nt, Mycobacterium bovis subsp bovis AF2122/97
ugccgaacgucgcggcca

SEQ ID NO: 1188158 - RNA, 17 nt, Mycobacterium bovis subsp bovis AF2122/97
ugccgagcacucggcca

SEQ ID NO: 1188159 - RNA, 19 nt, Mycobacterium bovis subsp bovis AF2122/97
ugccgauggaugggcugcg

SEQ ID NO: 1188160 - RNA, 22 nt, Mycobacterium bovis subsp bovis AF2122/97
ugccgauggaugggcugcgcgu

SEQ ID NO: 1188161 - RNA, 16 nt, Mycobacterium bovis subsp bovis AF2122/97
ugccgccaccaccggc

SEQ ID NO: 1188162 - RNA, 23 nt, Mycobacterium bovis subsp bovis AF2122/97
ugccgccaccgccaccgcggccu

SEQ ID NO: 1188163 - RNA, 17 nt, Mycobacterium bovis subsp bovis AF2122/97
ugccgcaccaaggccgc

SEQ ID NO: 1188164 - RNA, 13 nt, Mycobacterium bovis subsp bovis AF2122/97
ugccgccaccggc

SEQ ID NO: 1188165 - RNA, 15 nt, Mycobacterium bovis subsp bovis AF2122/97
ugccgccaccggcgu

SEQ ID NO: 1188166 - RNA, 18 nt, Mycobacterium bovis subsp bovis AF2122/97
ugccgauuacggugaucg

SEQ ID NO: 1188167 - RNA, 22 nt, Mycobacterium bovis subsp bovis AF2122/97
ugccgauggugaugggggagcc

SEQ ID NO: 1188168 - RNA, 21 nt, Mycobacterium bovis subsp bovis AF2122/97
ugcccggucuauuugccugcc

SEQ ID NO: 1188169 - RNA, 17 nt, Mycobacterium bovis subsp bovis AF2122/97
ugcccgggaccauagcc

SEQ ID NO: 1188170 - RNA, 17 nt, Mycobacterium bovis subsp bovis AF2122/97
ugcccgggcccgucguc

SEQ ID NO: 1188171 - RNA, 19 nt, Mycobacterium bovis subsp bovis AF2122/97
ugcccggcccgcucagccg

SEQ ID NO: 1188172 - RNA, 13 nt, Mycobacterium bovis subsp bovis AF2122/97
ugcccggccgcca

SEQ ID NO: 1188173 - RNA, 21 nt, Mycobacterium bovis subsp bovis AF2122/97
ugcccggccgccagcgcgccg

SEQ ID NO: 1188174 - RNA, 22 nt, Mycobacterium bovis subsp bovis AF2122/97
ugccgaaacgccgaccgcgccg

SEQ ID NO: 1188175 - RNA, 15 nt, Mycobacterium bovis subsp bovis AF2122/97
ugccgaaccgcgcgu

SEQ ID NO: 1188176 - RNA, 23 nt, Mycobacterium bovis subsp bovis AF2122/97
ugccgaacagcgaaccgccggca

SEQ ID NO: 1188177 - RNA, 15 nt, Mycobacterium bovis subsp bovis AF2122/97
ugcccuuucccaccu

SEQ ID NO: 1188178 - RNA, 17 nt, Mycobacterium bovis subsp bovis AF2122/97
ugcccuuucccaccuuc

SEQ ID NO: 1188179 - RNA, 22 nt, Mycobacterium bovis subsp bovis AF2122/97
ugcccuuucccaccuucaguuu

SEQ ID NO: 1188180 - RNA, 16 nt, Mycobacterium bovis subsp bovis AF2122/97
ugcccuugcggaagaa

SEQ ID NO: 1188181 - RNA, 12 nt, Mycobacterium bovis subsp bovis AF2122/97
ugcccuugggac

SEQ ID NO: 1188182 - RNA, 14 nt, Mycobacterium bovis subsp bovis AF2122/97
ugcccuuggccagc

SEQ ID NO: 1188183 - RNA, 16 nt, Mycobacterium bovis subsp bovis AF2122/97
ugccggacgccaugcc

SEQ ID NO: 1188184 - RNA, 16 nt, Mycobacterium bovis subsp bovis AF2122/97
ugccgccggcuccacc

SEQ ID NO: 1188185 - RNA, 17 nt, Mycobacterium bovis subsp bovis AF2122/97
ugccgccggccccgcca

SEQ ID NO: 1188186 - RNA, 17 nt, Mycobacterium bovis subsp bovis AF2122/97
ugccgccggcgccaccc

SEQ ID NO: 1188187 - RNA, 14 nt, Mycobacterium bovis subsp bovis AF2122/97
ugccgccggcgccg

SEQ ID NO: 1188188 - RNA, 17 nt, Mycobacterium bovis subsp bovis AF2122/97
ugccgccggcgccgccg

SEQ ID NO: 1188189 - RNA, 16 nt, Mycobacterium bovis subsp bovis AF2122/97
ugccgccggccagucc

SEQ ID NO: 1188190 - RNA, 19 nt, Mycobacterium bovis subsp bovis AF2122/97
ugccgccggccccgccguc

SEQ ID NO: 1188191 - RNA, 22 nt, Mycobacterium bovis subsp bovis AF2122/97
ugccgccggccccgccgucacc

SEQ ID NO: 1188192 - RNA, 14 nt, Mycobacterium bovis subsp bovis AF2122/97
ugccgccggcgcca

SEQ ID NO: 1188193 - RNA, 16 nt, Mycobacterium bovis subsp bovis AF2122/97
ugccgccgcggccacc

SEQ ID NO: 1188194 - RNA, 21 nt, Mycobacterium bovis subsp bovis AF2122/97
ugccgccgcggcgcccggcgg

SEQ ID NO: 1188195 - RNA, 13 nt, Mycobacterium bovis subsp bovis AF2122/97
ugccggaguugaa

SEQ ID NO: 1188196 - RNA, 17 nt, Mycobacterium bovis subsp bovis AF2122/97
ugccgccggcgccggca

SEQ ID NO: 1188197 - RNA, 16 nt, Mycobacterium bovis subsp bovis AF2122/97
ugccggacugccgcag

SEQ ID NO: 1188198 - RNA, 15 nt, Mycobacterium bovis subsp bovis AF2122/97
ugccggacuuggccu

SEQ ID NO: 1188199 - RNA, 14 nt, Mycobacterium bovis subsp bovis AF2122/97
ugccgccgcggcca

SEQ ID NO: 1188200 - RNA, 16 nt, Mycobacterium bovis subsp bovis AF2122/97
ugccgccgcggccaca

SEQ ID NO: 1188201 - RNA, 23 nt, Mycobacterium bovis subsp bovis AF2122/97
ugccgccgccuccgccgaggccg

SEQ ID NO: 1188202 - RNA, 14 nt, Mycobacterium bovis subsp bovis AF2122/97
ugccgccgccgccg

SEQ ID NO: 1188203 - RNA, 20 nt, Mycobacterium bovis subsp bovis AF2122/97
ugccgcccaccacacagccg

SEQ ID NO: 1188204 - RNA, 17 nt, Mycobacterium bovis subsp bovis AF2122/97
ugccgccacgggcggcc

SEQ ID NO: 1188205 - RNA, 20 nt, Mycobacterium bovis subsp bovis AF2122/97
ugccgccacgggcggccacc

SEQ ID NO: 1188206 - RNA, 17 nt, Mycobacterium bovis subsp bovis AF2122/97
ugccgccagcccagccc

SEQ ID NO: 1188207 - RNA, 22 nt, Mycobacterium bovis subsp bovis AF2122/97
ugccgccaccggcguccagucc

SEQ ID NO: 1188208 - RNA, 18 nt, Mycobacterium bovis subsp bovis AF2122/97
ugccggcguuagcguagc

SEQ ID NO: 1188209 - RNA, 15 nt, Mycobacterium bovis subsp bovis AF2122/97
ugccguauccaggcg

SEQ ID NO: 1188210 - RNA, 14 nt, Mycobacterium bovis subsp bovis AF2122/97
ugccguccggcgcu

SEQ ID NO: 1188211 - RNA, 22 nt, Mycobacterium bovis subsp bovis AF2122/97
ugccggcgugcggcgaggacgc

SEQ ID NO: 1188212 - RNA, 23 nt, Mycobacterium bovis subsp bovis AF2122/97
ugccggcgccuuggucgccgccu

SEQ ID NO: 1188213 - RNA, 16 nt, Mycobacterium bovis subsp bovis AF2122/97
ugccggcguugccgcc

SEQ ID NO: 1188214 - RNA, 20 nt, Mycobacterium bovis subsp bovis AF2122/97
ugccggcgucgcuggccagg

SEQ ID NO: 1188215 - RNA, 14 nt, Mycobacterium bovis subsp bovis AF2122/97
ugccggcgccgcca

SEQ ID NO: 1188216 - RNA, 24 nt, Mycobacterium bovis subsp bovis AF2122/97
ugccggcgccgccagcaccaccgg

SEQ ID NO: 1188217 - RNA, 14 nt, Mycobacterium bovis subsp bovis AF2122/97
ugccggcgccgccc

SEQ ID NO: 1188218 - RNA, 18 nt, Mycobacterium bovis subsp bovis AF2122/97
ugccggcgccgcccuugc

SEQ ID NO: 1188219 - RNA, 19 nt, Mycobacterium bovis subsp bovis AF2122/97
ugccggcgccgcccuugcc

SEQ ID NO: 1188220 - RNA, 15 nt, Mycobacterium bovis subsp bovis AF2122/97
ugccggcgccuuggu

SEQ ID NO: 1188221 - RNA, 13 nt, Mycobacterium bovis subsp bovis AF2122/97
ugccggcaccaac

SEQ ID NO: 1188222 - RNA, 17 nt, Mycobacterium bovis subsp bovis AF2122/97
ugccggcacgcaugccg

SEQ ID NO: 1188223 - RNA, 13 nt, Mycobacterium bovis subsp bovis AF2122/97
ugccggcagcgcc

SEQ ID NO: 1188224 - RNA, 12 nt, Mycobacterium bovis subsp bovis AF2122/97
ugccggcagcgg

SEQ ID NO: 1188225 - RNA, 13 nt, Mycobacterium bovis subsp bovis AF2122/97
ugccuugagcaaa

SEQ ID NO: 1188226 - RNA, 16 nt, Mycobacterium bovis subsp bovis AF2122/97
ugccugcgcacgaccc

SEQ ID NO: 1188227 - RNA, 22 nt, Mycobacterium bovis subsp bovis AF2122/97
ugccuucaccgaggaucaucaa

SEQ ID NO: 1188228 - RNA, 19 nt, Mycobacterium bovis subsp bovis AF2122/97
ugccuuaucgagauauugc

SEQ ID NO: 1188229 - RNA, 14 nt, Mycobacterium bovis subsp bovis AF2122/97
ugccugcagcuugg

SEQ ID NO: 1188230 - RNA, 16 nt, Mycobacterium bovis subsp bovis AF2122/97
ugccucaccgccgcua

SEQ ID NO: 1188231 - RNA, 13 nt, Mycobacterium bovis subsp bovis AF2122/97
ugccucaccaggu

SEQ ID NO: 1188232 - RNA, 12 nt, Mycobacterium bovis subsp bovis AF2122/97
ugccgucggccu

SEQ ID NO: 1188233 - RNA, 14 nt, Mycobacterium bovis subsp bovis AF2122/97
ugccgucgccgccc

SEQ ID NO: 1188234 - RNA, 18 nt, Mycobacterium bovis subsp bovis AF2122/97
ugccgucgccgcccuggc

SEQ ID NO: 1188235 - RNA, 19 nt, Mycobacterium bovis subsp bovis AF2122/97
ugccgucgccgcccuggcc

SEQ ID NO: 1188236 - RNA, 19 nt, Mycobacterium bovis subsp bovis AF2122/97
ugccgucgccggucaggcc

SEQ ID NO: 1188237 - RNA, 21 nt, Mycobacterium bovis subsp bovis AF2122/97
ugccgucggcguacagcgccu

SEQ ID NO: 1188238 - RNA, 18 nt, Mycobacterium bovis subsp bovis AF2122/97
ugccuagccgcagccccg

SEQ ID NO: 1188239 - RNA, 17 nt, Mycobacterium bovis subsp bovis AF2122/97
ugcgcagauuugcucca

SEQ ID NO: 1188240 - RNA, 20 nt, Mycobacterium bovis subsp bovis AF2122/97
ugcgcagauuugcuccagcg

SEQ ID NO: 1188241 - RNA, 16 nt, Mycobacterium bovis subsp bovis AF2122/97
ugcgcagauuugcucc

SEQ ID NO: 1188242 - RNA, 20 nt, Mycobacterium bovis subsp bovis AF2122/97
ugcgcagaaacgccgagcgc

SEQ ID NO: 1188243 - RNA, 20 nt, Mycobacterium bovis subsp bovis AF2122/97
ugcgcagaacaccaccgcca

SEQ ID NO: 1188244 - RNA, 14 nt, Mycobacterium bovis subsp bovis AF2122/97
ugcgcacucccggc

SEQ ID NO: 1188245 - RNA, 22 nt, Mycobacterium bovis subsp bovis AF2122/97
ugcgcacugaggcucaggugcu

SEQ ID NO: 1188246 - RNA, 19 nt, Mycobacterium bovis subsp bovis AF2122/97
ugcgcaccaguccagcggg

SEQ ID NO: 1188247 - RNA, 12 nt, Mycobacterium bovis subsp bovis AF2122/97
ugcgcaccagca

SEQ ID NO: 1188248 - RNA, 21 nt, Mycobacterium bovis subsp bovis AF2122/97
ugcgcaauagcgacagcagcg

SEQ ID NO: 1188249 - RNA, 21 nt, Mycobacterium bovis subsp bovis AF2122/97
ugcgcagcagcgugcacaccc

SEQ ID NO: 1188250 - RNA, 16 nt, Mycobacterium bovis subsp bovis AF2122/97
ugcgcagccgcagccg

SEQ ID NO: 1188251 - RNA, 12 nt, Mycobacterium bovis subsp bovis AF2122/97
ugcgcagcgcaa

SEQ ID NO: 1188252 - RNA, 17 nt, Mycobacterium bovis subsp bovis AF2122/97
ugcgcagcuuggccagc

SEQ ID NO: 1188253 - RNA, 18 nt, Mycobacterium bovis subsp bovis AF2122/97
ugcgcagcgugaaaugca

SEQ ID NO: 1188254 - RNA, 15 nt, Mycobacterium bovis subsp bovis AF2122/97
ugcgcagggccugga

SEQ ID NO: 1188255 - RNA, 18 nt, Mycobacterium bovis subsp bovis AF2122/97
ugcgcagugacgccucga

SEQ ID NO: 1188256 - RNA, 17 nt, Mycobacterium bovis subsp bovis AF2122/97
ugcgcagugcaccgcgu

SEQ ID NO: 1188257 - RNA, 16 nt, Mycobacterium bovis subsp bovis AF2122/97
ugcgcaaccgcggccc

SEQ ID NO: 1188258 - RNA, 20 nt, Mycobacterium bovis subsp bovis AF2122/97
ugcgcaacccagccgcgcca

SEQ ID NO: 1188259 - RNA, 22 nt, Mycobacterium bovis subsp bovis AF2122/97
ugcgcaacccagccgcgccagc

SEQ ID NO: 1188260 - RNA, 18 nt, Mycobacterium bovis subsp bovis AF2122/97
ugcgcaacaccucaccgc

SEQ ID NO: 1188261 - RNA, 22 nt, Mycobacterium bovis subsp bovis AF2122/97
ugcgcaacaccgugcaccagcu

SEQ ID NO: 1188262 - RNA, 15 nt, Mycobacterium bovis subsp bovis AF2122/97
ugcgaugcagcgcgc

SEQ ID NO: 1188263 - RNA, 22 nt, Mycobacterium bovis subsp bovis AF2122/97
ugcgcaaauaggacugcgccac

SEQ ID NO: 1188264 - RNA, 21 nt, Mycobacterium bovis subsp bovis AF2122/97
ugcgcaacaccgugcaccagc

SEQ ID NO: 1188265 - RNA, 14 nt, Mycobacterium bovis subsp bovis AF2122/97
ugcgaugcacaacc

SEQ ID NO: 1188266 - RNA, 14 nt, Mycobacterium bovis subsp bovis AF2122/97
ugcgauggcccggg

SEQ ID NO: 1188267 - RNA, 12 nt, Mycobacterium bovis subsp bovis AF2122/97
ugcgaucggcac

SEQ ID NO: 1188268 - RNA, 19 nt, Mycobacterium bovis subsp bovis AF2122/97
ugcgaucggcacuuagccc

SEQ ID NO: 1188269 - RNA, 18 nt, Mycobacterium bovis subsp bovis AF2122/97
ugcgaucggugcgaucag

SEQ ID NO: 1188270 - RNA, 15 nt, Mycobacterium bovis subsp bovis AF2122/97
ugcgaucccacccuc

SEQ ID NO: 1188271 - RNA, 16 nt, Mycobacterium bovis subsp bovis AF2122/97
ugcgaucaacccuacc

SEQ ID NO: 1188272 - RNA, 21 nt, Mycobacterium bovis subsp bovis AF2122/97
ugcgaucaacccuacccgcau

SEQ ID NO: 1188273 - RNA, 20 nt, Mycobacterium bovis subsp bovis AF2122/97
ugcgacucugcgucugcuca

SEQ ID NO: 1188274 - RNA, 13 nt, Mycobacterium bovis subsp bovis AF2122/97
ugcgagagcaccg

SEQ ID NO: 1188275 - RNA, 17 nt, Mycobacterium bovis subsp bovis AF2122/97
ugcgagucgucccaguc

SEQ ID NO: 1188276 - RNA, 18 nt, Mycobacterium bovis subsp bovis AF2122/97
ugcgagucgucccagucc

SEQ ID NO: 1188277 - RNA, 14 nt, Mycobacterium bovis subsp bovis AF2122/97
ugcgaggaugcgca

SEQ ID NO: 1188278 - RNA, 22 nt, Mycobacterium bovis subsp bovis AF2122/97
ugcgaggaugcgcaacaccuca

SEQ ID NO: 1188279 - RNA, 23 nt, Mycobacterium bovis subsp bovis AF2122/97
ugcgaggcguaaucaagcagcgu

SEQ ID NO: 1188280 - RNA, 14 nt, Mycobacterium bovis subsp bovis AF2122/97
ugcgaggggcggca

SEQ ID NO: 1188281 - RNA, 21 nt, Mycobacterium bovis subsp bovis AF2122/97
ugcgaccggcuccggacaccc

SEQ ID NO: 1188282 - RNA, 17 nt, Mycobacterium bovis subsp bovis AF2122/97
ugcgacgaaccggauca

SEQ ID NO: 1188283 - RNA, 14 nt, Mycobacterium bovis subsp bovis AF2122/97
ugcgacgaaccgga

SEQ ID NO: 1188284 - RNA, 18 nt, Mycobacterium bovis subsp bovis AF2122/97
ugcgacgacgccaaugcc

SEQ ID NO: 1188285 - RNA, 20 nt, Mycobacterium bovis subsp bovis AF2122/97
ugcgacccgcagaccgccac

SEQ ID NO: 1188286 - RNA, 23 nt, Mycobacterium bovis subsp bovis AF2122/97
ugcgacauuggucaccugcugca

SEQ ID NO: 1188287 - RNA, 18 nt, Mycobacterium bovis subsp bovis AF2122/97
ugcgaccaagucaugccc

SEQ ID NO: 1188288 - RNA, 14 nt, Mycobacterium bovis subsp bovis AF2122/97
ugcgaagggcaccg

SEQ ID NO: 1188289 - RNA, 20 nt, Mycobacterium bovis subsp bovis AF2122/97
ugcgaaggaccagagcucga

SEQ ID NO: 1188290 - RNA, 17 nt, Mycobacterium bovis subsp bovis AF2122/97
ugcgaaucaucuuggug

SEQ ID NO: 1188291 - RNA, 14 nt, Mycobacterium bovis subsp bovis AF2122/97
ugcgaaugcugggc

SEQ ID NO: 1188292 - RNA, 17 nt, Mycobacterium bovis subsp bovis AF2122/97
ugcgaaacgcuggccac

SEQ ID NO: 1188293 - RNA, 19 nt, Mycobacterium bovis subsp bovis AF2122/97
ugcgaacaaguggccagcg

SEQ ID NO: 1188294 - RNA, 20 nt, Mycobacterium bovis subsp bovis AF2122/97
ugcgaacucaucgugguaac

SEQ ID NO: 1188295 - RNA, 14 nt, Mycobacterium bovis subsp bovis AF2122/97
ugcgaaaguggugg

SEQ ID NO: 1188296 - RNA, 21 nt, Mycobacterium bovis subsp bovis AF2122/97
ugcucgcgcagggaucgcagg

SEQ ID NO: 1188297 - RNA, 14 nt, Mycobacterium bovis subsp bovis AF2122/97
ugcucgcgccgcua

SEQ ID NO: 1188298 - RNA, 24 nt, Mycobacterium bovis subsp bovis AF2122/97
ugcucgcgaggcucgcguggccgc

SEQ ID NO: 1188299 - RNA, 23 nt, Mycobacterium bovis subsp bovis AF2122/97
ugcucgccguaagcaccagccag

SEQ ID NO: 1188300 - RNA, 16 nt, Mycobacterium bovis subsp bovis AF2122/97
ugcucgccguggugga

SEQ ID NO: 1188301 - RNA, 23 nt, Mycobacterium bovis subsp bovis AF2122/97
ugcucgccguugaugucggcagg

SEQ ID NO: 1188302 - RNA, 16 nt, Mycobacterium bovis subsp bovis AF2122/97
ugcuccaggcgcgccg

SEQ ID NO: 1188303 - RNA, 18 nt, Mycobacterium bovis subsp bovis AF2122/97
ugcuccaggcgcgccgca

SEQ ID NO: 1188304 - RNA, 15 nt, Mycobacterium bovis subsp bovis AF2122/97
ugcucagcgcggccc

SEQ ID NO: 1188305 - RNA, 13 nt, Mycobacterium bovis subsp bovis AF2122/97
ugcucagccggcc

SEQ ID NO: 1188306 - RNA, 13 nt, Mycobacterium bovis subsp bovis AF2122/97
ugcucacgcagca

SEQ ID NO: 1188307 - RNA, 14 nt, Mycobacterium bovis subsp bovis AF2122/97
ugcucucgcagcau

SEQ ID NO: 1188308 - RNA, 22 nt, Mycobacterium bovis subsp bovis AF2122/97
ugcucugcgcaucgguccaaag

SEQ ID NO: 1188309 - RNA, 19 nt, Mycobacterium bovis subsp bovis AF2122/97
ugcucggcaucgagcagcc

SEQ ID NO: 1188310 - RNA, 19 nt, Mycobacterium bovis subsp bovis AF2122/97
ugcucacgagcaaaccaga

SEQ ID NO: 1188311 - RNA, 13 nt, Mycobacterium bovis subsp bovis AF2122/97
ugcuacucugcaa

SEQ ID NO: 1188312 - RNA, 14 nt, Mycobacterium bovis subsp bovis AF2122/97
ugcuagcagcagcc

SEQ ID NO: 1188313 - RNA, 22 nt, Mycobacterium bovis subsp bovis AF2122/97
ugcuagccagucggccaccugg

SEQ ID NO: 1188314 - RNA, 14 nt, Mycobacterium bovis subsp bovis AF2122/97
ugcuagcgccgcca

SEQ ID NO: 1188315 - RNA, 17 nt, Mycobacterium bovis subsp bovis AF2122/97
ugcuaaacuccgugccg

SEQ ID NO: 1188316 - RNA, 22 nt, Mycobacterium bovis subsp bovis AF2122/97
ugcguuccaguccccgccggcc

SEQ ID NO: 1188317 - RNA, 16 nt, Mycobacterium bovis subsp bovis AF2122/97
ugcguccaggccaggg

SEQ ID NO: 1188318 - RNA, 21 nt, Mycobacterium bovis subsp bovis AF2122/97
ugcgucgaugcgcugcucacg

SEQ ID NO: 1188319 - RNA, 19 nt, Mycobacterium bovis subsp bovis AF2122/97
ugcgucgcacgagccaaca

SEQ ID NO: 1188320 - RNA, 22 nt, Mycobacterium bovis subsp bovis AF2122/97
ugcgucaucgcgggugaucucc

SEQ ID NO: 1188321 - RNA, 17 nt, Mycobacterium bovis subsp bovis AF2122/97
ugcgucgaaauccacaa

SEQ ID NO: 1188322 - RNA, 22 nt, Mycobacterium bovis subsp bovis AF2122/97
ugcguccguagcgauucugggc

SEQ ID NO: 1188323 - RNA, 21 nt, Mycobacterium bovis subsp bovis AF2122/97
ugcggguucacuuccgggcag

SEQ ID NO: 1188324 - RNA, 21 nt, Mycobacterium bovis subsp bovis AF2122/97
ugcgggucguccgccugcacc

SEQ ID NO: 1188325 - RNA, 18 nt, Mycobacterium bovis subsp bovis AF2122/97
ugcgggucggcaucggag

SEQ ID NO: 1188326 - RNA, 12 nt, Mycobacterium bovis subsp bovis AF2122/97
ugcggguggagu

SEQ ID NO: 1188327 - RNA, 14 nt, Mycobacterium bovis subsp bovis AF2122/97
ugcgggucagcgcc

SEQ ID NO: 1188328 - RNA, 22 nt, Mycobacterium bovis subsp bovis AF2122/97
ugcggcuucggcagaccggcau

SEQ ID NO: 1188329 - RNA, 20 nt, Mycobacterium bovis subsp bovis AF2122/97
ugcguagacauuggcuccga

SEQ ID NO: 1188330 - RNA, 22 nt, Mycobacterium bovis subsp bovis AF2122/97
ugcggcugguguccagccaggc

SEQ ID NO: 1188331 - RNA, 17 nt, Mycobacterium bovis subsp bovis AF2122/97
ugcggcucgcugaucug

SEQ ID NO: 1188332 - RNA, 13 nt, Mycobacterium bovis subsp bovis AF2122/97
ugcggcgugccgg

SEQ ID NO: 1188333 - RNA, 14 nt, Mycobacterium bovis subsp bovis AF2122/97
ugcggcguggauca

SEQ ID NO: 1188334 - RNA, 19 nt, Mycobacterium bovis subsp bovis AF2122/97
ugcggcguauugcggccug

SEQ ID NO: 1188335 - RNA, 15 nt, Mycobacterium bovis subsp bovis AF2122/97
ugcggcagaccaagc

SEQ ID NO: 1188336 - RNA, 17 nt, Mycobacterium bovis subsp bovis AF2122/97
ugcggcagcccccggau

SEQ ID NO: 1188337 - RNA, 13 nt, Mycobacterium bovis subsp bovis AF2122/97
ugcggcagcgcgg

SEQ ID NO: 1188338 - RNA, 16 nt, Mycobacterium bovis subsp bovis AF2122/97
ugcggcagcgcggcca

SEQ ID NO: 1188339 - RNA, 17 nt, Mycobacterium bovis subsp bovis AF2122/97
ugcggcaacagcggggu

SEQ ID NO: 1188340 - RNA, 19 nt, Mycobacterium bovis subsp bovis AF2122/97
ugcgcuuccaacaccaacg

SEQ ID NO: 1188341 - RNA, 20 nt, Mycobacterium bovis subsp bovis AF2122/97
ugcgcuucauagguucggua

SEQ ID NO: 1188342 - RNA, 17 nt, Mycobacterium bovis subsp bovis AF2122/97
ugcgcugggugaugagc

SEQ ID NO: 1188343 - RNA, 19 nt, Mycobacterium bovis subsp bovis AF2122/97
ugcgcuggaggcuccuggu

SEQ ID NO: 1188344 - RNA, 21 nt, Mycobacterium bovis subsp bovis AF2122/97
ugcgcucguugguucagcucg

SEQ ID NO: 1188345 - RNA, 15 nt, Mycobacterium bovis subsp bovis AF2122/97
ugcgccacagcagcg

SEQ ID NO: 1188346 - RNA, 23 nt, Mycobacterium bovis subsp bovis AF2122/97
ugcgccaaaauccgcccaccggu

SEQ ID NO: 1188347 - RNA, 21 nt, Mycobacterium bovis subsp bovis AF2122/97
ugcgcaucgguccaaagcacg

SEQ ID NO: 1188348 - RNA, 15 nt, Mycobacterium bovis subsp bovis AF2122/97
ugcgcaucgccacca

SEQ ID NO: 1188349 - RNA, 12 nt, Mycobacterium bovis subsp bovis AF2122/97
ugcuggccgcgg

SEQ ID NO: 1188350 - RNA, 21 nt, Mycobacterium bovis subsp bovis AF2122/97
ugcugguauagccggcgcagc

SEQ ID NO: 1188351 - RNA, 18 nt, Mycobacterium bovis subsp bovis AF2122/97
ugcuggucagcggcgcga

SEQ ID NO: 1188352 - RNA, 23 nt, Mycobacterium bovis subsp bovis AF2122/97
ugcuggugggccggaccuuguug

SEQ ID NO: 1188353 - RNA, 18 nt, Mycobacterium bovis subsp bovis AF2122/97
ugcugucgauuucgccgu

SEQ ID NO: 1188354 - RNA, 21 nt, Mycobacterium bovis subsp bovis AF2122/97
ugcuggcaccagcacacucuc

SEQ ID NO: 1188355 - RNA, 17 nt, Mycobacterium bovis subsp bovis AF2122/97
ugcuggcagcggccucc

SEQ ID NO: 1188356 - RNA, 21 nt, Mycobacterium bovis subsp bovis AF2122/97
ugcugcgcaccaaggccguga

SEQ ID NO: 1188357 - RNA, 14 nt, Mycobacterium bovis subsp bovis AF2122/97
ugcugcgcgcggcg

SEQ ID NO: 1188358 - RNA, 19 nt, Mycobacterium bovis subsp bovis AF2122/97
ugcugcgcguugcugcagc

SEQ ID NO: 1188359 - RNA, 14 nt, Mycobacterium bovis subsp bovis AF2122/97
ugcugcgcugucuu

SEQ ID NO: 1188360 - RNA, 15 nt, Mycobacterium bovis subsp bovis AF2122/97
ugcugaccggaguuc

SEQ ID NO: 1188361 - RNA, 22 nt, Mycobacterium bovis subsp bovis AF2122/97
ugcugacgacgagggccagcag

SEQ ID NO: 1188362 - RNA, 16 nt, Mycobacterium bovis subsp bovis AF2122/97
ugcugacauuuccacc

SEQ ID NO: 1188363 - RNA, 16 nt, Mycobacterium bovis subsp bovis AF2122/97
ugcuugcgcccggccu

SEQ ID NO: 1188364 - RNA, 15 nt, Mycobacterium bovis subsp bovis AF2122/97
ugcuuggucgcccag

SEQ ID NO: 1188365 - RNA, 16 nt, Mycobacterium bovis subsp bovis AF2122/97
ugcuugucgaggcgca

SEQ ID NO: 1188366 - RNA, 11 nt, Mycobacterium bovis subsp bovis AF2122/97
ugcuuuccaga

SEQ ID NO: 1188367 - RNA, 21 nt, Mycobacterium bovis subsp bovis AF2122/97
uggaagacggugcgggcuagg

SEQ ID NO: 1188368 - RNA, 15 nt, Mycobacterium bovis subsp bovis AF2122/97
uggaagaucacgcgu

SEQ ID NO: 1188369 - RNA, 18 nt, Mycobacterium bovis subsp bovis AF2122/97
uggaagccgacgaccagc

SEQ ID NO: 1188370 - RNA, 21 nt, Mycobacterium bovis subsp bovis AF2122/97
uggaagccgacgaccagcaga

SEQ ID NO: 1188371 - RNA, 22 nt, Mycobacterium bovis subsp bovis AF2122/97
uggaagccgacgaccagcagau

SEQ ID NO: 1188372 - RNA, 13 nt, Mycobacterium bovis subsp bovis AF2122/97
uggaagccgcacc

SEQ ID NO: 1188373 - RNA, 23 nt, Mycobacterium bovis subsp bovis AF2122/97
uggaagcggcgacuacccagcca

SEQ ID NO: 1188374 - RNA, 16 nt, Mycobacterium bovis subsp bovis AF2122/97
uggaaccaaaccuggg

SEQ ID NO: 1188375 - RNA, 13 nt, Mycobacterium bovis subsp bovis AF2122/97
uggaacagaucuu

SEQ ID NO: 1188376 - RNA, 13 nt, Mycobacterium bovis subsp bovis AF2122/97
uggaacaccgcgg

SEQ ID NO: 1188377 - RNA, 14 nt, Mycobacterium bovis subsp bovis AF2122/97
uggacgcagaguca

SEQ ID NO: 1188378 - RNA, 21 nt, Mycobacterium bovis subsp bovis AF2122/97
uggacgcccgaguugaagaau

SEQ ID NO: 1188379 - RNA, 15 nt, Mycobacterium bovis subsp bovis AF2122/97
uggacgccuugcaca

SEQ ID NO: 1188380 - RNA, 13 nt, Mycobacterium bovis subsp bovis AF2122/97
uggaccgccgccg

SEQ ID NO: 1188381 - RNA, 17 nt, Mycobacterium bovis subsp bovis AF2122/97
uggacccugcgccgcca

SEQ ID NO: 1188382 - RNA, 16 nt, Mycobacterium bovis subsp bovis AF2122/97
uggaccgcggugaccc

SEQ ID NO: 1188383 - RNA, 13 nt, Mycobacterium bovis subsp bovis AF2122/97
uggaccgcugaug

SEQ ID NO: 1188384 - RNA, 21 nt, Mycobacterium bovis subsp bovis AF2122/97
uggaccagcgccccggcgcgu

SEQ ID NO: 1188385 - RNA, 21 nt, Mycobacterium bovis subsp bovis AF2122/97
uggacaggucgcccaacaccg

SEQ ID NO: 1188386 - RNA, 14 nt, Mycobacterium bovis subsp bovis AF2122/97
uggacaccaaccca

SEQ ID NO: 1188387 - RNA, 17 nt, Mycobacterium bovis subsp bovis AF2122/97
uggacaccaacccaccc

SEQ ID NO: 1188388 - RNA, 12 nt, Mycobacterium bovis subsp bovis AF2122/97
uggacaccaccu

SEQ ID NO: 1188389 - RNA, 16 nt, Mycobacterium bovis subsp bovis AF2122/97
uggacacggcgcugcc

SEQ ID NO: 1188390 - RNA, 12 nt, Mycobacterium bovis subsp bovis AF2122/97
uggacaccagcc

SEQ ID NO: 1188391 - RNA, 16 nt, Mycobacterium bovis subsp bovis AF2122/97
uggacaccagccagau

SEQ ID NO: 1188392 - RNA, 14 nt, Mycobacterium bovis subsp bovis AF2122/97
uggacaagcacagc

SEQ ID NO: 1188393 - RNA, 18 nt, Mycobacterium bovis subsp bovis AF2122/97
uggaaucgcggagccagg

SEQ ID NO: 1188394 - RNA, 19 nt, Mycobacterium bovis subsp bovis AF2122/97
uggaaucgcggagccagga

SEQ ID NO: 1188395 - RNA, 15 nt, Mycobacterium bovis subsp bovis AF2122/97
uggaauggcgccggc

SEQ ID NO: 1188396 - RNA, 13 nt, Mycobacterium bovis subsp bovis AF2122/97
uuagacuggcagg

SEQ ID NO: 1188397 - RNA, 15 nt, Mycobacterium bovis subsp bovis AF2122/97
uuagcgcgggccugg

SEQ ID NO: 1188398 - RNA, 18 nt, Mycobacterium bovis subsp bovis AF2122/97
uuagcggcuugaacagcu

SEQ ID NO: 1188399 - RNA, 18 nt, Mycobacterium bovis subsp bovis AF2122/97
uuaggccgccagccggcg

SEQ ID NO: 1188400 - RNA, 15 nt, Mycobacterium bovis subsp bovis AF2122/97
uuaagucuggaguga

SEQ ID NO: 1188401 - RNA, 14 nt, Mycobacterium bovis subsp bovis AF2122/97
uuaccaccgucucc

SEQ ID NO: 1188402 - RNA, 15 nt, Mycobacterium bovis subsp bovis AF2122/97
uuaccgauuggcccg

SEQ ID NO: 1188403 - RNA, 14 nt, Mycobacterium bovis subsp bovis AF2122/97
uuaccgaagcccga

SEQ ID NO: 1188404 - RNA, 11 nt, Mycobacterium bovis subsp bovis AF2122/97
uuaccggugac

SEQ ID NO: 1188405 - RNA, 18 nt, Mycobacterium bovis subsp bovis AF2122/97
uguggucgaguugaagaa

SEQ ID NO: 1188406 - RNA, 14 nt, Mycobacterium bovis subsp bovis AF2122/97
uguggucaccaggc

SEQ ID NO: 1188407 - RNA, 15 nt, Mycobacterium bovis subsp bovis AF2122/97
ugugucgaccuucuc

SEQ ID NO: 1188408 - RNA, 19 nt, Mycobacterium bovis subsp bovis AF2122/97
ugugugcgauccagggccg

SEQ ID NO: 1188409 - RNA, 13 nt, Mycobacterium bovis subsp bovis AF2122/97
ugugucggccugg

SEQ ID NO: 1188410 - RNA, 17 nt, Mycobacterium bovis subsp bovis AF2122/97
uguuaaccgggcacgga

SEQ ID NO: 1188411 - RNA, 13 nt, Mycobacterium bovis subsp bovis AF2122/97
uguuaaagaagcc

SEQ ID NO: 1188412 - RNA, 17 nt, Mycobacterium bovis subsp bovis AF2122/97
uguggcccaacaccgcc

SEQ ID NO: 1188413 - RNA, 16 nt, Mycobacterium bovis subsp bovis AF2122/97
uguggccguuggccgg

SEQ ID NO: 1188414 - RNA, 20 nt, Mycobacterium bovis subsp bovis AF2122/97
ugugcgucguucggagcccu

SEQ ID NO: 1188415 - RNA, 17 nt, Mycobacterium bovis subsp bovis AF2122/97
ugugcgucuccagcugg

SEQ ID NO: 1188416 - RNA, 17 nt, Mycobacterium bovis subsp bovis AF2122/97
ugugcgugucacccaau

SEQ ID NO: 1188417 - RNA, 13 nt, Mycobacterium bovis subsp bovis AF2122/97
uguggggcggcuu

SEQ ID NO: 1188418 - RNA, 20 nt, Mycobacterium bovis subsp bovis AF2122/97
ugugggcgauggcaccggcg

SEQ ID NO: 1188419 - RNA, 17 nt, Mycobacterium bovis subsp bovis AF2122/97
uguggcggcguccagaa

SEQ ID NO: 1188420 - RNA, 21 nt, Mycobacterium bovis subsp bovis AF2122/97
uguggcugaucccggccaggc

SEQ ID NO: 1188421 - RNA, 21 nt, Mycobacterium bovis subsp bovis AF2122/97
ugugggaacuggaccacagcc

SEQ ID NO: 1188422 - RNA, 15 nt, Mycobacterium bovis subsp bovis AF2122/97
ugugacgccgggcug

SEQ ID NO: 1188423 - RNA, 21 nt, Mycobacterium bovis subsp bovis AF2122/97
ugugacuuauccggccaguga

SEQ ID NO: 1188424 - RNA, 21 nt, Mycobacterium bovis subsp bovis AF2122/97
ugucagcgcugagccgcucau

SEQ ID NO: 1188425 - RNA, 11 nt, Mycobacterium bovis subsp bovis AF2122/97
ugucagcggcc

SEQ ID NO: 1188426 - RNA, 14 nt, Mycobacterium bovis subsp bovis AF2122/97
ugucagccaccggu

SEQ ID NO: 1188427 - RNA, 17 nt, Mycobacterium bovis subsp bovis AF2122/97
ugucaccccgcccagcg

SEQ ID NO: 1188428 - RNA, 13 nt, Mycobacterium bovis subsp bovis AF2122/97
ugucaccgccggg

SEQ ID NO: 1188429 - RNA, 18 nt, Mycobacterium bovis subsp bovis AF2122/97
ugucaccgccgggaagcc

SEQ ID NO: 1188430 - RNA, 21 nt, Mycobacterium bovis subsp bovis AF2122/97
ugucaccgcagccaacgucac

SEQ ID NO: 1188431 - RNA, 17 nt, Mycobacterium bovis subsp bovis AF2122/97
ugucacccaauggagcc

SEQ ID NO: 1188432 - RNA, 20 nt, Mycobacterium bovis subsp bovis AF2122/97
ugucaccggcgucgcugccu

SEQ ID NO: 1188433 - RNA, 17 nt, Mycobacterium bovis subsp bovis AF2122/97
ugugacgggcacaacca

SEQ ID NO: 1188434 - RNA, 20 nt, Mycobacterium bovis subsp bovis AF2122/97
ugugcacggugugcacggcg

SEQ ID NO: 1188435 - RNA, 13 nt, Mycobacterium bovis subsp bovis AF2122/97
ugugcggcagccc

SEQ ID NO: 1188436 - RNA, 14 nt, Mycobacterium bovis subsp bovis AF2122/97
ugugcggccaggcg

SEQ ID NO: 1188437 - RNA, 15 nt, Mycobacterium bovis subsp bovis AF2122/97
ugugcgauccagggc

SEQ ID NO: 1188438 - RNA, 21 nt, Mycobacterium bovis subsp bovis AF2122/97
ugugcgauccagggccgacgc

SEQ ID NO: 1188439 - RNA, 17 nt, Mycobacterium bovis subsp bovis AF2122/97
ugugcgccgcagccugc

SEQ ID NO: 1188440 - RNA, 16 nt, Mycobacterium bovis subsp bovis AF2122/97
ugugccgcugugaauu

SEQ ID NO: 1188441 - RNA, 20 nt, Mycobacterium bovis subsp bovis AF2122/97
ugugccgggcgaugcugggc

SEQ ID NO: 1188442 - RNA, 22 nt, Mycobacterium bovis subsp bovis AF2122/97
uguucagcuucgccagguggcc

SEQ ID NO: 1188443 - RNA, 18 nt, Mycobacterium bovis subsp bovis AF2122/97
uguuccagaaggccgcac

SEQ ID NO: 1188444 - RNA, 15 nt, Mycobacterium bovis subsp bovis AF2122/97
uguuccgccacccgc

SEQ ID NO: 1188445 - RNA, 16 nt, Mycobacterium bovis subsp bovis AF2122/97
uguuccauuccgguca

SEQ ID NO: 1188446 - RNA, 21 nt, Mycobacterium bovis subsp bovis AF2122/97
uguucgacgggccggaccauc

SEQ ID NO: 1188447 - RNA, 15 nt, Mycobacterium bovis subsp bovis AF2122/97
uguucgacugcagaa

SEQ ID NO: 1188448 - RNA, 19 nt, Mycobacterium bovis subsp bovis AF2122/97
uguuccuugugaccccggc

SEQ ID NO: 1188449 - RNA, 14 nt, Mycobacterium bovis subsp bovis AF2122/97
uguugcugcugccg

SEQ ID NO: 1188450 - RNA, 16 nt, Mycobacterium bovis subsp bovis AF2122/97
uguuggcaugccgccc

SEQ ID NO: 1188451 - RNA, 15 nt, Mycobacterium bovis subsp bovis AF2122/97
uguuguugaagcccg

SEQ ID NO: 1188452 - RNA, 12 nt, Mycobacterium bovis subsp bovis AF2122/97
uguuguuugaga

SEQ ID NO: 1188453 - RNA, 19 nt, Mycobacterium bovis subsp bovis AF2122/97
uguugugagauuggcagac

SEQ ID NO: 1188454 - RNA, 15 nt, Mycobacterium bovis subsp bovis AF2122/97
uguugucugaccccc

SEQ ID NO: 1188455 - RNA, 20 nt, Mycobacterium bovis subsp bovis AF2122/97
uguugucccuauaccgcugg

SEQ ID NO: 1188456 - RNA, 15 nt, Mycobacterium bovis subsp bovis AF2122/97
uguugucggugucgg

SEQ ID NO: 1188457 - RNA, 18 nt, Mycobacterium bovis subsp bovis AF2122/97
uguugucgucgagcgcgc

SEQ ID NO: 1188458 - RNA, 23 nt, Mycobacterium bovis subsp bovis AF2122/97
uguuggccagucccucgccaacc

SEQ ID NO: 1188459 - RNA, 19 nt, Mycobacterium bovis subsp bovis AF2122/97
uguuggcguggaucuuggc

SEQ ID NO: 1188460 - RNA, 17 nt, Mycobacterium bovis subsp bovis AF2122/97
uguuggcgcccgggccc

SEQ ID NO: 1188461 - RNA, 20 nt, Mycobacterium bovis subsp bovis AF2122/97
uguugggcgcgaaacgccgc

SEQ ID NO: 1188462 - RNA, 14 nt, Mycobacterium bovis subsp bovis AF2122/97
uguugggagccacc

SEQ ID NO: 1188463 - RNA, 23 nt, Mycobacterium bovis subsp bovis AF2122/97
uguugguggauucgaucaggccu

SEQ ID NO: 1188464 - RNA, 12 nt, Mycobacterium bovis subsp bovis AF2122/97
uguuugacugcg

SEQ ID NO: 1188465 - RNA, 14 nt, Mycobacterium bovis subsp bovis AF2122/97
uguuuggguuuugu

SEQ ID NO: 1188466 - RNA, 16 nt, Mycobacterium bovis subsp bovis AF2122/97
uguuuccggugugcuc

SEQ ID NO: 1188467 - RNA, 21 nt, Mycobacterium bovis subsp bovis AF2122/97
uggagauacauuucccaguca

SEQ ID NO: 1188468 - RNA, 21 nt, Mycobacterium bovis subsp bovis AF2122/97
uggagcuaugucauagcgcac

SEQ ID NO: 1188469 - RNA, 21 nt, Mycobacterium bovis subsp bovis AF2122/97
uggagcucaucgacgagccgc

SEQ ID NO: 1188470 - RNA, 22 nt, Mycobacterium bovis subsp bovis AF2122/97
uggagggaaucuccggcuggcc

SEQ ID NO: 1188471 - RNA, 17 nt, Mycobacterium bovis subsp bovis AF2122/97
uggaggucaaaucaacg

SEQ ID NO: 1188472 - RNA, 22 nt, Mycobacterium bovis subsp bovis AF2122/97
uggaguaggugugcgggaagaa

SEQ ID NO: 1188473 - RNA, 16 nt, Mycobacterium bovis subsp bovis AF2122/97
uggaguauccggcaga

SEQ ID NO: 1188474 - RNA, 17 nt, Mycobacterium bovis subsp bovis AF2122/97
uggaguauccggcagac

SEQ ID NO: 1188475 - RNA, 19 nt, Mycobacterium bovis subsp bovis AF2122/97
uggagugaggcugugcccc

SEQ ID NO: 1188476 - RNA, 22 nt, Mycobacterium bovis subsp bovis AF2122/97
uggagugaggcugugccccagg

SEQ ID NO: 1188477 - RNA, 13 nt, Mycobacterium bovis subsp bovis AF2122/97
uggacggccaggu

SEQ ID NO: 1188478 - RNA, 20 nt, Mycobacterium bovis subsp bovis AF2122/97
uggacggugcgcagggccug

SEQ ID NO: 1188479 - RNA, 16 nt, Mycobacterium bovis subsp bovis AF2122/97
uggacgcgaugaucau

SEQ ID NO: 1188480 - RNA, 15 nt, Mycobacterium bovis subsp bovis AF2122/97
uggacggcagccagc

SEQ ID NO: 1188481 - RNA, 21 nt, Mycobacterium bovis subsp bovis AF2122/97
uggacugagucguaguaggcg

SEQ ID NO: 1188482 - RNA, 20 nt, Mycobacterium bovis subsp bovis AF2122/97
uggacgugucaucacgguca

SEQ ID NO: 1188483 - RNA, 18 nt, Mycobacterium bovis subsp bovis AF2122/97
uggacuucagcaggccca

SEQ ID NO: 1188484 - RNA, 23 nt, Mycobacterium bovis subsp bovis AF2122/97
uggacugggucgccuccugccgc

SEQ ID NO: 1188485 - RNA, 22 nt, Mycobacterium bovis subsp bovis AF2122/97
uggauaauccaugacacugggg

SEQ ID NO: 1188486 - RNA, 14 nt, Mycobacterium bovis subsp bovis AF2122/97
uggauguguaggug

SEQ ID NO: 1188487 - RNA, 16 nt, Mycobacterium bovis subsp bovis AF2122/97
uggaugcccguagacg

SEQ ID NO: 1188488 - RNA, 22 nt, Mycobacterium bovis subsp bovis AF2122/97
uggaucaucccgaccagcagau

SEQ ID NO: 1188489 - RNA, 18 nt, Mycobacterium bovis subsp bovis AF2122/97
uggaucccacgaguuggc

SEQ ID NO: 1188490 - RNA, 17 nt, Mycobacterium bovis subsp bovis AF2122/97
uggaucgucgcuguggc

SEQ ID NO: 1188491 - RNA, 20 nt, Mycobacterium bovis subsp bovis AF2122/97
uggaucauguucggccacca

SEQ ID NO: 1188492 - RNA, 19 nt, Mycobacterium bovis subsp bovis AF2122/97
uggaucgucgcuguggcuu

SEQ ID NO: 1188493 - RNA, 19 nt, Mycobacterium bovis subsp bovis AF2122/97
uggaucgucgggagcacac

SEQ ID NO: 1188494 - RNA, 17 nt, Mycobacterium bovis subsp bovis AF2122/97
uggcaagucaacaccgc

SEQ ID NO: 1188495 - RNA, 22 nt, Mycobacterium bovis subsp bovis AF2122/97
uggcaagucaacaccgcggccg

SEQ ID NO: 1188496 - RNA, 14 nt, Mycobacterium bovis subsp bovis AF2122/97
uggcaagcggccgc

SEQ ID NO: 1188497 - RNA, 15 nt, Mycobacterium bovis subsp bovis AF2122/97
uggcaagcugucguc

SEQ ID NO: 1188498 - RNA, 22 nt, Mycobacterium bovis subsp bovis AF2122/97
uggcaaucccgccaucugccug

SEQ ID NO: 1188499 - RNA, 21 nt, Mycobacterium bovis subsp bovis AF2122/97
uggcaacgccgcgccguucca

SEQ ID NO: 1188500 - RNA, 19 nt, Mycobacterium bovis subsp bovis AF2122/97
uggcaaagacgcuggccac

SEQ ID NO: 1188501 - RNA, 15 nt, Mycobacterium bovis subsp bovis AF2122/97
uggauucgaucaggc

SEQ ID NO: 1188502 - RNA, 22 nt, Mycobacterium bovis subsp bovis AF2122/97
uggauugcgccaggagcgcggc

SEQ ID NO: 1188503 - RNA, 14 nt, Mycobacterium bovis subsp bovis AF2122/97
uggauuuuggcuga

SEQ ID NO: 1188504 - RNA, 22 nt, Mycobacterium bovis subsp bovis AF2122/97
uggcaggugaucccgaugguca

SEQ ID NO: 1188505 - RNA, 21 nt, Mycobacterium bovis subsp bovis AF2122/97
uggcagcuccucgcgcucgcc

SEQ ID NO: 1188506 - RNA, 13 nt, Mycobacterium bovis subsp bovis AF2122/97
uggcagggaacca

SEQ ID NO: 1188507 - RNA, 13 nt, Mycobacterium bovis subsp bovis AF2122/97
uggcaggugccuu

SEQ ID NO: 1188508 - RNA, 22 nt, Mycobacterium bovis subsp bovis AF2122/97
uggcagggccagcggcagccug

SEQ ID NO: 1188509 - RNA, 20 nt, Mycobacterium bovis subsp bovis AF2122/97
uggcagcugcucuccgucgc

SEQ ID NO: 1188510 - RNA, 15 nt, Mycobacterium bovis subsp bovis AF2122/97
uggcaggcagguugg

SEQ ID NO: 1188511 - RNA, 12 nt, Mycobacterium bovis subsp bovis AF2122/97
uggcaggccagc

SEQ ID NO: 1188512 - RNA, 11 nt, Mycobacterium bovis subsp bovis AF2122/97
uggcagcggcg

SEQ ID NO: 1188513 - RNA, 20 nt, Mycobacterium bovis subsp bovis AF2122/97
uggcagcggccuccgggcca

SEQ ID NO: 1188514 - RNA, 13 nt, Mycobacterium bovis subsp bovis AF2122/97
uggcagcgcggcc

SEQ ID NO: 1188515 - RNA, 22 nt, Mycobacterium bovis subsp bovis AF2122/97
uggcagcccguucgaaguucuc

SEQ ID NO: 1188516 - RNA, 20 nt, Mycobacterium bovis subsp bovis AF2122/97
uggcagccaaaaacgcugcc

SEQ ID NO: 1188517 - RNA, 21 nt, Mycobacterium bovis subsp bovis AF2122/97
uggcagccaaaaacgcugccg

SEQ ID NO: 1188518 - RNA, 21 nt, Mycobacterium bovis subsp bovis AF2122/97
uggcagccagcggcgaagguc

SEQ ID NO: 1188519 - RNA, 15 nt, Mycobacterium bovis subsp bovis AF2122/97
uggcagcacgaccug

SEQ ID NO: 1188520 - RNA, 12 nt, Mycobacterium bovis subsp bovis AF2122/97
uggcagagccgc

SEQ ID NO: 1188521 - RNA, 22 nt, Mycobacterium bovis subsp bovis AF2122/97
uggcacaagcuggggaacagca

SEQ ID NO: 1188522 - RNA, 22 nt, Mycobacterium bovis subsp bovis AF2122/97
uggcaccagccggugagcgagc

SEQ ID NO: 1188523 - RNA, 14 nt, Mycobacterium bovis subsp bovis AF2122/97
uggcaccgccagcc

SEQ ID NO: 1188524 - RNA, 23 nt, Mycobacterium bovis subsp bovis AF2122/97
uggccccaccgaacgugugggcc

SEQ ID NO: 1188525 - RNA, 12 nt, Mycobacterium bovis subsp bovis AF2122/97
uggccccgggcg

SEQ ID NO: 1188526 - RNA, 22 nt, Mycobacterium bovis subsp bovis AF2122/97
uggccccgggcggugaggcagc

SEQ ID NO: 1188527 - RNA, 16 nt, Mycobacterium bovis subsp bovis AF2122/97
uggccccgguggugcu

SEQ ID NO: 1188528 - RNA, 13 nt, Mycobacterium bovis subsp bovis AF2122/97
uggccccggcucu

SEQ ID NO: 1188529 - RNA, 17 nt, Mycobacterium bovis subsp bovis AF2122/97
uggcccgaccgggaacc

SEQ ID NO: 1188530 - RNA, 20 nt, Mycobacterium bovis subsp bovis AF2122/97
uggccccgguggugcugccg

SEQ ID NO: 1188531 - RNA, 20 nt, Mycobacterium bovis subsp bovis AF2122/97
uggcccggaacaccgacguc

SEQ ID NO: 1188532 - RNA, 17 nt, Mycobacterium bovis subsp bovis AF2122/97
uggcccgccggcaguga

SEQ ID NO: 1188533 - RNA, 17 nt, Mycobacterium bovis subsp bovis AF2122/97
uggcccggugcagcagu

SEQ ID NO: 1188534 - RNA, 22 nt, Mycobacterium bovis subsp bovis AF2122/97
uggcccguucgaccguguaacc

SEQ ID NO: 1188535 - RNA, 18 nt, Mycobacterium bovis subsp bovis AF2122/97
uggcccguuggcagcaca

SEQ ID NO: 1188536 - RNA, 17 nt, Mycobacterium bovis subsp bovis AF2122/97
uggcccgggccaccgga

SEQ ID NO: 1188537 - RNA, 15 nt, Mycobacterium bovis subsp bovis AF2122/97
uggcccgggccgaag

SEQ ID NO: 1188538 - RNA, 22 nt, Mycobacterium bovis subsp bovis AF2122/97
uggcccggacaugcgggcagca

SEQ ID NO: 1188539 - RNA, 22 nt, Mycobacterium bovis subsp bovis AF2122/97
uggcccggcgaaagcuugggcg

SEQ ID NO: 1188540 - RNA, 22 nt, Mycobacterium bovis subsp bovis AF2122/97
uggcccacauguccagcguccu

SEQ ID NO: 1188541 - RNA, 18 nt, Mycobacterium bovis subsp bovis AF2122/97
uggccaugcuggucagcg

SEQ ID NO: 1188542 - RNA, 21 nt, Mycobacterium bovis subsp bovis AF2122/97
uggccaucugauccggugccg

SEQ ID NO: 1188543 - RNA, 13 nt, Mycobacterium bovis subsp bovis AF2122/97
uggcccagcgugu

SEQ ID NO: 1188544 - RNA, 15 nt, Mycobacterium bovis subsp bovis AF2122/97
uggccgccggcgccg

SEQ ID NO: 1188545 - RNA, 13 nt, Mycobacterium bovis subsp bovis AF2122/97
uggccgccgcgag

SEQ ID NO: 1188546 - RNA, 16 nt, Mycobacterium bovis subsp bovis AF2122/97
uggccgcgagguaccc

SEQ ID NO: 1188547 - RNA, 20 nt, Mycobacterium bovis subsp bovis AF2122/97
uggccgccgaauccgacguc

SEQ ID NO: 1188548 - RNA, 12 nt, Mycobacterium bovis subsp bovis AF2122/97
uggccgccgccc

SEQ ID NO: 1188549 - RNA, 22 nt, Mycobacterium bovis subsp bovis AF2122/97
uggccgccgcagcuccccgacc

SEQ ID NO: 1188550 - RNA, 17 nt, Mycobacterium bovis subsp bovis AF2122/97
uggccgcccuggccgcc

SEQ ID NO: 1188551 - RNA, 16 nt, Mycobacterium bovis subsp bovis AF2122/97
uggccgccaccuccca

SEQ ID NO: 1188552 - RNA, 16 nt, Mycobacterium bovis subsp bovis AF2122/97
uggccgccacaccgcc

SEQ ID NO: 1188553 - RNA, 17 nt, Mycobacterium bovis subsp bovis AF2122/97
uggccgauuccgcgcgu

SEQ ID NO: 1188554 - RNA, 23 nt, Mycobacterium bovis subsp bovis AF2122/97
uggccgauguaguccggccaguc

SEQ ID NO: 1188555 - RNA, 18 nt, Mycobacterium bovis subsp bovis AF2122/97
uggccgaugagcccagcc

SEQ ID NO: 1188556 - RNA, 16 nt, Mycobacterium bovis subsp bovis AF2122/97
uggccgagcagggccg

SEQ ID NO: 1188557 - RNA, 12 nt, Mycobacterium bovis subsp bovis AF2122/97
uggccgagccgc

SEQ ID NO: 1188558 - RNA, 13 nt, Mycobacterium bovis subsp bovis AF2122/97
uggccgagccgcg

SEQ ID NO: 1188559 - RNA, 22 nt, Mycobacterium bovis subsp bovis AF2122/97
uggccgacgucugguuggcugg

SEQ ID NO: 1188560 - RNA, 18 nt, Mycobacterium bovis subsp bovis AF2122/97
uggccgacagccaccgcg

SEQ ID NO: 1188561 - RNA, 17 nt, Mycobacterium bovis subsp bovis AF2122/97
uggccgaacaggaugau

SEQ ID NO: 1188562 - RNA, 18 nt, Mycobacterium bovis subsp bovis AF2122/97
uggcaucgcgagccagcu

SEQ ID NO: 1188563 - RNA, 14 nt, Mycobacterium bovis subsp bovis AF2122/97
uggcaugcaggugg

SEQ ID NO: 1188564 - RNA, 22 nt, Mycobacterium bovis subsp bovis AF2122/97
uggcaucccgggcaguccaggc

SEQ ID NO: 1188565 - RNA, 23 nt, Mycobacterium bovis subsp bovis AF2122/97
uggcaucccgggcaguccaggca

SEQ ID NO: 1188566 - RNA, 17 nt, Mycobacterium bovis subsp bovis AF2122/97
uggcauccgccccgccc

SEQ ID NO: 1188567 - RNA, 17 nt, Mycobacterium bovis subsp bovis AF2122/97
uggcaucgcgagccagc

SEQ ID NO: 1188568 - RNA, 22 nt, Mycobacterium bovis subsp bovis AF2122/97
uggcauugaccaccgauauggc

SEQ ID NO: 1188569 - RNA, 22 nt, Mycobacterium bovis subsp bovis AF2122/97
uggcauucgauaccgcaccaaa

SEQ ID NO: 1188570 - RNA, 22 nt, Mycobacterium bovis subsp bovis AF2122/97
uggccaauagaagcacgucguc

SEQ ID NO: 1188571 - RNA, 22 nt, Mycobacterium bovis subsp bovis AF2122/97
uggccaacucuucagcaagcca

SEQ ID NO: 1188572 - RNA, 18 nt, Mycobacterium bovis subsp bovis AF2122/97
uggccaaccccauggcca

SEQ ID NO: 1188573 - RNA, 13 nt, Mycobacterium bovis subsp bovis AF2122/97
uggccagcgcggc

SEQ ID NO: 1188574 - RNA, 19 nt, Mycobacterium bovis subsp bovis AF2122/97
uggccagccacagccgacc

SEQ ID NO: 1188575 - RNA, 12 nt, Mycobacterium bovis subsp bovis AF2122/97
uggccagcgcgu

SEQ ID NO: 1188576 - RNA, 19 nt, Mycobacterium bovis subsp bovis AF2122/97
uggccagcaccacggccag

SEQ ID NO: 1188577 - RNA, 15 nt, Mycobacterium bovis subsp bovis AF2122/97
uggccagcagcgcgg

SEQ ID NO: 1188578 - RNA, 19 nt, Mycobacterium bovis subsp bovis AF2122/97
uggccaguucggugagccg

SEQ ID NO: 1188579 - RNA, 15 nt, Mycobacterium bovis subsp bovis AF2122/97
uggccaggaaguccc

SEQ ID NO: 1188580 - RNA, 24 nt, Mycobacterium bovis subsp bovis AF2122/97
uggccacggaaguaucgccggccg

SEQ ID NO: 1188581 - RNA, 15 nt, Mycobacterium bovis subsp bovis AF2122/97
uggccacgcccaggc

SEQ ID NO: 1188582 - RNA, 22 nt, Mycobacterium bovis subsp bovis AF2122/97
uggccaccaaacgcugcuggca

SEQ ID NO: 1188583 - RNA, 18 nt, Mycobacterium bovis subsp bovis AF2122/97
uggccacgcccaggcaag

SEQ ID NO: 1188584 - RNA, 18 nt, Mycobacterium bovis subsp bovis AF2122/97
uggccagacccaccaccg

SEQ ID NO: 1188585 - RNA, 22 nt, Mycobacterium bovis subsp bovis AF2122/97
uggccagacccaccaccgcaac

SEQ ID NO: 1188586 - RNA, 21 nt, Mycobacterium bovis subsp bovis AF2122/97
uggccacucacauuggccagg

SEQ ID NO: 1188587 - RNA, 18 nt, Mycobacterium bovis subsp bovis AF2122/97
uggccaccaccgugaagc

SEQ ID NO: 1188588 - RNA, 13 nt, Mycobacterium bovis subsp bovis AF2122/97
uggccacacucag

SEQ ID NO: 1188589 - RNA, 19 nt, Mycobacterium bovis subsp bovis AF2122/97
uggccacacucagcaccca

SEQ ID NO: 1188590 - RNA, 21 nt, Mycobacterium bovis subsp bovis AF2122/97
uggccacacucagcacccaau

SEQ ID NO: 1188591 - RNA, 23 nt, Mycobacterium bovis subsp bovis AF2122/97
uggccggaauacccgcuggcccg

SEQ ID NO: 1188592 - RNA, 19 nt, Mycobacterium bovis subsp bovis AF2122/97
uggccgcuuuucgauggug

SEQ ID NO: 1188593 - RNA, 18 nt, Mycobacterium bovis subsp bovis AF2122/97
uggccgcgaucccggccg

SEQ ID NO: 1188594 - RNA, 14 nt, Mycobacterium bovis subsp bovis AF2122/97
uggccgcugccagc

SEQ ID NO: 1188595 - RNA, 14 nt, Mycobacterium bovis subsp bovis AF2122/97
uggccgcugccuuc

SEQ ID NO: 1188596 - RNA, 16 nt, Mycobacterium bovis subsp bovis AF2122/97
uggccgcugccuucuu

SEQ ID NO: 1188597 - RNA, 14 nt, Mycobacterium bovis subsp bovis AF2122/97
uggccgcgcggucg

SEQ ID NO: 1188598 - RNA, 17 nt, Mycobacterium bovis subsp bovis AF2122/97
uggccggugggccgccc

SEQ ID NO: 1188599 - RNA, 18 nt, Mycobacterium bovis subsp bovis AF2122/97
uggccgguucaggggugg

SEQ ID NO: 1188600 - RNA, 16 nt, Mycobacterium bovis subsp bovis AF2122/97
uggccgucccaccagc

SEQ ID NO: 1188601 - RNA, 12 nt, Mycobacterium bovis subsp bovis AF2122/97
uggccggccccg

SEQ ID NO: 1188602 - RNA, 17 nt, Mycobacterium bovis subsp bovis AF2122/97
uggccggcgagggugag

SEQ ID NO: 1188603 - RNA, 22 nt, Mycobacterium bovis subsp bovis AF2122/97
uggccggguccagcccggaacc

SEQ ID NO: 1188604 - RNA, 23 nt, Mycobacterium bovis subsp bovis AF2122/97
uggccgggaccgccccggccagg

SEQ ID NO: 1188605 - RNA, 19 nt, Mycobacterium bovis subsp bovis AF2122/97
uggccuuguuguccuucag

SEQ ID NO: 1188606 - RNA, 15 nt, Mycobacterium bovis subsp bovis AF2122/97
uggccuguucaacuc

SEQ ID NO: 1188607 - RNA, 22 nt, Mycobacterium bovis subsp bovis AF2122/97
uggccugucaggcggcggaccc

SEQ ID NO: 1188608 - RNA, 17 nt, Mycobacterium bovis subsp bovis AF2122/97
uggccuugacagcuuuc

SEQ ID NO: 1188609 - RNA, 21 nt, Mycobacterium bovis subsp bovis AF2122/97
uggccuugacagcuuucuugg

SEQ ID NO: 1188610 - RNA, 18 nt, Mycobacterium bovis subsp bovis AF2122/97
uggccucccacggcgcgu

SEQ ID NO: 1188611 - RNA, 19 nt, Mycobacterium bovis subsp bovis AF2122/97
uggccucagccaccgggcg

SEQ ID NO: 1188612 - RNA, 13 nt, Mycobacterium bovis subsp bovis AF2122/97
uggccucauccac

SEQ ID NO: 1188613 - RNA, 20 nt, Mycobacterium bovis subsp bovis AF2122/97
uggccguucggcgcccgcuc

SEQ ID NO: 1188614 - RNA, 21 nt, Mycobacterium bovis subsp bovis AF2122/97
uggccguuggccggaucgaag

SEQ ID NO: 1188615 - RNA, 17 nt, Mycobacterium bovis subsp bovis AF2122/97
uggccguuuguuuuguc

SEQ ID NO: 1188616 - RNA, 20 nt, Mycobacterium bovis subsp bovis AF2122/97
uggccugccauaggcccacg

SEQ ID NO: 1188617 - RNA, 13 nt, Mycobacterium bovis subsp bovis AF2122/97
uggccugcaacgc

SEQ ID NO: 1188618 - RNA, 16 nt, Mycobacterium bovis subsp bovis AF2122/97
uggcgaucucuaccag

SEQ ID NO: 1188619 - RNA, 13 nt, Mycobacterium bovis subsp bovis AF2122/97
uggcgaucuccag

SEQ ID NO: 1188620 - RNA, 16 nt, Mycobacterium bovis subsp bovis AF2122/97
uggcgauccaggccag

SEQ ID NO: 1188621 - RNA, 17 nt, Mycobacterium bovis subsp bovis AF2122/97
uggcgaucaugagcagc

SEQ ID NO: 1188622 - RNA, 15 nt, Mycobacterium bovis subsp bovis AF2122/97
uggcgaucagcagcc

SEQ ID NO: 1188623 - RNA, 21 nt, Mycobacterium bovis subsp bovis AF2122/97
uggcgaguggcugacacugcc

SEQ ID NO: 1188624 - RNA, 19 nt, Mycobacterium bovis subsp bovis AF2122/97
uggcgauaaccgacgauca

SEQ ID NO: 1188625 - RNA, 14 nt, Mycobacterium bovis subsp bovis AF2122/97
uggcgaggcagcac

SEQ ID NO: 1188626 - RNA, 16 nt, Mycobacterium bovis subsp bovis AF2122/97
uggcgaggcagcaccc

SEQ ID NO: 1188627 - RNA, 19 nt, Mycobacterium bovis subsp bovis AF2122/97
uggcgagccacggcacugg

SEQ ID NO: 1188628 - RNA, 16 nt, Mycobacterium bovis subsp bovis AF2122/97
uggcgagccagcuucc

SEQ ID NO: 1188629 - RNA, 20 nt, Mycobacterium bovis subsp bovis AF2122/97
uggcgacggugcgcuggaug

SEQ ID NO: 1188630 - RNA, 12 nt, Mycobacterium bovis subsp bovis AF2122/97
uggcgaccuggu

SEQ ID NO: 1188631 - RNA, 18 nt, Mycobacterium bovis subsp bovis AF2122/97
uggcgaaggccgcaauac

SEQ ID NO: 1188632 - RNA, 19 nt, Mycobacterium bovis subsp bovis AF2122/97
uggcgacaucucggucaga

SEQ ID NO: 1188633 - RNA, 17 nt, Mycobacterium bovis subsp bovis AF2122/97
uggcgaaugacggccag

SEQ ID NO: 1188634 - RNA, 18 nt, Mycobacterium bovis subsp bovis AF2122/97
uggcgccggccagccagc

SEQ ID NO: 1188635 - RNA, 21 nt, Mycobacterium bovis subsp bovis AF2122/97
uggcgccggccaguucggccu

SEQ ID NO: 1188636 - RNA, 13 nt, Mycobacterium bovis subsp bovis AF2122/97
uggcgccggggcg

SEQ ID NO: 1188637 - RNA, 19 nt, Mycobacterium bovis subsp bovis AF2122/97
uggcgccggggcgcagguu

SEQ ID NO: 1188638 - RNA, 19 nt, Mycobacterium bovis subsp bovis AF2122/97
uggcgccguugccggcguu

SEQ ID NO: 1188639 - RNA, 14 nt, Mycobacterium bovis subsp bovis AF2122/97
uggcgccggugccg

SEQ ID NO: 1188640 - RNA, 15 nt, Mycobacterium bovis subsp bovis AF2122/97
uggcgccgaccugga

SEQ ID NO: 1188641 - RNA, 14 nt, Mycobacterium bovis subsp bovis AF2122/97
uggcgccgcggcug

SEQ ID NO: 1188642 - RNA, 17 nt, Mycobacterium bovis subsp bovis AF2122/97
uggcgcccugcgccaca

SEQ ID NO: 1188643 - RNA, 22 nt, Mycobacterium bovis subsp bovis AF2122/97
uggcgccaugaagccgggcgcu

SEQ ID NO: 1188644 - RNA, 17 nt, Mycobacterium bovis subsp bovis AF2122/97
uggcgcccauggccacc

SEQ ID NO: 1188645 - RNA, 14 nt, Mycobacterium bovis subsp bovis AF2122/97
uggcgccaccaguc

SEQ ID NO: 1188646 - RNA, 15 nt, Mycobacterium bovis subsp bovis AF2122/97
uggcgccacggcagc

SEQ ID NO: 1188647 - RNA, 12 nt, Mycobacterium bovis subsp bovis AF2122/97
uggcgcaccacc

SEQ ID NO: 1188648 - RNA, 13 nt, Mycobacterium bovis subsp bovis AF2122/97
uggcgcagcaucu

SEQ ID NO: 1188649 - RNA, 19 nt, Mycobacterium bovis subsp bovis AF2122/97
uggcgcaacccccgaagac

SEQ ID NO: 1188650 - RNA, 17 nt, Mycobacterium bovis subsp bovis AF2122/97
uggcgcagaucgugcac

SEQ ID NO: 1188651 - RNA, 14 nt, Mycobacterium bovis subsp bovis AF2122/97
uggcggccgggucg

SEQ ID NO: 1188652 - RNA, 12 nt, Mycobacterium bovis subsp bovis AF2122/97
uggcggcccggu

SEQ ID NO: 1188653 - RNA, 22 nt, Mycobacterium bovis subsp bovis AF2122/97
uggcggccaacggcuccgggcg

SEQ ID NO: 1188654 - RNA, 21 nt, Mycobacterium bovis subsp bovis AF2122/97
uggcggccaguucggcggccg

SEQ ID NO: 1188655 - RNA, 23 nt, Mycobacterium bovis subsp bovis AF2122/97
uggcggauggccgccuuggcuuc

SEQ ID NO: 1188656 - RNA, 20 nt, Mycobacterium bovis subsp bovis AF2122/97
uggcggaucgcgagcgccgc

SEQ ID NO: 1188657 - RNA, 17 nt, Mycobacterium bovis subsp bovis AF2122/97
uggcggccaccgucagc

SEQ ID NO: 1188658 - RNA, 16 nt, Mycobacterium bovis subsp bovis AF2122/97
uggcggccagcgcacc

SEQ ID NO: 1188659 - RNA, 22 nt, Mycobacterium bovis subsp bovis AF2122/97
uggcggcaaggguggggccggc

SEQ ID NO: 1188660 - RNA, 13 nt, Mycobacterium bovis subsp bovis AF2122/97
uggcggcacuggc

SEQ ID NO: 1188661 - RNA, 15 nt, Mycobacterium bovis subsp bovis AF2122/97
ugggaucaggcuggg

SEQ ID NO: 1188662 - RNA, 19 nt, Mycobacterium bovis subsp bovis AF2122/97
ugggaucaggcugggcaga

SEQ ID NO: 1188663 - RNA, 17 nt, Mycobacterium bovis subsp bovis AF2122/97
ugggaucccagcgcagc

SEQ ID NO: 1188664 - RNA, 15 nt, Mycobacterium bovis subsp bovis AF2122/97
ugggcagcaggccca

SEQ ID NO: 1188665 - RNA, 16 nt, Mycobacterium bovis subsp bovis AF2122/97
ugggcacguugugauc

SEQ ID NO: 1188666 - RNA, 19 nt, Mycobacterium bovis subsp bovis AF2122/97
ugggcacuugcccgucggc

SEQ ID NO: 1188667 - RNA, 23 nt, Mycobacterium bovis subsp bovis AF2122/97
ugggcaauuccgccgagcgcaac

SEQ ID NO: 1188668 - RNA, 23 nt, Mycobacterium bovis subsp bovis AF2122/97
ugggcaugcggauucgcgcuguc

SEQ ID NO: 1188669 - RNA, 15 nt, Mycobacterium bovis subsp bovis AF2122/97
ugggcaucaggccgc

SEQ ID NO: 1188670 - RNA, 18 nt, Mycobacterium bovis subsp bovis AF2122/97
ugggaucggauuuuccgc

SEQ ID NO: 1188671 - RNA, 20 nt, Mycobacterium bovis subsp bovis AF2122/97
ugggaugaccuuggccgugc

SEQ ID NO: 1188672 - RNA, 19 nt, Mycobacterium bovis subsp bovis AF2122/97
ugggauugaagcuggccac

SEQ ID NO: 1188673 - RNA, 14 nt, Mycobacterium bovis subsp bovis AF2122/97
ugggauugagcccg

SEQ ID NO: 1188674 - RNA, 20 nt, Mycobacterium bovis subsp bovis AF2122/97
ugggcaccacccgauuggcc

SEQ ID NO: 1188675 - RNA, 17 nt, Mycobacterium bovis subsp bovis AF2122/97
uggggccuggucccacc

SEQ ID NO: 1188676 - RNA, 11 nt, Mycobacterium bovis subsp bovis AF2122/97
uggggccggcg

SEQ ID NO: 1188677 - RNA, 12 nt, Mycobacterium bovis subsp bovis AF2122/97
uggggcgccggg

SEQ ID NO: 1188678 - RNA, 14 nt, Mycobacterium bovis subsp bovis AF2122/97
uggggcgcgccggc

SEQ ID NO: 1188679 - RNA, 19 nt, Mycobacterium bovis subsp bovis AF2122/97
uggggcgcgugggcgugca

SEQ ID NO: 1188680 - RNA, 13 nt, Mycobacterium bovis subsp bovis AF2122/97
uggggcucgagug

SEQ ID NO: 1188681 - RNA, 21 nt, Mycobacterium bovis subsp bovis AF2122/97
uggggcgcgugggcgugcagg

SEQ ID NO: 1188682 - RNA, 16 nt, Mycobacterium bovis subsp bovis AF2122/97
uggggcuauggcgcag

SEQ ID NO: 1188683 - RNA, 15 nt, Mycobacterium bovis subsp bovis AF2122/97
uggguagccgcccag

SEQ ID NO: 1188684 - RNA, 23 nt, Mycobacterium bovis subsp bovis AF2122/97
uggguagcggaucaagcgcacaa

SEQ ID NO: 1188685 - RNA, 11 nt, Mycobacterium bovis subsp bovis AF2122/97
uggguaggcuc

SEQ ID NO: 1188686 - RNA, 20 nt, Mycobacterium bovis subsp bovis AF2122/97
uggguccucgagcggcagau

SEQ ID NO: 1188687 - RNA, 20 nt, Mycobacterium bovis subsp bovis AF2122/97
ugggucgcaauauccggccg

SEQ ID NO: 1188688 - RNA, 20 nt, Mycobacterium bovis subsp bovis AF2122/97
ugggucggcuuccggugccg

SEQ ID NO: 1188689 - RNA, 19 nt, Mycobacterium bovis subsp bovis AF2122/97
ugggucaacgucaggcccu

SEQ ID NO: 1188690 - RNA, 13 nt, Mycobacterium bovis subsp bovis AF2122/97
ugggugaggccaa

SEQ ID NO: 1188691 - RNA, 15 nt, Mycobacterium bovis subsp bovis AF2122/97
ugggugaucugcccu

SEQ ID NO: 1188692 - RNA, 19 nt, Mycobacterium bovis subsp bovis AF2122/97
ugggugacguaggcgcuga

SEQ ID NO: 1188693 - RNA, 21 nt, Mycobacterium bovis subsp bovis AF2122/97
ugggugcgccgucagcccagg

SEQ ID NO: 1188694 - RNA, 18 nt, Mycobacterium bovis subsp bovis AF2122/97
ugggugccggcagcggcg

SEQ ID NO: 1188695 - RNA, 19 nt, Mycobacterium bovis subsp bovis AF2122/97
ugggucugcucagcgcggc

SEQ ID NO: 1188696 - RNA, 21 nt, Mycobacterium bovis subsp bovis AF2122/97
ugggucuuugcccgccacgcu

SEQ ID NO: 1188697 - RNA, 18 nt, Mycobacterium bovis subsp bovis AF2122/97
uggggccggaugucgacg

SEQ ID NO: 1188698 - RNA, 18 nt, Mycobacterium bovis subsp bovis AF2122/97
ugggcugcggaugcgcgg

SEQ ID NO: 1188699 - RNA, 22 nt, Mycobacterium bovis subsp bovis AF2122/97
uggggcacuuccagcccggcaa

SEQ ID NO: 1188700 - RNA, 13 nt, Mycobacterium bovis subsp bovis AF2122/97
ugggcuggccagc

SEQ ID NO: 1188701 - RNA, 16 nt, Mycobacterium bovis subsp bovis AF2122/97
ugggcugaggguggac

SEQ ID NO: 1188702 - RNA, 21 nt, Mycobacterium bovis subsp bovis AF2122/97
ugggcuaccgagauugggcug

SEQ ID NO: 1188703 - RNA, 22 nt, Mycobacterium bovis subsp bovis AF2122/97
ugggcgacgcggcgccgccauc

SEQ ID NO: 1188704 - RNA, 23 nt, Mycobacterium bovis subsp bovis AF2122/97
ugggcgagaccgcgagcagcaca

SEQ ID NO: 1188705 - RNA, 14 nt, Mycobacterium bovis subsp bovis AF2122/97
ugggcgagcugcug

SEQ ID NO: 1188706 - RNA, 22 nt, Mycobacterium bovis subsp bovis AF2122/97
ugggcguucccccggcaccgcc

SEQ ID NO: 1188707 - RNA, 23 nt, Mycobacterium bovis subsp bovis AF2122/97
ugggcguucccccggcaccgccg

SEQ ID NO: 1188708 - RNA, 20 nt, Mycobacterium bovis subsp bovis AF2122/97
ugggcgagaaguccgggccc

SEQ ID NO: 1188709 - RNA, 23 nt, Mycobacterium bovis subsp bovis AF2122/97
ugggcgagaaguccgggccccuu

SEQ ID NO: 1188710 - RNA, 20 nt, Mycobacterium bovis subsp bovis AF2122/97
ugggcgagaccgcgagcagc

SEQ ID NO: 1188711 - RNA, 19 nt, Mycobacterium bovis subsp bovis AF2122/97
ugggccuccaccgcgucca

SEQ ID NO: 1188712 - RNA, 23 nt, Mycobacterium bovis subsp bovis AF2122/97
uggucgaaacgguacgccgccgc

SEQ ID NO: 1188713 - RNA, 20 nt, Mycobacterium bovis subsp bovis AF2122/97
uggucgaagaucgccugggg

SEQ ID NO: 1188714 - RNA, 18 nt, Mycobacterium bovis subsp bovis AF2122/97
ugguccgcugcagcaccg

SEQ ID NO: 1188715 - RNA, 19 nt, Mycobacterium bovis subsp bovis AF2122/97
uggucccguucgcccgccc

SEQ ID NO: 1188716 - RNA, 17 nt, Mycobacterium bovis subsp bovis AF2122/97
ugguccgaccagcggcc

SEQ ID NO: 1188717 - RNA, 16 nt, Mycobacterium bovis subsp bovis AF2122/97
uggucagucaccaacc

SEQ ID NO: 1188718 - RNA, 18 nt, Mycobacterium bovis subsp bovis AF2122/97
uggucagucaccaaccac

SEQ ID NO: 1188719 - RNA, 19 nt, Mycobacterium bovis subsp bovis AF2122/97
uggucagugugaacugucc

SEQ ID NO: 1188720 - RNA, 23 nt, Mycobacterium bovis subsp bovis AF2122/97
uggucgaauaguugaccaggccg

SEQ ID NO: 1188721 - RNA, 16 nt, Mycobacterium bovis subsp bovis AF2122/97
uggucgaguugaagaa

SEQ ID NO: 1188722 - RNA, 17 nt, Mycobacterium bovis subsp bovis AF2122/97
uggucgaguugaagaau

SEQ ID NO: 1188723 - RNA, 16 nt, Mycobacterium bovis subsp bovis AF2122/97
uggucggugacugugc

SEQ ID NO: 1188724 - RNA, 18 nt, Mycobacterium bovis subsp bovis AF2122/97
uggucggugggguauucg

SEQ ID NO: 1188725 - RNA, 18 nt, Mycobacterium bovis subsp bovis AF2122/97
uggucgcaggauucccag

SEQ ID NO: 1188726 - RNA, 20 nt, Mycobacterium bovis subsp bovis AF2122/97
uggucgcaggauucccaguc

SEQ ID NO: 1188727 - RNA, 17 nt, Mycobacterium bovis subsp bovis AF2122/97
uggucuccggcaccgag

SEQ ID NO: 1188728 - RNA, 20 nt, Mycobacterium bovis subsp bovis AF2122/97
uggucucuagcaaagccagc

SEQ ID NO: 1188729 - RNA, 23 nt, Mycobacterium bovis subsp bovis AF2122/97
uggugaccgggucgaucaccgac

SEQ ID NO: 1188730 - RNA, 22 nt, Mycobacterium bovis subsp bovis AF2122/97
uggugaucugcugggcaagauc

SEQ ID NO: 1188731 - RNA, 16 nt, Mycobacterium bovis subsp bovis AF2122/97
ugguggacgccaugga

SEQ ID NO: 1188732 - RNA, 14 nt, Mycobacterium bovis subsp bovis AF2122/97
uggugaggcccccc

SEQ ID NO: 1188733 - RNA, 12 nt, Mycobacterium bovis subsp bovis AF2122/97
ugguggcccggc

SEQ ID NO: 1188734 - RNA, 13 nt, Mycobacterium bovis subsp bovis AF2122/97
ugguggcccggcu

SEQ ID NO: 1188735 - RNA, 16 nt, Mycobacterium bovis subsp bovis AF2122/97
ugguggcccgggccac

SEQ ID NO: 1188736 - RNA, 18 nt, Mycobacterium bovis subsp bovis AF2122/97
ugguggcccgggccaccg

SEQ ID NO: 1188737 - RNA, 15 nt, Mycobacterium bovis subsp bovis AF2122/97
ugguggccagccagc

SEQ ID NO: 1188738 - RNA, 14 nt, Mycobacterium bovis subsp bovis AF2122/97
ugguggcagcgcac

SEQ ID NO: 1188739 - RNA, 15 nt, Mycobacterium bovis subsp bovis AF2122/97
ugguggcagcgcacc

SEQ ID NO: 1188740 - RNA, 21 nt, Mycobacterium bovis subsp bovis AF2122/97
ugguggccaugacggcuccga

SEQ ID NO: 1188741 - RNA, 23 nt, Mycobacterium bovis subsp bovis AF2122/97
ugguggagcggcgcggggguggg

SEQ ID NO: 1188742 - RNA, 18 nt, Mycobacterium bovis subsp bovis AF2122/97
ugguggcaacggguccga

SEQ ID NO: 1188743 - RNA, 14 nt, Mycobacterium bovis subsp bovis AF2122/97
uggugucgcggccg

SEQ ID NO: 1188744 - RNA, 22 nt, Mycobacterium bovis subsp bovis AF2122/97
uggugucagcugauuaccgaca

SEQ ID NO: 1188745 - RNA, 16 nt, Mycobacterium bovis subsp bovis AF2122/97
ugguguccaccaccgg

SEQ ID NO: 1188746 - RNA, 23 nt, Mycobacterium bovis subsp bovis AF2122/97
ugguggcgccaacgcaacgguga

SEQ ID NO: 1188747 - RNA, 16 nt, Mycobacterium bovis subsp bovis AF2122/97
ugguggcgccaucccc

SEQ ID NO: 1188748 - RNA, 18 nt, Mycobacterium bovis subsp bovis AF2122/97
ugguggcgguguugcucc

SEQ ID NO: 1188749 - RNA, 22 nt, Mycobacterium bovis subsp bovis AF2122/97
ugguggcgaucaucggccccga

SEQ ID NO: 1188750 - RNA, 22 nt, Mycobacterium bovis subsp bovis AF2122/97
uggugugauacagcgccagggg

SEQ ID NO: 1188751 - RNA, 11 nt, Mycobacterium bovis subsp bovis AF2122/97
ugguguuccag

SEQ ID NO: 1188752 - RNA, 12 nt, Mycobacterium bovis subsp bovis AF2122/97
uggugugcagca

SEQ ID NO: 1188753 - RNA, 17 nt, Mycobacterium bovis subsp bovis AF2122/97
uggugugacgaucccca

SEQ ID NO: 1188754 - RNA, 13 nt, Mycobacterium bovis subsp bovis AF2122/97
uggucagccgcgg

SEQ ID NO: 1188755 - RNA, 24 nt, Mycobacterium bovis subsp bovis AF2122/97
uggucaggaacacucgcgaauaac

SEQ ID NO: 1188756 - RNA, 16 nt, Mycobacterium bovis subsp bovis AF2122/97
uggucaggcuggaggu

SEQ ID NO: 1188757 - RNA, 23 nt, Mycobacterium bovis subsp bovis AF2122/97
uggucacggcgucgacuggccgu

SEQ ID NO: 1188758 - RNA, 15 nt, Mycobacterium bovis subsp bovis AF2122/97
uggucaccugcugca

SEQ ID NO: 1188759 - RNA, 23 nt, Mycobacterium bovis subsp bovis AF2122/97
ugguaugcccgccguagaccagc

SEQ ID NO: 1188760 - RNA, 22 nt, Mycobacterium bovis subsp bovis AF2122/97
uggguguugucgucgagcgcgc

SEQ ID NO: 1188761 - RNA, 17 nt, Mycobacterium bovis subsp bovis AF2122/97
ugggugcgucgacccag

SEQ ID NO: 1188762 - RNA, 16 nt, Mycobacterium bovis subsp bovis AF2122/97
ugggugcgucugggca

SEQ ID NO: 1188763 - RNA, 22 nt, Mycobacterium bovis subsp bovis AF2122/97
ugggugcgccgucagcccaggu

SEQ ID NO: 1188764 - RNA, 16 nt, Mycobacterium bovis subsp bovis AF2122/97
ugguaccggcgccgca

SEQ ID NO: 1188765 - RNA, 20 nt, Mycobacterium bovis subsp bovis AF2122/97
ugguaccggcggcgccggcc

SEQ ID NO: 1188766 - RNA, 18 nt, Mycobacterium bovis subsp bovis AF2122/97
ugguacccgcgccgcgca

SEQ ID NO: 1188767 - RNA, 15 nt, Mycobacterium bovis subsp bovis AF2122/97
ugguacccaccaggg

SEQ ID NO: 1188768 - RNA, 19 nt, Mycobacterium bovis subsp bovis AF2122/97
uggguugugccgcccugga

SEQ ID NO: 1188769 - RNA, 15 nt, Mycobacterium bovis subsp bovis AF2122/97
uguaggcuuccagcu

SEQ ID NO: 1188770 - RNA, 14 nt, Mycobacterium bovis subsp bovis AF2122/97
uguagggcugcucc

SEQ ID NO: 1188771 - RNA, 15 nt, Mycobacterium bovis subsp bovis AF2122/97
uguaggccgggccgg

SEQ ID NO: 1188772 - RNA, 12 nt, Mycobacterium bovis subsp bovis AF2122/97
uguagcccagcc

SEQ ID NO: 1188773 - RNA, 12 nt, Mycobacterium bovis subsp bovis AF2122/97
uguagcccuccg

SEQ ID NO: 1188774 - RNA, 16 nt, Mycobacterium bovis subsp bovis AF2122/97
uguagcucggacccuc

SEQ ID NO: 1188775 - RNA, 20 nt, Mycobacterium bovis subsp bovis AF2122/97
uguagaugaacuucccaccc

SEQ ID NO: 1188776 - RNA, 15 nt, Mycobacterium bovis subsp bovis AF2122/97
uguagacggcggcau

SEQ ID NO: 1188777 - RNA, 23 nt, Mycobacterium bovis subsp bovis AF2122/97
ugucacaacgcgugaccagggcc

SEQ ID NO: 1188778 - RNA, 15 nt, Mycobacterium bovis subsp bovis AF2122/97
uguaccccagcaucu

SEQ ID NO: 1188779 - RNA, 18 nt, Mycobacterium bovis subsp bovis AF2122/97
uguaccccagcgccacca

SEQ ID NO: 1188780 - RNA, 18 nt, Mycobacterium bovis subsp bovis AF2122/97
uguacccgaccagcacca

SEQ ID NO: 1188781 - RNA, 17 nt, Mycobacterium bovis subsp bovis AF2122/97
uguacgcaucgccguca

SEQ ID NO: 1188782 - RNA, 21 nt, Mycobacterium bovis subsp bovis AF2122/97
uguacuggucuggacugcagc

SEQ ID NO: 1188783 - RNA, 22 nt, Mycobacterium bovis subsp bovis AF2122/97
uguacugcggugccacggugac

SEQ ID NO: 1188784 - RNA, 14 nt, Mycobacterium bovis subsp bovis AF2122/97
ucuuccucggccac

SEQ ID NO: 1188785 - RNA, 23 nt, Mycobacterium bovis subsp bovis AF2122/97
ucuuccaacccaaccgagaugcg

SEQ ID NO: 1188786 - RNA, 23 nt, Mycobacterium bovis subsp bovis AF2122/97
ucuucagguccaccgcugccggc

SEQ ID NO: 1188787 - RNA, 19 nt, Mycobacterium bovis subsp bovis AF2122/97
ucuuccggugcgccgaucc

SEQ ID NO: 1188788 - RNA, 21 nt, Mycobacterium bovis subsp bovis AF2122/97
ucuucgccgucacgcacgccg

SEQ ID NO: 1188789 - RNA, 23 nt, Mycobacterium bovis subsp bovis AF2122/97
ucuucgccgucggcgacuccucu

SEQ ID NO: 1188790 - RNA, 20 nt, Mycobacterium bovis subsp bovis AF2122/97
ucuucgccgaugaauuucau

SEQ ID NO: 1188791 - RNA, 17 nt, Mycobacterium bovis subsp bovis AF2122/97
ucuucgcgauguccucg

SEQ ID NO: 1188792 - RNA, 16 nt, Mycobacterium bovis subsp bovis AF2122/97
ucuucgcuaccuucuu

SEQ ID NO: 1188793 - RNA, 13 nt, Mycobacterium bovis subsp bovis AF2122/97
ucuucgcgcgcuc

SEQ ID NO: 1188794 - RNA, 15 nt, Mycobacterium bovis subsp bovis AF2122/97
ucuucggccagcucc

SEQ ID NO: 1188795 - RNA, 18 nt, Mycobacterium bovis subsp bovis AF2122/97
ucuucggcggacaggccc

SEQ ID NO: 1188796 - RNA, 19 nt, Mycobacterium bovis subsp bovis AF2122/97
ucuucgggcucguccagca

SEQ ID NO: 1188797 - RNA, 21 nt, Mycobacterium bovis subsp bovis AF2122/97
ucuucgggcucguccagcaac

SEQ ID NO: 1188798 - RNA, 14 nt, Mycobacterium bovis subsp bovis AF2122/97
ucuucucggcuacu

SEQ ID NO: 1188799 - RNA, 16 nt, Mycobacterium bovis subsp bovis AF2122/97
ucuugaacugggccuc

SEQ ID NO: 1188800 - RNA, 16 nt, Mycobacterium bovis subsp bovis AF2122/97
ucuugaccgcaccggc

SEQ ID NO: 1188801 - RNA, 23 nt, Mycobacterium bovis subsp bovis AF2122/97
ucuugaccgcggugacucggccu

SEQ ID NO: 1188802 - RNA, 21 nt, Mycobacterium bovis subsp bovis AF2122/97
ucuugccgcgaaugaagcccu

SEQ ID NO: 1188803 - RNA, 19 nt, Mycobacterium bovis subsp bovis AF2122/97
ucuugccgucggccggcaa

SEQ ID NO: 1188804 - RNA, 17 nt, Mycobacterium bovis subsp bovis AF2122/97
ucuugcaucgccaaugc

SEQ ID NO: 1188805 - RNA, 15 nt, Mycobacterium bovis subsp bovis AF2122/97
ucuugcgccacggcg

SEQ ID NO: 1188806 - RNA, 14 nt, Mycobacterium bovis subsp bovis AF2122/97
ucuggccugcccca

SEQ ID NO: 1188807 - RNA, 21 nt, Mycobacterium bovis subsp bovis AF2122/97
ucuggcgacucgugucugccu

SEQ ID NO: 1188808 - RNA, 20 nt, Mycobacterium bovis subsp bovis AF2122/97
ucuggccccaggggaggcga

SEQ ID NO: 1188809 - RNA, 20 nt, Mycobacterium bovis subsp bovis AF2122/97
ucuggcaacccccgccggcg

SEQ ID NO: 1188810 - RNA, 15 nt, Mycobacterium bovis subsp bovis AF2122/97
ucuggcaggccagca

SEQ ID NO: 1188811 - RNA, 23 nt, Mycobacterium bovis subsp bovis AF2122/97
ucuggcagccgaaguggcgccuu

SEQ ID NO: 1188812 - RNA, 20 nt, Mycobacterium bovis subsp bovis AF2122/97
ucuggggguagccgccggcg

SEQ ID NO: 1188813 - RNA, 20 nt, Mycobacterium bovis subsp bovis AF2122/97
ucuggggcaccacgcugugc

SEQ ID NO: 1188814 - RNA, 16 nt, Mycobacterium bovis subsp bovis AF2122/97
ucugggguccggugac

SEQ ID NO: 1188815 - RNA, 14 nt, Mycobacterium bovis subsp bovis AF2122/97
ucugggugcagguu

SEQ ID NO: 1188816 - RNA, 18 nt, Mycobacterium bovis subsp bovis AF2122/97
ucugggcggugaaggccc

SEQ ID NO: 1188817 - RNA, 14 nt, Mycobacterium bovis subsp bovis AF2122/97
ucugggcuuugcag

SEQ ID NO: 1188818 - RNA, 13 nt, Mycobacterium bovis subsp bovis AF2122/97
ucugcgccaggcg

SEQ ID NO: 1188819 - RNA, 14 nt, Mycobacterium bovis subsp bovis AF2122/97
ucugcgcccacccg

SEQ ID NO: 1188820 - RNA, 17 nt, Mycobacterium bovis subsp bovis AF2122/97
ucugcgaucccgaucgc

SEQ ID NO: 1188821 - RNA, 13 nt, Mycobacterium bovis subsp bovis AF2122/97
ucugcgccacagc

SEQ ID NO: 1188822 - RNA, 13 nt, Mycobacterium bovis subsp bovis AF2122/97
ucuggauacccag

SEQ ID NO: 1188823 - RNA, 18 nt, Mycobacterium bovis subsp bovis AF2122/97
ucugugcgcggacaccuu

SEQ ID NO: 1188824 - RNA, 13 nt, Mycobacterium bovis subsp bovis AF2122/97
ucugucuggcccc

SEQ ID NO: 1188825 - RNA, 22 nt, Mycobacterium bovis subsp bovis AF2122/97
ucuggucgaccaucgguuugca

SEQ ID NO: 1188826 - RNA, 22 nt, Mycobacterium bovis subsp bovis AF2122/97
ucuggucggcuacggccagugc

SEQ ID NO: 1188827 - RNA, 14 nt, Mycobacterium bovis subsp bovis AF2122/97
ucuggucgggucgc

SEQ ID NO: 1188828 - RNA, 18 nt, Mycobacterium bovis subsp bovis AF2122/97
ucuguugacucugcgucc

SEQ ID NO: 1188829 - RNA, 15 nt, Mycobacterium bovis subsp bovis AF2122/97
ucugacccaccgccc

SEQ ID NO: 1188830 - RNA, 23 nt, Mycobacterium bovis subsp bovis AF2122/97
ucugagcgcggguggcagcggcg

SEQ ID NO: 1188831 - RNA, 22 nt, Mycobacterium bovis subsp bovis AF2122/97
ucugacaucggccaagguuguc

SEQ ID NO: 1188832 - RNA, 16 nt, Mycobacterium bovis subsp bovis AF2122/97
ucugaccccccgaccc

SEQ ID NO: 1188833 - RNA, 18 nt, Mycobacterium bovis subsp bovis AF2122/97
ucucgaaagccgcggccg

SEQ ID NO: 1188834 - RNA, 22 nt, Mycobacterium bovis subsp bovis AF2122/97
ucuccuugggcgacgcggcgcc

SEQ ID NO: 1188835 - RNA, 12 nt, Mycobacterium bovis subsp bovis AF2122/97
ucucgccgccag

SEQ ID NO: 1188836 - RNA, 15 nt, Mycobacterium bovis subsp bovis AF2122/97
ucucgccgccagcgc

SEQ ID NO: 1188837 - RNA, 16 nt, Mycobacterium bovis subsp bovis AF2122/97
ucucgccgggaaacac

SEQ ID NO: 1188838 - RNA, 20 nt, Mycobacterium bovis subsp bovis AF2122/97
ucucgcgaagaucagcggau

SEQ ID NO: 1188839 - RNA, 14 nt, Mycobacterium bovis subsp bovis AF2122/97
ucucgcgcgcggcg

SEQ ID NO: 1188840 - RNA, 14 nt, Mycobacterium bovis subsp bovis AF2122/97
ucugccggccggcg

SEQ ID NO: 1188841 - RNA, 23 nt, Mycobacterium bovis subsp bovis AF2122/97
ucugccgccgcggccacaaccuc

SEQ ID NO: 1188842 - RNA, 16 nt, Mycobacterium bovis subsp bovis AF2122/97
ucugccaugugucccg

SEQ ID NO: 1188843 - RNA, 17 nt, Mycobacterium bovis subsp bovis AF2122/97
ucugcccgcccagcccg

SEQ ID NO: 1188844 - RNA, 20 nt, Mycobacterium bovis subsp bovis AF2122/97
ucugcccgcccagcccggcg

SEQ ID NO: 1188845 - RNA, 20 nt, Mycobacterium bovis subsp bovis AF2122/97
ucugcccgauacccggugau

SEQ ID NO: 1188846 - RNA, 23 nt, Mycobacterium bovis subsp bovis AF2122/97
ucugccucucagcacgguuguug

SEQ ID NO: 1188847 - RNA, 14 nt, Mycobacterium bovis subsp bovis AF2122/97
ucugccuuaccaac

SEQ ID NO: 1188848 - RNA, 15 nt, Mycobacterium bovis subsp bovis AF2122/97
ucugcgacccgggcc

SEQ ID NO: 1188849 - RNA, 17 nt, Mycobacterium bovis subsp bovis AF2122/97
ucugccagcacccugau

SEQ ID NO: 1188850 - RNA, 14 nt, Mycobacterium bovis subsp bovis AF2122/97
ucugcagugcagcg

SEQ ID NO: 1188851 - RNA, 11 nt, Mycobacterium bovis subsp bovis AF2122/97
ucgugccaccg

SEQ ID NO: 1188852 - RNA, 12 nt, Mycobacterium bovis subsp bovis AF2122/97
ucgugcacggcg

SEQ ID NO: 1188853 - RNA, 19 nt, Mycobacterium bovis subsp bovis AF2122/97
ucgugcacggcggccaggg

SEQ ID NO: 1188854 - RNA, 15 nt, Mycobacterium bovis subsp bovis AF2122/97
ucgugcggcacuccc

SEQ ID NO: 1188855 - RNA, 23 nt, Mycobacterium bovis subsp bovis AF2122/97
ucgugcgacaacacgaccucuug

SEQ ID NO: 1188856 - RNA, 14 nt, Mycobacterium bovis subsp bovis AF2122/97
ucgugggcugugcg

SEQ ID NO: 1188857 - RNA, 22 nt, Mycobacterium bovis subsp bovis AF2122/97
ucguggugagaucaugagguga

SEQ ID NO: 1188858 - RNA, 21 nt, Mycobacterium bovis subsp bovis AF2122/97
ucguggcgcgccgcaucggcg

SEQ ID NO: 1188859 - RNA, 12 nt, Mycobacterium bovis subsp bovis AF2122/97
ucguggagcuca

SEQ ID NO: 1188860 - RNA, 20 nt, Mycobacterium bovis subsp bovis AF2122/97
ucguggauccagccaugcgg

SEQ ID NO: 1188861 - RNA, 22 nt, Mycobacterium bovis subsp bovis AF2122/97
ucguggagcucacgugcugccg

SEQ ID NO: 1188862 - RNA, 14 nt, Mycobacterium bovis subsp bovis AF2122/97
ucgucgaaagccug

SEQ ID NO: 1188863 - RNA, 17 nt, Mycobacterium bovis subsp bovis AF2122/97
ucgucgaacauggcacg

SEQ ID NO: 1188864 - RNA, 18 nt, Mycobacterium bovis subsp bovis AF2122/97
ucgucgagaagaucucgu

SEQ ID NO: 1188865 - RNA, 17 nt, Mycobacterium bovis subsp bovis AF2122/97
ucgucgacccaccaugu

SEQ ID NO: 1188866 - RNA, 13 nt, Mycobacterium bovis subsp bovis AF2122/97
ucgucgagccaca

SEQ ID NO: 1188867 - RNA, 19 nt, Mycobacterium bovis subsp bovis AF2122/97
ucgucgagcaccacccggg

SEQ ID NO: 1188868 - RNA, 22 nt, Mycobacterium bovis subsp bovis AF2122/97
ucgucgaucgacucacacaccg

SEQ ID NO: 1188869 - RNA, 18 nt, Mycobacterium bovis subsp bovis AF2122/97
ucgucgaucgccgcgccg

SEQ ID NO: 1188870 - RNA, 16 nt, Mycobacterium bovis subsp bovis AF2122/97
ucgucgaggaagauca

SEQ ID NO: 1188871 - RNA, 21 nt, Mycobacterium bovis subsp bovis AF2122/97
ucgucgagguccucgucgucg

SEQ ID NO: 1188872 - RNA, 23 nt, Mycobacterium bovis subsp bovis AF2122/97
ucgucauugcgaaaaucgaagcc

SEQ ID NO: 1188873 - RNA, 15 nt, Mycobacterium bovis subsp bovis AF2122/97
ucgucgaugucgacg

SEQ ID NO: 1188874 - RNA, 13 nt, Mycobacterium bovis subsp bovis AF2122/97
ucgugaaaccaca

SEQ ID NO: 1188875 - RNA, 23 nt, Mycobacterium bovis subsp bovis AF2122/97
ucgugcaaugcuuccagcaucag

SEQ ID NO: 1188876 - RNA, 14 nt, Mycobacterium bovis subsp bovis AF2122/97
ucgucacugccacc

SEQ ID NO: 1188877 - RNA, 15 nt, Mycobacterium bovis subsp bovis AF2122/97
ucgucagucaacuca

SEQ ID NO: 1188878 - RNA, 15 nt, Mycobacterium bovis subsp bovis AF2122/97
ucguaggagccguca

SEQ ID NO: 1188879 - RNA, 21 nt, Mycobacterium bovis subsp bovis AF2122/97
ucgucaaaucuggcuggacca

SEQ ID NO: 1188880 - RNA, 13 nt, Mycobacterium bovis subsp bovis AF2122/97
ucggcauccgcgg

SEQ ID NO: 1188881 - RNA, 12 nt, Mycobacterium bovis subsp bovis AF2122/97
ucgguguggacu

SEQ ID NO: 1188882 - RNA, 13 nt, Mycobacterium bovis subsp bovis AF2122/97
ucgguguggccgu

SEQ ID NO: 1188883 - RNA, 22 nt, Mycobacterium bovis subsp bovis AF2122/97
ucggcauguuccuugcggccgc

SEQ ID NO: 1188884 - RNA, 22 nt, Mycobacterium bovis subsp bovis AF2122/97
ucggcauucgcaccaccugggc

SEQ ID NO: 1188885 - RNA, 22 nt, Mycobacterium bovis subsp bovis AF2122/97
ucguagacagucugcgacugga

SEQ ID NO: 1188886 - RNA, 22 nt, Mycobacterium bovis subsp bovis AF2122/97
ucguugaggccggugaacggca

SEQ ID NO: 1188887 - RNA, 16 nt, Mycobacterium bovis subsp bovis AF2122/97
ucguugaccggccgga

SEQ ID NO: 1188888 - RNA, 19 nt, Mycobacterium bovis subsp bovis AF2122/97
ucguugccggacaaccugg

SEQ ID NO: 1188889 - RNA, 22 nt, Mycobacterium bovis subsp bovis AF2122/97
ucguguaucgagcggcacauca

SEQ ID NO: 1188890 - RNA, 17 nt, Mycobacterium bovis subsp bovis AF2122/97
ucguugcccgacccgcc

SEQ ID NO: 1188891 - RNA, 21 nt, Mycobacterium bovis subsp bovis AF2122/97
ucguuggcaaagacgcuggcc

SEQ ID NO: 1188892 - RNA, 13 nt, Mycobacterium bovis subsp bovis AF2122/97
ucuaccuccgcca

SEQ ID NO: 1188893 - RNA, 23 nt, Mycobacterium bovis subsp bovis AF2122/97
ucuaccuuagcgccguugccgcc

SEQ ID NO: 1188894 - RNA, 21 nt, Mycobacterium bovis subsp bovis AF2122/97
ucuaccaccuugccgaacacu

SEQ ID NO: 1188895 - RNA, 22 nt, Mycobacterium bovis subsp bovis AF2122/97
ucuagcggccuaggacgccgcc

SEQ ID NO: 1188896 - RNA, 22 nt, Mycobacterium bovis subsp bovis AF2122/97
ucuagcgccucgccggccaccc

SEQ ID NO: 1188897 - RNA, 14 nt, Mycobacterium bovis subsp bovis AF2122/97
ucuagcaaagccag

SEQ ID NO: 1188898 - RNA, 20 nt, Mycobacterium bovis subsp bovis AF2122/97
ucuccaccggcgaucugcuc

SEQ ID NO: 1188899 - RNA, 17 nt, Mycobacterium bovis subsp bovis AF2122/97
ucuccaccgucgccgcc

SEQ ID NO: 1188900 - RNA, 12 nt, Mycobacterium bovis subsp bovis AF2122/97
ucuccaccuucu

SEQ ID NO: 1188901 - RNA, 23 nt, Mycobacterium bovis subsp bovis AF2122/97
ucuccgggucgaugucggggccg

SEQ ID NO: 1188902 - RNA, 11 nt, Mycobacterium bovis subsp bovis AF2122/97
ucuccggugau

SEQ ID NO: 1188903 - RNA, 23 nt, Mycobacterium bovis subsp bovis AF2122/97
ucuccccagagcugguccuccaa

SEQ ID NO: 1188904 - RNA, 13 nt, Mycobacterium bovis subsp bovis AF2122/97
ucucccccaucgc

SEQ ID NO: 1188905 - RNA, 18 nt, Mycobacterium bovis subsp bovis AF2122/97
ucuccccgcuagcccacc

SEQ ID NO: 1188906 - RNA, 16 nt, Mycobacterium bovis subsp bovis AF2122/97
ucuccuugagcuucuc

SEQ ID NO: 1188907 - RNA, 19 nt, Mycobacterium bovis subsp bovis AF2122/97
ucuccaccccgucugcagg

SEQ ID NO: 1188908 - RNA, 22 nt, Mycobacterium bovis subsp bovis AF2122/97
ucuccaagcucgacaacugccc

SEQ ID NO: 1188909 - RNA, 18 nt, Mycobacterium bovis subsp bovis AF2122/97
ucucaccgucaacgccug

SEQ ID NO: 1188910 - RNA, 18 nt, Mycobacterium bovis subsp bovis AF2122/97
ucgcguucugcaccagcu

SEQ ID NO: 1188911 - RNA, 19 nt, Mycobacterium bovis subsp bovis AF2122/97
ucgcguaccaacaggaugg

SEQ ID NO: 1188912 - RNA, 17 nt, Mycobacterium bovis subsp bovis AF2122/97
ucgcguacguacugcuu

SEQ ID NO: 1188913 - RNA, 18 nt, Mycobacterium bovis subsp bovis AF2122/97
ucgcguagcuggccaggu

SEQ ID NO: 1188914 - RNA, 20 nt, Mycobacterium bovis subsp bovis AF2122/97
ucgcgguggcggugucggcg

SEQ ID NO: 1188915 - RNA, 14 nt, Mycobacterium bovis subsp bovis AF2122/97
ucgcggugguuggg

SEQ ID NO: 1188916 - RNA, 15 nt, Mycobacterium bovis subsp bovis AF2122/97
ucgcgguagccgcgg

SEQ ID NO: 1188917 - RNA, 14 nt, Mycobacterium bovis subsp bovis AF2122/97
ucgcguuguaggcu

SEQ ID NO: 1188918 - RNA, 22 nt, Mycobacterium bovis subsp bovis AF2122/97
ucgcuacgcaacgggucggguc

SEQ ID NO: 1188919 - RNA, 18 nt, Mycobacterium bovis subsp bovis AF2122/97
ucgcugacggcaaacgac

SEQ ID NO: 1188920 - RNA, 22 nt, Mycobacterium bovis subsp bovis AF2122/97
ucgcugaccgcguagaccagug

SEQ ID NO: 1188921 - RNA, 15 nt, Mycobacterium bovis subsp bovis AF2122/97
ucgcugagcacggcg

SEQ ID NO: 1188922 - RNA, 16 nt, Mycobacterium bovis subsp bovis AF2122/97
ucgcucugugucgccg

SEQ ID NO: 1188923 - RNA, 19 nt, Mycobacterium bovis subsp bovis AF2122/97
ucgcugaccgcguagacca

SEQ ID NO: 1188924 - RNA, 16 nt, Mycobacterium bovis subsp bovis AF2122/97
ucgcucgcgccagguc

SEQ ID NO: 1188925 - RNA, 13 nt, Mycobacterium bovis subsp bovis AF2122/97
ucgcucccccgcu

SEQ ID NO: 1188926 - RNA, 19 nt, Mycobacterium bovis subsp bovis AF2122/97
ucgcucccgguuggggugg

SEQ ID NO: 1188927 - RNA, 18 nt, Mycobacterium bovis subsp bovis AF2122/97
ucgcuccgcggcgcagca

SEQ ID NO: 1188928 - RNA, 20 nt, Mycobacterium bovis subsp bovis AF2122/97
ucgcuccgcggcgcagcacg

SEQ ID NO: 1188929 - RNA, 22 nt, Mycobacterium bovis subsp bovis AF2122/97
ucgcugccuucaucggggcuuc

SEQ ID NO: 1188930 - RNA, 13 nt, Mycobacterium bovis subsp bovis AF2122/97
ucgcuucgcaagu

SEQ ID NO: 1188931 - RNA, 21 nt, Mycobacterium bovis subsp bovis AF2122/97
ucggaagaaacgucugccacg

SEQ ID NO: 1188932 - RNA, 17 nt, Mycobacterium bovis subsp bovis AF2122/97
ucggaaugcuggggccu

SEQ ID NO: 1188933 - RNA, 20 nt, Mycobacterium bovis subsp bovis AF2122/97
ucggaaucggcggaugaugc

SEQ ID NO: 1188934 - RNA, 19 nt, Mycobacterium bovis subsp bovis AF2122/97
ucggaaaaccgcaccgucc

SEQ ID NO: 1188935 - RNA, 17 nt, Mycobacterium bovis subsp bovis AF2122/97
ucggcagauggucucga

SEQ ID NO: 1188936 - RNA, 15 nt, Mycobacterium bovis subsp bovis AF2122/97
ucggcagcagcgcaa

SEQ ID NO: 1188937 - RNA, 17 nt, Mycobacterium bovis subsp bovis AF2122/97
ucggcagcaggacaccu

SEQ ID NO: 1188938 - RNA, 20 nt, Mycobacterium bovis subsp bovis AF2122/97
ucggcacgccauaccggcug

SEQ ID NO: 1188939 - RNA, 17 nt, Mycobacterium bovis subsp bovis AF2122/97
ucggcacgacccgggaa

SEQ ID NO: 1188940 - RNA, 15 nt, Mycobacterium bovis subsp bovis AF2122/97
ucggcaccagcagcc

SEQ ID NO: 1188941 - RNA, 16 nt, Mycobacterium bovis subsp bovis AF2122/97
ucggcaccgcggccgc

SEQ ID NO: 1188942 - RNA, 12 nt, Mycobacterium bovis subsp bovis AF2122/97
ucggcaccccac

SEQ ID NO: 1188943 - RNA, 22 nt, Mycobacterium bovis subsp bovis AF2122/97
ucggcacccggcagagcacgcg

SEQ ID NO: 1188944 - RNA, 23 nt, Mycobacterium bovis subsp bovis AF2122/97
ucggagaacauguaggucgccgc

SEQ ID NO: 1188945 - RNA, 19 nt, Mycobacterium bovis subsp bovis AF2122/97
ucggcaauacuccgcugac

SEQ ID NO: 1188946 - RNA, 12 nt, Mycobacterium bovis subsp bovis AF2122/97
ucggacugaaga

SEQ ID NO: 1188947 - RNA, 12 nt, Mycobacterium bovis subsp bovis AF2122/97
ucggaccacauc

SEQ ID NO: 1188948 - RNA, 14 nt, Mycobacterium bovis subsp bovis AF2122/97
ucgcgagccagcug

SEQ ID NO: 1188949 - RNA, 16 nt, Mycobacterium bovis subsp bovis AF2122/97
ucgcgagcgagccaac

SEQ ID NO: 1188950 - RNA, 18 nt, Mycobacterium bovis subsp bovis AF2122/97
ucgcgaacgaagucgacg

SEQ ID NO: 1188951 - RNA, 20 nt, Mycobacterium bovis subsp bovis AF2122/97
ucgcgaagcggaccgagccg

SEQ ID NO: 1188952 - RNA, 15 nt, Mycobacterium bovis subsp bovis AF2122/97
ucgcgaagcugugcc

SEQ ID NO: 1188953 - RNA, 15 nt, Mycobacterium bovis subsp bovis AF2122/97
ucgccugcacgcccg

SEQ ID NO: 1188954 - RNA, 21 nt, Mycobacterium bovis subsp bovis AF2122/97
ucgccucggacacggcagccu

SEQ ID NO: 1188955 - RNA, 24 nt, Mycobacterium bovis subsp bovis AF2122/97
ucgccucgauggcguagggcuguc

SEQ ID NO: 1188956 - RNA, 13 nt, Mycobacterium bovis subsp bovis AF2122/97
ucgccuccaggcg

SEQ ID NO: 1188957 - RNA, 23 nt, Mycobacterium bovis subsp bovis AF2122/97
ucgccgguaggcggccagcgcgc

SEQ ID NO: 1188958 - RNA, 14 nt, Mycobacterium bovis subsp bovis AF2122/97
ucgccuaccggccu

SEQ ID NO: 1188959 - RNA, 16 nt, Mycobacterium bovis subsp bovis AF2122/97
ucgccggccaccagcc

SEQ ID NO: 1188960 - RNA, 20 nt, Mycobacterium bovis subsp bovis AF2122/97
ucgccgcgacugcaccuggc

SEQ ID NO: 1188961 - RNA, 19 nt, Mycobacterium bovis subsp bovis AF2122/97
ucgccggccaacugggccg

SEQ ID NO: 1188962 - RNA, 15 nt, Mycobacterium bovis subsp bovis AF2122/97
ucgccgccggugccg

SEQ ID NO: 1188963 - RNA, 17 nt, Mycobacterium bovis subsp bovis AF2122/97
ucgccgccguugccgcc

SEQ ID NO: 1188964 - RNA, 20 nt, Mycobacterium bovis subsp bovis AF2122/97
ucgccgccguugccgccguc

SEQ ID NO: 1188965 - RNA, 23 nt, Mycobacterium bovis subsp bovis AF2122/97
ucgccgccguugccgccgucguu

SEQ ID NO: 1188966 - RNA, 16 nt, Mycobacterium bovis subsp bovis AF2122/97
ucgccgggcuuggccg

SEQ ID NO: 1188967 - RNA, 22 nt, Mycobacterium bovis subsp bovis AF2122/97
ucgccggggacgccgcggcgcc

SEQ ID NO: 1188968 - RNA, 22 nt, Mycobacterium bovis subsp bovis AF2122/97
ucgccggcgcgcagccgggcca

SEQ ID NO: 1188969 - RNA, 18 nt, Mycobacterium bovis subsp bovis AF2122/97
ucgccgcccgcagggccg

SEQ ID NO: 1188970 - RNA, 14 nt, Mycobacterium bovis subsp bovis AF2122/97
ucgccgccgcgcgu

SEQ ID NO: 1188971 - RNA, 22 nt, Mycobacterium bovis subsp bovis AF2122/97
ucgccgcccccguuuacggccc

SEQ ID NO: 1188972 - RNA, 15 nt, Mycobacterium bovis subsp bovis AF2122/97
ucgccaggccguggc

SEQ ID NO: 1188973 - RNA, 20 nt, Mycobacterium bovis subsp bovis AF2122/97
ucgcgcgcgaacacccgaag

SEQ ID NO: 1188974 - RNA, 16 nt, Mycobacterium bovis subsp bovis AF2122/97
ucgcgcucgcaccacc

SEQ ID NO: 1188975 - RNA, 21 nt, Mycobacterium bovis subsp bovis AF2122/97
ucgcgcgucgucgcgcugaac

SEQ ID NO: 1188976 - RNA, 16 nt, Mycobacterium bovis subsp bovis AF2122/97
ucgcgcggcugugccc

SEQ ID NO: 1188977 - RNA, 16 nt, Mycobacterium bovis subsp bovis AF2122/97
ucgcgcgcaccggguu

SEQ ID NO: 1188978 - RNA, 23 nt, Mycobacterium bovis subsp bovis AF2122/97
ucgcgcccgccaucagcccggcg

SEQ ID NO: 1188979 - RNA, 21 nt, Mycobacterium bovis subsp bovis AF2122/97
ucgcgcccgcuaacuggcccg

SEQ ID NO: 1188980 - RNA, 18 nt, Mycobacterium bovis subsp bovis AF2122/97
ucgcgcaucgccuccucg

SEQ ID NO: 1188981 - RNA, 22 nt, Mycobacterium bovis subsp bovis AF2122/97
ucgcgccaggccacguagcagc

SEQ ID NO: 1188982 - RNA, 14 nt, Mycobacterium bovis subsp bovis AF2122/97
ucgcgccaggcgcg

SEQ ID NO: 1188983 - RNA, 19 nt, Mycobacterium bovis subsp bovis AF2122/97
ucgcgccaucgucgcgccg

SEQ ID NO: 1188984 - RNA, 11 nt, Mycobacterium bovis subsp bovis AF2122/97
ucgcggcggcg

SEQ ID NO: 1188985 - RNA, 23 nt, Mycobacterium bovis subsp bovis AF2122/97
ucgcggcggucccugaagccagc

SEQ ID NO: 1188986 - RNA, 16 nt, Mycobacterium bovis subsp bovis AF2122/97
ucgcggcgccgucguc

SEQ ID NO: 1188987 - RNA, 23 nt, Mycobacterium bovis subsp bovis AF2122/97
ucgcggcgacccggucgcggaac

SEQ ID NO: 1188988 - RNA, 20 nt, Mycobacterium bovis subsp bovis AF2122/97
ucgcggcccggcccuccggg

SEQ ID NO: 1188989 - RNA, 19 nt, Mycobacterium bovis subsp bovis AF2122/97
ucgcggccgagacggcguu

SEQ ID NO: 1188990 - RNA, 21 nt, Mycobacterium bovis subsp bovis AF2122/97
ucgcggccgcggccucccgca

SEQ ID NO: 1188991 - RNA, 20 nt, Mycobacterium bovis subsp bovis AF2122/97
ucgcggcuauggcgccgcgg

SEQ ID NO: 1188992 - RNA, 19 nt, Mycobacterium bovis subsp bovis AF2122/97
ucgcgggacaacagcaugg

SEQ ID NO: 1188993 - RNA, 23 nt, Mycobacterium bovis subsp bovis AF2122/97
ucgcgggcccgcgcggcgguguc

SEQ ID NO: 1188994 - RNA, 20 nt, Mycobacterium bovis subsp bovis AF2122/97
ucgcgggagaaaacggcggc

SEQ ID NO: 1188995 - RNA, 11 nt, Mycobacterium bovis subsp bovis AF2122/97
ucgcgggccga

SEQ ID NO: 1188996 - RNA, 16 nt, Mycobacterium bovis subsp bovis AF2122/97
ucgcgggccgaggccg

SEQ ID NO: 1188997 - RNA, 14 nt, Mycobacterium bovis subsp bovis AF2122/97
ucgcgggcggcgcu

SEQ ID NO: 1188998 - RNA, 18 nt, Mycobacterium bovis subsp bovis AF2122/97
ucgcgggguaggcccagc

SEQ ID NO: 1188999 - RNA, 15 nt, Mycobacterium bovis subsp bovis AF2122/97
ucgcgcugccggccg

SEQ ID NO: 1189000 - RNA, 23 nt, Mycobacterium bovis subsp bovis AF2122/97
ucgcgcugcggcccacaccagcg

SEQ ID NO: 1189001 - RNA, 15 nt, Mycobacterium bovis subsp bovis AF2122/97
ucgcgcugcgggaac

SEQ ID NO: 1189002 - RNA, 14 nt, Mycobacterium bovis subsp bovis AF2122/97
ucgcgcuggccaug

SEQ ID NO: 1189003 - RNA, 14 nt, Mycobacterium bovis subsp bovis AF2122/97
ucgcgcuugaaacu

SEQ ID NO: 1189004 - RNA, 20 nt, Mycobacterium bovis subsp bovis AF2122/97
ucgcgcuggcgccggccagc

SEQ ID NO: 1189005 - RNA, 20 nt, Mycobacterium bovis subsp bovis AF2122/97
ucgcggaacucgucgcugcc

SEQ ID NO: 1189006 - RNA, 22 nt, Mycobacterium bovis subsp bovis AF2122/97
ucgcgcuugcgccgcccaugcc

SEQ ID NO: 1189007 - RNA, 17 nt, Mycobacterium bovis subsp bovis AF2122/97
ucgcggaagugucgucg

SEQ ID NO: 1189008 - RNA, 21 nt, Mycobacterium bovis subsp bovis AF2122/97
ucgcggauuucucgcccugag

SEQ ID NO: 1189009 - RNA, 16 nt, Mycobacterium bovis subsp bovis AF2122/97
ucgcggcacgcccaca

SEQ ID NO: 1189010 - RNA, 15 nt, Mycobacterium bovis subsp bovis AF2122/97
ucgcggaucagcccg

SEQ ID NO: 1189011 - RNA, 18 nt, Mycobacterium bovis subsp bovis AF2122/97
ucgcggagccaggacgac

SEQ ID NO: 1189012 - RNA, 14 nt, Mycobacterium bovis subsp bovis AF2122/97
ucgagcagcgcgcc

SEQ ID NO: 1189013 - RNA, 18 nt, Mycobacterium bovis subsp bovis AF2122/97
ucgagcaggcuggcugcc

SEQ ID NO: 1189014 - RNA, 15 nt, Mycobacterium bovis subsp bovis AF2122/97
ucgagcagcaccacc

SEQ ID NO: 1189015 - RNA, 17 nt, Mycobacterium bovis subsp bovis AF2122/97
ucgagcaccgacaccgg

SEQ ID NO: 1189016 - RNA, 19 nt, Mycobacterium bovis subsp bovis AF2122/97
ucgagcaccgacaccggcc

SEQ ID NO: 1189017 - RNA, 13 nt, Mycobacterium bovis subsp bovis AF2122/97
ucgagcaccaccc

SEQ ID NO: 1189018 - RNA, 20 nt, Mycobacterium bovis subsp bovis AF2122/97
ucgagccggauucggcugcc

SEQ ID NO: 1189019 - RNA, 17 nt, Mycobacterium bovis subsp bovis AF2122/97
ucgagauauugcgcgcc

SEQ ID NO: 1189020 - RNA, 16 nt, Mycobacterium bovis subsp bovis AF2122/97
ucgagacgagccacgg

SEQ ID NO: 1189021 - RNA, 19 nt, Mycobacterium bovis subsp bovis AF2122/97
ucgacgagcgccucaagcu

SEQ ID NO: 1189022 - RNA, 15 nt, Mycobacterium bovis subsp bovis AF2122/97
ucgacgaggucagcg

SEQ ID NO: 1189023 - RNA, 22 nt, Mycobacterium bovis subsp bovis AF2122/97
ucgacgaagaucuucaccggcc

SEQ ID NO: 1189024 - RNA, 13 nt, Mycobacterium bovis subsp bovis AF2122/97
ucgacgagcaccg

SEQ ID NO: 1189025 - RNA, 23 nt, Mycobacterium bovis subsp bovis AF2122/97
ucgaccugaggcaccucggccuu

SEQ ID NO: 1189026 - RNA, 15 nt, Mycobacterium bovis subsp bovis AF2122/97
ucgacgaugcgguca

SEQ ID NO: 1189027 - RNA, 16 nt, Mycobacterium bovis subsp bovis AF2122/97
ucgacgaucucuccug

SEQ ID NO: 1189028 - RNA, 15 nt, Mycobacterium bovis subsp bovis AF2122/97
ucgacggcgccgccc

SEQ ID NO: 1189029 - RNA, 22 nt, Mycobacterium bovis subsp bovis AF2122/97
ucgacggcggccuucggccggc

SEQ ID NO: 1189030 - RNA, 16 nt, Mycobacterium bovis subsp bovis AF2122/97
ucgacggugaucaggu

SEQ ID NO: 1189031 - RNA, 20 nt, Mycobacterium bovis subsp bovis AF2122/97
ucgacggguucacccugcca

SEQ ID NO: 1189032 - RNA, 15 nt, Mycobacterium bovis subsp bovis AF2122/97
ucgacucacacaccg

SEQ ID NO: 1189033 - RNA, 14 nt, Mycobacterium bovis subsp bovis AF2122/97
ucgacguuccagca

SEQ ID NO: 1189034 - RNA, 20 nt, Mycobacterium bovis subsp bovis AF2122/97
ucgacuacacauucauccac

SEQ ID NO: 1189035 - RNA, 18 nt, Mycobacterium bovis subsp bovis AF2122/97
ucgacgucagcaccaucc

SEQ ID NO: 1189036 - RNA, 15 nt, Mycobacterium bovis subsp bovis AF2122/97
ucgacggugccgucg

SEQ ID NO: 1189037 - RNA, 16 nt, Mycobacterium bovis subsp bovis AF2122/97
ucgacguaagugugcc

SEQ ID NO: 1189038 - RNA, 13 nt, Mycobacterium bovis subsp bovis AF2122/97
ucgaccaccgccg

SEQ ID NO: 1189039 - RNA, 15 nt, Mycobacterium bovis subsp bovis AF2122/97
ucgaccacgaccguc

SEQ ID NO: 1189040 - RNA, 22 nt, Mycobacterium bovis subsp bovis AF2122/97
ucgaccaagguguccagcaccu

SEQ ID NO: 1189041 - RNA, 18 nt, Mycobacterium bovis subsp bovis AF2122/97
ucgaccaucaucucggug

SEQ ID NO: 1189042 - RNA, 16 nt, Mycobacterium bovis subsp bovis AF2122/97
ucgacccacucaucag

SEQ ID NO: 1189043 - RNA, 17 nt, Mycobacterium bovis subsp bovis AF2122/97
ucgacccccugccacag

SEQ ID NO: 1189044 - RNA, 18 nt, Mycobacterium bovis subsp bovis AF2122/97
ucgacaggugccagacca

SEQ ID NO: 1189045 - RNA, 16 nt, Mycobacterium bovis subsp bovis AF2122/97
ucgacagcaucacgcc

SEQ ID NO: 1189046 - RNA, 19 nt, Mycobacterium bovis subsp bovis AF2122/97
ucgacaguugcgccagcgu

SEQ ID NO: 1189047 - RNA, 13 nt, Mycobacterium bovis subsp bovis AF2122/97
ucgacaucauccc

SEQ ID NO: 1189048 - RNA, 14 nt, Mycobacterium bovis subsp bovis AF2122/97
ucgaauuccggcuc

SEQ ID NO: 1189049 - RNA, 15 nt, Mycobacterium bovis subsp bovis AF2122/97
ucgaauuaaagccac

SEQ ID NO: 1189050 - RNA, 19 nt, Mycobacterium bovis subsp bovis AF2122/97
ucgaagaucgccugggggu

SEQ ID NO: 1189051 - RNA, 21 nt, Mycobacterium bovis subsp bovis AF2122/97
ucgaagaccgccuccaccgcc

SEQ ID NO: 1189052 - RNA, 17 nt, Mycobacterium bovis subsp bovis AF2122/97
uccuguugaucugcccu

SEQ ID NO: 1189053 - RNA, 20 nt, Mycobacterium bovis subsp bovis AF2122/97
ucgcagcagcaucugggggu

SEQ ID NO: 1189054 - RNA, 14 nt, Mycobacterium bovis subsp bovis AF2122/97
ucgcagcagaccac

SEQ ID NO: 1189055 - RNA, 14 nt, Mycobacterium bovis subsp bovis AF2122/97
ucgcaggauuccca

SEQ ID NO: 1189056 - RNA, 18 nt, Mycobacterium bovis subsp bovis AF2122/97
ucgcaggauucccagucc

SEQ ID NO: 1189057 - RNA, 12 nt, Mycobacterium bovis subsp bovis AF2122/97
ucgccagcggcg

SEQ ID NO: 1189058 - RNA, 14 nt, Mycobacterium bovis subsp bovis AF2122/97
ucgccagcggcgcg

SEQ ID NO: 1189059 - RNA, 14 nt, Mycobacterium bovis subsp bovis AF2122/97
ucgccagccugugc

SEQ ID NO: 1189060 - RNA, 15 nt, Mycobacterium bovis subsp bovis AF2122/97
ucgccaccaucaccg

SEQ ID NO: 1189061 - RNA, 15 nt, Mycobacterium bovis subsp bovis AF2122/97
ucgccacaccaugau

SEQ ID NO: 1189062 - RNA, 11 nt, Mycobacterium bovis subsp bovis AF2122/97
ucgccacaccc

SEQ ID NO: 1189063 - RNA, 22 nt, Mycobacterium bovis subsp bovis AF2122/97
ucgccacuguugaagaagcccg

SEQ ID NO: 1189064 - RNA, 18 nt, Mycobacterium bovis subsp bovis AF2122/97
ucgccacuguugaagaag

SEQ ID NO: 1189065 - RNA, 18 nt, Mycobacterium bovis subsp bovis AF2122/97
ucgccacggucgccgacc

SEQ ID NO: 1189066 - RNA, 12 nt, Mycobacterium bovis subsp bovis AF2122/97
ucgagcgcugcu

SEQ ID NO: 1189067 - RNA, 18 nt, Mycobacterium bovis subsp bovis AF2122/97
ucgagcgugcgcacggcg

SEQ ID NO: 1189068 - RNA, 13 nt, Mycobacterium bovis subsp bovis AF2122/97
ucgagcguggcga

SEQ ID NO: 1189069 - RNA, 20 nt, Mycobacterium bovis subsp bovis AF2122/97
ucgagcgcgccgcgcucgcc

SEQ ID NO: 1189070 - RNA, 21 nt, Mycobacterium bovis subsp bovis AF2122/97
ucgagcgcgccuucacgcugg

SEQ ID NO: 1189071 - RNA, 20 nt, Mycobacterium bovis subsp bovis AF2122/97
ucgagcgacccccagcgccc

SEQ ID NO: 1189072 - RNA, 16 nt, Mycobacterium bovis subsp bovis AF2122/97
ucgauacccaggaugu

SEQ ID NO: 1189073 - RNA, 18 nt, Mycobacterium bovis subsp bovis AF2122/97
ucgauccccgcaauuccc

SEQ ID NO: 1189074 - RNA, 19 nt, Mycobacterium bovis subsp bovis AF2122/97
ucgaucaucgaccuggcca

SEQ ID NO: 1189075 - RNA, 15 nt, Mycobacterium bovis subsp bovis AF2122/97
ucgaucaggccuugg

SEQ ID NO: 1189076 - RNA, 17 nt, Mycobacterium bovis subsp bovis AF2122/97
ucgaucaggggcccacc

SEQ ID NO: 1189077 - RNA, 21 nt, Mycobacterium bovis subsp bovis AF2122/97
ucgaucagcuccuguaacugc

SEQ ID NO: 1189078 - RNA, 20 nt, Mycobacterium bovis subsp bovis AF2122/97
ucgaugccguguucagcacc

SEQ ID NO: 1189079 - RNA, 15 nt, Mycobacterium bovis subsp bovis AF2122/97
ucgaugcugaacacg

SEQ ID NO: 1189080 - RNA, 20 nt, Mycobacterium bovis subsp bovis AF2122/97
ucgaugccgcguagcugguc

SEQ ID NO: 1189081 - RNA, 14 nt, Mycobacterium bovis subsp bovis AF2122/97
ucgaugaucugcuu

SEQ ID NO: 1189082 - RNA, 17 nt, Mycobacterium bovis subsp bovis AF2122/97
ucgaugagugacggucc

SEQ ID NO: 1189083 - RNA, 19 nt, Mycobacterium bovis subsp bovis AF2122/97
ucgaucgcggcgcccagga

SEQ ID NO: 1189084 - RNA, 20 nt, Mycobacterium bovis subsp bovis AF2122/97
ucgauguccucgauccgggc

SEQ ID NO: 1189085 - RNA, 23 nt, Mycobacterium bovis subsp bovis AF2122/97
ucgauggucucccggcugaugcc

SEQ ID NO: 1189086 - RNA, 18 nt, Mycobacterium bovis subsp bovis AF2122/97
ucgauggcguacagcacc

SEQ ID NO: 1189087 - RNA, 19 nt, Mycobacterium bovis subsp bovis AF2122/97
ucgauggcggccaccagcg

SEQ ID NO: 1189088 - RNA, 20 nt, Mycobacterium bovis subsp bovis AF2122/97
uccggccgucggcgggcaug

SEQ ID NO: 1189089 - RNA, 18 nt, Mycobacterium bovis subsp bovis AF2122/97
uccggccgucgggcagca

SEQ ID NO: 1189090 - RNA, 18 nt, Mycobacterium bovis subsp bovis AF2122/97
uccggcccaccagcgcag

SEQ ID NO: 1189091 - RNA, 19 nt, Mycobacterium bovis subsp bovis AF2122/97
uccggcccacuucccagga

SEQ ID NO: 1189092 - RNA, 13 nt, Mycobacterium bovis subsp bovis AF2122/97
uccggccagaccc

SEQ ID NO: 1189093 - RNA, 15 nt, Mycobacterium bovis subsp bovis AF2122/97
uccggcgccaccgcc

SEQ ID NO: 1189094 - RNA, 16 nt, Mycobacterium bovis subsp bovis AF2122/97
uccggcgccaccgccg

SEQ ID NO: 1189095 - RNA, 15 nt, Mycobacterium bovis subsp bovis AF2122/97
uccggcggaucuggg

SEQ ID NO: 1189096 - RNA, 12 nt, Mycobacterium bovis subsp bovis AF2122/97
uccggcgcaccu

SEQ ID NO: 1189097 - RNA, 22 nt, Mycobacterium bovis subsp bovis AF2122/97
uccggcgccaccgccgcugccg

SEQ ID NO: 1189098 - RNA, 23 nt, Mycobacterium bovis subsp bovis AF2122/97
uccggcggcgaagaagccggcaa

SEQ ID NO: 1189099 - RNA, 19 nt, Mycobacterium bovis subsp bovis AF2122/97
uccggcggccacgccggcg

SEQ ID NO: 1189100 - RNA, 15 nt, Mycobacterium bovis subsp bovis AF2122/97
uccggcggcagguag

SEQ ID NO: 1189101 - RNA, 20 nt, Mycobacterium bovis subsp bovis AF2122/97
uccggcggaaacaugugggu

SEQ ID NO: 1189102 - RNA, 22 nt, Mycobacterium bovis subsp bovis AF2122/97
uccggcggcagcggcgccgccu

SEQ ID NO: 1189103 - RNA, 18 nt, Mycobacterium bovis subsp bovis AF2122/97
uccggcucgucagguucc

SEQ ID NO: 1189104 - RNA, 17 nt, Mycobacterium bovis subsp bovis AF2122/97
uccggcgugcagcaccc

SEQ ID NO: 1189105 - RNA, 14 nt, Mycobacterium bovis subsp bovis AF2122/97
uccggcgugggcac

SEQ ID NO: 1189106 - RNA, 22 nt, Mycobacterium bovis subsp bovis AF2122/97
uccggcauaccgaacagcaccu

SEQ ID NO: 1189107 - RNA, 20 nt, Mycobacterium bovis subsp bovis AF2122/97
uccggccacucaacgaccug

SEQ ID NO: 1189108 - RNA, 14 nt, Mycobacterium bovis subsp bovis AF2122/97
uccggccacuccgg

SEQ ID NO: 1189109 - RNA, 18 nt, Mycobacterium bovis subsp bovis AF2122/97
uccggcaaccaccggccg

SEQ ID NO: 1189110 - RNA, 16 nt, Mycobacterium bovis subsp bovis AF2122/97
uccggcaagcacaccg

SEQ ID NO: 1189111 - RNA, 18 nt, Mycobacterium bovis subsp bovis AF2122/97
uccggcaagcacaccgcc

SEQ ID NO: 1189112 - RNA, 18 nt, Mycobacterium bovis subsp bovis AF2122/97
uccggaguuuaagacgcc

SEQ ID NO: 1189113 - RNA, 16 nt, Mycobacterium bovis subsp bovis AF2122/97
uccggaucccaccacc

SEQ ID NO: 1189114 - RNA, 14 nt, Mycobacterium bovis subsp bovis AF2122/97
uccgggcagaugau

SEQ ID NO: 1189115 - RNA, 13 nt, Mycobacterium bovis subsp bovis AF2122/97
uccgggcagcugg

SEQ ID NO: 1189116 - RNA, 16 nt, Mycobacterium bovis subsp bovis AF2122/97
uccgggccaugugggg

SEQ ID NO: 1189117 - RNA, 20 nt, Mycobacterium bovis subsp bovis AF2122/97
uccgggccauguggggaccu

SEQ ID NO: 1189118 - RNA, 18 nt, Mycobacterium bovis subsp bovis AF2122/97
uccgggccgagcgcacca

SEQ ID NO: 1189119 - RNA, 16 nt, Mycobacterium bovis subsp bovis AF2122/97
uccgggaccaggccaa

SEQ ID NO: 1189120 - RNA, 19 nt, Mycobacterium bovis subsp bovis AF2122/97
uccgggaccaggccaacgg

SEQ ID NO: 1189121 - RNA, 18 nt, Mycobacterium bovis subsp bovis AF2122/97
uccgggacuaccacccgc

SEQ ID NO: 1189122 - RNA, 19 nt, Mycobacterium bovis subsp bovis AF2122/97
uccggguuuugcgcggcca

SEQ ID NO: 1189123 - RNA, 14 nt, Mycobacterium bovis subsp bovis AF2122/97
uccgggguggacgg

SEQ ID NO: 1189124 - RNA, 16 nt, Mycobacterium bovis subsp bovis AF2122/97
uccgggcggccucccg

SEQ ID NO: 1189125 - RNA, 17 nt, Mycobacterium bovis subsp bovis AF2122/97
uccgggccuggccugcc

SEQ ID NO: 1189126 - RNA, 20 nt, Mycobacterium bovis subsp bovis AF2122/97
uccggggggauccagcaggc

SEQ ID NO: 1189127 - RNA, 23 nt, Mycobacterium bovis subsp bovis AF2122/97
uccggucgacuccagcaccagca

SEQ ID NO: 1189128 - RNA, 16 nt, Mycobacterium bovis subsp bovis AF2122/97
uccggucagcgcggcg

SEQ ID NO: 1189129 - RNA, 14 nt, Mycobacterium bovis subsp bovis AF2122/97
uccggucgccaagu

SEQ ID NO: 1189130 - RNA, 15 nt, Mycobacterium bovis subsp bovis AF2122/97
uccggucggccaggc

SEQ ID NO: 1189131 - RNA, 15 nt, Mycobacterium bovis subsp bovis AF2122/97
uccggucggcccaca

SEQ ID NO: 1189132 - RNA, 16 nt, Mycobacterium bovis subsp bovis AF2122/97
uccggucggcgggcac

SEQ ID NO: 1189133 - RNA, 15 nt, Mycobacterium bovis subsp bovis AF2122/97
uccggucggucucgg

SEQ ID NO: 1189134 - RNA, 20 nt, Mycobacterium bovis subsp bovis AF2122/97
uccgguggaauccaccagcc

SEQ ID NO: 1189135 - RNA, 17 nt, Mycobacterium bovis subsp bovis AF2122/97
uccgguggugcucgucg

SEQ ID NO: 1189136 - RNA, 15 nt, Mycobacterium bovis subsp bovis AF2122/97
uccgguucugggccu

SEQ ID NO: 1189137 - RNA, 14 nt, Mycobacterium bovis subsp bovis AF2122/97
uccgccaacaucuc

SEQ ID NO: 1189138 - RNA, 13 nt, Mycobacterium bovis subsp bovis AF2122/97
uccgcaggcccgc

SEQ ID NO: 1189139 - RNA, 20 nt, Mycobacterium bovis subsp bovis AF2122/97
uccgcagcguccagcgccug

SEQ ID NO: 1189140 - RNA, 15 nt, Mycobacterium bovis subsp bovis AF2122/97
uccgcagcgccaccc

SEQ ID NO: 1189141 - RNA, 22 nt, Mycobacterium bovis subsp bovis AF2122/97
uccgcagcgaagaccagcggcg

SEQ ID NO: 1189142 - RNA, 23 nt, Mycobacterium bovis subsp bovis AF2122/97
uccgcaacggauaacccguggcg

SEQ ID NO: 1189143 - RNA, 18 nt, Mycobacterium bovis subsp bovis AF2122/97
uccgcaaugaccuggccg

SEQ ID NO: 1189144 - RNA, 14 nt, Mycobacterium bovis subsp bovis AF2122/97
uccgcacagguccg

SEQ ID NO: 1189145 - RNA, 18 nt, Mycobacterium bovis subsp bovis AF2122/97
uccgcacagguccggguu

SEQ ID NO: 1189146 - RNA, 14 nt, Mycobacterium bovis subsp bovis AF2122/97
uccgcaccacgccc

SEQ ID NO: 1189147 - RNA, 23 nt, Mycobacterium bovis subsp bovis AF2122/97
uccgcacgaucggggaagccugc

SEQ ID NO: 1189148 - RNA, 12 nt, Mycobacterium bovis subsp bovis AF2122/97
uccgcacagcaa

SEQ ID NO: 1189149 - RNA, 21 nt, Mycobacterium bovis subsp bovis AF2122/97
uccgcacccggccgcgcaccc

SEQ ID NO: 1189150 - RNA, 22 nt, Mycobacterium bovis subsp bovis AF2122/97
uccgccuaagcauucagcgcgc

SEQ ID NO: 1189151 - RNA, 20 nt, Mycobacterium bovis subsp bovis AF2122/97
uccgccguugccgaucccca

SEQ ID NO: 1189152 - RNA, 22 nt, Mycobacterium bovis subsp bovis AF2122/97
uccgccguugccgauccccagg

SEQ ID NO: 1189153 - RNA, 15 nt, Mycobacterium bovis subsp bovis AF2122/97
uccgccguugccgcc

SEQ ID NO: 1189154 - RNA, 19 nt, Mycobacterium bovis subsp bovis AF2122/97
uccgccguugccgccgccu

SEQ ID NO: 1189155 - RNA, 14 nt, Mycobacterium bovis subsp bovis AF2122/97
uccgccgccggguu

SEQ ID NO: 1189156 - RNA, 16 nt, Mycobacterium bovis subsp bovis AF2122/97
uccgccgucgccgccg

SEQ ID NO: 1189157 - RNA, 17 nt, Mycobacterium bovis subsp bovis AF2122/97
uccgccgucgccgccgg

SEQ ID NO: 1189158 - RNA, 11 nt, Mycobacterium bovis subsp bovis AF2122/97
uccgccggcaa

SEQ ID NO: 1189159 - RNA, 14 nt, Mycobacterium bovis subsp bovis AF2122/97
uccgccccagcugc

SEQ ID NO: 1189160 - RNA, 21 nt, Mycobacterium bovis subsp bovis AF2122/97
uccgccgcgggcuccccggca

SEQ ID NO: 1189161 - RNA, 18 nt, Mycobacterium bovis subsp bovis AF2122/97
uccgccgccgccgggucg

SEQ ID NO: 1189162 - RNA, 20 nt, Mycobacterium bovis subsp bovis AF2122/97
uccgcccauucccagaggcc

SEQ ID NO: 1189163 - RNA, 19 nt, Mycobacterium bovis subsp bovis AF2122/97
uccgccauuucucguaccc

SEQ ID NO: 1189164 - RNA, 15 nt, Mycobacterium bovis subsp bovis AF2122/97
uccgccagaucucgc

SEQ ID NO: 1189165 - RNA, 14 nt, Mycobacterium bovis subsp bovis AF2122/97
uccgcucgccgcca

SEQ ID NO: 1189166 - RNA, 16 nt, Mycobacterium bovis subsp bovis AF2122/97
uccgcucguucgugca

SEQ ID NO: 1189167 - RNA, 23 nt, Mycobacterium bovis subsp bovis AF2122/97
uccgcguggugcugaccgcgccg

SEQ ID NO: 1189168 - RNA, 16 nt, Mycobacterium bovis subsp bovis AF2122/97
uccgcguccaaggcgc

SEQ ID NO: 1189169 - RNA, 13 nt, Mycobacterium bovis subsp bovis AF2122/97
uccgcgucgccgg

SEQ ID NO: 1189170 - RNA, 16 nt, Mycobacterium bovis subsp bovis AF2122/97
uccgcgucgccggccu

SEQ ID NO: 1189171 - RNA, 16 nt, Mycobacterium bovis subsp bovis AF2122/97
uccgcguugggcaccu

SEQ ID NO: 1189172 - RNA, 17 nt, Mycobacterium bovis subsp bovis AF2122/97
uccgcuaggucagguga

SEQ ID NO: 1189173 - RNA, 13 nt, Mycobacterium bovis subsp bovis AF2122/97
uccggaagcggcg

SEQ ID NO: 1189174 - RNA, 22 nt, Mycobacterium bovis subsp bovis AF2122/97
uccggacccacccgcaccgccg

SEQ ID NO: 1189175 - RNA, 15 nt, Mycobacterium bovis subsp bovis AF2122/97
uccgcgcagccaggg

SEQ ID NO: 1189176 - RNA, 14 nt, Mycobacterium bovis subsp bovis AF2122/97
uccgcgcgccggcg

SEQ ID NO: 1189177 - RNA, 18 nt, Mycobacterium bovis subsp bovis AF2122/97
uccgcggcauuggcgucg

SEQ ID NO: 1189178 - RNA, 20 nt, Mycobacterium bovis subsp bovis AF2122/97
uccgcggaucugguccagug

SEQ ID NO: 1189179 - RNA, 16 nt, Mycobacterium bovis subsp bovis AF2122/97
uccgcggaucaccauc

SEQ ID NO: 1189180 - RNA, 11 nt, Mycobacterium bovis subsp bovis AF2122/97
uccgcggcgca

SEQ ID NO: 1189181 - RNA, 21 nt, Mycobacterium bovis subsp bovis AF2122/97
uccgcggguuugaucuccacc

SEQ ID NO: 1189182 - RNA, 15 nt, Mycobacterium bovis subsp bovis AF2122/97
uccgcggcgcgcaac

SEQ ID NO: 1189183 - RNA, 16 nt, Mycobacterium bovis subsp bovis AF2122/97
uccgccugcuccugcg

SEQ ID NO: 1189184 - RNA, 13 nt, Mycobacterium bovis subsp bovis AF2122/97
uccgcgaaauagc

SEQ ID NO: 1189185 - RNA, 19 nt, Mycobacterium bovis subsp bovis AF2122/97
uccgcgaucugcagcgcgg

SEQ ID NO: 1189186 - RNA, 23 nt, Mycobacterium bovis subsp bovis AF2122/97
uccgcgaagugcuugggccgcug

SEQ ID NO: 1189187 - RNA, 19 nt, Mycobacterium bovis subsp bovis AF2122/97
uccgcgacguaguggaagc

SEQ ID NO: 1189188 - RNA, 14 nt, Mycobacterium bovis subsp bovis AF2122/97
uccugcccaccauc

SEQ ID NO: 1189189 - RNA, 19 nt, Mycobacterium bovis subsp bovis AF2122/97
uccugcccaccaucccgcu

SEQ ID NO: 1189190 - RNA, 15 nt, Mycobacterium bovis subsp bovis AF2122/97
uccugcccgucgucg

SEQ ID NO: 1189191 - RNA, 16 nt, Mycobacterium bovis subsp bovis AF2122/97
uccugggccgccgccc

SEQ ID NO: 1189192 - RNA, 21 nt, Mycobacterium bovis subsp bovis AF2122/97
uccugggccgccgcccugguc

SEQ ID NO: 1189193 - RNA, 14 nt, Mycobacterium bovis subsp bovis AF2122/97
uccugguggcagac

SEQ ID NO: 1189194 - RNA, 21 nt, Mycobacterium bovis subsp bovis AF2122/97
uccuggguguagcaagucgcc

SEQ ID NO: 1189195 - RNA, 21 nt, Mycobacterium bovis subsp bovis AF2122/97
uccuggccggugguagcggac

SEQ ID NO: 1189196 - RNA, 17 nt, Mycobacterium bovis subsp bovis AF2122/97
uccuggcguagugcagc

SEQ ID NO: 1189197 - RNA, 14 nt, Mycobacterium bovis subsp bovis AF2122/97
uccuggcgugagcc

SEQ ID NO: 1189198 - RNA, 13 nt, Mycobacterium bovis subsp bovis AF2122/97
uccuggcggcugc

SEQ ID NO: 1189199 - RNA, 12 nt, Mycobacterium bovis subsp bovis AF2122/97
uccucgaccguc

SEQ ID NO: 1189200 - RNA, 16 nt, Mycobacterium bovis subsp bovis AF2122/97
uccucgacgaggagcc

SEQ ID NO: 1189201 - RNA, 14 nt, Mycobacterium bovis subsp bovis AF2122/97
uccucgaagaacug

SEQ ID NO: 1189202 - RNA, 19 nt, Mycobacterium bovis subsp bovis AF2122/97
uccucgauauggguugcca

SEQ ID NO: 1189203 - RNA, 17 nt, Mycobacterium bovis subsp bovis AF2122/97
uccucgagugccgccgu

SEQ ID NO: 1189204 - RNA, 19 nt, Mycobacterium bovis subsp bovis AF2122/97
uccucgccgcacgccggca

SEQ ID NO: 1189205 - RNA, 20 nt, Mycobacterium bovis subsp bovis AF2122/97
uccucgcccauuggccaggu

SEQ ID NO: 1189206 - RNA, 15 nt, Mycobacterium bovis subsp bovis AF2122/97
uccucgcgagcuccc

SEQ ID NO: 1189207 - RNA, 20 nt, Mycobacterium bovis subsp bovis AF2122/97
uccucgaugcgggcgcccca

SEQ ID NO: 1189208 - RNA, 22 nt, Mycobacterium bovis subsp bovis AF2122/97
uccucggugugcucgccgacca

SEQ ID NO: 1189209 - RNA, 20 nt, Mycobacterium bovis subsp bovis AF2122/97
uccucggguucgucagucaa

SEQ ID NO: 1189210 - RNA, 13 nt, Mycobacterium bovis subsp bovis AF2122/97
uccucggucacga

SEQ ID NO: 1189211 - RNA, 13 nt, Mycobacterium bovis subsp bovis AF2122/97
uccucggucagcu

SEQ ID NO: 1189212 - RNA, 15 nt, Mycobacterium bovis subsp bovis AF2122/97
uccucggccacccgc

SEQ ID NO: 1189213 - RNA, 15 nt, Mycobacterium bovis subsp bovis AF2122/97
uccucgucuucgucg

SEQ ID NO: 1189214 - RNA, 14 nt, Mycobacterium bovis subsp bovis AF2122/97
uccugaccagccag

SEQ ID NO: 1189215 - RNA, 19 nt, Mycobacterium bovis subsp bovis AF2122/97
uccucaaggucggccaggc

SEQ ID NO: 1189216 - RNA, 20 nt, Mycobacterium bovis subsp bovis AF2122/97
uccucaaggucggccaggcu

SEQ ID NO: 1189217 - RNA, 23 nt, Mycobacterium bovis subsp bovis AF2122/97
uccucagccaucucuugcaaccu

SEQ ID NO: 1189218 - RNA, 22 nt, Mycobacterium bovis subsp bovis AF2122/97
uccuccaaggcggucaccaccg

SEQ ID NO: 1189219 - RNA, 16 nt, Mycobacterium bovis subsp bovis AF2122/97
uccuccugcgccgcag

SEQ ID NO: 1189220 - RNA, 23 nt, Mycobacterium bovis subsp bovis AF2122/97
uccuccuggaugaaguguuuggc

SEQ ID NO: 1189221 - RNA, 18 nt, Mycobacterium bovis subsp bovis AF2122/97
uccuccggguuggcgacg

SEQ ID NO: 1189222 - RNA, 17 nt, Mycobacterium bovis subsp bovis AF2122/97
uccgucgagucgccgag

SEQ ID NO: 1189223 - RNA, 15 nt, Mycobacterium bovis subsp bovis AF2122/97
uccgucggccaggcc

SEQ ID NO: 1189224 - RNA, 19 nt, Mycobacterium bovis subsp bovis AF2122/97
uccgucggccaggccacgg

SEQ ID NO: 1189225 - RNA, 24 nt, Mycobacterium bovis subsp bovis AF2122/97
uccgugccgagcuucagcgcgcug

SEQ ID NO: 1189226 - RNA, 17 nt, Mycobacterium bovis subsp bovis AF2122/97
uccgucugacccaccgc

SEQ ID NO: 1189227 - RNA, 17 nt, Mycobacterium bovis subsp bovis AF2122/97
uccgugaauggcagcac

SEQ ID NO: 1189228 - RNA, 13 nt, Mycobacterium bovis subsp bovis AF2122/97
uccguugccccca

SEQ ID NO: 1189229 - RNA, 20 nt, Mycobacterium bovis subsp bovis AF2122/97
ucccgauccugcccaccauc

SEQ ID NO: 1189230 - RNA, 17 nt, Mycobacterium bovis subsp bovis AF2122/97
ucccgaucccggccagc

SEQ ID NO: 1189231 - RNA, 20 nt, Mycobacterium bovis subsp bovis AF2122/97
ucccgauguaugacagguca

SEQ ID NO: 1189232 - RNA, 21 nt, Mycobacterium bovis subsp bovis AF2122/97
ucccgcaaugcgagcgcgccg

SEQ ID NO: 1189233 - RNA, 17 nt, Mycobacterium bovis subsp bovis AF2122/97
ucccgcaaaccgguccg

SEQ ID NO: 1189234 - RNA, 19 nt, Mycobacterium bovis subsp bovis AF2122/97
ucccgacccugcugcaggg

SEQ ID NO: 1189235 - RNA, 13 nt, Mycobacterium bovis subsp bovis AF2122/97
ucccgagccacaa

SEQ ID NO: 1189236 - RNA, 15 nt, Mycobacterium bovis subsp bovis AF2122/97
ucccgacgucggccu

SEQ ID NO: 1189237 - RNA, 19 nt, Mycobacterium bovis subsp bovis AF2122/97
ucccgaguugcccucuggc

SEQ ID NO: 1189238 - RNA, 15 nt, Mycobacterium bovis subsp bovis AF2122/97
ucccgccgaucgaac

SEQ ID NO: 1189239 - RNA, 14 nt, Mycobacterium bovis subsp bovis AF2122/97
ucccgccgccugga

SEQ ID NO: 1189240 - RNA, 23 nt, Mycobacterium bovis subsp bovis AF2122/97
ucccgccuucucccgcacggccg

SEQ ID NO: 1189241 - RNA, 22 nt, Mycobacterium bovis subsp bovis AF2122/97
ucccgccguugccgccgucacc

SEQ ID NO: 1189242 - RNA, 18 nt, Mycobacterium bovis subsp bovis AF2122/97
ucccgcacggccgggucg

SEQ ID NO: 1189243 - RNA, 23 nt, Mycobacterium bovis subsp bovis AF2122/97
ucccgcaugcacgucaucggcug

SEQ ID NO: 1189244 - RNA, 23 nt, Mycobacterium bovis subsp bovis AF2122/97
uccccgguucugcgcccacccgc

SEQ ID NO: 1189245 - RNA, 21 nt, Mycobacterium bovis subsp bovis AF2122/97
uccccguugacccagaccggc

SEQ ID NO: 1189246 - RNA, 22 nt, Mycobacterium bovis subsp bovis AF2122/97
uccccgguacgucgagggugac

SEQ ID NO: 1189247 - RNA, 19 nt, Mycobacterium bovis subsp bovis AF2122/97
ucccgaaucucacccacau

SEQ ID NO: 1189248 - RNA, 21 nt, Mycobacterium bovis subsp bovis AF2122/97
ucccgaacacuuugcgcacua

SEQ ID NO: 1189249 - RNA, 13 nt, Mycobacterium bovis subsp bovis AF2122/97
uccccuggccagc

SEQ ID NO: 1189250 - RNA, 20 nt, Mycobacterium bovis subsp bovis AF2122/97
uccccuguugcagaaaaccc

SEQ ID NO: 1189251 - RNA, 13 nt, Mycobacterium bovis subsp bovis AF2122/97
uccccucggccgc

SEQ ID NO: 1189252 - RNA, 18 nt, Mycobacterium bovis subsp bovis AF2122/97
ucccgggcaguccaggca

SEQ ID NO: 1189253 - RNA, 23 nt, Mycobacterium bovis subsp bovis AF2122/97
ucccggcggucagcggcucggcg

SEQ ID NO: 1189254 - RNA, 16 nt, Mycobacterium bovis subsp bovis AF2122/97
ucccggcggucagcgg

SEQ ID NO: 1189255 - RNA, 14 nt, Mycobacterium bovis subsp bovis AF2122/97
ucccggcggucagc

SEQ ID NO: 1189256 - RNA, 16 nt, Mycobacterium bovis subsp bovis AF2122/97
ucccggcucggccagc

SEQ ID NO: 1189257 - RNA, 14 nt, Mycobacterium bovis subsp bovis AF2122/97
ucccggcuggggcc

SEQ ID NO: 1189258 - RNA, 14 nt, Mycobacterium bovis subsp bovis AF2122/97
ucccggcgccgcgg

SEQ ID NO: 1189259 - RNA, 13 nt, Mycobacterium bovis subsp bovis AF2122/97
ucccggccaggcc

SEQ ID NO: 1189260 - RNA, 18 nt, Mycobacterium bovis subsp bovis AF2122/97
ucccggcgaccggguccg

SEQ ID NO: 1189261 - RNA, 15 nt, Mycobacterium bovis subsp bovis AF2122/97
ucccggccucgaugu

SEQ ID NO: 1189262 - RNA, 23 nt, Mycobacterium bovis subsp bovis AF2122/97
ucccggccucgaugucgcggucg

SEQ ID NO: 1189263 - RNA, 12 nt, Mycobacterium bovis subsp bovis AF2122/97
ucccggccaggg

SEQ ID NO: 1189264 - RNA, 12 nt, Mycobacterium bovis subsp bovis AF2122/97
ucccgcgcggcg

SEQ ID NO: 1189265 - RNA, 15 nt, Mycobacterium bovis subsp bovis AF2122/97
ucccgcgccggcguu

SEQ ID NO: 1189266 - RNA, 14 nt, Mycobacterium bovis subsp bovis AF2122/97
ucccgcgcgagccg

SEQ ID NO: 1189267 - RNA, 20 nt, Mycobacterium bovis subsp bovis AF2122/97
ucccgcggucgaucaggccg

SEQ ID NO: 1189268 - RNA, 21 nt, Mycobacterium bovis subsp bovis AF2122/97
ucccgcucagcauucaccaaa

SEQ ID NO: 1189269 - RNA, 13 nt, Mycobacterium bovis subsp bovis AF2122/97
ucccgcucgcagg

SEQ ID NO: 1189270 - RNA, 14 nt, Mycobacterium bovis subsp bovis AF2122/97
ucccggacgugccg

SEQ ID NO: 1189271 - RNA, 17 nt, Mycobacterium bovis subsp bovis AF2122/97
ucccggauauugccauc

SEQ ID NO: 1189272 - RNA, 21 nt, Mycobacterium bovis subsp bovis AF2122/97
ucccggauauugccaucccuc

SEQ ID NO: 1189273 - RNA, 14 nt, Mycobacterium bovis subsp bovis AF2122/97
ucccgucgccgccc

SEQ ID NO: 1189274 - RNA, 16 nt, Mycobacterium bovis subsp bovis AF2122/97
ucccguacgccggcgg

SEQ ID NO: 1189275 - RNA, 15 nt, Mycobacterium bovis subsp bovis AF2122/97
ucccgguguccagcc

SEQ ID NO: 1189276 - RNA, 17 nt, Mycobacterium bovis subsp bovis AF2122/97
ucccgggggcacuccgg

SEQ ID NO: 1189277 - RNA, 20 nt, Mycobacterium bovis subsp bovis AF2122/97
ucccgggugcgacgcgaccg

SEQ ID NO: 1189278 - RNA, 19 nt, Mycobacterium bovis subsp bovis AF2122/97
ucccgguccuucuccagau

SEQ ID NO: 1189279 - RNA, 21 nt, Mycobacterium bovis subsp bovis AF2122/97
ucccggucgguguggacuggg

SEQ ID NO: 1189280 - RNA, 17 nt, Mycobacterium bovis subsp bovis AF2122/97
ucccguugccgcccacu

SEQ ID NO: 1189281 - RNA, 18 nt, Mycobacterium bovis subsp bovis AF2122/97
ucccguugccgcccacua

SEQ ID NO: 1189282 - RNA, 22 nt, Mycobacterium bovis subsp bovis AF2122/97
ucccguucggggccccgcggcg

SEQ ID NO: 1189283 - RNA, 20 nt, Mycobacterium bovis subsp bovis AF2122/97
ucccuggggccguccggcuu

SEQ ID NO: 1189284 - RNA, 16 nt, Mycobacterium bovis subsp bovis AF2122/97
ucccuggccgccgccg

SEQ ID NO: 1189285 - RNA, 17 nt, Mycobacterium bovis subsp bovis AF2122/97
ucccucaugcuggaagu

SEQ ID NO: 1189286 - RNA, 23 nt, Mycobacterium bovis subsp bovis AF2122/97
ucccucaguguacaccgcgcccg

SEQ ID NO: 1189287 - RNA, 14 nt, Mycobacterium bovis subsp bovis AF2122/97
ucccucgacagugc

SEQ ID NO: 1189288 - RNA, 11 nt, Mycobacterium bovis subsp bovis AF2122/97
ucccuuuucca

SEQ ID NO: 1189289 - RNA, 22 nt, Mycobacterium bovis subsp bovis AF2122/97
ucccugugccagcagcagcgcc

SEQ ID NO: 1189290 - RNA, 13 nt, Mycobacterium bovis subsp bovis AF2122/97
uccgagccgcgau

SEQ ID NO: 1189291 - RNA, 16 nt, Mycobacterium bovis subsp bovis AF2122/97
uccgagcuuggccgcc

SEQ ID NO: 1189292 - RNA, 22 nt, Mycobacterium bovis subsp bovis AF2122/97
uccgagcggcccuucaccagcc

SEQ ID NO: 1189293 - RNA, 22 nt, Mycobacterium bovis subsp bovis AF2122/97
uccgagcgcggcggcggaggcu

SEQ ID NO: 1189294 - RNA, 20 nt, Mycobacterium bovis subsp bovis AF2122/97
uccgaucaugucggccgggg

SEQ ID NO: 1189295 - RNA, 19 nt, Mycobacterium bovis subsp bovis AF2122/97
uccgagggaacggugcaca

SEQ ID NO: 1189296 - RNA, 15 nt, Mycobacterium bovis subsp bovis AF2122/97
uccgauuggcgaucu

SEQ ID NO: 1189297 - RNA, 17 nt, Mycobacterium bovis subsp bovis AF2122/97
uccgauuggugucggug

SEQ ID NO: 1189298 - RNA, 19 nt, Mycobacterium bovis subsp bovis AF2122/97
uccgaugcaucggugcagc

SEQ ID NO: 1189299 - RNA, 20 nt, Mycobacterium bovis subsp bovis AF2122/97
uccgaugcaucggugcagcc

SEQ ID NO: 1189300 - RNA, 13 nt, Mycobacterium bovis subsp bovis AF2122/97
uccgaucgcagac

SEQ ID NO: 1189301 - RNA, 14 nt, Mycobacterium bovis subsp bovis AF2122/97
uccgauuccgaacu

SEQ ID NO: 1189302 - RNA, 16 nt, Mycobacterium bovis subsp bovis AF2122/97
uccgauccgcacagca

SEQ ID NO: 1189303 - RNA, 18 nt, Mycobacterium bovis subsp bovis AF2122/97
uccgaugguaugcccgcc

SEQ ID NO: 1189304 - RNA, 18 nt, Mycobacterium bovis subsp bovis AF2122/97
uccgaacauggccagcau

SEQ ID NO: 1189305 - RNA, 22 nt, Mycobacterium bovis subsp bovis AF2122/97
uccgaacggguagacccacauc

SEQ ID NO: 1189306 - RNA, 21 nt, Mycobacterium bovis subsp bovis AF2122/97
uccgacccaacgaccaccacc

SEQ ID NO: 1189307 - RNA, 23 nt, Mycobacterium bovis subsp bovis AF2122/97
uccgaccgauaacacccgggcca

SEQ ID NO: 1189308 - RNA, 12 nt, Mycobacterium bovis subsp bovis AF2122/97
uccgacaguccg

SEQ ID NO: 1189309 - RNA, 21 nt, Mycobacterium bovis subsp bovis AF2122/97
uccgacaguccgcgccggcgg

SEQ ID NO: 1189310 - RNA, 13 nt, Mycobacterium bovis subsp bovis AF2122/97
uccgacaugaacc

SEQ ID NO: 1189311 - RNA, 24 nt, Mycobacterium bovis subsp bovis AF2122/97
uccgacuggccccgccagcggcag

SEQ ID NO: 1189312 - RNA, 22 nt, Mycobacterium bovis subsp bovis AF2122/97
uccgacgggccgucgccgucca

SEQ ID NO: 1189313 - RNA, 16 nt, Mycobacterium bovis subsp bovis AF2122/97
uccgacgggggucggg

SEQ ID NO: 1189314 - RNA, 22 nt, Mycobacterium bovis subsp bovis AF2122/97
uccgacgguguagccgccggca

SEQ ID NO: 1189315 - RNA, 23 nt, Mycobacterium bovis subsp bovis AF2122/97
uccgacgguguagccgccggcag

SEQ ID NO: 1189316 - RNA, 15 nt, Mycobacterium bovis subsp bovis AF2122/97
uccccgcgcugagca

SEQ ID NO: 1189317 - RNA, 14 nt, Mycobacterium bovis subsp bovis AF2122/97
uccccgcagcgccu

SEQ ID NO: 1189318 - RNA, 19 nt, Mycobacterium bovis subsp bovis AF2122/97
uccccccguugccgccguu

SEQ ID NO: 1189319 - RNA, 16 nt, Mycobacterium bovis subsp bovis AF2122/97
uccccccguugccgcc

SEQ ID NO: 1189320 - RNA, 17 nt, Mycobacterium bovis subsp bovis AF2122/97
ucccccgccaaccccaa

SEQ ID NO: 1189321 - RNA, 18 nt, Mycobacterium bovis subsp bovis AF2122/97
ucccccggguccgccguu

SEQ ID NO: 1189322 - RNA, 16 nt, Mycobacterium bovis subsp bovis AF2122/97
uccccgaccgcgcccg

SEQ ID NO: 1189323 - RNA, 23 nt, Mycobacterium bovis subsp bovis AF2122/97
uccccaugcagcgcgucgccgaa

SEQ ID NO: 1189324 - RNA, 18 nt, Mycobacterium bovis subsp bovis AF2122/97
ucccccagccgcggcgcc

SEQ ID NO: 1189325 - RNA, 15 nt, Mycobacterium bovis subsp bovis AF2122/97
uccccacauggcccg

SEQ ID NO: 1189326 - RNA, 16 nt, Mycobacterium bovis subsp bovis AF2122/97
uccccaggugggcagc

SEQ ID NO: 1189327 - RNA, 22 nt, Mycobacterium bovis subsp bovis AF2122/97
uccccaggugggcagcaggccc

SEQ ID NO: 1189328 - RNA, 18 nt, Mycobacterium bovis subsp bovis AF2122/97
uccccagaccggcggcua

SEQ ID NO: 1189329 - RNA, 11 nt, Mycobacterium bovis subsp bovis AF2122/97
ucccagcgccg

SEQ ID NO: 1189330 - RNA, 19 nt, Mycobacterium bovis subsp bovis AF2122/97
ucccagcgccgcacagaaa

SEQ ID NO: 1189331 - RNA, 14 nt, Mycobacterium bovis subsp bovis AF2122/97
ucccagccaacccg

SEQ ID NO: 1189332 - RNA, 16 nt, Mycobacterium bovis subsp bovis AF2122/97
ucccagaggcccgcgg

SEQ ID NO: 1189333 - RNA, 14 nt, Mycobacterium bovis subsp bovis AF2122/97
ucccauucccaaca

SEQ ID NO: 1189334 - RNA, 21 nt, Mycobacterium bovis subsp bovis AF2122/97
uccauggacggccaggugcag

SEQ ID NO: 1189335 - RNA, 15 nt, Mycobacterium bovis subsp bovis AF2122/97
uccaugacaaaccug

SEQ ID NO: 1189336 - RNA, 16 nt, Mycobacterium bovis subsp bovis AF2122/97
uccaugacaaaccugc

SEQ ID NO: 1189337 - RNA, 13 nt, Mycobacterium bovis subsp bovis AF2122/97
uccaugucgucga

SEQ ID NO: 1189338 - RNA, 14 nt, Mycobacterium bovis subsp bovis AF2122/97
uccaugugcccagg

SEQ ID NO: 1189339 - RNA, 21 nt, Mycobacterium bovis subsp bovis AF2122/97
uccauguuuugcugcaugccg

SEQ ID NO: 1189340 - RNA, 17 nt, Mycobacterium bovis subsp bovis AF2122/97
uccauucauggccgcga

SEQ ID NO: 1189341 - RNA, 18 nt, Mycobacterium bovis subsp bovis AF2122/97
uccauuggaaccugaucc

SEQ ID NO: 1189342 - RNA, 22 nt, Mycobacterium bovis subsp bovis AF2122/97
ucccaaucgggaucgcugccag

SEQ ID NO: 1189343 - RNA, 17 nt, Mycobacterium bovis subsp bovis AF2122/97
ucccaacccaugaugug

SEQ ID NO: 1189344 - RNA, 22 nt, Mycobacterium bovis subsp bovis AF2122/97
ucccaaccgguggccggucguu

SEQ ID NO: 1189345 - RNA, 14 nt, Mycobacterium bovis subsp bovis AF2122/97
ucccacuggagguc

SEQ ID NO: 1189346 - RNA, 23 nt, Mycobacterium bovis subsp bovis AF2122/97
ucccacggccggccgcugccacu

SEQ ID NO: 1189347 - RNA, 14 nt, Mycobacterium bovis subsp bovis AF2122/97
ucccacgcccggcc

SEQ ID NO: 1189348 - RNA, 15 nt, Mycobacterium bovis subsp bovis AF2122/97
ucccacgccgccguu

SEQ ID NO: 1189349 - RNA, 13 nt, Mycobacterium bovis subsp bovis AF2122/97
ucccacccggccu

SEQ ID NO: 1189350 - RNA, 14 nt, Mycobacterium bovis subsp bovis AF2122/97
ucccaccaccaccg

SEQ ID NO: 1189351 - RNA, 22 nt, Mycobacterium bovis subsp bovis AF2122/97
ucccaccaccgcucgucguccg

SEQ ID NO: 1189352 - RNA, 20 nt, Mycobacterium bovis subsp bovis AF2122/97
ucccacagguagaccgucuc

SEQ ID NO: 1189353 - RNA, 13 nt, Mycobacterium bovis subsp bovis AF2122/97
uccaucaugugcg

SEQ ID NO: 1189354 - RNA, 13 nt, Mycobacterium bovis subsp bovis AF2122/97
uccaucacaucca

SEQ ID NO: 1189355 - RNA, 19 nt, Mycobacterium bovis subsp bovis AF2122/97
uccaucacauccacgcacu

SEQ ID NO: 1189356 - RNA, 17 nt, Mycobacterium bovis subsp bovis AF2122/97
uccaucacggaccaggc

SEQ ID NO: 1189357 - RNA, 12 nt, Mycobacterium bovis subsp bovis AF2122/97
uccaggucuggg

SEQ ID NO: 1189358 - RNA, 21 nt, Mycobacterium bovis subsp bovis AF2122/97
uccagguggcgcggacccgcc

SEQ ID NO: 1189359 - RNA, 19 nt, Mycobacterium bovis subsp bovis AF2122/97
uccagguucuucuccacca

SEQ ID NO: 1189360 - RNA, 14 nt, Mycobacterium bovis subsp bovis AF2122/97
uccaguaaccgucc

SEQ ID NO: 1189361 - RNA, 18 nt, Mycobacterium bovis subsp bovis AF2122/97
uccaguggcagccagcgg

SEQ ID NO: 1189362 - RNA, 19 nt, Mycobacterium bovis subsp bovis AF2122/97
uccagcagguccgcggccg

SEQ ID NO: 1189363 - RNA, 19 nt, Mycobacterium bovis subsp bovis AF2122/97
uccagcagcgacgcugccg

SEQ ID NO: 1189364 - RNA, 21 nt, Mycobacterium bovis subsp bovis AF2122/97
uccagcagcgacgcugccgcc

SEQ ID NO: 1189365 - RNA, 14 nt, Mycobacterium bovis subsp bovis AF2122/97
uccagcagcgccuc

SEQ ID NO: 1189366 - RNA, 19 nt, Mycobacterium bovis subsp bovis AF2122/97
uccagcaggacggugaagc

SEQ ID NO: 1189367 - RNA, 16 nt, Mycobacterium bovis subsp bovis AF2122/97
uccagccgcgcguccg

SEQ ID NO: 1189368 - RNA, 15 nt, Mycobacterium bovis subsp bovis AF2122/97
uccagccgcgcgccg

SEQ ID NO: 1189369 - RNA, 18 nt, Mycobacterium bovis subsp bovis AF2122/97
uccagccgcgcguccggg

SEQ ID NO: 1189370 - RNA, 22 nt, Mycobacterium bovis subsp bovis AF2122/97
uccagccgcgcguccgggcagc

SEQ ID NO: 1189371 - RNA, 22 nt, Mycobacterium bovis subsp bovis AF2122/97
uccagccgacguaccagggugu

SEQ ID NO: 1189372 - RNA, 15 nt, Mycobacterium bovis subsp bovis AF2122/97
uccagccacagcccg

SEQ ID NO: 1189373 - RNA, 23 nt, Mycobacterium bovis subsp bovis AF2122/97
uccagcccaugcgccacgccacu

SEQ ID NO: 1189374 - RNA, 12 nt, Mycobacterium bovis subsp bovis AF2122/97
uccagccaggcc

SEQ ID NO: 1189375 - RNA, 12 nt, Mycobacterium bovis subsp bovis AF2122/97
uccagccaggcg

SEQ ID NO: 1189376 - RNA, 14 nt, Mycobacterium bovis subsp bovis AF2122/97
uccagcgccgaccu

SEQ ID NO: 1189377 - RNA, 16 nt, Mycobacterium bovis subsp bovis AF2122/97
uccagcgccgcggccc

SEQ ID NO: 1189378 - RNA, 13 nt, Mycobacterium bovis subsp bovis AF2122/97
uccagcgcggccu

SEQ ID NO: 1189379 - RNA, 14 nt, Mycobacterium bovis subsp bovis AF2122/97
uccagcgcggccuu

SEQ ID NO: 1189380 - RNA, 13 nt, Mycobacterium bovis subsp bovis AF2122/97
uccagcgcgcgcc

SEQ ID NO: 1189381 - RNA, 21 nt, Mycobacterium bovis subsp bovis AF2122/97
uccagcgaaccgacccggccg

SEQ ID NO: 1189382 - RNA, 13 nt, Mycobacterium bovis subsp bovis AF2122/97
uccagccguggcg

SEQ ID NO: 1189383 - RNA, 16 nt, Mycobacterium bovis subsp bovis AF2122/97
uccagccgguccagac

SEQ ID NO: 1189384 - RNA, 21 nt, Mycobacterium bovis subsp bovis AF2122/97
uccagccgguccagacccagc

SEQ ID NO: 1189385 - RNA, 13 nt, Mycobacterium bovis subsp bovis AF2122/97
uccagcgcaccgg

SEQ ID NO: 1189386 - RNA, 20 nt, Mycobacterium bovis subsp bovis AF2122/97
uccagccggcgcgccggaug

SEQ ID NO: 1189387 - RNA, 13 nt, Mycobacterium bovis subsp bovis AF2122/97
uccaggccggcag

SEQ ID NO: 1189388 - RNA, 20 nt, Mycobacterium bovis subsp bovis AF2122/97
uccaggcgcgccgcacccgg

SEQ ID NO: 1189389 - RNA, 16 nt, Mycobacterium bovis subsp bovis AF2122/97
uccaggcgcgcaccac

SEQ ID NO: 1189390 - RNA, 16 nt, Mycobacterium bovis subsp bovis AF2122/97
uccagggcccugcugg

SEQ ID NO: 1189391 - RNA, 14 nt, Mycobacterium bovis subsp bovis AF2122/97
uccaggcugucgcg

SEQ ID NO: 1189392 - RNA, 17 nt, Mycobacterium bovis subsp bovis AF2122/97
uccaggcgcgcaccacc

SEQ ID NO: 1189393 - RNA, 21 nt, Mycobacterium bovis subsp bovis AF2122/97
uccaggcccauacgugccgcc

SEQ ID NO: 1189394 - RNA, 15 nt, Mycobacterium bovis subsp bovis AF2122/97
uccaggaauucccca

SEQ ID NO: 1189395 - RNA, 18 nt, Mycobacterium bovis subsp bovis AF2122/97
uccagcucgcugcgcgcc

SEQ ID NO: 1189396 - RNA, 17 nt, Mycobacterium bovis subsp bovis AF2122/97
uccagcucggccagugc

SEQ ID NO: 1189397 - RNA, 12 nt, Mycobacterium bovis subsp bovis AF2122/97
uccagcuggcau

SEQ ID NO: 1189398 - RNA, 16 nt, Mycobacterium bovis subsp bovis AF2122/97
uccagcugcgcgggcg

SEQ ID NO: 1189399 - RNA, 18 nt, Mycobacterium bovis subsp bovis AF2122/97
uccagcaaggccagcacg

SEQ ID NO: 1189400 - RNA, 15 nt, Mycobacterium bovis subsp bovis AF2122/97
uccagaugcccagca

SEQ ID NO: 1189401 - RNA, 16 nt, Mycobacterium bovis subsp bovis AF2122/97
uccagcacccgcugca

SEQ ID NO: 1189402 - RNA, 24 nt, Mycobacterium bovis subsp bovis AF2122/97
uccagcaccacggcgcgcgcgccg

SEQ ID NO: 1189403 - RNA, 18 nt, Mycobacterium bovis subsp bovis AF2122/97
uccagcaccagcacggca

SEQ ID NO: 1189404 - RNA, 18 nt, Mycobacterium bovis subsp bovis AF2122/97
uccagcacgccguccagg

SEQ ID NO: 1189405 - RNA, 17 nt, Mycobacterium bovis subsp bovis AF2122/97
uccagcagccaggagcc

SEQ ID NO: 1189406 - RNA, 16 nt, Mycobacterium bovis subsp bovis AF2122/97
uccagauaccaccgcc

SEQ ID NO: 1189407 - RNA, 15 nt, Mycobacterium bovis subsp bovis AF2122/97
uccagagacagcgcc

SEQ ID NO: 1189408 - RNA, 22 nt, Mycobacterium bovis subsp bovis AF2122/97
uccagaggccggcgggcucgcc

SEQ ID NO: 1189409 - RNA, 21 nt, Mycobacterium bovis subsp bovis AF2122/97
uccagacgccacugccagccg

SEQ ID NO: 1189410 - RNA, 21 nt, Mycobacterium bovis subsp bovis AF2122/97
uccagaccguagcggccggga

SEQ ID NO: 1189411 - RNA, 22 nt, Mycobacterium bovis subsp bovis AF2122/97
uccagaaugucgcggguggcuu

SEQ ID NO: 1189412 - RNA, 23 nt, Mycobacterium bovis subsp bovis AF2122/97
uccagaagaagaugaucgcgaac

SEQ ID NO: 1189413 - RNA, 19 nt, Mycobacterium bovis subsp bovis AF2122/97
uccagaaggccgcaccgcc

SEQ ID NO: 1189414 - RNA, 20 nt, Mycobacterium bovis subsp bovis AF2122/97
uccacuccccagccccaccc

SEQ ID NO: 1189415 - RNA, 15 nt, Mycobacterium bovis subsp bovis AF2122/97
uccacugaccagguc

SEQ ID NO: 1189416 - RNA, 21 nt, Mycobacterium bovis subsp bovis AF2122/97
uccacuggucaacgggaugcc

SEQ ID NO: 1189417 - RNA, 20 nt, Mycobacterium bovis subsp bovis AF2122/97
uccacugggccugccagucc

SEQ ID NO: 1189418 - RNA, 15 nt, Mycobacterium bovis subsp bovis AF2122/97
uccacgccgaccauc

SEQ ID NO: 1189419 - RNA, 13 nt, Mycobacterium bovis subsp bovis AF2122/97
uccacggccaggu

SEQ ID NO: 1189420 - RNA, 15 nt, Mycobacterium bovis subsp bovis AF2122/97
uccacgucgcggcgu

SEQ ID NO: 1189421 - RNA, 15 nt, Mycobacterium bovis subsp bovis AF2122/97
uccacgcaaacgggg

SEQ ID NO: 1189422 - RNA, 13 nt, Mycobacterium bovis subsp bovis AF2122/97
uccacgcaccacg

SEQ ID NO: 1189423 - RNA, 21 nt, Mycobacterium bovis subsp bovis AF2122/97
uccacgcaccacgagcagccg

SEQ ID NO: 1189424 - RNA, 18 nt, Mycobacterium bovis subsp bovis AF2122/97
uccacgcagcccgucggc

SEQ ID NO: 1189425 - RNA, 20 nt, Mycobacterium bovis subsp bovis AF2122/97
uccaccucggcguuggaaaa

SEQ ID NO: 1189426 - RNA, 22 nt, Mycobacterium bovis subsp bovis AF2122/97
uccaccgacguggccagcccgc

SEQ ID NO: 1189427 - RNA, 17 nt, Mycobacterium bovis subsp bovis AF2122/97
uccaccgcgccgucguc

SEQ ID NO: 1189428 - RNA, 22 nt, Mycobacterium bovis subsp bovis AF2122/97
uccaccgcgcggcgcagcaccg

SEQ ID NO: 1189429 - RNA, 21 nt, Mycobacterium bovis subsp bovis AF2122/97
uccaccgcagauccccgccac

SEQ ID NO: 1189430 - RNA, 13 nt, Mycobacterium bovis subsp bovis AF2122/97
uccaccgccacca

SEQ ID NO: 1189431 - RNA, 21 nt, Mycobacterium bovis subsp bovis AF2122/97
uccaccgacguggccagcccg

SEQ ID NO: 1189432 - RNA, 18 nt, Mycobacterium bovis subsp bovis AF2122/97
uccaccgaagccccuccc

SEQ ID NO: 1189433 - RNA, 16 nt, Mycobacterium bovis subsp bovis AF2122/97
uccaccgaccuaccgu

SEQ ID NO: 1189434 - RNA, 22 nt, Mycobacterium bovis subsp bovis AF2122/97
uccaccgaaaaguccgccgccu

SEQ ID NO: 1189435 - RNA, 17 nt, Mycobacterium bovis subsp bovis AF2122/97
uccaccguuagccaggu

SEQ ID NO: 1189436 - RNA, 16 nt, Mycobacterium bovis subsp bovis AF2122/97
uccaccgggcgucguc

SEQ ID NO: 1189437 - RNA, 19 nt, Mycobacterium bovis subsp bovis AF2122/97
uccacccacgaucagcagc

SEQ ID NO: 1189438 - RNA, 14 nt, Mycobacterium bovis subsp bovis AF2122/97
uccacccgccggcc

SEQ ID NO: 1189439 - RNA, 15 nt, Mycobacterium bovis subsp bovis AF2122/97
uccaccaccuggccg

SEQ ID NO: 1189440 - RNA, 19 nt, Mycobacterium bovis subsp bovis AF2122/97
uccaccacgucgggaugcc

SEQ ID NO: 1189441 - RNA, 19 nt, Mycobacterium bovis subsp bovis AF2122/97
uccacauggugaccauggc

SEQ ID NO: 1189442 - RNA, 16 nt, Mycobacterium bovis subsp bovis AF2122/97
uccacauaugucccau

SEQ ID NO: 1189443 - RNA, 10 nt, Mycobacterium bovis subsp bovis AF2122/97
uccacaucaa

SEQ ID NO: 1189444 - RNA, 13 nt, Mycobacterium bovis subsp bovis AF2122/97
uccacaucaaaac

SEQ ID NO: 1189445 - RNA, 20 nt, Mycobacterium bovis subsp bovis AF2122/97
uccaagcucgacaacugccc

SEQ ID NO: 1189446 - RNA, 20 nt, Mycobacterium bovis subsp bovis AF2122/97
uccaagcaauuccaccgccg

SEQ ID NO: 1189447 - RNA, 23 nt, Mycobacterium bovis subsp bovis AF2122/97
uccaagccgggugggagcagccg

SEQ ID NO: 1189448 - RNA, 19 nt, Mycobacterium bovis subsp bovis AF2122/97
uccaaggcgcgcugggcgc

SEQ ID NO: 1189449 - RNA, 17 nt, Mycobacterium bovis subsp bovis AF2122/97
uccaaggcucagcagcg

SEQ ID NO: 1189450 - RNA, 14 nt, Mycobacterium bovis subsp bovis AF2122/97
uccaagucacagcu

SEQ ID NO: 1189451 - RNA, 15 nt, Mycobacterium bovis subsp bovis AF2122/97
uccaagugggccggc

SEQ ID NO: 1189452 - RNA, 13 nt, Mycobacterium bovis subsp bovis AF2122/97
uccaacucggcca

SEQ ID NO: 1189453 - RNA, 18 nt, Mycobacterium bovis subsp bovis AF2122/97
uccaacucggcggccagc

SEQ ID NO: 1189454 - RNA, 15 nt, Mycobacterium bovis subsp bovis AF2122/97
uccaacuggccgcgu

SEQ ID NO: 1189455 - RNA, 17 nt, Mycobacterium bovis subsp bovis AF2122/97
uccaaugcuguggcccg

SEQ ID NO: 1189456 - RNA, 22 nt, Mycobacterium bovis subsp bovis AF2122/97
uccaauaucgcuuucgaagaac

SEQ ID NO: 1189457 - RNA, 17 nt, Mycobacterium bovis subsp bovis AF2122/97
uccacaaguaccgcauc

SEQ ID NO: 1189458 - RNA, 17 nt, Mycobacterium bovis subsp bovis AF2122/97
uccacaaauccaaaccu

SEQ ID NO: 1189459 - RNA, 14 nt, Mycobacterium bovis subsp bovis AF2122/97
uccacaacagcccg

SEQ ID NO: 1189460 - RNA, 22 nt, Mycobacterium bovis subsp bovis AF2122/97
ucaggggcuacuaggcccagca

SEQ ID NO: 1189461 - RNA, 20 nt, Mycobacterium bovis subsp bovis AF2122/97
ucaggucgccgagaccggcc

SEQ ID NO: 1189462 - RNA, 20 nt, Mycobacterium bovis subsp bovis AF2122/97
ucaggucguuugugaacacc

SEQ ID NO: 1189463 - RNA, 17 nt, Mycobacterium bovis subsp bovis AF2122/97
ucaggucgucacgcccc

SEQ ID NO: 1189464 - RNA, 20 nt, Mycobacterium bovis subsp bovis AF2122/97
ucaggucgucacgccccuca

SEQ ID NO: 1189465 - RNA, 16 nt, Mycobacterium bovis subsp bovis AF2122/97
ucaggucggggucaga

SEQ ID NO: 1189466 - RNA, 15 nt, Mycobacterium bovis subsp bovis AF2122/97
ucaggugcgcgacca

SEQ ID NO: 1189467 - RNA, 20 nt, Mycobacterium bovis subsp bovis AF2122/97
ucaggucuucgauggccaug

SEQ ID NO: 1189468 - RNA, 21 nt, Mycobacterium bovis subsp bovis AF2122/97
ucagggcgcaaaccacccgca

SEQ ID NO: 1189469 - RNA, 22 nt, Mycobacterium bovis subsp bovis AF2122/97
ucaggcccuuuucccugccuuc

SEQ ID NO: 1189470 - RNA, 22 nt, Mycobacterium bovis subsp bovis AF2122/97
ucaggccgacgucuaggccaaa

SEQ ID NO: 1189471 - RNA, 21 nt, Mycobacterium bovis subsp bovis AF2122/97
ucaggccgaugcgggucucga

SEQ ID NO: 1189472 - RNA, 16 nt, Mycobacterium bovis subsp bovis AF2122/97
ucaggcgaaccuggug

SEQ ID NO: 1189473 - RNA, 20 nt, Mycobacterium bovis subsp bovis AF2122/97
ucaggaucccgguggcagca

SEQ ID NO: 1189474 - RNA, 21 nt, Mycobacterium bovis subsp bovis AF2122/97
ucaggaucccgguggcagcac

SEQ ID NO: 1189475 - RNA, 21 nt, Mycobacterium bovis subsp bovis AF2122/97
ucaggcaacgaagagggcgcc

SEQ ID NO: 1189476 - RNA, 18 nt, Mycobacterium bovis subsp bovis AF2122/97
ucagcggauccagaaacu

SEQ ID NO: 1189477 - RNA, 16 nt, Mycobacterium bovis subsp bovis AF2122/97
ucagcgcguagccaau

SEQ ID NO: 1189478 - RNA, 13 nt, Mycobacterium bovis subsp bovis AF2122/97
ucagcgcggcgcg

SEQ ID NO: 1189479 - RNA, 22 nt, Mycobacterium bovis subsp bovis AF2122/97
ucagcgcggcgcgcaggaccug

SEQ ID NO: 1189480 - RNA, 19 nt, Mycobacterium bovis subsp bovis AF2122/97
ucagcgcguagccaaugcc

SEQ ID NO: 1189481 - RNA, 13 nt, Mycobacterium bovis subsp bovis AF2122/97
ucagcgcugagcc

SEQ ID NO: 1189482 - RNA, 15 nt, Mycobacterium bovis subsp bovis AF2122/97
ucagcggcagcaccg

SEQ ID NO: 1189483 - RNA, 14 nt, Mycobacterium bovis subsp bovis AF2122/97
ucagcggccaaccc

SEQ ID NO: 1189484 - RNA, 17 nt, Mycobacterium bovis subsp bovis AF2122/97
ucagcggccaacccauc

SEQ ID NO: 1189485 - RNA, 13 nt, Mycobacterium bovis subsp bovis AF2122/97
ucagcgggcagca

SEQ ID NO: 1189486 - RNA, 12 nt, Mycobacterium bovis subsp bovis AF2122/97
ucagcgguuggg

SEQ ID NO: 1189487 - RNA, 16 nt, Mycobacterium bovis subsp bovis AF2122/97
ucagcgguggcguggu

SEQ ID NO: 1189488 - RNA, 22 nt, Mycobacterium bovis subsp bovis AF2122/97
ucagcgucaggccuccaaaauc

SEQ ID NO: 1189489 - RNA, 21 nt, Mycobacterium bovis subsp bovis AF2122/97
ucagcgccgcgccccagacgc

SEQ ID NO: 1189490 - RNA, 22 nt, Mycobacterium bovis subsp bovis AF2122/97
ucagcgccgcauucgcgacaac

SEQ ID NO: 1189491 - RNA, 16 nt, Mycobacterium bovis subsp bovis AF2122/97
ucagcgcggcacggug

SEQ ID NO: 1189492 - RNA, 13 nt, Mycobacterium bovis subsp bovis AF2122/97
ucagcgccagcga

SEQ ID NO: 1189493 - RNA, 22 nt, Mycobacterium bovis subsp bovis AF2122/97
ucagcgcaucgccgcuggccag

SEQ ID NO: 1189494 - RNA, 20 nt, Mycobacterium bovis subsp bovis AF2122/97
ucagcgcaucgccgcuggcc

SEQ ID NO: 1189495 - RNA, 14 nt, Mycobacterium bovis subsp bovis AF2122/97
ucagcgcagcaucg

SEQ ID NO: 1189496 - RNA, 16 nt, Mycobacterium bovis subsp bovis AF2122/97
ucagcuuuaucggccc

SEQ ID NO: 1189497 - RNA, 19 nt, Mycobacterium bovis subsp bovis AF2122/97
ucagcucgaggaccaccug

SEQ ID NO: 1189498 - RNA, 18 nt, Mycobacterium bovis subsp bovis AF2122/97
ucagcucggcagcaucuc

SEQ ID NO: 1189499 - RNA, 21 nt, Mycobacterium bovis subsp bovis AF2122/97
ucagcuccuccgacagggccu

SEQ ID NO: 1189500 - RNA, 18 nt, Mycobacterium bovis subsp bovis AF2122/97
ucagcucaccacccagau

SEQ ID NO: 1189501 - RNA, 15 nt, Mycobacterium bovis subsp bovis AF2122/97
ucagcugcggauaca

SEQ ID NO: 1189502 - RNA, 15 nt, Mycobacterium bovis subsp bovis AF2122/97
ucagcugcucgucuu

SEQ ID NO: 1189503 - RNA, 16 nt, Mycobacterium bovis subsp bovis AF2122/97
ucaguagcagcggcuc

SEQ ID NO: 1189504 - RNA, 14 nt, Mycobacterium bovis subsp bovis AF2122/97
ucaguauggcgacg

SEQ ID NO: 1189505 - RNA, 13 nt, Mycobacterium bovis subsp bovis AF2122/97
ucagguuggcacg

SEQ ID NO: 1189506 - RNA, 20 nt, Mycobacterium bovis subsp bovis AF2122/97
ucagugaagacaccaggccc

SEQ ID NO: 1189507 - RNA, 21 nt, Mycobacterium bovis subsp bovis AF2122/97
ucaguguacaccgcgcccgcc

SEQ ID NO: 1189508 - RNA, 20 nt, Mycobacterium bovis subsp bovis AF2122/97
ucauaaaugggugugcugcc

SEQ ID NO: 1189509 - RNA, 20 nt, Mycobacterium bovis subsp bovis AF2122/97
ucaguucccgaaccccgacc

SEQ ID NO: 1189510 - RNA, 22 nt, Mycobacterium bovis subsp bovis AF2122/97
ucaguucccgcuugaucugggc

SEQ ID NO: 1189511 - RNA, 19 nt, Mycobacterium bovis subsp bovis AF2122/97
ucaguucgacggugccguc

SEQ ID NO: 1189512 - RNA, 22 nt, Mycobacterium bovis subsp bovis AF2122/97
ucaguucggccgucauggcccg

SEQ ID NO: 1189513 - RNA, 20 nt, Mycobacterium bovis subsp bovis AF2122/97
ucaguucggugugcggcgca

SEQ ID NO: 1189514 - RNA, 15 nt, Mycobacterium bovis subsp bovis AF2122/97
ucaguugcacaccga

SEQ ID NO: 1189515 - RNA, 12 nt, Mycobacterium bovis subsp bovis AF2122/97
ucauagugcagg

SEQ ID NO: 1189516 - RNA, 21 nt, Mycobacterium bovis subsp bovis AF2122/97
ucauagccguugcgggccagg

SEQ ID NO: 1189517 - RNA, 19 nt, Mycobacterium bovis subsp bovis AF2122/97
ucauauccgccccagcugc

SEQ ID NO: 1189518 - RNA, 20 nt, Mycobacterium bovis subsp bovis AF2122/97
ucauaucucgagcccucguu

SEQ ID NO: 1189519 - RNA, 15 nt, Mycobacterium bovis subsp bovis AF2122/97
ucaucgcgcacgccc

SEQ ID NO: 1189520 - RNA, 19 nt, Mycobacterium bovis subsp bovis AF2122/97
ucaucgcggucgccaccgu

SEQ ID NO: 1189521 - RNA, 13 nt, Mycobacterium bovis subsp bovis AF2122/97
ucaucgccagcgg

SEQ ID NO: 1189522 - RNA, 23 nt, Mycobacterium bovis subsp bovis AF2122/97
ucaucgccaucguuucacccggg

SEQ ID NO: 1189523 - RNA, 18 nt, Mycobacterium bovis subsp bovis AF2122/97
ucaucgccgacccgccac

SEQ ID NO: 1189524 - RNA, 21 nt, Mycobacterium bovis subsp bovis AF2122/97
ucaucgagcgggaucgggccc

SEQ ID NO: 1189525 - RNA, 17 nt, Mycobacterium bovis subsp bovis AF2122/97
ucaucgacguuccagca

SEQ ID NO: 1189526 - RNA, 13 nt, Mycobacterium bovis subsp bovis AF2122/97
ucaucgaagcuuc

SEQ ID NO: 1189527 - RNA, 17 nt, Mycobacterium bovis subsp bovis AF2122/97
ucauccccggccagccu

SEQ ID NO: 1189528 - RNA, 18 nt, Mycobacterium bovis subsp bovis AF2122/97
ucaucccgagaucaccuu

SEQ ID NO: 1189529 - RNA, 16 nt, Mycobacterium bovis subsp bovis AF2122/97
ucaucccgaccagcag

SEQ ID NO: 1189530 - RNA, 19 nt, Mycobacterium bovis subsp bovis AF2122/97
ucauccgggcgaccaccac

SEQ ID NO: 1189531 - RNA, 21 nt, Mycobacterium bovis subsp bovis AF2122/97
ucaucaccucuccguccucgu

SEQ ID NO: 1189532 - RNA, 16 nt, Mycobacterium bovis subsp bovis AF2122/97
ucaucaccucucgcuu

SEQ ID NO: 1189533 - RNA, 13 nt, Mycobacterium bovis subsp bovis AF2122/97
ucaucacccagcg

SEQ ID NO: 1189534 - RNA, 19 nt, Mycobacterium bovis subsp bovis AF2122/97
ucauccaccccugagcucc

SEQ ID NO: 1189535 - RNA, 15 nt, Mycobacterium bovis subsp bovis AF2122/97
ucaucauccacaccg

SEQ ID NO: 1189536 - RNA, 13 nt, Mycobacterium bovis subsp bovis AF2122/97
ucaucguggggau

SEQ ID NO: 1189537 - RNA, 15 nt, Mycobacterium bovis subsp bovis AF2122/97
ucaucggcuggccgc

SEQ ID NO: 1189538 - RNA, 22 nt, Mycobacterium bovis subsp bovis AF2122/97
ucaucucgguggacggcaggcg

SEQ ID NO: 1189539 - RNA, 17 nt, Mycobacterium bovis subsp bovis AF2122/97
ucaugagccgcugcgcc

SEQ ID NO: 1189540 - RNA, 18 nt, Mycobacterium bovis subsp bovis AF2122/97
ucaugacgagccgagccu

SEQ ID NO: 1189541 - RNA, 20 nt, Mycobacterium bovis subsp bovis AF2122/97
ucaugcccaugauggccgcg

SEQ ID NO: 1189542 - RNA, 21 nt, Mycobacterium bovis subsp bovis AF2122/97
ucaugccauagaugcccgcga

SEQ ID NO: 1189543 - RNA, 17 nt, Mycobacterium bovis subsp bovis AF2122/97
ucaugcaaaagccgcga

SEQ ID NO: 1189544 - RNA, 22 nt, Mycobacterium bovis subsp bovis AF2122/97
ucaugcagggaauagcggcgcc

SEQ ID NO: 1189545 - RNA, 21 nt, Mycobacterium bovis subsp bovis AF2122/97
ucaugcuggaaguugugcgca

SEQ ID NO: 1189546 - RNA, 16 nt, Mycobacterium bovis subsp bovis AF2122/97
ucaugcgauucugcgu

SEQ ID NO: 1189547 - RNA, 13 nt, Mycobacterium bovis subsp bovis AF2122/97
uccaacgaucagu

SEQ ID NO: 1189548 - RNA, 21 nt, Mycobacterium bovis subsp bovis AF2122/97
uccaacccaggguggcgacgu

SEQ ID NO: 1189549 - RNA, 22 nt, Mycobacterium bovis subsp bovis AF2122/97
uccaacgacuguggcgccgccg

SEQ ID NO: 1189550 - RNA, 16 nt, Mycobacterium bovis subsp bovis AF2122/97
uccaaaaaguagcugc

SEQ ID NO: 1189551 - RNA, 23 nt, Mycobacterium bovis subsp bovis AF2122/97
ucauuggccuggcuaguugggug

SEQ ID NO: 1189552 - RNA, 17 nt, Mycobacterium bovis subsp bovis AF2122/97
ucauuuucuguaaccac

SEQ ID NO: 1189553 - RNA, 15 nt, Mycobacterium bovis subsp bovis AF2122/97
ucauugcccuugacc

SEQ ID NO: 1189554 - RNA, 14 nt, Mycobacterium bovis subsp bovis AF2122/97
ucauggucagcaga

SEQ ID NO: 1189555 - RNA, 22 nt, Mycobacterium bovis subsp bovis AF2122/97
ucauggccggucugcugggcac

SEQ ID NO: 1189556 - RNA, 17 nt, Mycobacterium bovis subsp bovis AF2122/97
ucauguccugggccgcc

SEQ ID NO: 1189557 - RNA, 24 nt, Mycobacterium bovis subsp bovis AF2122/97
ucaugucgaagaaccggccgacga

SEQ ID NO: 1189558 - RNA, 20 nt, Mycobacterium bovis subsp bovis AF2122/97
ucauuacucaacaguucacg

SEQ ID NO: 1189559 - RNA, 14 nt, Mycobacterium bovis subsp bovis AF2122/97
ggaccggugccagc

SEQ ID NO: 1189560 - RNA, 14 nt, Mycobacterium bovis subsp bovis AF2122/97
ggaccggcugcagg

SEQ ID NO: 1189561 - RNA, 17 nt, Mycobacterium bovis subsp bovis AF2122/97
ggaccggcuuccccagc

SEQ ID NO: 1189562 - RNA, 17 nt, Mycobacterium bovis subsp bovis AF2122/97
ggaccggcaggccggcg

SEQ ID NO: 1189563 - RNA, 21 nt, Mycobacterium bovis subsp bovis AF2122/97
ggaccgaucuuggccaccgcc

SEQ ID NO: 1189564 - RNA, 22 nt, Mycobacterium bovis subsp bovis AF2122/97
ggaccgaugacgaucggcggcg

SEQ ID NO: 1189565 - RNA, 14 nt, Mycobacterium bovis subsp bovis AF2122/97
ggaccgcagcguga

SEQ ID NO: 1189566 - RNA, 19 nt, Mycobacterium bovis subsp bovis AF2122/97
ggacccugcgccgccacag

SEQ ID NO: 1189567 - RNA, 13 nt, Mycobacterium bovis subsp bovis AF2122/97
ggacccgcagcug

SEQ ID NO: 1189568 - RNA, 15 nt, Mycobacterium bovis subsp bovis AF2122/97
ggacccgcagcugcg

SEQ ID NO: 1189569 - RNA, 12 nt, Mycobacterium bovis subsp bovis AF2122/97
ggacccagcacc

SEQ ID NO: 1189570 - RNA, 14 nt, Mycobacterium bovis subsp bovis AF2122/97
ggacccagccagcu

SEQ ID NO: 1189571 - RNA, 16 nt, Mycobacterium bovis subsp bovis AF2122/97
ggacccagccagcugg

SEQ ID NO: 1189572 - RNA, 21 nt, Mycobacterium bovis subsp bovis AF2122/97
ggaccggugugcacgcgggcg

SEQ ID NO: 1189573 - RNA, 16 nt, Mycobacterium bovis subsp bovis AF2122/97
ggaccgucgccgguga

SEQ ID NO: 1189574 - RNA, 19 nt, Mycobacterium bovis subsp bovis AF2122/97
ggaccgucuuuggugccga

SEQ ID NO: 1189575 - RNA, 19 nt, Mycobacterium bovis subsp bovis AF2122/97
ggaccgugacguaucgccg

SEQ ID NO: 1189576 - RNA, 20 nt, Mycobacterium bovis subsp bovis AF2122/97
ggaccgugacguaucgccgc

SEQ ID NO: 1189577 - RNA, 15 nt, Mycobacterium bovis subsp bovis AF2122/97
ggaccuggcggcggu

SEQ ID NO: 1189578 - RNA, 22 nt, Mycobacterium bovis subsp bovis AF2122/97
ggaccuccgacgugcccccgua

SEQ ID NO: 1189579 - RNA, 20 nt, Mycobacterium bovis subsp bovis AF2122/97
ggaccuucugucccugcagu

SEQ ID NO: 1189580 - RNA, 17 nt, Mycobacterium bovis subsp bovis AF2122/97
ggaccagcguggggccg

SEQ ID NO: 1189581 - RNA, 12 nt, Mycobacterium bovis subsp bovis AF2122/97
ggaccagcuccu

SEQ ID NO: 1189582 - RNA, 17 nt, Mycobacterium bovis subsp bovis AF2122/97
ggaccauagccugcgcc

SEQ ID NO: 1189583 - RNA, 16 nt, Mycobacterium bovis subsp bovis AF2122/97
ggaccauagucgccgu

SEQ ID NO: 1189584 - RNA, 22 nt, Mycobacterium bovis subsp bovis AF2122/97
ggaccaucccgccgaucacugu

SEQ ID NO: 1189585 - RNA, 13 nt, Mycobacterium bovis subsp bovis AF2122/97
ggaccaucgccag

SEQ ID NO: 1189586 - RNA, 22 nt, Mycobacterium bovis subsp bovis AF2122/97
ggaccaccagcgcuccagcacc

SEQ ID NO: 1189587 - RNA, 16 nt, Mycobacterium bovis subsp bovis AF2122/97
ggaccaccgggauggc

SEQ ID NO: 1189588 - RNA, 17 nt, Mycobacterium bovis subsp bovis AF2122/97
ggaccaacgccaacgcc

SEQ ID NO: 1189589 - RNA, 18 nt, Mycobacterium bovis subsp bovis AF2122/97
ggaccacaccgucaccga

SEQ ID NO: 1189590 - RNA, 14 nt, Mycobacterium bovis subsp bovis AF2122/97
ggaccacagccgcg

SEQ ID NO: 1189591 - RNA, 15 nt, Mycobacterium bovis subsp bovis AF2122/97
ggacaucgggcggca

SEQ ID NO: 1189592 - RNA, 20 nt, Mycobacterium bovis subsp bovis AF2122/97
ggacaugcgggcagcacucu

SEQ ID NO: 1189593 - RNA, 11 nt, Mycobacterium bovis subsp bovis AF2122/97
ggacagcagcc

SEQ ID NO: 1189594 - RNA, 15 nt, Mycobacterium bovis subsp bovis AF2122/97
ggacagcagcagauc

SEQ ID NO: 1189595 - RNA, 24 nt, Mycobacterium bovis subsp bovis AF2122/97
ggacagcccggacgcgcggauggc

SEQ ID NO: 1189596 - RNA, 20 nt, Mycobacterium bovis subsp bovis AF2122/97
ggacaaggucaucggcaucc

SEQ ID NO: 1189597 - RNA, 15 nt, Mycobacterium bovis subsp bovis AF2122/97
ggacaagccgcugau

SEQ ID NO: 1189598 - RNA, 15 nt, Mycobacterium bovis subsp bovis AF2122/97
ggacaagcuccucgc

SEQ ID NO: 1189599 - RNA, 14 nt, Mycobacterium bovis subsp bovis AF2122/97
ggacaagugccggc

SEQ ID NO: 1189600 - RNA, 18 nt, Mycobacterium bovis subsp bovis AF2122/97
ggacaagugccggcgcgg

SEQ ID NO: 1189601 - RNA, 20 nt, Mycobacterium bovis subsp bovis AF2122/97
ggacagaugcauccagcugc

SEQ ID NO: 1189602 - RNA, 15 nt, Mycobacterium bovis subsp bovis AF2122/97
ggacagauggcggcc

SEQ ID NO: 1189603 - RNA, 15 nt, Mycobacterium bovis subsp bovis AF2122/97
gcucggcgguacaca

SEQ ID NO: 1189604 - RNA, 23 nt, Mycobacterium bovis subsp bovis AF2122/97
gcucggcgggggaccccgccagc

SEQ ID NO: 1189605 - RNA, 17 nt, Mycobacterium bovis subsp bovis AF2122/97
gcucggcgucgccgcca

SEQ ID NO: 1189606 - RNA, 17 nt, Mycobacterium bovis subsp bovis AF2122/97
gcucgggccgcacuuuc

SEQ ID NO: 1189607 - RNA, 13 nt, Mycobacterium bovis subsp bovis AF2122/97
gcucggcggugca

SEQ ID NO: 1189608 - RNA, 14 nt, Mycobacterium bovis subsp bovis AF2122/97
gcucggcguccgcc

SEQ ID NO: 1189609 - RNA, 21 nt, Mycobacterium bovis subsp bovis AF2122/97
gcucggucggcagcuccagca

SEQ ID NO: 1189610 - RNA, 22 nt, Mycobacterium bovis subsp bovis AF2122/97
gcucggugacaagcggcccgcu

SEQ ID NO: 1189611 - RNA, 21 nt, Mycobacterium bovis subsp bovis AF2122/97
gcucggugaucaccaugauca

SEQ ID NO: 1189612 - RNA, 18 nt, Mycobacterium bovis subsp bovis AF2122/97
gcucggugacccccgaga

SEQ ID NO: 1189613 - RNA, 20 nt, Mycobacterium bovis subsp bovis AF2122/97
gcucggugcugcgccgauac

SEQ ID NO: 1189614 - RNA, 16 nt, Mycobacterium bovis subsp bovis AF2122/97
gcucgguccagccggu

SEQ ID NO: 1189615 - RNA, 22 nt, Mycobacterium bovis subsp bovis AF2122/97
gcucggggcgaugagccugcag

SEQ ID NO: 1189616 - RNA, 13 nt, Mycobacterium bovis subsp bovis AF2122/97
gcucgggggccga

SEQ ID NO: 1189617 - RNA, 15 nt, Mycobacterium bovis subsp bovis AF2122/97
gcucggggugcagag

SEQ ID NO: 1189618 - RNA, 16 nt, Mycobacterium bovis subsp bovis AF2122/97
gcucgggcaaggccac

SEQ ID NO: 1189619 - RNA, 23 nt, Mycobacterium bovis subsp bovis AF2122/97
gcucgggugguuugcgaacgaau

SEQ ID NO: 1189620 - RNA, 19 nt, Mycobacterium bovis subsp bovis AF2122/97
ggaaguccagcuggccggg

SEQ ID NO: 1189621 - RNA, 14 nt, Mycobacterium bovis subsp bovis AF2122/97
ggaagucccgccgu

SEQ ID NO: 1189622 - RNA, 22 nt, Mycobacterium bovis subsp bovis AF2122/97
ggaaggugugcgucuccagcug

SEQ ID NO: 1189623 - RNA, 21 nt, Mycobacterium bovis subsp bovis AF2122/97
gcucggugcuguugcgcgguc

SEQ ID NO: 1189624 - RNA, 19 nt, Mycobacterium bovis subsp bovis AF2122/97
ggaaguacuuuuggguucg

SEQ ID NO: 1189625 - RNA, 17 nt, Mycobacterium bovis subsp bovis AF2122/97
ggaaguuggcugagcag

SEQ ID NO: 1189626 - RNA, 23 nt, Mycobacterium bovis subsp bovis AF2122/97
ggaaguugaucuugccgcccuug

SEQ ID NO: 1189627 - RNA, 20 nt, Mycobacterium bovis subsp bovis AF2122/97
ggacaagcacagcgaacaga

SEQ ID NO: 1189628 - RNA, 22 nt, Mycobacterium bovis subsp bovis AF2122/97
ggacaacaagaugccugacacg

SEQ ID NO: 1189629 - RNA, 14 nt, Mycobacterium bovis subsp bovis AF2122/97
ggaaucuccggcug

SEQ ID NO: 1189630 - RNA, 15 nt, Mycobacterium bovis subsp bovis AF2122/97
ggaaucgucgcggcc

SEQ ID NO: 1189631 - RNA, 20 nt, Mycobacterium bovis subsp bovis AF2122/97
ggaauagcaacgcugcggca

SEQ ID NO: 1189632 - RNA, 19 nt, Mycobacterium bovis subsp bovis AF2122/97
ggaauccgaacgcgauccg

SEQ ID NO: 1189633 - RNA, 14 nt, Mycobacterium bovis subsp bovis AF2122/97
ggaauccggccaga

SEQ ID NO: 1189634 - RNA, 17 nt, Mycobacterium bovis subsp bovis AF2122/97
ggaauccggccagaccc

SEQ ID NO: 1189635 - RNA, 22 nt, Mycobacterium bovis subsp bovis AF2122/97
ggaaucgcgagcuuggccggca

SEQ ID NO: 1189636 - RNA, 18 nt, Mycobacterium bovis subsp bovis AF2122/97
ggaauccggugaugaccg

SEQ ID NO: 1189637 - RNA, 23 nt, Mycobacterium bovis subsp bovis AF2122/97
ggaauacgcugcuggucuugccg

SEQ ID NO: 1189638 - RNA, 14 nt, Mycobacterium bovis subsp bovis AF2122/97
ggaauacagcuuga

SEQ ID NO: 1189639 - RNA, 19 nt, Mycobacterium bovis subsp bovis AF2122/97
ggacgccagcucaaccaca

SEQ ID NO: 1189640 - RNA, 20 nt, Mycobacterium bovis subsp bovis AF2122/97
ggacgcccgaguugaagaau

SEQ ID NO: 1189641 - RNA, 20 nt, Mycobacterium bovis subsp bovis AF2122/97
ggacggcguugagcaggugc

SEQ ID NO: 1189642 - RNA, 21 nt, Mycobacterium bovis subsp bovis AF2122/97
ggacggcuaccaccgcaccug

SEQ ID NO: 1189643 - RNA, 20 nt, Mycobacterium bovis subsp bovis AF2122/97
ggacgggaugcuuggucucg

SEQ ID NO: 1189644 - RNA, 18 nt, Mycobacterium bovis subsp bovis AF2122/97
ggacgacgccaccugacg

SEQ ID NO: 1189645 - RNA, 20 nt, Mycobacterium bovis subsp bovis AF2122/97
ggacgauggcgucggccagg

SEQ ID NO: 1189646 - RNA, 23 nt, Mycobacterium bovis subsp bovis AF2122/97
ggacgaucaacccgguccagccg

SEQ ID NO: 1189647 - RNA, 23 nt, Mycobacterium bovis subsp bovis AF2122/97
ggacgaucagggugucgaagagc

SEQ ID NO: 1189648 - RNA, 14 nt, Mycobacterium bovis subsp bovis AF2122/97
ggacgggugcagcg

SEQ ID NO: 1189649 - RNA, 14 nt, Mycobacterium bovis subsp bovis AF2122/97
ggacggucgccagg

SEQ ID NO: 1189650 - RNA, 14 nt, Mycobacterium bovis subsp bovis AF2122/97
ggacggucgcucgg

SEQ ID NO: 1189651 - RNA, 18 nt, Mycobacterium bovis subsp bovis AF2122/97
ggacggucgcucggcaug

SEQ ID NO: 1189652 - RNA, 14 nt, Mycobacterium bovis subsp bovis AF2122/97
ggacgggucgccgc

SEQ ID NO: 1189653 - RNA, 16 nt, Mycobacterium bovis subsp bovis AF2122/97
ggacggugggucucga

SEQ ID NO: 1189654 - RNA, 13 nt, Mycobacterium bovis subsp bovis AF2122/97
ggacggugaaacc

SEQ ID NO: 1189655 - RNA, 18 nt, Mycobacterium bovis subsp bovis AF2122/97
ggacggugaaaccggccu

SEQ ID NO: 1189656 - RNA, 22 nt, Mycobacterium bovis subsp bovis AF2122/97
ggacgugacgucguggcgcucg

SEQ ID NO: 1189657 - RNA, 16 nt, Mycobacterium bovis subsp bovis AF2122/97
ggacucgcguccucgg

SEQ ID NO: 1189658 - RNA, 12 nt, Mycobacterium bovis subsp bovis AF2122/97
ggacgugccggg

SEQ ID NO: 1189659 - RNA, 14 nt, Mycobacterium bovis subsp bovis AF2122/97
ggacguggacuuug

SEQ ID NO: 1189660 - RNA, 17 nt, Mycobacterium bovis subsp bovis AF2122/97
ggacucugccacccagc

SEQ ID NO: 1189661 - RNA, 17 nt, Mycobacterium bovis subsp bovis AF2122/97
ggacucgggcaggcccc

SEQ ID NO: 1189662 - RNA, 15 nt, Mycobacterium bovis subsp bovis AF2122/97
ggacugaccucguca

SEQ ID NO: 1189663 - RNA, 18 nt, Mycobacterium bovis subsp bovis AF2122/97
ggacucgggcgcugaugc

SEQ ID NO: 1189664 - RNA, 13 nt, Mycobacterium bovis subsp bovis AF2122/97
ggacugaagagca

SEQ ID NO: 1189665 - RNA, 22 nt, Mycobacterium bovis subsp bovis AF2122/97
ggagaacacgucgacaccgagg

SEQ ID NO: 1189666 - RNA, 21 nt, Mycobacterium bovis subsp bovis AF2122/97
ggagauacauuucccagucau

SEQ ID NO: 1189667 - RNA, 21 nt, Mycobacterium bovis subsp bovis AF2122/97
ggagaugaucaugugguggcg

SEQ ID NO: 1189668 - RNA, 16 nt, Mycobacterium bovis subsp bovis AF2122/97
ggagauccagggccuu

SEQ ID NO: 1189669 - RNA, 20 nt, Mycobacterium bovis subsp bovis AF2122/97
ggagccuugguagccggccg

SEQ ID NO: 1189670 - RNA, 17 nt, Mycobacterium bovis subsp bovis AF2122/97
ggacuggcaccgccagc

SEQ ID NO: 1189671 - RNA, 21 nt, Mycobacterium bovis subsp bovis AF2122/97
ggacugcgccaccggugaggc

SEQ ID NO: 1189672 - RNA, 22 nt, Mycobacterium bovis subsp bovis AF2122/97
ggacuucguuccgugccgagcu

SEQ ID NO: 1189673 - RNA, 16 nt, Mycobacterium bovis subsp bovis AF2122/97
ggacugucccaccagg

SEQ ID NO: 1189674 - RNA, 18 nt, Mycobacterium bovis subsp bovis AF2122/97
ggacugucccaccaggua

SEQ ID NO: 1189675 - RNA, 16 nt, Mycobacterium bovis subsp bovis AF2122/97
ggacuugcgagccgua

SEQ ID NO: 1189676 - RNA, 21 nt, Mycobacterium bovis subsp bovis AF2122/97
ggacuugguuucgaugaagac

SEQ ID NO: 1189677 - RNA, 16 nt, Mycobacterium bovis subsp bovis AF2122/97
ggaguaguggugggcg

SEQ ID NO: 1189678 - RNA, 20 nt, Mycobacterium bovis subsp bovis AF2122/97
ggaguacuccagccgcaaca

SEQ ID NO: 1189679 - RNA, 21 nt, Mycobacterium bovis subsp bovis AF2122/97
ggagucaacuucgacaacgca

SEQ ID NO: 1189680 - RNA, 15 nt, Mycobacterium bovis subsp bovis AF2122/97
ggaguagccgcagcu

SEQ ID NO: 1189681 - RNA, 13 nt, Mycobacterium bovis subsp bovis AF2122/97
ggaggccaucauc

SEQ ID NO: 1189682 - RNA, 15 nt, Mycobacterium bovis subsp bovis AF2122/97
ggaggccaucauccc

SEQ ID NO: 1189683 - RNA, 22 nt, Mycobacterium bovis subsp bovis AF2122/97
ggaggcaagcaaccggugcgca

SEQ ID NO: 1189684 - RNA, 20 nt, Mycobacterium bovis subsp bovis AF2122/97
ggaggcggaccaggccgcgc

SEQ ID NO: 1189685 - RNA, 12 nt, Mycobacterium bovis subsp bovis AF2122/97
ggagcggcugca

SEQ ID NO: 1189686 - RNA, 18 nt, Mycobacterium bovis subsp bovis AF2122/97
ggagcggaauggcgccgg

SEQ ID NO: 1189687 - RNA, 15 nt, Mycobacterium bovis subsp bovis AF2122/97
ggagcgcggcccgcc

SEQ ID NO: 1189688 - RNA, 17 nt, Mycobacterium bovis subsp bovis AF2122/97
ggagcgcggcccgccuc

SEQ ID NO: 1189689 - RNA, 20 nt, Mycobacterium bovis subsp bovis AF2122/97
ggagcgcgccucgcccagca

SEQ ID NO: 1189690 - RNA, 13 nt, Mycobacterium bovis subsp bovis AF2122/97
ggagcgccgcagg

SEQ ID NO: 1189691 - RNA, 21 nt, Mycobacterium bovis subsp bovis AF2122/97
ggagcgcaccugaaggcggcg

SEQ ID NO: 1189692 - RNA, 17 nt, Mycobacterium bovis subsp bovis AF2122/97
ggagaucgaucgacagc

SEQ ID NO: 1189693 - RNA, 14 nt, Mycobacterium bovis subsp bovis AF2122/97
ggagcgaacggcgc

SEQ ID NO: 1189694 - RNA, 13 nt, Mycobacterium bovis subsp bovis AF2122/97
ggagcggccgccg

SEQ ID NO: 1189695 - RNA, 15 nt, Mycobacterium bovis subsp bovis AF2122/97
ggagcggcgcggggg

SEQ ID NO: 1189696 - RNA, 16 nt, Mycobacterium bovis subsp bovis AF2122/97
ggagcggcgcgggggu

SEQ ID NO: 1189697 - RNA, 13 nt, Mycobacterium bovis subsp bovis AF2122/97
ggagcgggccagc

SEQ ID NO: 1189698 - RNA, 17 nt, Mycobacterium bovis subsp bovis AF2122/97
ggagcgggccagcaccc

SEQ ID NO: 1189699 - RNA, 14 nt, Mycobacterium bovis subsp bovis AF2122/97
ggagcgggugcggg

SEQ ID NO: 1189700 - RNA, 16 nt, Mycobacterium bovis subsp bovis AF2122/97
ggagcgggugcgggcg

SEQ ID NO: 1189701 - RNA, 19 nt, Mycobacterium bovis subsp bovis AF2122/97
ggaggacuacuaggccccu

SEQ ID NO: 1189702 - RNA, 15 nt, Mycobacterium bovis subsp bovis AF2122/97
ggauagcagugcagc

SEQ ID NO: 1189703 - RNA, 18 nt, Mycobacterium bovis subsp bovis AF2122/97
ggauagcgucgucccagc

SEQ ID NO: 1189704 - RNA, 20 nt, Mycobacterium bovis subsp bovis AF2122/97
ggauagcgucgucccagcgc

SEQ ID NO: 1189705 - RNA, 22 nt, Mycobacterium bovis subsp bovis AF2122/97
ggaguucucgcugaucagcaug

SEQ ID NO: 1189706 - RNA, 22 nt, Mycobacterium bovis subsp bovis AF2122/97
ggauacuguucugcuggcugug

SEQ ID NO: 1189707 - RNA, 19 nt, Mycobacterium bovis subsp bovis AF2122/97
ggagucgaucagcuugggc

SEQ ID NO: 1189708 - RNA, 16 nt, Mycobacterium bovis subsp bovis AF2122/97
ggagucgcgcagggcg

SEQ ID NO: 1189709 - RNA, 20 nt, Mycobacterium bovis subsp bovis AF2122/97
ggagucgucggcaugggccg

SEQ ID NO: 1189710 - RNA, 24 nt, Mycobacterium bovis subsp bovis AF2122/97
ggagucgucguguuggccgggucg

SEQ ID NO: 1189711 - RNA, 15 nt, Mycobacterium bovis subsp bovis AF2122/97
ggagucgaacaucac

SEQ ID NO: 1189712 - RNA, 16 nt, Mycobacterium bovis subsp bovis AF2122/97
ggagucgacccugccc

SEQ ID NO: 1189713 - RNA, 23 nt, Mycobacterium bovis subsp bovis AF2122/97
ggagucgacccugcccagcaccc

SEQ ID NO: 1189714 - RNA, 14 nt, Mycobacterium bovis subsp bovis AF2122/97
ggagucgacgacgu

SEQ ID NO: 1189715 - RNA, 12 nt, Mycobacterium bovis subsp bovis AF2122/97
ggaguggccggg

SEQ ID NO: 1189716 - RNA, 14 nt, Mycobacterium bovis subsp bovis AF2122/97
ggaguggccgggcg

SEQ ID NO: 1189717 - RNA, 22 nt, Mycobacterium bovis subsp bovis AF2122/97
ggagucuucaacgucgagaucc

SEQ ID NO: 1189718 - RNA, 15 nt, Mycobacterium bovis subsp bovis AF2122/97
ggaugccgaaccgcu

SEQ ID NO: 1189719 - RNA, 22 nt, Mycobacterium bovis subsp bovis AF2122/97
ggaugccccuucaaagcggccu

SEQ ID NO: 1189720 - RNA, 23 nt, Mycobacterium bovis subsp bovis AF2122/97
ggaugcaugucaaguucgccagc

SEQ ID NO: 1189721 - RNA, 18 nt, Mycobacterium bovis subsp bovis AF2122/97
ggaucugggcucgguccu

SEQ ID NO: 1189722 - RNA, 15 nt, Mycobacterium bovis subsp bovis AF2122/97
ggaucugguccagug

SEQ ID NO: 1189723 - RNA, 18 nt, Mycobacterium bovis subsp bovis AF2122/97
ggaucucggcguaggcga

SEQ ID NO: 1189724 - RNA, 16 nt, Mycobacterium bovis subsp bovis AF2122/97
ggaucucauccauguu

SEQ ID NO: 1189725 - RNA, 21 nt, Mycobacterium bovis subsp bovis AF2122/97
ggaucucaucgggccacagca

SEQ ID NO: 1189726 - RNA, 12 nt, Mycobacterium bovis subsp bovis AF2122/97
ggaucacacauu

SEQ ID NO: 1189727 - RNA, 17 nt, Mycobacterium bovis subsp bovis AF2122/97
ggaucuauuggaugcga

SEQ ID NO: 1189728 - RNA, 20 nt, Mycobacterium bovis subsp bovis AF2122/97
ggaucacucccccacacacc

SEQ ID NO: 1189729 - RNA, 14 nt, Mycobacterium bovis subsp bovis AF2122/97
ggaucacccgccgc

SEQ ID NO: 1189730 - RNA, 13 nt, Mycobacterium bovis subsp bovis AF2122/97
ggaucaccgcgcc

SEQ ID NO: 1189731 - RNA, 15 nt, Mycobacterium bovis subsp bovis AF2122/97
ggauguuugcucggc

SEQ ID NO: 1189732 - RNA, 18 nt, Mycobacterium bovis subsp bovis AF2122/97
ggauuggugggccagcag

SEQ ID NO: 1189733 - RNA, 18 nt, Mycobacterium bovis subsp bovis AF2122/97
ggauuggcgucagcagca

SEQ ID NO: 1189734 - RNA, 17 nt, Mycobacterium bovis subsp bovis AF2122/97
ggauggcgcccugcgcc

SEQ ID NO: 1189735 - RNA, 19 nt, Mycobacterium bovis subsp bovis AF2122/97
ggauggcucacccaggcgc

SEQ ID NO: 1189736 - RNA, 19 nt, Mycobacterium bovis subsp bovis AF2122/97
ggaugccgaaccgcugcgg

SEQ ID NO: 1189737 - RNA, 14 nt, Mycobacterium bovis subsp bovis AF2122/97
ggauggacaccacc

SEQ ID NO: 1189738 - RNA, 22 nt, Mycobacterium bovis subsp bovis AF2122/97
ggauggacggcagccagccacc

SEQ ID NO: 1189739 - RNA, 20 nt, Mycobacterium bovis subsp bovis AF2122/97
ggcaaaggaugaugaacaga

SEQ ID NO: 1189740 - RNA, 20 nt, Mycobacterium bovis subsp bovis AF2122/97
ggcaacccccgccggcgccc

SEQ ID NO: 1189741 - RNA, 22 nt, Mycobacterium bovis subsp bovis AF2122/97
ggcaacccagugucagcaagau

SEQ ID NO: 1189742 - RNA, 14 nt, Mycobacterium bovis subsp bovis AF2122/97
ggcaaccugccggg

SEQ ID NO: 1189743 - RNA, 17 nt, Mycobacterium bovis subsp bovis AF2122/97
ggcaaccgacacuggga

SEQ ID NO: 1189744 - RNA, 14 nt, Mycobacterium bovis subsp bovis AF2122/97
ggcaacgcggccuu

SEQ ID NO: 1189745 - RNA, 17 nt, Mycobacterium bovis subsp bovis AF2122/97
ggcaaccuuuggccgcu

SEQ ID NO: 1189746 - RNA, 12 nt, Mycobacterium bovis subsp bovis AF2122/97
ggcaacgacacg

SEQ ID NO: 1189747 - RNA, 16 nt, Mycobacterium bovis subsp bovis AF2122/97
ggcaacgacccgccgc

SEQ ID NO: 1189748 - RNA, 12 nt, Mycobacterium bovis subsp bovis AF2122/97
ggcaacgaucag

SEQ ID NO: 1189749 - RNA, 14 nt, Mycobacterium bovis subsp bovis AF2122/97
ggcaaccagcgagc

SEQ ID NO: 1189750 - RNA, 12 nt, Mycobacterium bovis subsp bovis AF2122/97
ggcaacagggga

SEQ ID NO: 1189751 - RNA, 14 nt, Mycobacterium bovis subsp bovis AF2122/97
ggcaaccaccggcc

SEQ ID NO: 1189752 - RNA, 16 nt, Mycobacterium bovis subsp bovis AF2122/97
ggcaaccaccggccgc

SEQ ID NO: 1189753 - RNA, 19 nt, Mycobacterium bovis subsp bovis AF2122/97
ggcaaaguuggccgcccga

SEQ ID NO: 1189754 - RNA, 18 nt, Mycobacterium bovis subsp bovis AF2122/97
ggcaaaucaagcacagcc

SEQ ID NO: 1189755 - RNA, 12 nt, Mycobacterium bovis subsp bovis AF2122/97
ggcacgggcggg

SEQ ID NO: 1189756 - RNA, 19 nt, Mycobacterium bovis subsp bovis AF2122/97
ggcacgggaaucgcucgcg

SEQ ID NO: 1189757 - RNA, 18 nt, Mycobacterium bovis subsp bovis AF2122/97
ggcacggucacacgccag

SEQ ID NO: 1189758 - RNA, 22 nt, Mycobacterium bovis subsp bovis AF2122/97
ggcacggucacacgccagccgg

SEQ ID NO: 1189759 - RNA, 14 nt, Mycobacterium bovis subsp bovis AF2122/97
ggcacggccgucga

SEQ ID NO: 1189760 - RNA, 21 nt, Mycobacterium bovis subsp bovis AF2122/97
ggcacggugucgcgcgaccug

SEQ ID NO: 1189761 - RNA, 14 nt, Mycobacterium bovis subsp bovis AF2122/97
ggcacugcggccag

SEQ ID NO: 1189762 - RNA, 18 nt, Mycobacterium bovis subsp bovis AF2122/97
ggcacugccggcacgccg

SEQ ID NO: 1189763 - RNA, 20 nt, Mycobacterium bovis subsp bovis AF2122/97
ggcaccuuggccggccccgc

SEQ ID NO: 1189764 - RNA, 15 nt, Mycobacterium bovis subsp bovis AF2122/97
ggcacggaccgcguc

SEQ ID NO: 1189765 - RNA, 20 nt, Mycobacterium bovis subsp bovis AF2122/97
ggcacggaccgcgucgcggg

SEQ ID NO: 1189766 - RNA, 24 nt, Mycobacterium bovis subsp bovis AF2122/97
ggcacggaugcgauggccgacgcu

SEQ ID NO: 1189767 - RNA, 13 nt, Mycobacterium bovis subsp bovis AF2122/97
ggcaccucggccu

SEQ ID NO: 1189768 - RNA, 20 nt, Mycobacterium bovis subsp bovis AF2122/97
ggcaccuucggcccaugcag

SEQ ID NO: 1189769 - RNA, 21 nt, Mycobacterium bovis subsp bovis AF2122/97
ggcaccgugcggaucgcgcug

SEQ ID NO: 1189770 - RNA, 22 nt, Mycobacterium bovis subsp bovis AF2122/97
ggcaccgugcggaucgcgcugc

SEQ ID NO: 1189771 - RNA, 18 nt, Mycobacterium bovis subsp bovis AF2122/97
ggcaccguuaccgccguc

SEQ ID NO: 1189772 - RNA, 24 nt, Mycobacterium bovis subsp bovis AF2122/97
ggcaccgaaaaacaccagcgaggc

SEQ ID NO: 1189773 - RNA, 19 nt, Mycobacterium bovis subsp bovis AF2122/97
ggcacccggggugcccggc

SEQ ID NO: 1189774 - RNA, 20 nt, Mycobacterium bovis subsp bovis AF2122/97
ggcacccggggugcccggcc

SEQ ID NO: 1189775 - RNA, 23 nt, Mycobacterium bovis subsp bovis AF2122/97
ggcacccggggugcccggccgcc

SEQ ID NO: 1189776 - RNA, 19 nt, Mycobacterium bovis subsp bovis AF2122/97
ggcacccggucggccaucc

SEQ ID NO: 1189777 - RNA, 22 nt, Mycobacterium bovis subsp bovis AF2122/97
ggcacccggugagaagaagccc

SEQ ID NO: 1189778 - RNA, 22 nt, Mycobacterium bovis subsp bovis AF2122/97
ggcaccgggguuacucgcagcg

SEQ ID NO: 1189779 - RNA, 13 nt, Mycobacterium bovis subsp bovis AF2122/97
ggcaccggcggcg

SEQ ID NO: 1189780 - RNA, 15 nt, Mycobacterium bovis subsp bovis AF2122/97
ggcaccccggccacu

SEQ ID NO: 1189781 - RNA, 15 nt, Mycobacterium bovis subsp bovis AF2122/97
ggcacccccgucgcc

SEQ ID NO: 1189782 - RNA, 20 nt, Mycobacterium bovis subsp bovis AF2122/97
ggcaccccgaccaccagagc

SEQ ID NO: 1189783 - RNA, 17 nt, Mycobacterium bovis subsp bovis AF2122/97
ggcaccccacggccagu

SEQ ID NO: 1189784 - RNA, 15 nt, Mycobacterium bovis subsp bovis AF2122/97
ggcaccccacggcca

SEQ ID NO: 1189785 - RNA, 16 nt, Mycobacterium bovis subsp bovis AF2122/97
ggcaccccacggccag

SEQ ID NO: 1189786 - RNA, 11 nt, Mycobacterium bovis subsp bovis AF2122/97
ggcacccggcu

SEQ ID NO: 1189787 - RNA, 17 nt, Mycobacterium bovis subsp bovis AF2122/97
ggcacccgacucgucgg

SEQ ID NO: 1189788 - RNA, 22 nt, Mycobacterium bovis subsp bovis AF2122/97
ggcacaauaggcuccagcgcgc

SEQ ID NO: 1189789 - RNA, 17 nt, Mycobacterium bovis subsp bovis AF2122/97
ggcacaaucaccgccgc

SEQ ID NO: 1189790 - RNA, 19 nt, Mycobacterium bovis subsp bovis AF2122/97
ggcacaaccaacgacaggu

SEQ ID NO: 1189791 - RNA, 22 nt, Mycobacterium bovis subsp bovis AF2122/97
ggcaauuacccgacuucaagac

SEQ ID NO: 1189792 - RNA, 14 nt, Mycobacterium bovis subsp bovis AF2122/97
ggcaauuccgccga

SEQ ID NO: 1189793 - RNA, 17 nt, Mycobacterium bovis subsp bovis AF2122/97
ggcaauuccgccgagcg

SEQ ID NO: 1189794 - RNA, 15 nt, Mycobacterium bovis subsp bovis AF2122/97
ggcaaggucgcggcc

SEQ ID NO: 1189795 - RNA, 17 nt, Mycobacterium bovis subsp bovis AF2122/97
ggcaaggguggggccgg

SEQ ID NO: 1189796 - RNA, 22 nt, Mycobacterium bovis subsp bovis AF2122/97
ggcaaguagucgaaggucagca

SEQ ID NO: 1189797 - RNA, 20 nt, Mycobacterium bovis subsp bovis AF2122/97
ggcaagucaacaccgcggcc

SEQ ID NO: 1189798 - RNA, 23 nt, Mycobacterium bovis subsp bovis AF2122/97
ggcaauaccgaaccgguguagca

SEQ ID NO: 1189799 - RNA, 22 nt, Mycobacterium bovis subsp bovis AF2122/97
ggcaaucgcucugugucgccga

SEQ ID NO: 1189800 - RNA, 14 nt, Mycobacterium bovis subsp bovis AF2122/97
ggcaaucggcggca

SEQ ID NO: 1189801 - RNA, 19 nt, Mycobacterium bovis subsp bovis AF2122/97
ggcaaucaucucccgaccg

SEQ ID NO: 1189802 - RNA, 18 nt, Mycobacterium bovis subsp bovis AF2122/97
ggcaaucaacgcaaugcc

SEQ ID NO: 1189803 - RNA, 23 nt, Mycobacterium bovis subsp bovis AF2122/97
ggcaaucacaucaaagucggcgu

SEQ ID NO: 1189804 - RNA, 20 nt, Mycobacterium bovis subsp bovis AF2122/97
ggcaaucaccgccggcggcg

SEQ ID NO: 1189805 - RNA, 22 nt, Mycobacterium bovis subsp bovis AF2122/97
ggcaagccauucacgagccgcu

SEQ ID NO: 1189806 - RNA, 12 nt, Mycobacterium bovis subsp bovis AF2122/97
ggcaagcgcaga

SEQ ID NO: 1189807 - RNA, 13 nt, Mycobacterium bovis subsp bovis AF2122/97
ggcaagcuccagu

SEQ ID NO: 1189808 - RNA, 18 nt, Mycobacterium bovis subsp bovis AF2122/97
ggcaagccgauugcuucu

SEQ ID NO: 1189809 - RNA, 14 nt, Mycobacterium bovis subsp bovis AF2122/97
ggcaagccguucug

SEQ ID NO: 1189810 - RNA, 21 nt, Mycobacterium bovis subsp bovis AF2122/97
ggcaaggccaccgucgcggcg

SEQ ID NO: 1189811 - RNA, 21 nt, Mycobacterium bovis subsp bovis AF2122/97
ggcaaggcauccaacgcggcg

SEQ ID NO: 1189812 - RNA, 18 nt, Mycobacterium bovis subsp bovis AF2122/97
ggcaagcugaccgccagc

SEQ ID NO: 1189813 - RNA, 14 nt, Mycobacterium bovis subsp bovis AF2122/97
ggcaaggcggcggc

SEQ ID NO: 1189814 - RNA, 16 nt, Mycobacterium bovis subsp bovis AF2122/97
ggcaagggcauacagc

SEQ ID NO: 1189815 - RNA, 19 nt, Mycobacterium bovis subsp bovis AF2122/97
ggcaagaccgaacagcggc

SEQ ID NO: 1189816 - RNA, 23 nt, Mycobacterium bovis subsp bovis AF2122/97
ggcaacuccggucaacacccgcc

SEQ ID NO: 1189817 - RNA, 16 nt, Mycobacterium bovis subsp bovis AF2122/97
ggcaacgggggcgccg

SEQ ID NO: 1189818 - RNA, 12 nt, Mycobacterium bovis subsp bovis AF2122/97
ggcaacugcagc

SEQ ID NO: 1189819 - RNA, 18 nt, Mycobacterium bovis subsp bovis AF2122/97
ggcaagcaaccggugcgc

SEQ ID NO: 1189820 - RNA, 15 nt, Mycobacterium bovis subsp bovis AF2122/97
ggcaagcacaccgcc

SEQ ID NO: 1189821 - RNA, 18 nt, Mycobacterium bovis subsp bovis AF2122/97
ggcaagcacaccgccagc

SEQ ID NO: 1189822 - RNA, 19 nt, Mycobacterium bovis subsp bovis AF2122/97
ggcaagcacaccgccagcg

SEQ ID NO: 1189823 - RNA, 21 nt, Mycobacterium bovis subsp bovis AF2122/97
ggcaagcacaccgccagcggc

SEQ ID NO: 1189824 - RNA, 16 nt, Mycobacterium bovis subsp bovis AF2122/97
ggcaagcacgguggcc

SEQ ID NO: 1189825 - RNA, 16 nt, Mycobacterium bovis subsp bovis AF2122/97
ggccggggcgaacggc

SEQ ID NO: 1189826 - RNA, 17 nt, Mycobacterium bovis subsp bovis AF2122/97
ggccgggucgcgcuggc

SEQ ID NO: 1189827 - RNA, 21 nt, Mycobacterium bovis subsp bovis AF2122/97
ggccggguuaucggcagcagg

SEQ ID NO: 1189828 - RNA, 22 nt, Mycobacterium bovis subsp bovis AF2122/97
ggccggguuaucggcagcagga

SEQ ID NO: 1189829 - RNA, 17 nt, Mycobacterium bovis subsp bovis AF2122/97
ggccggguuccagcggc

SEQ ID NO: 1189830 - RNA, 12 nt, Mycobacterium bovis subsp bovis AF2122/97
ggccgggcggcc

SEQ ID NO: 1189831 - RNA, 16 nt, Mycobacterium bovis subsp bovis AF2122/97
ggccgggcggccaggc

SEQ ID NO: 1189832 - RNA, 23 nt, Mycobacterium bovis subsp bovis AF2122/97
ggccgggcgaucgccugggcuug

SEQ ID NO: 1189833 - RNA, 17 nt, Mycobacterium bovis subsp bovis AF2122/97
ggccgggcgcaagcagc

SEQ ID NO: 1189834 - RNA, 22 nt, Mycobacterium bovis subsp bovis AF2122/97
ggccgggcccuccacugcgagc

SEQ ID NO: 1189835 - RNA, 13 nt, Mycobacterium bovis subsp bovis AF2122/97
ggccggcgcggcg

SEQ ID NO: 1189836 - RNA, 14 nt, Mycobacterium bovis subsp bovis AF2122/97
ggccggcggcggcg

SEQ ID NO: 1189837 - RNA, 22 nt, Mycobacterium bovis subsp bovis AF2122/97
ggccggcggcggcgcucggcca

SEQ ID NO: 1189838 - RNA, 17 nt, Mycobacterium bovis subsp bovis AF2122/97
ggccggcggucagcagc

SEQ ID NO: 1189839 - RNA, 17 nt, Mycobacterium bovis subsp bovis AF2122/97
ggccggcggucgccagu

SEQ ID NO: 1189840 - RNA, 17 nt, Mycobacterium bovis subsp bovis AF2122/97
ggccggcgugccagcac

SEQ ID NO: 1189841 - RNA, 20 nt, Mycobacterium bovis subsp bovis AF2122/97
ggccggcucagucacgcacu

SEQ ID NO: 1189842 - RNA, 13 nt, Mycobacterium bovis subsp bovis AF2122/97
ggccgggcagugc

SEQ ID NO: 1189843 - RNA, 22 nt, Mycobacterium bovis subsp bovis AF2122/97
ggccgucgcgaaacaccagaca

SEQ ID NO: 1189844 - RNA, 15 nt, Mycobacterium bovis subsp bovis AF2122/97
ggccgucggccggau

SEQ ID NO: 1189845 - RNA, 12 nt, Mycobacterium bovis subsp bovis AF2122/97
ggccgucgccgg

SEQ ID NO: 1189846 - RNA, 12 nt, Mycobacterium bovis subsp bovis AF2122/97
ggccgucgccgu

SEQ ID NO: 1189847 - RNA, 19 nt, Mycobacterium bovis subsp bovis AF2122/97
ggccgucgaacgguagcac

SEQ ID NO: 1189848 - RNA, 18 nt, Mycobacterium bovis subsp bovis AF2122/97
ggccguccucggucagcu

SEQ ID NO: 1189849 - RNA, 15 nt, Mycobacterium bovis subsp bovis AF2122/97
ggccgucccaccagc

SEQ ID NO: 1189850 - RNA, 21 nt, Mycobacterium bovis subsp bovis AF2122/97
ggccgucccgcgagcagcccg

SEQ ID NO: 1189851 - RNA, 16 nt, Mycobacterium bovis subsp bovis AF2122/97
ggccgucauggcccga

SEQ ID NO: 1189852 - RNA, 17 nt, Mycobacterium bovis subsp bovis AF2122/97
ggccgucagcgucggcg

SEQ ID NO: 1189853 - RNA, 15 nt, Mycobacterium bovis subsp bovis AF2122/97
ggccguacggcgcgu

SEQ ID NO: 1189854 - RNA, 18 nt, Mycobacterium bovis subsp bovis AF2122/97
ggccguagcccacgacga

SEQ ID NO: 1189855 - RNA, 18 nt, Mycobacterium bovis subsp bovis AF2122/97
ggccguaguggccggcuu

SEQ ID NO: 1189856 - RNA, 14 nt, Mycobacterium bovis subsp bovis AF2122/97
ggccguaggcggcg

SEQ ID NO: 1189857 - RNA, 17 nt, Mycobacterium bovis subsp bovis AF2122/97
ggccguaggcggcgacc

SEQ ID NO: 1189858 - RNA, 20 nt, Mycobacterium bovis subsp bovis AF2122/97
ggccgguaccgggacgaauc

SEQ ID NO: 1189859 - RNA, 21 nt, Mycobacterium bovis subsp bovis AF2122/97
ggccgguaccgggacgaaucc

SEQ ID NO: 1189860 - RNA, 14 nt, Mycobacterium bovis subsp bovis AF2122/97
ggccgguaguagcu

SEQ ID NO: 1189861 - RNA, 19 nt, Mycobacterium bovis subsp bovis AF2122/97
ggccggucacguccgcggg

SEQ ID NO: 1189862 - RNA, 16 nt, Mycobacterium bovis subsp bovis AF2122/97
ggccggugcagcacgu

SEQ ID NO: 1189863 - RNA, 20 nt, Mycobacterium bovis subsp bovis AF2122/97
ggccggugcgaauggugcaa

SEQ ID NO: 1189864 - RNA, 13 nt, Mycobacterium bovis subsp bovis AF2122/97
ggccggugcgccc

SEQ ID NO: 1189865 - RNA, 15 nt, Mycobacterium bovis subsp bovis AF2122/97
ggccggugcccgggc

SEQ ID NO: 1189866 - RNA, 12 nt, Mycobacterium bovis subsp bovis AF2122/97
ggccgguuggcc

SEQ ID NO: 1189867 - RNA, 19 nt, Mycobacterium bovis subsp bovis AF2122/97
ggccgguggguagccagcg

SEQ ID NO: 1189868 - RNA, 21 nt, Mycobacterium bovis subsp bovis AF2122/97
ggccgguggguagccagcgcg

SEQ ID NO: 1189869 - RNA, 19 nt, Mycobacterium bovis subsp bovis AF2122/97
ggccgguggaaaccgggcg

SEQ ID NO: 1189870 - RNA, 20 nt, Mycobacterium bovis subsp bovis AF2122/97
ggccgguuagcaccaguucc

SEQ ID NO: 1189871 - RNA, 14 nt, Mycobacterium bovis subsp bovis AF2122/97
ggccguacgacggc

SEQ ID NO: 1189872 - RNA, 13 nt, Mycobacterium bovis subsp bovis AF2122/97
ggccgcggccucg

SEQ ID NO: 1189873 - RNA, 17 nt, Mycobacterium bovis subsp bovis AF2122/97
ggccgcggcggccagcg

SEQ ID NO: 1189874 - RNA, 19 nt, Mycobacterium bovis subsp bovis AF2122/97
ggccgcggcggccagcgca

SEQ ID NO: 1189875 - RNA, 12 nt, Mycobacterium bovis subsp bovis AF2122/97
ggccgcggccuc

SEQ ID NO: 1189876 - RNA, 19 nt, Mycobacterium bovis subsp bovis AF2122/97
ggccgcgcugcagcacggc

SEQ ID NO: 1189877 - RNA, 13 nt, Mycobacterium bovis subsp bovis AF2122/97
ggccgcggagaag

SEQ ID NO: 1189878 - RNA, 22 nt, Mycobacterium bovis subsp bovis AF2122/97
ggccgcggagaaggcgcgggcg

SEQ ID NO: 1189879 - RNA, 13 nt, Mycobacterium bovis subsp bovis AF2122/97
ggccgcggcgucg

SEQ ID NO: 1189880 - RNA, 14 nt, Mycobacterium bovis subsp bovis AF2122/97
ggccgcggucggcc

SEQ ID NO: 1189881 - RNA, 17 nt, Mycobacterium bovis subsp bovis AF2122/97
ggccgcggucggccacc

SEQ ID NO: 1189882 - RNA, 22 nt, Mycobacterium bovis subsp bovis AF2122/97
ggccgcggucgauguccgcagc

SEQ ID NO: 1189883 - RNA, 20 nt, Mycobacterium bovis subsp bovis AF2122/97
ggccgcuccagguagagucc

SEQ ID NO: 1189884 - RNA, 13 nt, Mycobacterium bovis subsp bovis AF2122/97
ggccgcugggccg

SEQ ID NO: 1189885 - RNA, 13 nt, Mycobacterium bovis subsp bovis AF2122/97
ggccgcuccacca

SEQ ID NO: 1189886 - RNA, 19 nt, Mycobacterium bovis subsp bovis AF2122/97
ggccggaagauccgggccu

SEQ ID NO: 1189887 - RNA, 17 nt, Mycobacterium bovis subsp bovis AF2122/97
ggccgcuugccccgccu

SEQ ID NO: 1189888 - RNA, 13 nt, Mycobacterium bovis subsp bovis AF2122/97
ggccggcauccgg

SEQ ID NO: 1189889 - RNA, 13 nt, Mycobacterium bovis subsp bovis AF2122/97
ggccggccagcac

SEQ ID NO: 1189890 - RNA, 13 nt, Mycobacterium bovis subsp bovis AF2122/97
ggccggccgagcg

SEQ ID NO: 1189891 - RNA, 16 nt, Mycobacterium bovis subsp bovis AF2122/97
ggccggccccgcccgc

SEQ ID NO: 1189892 - RNA, 20 nt, Mycobacterium bovis subsp bovis AF2122/97
ggccggccgagcgcacuggg

SEQ ID NO: 1189893 - RNA, 11 nt, Mycobacterium bovis subsp bovis AF2122/97
ggccggccgcg

SEQ ID NO: 1189894 - RNA, 15 nt, Mycobacterium bovis subsp bovis AF2122/97
ggccggccgguggcc

SEQ ID NO: 1189895 - RNA, 15 nt, Mycobacterium bovis subsp bovis AF2122/97
ggccggcgcaguggu

SEQ ID NO: 1189896 - RNA, 17 nt, Mycobacterium bovis subsp bovis AF2122/97
ggccggcgccggcgcgu

SEQ ID NO: 1189897 - RNA, 18 nt, Mycobacterium bovis subsp bovis AF2122/97
ggccggcaacggcgcgcc

SEQ ID NO: 1189898 - RNA, 15 nt, Mycobacterium bovis subsp bovis AF2122/97
ggccggcacccacca

SEQ ID NO: 1189899 - RNA, 14 nt, Mycobacterium bovis subsp bovis AF2122/97
ggccggcaccccac

SEQ ID NO: 1189900 - RNA, 17 nt, Mycobacterium bovis subsp bovis AF2122/97
ggccggcaccccacggc

SEQ ID NO: 1189901 - RNA, 18 nt, Mycobacterium bovis subsp bovis AF2122/97
ggccggagggguuagguu

SEQ ID NO: 1189902 - RNA, 17 nt, Mycobacterium bovis subsp bovis AF2122/97
ggccggaguccgucggg

SEQ ID NO: 1189903 - RNA, 14 nt, Mycobacterium bovis subsp bovis AF2122/97
ggccggacgggugc

SEQ ID NO: 1189904 - RNA, 14 nt, Mycobacterium bovis subsp bovis AF2122/97
ggccggagccgccg

SEQ ID NO: 1189905 - RNA, 18 nt, Mycobacterium bovis subsp bovis AF2122/97
ggccggagccggugccga

SEQ ID NO: 1189906 - RNA, 12 nt, Mycobacterium bovis subsp bovis AF2122/97
ggccggagcgca

SEQ ID NO: 1189907 - RNA, 21 nt, Mycobacterium bovis subsp bovis AF2122/97
ggcccuuguuggccugcaacg

SEQ ID NO: 1189908 - RNA, 17 nt, Mycobacterium bovis subsp bovis AF2122/97
ggcccuugcucguccag

SEQ ID NO: 1189909 - RNA, 20 nt, Mycobacterium bovis subsp bovis AF2122/97
ggccgaaacuucgcccgggc

SEQ ID NO: 1189910 - RNA, 18 nt, Mycobacterium bovis subsp bovis AF2122/97
ggcccuagccggcgcgcc

SEQ ID NO: 1189911 - RNA, 14 nt, Mycobacterium bovis subsp bovis AF2122/97
ggcccuggccagcc

SEQ ID NO: 1189912 - RNA, 23 nt, Mycobacterium bovis subsp bovis AF2122/97
ggcccugggugguuccgcgcggc

SEQ ID NO: 1189913 - RNA, 14 nt, Mycobacterium bovis subsp bovis AF2122/97
ggcccgguucgagg

SEQ ID NO: 1189914 - RNA, 16 nt, Mycobacterium bovis subsp bovis AF2122/97
ggcccguagccgagcu

SEQ ID NO: 1189915 - RNA, 16 nt, Mycobacterium bovis subsp bovis AF2122/97
ggcccgucggcgugcg

SEQ ID NO: 1189916 - RNA, 22 nt, Mycobacterium bovis subsp bovis AF2122/97
ggcccgucggcgugcggacuga

SEQ ID NO: 1189917 - RNA, 19 nt, Mycobacterium bovis subsp bovis AF2122/97
ggcccguuggcagcacagg

SEQ ID NO: 1189918 - RNA, 21 nt, Mycobacterium bovis subsp bovis AF2122/97
ggcccgugccacagcucgccg

SEQ ID NO: 1189919 - RNA, 21 nt, Mycobacterium bovis subsp bovis AF2122/97
ggcccguuggcagcacaggcu

SEQ ID NO: 1189920 - RNA, 17 nt, Mycobacterium bovis subsp bovis AF2122/97
ggcccgggcggccagcu

SEQ ID NO: 1189921 - RNA, 18 nt, Mycobacterium bovis subsp bovis AF2122/97
ggcccgggcggccagcug

SEQ ID NO: 1189922 - RNA, 16 nt, Mycobacterium bovis subsp bovis AF2122/97
ggcccgggucuccggc

SEQ ID NO: 1189923 - RNA, 19 nt, Mycobacterium bovis subsp bovis AF2122/97
ggcccgggucuccggcgca

SEQ ID NO: 1189924 - RNA, 20 nt, Mycobacterium bovis subsp bovis AF2122/97
ggcccggugcucaagcgcgu

SEQ ID NO: 1189925 - RNA, 13 nt, Mycobacterium bovis subsp bovis AF2122/97
ggcccggcgcggc

SEQ ID NO: 1189926 - RNA, 18 nt, Mycobacterium bovis subsp bovis AF2122/97
ggcccggcuacgacggcg

SEQ ID NO: 1189927 - RNA, 20 nt, Mycobacterium bovis subsp bovis AF2122/97
ggcccggcucacagcacagc

SEQ ID NO: 1189928 - RNA, 14 nt, Mycobacterium bovis subsp bovis AF2122/97
ggcccggcgcggcc

SEQ ID NO: 1189929 - RNA, 15 nt, Mycobacterium bovis subsp bovis AF2122/97
ggcccgccggccccg

SEQ ID NO: 1189930 - RNA, 21 nt, Mycobacterium bovis subsp bovis AF2122/97
ggcccgccggccccgccggcc

SEQ ID NO: 1189931 - RNA, 14 nt, Mycobacterium bovis subsp bovis AF2122/97
ggcccgccgucacc

SEQ ID NO: 1189932 - RNA, 23 nt, Mycobacterium bovis subsp bovis AF2122/97
ggcccgcgcgagagccuccaugg

SEQ ID NO: 1189933 - RNA, 22 nt, Mycobacterium bovis subsp bovis AF2122/97
ggcccgagccgcgugggccgcu

SEQ ID NO: 1189934 - RNA, 15 nt, Mycobacterium bovis subsp bovis AF2122/97
ggcccgagcgcgcgc

SEQ ID NO: 1189935 - RNA, 17 nt, Mycobacterium bovis subsp bovis AF2122/97
ggcccgagcgcgcgcug

SEQ ID NO: 1189936 - RNA, 14 nt, Mycobacterium bovis subsp bovis AF2122/97
ggcccgacggcgcc

SEQ ID NO: 1189937 - RNA, 18 nt, Mycobacterium bovis subsp bovis AF2122/97
ggcccgacggcgcccagc

SEQ ID NO: 1189938 - RNA, 20 nt, Mycobacterium bovis subsp bovis AF2122/97
ggcccgacggcgcccagcgc

SEQ ID NO: 1189939 - RNA, 22 nt, Mycobacterium bovis subsp bovis AF2122/97
ggcccgacggguaucccguccc

SEQ ID NO: 1189940 - RNA, 19 nt, Mycobacterium bovis subsp bovis AF2122/97
ggcccgccgaguucugcug

SEQ ID NO: 1189941 - RNA, 19 nt, Mycobacterium bovis subsp bovis AF2122/97
ggcccgaggugccggggcc

SEQ ID NO: 1189942 - RNA, 22 nt, Mycobacterium bovis subsp bovis AF2122/97
ggcccgaguuggcgaagcccga

SEQ ID NO: 1189943 - RNA, 12 nt, Mycobacterium bovis subsp bovis AF2122/97
ggcccacggcag

SEQ ID NO: 1189944 - RNA, 23 nt, Mycobacterium bovis subsp bovis AF2122/97
ggcccacgcgcacucgaccagga

SEQ ID NO: 1189945 - RNA, 20 nt, Mycobacterium bovis subsp bovis AF2122/97
ggccccguccgauuucccag

SEQ ID NO: 1189946 - RNA, 15 nt, Mycobacterium bovis subsp bovis AF2122/97
ggccccgggcgguga

SEQ ID NO: 1189947 - RNA, 21 nt, Mycobacterium bovis subsp bovis AF2122/97
ggccgccgcugccgccugcag

SEQ ID NO: 1189948 - RNA, 14 nt, Mycobacterium bovis subsp bovis AF2122/97
ggccgccggccagc

SEQ ID NO: 1189949 - RNA, 14 nt, Mycobacterium bovis subsp bovis AF2122/97
ggccgccggccgcg

SEQ ID NO: 1189950 - RNA, 13 nt, Mycobacterium bovis subsp bovis AF2122/97
ggccgccggcgcc

SEQ ID NO: 1189951 - RNA, 12 nt, Mycobacterium bovis subsp bovis AF2122/97
ggccgccguccc

SEQ ID NO: 1189952 - RNA, 14 nt, Mycobacterium bovis subsp bovis AF2122/97
ggccgccggcgccg

SEQ ID NO: 1189953 - RNA, 19 nt, Mycobacterium bovis subsp bovis AF2122/97
ggccgccguccccgccguc

SEQ ID NO: 1189954 - RNA, 15 nt, Mycobacterium bovis subsp bovis AF2122/97
ggccgccuccgcggc

SEQ ID NO: 1189955 - RNA, 16 nt, Mycobacterium bovis subsp bovis AF2122/97
ggccgccuccgcggca

SEQ ID NO: 1189956 - RNA, 21 nt, Mycobacterium bovis subsp bovis AF2122/97
ggccgcgaaugcugugccgag

SEQ ID NO: 1189957 - RNA, 13 nt, Mycobacterium bovis subsp bovis AF2122/97
ggccgcgaccagc

SEQ ID NO: 1189958 - RNA, 15 nt, Mycobacterium bovis subsp bovis AF2122/97
ggccgcgaccagcgc

SEQ ID NO: 1189959 - RNA, 15 nt, Mycobacterium bovis subsp bovis AF2122/97
ggccgcgacgacacg

SEQ ID NO: 1189960 - RNA, 17 nt, Mycobacterium bovis subsp bovis AF2122/97
ggccgcgauccagcgcu

SEQ ID NO: 1189961 - RNA, 14 nt, Mycobacterium bovis subsp bovis AF2122/97
ggccgcgauccagc

SEQ ID NO: 1189962 - RNA, 19 nt, Mycobacterium bovis subsp bovis AF2122/97
ggccgcgcaggggcggcgu

SEQ ID NO: 1189963 - RNA, 22 nt, Mycobacterium bovis subsp bovis AF2122/97
ggccgcgauggugcgccgggcg

SEQ ID NO: 1189964 - RNA, 13 nt, Mycobacterium bovis subsp bovis AF2122/97
ggccgcgcaggcu

SEQ ID NO: 1189965 - RNA, 22 nt, Mycobacterium bovis subsp bovis AF2122/97
ggccgcgcgacaacccggcguc

SEQ ID NO: 1189966 - RNA, 17 nt, Mycobacterium bovis subsp bovis AF2122/97
ggccgcgcggacccagc

SEQ ID NO: 1189967 - RNA, 14 nt, Mycobacterium bovis subsp bovis AF2122/97
ggccgcgcucgucg

SEQ ID NO: 1189968 - RNA, 15 nt, Mycobacterium bovis subsp bovis AF2122/97
ggccgccaccgcacg

SEQ ID NO: 1189969 - RNA, 16 nt, Mycobacterium bovis subsp bovis AF2122/97
ggccgccaccgucacc

SEQ ID NO: 1189970 - RNA, 19 nt, Mycobacterium bovis subsp bovis AF2122/97
ggccgccaccgucaccgcc

SEQ ID NO: 1189971 - RNA, 12 nt, Mycobacterium bovis subsp bovis AF2122/97
ggccgccagcgc

SEQ ID NO: 1189972 - RNA, 20 nt, Mycobacterium bovis subsp bovis AF2122/97
ggccgccagccccacccgca

SEQ ID NO: 1189973 - RNA, 13 nt, Mycobacterium bovis subsp bovis AF2122/97
ggccgccagccgg

SEQ ID NO: 1189974 - RNA, 23 nt, Mycobacterium bovis subsp bovis AF2122/97
ggccgcccgcuccaacacccgcc

SEQ ID NO: 1189975 - RNA, 23 nt, Mycobacterium bovis subsp bovis AF2122/97
ggccgccgacuccccgccgggca

SEQ ID NO: 1189976 - RNA, 21 nt, Mycobacterium bovis subsp bovis AF2122/97
ggccgcccuggccgcccagac

SEQ ID NO: 1189977 - RNA, 18 nt, Mycobacterium bovis subsp bovis AF2122/97
ggccgccgaaacucacca

SEQ ID NO: 1189978 - RNA, 12 nt, Mycobacterium bovis subsp bovis AF2122/97
ggccgccgcccc

SEQ ID NO: 1189979 - RNA, 15 nt, Mycobacterium bovis subsp bovis AF2122/97
ggccgccgccccggc

SEQ ID NO: 1189980 - RNA, 14 nt, Mycobacterium bovis subsp bovis AF2122/97
ggccgccgcagcuc

SEQ ID NO: 1189981 - RNA, 13 nt, Mycobacterium bovis subsp bovis AF2122/97
ggccgccgcgccg

SEQ ID NO: 1189982 - RNA, 13 nt, Mycobacterium bovis subsp bovis AF2122/97
ggccgccgcggcc

SEQ ID NO: 1189983 - RNA, 20 nt, Mycobacterium bovis subsp bovis AF2122/97
ggccgagagcagccagccac

SEQ ID NO: 1189984 - RNA, 18 nt, Mycobacterium bovis subsp bovis AF2122/97
ggccgcauauugcggcgc

SEQ ID NO: 1189985 - RNA, 19 nt, Mycobacterium bovis subsp bovis AF2122/97
ggccgcauauugcggcgcc

SEQ ID NO: 1189986 - RNA, 20 nt, Mycobacterium bovis subsp bovis AF2122/97
ggccgcauauugcggcgccg

SEQ ID NO: 1189987 - RNA, 23 nt, Mycobacterium bovis subsp bovis AF2122/97
ggccgacggcaaaccaguuggcg

SEQ ID NO: 1189988 - RNA, 14 nt, Mycobacterium bovis subsp bovis AF2122/97
ggccgacgcugcug

SEQ ID NO: 1189989 - RNA, 19 nt, Mycobacterium bovis subsp bovis AF2122/97
ggccgacgugaccagcuuc

SEQ ID NO: 1189990 - RNA, 22 nt, Mycobacterium bovis subsp bovis AF2122/97
ggccgaccgcgacccggcccag

SEQ ID NO: 1189991 - RNA, 19 nt, Mycobacterium bovis subsp bovis AF2122/97
ggccagcgucaacagcgug

SEQ ID NO: 1189992 - RNA, 13 nt, Mycobacterium bovis subsp bovis AF2122/97
ggccagcggguga

SEQ ID NO: 1189993 - RNA, 22 nt, Mycobacterium bovis subsp bovis AF2122/97
ggccagcgguaaugccagcggc

SEQ ID NO: 1189994 - RNA, 16 nt, Mycobacterium bovis subsp bovis AF2122/97
ggccagccuaccggcu

SEQ ID NO: 1189995 - RNA, 20 nt, Mycobacterium bovis subsp bovis AF2122/97
ggccagcgucaacagcgugg

SEQ ID NO: 1189996 - RNA, 17 nt, Mycobacterium bovis subsp bovis AF2122/97
ggccagcguguccgcca

SEQ ID NO: 1189997 - RNA, 12 nt, Mycobacterium bovis subsp bovis AF2122/97
ggccagcucgcg

SEQ ID NO: 1189998 - RNA, 23 nt, Mycobacterium bovis subsp bovis AF2122/97
ggccagcucccgggcggcggccu

SEQ ID NO: 1189999 - RNA, 17 nt, Mycobacterium bovis subsp bovis AF2122/97
ggccagcuccucagcca

SEQ ID NO: 1190000 - RNA, 22 nt, Mycobacterium bovis subsp bovis AF2122/97
ggccaggccguaguggccggcu

SEQ ID NO: 1190001 - RNA, 15 nt, Mycobacterium bovis subsp bovis AF2122/97
ggccaggccggcggc

SEQ ID NO: 1190002 - RNA, 18 nt, Mycobacterium bovis subsp bovis AF2122/97
ggccaggcuggccaacuu

SEQ ID NO: 1190003 - RNA, 16 nt, Mycobacterium bovis subsp bovis AF2122/97
ggccagguggcgagcg

SEQ ID NO: 1190004 - RNA, 23 nt, Mycobacterium bovis subsp bovis AF2122/97
ggccaggcgguacgggucgccgg

SEQ ID NO: 1190005 - RNA, 14 nt, Mycobacterium bovis subsp bovis AF2122/97
ggccaggugcaggc

SEQ ID NO: 1190006 - RNA, 15 nt, Mycobacterium bovis subsp bovis AF2122/97
ggccaggugcagggu

SEQ ID NO: 1190007 - RNA, 16 nt, Mycobacterium bovis subsp bovis AF2122/97
ggccaucgagggcauc

SEQ ID NO: 1190008 - RNA, 17 nt, Mycobacterium bovis subsp bovis AF2122/97
ggccaucccggccucca

SEQ ID NO: 1190009 - RNA, 21 nt, Mycobacterium bovis subsp bovis AF2122/97
ggccaucgcgcggaccagagu

SEQ ID NO: 1190010 - RNA, 17 nt, Mycobacterium bovis subsp bovis AF2122/97
ggccaucguccagcagg

SEQ ID NO: 1190011 - RNA, 18 nt, Mycobacterium bovis subsp bovis AF2122/97
ggccaucgugcggcacuc

SEQ ID NO: 1190012 - RNA, 14 nt, Mycobacterium bovis subsp bovis AF2122/97
ggccagucgugcuu

SEQ ID NO: 1190013 - RNA, 13 nt, Mycobacterium bovis subsp bovis AF2122/97
ggccagugccacc

SEQ ID NO: 1190014 - RNA, 14 nt, Mycobacterium bovis subsp bovis AF2122/97
ggccaguacgucga

SEQ ID NO: 1190015 - RNA, 22 nt, Mycobacterium bovis subsp bovis AF2122/97
ggccaguaugcggugcccgccc

SEQ ID NO: 1190016 - RNA, 17 nt, Mycobacterium bovis subsp bovis AF2122/97
ggcccaccagcgcagcc

SEQ ID NO: 1190017 - RNA, 16 nt, Mycobacterium bovis subsp bovis AF2122/97
ggcccaauugcgccga

SEQ ID NO: 1190018 - RNA, 16 nt, Mycobacterium bovis subsp bovis AF2122/97
ggcccacaccagcgca

SEQ ID NO: 1190019 - RNA, 15 nt, Mycobacterium bovis subsp bovis AF2122/97
ggcccaccggccacu

SEQ ID NO: 1190020 - RNA, 18 nt, Mycobacterium bovis subsp bovis AF2122/97
ggcccaccgcugcggcac

SEQ ID NO: 1190021 - RNA, 20 nt, Mycobacterium bovis subsp bovis AF2122/97
ggcccaccgccguugggccg

SEQ ID NO: 1190022 - RNA, 19 nt, Mycobacterium bovis subsp bovis AF2122/97
ggcccaccagcgcagccga

SEQ ID NO: 1190023 - RNA, 20 nt, Mycobacterium bovis subsp bovis AF2122/97
ggccaccuuagcgcuugccg

SEQ ID NO: 1190024 - RNA, 16 nt, Mycobacterium bovis subsp bovis AF2122/97
ggccacgaacccucag

SEQ ID NO: 1190025 - RNA, 22 nt, Mycobacterium bovis subsp bovis AF2122/97
ggccacgcauuccagcaggcca

SEQ ID NO: 1190026 - RNA, 22 nt, Mycobacterium bovis subsp bovis AF2122/97
ggccacgguccggcccaccagc

SEQ ID NO: 1190027 - RNA, 15 nt, Mycobacterium bovis subsp bovis AF2122/97
ggccacguagcagca

SEQ ID NO: 1190028 - RNA, 16 nt, Mycobacterium bovis subsp bovis AF2122/97
ggccaccuccgaggcc

SEQ ID NO: 1190029 - RNA, 16 nt, Mycobacterium bovis subsp bovis AF2122/97
ggccaccucuucucgg

SEQ ID NO: 1190030 - RNA, 12 nt, Mycobacterium bovis subsp bovis AF2122/97
ggccaccguccc

SEQ ID NO: 1190031 - RNA, 18 nt, Mycobacterium bovis subsp bovis AF2122/97
ggccaccaccaggcugac

SEQ ID NO: 1190032 - RNA, 20 nt, Mycobacterium bovis subsp bovis AF2122/97
ggccaccguaaacagcgcgc

SEQ ID NO: 1190033 - RNA, 16 nt, Mycobacterium bovis subsp bovis AF2122/97
ggccaccguagccagc

SEQ ID NO: 1190034 - RNA, 14 nt, Mycobacterium bovis subsp bovis AF2122/97
ggccacagcccggc

SEQ ID NO: 1190035 - RNA, 18 nt, Mycobacterium bovis subsp bovis AF2122/97
ggccaauagaagcacguc

SEQ ID NO: 1190036 - RNA, 22 nt, Mycobacterium bovis subsp bovis AF2122/97
ggccaaugacgucggaccagcu

SEQ ID NO: 1190037 - RNA, 17 nt, Mycobacterium bovis subsp bovis AF2122/97
ggccaauggccugcagc

SEQ ID NO: 1190038 - RNA, 15 nt, Mycobacterium bovis subsp bovis AF2122/97
ggccacaaccucguc

SEQ ID NO: 1190039 - RNA, 21 nt, Mycobacterium bovis subsp bovis AF2122/97
ggccacaccuuggccgccggc

SEQ ID NO: 1190040 - RNA, 14 nt, Mycobacterium bovis subsp bovis AF2122/97
ggccacaaucgcgg

SEQ ID NO: 1190041 - RNA, 18 nt, Mycobacterium bovis subsp bovis AF2122/97
ggccacacagucacggac

SEQ ID NO: 1190042 - RNA, 23 nt, Mycobacterium bovis subsp bovis AF2122/97
ggccacaggaagcgaccgucguc

SEQ ID NO: 1190043 - RNA, 12 nt, Mycobacterium bovis subsp bovis AF2122/97
ggccacauccag

SEQ ID NO: 1190044 - RNA, 15 nt, Mycobacterium bovis subsp bovis AF2122/97
ggccacauccagcgc

SEQ ID NO: 1190045 - RNA, 18 nt, Mycobacterium bovis subsp bovis AF2122/97
ggccacaucgccagcagc

SEQ ID NO: 1190046 - RNA, 14 nt, Mycobacterium bovis subsp bovis AF2122/97
ggccagcagcagau

SEQ ID NO: 1190047 - RNA, 22 nt, Mycobacterium bovis subsp bovis AF2122/97
ggccagcagcgacuccagcgcc

SEQ ID NO: 1190048 - RNA, 14 nt, Mycobacterium bovis subsp bovis AF2122/97
ggccagcgcaccgc

SEQ ID NO: 1190049 - RNA, 14 nt, Mycobacterium bovis subsp bovis AF2122/97
ggccagccgcggcc

SEQ ID NO: 1190050 - RNA, 13 nt, Mycobacterium bovis subsp bovis AF2122/97
ggccagcacgccg

SEQ ID NO: 1190051 - RNA, 18 nt, Mycobacterium bovis subsp bovis AF2122/97
ggccagcacgccgccggc

SEQ ID NO: 1190052 - RNA, 20 nt, Mycobacterium bovis subsp bovis AF2122/97
ggccagcaccucgaccgcca

SEQ ID NO: 1190053 - RNA, 15 nt, Mycobacterium bovis subsp bovis AF2122/97
ggccagaccgcgcgc

SEQ ID NO: 1190054 - RNA, 11 nt, Mycobacterium bovis subsp bovis AF2122/97
ggccagcagca

SEQ ID NO: 1190055 - RNA, 12 nt, Mycobacterium bovis subsp bovis AF2122/97
ggccagcagcaa

SEQ ID NO: 1190056 - RNA, 23 nt, Mycobacterium bovis subsp bovis AF2122/97
ggccagacggugcagcuccccgc

SEQ ID NO: 1190057 - RNA, 19 nt, Mycobacterium bovis subsp bovis AF2122/97
ggccagcacgccgccggcc

SEQ ID NO: 1190058 - RNA, 24 nt, Mycobacterium bovis subsp bovis AF2122/97
ggccagcacgccgccggccgccag

SEQ ID NO: 1190059 - RNA, 16 nt, Mycobacterium bovis subsp bovis AF2122/97
ggccagcagagcggca

SEQ ID NO: 1190060 - RNA, 18 nt, Mycobacterium bovis subsp bovis AF2122/97
ggccacugauucgcaggc

SEQ ID NO: 1190061 - RNA, 19 nt, Mycobacterium bovis subsp bovis AF2122/97
ggccacuugaugcucgaug

SEQ ID NO: 1190062 - RNA, 18 nt, Mycobacterium bovis subsp bovis AF2122/97
ggccacguccucagccgu

SEQ ID NO: 1190063 - RNA, 21 nt, Mycobacterium bovis subsp bovis AF2122/97
ggccacguccugcccgucguc

SEQ ID NO: 1190064 - RNA, 16 nt, Mycobacterium bovis subsp bovis AF2122/97
ggccacuccgguggcc

SEQ ID NO: 1190065 - RNA, 21 nt, Mycobacterium bovis subsp bovis AF2122/97
ggccacuccgguggccaacac

SEQ ID NO: 1190066 - RNA, 20 nt, Mycobacterium bovis subsp bovis AF2122/97
ggccacucacauuggccagg

SEQ ID NO: 1190067 - RNA, 15 nt, Mycobacterium bovis subsp bovis AF2122/97
ggccaacccgggccg

SEQ ID NO: 1190068 - RNA, 18 nt, Mycobacterium bovis subsp bovis AF2122/97
ggccaaccgggugugcgu

SEQ ID NO: 1190069 - RNA, 15 nt, Mycobacterium bovis subsp bovis AF2122/97
ggccaaccggucguc

SEQ ID NO: 1190070 - RNA, 13 nt, Mycobacterium bovis subsp bovis AF2122/97
ggccaacggcucc

SEQ ID NO: 1190071 - RNA, 16 nt, Mycobacterium bovis subsp bovis AF2122/97
ggccaacuuggcggcc

SEQ ID NO: 1190072 - RNA, 20 nt, Mycobacterium bovis subsp bovis AF2122/97
ggccaacuuggcggccagcc

SEQ ID NO: 1190073 - RNA, 22 nt, Mycobacterium bovis subsp bovis AF2122/97
ggccaacuuggcggccagccgc

SEQ ID NO: 1190074 - RNA, 18 nt, Mycobacterium bovis subsp bovis AF2122/97
ggccaacugggccgagcg

SEQ ID NO: 1190075 - RNA, 20 nt, Mycobacterium bovis subsp bovis AF2122/97
ggccaacucuucagcaagcc

SEQ ID NO: 1190076 - RNA, 21 nt, Mycobacterium bovis subsp bovis AF2122/97
ggccaagggugcuugucgccg

SEQ ID NO: 1190077 - RNA, 15 nt, Mycobacterium bovis subsp bovis AF2122/97
ggccaagguggccac

SEQ ID NO: 1190078 - RNA, 21 nt, Mycobacterium bovis subsp bovis AF2122/97
ggccaagaaugugggcgacgg

SEQ ID NO: 1190079 - RNA, 21 nt, Mycobacterium bovis subsp bovis AF2122/97
ggccaagaucggcgccccugc

SEQ ID NO: 1190080 - RNA, 14 nt, Mycobacterium bovis subsp bovis AF2122/97
ggccaagccgcggc

SEQ ID NO: 1190081 - RNA, 14 nt, Mycobacterium bovis subsp bovis AF2122/97
ggccaaccccaugg

SEQ ID NO: 1190082 - RNA, 20 nt, Mycobacterium bovis subsp bovis AF2122/97
ggccaaccccauggccagcg

SEQ ID NO: 1190083 - RNA, 21 nt, Mycobacterium bovis subsp bovis AF2122/97
ggccaacaccacuagcggcuc

SEQ ID NO: 1190084 - RNA, 18 nt, Mycobacterium bovis subsp bovis AF2122/97
ggccaacaccgccagcau

SEQ ID NO: 1190085 - RNA, 21 nt, Mycobacterium bovis subsp bovis AF2122/97
ggccaaagacccggcacccag

SEQ ID NO: 1190086 - RNA, 14 nt, Mycobacterium bovis subsp bovis AF2122/97
ggcauccuucacca

SEQ ID NO: 1190087 - RNA, 17 nt, Mycobacterium bovis subsp bovis AF2122/97
ggcaucgacugccagcg

SEQ ID NO: 1190088 - RNA, 16 nt, Mycobacterium bovis subsp bovis AF2122/97
ggcaucgagacgagcc

SEQ ID NO: 1190089 - RNA, 18 nt, Mycobacterium bovis subsp bovis AF2122/97
ggcauccgccccgcccgc

SEQ ID NO: 1190090 - RNA, 22 nt, Mycobacterium bovis subsp bovis AF2122/97
ggcauccugcacgacccgcugg

SEQ ID NO: 1190091 - RNA, 20 nt, Mycobacterium bovis subsp bovis AF2122/97
ggcaucgaauuccagccagc

SEQ ID NO: 1190092 - RNA, 20 nt, Mycobacterium bovis subsp bovis AF2122/97
ggcaucuccaccgucgccgc

SEQ ID NO: 1190093 - RNA, 22 nt, Mycobacterium bovis subsp bovis AF2122/97
ggcaucucgcaccgcgccgugg

SEQ ID NO: 1190094 - RNA, 22 nt, Mycobacterium bovis subsp bovis AF2122/97
ggcaugauuuuucgcagugacg

SEQ ID NO: 1190095 - RNA, 15 nt, Mycobacterium bovis subsp bovis AF2122/97
ggcauuaggccgggg

SEQ ID NO: 1190096 - RNA, 15 nt, Mycobacterium bovis subsp bovis AF2122/97
ggcaugacauacagc

SEQ ID NO: 1190097 - RNA, 19 nt, Mycobacterium bovis subsp bovis AF2122/97
ggcaugacauacagcgggc

SEQ ID NO: 1190098 - RNA, 13 nt, Mycobacterium bovis subsp bovis AF2122/97
ggcauugcggccc

SEQ ID NO: 1190099 - RNA, 21 nt, Mycobacterium bovis subsp bovis AF2122/97
ggcauuccuugauaacgaccc

SEQ ID NO: 1190100 - RNA, 13 nt, Mycobacterium bovis subsp bovis AF2122/97
ggcauucccgcgg

SEQ ID NO: 1190101 - RNA, 19 nt, Mycobacterium bovis subsp bovis AF2122/97
ggcaggguggccagcaggc

SEQ ID NO: 1190102 - RNA, 13 nt, Mycobacterium bovis subsp bovis AF2122/97
ggcaggguggggc

SEQ ID NO: 1190103 - RNA, 21 nt, Mycobacterium bovis subsp bovis AF2122/97
ggcagguccaucuggcgcgcc

SEQ ID NO: 1190104 - RNA, 13 nt, Mycobacterium bovis subsp bovis AF2122/97
ggcaggucgagcg

SEQ ID NO: 1190105 - RNA, 18 nt, Mycobacterium bovis subsp bovis AF2122/97
ggcagguugcguugcagg

SEQ ID NO: 1190106 - RNA, 21 nt, Mycobacterium bovis subsp bovis AF2122/97
ggcagguugcguugcaggaaa

SEQ ID NO: 1190107 - RNA, 15 nt, Mycobacterium bovis subsp bovis AF2122/97
ggcaggucgaugcug

SEQ ID NO: 1190108 - RNA, 17 nt, Mycobacterium bovis subsp bovis AF2122/97
ggcaggucgaugcugcc

SEQ ID NO: 1190109 - RNA, 15 nt, Mycobacterium bovis subsp bovis AF2122/97
ggcaggcuggcgagg

SEQ ID NO: 1190110 - RNA, 17 nt, Mycobacterium bovis subsp bovis AF2122/97
ggcaggcuggcgagggc

SEQ ID NO: 1190111 - RNA, 19 nt, Mycobacterium bovis subsp bovis AF2122/97
ggcaggcuggcgagggcug

SEQ ID NO: 1190112 - RNA, 13 nt, Mycobacterium bovis subsp bovis AF2122/97
ggcagggccagcg

SEQ ID NO: 1190113 - RNA, 15 nt, Mycobacterium bovis subsp bovis AF2122/97
ggcagggccagcggc

SEQ ID NO: 1190114 - RNA, 14 nt, Mycobacterium bovis subsp bovis AF2122/97
ggcagggcagcccg

SEQ ID NO: 1190115 - RNA, 22 nt, Mycobacterium bovis subsp bovis AF2122/97
ggcaggcuuagcuuccggguuc

SEQ ID NO: 1190116 - RNA, 20 nt, Mycobacterium bovis subsp bovis AF2122/97
ggcacuggguccacgcgcuc

SEQ ID NO: 1190117 - RNA, 18 nt, Mycobacterium bovis subsp bovis AF2122/97
ggcacugugcguccgcaa

SEQ ID NO: 1190118 - RNA, 19 nt, Mycobacterium bovis subsp bovis AF2122/97
ggcacugugcguccgcaac

SEQ ID NO: 1190119 - RNA, 21 nt, Mycobacterium bovis subsp bovis AF2122/97
ggcagaacuggacaagcuccu

SEQ ID NO: 1190120 - RNA, 22 nt, Mycobacterium bovis subsp bovis AF2122/97
ggcauccccaguugugcggcca

SEQ ID NO: 1190121 - RNA, 18 nt, Mycobacterium bovis subsp bovis AF2122/97
ggcaucaucagcggcgcc

SEQ ID NO: 1190122 - RNA, 22 nt, Mycobacterium bovis subsp bovis AF2122/97
ggcaucaucgcugugcgcuggu

SEQ ID NO: 1190123 - RNA, 13 nt, Mycobacterium bovis subsp bovis AF2122/97
ggcaucaccuggc

SEQ ID NO: 1190124 - RNA, 19 nt, Mycobacterium bovis subsp bovis AF2122/97
ggcaucaccuggcgugucg

SEQ ID NO: 1190125 - RNA, 23 nt, Mycobacterium bovis subsp bovis AF2122/97
ggcaucaccuggcgugucgccgc

SEQ ID NO: 1190126 - RNA, 16 nt, Mycobacterium bovis subsp bovis AF2122/97
ggcaucaccgccgcgg

SEQ ID NO: 1190127 - RNA, 18 nt, Mycobacterium bovis subsp bovis AF2122/97
ggcaucaccgccgcggcc

SEQ ID NO: 1190128 - RNA, 14 nt, Mycobacterium bovis subsp bovis AF2122/97
ggcaucagcagagc

SEQ ID NO: 1190129 - RNA, 16 nt, Mycobacterium bovis subsp bovis AF2122/97
ggcaguggcagcccgu

SEQ ID NO: 1190130 - RNA, 18 nt, Mycobacterium bovis subsp bovis AF2122/97
ggcaguggccagacccga

SEQ ID NO: 1190131 - RNA, 23 nt, Mycobacterium bovis subsp bovis AF2122/97
ggcagugcgaaaaucgcgcgcga

SEQ ID NO: 1190132 - RNA, 17 nt, Mycobacterium bovis subsp bovis AF2122/97
ggcaguuuggcggcagg

SEQ ID NO: 1190133 - RNA, 18 nt, Mycobacterium bovis subsp bovis AF2122/97
ggcaguuguugacagaca

SEQ ID NO: 1190134 - RNA, 16 nt, Mycobacterium bovis subsp bovis AF2122/97
ggcggccagcucggcc

SEQ ID NO: 1190135 - RNA, 22 nt, Mycobacterium bovis subsp bovis AF2122/97
ggcggccccaggggcaccagcg

SEQ ID NO: 1190136 - RNA, 14 nt, Mycobacterium bovis subsp bovis AF2122/97
ggcggcccgcagcc

SEQ ID NO: 1190137 - RNA, 15 nt, Mycobacterium bovis subsp bovis AF2122/97
ggcggccgcagcggc

SEQ ID NO: 1190138 - RNA, 20 nt, Mycobacterium bovis subsp bovis AF2122/97
ggcggccgccaucagccgcu

SEQ ID NO: 1190139 - RNA, 11 nt, Mycobacterium bovis subsp bovis AF2122/97
ggcggccagca

SEQ ID NO: 1190140 - RNA, 19 nt, Mycobacterium bovis subsp bovis AF2122/97
ggcggccacguggucggcg

SEQ ID NO: 1190141 - RNA, 10 nt, Mycobacterium bovis subsp bovis AF2122/97
ggcggccagc

SEQ ID NO: 1190142 - RNA, 20 nt, Mycobacterium bovis subsp bovis AF2122/97
ggcggcaucggugguaacac

SEQ ID NO: 1190143 - RNA, 20 nt, Mycobacterium bovis subsp bovis AF2122/97
ggcggccaacgacgacccgu

SEQ ID NO: 1190144 - RNA, 16 nt, Mycobacterium bovis subsp bovis AF2122/97
ggcggcacuggauccg

SEQ ID NO: 1190145 - RNA, 15 nt, Mycobacterium bovis subsp bovis AF2122/97
ggcggcagcggcggu

SEQ ID NO: 1190146 - RNA, 18 nt, Mycobacterium bovis subsp bovis AF2122/97
ggcggcagcggugcuggu

SEQ ID NO: 1190147 - RNA, 16 nt, Mycobacterium bovis subsp bovis AF2122/97
ggcggcacuacgcagc

SEQ ID NO: 1190148 - RNA, 16 nt, Mycobacterium bovis subsp bovis AF2122/97
ggcggcacgggcggcc

SEQ ID NO: 1190149 - RNA, 22 nt, Mycobacterium bovis subsp bovis AF2122/97
ggcggcagguagaucagcaugc

SEQ ID NO: 1190150 - RNA, 12 nt, Mycobacterium bovis subsp bovis AF2122/97
ggcggcaggccg

SEQ ID NO: 1190151 - RNA, 22 nt, Mycobacterium bovis subsp bovis AF2122/97
ggcggcaggaaucgggucagca

SEQ ID NO: 1190152 - RNA, 16 nt, Mycobacterium bovis subsp bovis AF2122/97
ggcggcagguguuggu

SEQ ID NO: 1190153 - RNA, 20 nt, Mycobacterium bovis subsp bovis AF2122/97
ggcggcauacauccaggcug

SEQ ID NO: 1190154 - RNA, 14 nt, Mycobacterium bovis subsp bovis AF2122/97
ggcggcauccccag

SEQ ID NO: 1190155 - RNA, 17 nt, Mycobacterium bovis subsp bovis AF2122/97
ggcggacugagagaugg

SEQ ID NO: 1190156 - RNA, 14 nt, Mycobacterium bovis subsp bovis AF2122/97
ggcggacaugcacc

SEQ ID NO: 1190157 - RNA, 19 nt, Mycobacterium bovis subsp bovis AF2122/97
ggcggacgccgcgccggcg

SEQ ID NO: 1190158 - RNA, 16 nt, Mycobacterium bovis subsp bovis AF2122/97
ggcggacccgcucgcg

SEQ ID NO: 1190159 - RNA, 15 nt, Mycobacterium bovis subsp bovis AF2122/97
ggcggacccucgccg

SEQ ID NO: 1190160 - RNA, 19 nt, Mycobacterium bovis subsp bovis AF2122/97
ggcggaccaggccgcgcgc

SEQ ID NO: 1190161 - RNA, 22 nt, Mycobacterium bovis subsp bovis AF2122/97
ggcggaccaggccgcgcgcacc

SEQ ID NO: 1190162 - RNA, 20 nt, Mycobacterium bovis subsp bovis AF2122/97
ggcggacaggcccgguggcg

SEQ ID NO: 1190163 - RNA, 18 nt, Mycobacterium bovis subsp bovis AF2122/97
ggcggagucgcgcagggc

SEQ ID NO: 1190164 - RNA, 13 nt, Mycobacterium bovis subsp bovis AF2122/97
ggcggaggcuggg

SEQ ID NO: 1190165 - RNA, 14 nt, Mycobacterium bovis subsp bovis AF2122/97
ggcggaggcugggc

SEQ ID NO: 1190166 - RNA, 16 nt, Mycobacterium bovis subsp bovis AF2122/97
ggcggagagcacuggg

SEQ ID NO: 1190167 - RNA, 20 nt, Mycobacterium bovis subsp bovis AF2122/97
ggcggagagcacugggcugg

SEQ ID NO: 1190168 - RNA, 21 nt, Mycobacterium bovis subsp bovis AF2122/97
ggcggagagcacugggcuggc

SEQ ID NO: 1190169 - RNA, 17 nt, Mycobacterium bovis subsp bovis AF2122/97
ggcggcacccggguggc

SEQ ID NO: 1190170 - RNA, 22 nt, Mycobacterium bovis subsp bovis AF2122/97
ggcggcaaccucaugcacgccg

SEQ ID NO: 1190171 - RNA, 23 nt, Mycobacterium bovis subsp bovis AF2122/97
ggcggcaacgccgggcuguucgg

SEQ ID NO: 1190172 - RNA, 15 nt, Mycobacterium bovis subsp bovis AF2122/97
ggcggcaacggcggu

SEQ ID NO: 1190173 - RNA, 16 nt, Mycobacterium bovis subsp bovis AF2122/97
ggcggcaagggcggca

SEQ ID NO: 1190174 - RNA, 14 nt, Mycobacterium bovis subsp bovis AF2122/97
ggcggcaagggugg

SEQ ID NO: 1190175 - RNA, 20 nt, Mycobacterium bovis subsp bovis AF2122/97
ggcggaugcuguugacccgu

SEQ ID NO: 1190176 - RNA, 24 nt, Mycobacterium bovis subsp bovis AF2122/97
ggcggaucggcggccggcacgggc

SEQ ID NO: 1190177 - RNA, 20 nt, Mycobacterium bovis subsp bovis AF2122/97
ggcggaucgcgagcgccgcu

SEQ ID NO: 1190178 - RNA, 15 nt, Mycobacterium bovis subsp bovis AF2122/97
ggcggauucgcgcug

SEQ ID NO: 1190179 - RNA, 13 nt, Mycobacterium bovis subsp bovis AF2122/97
ggcggccggcacg

SEQ ID NO: 1190180 - RNA, 19 nt, Mycobacterium bovis subsp bovis AF2122/97
ggcggccggcacgggcggg

SEQ ID NO: 1190181 - RNA, 23 nt, Mycobacterium bovis subsp bovis AF2122/97
ggcggccggcacgggcggggacg

SEQ ID NO: 1190182 - RNA, 14 nt, Mycobacterium bovis subsp bovis AF2122/97
ggcggccgggcucc

SEQ ID NO: 1190183 - RNA, 12 nt, Mycobacterium bovis subsp bovis AF2122/97
ggcggccggcgg

SEQ ID NO: 1190184 - RNA, 14 nt, Mycobacterium bovis subsp bovis AF2122/97
ggcggccuccccga

SEQ ID NO: 1190185 - RNA, 22 nt, Mycobacterium bovis subsp bovis AF2122/97
ggcggccguggcuggacccgca

SEQ ID NO: 1190186 - RNA, 20 nt, Mycobacterium bovis subsp bovis AF2122/97
ggcggccuggucggccaggu

SEQ ID NO: 1190187 - RNA, 18 nt, Mycobacterium bovis subsp bovis AF2122/97
ggcggccuucggccggcg

SEQ ID NO: 1190188 - RNA, 20 nt, Mycobacterium bovis subsp bovis AF2122/97
ggcggccucccgggccgccg

SEQ ID NO: 1190189 - RNA, 15 nt, Mycobacterium bovis subsp bovis AF2122/97
ggcggccuccucccc

SEQ ID NO: 1190190 - RNA, 22 nt, Mycobacterium bovis subsp bovis AF2122/97
ggcggcgauccggucgggggcg

SEQ ID NO: 1190191 - RNA, 16 nt, Mycobacterium bovis subsp bovis AF2122/97
ggcggcgacgagcgca

SEQ ID NO: 1190192 - RNA, 21 nt, Mycobacterium bovis subsp bovis AF2122/97
ggcggcgccggaggcggcgcu

SEQ ID NO: 1190193 - RNA, 21 nt, Mycobacterium bovis subsp bovis AF2122/97
ggcggcgacacgccaggugau

SEQ ID NO: 1190194 - RNA, 22 nt, Mycobacterium bovis subsp bovis AF2122/97
ggcggccuugccgggccgcgcg

SEQ ID NO: 1190195 - RNA, 15 nt, Mycobacterium bovis subsp bovis AF2122/97
ggcggcgacgagcgc

SEQ ID NO: 1190196 - RNA, 17 nt, Mycobacterium bovis subsp bovis AF2122/97
ggcggcgaccgccagcg

SEQ ID NO: 1190197 - RNA, 19 nt, Mycobacterium bovis subsp bovis AF2122/97
ggcggcgaccgccagcgug

SEQ ID NO: 1190198 - RNA, 21 nt, Mycobacterium bovis subsp bovis AF2122/97
ggcggcgaccucggcggcggc

SEQ ID NO: 1190199 - RNA, 12 nt, Mycobacterium bovis subsp bovis AF2122/97
ggcggcggccug

SEQ ID NO: 1190200 - RNA, 19 nt, Mycobacterium bovis subsp bovis AF2122/97
ggcggcggccgcagcggcc

SEQ ID NO: 1190201 - RNA, 14 nt, Mycobacterium bovis subsp bovis AF2122/97
ggcggcggccagcc

SEQ ID NO: 1190202 - RNA, 15 nt, Mycobacterium bovis subsp bovis AF2122/97
ggcggcggaggcugg

SEQ ID NO: 1190203 - RNA, 18 nt, Mycobacterium bovis subsp bovis AF2122/97
ggcggcggaggcugggcu

SEQ ID NO: 1190204 - RNA, 22 nt, Mycobacterium bovis subsp bovis AF2122/97
ggcggcgcuggucgcgguggcg

SEQ ID NO: 1190205 - RNA, 14 nt, Mycobacterium bovis subsp bovis AF2122/97
ggcggcgcgcgcug

SEQ ID NO: 1190206 - RNA, 14 nt, Mycobacterium bovis subsp bovis AF2122/97
ggcggcgccgcaga

SEQ ID NO: 1190207 - RNA, 15 nt, Mycobacterium bovis subsp bovis AF2122/97
ggcggcgcgcagcuu

SEQ ID NO: 1190208 - RNA, 17 nt, Mycobacterium bovis subsp bovis AF2122/97
ggcggcgcgggucggcg

SEQ ID NO: 1190209 - RNA, 14 nt, Mycobacterium bovis subsp bovis AF2122/97
ggcggcgcucgucg

SEQ ID NO: 1190210 - RNA, 16 nt, Mycobacterium bovis subsp bovis AF2122/97
ggcggcgcugcagcug

SEQ ID NO: 1190211 - RNA, 16 nt, Mycobacterium bovis subsp bovis AF2122/97
ggcggcgggggcggcg

SEQ ID NO: 1190212 - RNA, 18 nt, Mycobacterium bovis subsp bovis AF2122/97
ggcggcgggggcggcggc

SEQ ID NO: 1190213 - RNA, 19 nt, Mycobacterium bovis subsp bovis AF2122/97
ggcggcgggggcggcggcu

SEQ ID NO: 1190214 - RNA, 19 nt, Mycobacterium bovis subsp bovis AF2122/97
ggcggcgcugcagcugcuc

SEQ ID NO: 1190215 - RNA, 13 nt, Mycobacterium bovis subsp bovis AF2122/97
ggcggcgggggcg

SEQ ID NO: 1190216 - RNA, 16 nt, Mycobacterium bovis subsp bovis AF2122/97
ggcggcggucggcugg

SEQ ID NO: 1190217 - RNA, 14 nt, Mycobacterium bovis subsp bovis AF2122/97
ggcggcggugggcg

SEQ ID NO: 1190218 - RNA, 22 nt, Mycobacterium bovis subsp bovis AF2122/97
ggcggcggugguaccggcgcca

SEQ ID NO: 1190219 - RNA, 21 nt, Mycobacterium bovis subsp bovis AF2122/97
ggcggcguuaccaccgucacc

SEQ ID NO: 1190220 - RNA, 22 nt, Mycobacterium bovis subsp bovis AF2122/97
ggcggcucaaccucuggcggcg

SEQ ID NO: 1190221 - RNA, 19 nt, Mycobacterium bovis subsp bovis AF2122/97
ggcggcguugugcaaugug

SEQ ID NO: 1190222 - RNA, 12 nt, Mycobacterium bovis subsp bovis AF2122/97
ggcggcuaccca

SEQ ID NO: 1190223 - RNA, 16 nt, Mycobacterium bovis subsp bovis AF2122/97
ggcggcguccaccugc

SEQ ID NO: 1190224 - RNA, 16 nt, Mycobacterium bovis subsp bovis AF2122/97
ggcggcguccagcagc

SEQ ID NO: 1190225 - RNA, 21 nt, Mycobacterium bovis subsp bovis AF2122/97
ggcggcguccaucgcgcgccg

SEQ ID NO: 1190226 - RNA, 17 nt, Mycobacterium bovis subsp bovis AF2122/97
ggcggcgucgacggcuc

SEQ ID NO: 1190227 - RNA, 18 nt, Mycobacterium bovis subsp bovis AF2122/97
ggcggcgucgacggcucc

SEQ ID NO: 1190228 - RNA, 22 nt, Mycobacterium bovis subsp bovis AF2122/97
ggcggcgucgacggcuccuccg

SEQ ID NO: 1190229 - RNA, 18 nt, Mycobacterium bovis subsp bovis AF2122/97
ggcgcucacccgccgcgg

SEQ ID NO: 1190230 - RNA, 16 nt, Mycobacterium bovis subsp bovis AF2122/97
ggcgcuccacugacca

SEQ ID NO: 1190231 - RNA, 14 nt, Mycobacterium bovis subsp bovis AF2122/97
ggcgcucagcgcgg

SEQ ID NO: 1190232 - RNA, 19 nt, Mycobacterium bovis subsp bovis AF2122/97
ggcgcucagcgcggccacg

SEQ ID NO: 1190233 - RNA, 14 nt, Mycobacterium bovis subsp bovis AF2122/97
ggcgcuagcugcug

SEQ ID NO: 1190234 - RNA, 20 nt, Mycobacterium bovis subsp bovis AF2122/97
ggcgcguucgucgucgcuga

SEQ ID NO: 1190235 - RNA, 21 nt, Mycobacterium bovis subsp bovis AF2122/97
ggcgcucgcgcgcugggcgcg

SEQ ID NO: 1190236 - RNA, 19 nt, Mycobacterium bovis subsp bovis AF2122/97
ggcgcugcccgggcugccg

SEQ ID NO: 1190237 - RNA, 14 nt, Mycobacterium bovis subsp bovis AF2122/97
ggcgcugcagcugc

SEQ ID NO: 1190238 - RNA, 11 nt, Mycobacterium bovis subsp bovis AF2122/97
ggcgcugccaa

SEQ ID NO: 1190239 - RNA, 15 nt, Mycobacterium bovis subsp bovis AF2122/97
ggcgcugagggugcu

SEQ ID NO: 1190240 - RNA, 16 nt, Mycobacterium bovis subsp bovis AF2122/97
ggcgcugaugcgcugg

SEQ ID NO: 1190241 - RNA, 17 nt, Mycobacterium bovis subsp bovis AF2122/97
ggcgcugaugcuggcca

SEQ ID NO: 1190242 - RNA, 16 nt, Mycobacterium bovis subsp bovis AF2122/97
ggcgcugaacgcgagc

SEQ ID NO: 1190243 - RNA, 22 nt, Mycobacterium bovis subsp bovis AF2122/97
ggcgcugaagccgacgauccac

SEQ ID NO: 1190244 - RNA, 18 nt, Mycobacterium bovis subsp bovis AF2122/97
ggcgcugaucggcagggu

SEQ ID NO: 1190245 - RNA, 16 nt, Mycobacterium bovis subsp bovis AF2122/97
ggcgcugcggcgugcc

SEQ ID NO: 1190246 - RNA, 15 nt, Mycobacterium bovis subsp bovis AF2122/97
ggcgcugcuggcaga

SEQ ID NO: 1190247 - RNA, 20 nt, Mycobacterium bovis subsp bovis AF2122/97
ggcgcugcggcgugccgggu

SEQ ID NO: 1190248 - RNA, 17 nt, Mycobacterium bovis subsp bovis AF2122/97
ggcgcuggacggcgggc

SEQ ID NO: 1190249 - RNA, 14 nt, Mycobacterium bovis subsp bovis AF2122/97
ggcgcugccgggau

SEQ ID NO: 1190250 - RNA, 16 nt, Mycobacterium bovis subsp bovis AF2122/97
ggcgcugcgcaccgcc

SEQ ID NO: 1190251 - RNA, 21 nt, Mycobacterium bovis subsp bovis AF2122/97
ggcgcugcgcaccgccgcgcg

SEQ ID NO: 1190252 - RNA, 18 nt, Mycobacterium bovis subsp bovis AF2122/97
ggcgcuggcguggccaac

SEQ ID NO: 1190253 - RNA, 22 nt, Mycobacterium bovis subsp bovis AF2122/97
ggcgcuggucgcgguggcggcg

SEQ ID NO: 1190254 - RNA, 14 nt, Mycobacterium bovis subsp bovis AF2122/97
ggcgcuggccagca

SEQ ID NO: 1190255 - RNA, 18 nt, Mycobacterium bovis subsp bovis AF2122/97
ggcgcuggacggcgggcc

SEQ ID NO: 1190256 - RNA, 19 nt, Mycobacterium bovis subsp bovis AF2122/97
ggcggaacuguaggucaca

SEQ ID NO: 1190257 - RNA, 13 nt, Mycobacterium bovis subsp bovis AF2122/97
ggcgcuugccggg

SEQ ID NO: 1190258 - RNA, 16 nt, Mycobacterium bovis subsp bovis AF2122/97
ggcggaaaaucggcug

SEQ ID NO: 1190259 - RNA, 22 nt, Mycobacterium bovis subsp bovis AF2122/97
ggcgcgcggguugucggcgacc

SEQ ID NO: 1190260 - RNA, 19 nt, Mycobacterium bovis subsp bovis AF2122/97
ggcgcgcuggcgggcggcg

SEQ ID NO: 1190261 - RNA, 19 nt, Mycobacterium bovis subsp bovis AF2122/97
ggcgcggaacgcgucgccg

SEQ ID NO: 1190262 - RNA, 23 nt, Mycobacterium bovis subsp bovis AF2122/97
ggcgcggagagccugcucgcagc

SEQ ID NO: 1190263 - RNA, 17 nt, Mycobacterium bovis subsp bovis AF2122/97
ggcgcgccggucgccga

SEQ ID NO: 1190264 - RNA, 21 nt, Mycobacterium bovis subsp bovis AF2122/97
ggcgcgccguugccggccacc

SEQ ID NO: 1190265 - RNA, 13 nt, Mycobacterium bovis subsp bovis AF2122/97
ggcgcgcgcgccg

SEQ ID NO: 1190266 - RNA, 16 nt, Mycobacterium bovis subsp bovis AF2122/97
ggcgcgccgcacccgg

SEQ ID NO: 1190267 - RNA, 20 nt, Mycobacterium bovis subsp bovis AF2122/97
ggcgcggucgaccugagccc

SEQ ID NO: 1190268 - RNA, 24 nt, Mycobacterium bovis subsp bovis AF2122/97
ggcgcggggccgccgcggccggcg

SEQ ID NO: 1190269 - RNA, 14 nt, Mycobacterium bovis subsp bovis AF2122/97
ggcgcggggcggcc

SEQ ID NO: 1190270 - RNA, 23 nt, Mycobacterium bovis subsp bovis AF2122/97
ggcgcggggcggccugcccgccg

SEQ ID NO: 1190271 - RNA, 18 nt, Mycobacterium bovis subsp bovis AF2122/97
ggcgcgggugcgccggcg

SEQ ID NO: 1190272 - RNA, 17 nt, Mycobacterium bovis subsp bovis AF2122/97
ggcgcgggucggcgacc

SEQ ID NO: 1190273 - RNA, 15 nt, Mycobacterium bovis subsp bovis AF2122/97
ggcgcguccucgccg

SEQ ID NO: 1190274 - RNA, 21 nt, Mycobacterium bovis subsp bovis AF2122/97
ggcgcguaguaaugcucgacg

SEQ ID NO: 1190275 - RNA, 17 nt, Mycobacterium bovis subsp bovis AF2122/97
ggcgcgucggcguuggg

SEQ ID NO: 1190276 - RNA, 23 nt, Mycobacterium bovis subsp bovis AF2122/97
ggcgcgguuucggcgucaccgug

SEQ ID NO: 1190277 - RNA, 23 nt, Mycobacterium bovis subsp bovis AF2122/97
ggcgcguccucgccgcacgccgg

SEQ ID NO: 1190278 - RNA, 18 nt, Mycobacterium bovis subsp bovis AF2122/97
ggcgcggccgcagccagc

SEQ ID NO: 1190279 - RNA, 20 nt, Mycobacterium bovis subsp bovis AF2122/97
ggcgcggcacccggucggcc

SEQ ID NO: 1190280 - RNA, 12 nt, Mycobacterium bovis subsp bovis AF2122/97
ggcgcggcggcg

SEQ ID NO: 1190281 - RNA, 11 nt, Mycobacterium bovis subsp bovis AF2122/97
ggcgcggcgga

SEQ ID NO: 1190282 - RNA, 14 nt, Mycobacterium bovis subsp bovis AF2122/97
ggcgcggccgugaa

SEQ ID NO: 1190283 - RNA, 14 nt, Mycobacterium bovis subsp bovis AF2122/97
ggcgcgggccggcg

SEQ ID NO: 1190284 - RNA, 14 nt, Mycobacterium bovis subsp bovis AF2122/97
ggcgggcacgcaca

SEQ ID NO: 1190285 - RNA, 15 nt, Mycobacterium bovis subsp bovis AF2122/97
ggcgggaugcagcug

SEQ ID NO: 1190286 - RNA, 16 nt, Mycobacterium bovis subsp bovis AF2122/97
ggcgggauggccgccg

SEQ ID NO: 1190287 - RNA, 21 nt, Mycobacterium bovis subsp bovis AF2122/97
ggcgggaucgagagccgaccg

SEQ ID NO: 1190288 - RNA, 19 nt, Mycobacterium bovis subsp bovis AF2122/97
ggcgggccaccguaaacag

SEQ ID NO: 1190289 - RNA, 13 nt, Mycobacterium bovis subsp bovis AF2122/97
ggcgggcccgccg

SEQ ID NO: 1190290 - RNA, 20 nt, Mycobacterium bovis subsp bovis AF2122/97
ggcgggcgauuucggcgccg

SEQ ID NO: 1190291 - RNA, 22 nt, Mycobacterium bovis subsp bovis AF2122/97
ggcgggcaaucaccgccggcgg

SEQ ID NO: 1190292 - RNA, 24 nt, Mycobacterium bovis subsp bovis AF2122/97
ggcgggcucuacucgcggccggcg

SEQ ID NO: 1190293 - RNA, 14 nt, Mycobacterium bovis subsp bovis AF2122/97
ggcggcucgggugc

SEQ ID NO: 1190294 - RNA, 13 nt, Mycobacterium bovis subsp bovis AF2122/97
ggcggcucccggg

SEQ ID NO: 1190295 - RNA, 21 nt, Mycobacterium bovis subsp bovis AF2122/97
ggcggcuccgcccggcguguc

SEQ ID NO: 1190296 - RNA, 13 nt, Mycobacterium bovis subsp bovis AF2122/97
ggcggcugcagcc

SEQ ID NO: 1190297 - RNA, 20 nt, Mycobacterium bovis subsp bovis AF2122/97
ggcggcuguggucgcugcug

SEQ ID NO: 1190298 - RNA, 16 nt, Mycobacterium bovis subsp bovis AF2122/97
ggcggcuucgccgacg

SEQ ID NO: 1190299 - RNA, 20 nt, Mycobacterium bovis subsp bovis AF2122/97
ggcggcuuagaacgugcugg

SEQ ID NO: 1190300 - RNA, 21 nt, Mycobacterium bovis subsp bovis AF2122/97
ggcggcuuagaacgugcuggu

SEQ ID NO: 1190301 - RNA, 23 nt, Mycobacterium bovis subsp bovis AF2122/97
ggcggcuucaaagaggauccgcu

SEQ ID NO: 1190302 - RNA, 22 nt, Mycobacterium bovis subsp bovis AF2122/97
ggcgggacccgugagcucgucg

SEQ ID NO: 1190303 - RNA, 23 nt, Mycobacterium bovis subsp bovis AF2122/97
ggcggcuucguggcggcgcgcgc

SEQ ID NO: 1190304 - RNA, 21 nt, Mycobacterium bovis subsp bovis AF2122/97
ggcggcuuggccgccccggcc

SEQ ID NO: 1190305 - RNA, 17 nt, Mycobacterium bovis subsp bovis AF2122/97
ggcggcuuuggccgccg

SEQ ID NO: 1190306 - RNA, 14 nt, Mycobacterium bovis subsp bovis AF2122/97
ggcgggcugguguc

SEQ ID NO: 1190307 - RNA, 13 nt, Mycobacterium bovis subsp bovis AF2122/97
ggcgggcucgccc

SEQ ID NO: 1190308 - RNA, 11 nt, Mycobacterium bovis subsp bovis AF2122/97
ggcgggcggca

SEQ ID NO: 1190309 - RNA, 14 nt, Mycobacterium bovis subsp bovis AF2122/97
ggcggggugagggg

SEQ ID NO: 1190310 - RNA, 23 nt, Mycobacterium bovis subsp bovis AF2122/97
ggcgggggcgucgccgccgggca

SEQ ID NO: 1190311 - RNA, 15 nt, Mycobacterium bovis subsp bovis AF2122/97
ggcggggcggcggug

SEQ ID NO: 1190312 - RNA, 19 nt, Mycobacterium bovis subsp bovis AF2122/97
ggcgguaccgccgcugccg

SEQ ID NO: 1190313 - RNA, 20 nt, Mycobacterium bovis subsp bovis AF2122/97
ggcgguaccgccgcugccgg

SEQ ID NO: 1190314 - RNA, 17 nt, Mycobacterium bovis subsp bovis AF2122/97
ggcggguuuucucgccg

SEQ ID NO: 1190315 - RNA, 17 nt, Mycobacterium bovis subsp bovis AF2122/97
ggcggguaagcgaccga

SEQ ID NO: 1190316 - RNA, 14 nt, Mycobacterium bovis subsp bovis AF2122/97
ggcggguggcuccu

SEQ ID NO: 1190317 - RNA, 23 nt, Mycobacterium bovis subsp bovis AF2122/97
ggcggucgaucauggcggcagca

SEQ ID NO: 1190318 - RNA, 17 nt, Mycobacterium bovis subsp bovis AF2122/97
ggcggucccugaagcca

SEQ ID NO: 1190319 - RNA, 20 nt, Mycobacterium bovis subsp bovis AF2122/97
ggcggucccugaagccagcg

SEQ ID NO: 1190320 - RNA, 21 nt, Mycobacterium bovis subsp bovis AF2122/97
ggcgguccgaugcgcgcggcg

SEQ ID NO: 1190321 - RNA, 11 nt, Mycobacterium bovis subsp bovis AF2122/97
ggcggucaggc

SEQ ID NO: 1190322 - RNA, 13 nt, Mycobacterium bovis subsp bovis AF2122/97
ggcggucggcaga

SEQ ID NO: 1190323 - RNA, 22 nt, Mycobacterium bovis subsp bovis AF2122/97
ggcggucggaaugccgucgccg

SEQ ID NO: 1190324 - RNA, 23 nt, Mycobacterium bovis subsp bovis AF2122/97
ggcggucguugauuucggcggcg

SEQ ID NO: 1190325 - RNA, 12 nt, Mycobacterium bovis subsp bovis AF2122/97
ggcggucugcgc

SEQ ID NO: 1190326 - RNA, 18 nt, Mycobacterium bovis subsp bovis AF2122/97
ggcggucugcgccaaaau

SEQ ID NO: 1190327 - RNA, 16 nt, Mycobacterium bovis subsp bovis AF2122/97
ggcggucugggugagc

SEQ ID NO: 1190328 - RNA, 13 nt, Mycobacterium bovis subsp bovis AF2122/97
ggcggucagcggc

SEQ ID NO: 1190329 - RNA, 22 nt, Mycobacterium bovis subsp bovis AF2122/97
ggcggucaccaccguggcgccc

SEQ ID NO: 1190330 - RNA, 18 nt, Mycobacterium bovis subsp bovis AF2122/97
ggcggucaccacgcggcg

SEQ ID NO: 1190331 - RNA, 20 nt, Mycobacterium bovis subsp bovis AF2122/97
ggcggucagcggccaaccca

SEQ ID NO: 1190332 - RNA, 16 nt, Mycobacterium bovis subsp bovis AF2122/97
ggcggucagcggcugg

SEQ ID NO: 1190333 - RNA, 14 nt, Mycobacterium bovis subsp bovis AF2122/97
ggcgguagccgacg

SEQ ID NO: 1190334 - RNA, 23 nt, Mycobacterium bovis subsp bovis AF2122/97
ggcgguaguacucgcgcagguag

SEQ ID NO: 1190335 - RNA, 21 nt, Mycobacterium bovis subsp bovis AF2122/97
ggcgucaucgacuugccgccg

SEQ ID NO: 1190336 - RNA, 21 nt, Mycobacterium bovis subsp bovis AF2122/97
ggcgucccagccgaucacggg

SEQ ID NO: 1190337 - RNA, 20 nt, Mycobacterium bovis subsp bovis AF2122/97
ggcguccgcccagcacccuc

SEQ ID NO: 1190338 - RNA, 14 nt, Mycobacterium bovis subsp bovis AF2122/97
ggcgucccgcccgg

SEQ ID NO: 1190339 - RNA, 15 nt, Mycobacterium bovis subsp bovis AF2122/97
ggcguccaucagaga

SEQ ID NO: 1190340 - RNA, 16 nt, Mycobacterium bovis subsp bovis AF2122/97
ggcgucaugcccaggu

SEQ ID NO: 1190341 - RNA, 21 nt, Mycobacterium bovis subsp bovis AF2122/97
ggcguagaucaucuggcuggu

SEQ ID NO: 1190342 - RNA, 24 nt, Mycobacterium bovis subsp bovis AF2122/97
ggcguaggcaggaucgccugagcg

SEQ ID NO: 1190343 - RNA, 21 nt, Mycobacterium bovis subsp bovis AF2122/97
ggcguagguccuugucggccc

SEQ ID NO: 1190344 - RNA, 15 nt, Mycobacterium bovis subsp bovis AF2122/97
ggcguauugcggccu

SEQ ID NO: 1190345 - RNA, 17 nt, Mycobacterium bovis subsp bovis AF2122/97
ggcgguggcgaacagca

SEQ ID NO: 1190346 - RNA, 23 nt, Mycobacterium bovis subsp bovis AF2122/97
ggcgguggccacccggccgcgcg

SEQ ID NO: 1190347 - RNA, 13 nt, Mycobacterium bovis subsp bovis AF2122/97
ggcgguggcccga

SEQ ID NO: 1190348 - RNA, 15 nt, Mycobacterium bovis subsp bovis AF2122/97
ggcgguggcccgauu

SEQ ID NO: 1190349 - RNA, 13 nt, Mycobacterium bovis subsp bovis AF2122/97
ggcgguggggcug

SEQ ID NO: 1190350 - RNA, 12 nt, Mycobacterium bovis subsp bovis AF2122/97
ggcggugggucg

SEQ ID NO: 1190351 - RNA, 16 nt, Mycobacterium bovis subsp bovis AF2122/97
ggcggugccgucgccg

SEQ ID NO: 1190352 - RNA, 13 nt, Mycobacterium bovis subsp bovis AF2122/97
ggcggugccggcg

SEQ ID NO: 1190353 - RNA, 15 nt, Mycobacterium bovis subsp bovis AF2122/97
ggcggugccggcggc

SEQ ID NO: 1190354 - RNA, 16 nt, Mycobacterium bovis subsp bovis AF2122/97
ggcggugccggcggcg

SEQ ID NO: 1190355 - RNA, 12 nt, Mycobacterium bovis subsp bovis AF2122/97
ggcggugccggc

SEQ ID NO: 1190356 - RNA, 13 nt, Mycobacterium bovis subsp bovis AF2122/97
ggcggugccgacg

SEQ ID NO: 1190357 - RNA, 16 nt, Mycobacterium bovis subsp bovis AF2122/97
ggcggugcccagcagc

SEQ ID NO: 1190358 - RNA, 15 nt, Mycobacterium bovis subsp bovis AF2122/97
ggcggugcagcaggg

SEQ ID NO: 1190359 - RNA, 19 nt, Mycobacterium bovis subsp bovis AF2122/97
ggcggugagcaacuggcau

SEQ ID NO: 1190360 - RNA, 20 nt, Mycobacterium bovis subsp bovis AF2122/97
ggcggucuugccgcaggccu

SEQ ID NO: 1190361 - RNA, 19 nt, Mycobacterium bovis subsp bovis AF2122/97
ggcggugaacugcuggccg

SEQ ID NO: 1190362 - RNA, 15 nt, Mycobacterium bovis subsp bovis AF2122/97
ggcgguugaucgccg

SEQ ID NO: 1190363 - RNA, 16 nt, Mycobacterium bovis subsp bovis AF2122/97
ggcgguugcccgagcg

SEQ ID NO: 1190364 - RNA, 19 nt, Mycobacterium bovis subsp bovis AF2122/97
ggcgguugcccgagcggcu

SEQ ID NO: 1190365 - RNA, 16 nt, Mycobacterium bovis subsp bovis AF2122/97
ggcgguuaucgucggg

SEQ ID NO: 1190366 - RNA, 15 nt, Mycobacterium bovis subsp bovis AF2122/97
ggcguacagcgccug

SEQ ID NO: 1190367 - RNA, 13 nt, Mycobacterium bovis subsp bovis AF2122/97
ggcguacagcgcc

SEQ ID NO: 1190368 - RNA, 17 nt, Mycobacterium bovis subsp bovis AF2122/97
ggcguccuugcgcagca

SEQ ID NO: 1190369 - RNA, 23 nt, Mycobacterium bovis subsp bovis AF2122/97
ggcguccuucuuguuggucccga

SEQ ID NO: 1190370 - RNA, 18 nt, Mycobacterium bovis subsp bovis AF2122/97
ggcgucgaucagggcccc

SEQ ID NO: 1190371 - RNA, 19 nt, Mycobacterium bovis subsp bovis AF2122/97
ggcgucgacgucgacggcg

SEQ ID NO: 1190372 - RNA, 14 nt, Mycobacterium bovis subsp bovis AF2122/97
ggcgucgacccaga

SEQ ID NO: 1190373 - RNA, 23 nt, Mycobacterium bovis subsp bovis AF2122/97
ggcgucgaucaacaacagccgca

SEQ ID NO: 1190374 - RNA, 19 nt, Mycobacterium bovis subsp bovis AF2122/97
ggcgucgaugaccuuggga

SEQ ID NO: 1190375 - RNA, 17 nt, Mycobacterium bovis subsp bovis AF2122/97
ggcgucgcaacccggcc

SEQ ID NO: 1190376 - RNA, 17 nt, Mycobacterium bovis subsp bovis AF2122/97
ggcgucggcgcggccgu

SEQ ID NO: 1190377 - RNA, 16 nt, Mycobacterium bovis subsp bovis AF2122/97
ggcgucgccggcaccg

SEQ ID NO: 1190378 - RNA, 17 nt, Mycobacterium bovis subsp bovis AF2122/97
ggcgucgcugcgcuggu

SEQ ID NO: 1190379 - RNA, 19 nt, Mycobacterium bovis subsp bovis AF2122/97
ggcgucguaggagccguca

SEQ ID NO: 1190380 - RNA, 15 nt, Mycobacterium bovis subsp bovis AF2122/97
ggcgucgugagaggc

SEQ ID NO: 1190381 - RNA, 16 nt, Mycobacterium bovis subsp bovis AF2122/97
ggcgucgucggcgggc

SEQ ID NO: 1190382 - RNA, 16 nt, Mycobacterium bovis subsp bovis AF2122/97
ggcgucgucggcggcg

SEQ ID NO: 1190383 - RNA, 14 nt, Mycobacterium bovis subsp bovis AF2122/97
ggcgucgucggcgg

SEQ ID NO: 1190384 - RNA, 19 nt, Mycobacterium bovis subsp bovis AF2122/97
ggcgucgucgacggcugcg

SEQ ID NO: 1190385 - RNA, 20 nt, Mycobacterium bovis subsp bovis AF2122/97
ggcgucgucgaguuggccau

SEQ ID NO: 1190386 - RNA, 18 nt, Mycobacterium bovis subsp bovis AF2122/97
ggcgucgugcgcggccgg

SEQ ID NO: 1190387 - RNA, 16 nt, Mycobacterium bovis subsp bovis AF2122/97
ggcgucuuccucggcc

SEQ ID NO: 1190388 - RNA, 18 nt, Mycobacterium bovis subsp bovis AF2122/97
ggcgugaaaaacgcccgc

SEQ ID NO: 1190389 - RNA, 23 nt, Mycobacterium bovis subsp bovis AF2122/97
ggcguggcugccuucggcgagcg

SEQ ID NO: 1190390 - RNA, 15 nt, Mycobacterium bovis subsp bovis AF2122/97
ggcguggcgggggcu

SEQ ID NO: 1190391 - RNA, 15 nt, Mycobacterium bovis subsp bovis AF2122/97
ggcguggccccaccg

SEQ ID NO: 1190392 - RNA, 18 nt, Mycobacterium bovis subsp bovis AF2122/97
ggcguggucggcaaagcg

SEQ ID NO: 1190393 - RNA, 14 nt, Mycobacterium bovis subsp bovis AF2122/97
ggcgugcggcggcc

SEQ ID NO: 1190394 - RNA, 17 nt, Mycobacterium bovis subsp bovis AF2122/97
ggcgugcuugacgagga

SEQ ID NO: 1190395 - RNA, 16 nt, Mycobacterium bovis subsp bovis AF2122/97
ggcgugcugcuagcca

SEQ ID NO: 1190396 - RNA, 16 nt, Mycobacterium bovis subsp bovis AF2122/97
ggcgugacugguggcg

SEQ ID NO: 1190397 - RNA, 13 nt, Mycobacterium bovis subsp bovis AF2122/97
ggcgugcagcagc

SEQ ID NO: 1190398 - RNA, 17 nt, Mycobacterium bovis subsp bovis AF2122/97
ggcgugauagcccuugc

SEQ ID NO: 1190399 - RNA, 16 nt, Mycobacterium bovis subsp bovis AF2122/97
ggcgugcagacccggu

SEQ ID NO: 1190400 - RNA, 13 nt, Mycobacterium bovis subsp bovis AF2122/97
ggcguuggcggcu

SEQ ID NO: 1190401 - RNA, 19 nt, Mycobacterium bovis subsp bovis AF2122/97
ggcguugcugaugucgccg

SEQ ID NO: 1190402 - RNA, 19 nt, Mycobacterium bovis subsp bovis AF2122/97
ggcguucagcggccagcag

SEQ ID NO: 1190403 - RNA, 16 nt, Mycobacterium bovis subsp bovis AF2122/97
ggcguuacguggugga

SEQ ID NO: 1190404 - RNA, 17 nt, Mycobacterium bovis subsp bovis AF2122/97
ggcguuugaugcgggcg

SEQ ID NO: 1190405 - RNA, 19 nt, Mycobacterium bovis subsp bovis AF2122/97
ggcguuguugaccagcacg

SEQ ID NO: 1190406 - RNA, 21 nt, Mycobacterium bovis subsp bovis AF2122/97
ggcguuguuaucgaagcccga

SEQ ID NO: 1190407 - RNA, 16 nt, Mycobacterium bovis subsp bovis AF2122/97
ggcguugaccagcacg

SEQ ID NO: 1190408 - RNA, 15 nt, Mycobacterium bovis subsp bovis AF2122/97
ggcuagggcagcagc

SEQ ID NO: 1190409 - RNA, 19 nt, Mycobacterium bovis subsp bovis AF2122/97
ggcuagggcccuggcggcc

SEQ ID NO: 1190410 - RNA, 15 nt, Mycobacterium bovis subsp bovis AF2122/97
ggcuagcugaugccu

SEQ ID NO: 1190411 - RNA, 19 nt, Mycobacterium bovis subsp bovis AF2122/97
ggcuaggcaccagcggauc

SEQ ID NO: 1190412 - RNA, 13 nt, Mycobacterium bovis subsp bovis AF2122/97
ggcuaggccagca

SEQ ID NO: 1190413 - RNA, 13 nt, Mycobacterium bovis subsp bovis AF2122/97
ggcuaggucagcg

SEQ ID NO: 1190414 - RNA, 16 nt, Mycobacterium bovis subsp bovis AF2122/97
ggcuaggucagcgggc

SEQ ID NO: 1190415 - RNA, 16 nt, Mycobacterium bovis subsp bovis AF2122/97
ggcuaguugccaacac

SEQ ID NO: 1190416 - RNA, 16 nt, Mycobacterium bovis subsp bovis AF2122/97
ggcuauaucccgcccc

SEQ ID NO: 1190417 - RNA, 16 nt, Mycobacterium bovis subsp bovis AF2122/97
ggcuaccuaacccgca

SEQ ID NO: 1190418 - RNA, 22 nt, Mycobacterium bovis subsp bovis AF2122/97
ggcuaccccagggagugccgca

SEQ ID NO: 1190419 - RNA, 15 nt, Mycobacterium bovis subsp bovis AF2122/97
ggcuacaucggcggc

SEQ ID NO: 1190420 - RNA, 13 nt, Mycobacterium bovis subsp bovis AF2122/97
ggcuacggccagu

SEQ ID NO: 1190421 - RNA, 15 nt, Mycobacterium bovis subsp bovis AF2122/97
ggcuacgccuccuuc

SEQ ID NO: 1190422 - RNA, 22 nt, Mycobacterium bovis subsp bovis AF2122/97
ggcuacgggccgcuccagguag

SEQ ID NO: 1190423 - RNA, 17 nt, Mycobacterium bovis subsp bovis AF2122/97
ggcuaaucagccaggcc

SEQ ID NO: 1190424 - RNA, 16 nt, Mycobacterium bovis subsp bovis AF2122/97
ggcuaauagcucgccg

SEQ ID NO: 1190425 - RNA, 22 nt, Mycobacterium bovis subsp bovis AF2122/97
ggcuaagccuucggugucgccg

SEQ ID NO: 1190426 - RNA, 23 nt, Mycobacterium bovis subsp bovis AF2122/97
ggcgaaauagcccaagccgaucg

SEQ ID NO: 1190427 - RNA, 16 nt, Mycobacterium bovis subsp bovis AF2122/97
ggcgaaauuccgggcc

SEQ ID NO: 1190428 - RNA, 21 nt, Mycobacterium bovis subsp bovis AF2122/97
ggcgaaaagacugcgccgccg

SEQ ID NO: 1190429 - RNA, 19 nt, Mycobacterium bovis subsp bovis AF2122/97
ggcgaaaauugcuccacca

SEQ ID NO: 1190430 - RNA, 15 nt, Mycobacterium bovis subsp bovis AF2122/97
ggccuuggcggcggc

SEQ ID NO: 1190431 - RNA, 22 nt, Mycobacterium bovis subsp bovis AF2122/97
ggccuuguugccgcgccacugu

SEQ ID NO: 1190432 - RNA, 16 nt, Mycobacterium bovis subsp bovis AF2122/97
ggccuuggugcggccg

SEQ ID NO: 1190433 - RNA, 14 nt, Mycobacterium bovis subsp bovis AF2122/97
ggccuugggcggca

SEQ ID NO: 1190434 - RNA, 22 nt, Mycobacterium bovis subsp bovis AF2122/97
ggcgaacggauucccgcccagc

SEQ ID NO: 1190435 - RNA, 15 nt, Mycobacterium bovis subsp bovis AF2122/97
ggcgaacccuccgca

SEQ ID NO: 1190436 - RNA, 18 nt, Mycobacterium bovis subsp bovis AF2122/97
ggcgaacccuccgcagcu

SEQ ID NO: 1190437 - RNA, 19 nt, Mycobacterium bovis subsp bovis AF2122/97
ggcgaacccuccgcagcua

SEQ ID NO: 1190438 - RNA, 16 nt, Mycobacterium bovis subsp bovis AF2122/97
ggcgaaccgcuccaca

SEQ ID NO: 1190439 - RNA, 19 nt, Mycobacterium bovis subsp bovis AF2122/97
ggcgaaccgucagcgcgcc

SEQ ID NO: 1190440 - RNA, 17 nt, Mycobacterium bovis subsp bovis AF2122/97
ggcgaaccuugguugcc

SEQ ID NO: 1190441 - RNA, 23 nt, Mycobacterium bovis subsp bovis AF2122/97
ggcgaacagcaugauccgcuggg

SEQ ID NO: 1190442 - RNA, 18 nt, Mycobacterium bovis subsp bovis AF2122/97
ggcgaaccacggcagcca

SEQ ID NO: 1190443 - RNA, 18 nt, Mycobacterium bovis subsp bovis AF2122/97
ggcgaccaggagccucca

SEQ ID NO: 1190444 - RNA, 16 nt, Mycobacterium bovis subsp bovis AF2122/97
ggcgaccagccgagcg

SEQ ID NO: 1190445 - RNA, 19 nt, Mycobacterium bovis subsp bovis AF2122/97
ggcgaccacgccgccggcg

SEQ ID NO: 1190446 - RNA, 22 nt, Mycobacterium bovis subsp bovis AF2122/97
ggcgaccacgccgccggcgcug

SEQ ID NO: 1190447 - RNA, 16 nt, Mycobacterium bovis subsp bovis AF2122/97
ggcgaccacgccgccg

SEQ ID NO: 1190448 - RNA, 20 nt, Mycobacterium bovis subsp bovis AF2122/97
ggcgaccaccaccgccgccg

SEQ ID NO: 1190449 - RNA, 14 nt, Mycobacterium bovis subsp bovis AF2122/97
ggcgaccaccgcgg

SEQ ID NO: 1190450 - RNA, 14 nt, Mycobacterium bovis subsp bovis AF2122/97
ggcgaccaccagcg

SEQ ID NO: 1190451 - RNA, 12 nt, Mycobacterium bovis subsp bovis AF2122/97
ggcgacagcgcg

SEQ ID NO: 1190452 - RNA, 20 nt, Mycobacterium bovis subsp bovis AF2122/97
ggcgaaugcgggccuccugc

SEQ ID NO: 1190453 - RNA, 17 nt, Mycobacterium bovis subsp bovis AF2122/97
ggcgaaugacggccagu

SEQ ID NO: 1190454 - RNA, 14 nt, Mycobacterium bovis subsp bovis AF2122/97
ggcgaaugcggucc

SEQ ID NO: 1190455 - RNA, 14 nt, Mycobacterium bovis subsp bovis AF2122/97
ggcgaaggccagca

SEQ ID NO: 1190456 - RNA, 15 nt, Mycobacterium bovis subsp bovis AF2122/97
ggcgaaggucuggcc

SEQ ID NO: 1190457 - RNA, 18 nt, Mycobacterium bovis subsp bovis AF2122/97
ggcgaagguguccuccag

SEQ ID NO: 1190458 - RNA, 14 nt, Mycobacterium bovis subsp bovis AF2122/97
ggcgaaugacggcc

SEQ ID NO: 1190459 - RNA, 16 nt, Mycobacterium bovis subsp bovis AF2122/97
ggcgaagucacgcacc

SEQ ID NO: 1190460 - RNA, 15 nt, Mycobacterium bovis subsp bovis AF2122/97
ggcgaccgcgucguc

SEQ ID NO: 1190461 - RNA, 22 nt, Mycobacterium bovis subsp bovis AF2122/97
ggcgaccgccaucacgaccagg

SEQ ID NO: 1190462 - RNA, 19 nt, Mycobacterium bovis subsp bovis AF2122/97
ggcgaccgagacggcgucg

SEQ ID NO: 1190463 - RNA, 21 nt, Mycobacterium bovis subsp bovis AF2122/97
ggcgaccccgaacauccgccg

SEQ ID NO: 1190464 - RNA, 14 nt, Mycobacterium bovis subsp bovis AF2122/97
ggcgacccgcuggg

SEQ ID NO: 1190465 - RNA, 16 nt, Mycobacterium bovis subsp bovis AF2122/97
ggcgaccaugcuccua

SEQ ID NO: 1190466 - RNA, 11 nt, Mycobacterium bovis subsp bovis AF2122/97
ggcgacccagc

SEQ ID NO: 1190467 - RNA, 21 nt, Mycobacterium bovis subsp bovis AF2122/97
ggcgacgaaguccccguaguc

SEQ ID NO: 1190468 - RNA, 12 nt, Mycobacterium bovis subsp bovis AF2122/97
ggcgacgacauc

SEQ ID NO: 1190469 - RNA, 16 nt, Mycobacterium bovis subsp bovis AF2122/97
ggcgacgaccgucggc

SEQ ID NO: 1190470 - RNA, 22 nt, Mycobacterium bovis subsp bovis AF2122/97
ggcgaccugcgcgagguuggcg

SEQ ID NO: 1190471 - RNA, 22 nt, Mycobacterium bovis subsp bovis AF2122/97
ggcgaccggugccugcaacgcc

SEQ ID NO: 1190472 - RNA, 23 nt, Mycobacterium bovis subsp bovis AF2122/97
ggcgacgucaucgccgacccgcc

SEQ ID NO: 1190473 - RNA, 13 nt, Mycobacterium bovis subsp bovis AF2122/97
ggcgacggacucc

SEQ ID NO: 1190474 - RNA, 18 nt, Mycobacterium bovis subsp bovis AF2122/97
ggcgacggcggcacgggc

SEQ ID NO: 1190475 - RNA, 22 nt, Mycobacterium bovis subsp bovis AF2122/97
ggcgaccggccggccgcgggcg

SEQ ID NO: 1190476 - RNA, 11 nt, Mycobacterium bovis subsp bovis AF2122/97
ggcgacgaggc

SEQ ID NO: 1190477 - RNA, 22 nt, Mycobacterium bovis subsp bovis AF2122/97
ggcgacgaucucgccgccagcg

SEQ ID NO: 1190478 - RNA, 19 nt, Mycobacterium bovis subsp bovis AF2122/97
ggcgacgaucucggcggcc

SEQ ID NO: 1190479 - RNA, 19 nt, Mycobacterium bovis subsp bovis AF2122/97
ggcgacgccgucuagcaca

SEQ ID NO: 1190480 - RNA, 23 nt, Mycobacterium bovis subsp bovis AF2122/97
ggcgacgccaguguugcgcugcg

SEQ ID NO: 1190481 - RNA, 22 nt, Mycobacterium bovis subsp bovis AF2122/97
ggcgagcagucgcaaaagcccc

SEQ ID NO: 1190482 - RNA, 18 nt, Mycobacterium bovis subsp bovis AF2122/97
ggcgagcggccuccagca

SEQ ID NO: 1190483 - RNA, 16 nt, Mycobacterium bovis subsp bovis AF2122/97
ggcgaggcggucgccg

SEQ ID NO: 1190484 - RNA, 13 nt, Mycobacterium bovis subsp bovis AF2122/97
ggcgaggcucccg

SEQ ID NO: 1190485 - RNA, 18 nt, Mycobacterium bovis subsp bovis AF2122/97
ggcgaggccucggcggcc

SEQ ID NO: 1190486 - RNA, 22 nt, Mycobacterium bovis subsp bovis AF2122/97
ggcgagcucggccccgccgccg

SEQ ID NO: 1190487 - RNA, 13 nt, Mycobacterium bovis subsp bovis AF2122/97
ggcgagcggccuc

SEQ ID NO: 1190488 - RNA, 15 nt, Mycobacterium bovis subsp bovis AF2122/97
ggcgagcggccucca

SEQ ID NO: 1190489 - RNA, 13 nt, Mycobacterium bovis subsp bovis AF2122/97
ggcgagcgcggcc

SEQ ID NO: 1190490 - RNA, 20 nt, Mycobacterium bovis subsp bovis AF2122/97
ggcgagcgcggccugcacca

SEQ ID NO: 1190491 - RNA, 14 nt, Mycobacterium bovis subsp bovis AF2122/97
ggcgagcagcaggu

SEQ ID NO: 1190492 - RNA, 24 nt, Mycobacterium bovis subsp bovis AF2122/97
ggcgagcaacucguccagcagugc

SEQ ID NO: 1190493 - RNA, 18 nt, Mycobacterium bovis subsp bovis AF2122/97
ggcgagcaccgugcccug

SEQ ID NO: 1190494 - RNA, 22 nt, Mycobacterium bovis subsp bovis AF2122/97
ggcgagcaccaccccagcggcc

SEQ ID NO: 1190495 - RNA, 18 nt, Mycobacterium bovis subsp bovis AF2122/97
ggcgagcaacucguccag

SEQ ID NO: 1190496 - RNA, 18 nt, Mycobacterium bovis subsp bovis AF2122/97
ggcgagagggcggggcag

SEQ ID NO: 1190497 - RNA, 16 nt, Mycobacterium bovis subsp bovis AF2122/97
ggcgacugcgucggcg

SEQ ID NO: 1190498 - RNA, 16 nt, Mycobacterium bovis subsp bovis AF2122/97
ggcgacugcagcgaag

SEQ ID NO: 1190499 - RNA, 18 nt, Mycobacterium bovis subsp bovis AF2122/97
ggcgacguuggcgggagc

SEQ ID NO: 1190500 - RNA, 16 nt, Mycobacterium bovis subsp bovis AF2122/97
ggcgacuacccagcca

SEQ ID NO: 1190501 - RNA, 15 nt, Mycobacterium bovis subsp bovis AF2122/97
ggcgacuacggccuc

SEQ ID NO: 1190502 - RNA, 12 nt, Mycobacterium bovis subsp bovis AF2122/97
ggcgagaagcgu

SEQ ID NO: 1190503 - RNA, 19 nt, Mycobacterium bovis subsp bovis AF2122/97
ggcgacucgaggaccugcu

SEQ ID NO: 1190504 - RNA, 19 nt, Mycobacterium bovis subsp bovis AF2122/97
ggcgacuucuucgcgcaac

SEQ ID NO: 1190505 - RNA, 22 nt, Mycobacterium bovis subsp bovis AF2122/97
ggcgacugucccauacgugucg

SEQ ID NO: 1190506 - RNA, 16 nt, Mycobacterium bovis subsp bovis AF2122/97
ggccuggccaccuggu

SEQ ID NO: 1190507 - RNA, 18 nt, Mycobacterium bovis subsp bovis AF2122/97
ggccuggcucguccgggu

SEQ ID NO: 1190508 - RNA, 16 nt, Mycobacterium bovis subsp bovis AF2122/97
ggccuggggcagccgg

SEQ ID NO: 1190509 - RNA, 16 nt, Mycobacterium bovis subsp bovis AF2122/97
ggccugggacggcggc

SEQ ID NO: 1190510 - RNA, 16 nt, Mycobacterium bovis subsp bovis AF2122/97
ggccugggccagccgc

SEQ ID NO: 1190511 - RNA, 13 nt, Mycobacterium bovis subsp bovis AF2122/97
ggccugggccgca

SEQ ID NO: 1190512 - RNA, 17 nt, Mycobacterium bovis subsp bovis AF2122/97
ggccuggucggccaggu

SEQ ID NO: 1190513 - RNA, 16 nt, Mycobacterium bovis subsp bovis AF2122/97
ggccugguacucccgc

SEQ ID NO: 1190514 - RNA, 15 nt, Mycobacterium bovis subsp bovis AF2122/97
ggccuguucggcggc

SEQ ID NO: 1190515 - RNA, 21 nt, Mycobacterium bovis subsp bovis AF2122/97
ggccugucgaagauccagcgc

SEQ ID NO: 1190516 - RNA, 22 nt, Mycobacterium bovis subsp bovis AF2122/97
ggccuucaaggaagccgcggcc

SEQ ID NO: 1190517 - RNA, 23 nt, Mycobacterium bovis subsp bovis AF2122/97
ggccuguuuaccuuccucgcccu

SEQ ID NO: 1190518 - RNA, 16 nt, Mycobacterium bovis subsp bovis AF2122/97
ggccuguucaacuccg

SEQ ID NO: 1190519 - RNA, 19 nt, Mycobacterium bovis subsp bovis AF2122/97
ggccuugcgucaucggcuc

SEQ ID NO: 1190520 - RNA, 13 nt, Mycobacterium bovis subsp bovis AF2122/97
ggccuuggcggcg

SEQ ID NO: 1190521 - RNA, 22 nt, Mycobacterium bovis subsp bovis AF2122/97
ggccuugccgaucagcuggcuc

SEQ ID NO: 1190522 - RNA, 20 nt, Mycobacterium bovis subsp bovis AF2122/97
ggccugcgcgaccgaccagc

SEQ ID NO: 1190523 - RNA, 14 nt, Mycobacterium bovis subsp bovis AF2122/97
ggccugcgcagacu

SEQ ID NO: 1190524 - RNA, 24 nt, Mycobacterium bovis subsp bovis AF2122/97
ggccugcuaaccacggugugcuac

SEQ ID NO: 1190525 - RNA, 15 nt, Mycobacterium bovis subsp bovis AF2122/97
ggccugcggucaggg

SEQ ID NO: 1190526 - RNA, 22 nt, Mycobacterium bovis subsp bovis AF2122/97
ggccugcucgggggccgaccag

SEQ ID NO: 1190527 - RNA, 16 nt, Mycobacterium bovis subsp bovis AF2122/97
ggccugcacgccggcg

SEQ ID NO: 1190528 - RNA, 15 nt, Mycobacterium bovis subsp bovis AF2122/97
ggccugcaccacggc

SEQ ID NO: 1190529 - RNA, 18 nt, Mycobacterium bovis subsp bovis AF2122/97
ggccugcaccacggcggc

SEQ ID NO: 1190530 - RNA, 19 nt, Mycobacterium bovis subsp bovis AF2122/97
ggccugcaccacggcggcc

SEQ ID NO: 1190531 - RNA, 14 nt, Mycobacterium bovis subsp bovis AF2122/97
ggccugagcggcca

SEQ ID NO: 1190532 - RNA, 13 nt, Mycobacterium bovis subsp bovis AF2122/97
ggccugcccagca

SEQ ID NO: 1190533 - RNA, 14 nt, Mycobacterium bovis subsp bovis AF2122/97
ggccugcccagcac

SEQ ID NO: 1190534 - RNA, 17 nt, Mycobacterium bovis subsp bovis AF2122/97
ggccugcgacgagccca

SEQ ID NO: 1190535 - RNA, 16 nt, Mycobacterium bovis subsp bovis AF2122/97
ggccugccgcucgccg

SEQ ID NO: 1190536 - RNA, 19 nt, Mycobacterium bovis subsp bovis AF2122/97
ggccugccguuccagcauc

SEQ ID NO: 1190537 - RNA, 21 nt, Mycobacterium bovis subsp bovis AF2122/97
ggccugccauaggcccacggc

SEQ ID NO: 1190538 - RNA, 18 nt, Mycobacterium bovis subsp bovis AF2122/97
ggccugcagccgaugcuc

SEQ ID NO: 1190539 - RNA, 18 nt, Mycobacterium bovis subsp bovis AF2122/97
ggccucggcggccguggc

SEQ ID NO: 1190540 - RNA, 16 nt, Mycobacterium bovis subsp bovis AF2122/97
ggccucggcgagcacg

SEQ ID NO: 1190541 - RNA, 15 nt, Mycobacterium bovis subsp bovis AF2122/97
ggccucgcugcucag

SEQ ID NO: 1190542 - RNA, 14 nt, Mycobacterium bovis subsp bovis AF2122/97
ggccucggccagcg

SEQ ID NO: 1190543 - RNA, 15 nt, Mycobacterium bovis subsp bovis AF2122/97
ggccucggccagcgu

SEQ ID NO: 1190544 - RNA, 23 nt, Mycobacterium bovis subsp bovis AF2122/97
ggccucggccagcgucagcuguu

SEQ ID NO: 1190545 - RNA, 21 nt, Mycobacterium bovis subsp bovis AF2122/97
ggccucgucgauguucgccgc

SEQ ID NO: 1190546 - RNA, 14 nt, Mycobacterium bovis subsp bovis AF2122/97
ggccucguccagcu

SEQ ID NO: 1190547 - RNA, 19 nt, Mycobacterium bovis subsp bovis AF2122/97
ggccucggggaucgcaagc

SEQ ID NO: 1190548 - RNA, 16 nt, Mycobacterium bovis subsp bovis AF2122/97
ggccugaaccacgcgu

SEQ ID NO: 1190549 - RNA, 18 nt, Mycobacterium bovis subsp bovis AF2122/97
ggccucauccaccgaugg

SEQ ID NO: 1190550 - RNA, 12 nt, Mycobacterium bovis subsp bovis AF2122/97
ggccucgccggc

SEQ ID NO: 1190551 - RNA, 12 nt, Mycobacterium bovis subsp bovis AF2122/97
ggccucgaucag

SEQ ID NO: 1190552 - RNA, 23 nt, Mycobacterium bovis subsp bovis AF2122/97
ggccucgaagggcuugucgccgg

SEQ ID NO: 1190553 - RNA, 23 nt, Mycobacterium bovis subsp bovis AF2122/97
ggccgucgcgggacaacagcaug

SEQ ID NO: 1190554 - RNA, 17 nt, Mycobacterium bovis subsp bovis AF2122/97
ggccgucgggacggcca

SEQ ID NO: 1190555 - RNA, 15 nt, Mycobacterium bovis subsp bovis AF2122/97
ggccgucgggcagca

SEQ ID NO: 1190556 - RNA, 17 nt, Mycobacterium bovis subsp bovis AF2122/97
ggccgugaauucgccga

SEQ ID NO: 1190557 - RNA, 13 nt, Mycobacterium bovis subsp bovis AF2122/97
ggccgugccgccg

SEQ ID NO: 1190558 - RNA, 14 nt, Mycobacterium bovis subsp bovis AF2122/97
ggccgugccgccga

SEQ ID NO: 1190559 - RNA, 17 nt, Mycobacterium bovis subsp bovis AF2122/97
ggccgugguggucucga

SEQ ID NO: 1190560 - RNA, 17 nt, Mycobacterium bovis subsp bovis AF2122/97
ggccgugucgggcgcga

SEQ ID NO: 1190561 - RNA, 20 nt, Mycobacterium bovis subsp bovis AF2122/97
ggccgugggugucgguggcc

SEQ ID NO: 1190562 - RNA, 15 nt, Mycobacterium bovis subsp bovis AF2122/97
ggccguggcggacgg

SEQ ID NO: 1190563 - RNA, 18 nt, Mycobacterium bovis subsp bovis AF2122/97
ggccguggaaagccggcg

SEQ ID NO: 1190564 - RNA, 23 nt, Mycobacterium bovis subsp bovis AF2122/97
ggccguuggugaggccccccgcg

SEQ ID NO: 1190565 - RNA, 20 nt, Mycobacterium bovis subsp bovis AF2122/97
ggccguuggcggcgguggcc

SEQ ID NO: 1190566 - RNA, 22 nt, Mycobacterium bovis subsp bovis AF2122/97
ggccuaccaggcgcggcccagg

SEQ ID NO: 1190567 - RNA, 13 nt, Mycobacterium bovis subsp bovis AF2122/97
ggccucagcccgg

SEQ ID NO: 1190568 - RNA, 13 nt, Mycobacterium bovis subsp bovis AF2122/97
ggccuagccgcgg

SEQ ID NO: 1190569 - RNA, 14 nt, Mycobacterium bovis subsp bovis AF2122/97
ggccuaggccgagg

SEQ ID NO: 1190570 - RNA, 16 nt, Mycobacterium bovis subsp bovis AF2122/97
ggccuagggcggcggc

SEQ ID NO: 1190571 - RNA, 18 nt, Mycobacterium bovis subsp bovis AF2122/97
ggccuaggucgacgccga

SEQ ID NO: 1190572 - RNA, 17 nt, Mycobacterium bovis subsp bovis AF2122/97
ggcgcccgucuccagca

SEQ ID NO: 1190573 - RNA, 18 nt, Mycobacterium bovis subsp bovis AF2122/97
ggcgcccgugccgcccgc

SEQ ID NO: 1190574 - RNA, 16 nt, Mycobacterium bovis subsp bovis AF2122/97
ggcgcccggggcggug

SEQ ID NO: 1190575 - RNA, 20 nt, Mycobacterium bovis subsp bovis AF2122/97
ggcgcccggggcggugggcg

SEQ ID NO: 1190576 - RNA, 14 nt, Mycobacterium bovis subsp bovis AF2122/97
ggcgcccuccuugg

SEQ ID NO: 1190577 - RNA, 19 nt, Mycobacterium bovis subsp bovis AF2122/97
ggcgccgaagccuugcagc

SEQ ID NO: 1190578 - RNA, 19 nt, Mycobacterium bovis subsp bovis AF2122/97
ggcgccgaaguagccgacc

SEQ ID NO: 1190579 - RNA, 21 nt, Mycobacterium bovis subsp bovis AF2122/97
ggcgccgaagagucgugccgc

SEQ ID NO: 1190580 - RNA, 13 nt, Mycobacterium bovis subsp bovis AF2122/97
ggcgcccuugagc

SEQ ID NO: 1190581 - RNA, 23 nt, Mycobacterium bovis subsp bovis AF2122/97
ggcgcccuuaagccggcgcggcg

SEQ ID NO: 1190582 - RNA, 21 nt, Mycobacterium bovis subsp bovis AF2122/97
ggcgccgaugaccgcaaccgg

SEQ ID NO: 1190583 - RNA, 19 nt, Mycobacterium bovis subsp bovis AF2122/97
ggcgccgauaccggcggcg

SEQ ID NO: 1190584 - RNA, 14 nt, Mycobacterium bovis subsp bovis AF2122/97
ggcgccgcccagca

SEQ ID NO: 1190585 - RNA, 17 nt, Mycobacterium bovis subsp bovis AF2122/97
ggcgccgcagggccgcg

SEQ ID NO: 1190586 - RNA, 15 nt, Mycobacterium bovis subsp bovis AF2122/97
ggcgccgccaagggc

SEQ ID NO: 1190587 - RNA, 21 nt, Mycobacterium bovis subsp bovis AF2122/97
ggcgccgccacugccggcagc

SEQ ID NO: 1190588 - RNA, 22 nt, Mycobacterium bovis subsp bovis AF2122/97
ggcgccgccacugccggcagcg

SEQ ID NO: 1190589 - RNA, 14 nt, Mycobacterium bovis subsp bovis AF2122/97
ggcgccgcagcgcu

SEQ ID NO: 1190590 - RNA, 23 nt, Mycobacterium bovis subsp bovis AF2122/97
ggcgccgcacagagugaggcgcu

SEQ ID NO: 1190591 - RNA, 11 nt, Mycobacterium bovis subsp bovis AF2122/97
ggcgccgcaga

SEQ ID NO: 1190592 - RNA, 22 nt, Mycobacterium bovis subsp bovis AF2122/97
ggcgccgcagaucaccgccagc

SEQ ID NO: 1190593 - RNA, 19 nt, Mycobacterium bovis subsp bovis AF2122/97
ggcgccgcccuugccgccg

SEQ ID NO: 1190594 - RNA, 12 nt, Mycobacterium bovis subsp bovis AF2122/97
ggcgccgcccgc

SEQ ID NO: 1190595 - RNA, 13 nt, Mycobacterium bovis subsp bovis AF2122/97
ggcgccgccggcg

SEQ ID NO: 1190596 - RNA, 22 nt, Mycobacterium bovis subsp bovis AF2122/97
ggcgccgccguuaccgccggcg

SEQ ID NO: 1190597 - RNA, 15 nt, Mycobacterium bovis subsp bovis AF2122/97
ggcgccgccguuccc

SEQ ID NO: 1190598 - RNA, 22 nt, Mycobacterium bovis subsp bovis AF2122/97
ggcgccgccguucccgccggcg

SEQ ID NO: 1190599 - RNA, 19 nt, Mycobacterium bovis subsp bovis AF2122/97
ggcgccgcccgcgccgccg

SEQ ID NO: 1190600 - RNA, 15 nt, Mycobacterium bovis subsp bovis AF2122/97
ggcgccgccggcgcc

SEQ ID NO: 1190601 - RNA, 16 nt, Mycobacterium bovis subsp bovis AF2122/97
ggcgccgccggugcca

SEQ ID NO: 1190602 - RNA, 16 nt, Mycobacterium bovis subsp bovis AF2122/97
ggcgccgccguccagc

SEQ ID NO: 1190603 - RNA, 15 nt, Mycobacterium bovis subsp bovis AF2122/97
ggcgccgccgucgcc

SEQ ID NO: 1190604 - RNA, 15 nt, Mycobacterium bovis subsp bovis AF2122/97
ggcgccgcggcuggg

SEQ ID NO: 1190605 - RNA, 13 nt, Mycobacterium bovis subsp bovis AF2122/97
ggcgcccagcgcu

SEQ ID NO: 1190606 - RNA, 14 nt, Mycobacterium bovis subsp bovis AF2122/97
ggcgcccaggaacu

SEQ ID NO: 1190607 - RNA, 15 nt, Mycobacterium bovis subsp bovis AF2122/97
ggcgcccgaagccgg

SEQ ID NO: 1190608 - RNA, 11 nt, Mycobacterium bovis subsp bovis AF2122/97
ggcgcccaggc

SEQ ID NO: 1190609 - RNA, 15 nt, Mycobacterium bovis subsp bovis AF2122/97
ggcgccccaccggcc

SEQ ID NO: 1190610 - RNA, 13 nt, Mycobacterium bovis subsp bovis AF2122/97
ggcgcccgccccg

SEQ ID NO: 1190611 - RNA, 21 nt, Mycobacterium bovis subsp bovis AF2122/97
ggcgcccgaagccgggcccca

SEQ ID NO: 1190612 - RNA, 13 nt, Mycobacterium bovis subsp bovis AF2122/97
ggcgcccgcccga

SEQ ID NO: 1190613 - RNA, 20 nt, Mycobacterium bovis subsp bovis AF2122/97
ggcgcccgcccgagccgcug

SEQ ID NO: 1190614 - RNA, 14 nt, Mycobacterium bovis subsp bovis AF2122/97
ggcgcccgcggucc

SEQ ID NO: 1190615 - RNA, 12 nt, Mycobacterium bovis subsp bovis AF2122/97
ggcgcccgccgg

SEQ ID NO: 1190616 - RNA, 16 nt, Mycobacterium bovis subsp bovis AF2122/97
ggcgcccgcucggccg

SEQ ID NO: 1190617 - RNA, 22 nt, Mycobacterium bovis subsp bovis AF2122/97
ggcgcccgggaucggggcaccg

SEQ ID NO: 1190618 - RNA, 23 nt, Mycobacterium bovis subsp bovis AF2122/97
ggcgcccggcuuuugcgcccagc

SEQ ID NO: 1190619 - RNA, 19 nt, Mycobacterium bovis subsp bovis AF2122/97
ggcgccauccccgccggcg

SEQ ID NO: 1190620 - RNA, 20 nt, Mycobacterium bovis subsp bovis AF2122/97
ggcgccaucccgccgcccgc

SEQ ID NO: 1190621 - RNA, 16 nt, Mycobacterium bovis subsp bovis AF2122/97
ggcgccaugaagccgg

SEQ ID NO: 1190622 - RNA, 13 nt, Mycobacterium bovis subsp bovis AF2122/97
ggcgccagggccu

SEQ ID NO: 1190623 - RNA, 23 nt, Mycobacterium bovis subsp bovis AF2122/97
ggcgcccacaucgucggcgggcg

SEQ ID NO: 1190624 - RNA, 12 nt, Mycobacterium bovis subsp bovis AF2122/97
ggcgccagcgcc

SEQ ID NO: 1190625 - RNA, 14 nt, Mycobacterium bovis subsp bovis AF2122/97
ggcgccacggcagc

SEQ ID NO: 1190626 - RNA, 15 nt, Mycobacterium bovis subsp bovis AF2122/97
ggcgccacggcagcg

SEQ ID NO: 1190627 - RNA, 12 nt, Mycobacterium bovis subsp bovis AF2122/97
ggcgccgcgcgc

SEQ ID NO: 1190628 - RNA, 16 nt, Mycobacterium bovis subsp bovis AF2122/97
ggcgccgcgcucgacg

SEQ ID NO: 1190629 - RNA, 17 nt, Mycobacterium bovis subsp bovis AF2122/97
ggcgccgcggcuggggg

SEQ ID NO: 1190630 - RNA, 19 nt, Mycobacterium bovis subsp bovis AF2122/97
ggcgccggauauggcagug

SEQ ID NO: 1190631 - RNA, 16 nt, Mycobacterium bovis subsp bovis AF2122/97
ggcgccggaggcggcg

SEQ ID NO: 1190632 - RNA, 22 nt, Mycobacterium bovis subsp bovis AF2122/97
ggcgccggaacgagcggccgcg

SEQ ID NO: 1190633 - RNA, 15 nt, Mycobacterium bovis subsp bovis AF2122/97
ggcgccggccagcca

SEQ ID NO: 1190634 - RNA, 13 nt, Mycobacterium bovis subsp bovis AF2122/97
ggcgccggccagu

SEQ ID NO: 1190635 - RNA, 14 nt, Mycobacterium bovis subsp bovis AF2122/97
ggcgccggccggca

SEQ ID NO: 1190636 - RNA, 16 nt, Mycobacterium bovis subsp bovis AF2122/97
ggcgccggccggcagg

SEQ ID NO: 1190637 - RNA, 17 nt, Mycobacterium bovis subsp bovis AF2122/97
ggcgccggccggcagga

SEQ ID NO: 1190638 - RNA, 19 nt, Mycobacterium bovis subsp bovis AF2122/97
ggcgccggcgcugcugcca

SEQ ID NO: 1190639 - RNA, 17 nt, Mycobacterium bovis subsp bovis AF2122/97
ggcgccggcggccgcgg

SEQ ID NO: 1190640 - RNA, 13 nt, Mycobacterium bovis subsp bovis AF2122/97
ggcgccggcggcc

SEQ ID NO: 1190641 - RNA, 18 nt, Mycobacterium bovis subsp bovis AF2122/97
ggcgccggcgucggcgcc

SEQ ID NO: 1190642 - RNA, 22 nt, Mycobacterium bovis subsp bovis AF2122/97
ggcgccggcgucggcgcccagc

SEQ ID NO: 1190643 - RNA, 23 nt, Mycobacterium bovis subsp bovis AF2122/97
ggcgccggcgucggcgcccagcu

SEQ ID NO: 1190644 - RNA, 15 nt, Mycobacterium bovis subsp bovis AF2122/97
ggcgccggggccgcc

SEQ ID NO: 1190645 - RNA, 12 nt, Mycobacterium bovis subsp bovis AF2122/97
ggcgccggggcc

SEQ ID NO: 1190646 - RNA, 16 nt, Mycobacterium bovis subsp bovis AF2122/97
ggcgccggugccgccg

SEQ ID NO: 1190647 - RNA, 16 nt, Mycobacterium bovis subsp bovis AF2122/97
ggcgccggugccgccu

SEQ ID NO: 1190648 - RNA, 18 nt, Mycobacterium bovis subsp bovis AF2122/97
ggcgccggugcggcgggc

SEQ ID NO: 1190649 - RNA, 20 nt, Mycobacterium bovis subsp bovis AF2122/97
ggcgccggugguaccggcgg

SEQ ID NO: 1190650 - RNA, 23 nt, Mycobacterium bovis subsp bovis AF2122/97
ggcgccgguguuuccgaaacccg

SEQ ID NO: 1190651 - RNA, 13 nt, Mycobacterium bovis subsp bovis AF2122/97
ggcgccgucgccg

SEQ ID NO: 1190652 - RNA, 17 nt, Mycobacterium bovis subsp bovis AF2122/97
ggcgccgucggagccgg

SEQ ID NO: 1190653 - RNA, 23 nt, Mycobacterium bovis subsp bovis AF2122/97
ggcgccgucggagccggccaccu

SEQ ID NO: 1190654 - RNA, 16 nt, Mycobacterium bovis subsp bovis AF2122/97
ggcgccuagcacgaag

SEQ ID NO: 1190655 - RNA, 20 nt, Mycobacterium bovis subsp bovis AF2122/97
ggcgccgucguugugccggu

SEQ ID NO: 1190656 - RNA, 20 nt, Mycobacterium bovis subsp bovis AF2122/97
ggcgccgucucgaucgcggu

SEQ ID NO: 1190657 - RNA, 18 nt, Mycobacterium bovis subsp bovis AF2122/97
ggcgccgugccccgggcc

SEQ ID NO: 1190658 - RNA, 19 nt, Mycobacterium bovis subsp bovis AF2122/97
ggcgccguuagcgucgccu

SEQ ID NO: 1190659 - RNA, 22 nt, Mycobacterium bovis subsp bovis AF2122/97
ggcgccuuccaggcgggcggca

SEQ ID NO: 1190660 - RNA, 11 nt, Mycobacterium bovis subsp bovis AF2122/97
ggcgccuuggu

SEQ ID NO: 1190661 - RNA, 19 nt, Mycobacterium bovis subsp bovis AF2122/97
ggcgccuuggucgccgccu

SEQ ID NO: 1190662 - RNA, 19 nt, Mycobacterium bovis subsp bovis AF2122/97
ggcgcgaauauucgcuggg

SEQ ID NO: 1190663 - RNA, 16 nt, Mycobacterium bovis subsp bovis AF2122/97
ggcgcgacagccgugg

SEQ ID NO: 1190664 - RNA, 21 nt, Mycobacterium bovis subsp bovis AF2122/97
ggcgccucgugcgugggcgcg

SEQ ID NO: 1190665 - RNA, 20 nt, Mycobacterium bovis subsp bovis AF2122/97
ggcgccugaugcggccggcg

SEQ ID NO: 1190666 - RNA, 14 nt, Mycobacterium bovis subsp bovis AF2122/97
ggcgcgcagccggg

SEQ ID NO: 1190667 - RNA, 15 nt, Mycobacterium bovis subsp bovis AF2122/97
ggcgcgagccggcuc

SEQ ID NO: 1190668 - RNA, 24 nt, Mycobacterium bovis subsp bovis AF2122/97
ggcgcgauagauacccgcggcagc

SEQ ID NO: 1190669 - RNA, 22 nt, Mycobacterium bovis subsp bovis AF2122/97
ggcgcgcaacguagccagcagc

SEQ ID NO: 1190670 - RNA, 20 nt, Mycobacterium bovis subsp bovis AF2122/97
ggcgcgcaacguagccagca

SEQ ID NO: 1190671 - RNA, 17 nt, Mycobacterium bovis subsp bovis AF2122/97
ggcgcgaucgcgcccgc

SEQ ID NO: 1190672 - RNA, 22 nt, Mycobacterium bovis subsp bovis AF2122/97
ggcgcgaucggugccgaagcug

SEQ ID NO: 1190673 - RNA, 18 nt, Mycobacterium bovis subsp bovis AF2122/97
ggcgcaccacaccacggu

SEQ ID NO: 1190674 - RNA, 16 nt, Mycobacterium bovis subsp bovis AF2122/97
ggcgcaccgucgcggg

SEQ ID NO: 1190675 - RNA, 17 nt, Mycobacterium bovis subsp bovis AF2122/97
ggcgcaccugggcugcc

SEQ ID NO: 1190676 - RNA, 23 nt, Mycobacterium bovis subsp bovis AF2122/97
ggcgcaaucaacgucacccccuu

SEQ ID NO: 1190677 - RNA, 18 nt, Mycobacterium bovis subsp bovis AF2122/97
ggcgcaacucgaccacuu

SEQ ID NO: 1190678 - RNA, 21 nt, Mycobacterium bovis subsp bovis AF2122/97
ggcgcaagaaugccgccgacg

SEQ ID NO: 1190679 - RNA, 15 nt, Mycobacterium bovis subsp bovis AF2122/97
ggcgcagcgaccggu

SEQ ID NO: 1190680 - RNA, 15 nt, Mycobacterium bovis subsp bovis AF2122/97
ggcgcagcgccagcg

SEQ ID NO: 1190681 - RNA, 17 nt, Mycobacterium bovis subsp bovis AF2122/97
ggcgcagcacggcggcc

SEQ ID NO: 1190682 - RNA, 19 nt, Mycobacterium bovis subsp bovis AF2122/97
ggcgcacgaaaccgcagcg

SEQ ID NO: 1190683 - RNA, 24 nt, Mycobacterium bovis subsp bovis AF2122/97
ggcgcagcacauccugcagcucgg

SEQ ID NO: 1190684 - RNA, 20 nt, Mycobacterium bovis subsp bovis AF2122/97
ggcgcacugguugggcgaga

SEQ ID NO: 1190685 - RNA, 18 nt, Mycobacterium bovis subsp bovis AF2122/97
ggcgcaccugggcugccg

SEQ ID NO: 1190686 - RNA, 20 nt, Mycobacterium bovis subsp bovis AF2122/97
ggcgcagggacugugggggc

SEQ ID NO: 1190687 - RNA, 21 nt, Mycobacterium bovis subsp bovis AF2122/97
ggcgcagggacugugggggcg

SEQ ID NO: 1190688 - RNA, 23 nt, Mycobacterium bovis subsp bovis AF2122/97
ggcgcagguagcggguugggacc

SEQ ID NO: 1190689 - RNA, 16 nt, Mycobacterium bovis subsp bovis AF2122/97
ggcgcagcugggugcg

SEQ ID NO: 1190690 - RNA, 14 nt, Mycobacterium bovis subsp bovis AF2122/97
ggcgcagcucaccg

SEQ ID NO: 1190691 - RNA, 13 nt, Mycobacterium bovis subsp bovis AF2122/97
ggcgcagcgucuc

SEQ ID NO: 1190692 - RNA, 16 nt, Mycobacterium bovis subsp bovis AF2122/97
ggcgcagcucaccgac

SEQ ID NO: 1190693 - RNA, 16 nt, Mycobacterium bovis subsp bovis AF2122/97
ggcgcauagggccacc

SEQ ID NO: 1190694 - RNA, 19 nt, Mycobacterium bovis subsp bovis AF2122/97
ggcgcaguuggcaccagcc

SEQ ID NO: 1190695 - RNA, 17 nt, Mycobacterium bovis subsp bovis AF2122/97
ggcgcauaccggcgucg

SEQ ID NO: 1190696 - RNA, 20 nt, Mycobacterium bovis subsp bovis AF2122/97
ggcgccaccgccgcugccgg

SEQ ID NO: 1190697 - RNA, 16 nt, Mycobacterium bovis subsp bovis AF2122/97
ggcgccaccgucgccg

SEQ ID NO: 1190698 - RNA, 15 nt, Mycobacterium bovis subsp bovis AF2122/97
ggcgccaccgucacc

SEQ ID NO: 1190699 - RNA, 18 nt, Mycobacterium bovis subsp bovis AF2122/97
ggcgccaccgucaccgcc

SEQ ID NO: 1190700 - RNA, 21 nt, Mycobacterium bovis subsp bovis AF2122/97
ggcgccacccgcgccgcccgc

SEQ ID NO: 1190701 - RNA, 17 nt, Mycobacterium bovis subsp bovis AF2122/97
ggcgcauuccggcgcca

SEQ ID NO: 1190702 - RNA, 14 nt, Mycobacterium bovis subsp bovis AF2122/97
ggcgaucaagccuc

SEQ ID NO: 1190703 - RNA, 18 nt, Mycobacterium bovis subsp bovis AF2122/97
ggcgaucagcagccgccg

SEQ ID NO: 1190704 - RNA, 23 nt, Mycobacterium bovis subsp bovis AF2122/97
ggcgaucgcauccgcgguuggca

SEQ ID NO: 1190705 - RNA, 17 nt, Mycobacterium bovis subsp bovis AF2122/97
ggcgaucccgccggggc

SEQ ID NO: 1190706 - RNA, 17 nt, Mycobacterium bovis subsp bovis AF2122/97
ggcgaucaugagcagca

SEQ ID NO: 1190707 - RNA, 16 nt, Mycobacterium bovis subsp bovis AF2122/97
ggcgaguucggcagcg

SEQ ID NO: 1190708 - RNA, 18 nt, Mycobacterium bovis subsp bovis AF2122/97
ggcgaguuaggccgccag

SEQ ID NO: 1190709 - RNA, 19 nt, Mycobacterium bovis subsp bovis AF2122/97
ggcgaguuaggccgccagc

SEQ ID NO: 1190710 - RNA, 22 nt, Mycobacterium bovis subsp bovis AF2122/97
ggcgagugucuuagccagcagc

SEQ ID NO: 1190711 - RNA, 24 nt, Mycobacterium bovis subsp bovis AF2122/97
ggcgagguauaaacgcggcgcgcu

SEQ ID NO: 1190712 - RNA, 16 nt, Mycobacterium bovis subsp bovis AF2122/97
ggcgauaaaucgccga

SEQ ID NO: 1190713 - RNA, 22 nt, Mycobacterium bovis subsp bovis AF2122/97
ggcgauaaaucgccgaaucuca

SEQ ID NO: 1190714 - RNA, 18 nt, Mycobacterium bovis subsp bovis AF2122/97
ggcgauaaagccgcugaa

SEQ ID NO: 1190715 - RNA, 20 nt, Mycobacterium bovis subsp bovis AF2122/97
ggcgaggucccggccgagcg

SEQ ID NO: 1190716 - RNA, 15 nt, Mycobacterium bovis subsp bovis AF2122/97
ggcgagucgggggcc

SEQ ID NO: 1190717 - RNA, 20 nt, Mycobacterium bovis subsp bovis AF2122/97
ggcgagguauaaacgcggcg

SEQ ID NO: 1190718 - RNA, 19 nt, Mycobacterium bovis subsp bovis AF2122/97
ggcgagggcggucagcggc

SEQ ID NO: 1190719 - RNA, 20 nt, Mycobacterium bovis subsp bovis AF2122/97
ggcgagggcuaccggcgccg

SEQ ID NO: 1190720 - RNA, 15 nt, Mycobacterium bovis subsp bovis AF2122/97
ggcgaugcggcgucg

SEQ ID NO: 1190721 - RNA, 21 nt, Mycobacterium bovis subsp bovis AF2122/97
ggcgaugcgggccgccaggcg

SEQ ID NO: 1190722 - RNA, 14 nt, Mycobacterium bovis subsp bovis AF2122/97
ggcgaugcgcgccc

SEQ ID NO: 1190723 - RNA, 13 nt, Mycobacterium bovis subsp bovis AF2122/97
ggcgaugcgcggg

SEQ ID NO: 1190724 - RNA, 13 nt, Mycobacterium bovis subsp bovis AF2122/97
ggcgaugcugggc

SEQ ID NO: 1190725 - RNA, 17 nt, Mycobacterium bovis subsp bovis AF2122/97
ggcgaugcugggcgaga

SEQ ID NO: 1190726 - RNA, 14 nt, Mycobacterium bovis subsp bovis AF2122/97
ggcgauggccagca

SEQ ID NO: 1190727 - RNA, 23 nt, Mycobacterium bovis subsp bovis AF2122/97
ggcgaucucgaccguauugacca

SEQ ID NO: 1190728 - RNA, 22 nt, Mycobacterium bovis subsp bovis AF2122/97
ggcgaucucuaccagccgcccc

SEQ ID NO: 1190729 - RNA, 17 nt, Mycobacterium bovis subsp bovis AF2122/97
ggcgaucugcugugucg

SEQ ID NO: 1190730 - RNA, 22 nt, Mycobacterium bovis subsp bovis AF2122/97
ggcgaucugcuaccagagccgc

SEQ ID NO: 1190731 - RNA, 23 nt, Mycobacterium bovis subsp bovis AF2122/97
ggcgaucugcuaccagagccgcg

SEQ ID NO: 1190732 - RNA, 23 nt, Mycobacterium bovis subsp bovis AF2122/97
ggcgaugagguggccgcgcaggg

SEQ ID NO: 1190733 - RNA, 14 nt, Mycobacterium bovis subsp bovis AF2122/97
ggcgaugagcgcga

SEQ ID NO: 1190734 - RNA, 20 nt, Mycobacterium bovis subsp bovis AF2122/97
ggcgaugagggcuuguggug

SEQ ID NO: 1190735 - RNA, 19 nt, Mycobacterium bovis subsp bovis AF2122/97
ggcgauuaccggcacgccg

SEQ ID NO: 1190736 - RNA, 21 nt, Mycobacterium bovis subsp bovis AF2122/97
ggcgauucgcaaucagcuggu

SEQ ID NO: 1190737 - RNA, 20 nt, Mycobacterium bovis subsp bovis AF2122/97
ggcgauugucggggccgcag

SEQ ID NO: 1190738 - RNA, 23 nt, Mycobacterium bovis subsp bovis AF2122/97
ggcgauuuugcgucugcucggcg

SEQ ID NO: 1190739 - RNA, 22 nt, Mycobacterium bovis subsp bovis AF2122/97
ggcucagcgguggcguggugga

SEQ ID NO: 1190740 - RNA, 17 nt, Mycobacterium bovis subsp bovis AF2122/97
ggcucagcugguggcgg

SEQ ID NO: 1190741 - RNA, 15 nt, Mycobacterium bovis subsp bovis AF2122/97
ggcucagcgguggcg

SEQ ID NO: 1190742 - RNA, 14 nt, Mycobacterium bovis subsp bovis AF2122/97
ggcuccaccgggcc

SEQ ID NO: 1190743 - RNA, 22 nt, Mycobacterium bovis subsp bovis AF2122/97
ggcuccaccgggcccgccggcc

SEQ ID NO: 1190744 - RNA, 17 nt, Mycobacterium bovis subsp bovis AF2122/97
ggcuccaauugcggccg

SEQ ID NO: 1190745 - RNA, 19 nt, Mycobacterium bovis subsp bovis AF2122/97
ggcucagcagcgccgcgcg

SEQ ID NO: 1190746 - RNA, 13 nt, Mycobacterium bovis subsp bovis AF2122/97
ggcucacagcaca

SEQ ID NO: 1190747 - RNA, 19 nt, Mycobacterium bovis subsp bovis AF2122/97
ggcucacgucuaacacgcg

SEQ ID NO: 1190748 - RNA, 16 nt, Mycobacterium bovis subsp bovis AF2122/97
ggcucacccaggcgcc

SEQ ID NO: 1190749 - RNA, 18 nt, Mycobacterium bovis subsp bovis AF2122/97
ggcucaccccggucgagg

SEQ ID NO: 1190750 - RNA, 13 nt, Mycobacterium bovis subsp bovis AF2122/97
ggcucacccuugg

SEQ ID NO: 1190751 - RNA, 20 nt, Mycobacterium bovis subsp bovis AF2122/97
ggcucaaccucuggcggcgg

SEQ ID NO: 1190752 - RNA, 21 nt, Mycobacterium bovis subsp bovis AF2122/97
ggcucaaccucuggcggcggg

SEQ ID NO: 1190753 - RNA, 15 nt, Mycobacterium bovis subsp bovis AF2122/97
ggcucaaccucuggc

SEQ ID NO: 1190754 - RNA, 16 nt, Mycobacterium bovis subsp bovis AF2122/97
ggcucaaccucuggcg

SEQ ID NO: 1190755 - RNA, 20 nt, Mycobacterium bovis subsp bovis AF2122/97
ggcucgacgcgucgccggcc

SEQ ID NO: 1190756 - RNA, 23 nt, Mycobacterium bovis subsp bovis AF2122/97
ggcucgacguauuggcgcagcau

SEQ ID NO: 1190757 - RNA, 19 nt, Mycobacterium bovis subsp bovis AF2122/97
ggcucgagcaagaucaccu

SEQ ID NO: 1190758 - RNA, 17 nt, Mycobacterium bovis subsp bovis AF2122/97
ggcucgauguccucgag

SEQ ID NO: 1190759 - RNA, 17 nt, Mycobacterium bovis subsp bovis AF2122/97
ggcuccggcggcagcgg

SEQ ID NO: 1190760 - RNA, 22 nt, Mycobacterium bovis subsp bovis AF2122/97
ggcuccgccgcgggcuccccgg

SEQ ID NO: 1190761 - RNA, 16 nt, Mycobacterium bovis subsp bovis AF2122/97
ggcuccgggacgguga

SEQ ID NO: 1190762 - RNA, 17 nt, Mycobacterium bovis subsp bovis AF2122/97
ggcuccgggaugaagcu

SEQ ID NO: 1190763 - RNA, 17 nt, Mycobacterium bovis subsp bovis AF2122/97
ggcuccgguaggcgaga

SEQ ID NO: 1190764 - RNA, 23 nt, Mycobacterium bovis subsp bovis AF2122/97
ggcuccgugguugccgaagccgg

SEQ ID NO: 1190765 - RNA, 21 nt, Mycobacterium bovis subsp bovis AF2122/97
ggcuccgacgaaacucucccg

SEQ ID NO: 1190766 - RNA, 16 nt, Mycobacterium bovis subsp bovis AF2122/97
ggcuccagcgcgcgcc

SEQ ID NO: 1190767 - RNA, 19 nt, Mycobacterium bovis subsp bovis AF2122/97
ggcuccagcgcgcgccgca

SEQ ID NO: 1190768 - RNA, 14 nt, Mycobacterium bovis subsp bovis AF2122/97
ggcuccagguccac

SEQ ID NO: 1190769 - RNA, 21 nt, Mycobacterium bovis subsp bovis AF2122/97
ggcuccaucgucugguggcag

SEQ ID NO: 1190770 - RNA, 22 nt, Mycobacterium bovis subsp bovis AF2122/97
ggcuccagcgcgcgccgcagcg

SEQ ID NO: 1190771 - RNA, 13 nt, Mycobacterium bovis subsp bovis AF2122/97
ggcuccggccggc

SEQ ID NO: 1190772 - RNA, 14 nt, Mycobacterium bovis subsp bovis AF2122/97
ggcuccggccggcc

SEQ ID NO: 1190773 - RNA, 17 nt, Mycobacterium bovis subsp bovis AF2122/97
ggcuccggccggccagc

SEQ ID NO: 1190774 - RNA, 18 nt, Mycobacterium bovis subsp bovis AF2122/97
ggcuccggccggccagca

SEQ ID NO: 1190775 - RNA, 19 nt, Mycobacterium bovis subsp bovis AF2122/97
ggcuccggccggccagcac

SEQ ID NO: 1190776 - RNA, 20 nt, Mycobacterium bovis subsp bovis AF2122/97
ggcuccggccggccagcacc

SEQ ID NO: 1190777 - RNA, 17 nt, Mycobacterium bovis subsp bovis AF2122/97
ggcucccuuuuccaaag

SEQ ID NO: 1190778 - RNA, 21 nt, Mycobacterium bovis subsp bovis AF2122/97
ggcuccgaacauggccagcau

SEQ ID NO: 1190779 - RNA, 19 nt, Mycobacterium bovis subsp bovis AF2122/97
ggcucccgcaauggggcgc

SEQ ID NO: 1190780 - RNA, 18 nt, Mycobacterium bovis subsp bovis AF2122/97
ggcucccggggguuccac

SEQ ID NO: 1190781 - RNA, 21 nt, Mycobacterium bovis subsp bovis AF2122/97
ggcucucggugguccagcgcu

SEQ ID NO: 1190782 - RNA, 22 nt, Mycobacterium bovis subsp bovis AF2122/97
ggcucugaggucaccggcgacc

SEQ ID NO: 1190783 - RNA, 14 nt, Mycobacterium bovis subsp bovis AF2122/97
ggcucuaucagacg

SEQ ID NO: 1190784 - RNA, 16 nt, Mycobacterium bovis subsp bovis AF2122/97
ggcucuacucgcggcc

SEQ ID NO: 1190785 - RNA, 12 nt, Mycobacterium bovis subsp bovis AF2122/97
ggcucggccacc

SEQ ID NO: 1190786 - RNA, 13 nt, Mycobacterium bovis subsp bovis AF2122/97
ggcucggccaccg

SEQ ID NO: 1190787 - RNA, 13 nt, Mycobacterium bovis subsp bovis AF2122/97
ggcucggccagcc

SEQ ID NO: 1190788 - RNA, 20 nt, Mycobacterium bovis subsp bovis AF2122/97
ggcucggccagccagcgggc

SEQ ID NO: 1190789 - RNA, 22 nt, Mycobacterium bovis subsp bovis AF2122/97
ggcucgucgaguggaucacaca

SEQ ID NO: 1190790 - RNA, 12 nt, Mycobacterium bovis subsp bovis AF2122/97
ggcucggugcgc

SEQ ID NO: 1190791 - RNA, 13 nt, Mycobacterium bovis subsp bovis AF2122/97
ggcucgguggcgg

SEQ ID NO: 1190792 - RNA, 18 nt, Mycobacterium bovis subsp bovis AF2122/97
ggcucgccgacccgccgc

SEQ ID NO: 1190793 - RNA, 14 nt, Mycobacterium bovis subsp bovis AF2122/97
ggcucgccggcggc

SEQ ID NO: 1190794 - RNA, 18 nt, Mycobacterium bovis subsp bovis AF2122/97
ggcucgcugcaccagcug

SEQ ID NO: 1190795 - RNA, 20 nt, Mycobacterium bovis subsp bovis AF2122/97
ggcugaccggggcgcccggc

SEQ ID NO: 1190796 - RNA, 21 nt, Mycobacterium bovis subsp bovis AF2122/97
ggcugaccggggcgcccggcc

SEQ ID NO: 1190797 - RNA, 19 nt, Mycobacterium bovis subsp bovis AF2122/97
ggcugaccucccacccccg

SEQ ID NO: 1190798 - RNA, 21 nt, Mycobacterium bovis subsp bovis AF2122/97
ggcugaccggggucggccugc

SEQ ID NO: 1190799 - RNA, 18 nt, Mycobacterium bovis subsp bovis AF2122/97
ggcugaaggacggcagcu

SEQ ID NO: 1190800 - RNA, 19 nt, Mycobacterium bovis subsp bovis AF2122/97
ggcugaccgaagaagcccg

SEQ ID NO: 1190801 - RNA, 20 nt, Mycobacterium bovis subsp bovis AF2122/97
ggcugaccgaagaagcccga

SEQ ID NO: 1190802 - RNA, 18 nt, Mycobacterium bovis subsp bovis AF2122/97
ggcugaaacguccuugaa

SEQ ID NO: 1190803 - RNA, 13 nt, Mycobacterium bovis subsp bovis AF2122/97
ggcugagcccgcc

SEQ ID NO: 1190804 - RNA, 17 nt, Mycobacterium bovis subsp bovis AF2122/97
ggcugagcagcgcggcc

SEQ ID NO: 1190805 - RNA, 14 nt, Mycobacterium bovis subsp bovis AF2122/97
ggcugagcccgccg

SEQ ID NO: 1190806 - RNA, 19 nt, Mycobacterium bovis subsp bovis AF2122/97
ggcugaucccggccaggcc

SEQ ID NO: 1190807 - RNA, 22 nt, Mycobacterium bovis subsp bovis AF2122/97
ggcugauggacggugcgcaggg

SEQ ID NO: 1190808 - RNA, 15 nt, Mycobacterium bovis subsp bovis AF2122/97
ggcugaugacgcgga

SEQ ID NO: 1190809 - RNA, 19 nt, Mycobacterium bovis subsp bovis AF2122/97
ggcugcaccggcuugggcc

SEQ ID NO: 1190810 - RNA, 14 nt, Mycobacterium bovis subsp bovis AF2122/97
ggcugauuggccca

SEQ ID NO: 1190811 - RNA, 19 nt, Mycobacterium bovis subsp bovis AF2122/97
ggcugauuggcccaccgcc

SEQ ID NO: 1190812 - RNA, 21 nt, Mycobacterium bovis subsp bovis AF2122/97
ggcugcgucgucugcagaccu

SEQ ID NO: 1190813 - RNA, 14 nt, Mycobacterium bovis subsp bovis AF2122/97
ggcugcuguuggua

SEQ ID NO: 1190814 - RNA, 19 nt, Mycobacterium bovis subsp bovis AF2122/97
ggcugcgccgaacaccaca

SEQ ID NO: 1190815 - RNA, 22 nt, Mycobacterium bovis subsp bovis AF2122/97
ggcugcgcgcucggccagcauc

SEQ ID NO: 1190816 - RNA, 14 nt, Mycobacterium bovis subsp bovis AF2122/97
ggcugcgcgcucgg

SEQ ID NO: 1190817 - RNA, 20 nt, Mycobacterium bovis subsp bovis AF2122/97
ggcugcgcgcucggccagca

SEQ ID NO: 1190818 - RNA, 19 nt, Mycobacterium bovis subsp bovis AF2122/97
ggcugccgguucaccaugu

SEQ ID NO: 1190819 - RNA, 22 nt, Mycobacterium bovis subsp bovis AF2122/97
ggcugcccguucugcccaggca

SEQ ID NO: 1190820 - RNA, 12 nt, Mycobacterium bovis subsp bovis AF2122/97
ggcugcccgcgg

SEQ ID NO: 1190821 - RNA, 19 nt, Mycobacterium bovis subsp bovis AF2122/97
ggcugccgcaaacgcggcg

SEQ ID NO: 1190822 - RNA, 16 nt, Mycobacterium bovis subsp bovis AF2122/97
ggcugccgcccaugcc

SEQ ID NO: 1190823 - RNA, 14 nt, Mycobacterium bovis subsp bovis AF2122/97
ggcugccccuccgg

SEQ ID NO: 1190824 - RNA, 16 nt, Mycobacterium bovis subsp bovis AF2122/97
ggcugcccgagaucgc

SEQ ID NO: 1190825 - RNA, 21 nt, Mycobacterium bovis subsp bovis AF2122/97
ggcugccagugccgcccacca

SEQ ID NO: 1190826 - RNA, 13 nt, Mycobacterium bovis subsp bovis AF2122/97
ggcugccagaaug

SEQ ID NO: 1190827 - RNA, 16 nt, Mycobacterium bovis subsp bovis AF2122/97
ggcugcauccuccucg

SEQ ID NO: 1190828 - RNA, 22 nt, Mycobacterium bovis subsp bovis AF2122/97
ggcuggcggcguggcgccggcc

SEQ ID NO: 1190829 - RNA, 12 nt, Mycobacterium bovis subsp bovis AF2122/97
ggcuggcggccu

SEQ ID NO: 1190830 - RNA, 13 nt, Mycobacterium bovis subsp bovis AF2122/97
ggcuggcggccua

SEQ ID NO: 1190831 - RNA, 14 nt, Mycobacterium bovis subsp bovis AF2122/97
ggcuggcugugccg

SEQ ID NO: 1190832 - RNA, 14 nt, Mycobacterium bovis subsp bovis AF2122/97
ggcugggcgccacc

SEQ ID NO: 1190833 - RNA, 14 nt, Mycobacterium bovis subsp bovis AF2122/97
ggcugggauagcgc

SEQ ID NO: 1190834 - RNA, 22 nt, Mycobacterium bovis subsp bovis AF2122/97
ggcuggccgccuccgcggcauu

SEQ ID NO: 1190835 - RNA, 15 nt, Mycobacterium bovis subsp bovis AF2122/97
ggcuggccgcgccuc

SEQ ID NO: 1190836 - RNA, 22 nt, Mycobacterium bovis subsp bovis AF2122/97
ggcuggcccaccuccucgccgg

SEQ ID NO: 1190837 - RNA, 17 nt, Mycobacterium bovis subsp bovis AF2122/97
ggcuggccgcgccucgg

SEQ ID NO: 1190838 - RNA, 20 nt, Mycobacterium bovis subsp bovis AF2122/97
ggcuggcaugccggcgugcg

SEQ ID NO: 1190839 - RNA, 12 nt, Mycobacterium bovis subsp bovis AF2122/97
ggcuggccagca

SEQ ID NO: 1190840 - RNA, 16 nt, Mycobacterium bovis subsp bovis AF2122/97
ggcuggcaccucccgg

SEQ ID NO: 1190841 - RNA, 22 nt, Mycobacterium bovis subsp bovis AF2122/97
ggcuggcaucccgggcagucca

SEQ ID NO: 1190842 - RNA, 23 nt, Mycobacterium bovis subsp bovis AF2122/97
ggcuggaccacucgccggcggac

SEQ ID NO: 1190843 - RNA, 14 nt, Mycobacterium bovis subsp bovis AF2122/97
ggcuggacggcgcc

SEQ ID NO: 1190844 - RNA, 19 nt, Mycobacterium bovis subsp bovis AF2122/97
ggcuggaccacucgccggc

SEQ ID NO: 1190845 - RNA, 22 nt, Mycobacterium bovis subsp bovis AF2122/97
ggcuguucgcgccauacuggcg

SEQ ID NO: 1190846 - RNA, 13 nt, Mycobacterium bovis subsp bovis AF2122/97
ggcuguucaccuc

SEQ ID NO: 1190847 - RNA, 15 nt, Mycobacterium bovis subsp bovis AF2122/97
ggcuuaccggcgggc

SEQ ID NO: 1190848 - RNA, 13 nt, Mycobacterium bovis subsp bovis AF2122/97
ggcuuccuccucg

SEQ ID NO: 1190849 - RNA, 16 nt, Mycobacterium bovis subsp bovis AF2122/97
ggcuuaaggcccuggc

SEQ ID NO: 1190850 - RNA, 19 nt, Mycobacterium bovis subsp bovis AF2122/97
ggcuuccagggcgacggcc

SEQ ID NO: 1190851 - RNA, 19 nt, Mycobacterium bovis subsp bovis AF2122/97
ggcuuccagcucgggggcg

SEQ ID NO: 1190852 - RNA, 15 nt, Mycobacterium bovis subsp bovis AF2122/97
ggcugguccgggugc

SEQ ID NO: 1190853 - RNA, 13 nt, Mycobacterium bovis subsp bovis AF2122/97
ggcuggucgccgu

SEQ ID NO: 1190854 - RNA, 13 nt, Mycobacterium bovis subsp bovis AF2122/97
ggcugggaaagca

SEQ ID NO: 1190855 - RNA, 19 nt, Mycobacterium bovis subsp bovis AF2122/97
ggcuggggccccgcgccgg

SEQ ID NO: 1190856 - RNA, 13 nt, Mycobacterium bovis subsp bovis AF2122/97
ggcuggugcaggu

SEQ ID NO: 1190857 - RNA, 13 nt, Mycobacterium bovis subsp bovis AF2122/97
ggcuggugccaac

SEQ ID NO: 1190858 - RNA, 18 nt, Mycobacterium bovis subsp bovis AF2122/97
ggcuggugggacgcggcc

SEQ ID NO: 1190859 - RNA, 19 nt, Mycobacterium bovis subsp bovis AF2122/97
ggcuggugggggagcggcc

SEQ ID NO: 1190860 - RNA, 20 nt, Mycobacterium bovis subsp bovis AF2122/97
ggcugguguccagccaggcg

SEQ ID NO: 1190861 - RNA, 21 nt, Mycobacterium bovis subsp bovis AF2122/97
ggcuguacucgcggcgcggcc

SEQ ID NO: 1190862 - RNA, 22 nt, Mycobacterium bovis subsp bovis AF2122/97
ggcuguaaaaaugcuucgccaa

SEQ ID NO: 1190863 - RNA, 23 nt, Mycobacterium bovis subsp bovis AF2122/97
ggcuuggguugauuggccccggc

SEQ ID NO: 1190864 - RNA, 13 nt, Mycobacterium bovis subsp bovis AF2122/97
ggcuuggugccca

SEQ ID NO: 1190865 - RNA, 15 nt, Mycobacterium bovis subsp bovis AF2122/97
ggcuugggccaggcc

SEQ ID NO: 1190866 - RNA, 16 nt, Mycobacterium bovis subsp bovis AF2122/97
ggcuugggccagcgca

SEQ ID NO: 1190867 - RNA, 15 nt, Mycobacterium bovis subsp bovis AF2122/97
ggcuuggcgucggcc

SEQ ID NO: 1190868 - RNA, 22 nt, Mycobacterium bovis subsp bovis AF2122/97
ggcuuggccgggaguguguccg

SEQ ID NO: 1190869 - RNA, 20 nt, Mycobacterium bovis subsp bovis AF2122/97
ggcuuggccguaggcggcga

SEQ ID NO: 1190870 - RNA, 23 nt, Mycobacterium bovis subsp bovis AF2122/97
ggcuucgcuggcuugggccagcg

SEQ ID NO: 1190871 - RNA, 15 nt, Mycobacterium bovis subsp bovis AF2122/97
ggcuucgacggcggc

SEQ ID NO: 1190872 - RNA, 19 nt, Mycobacterium bovis subsp bovis AF2122/97
ggcuucgacgucggcgacc

SEQ ID NO: 1190873 - RNA, 14 nt, Mycobacterium bovis subsp bovis AF2122/97
ggcuugucgccggc

SEQ ID NO: 1190874 - RNA, 18 nt, Mycobacterium bovis subsp bovis AF2122/97
gggcgugacgggcaggag

SEQ ID NO: 1190875 - RNA, 14 nt, Mycobacterium bovis subsp bovis AF2122/97
gggcgucgucggug

SEQ ID NO: 1190876 - RNA, 14 nt, Mycobacterium bovis subsp bovis AF2122/97
gggcgucugcagcg

SEQ ID NO: 1190877 - RNA, 18 nt, Mycobacterium bovis subsp bovis AF2122/97
gggcgucugcagcgggcg

SEQ ID NO: 1190878 - RNA, 23 nt, Mycobacterium bovis subsp bovis AF2122/97
gggcguccuucuuguuggucccg

SEQ ID NO: 1190879 - RNA, 16 nt, Mycobacterium bovis subsp bovis AF2122/97
gggcgucgaagaccgc

SEQ ID NO: 1190880 - RNA, 14 nt, Mycobacterium bovis subsp bovis AF2122/97
gggcgucgccgccg

SEQ ID NO: 1190881 - RNA, 18 nt, Mycobacterium bovis subsp bovis AF2122/97
gggcgucgccgccgggca

SEQ ID NO: 1190882 - RNA, 23 nt, Mycobacterium bovis subsp bovis AF2122/97
gggcgugguaaccagggcagccg

SEQ ID NO: 1190883 - RNA, 12 nt, Mycobacterium bovis subsp bovis AF2122/97
gggcgugcucgc

SEQ ID NO: 1190884 - RNA, 13 nt, Mycobacterium bovis subsp bovis AF2122/97
gggcgugcugccg

SEQ ID NO: 1190885 - RNA, 17 nt, Mycobacterium bovis subsp bovis AF2122/97
gggcguggugagcagug

SEQ ID NO: 1190886 - RNA, 20 nt, Mycobacterium bovis subsp bovis AF2122/97
gggcguguaaccccaggcgc

SEQ ID NO: 1190887 - RNA, 16 nt, Mycobacterium bovis subsp bovis AF2122/97
gggcguuggcgggcug

SEQ ID NO: 1190888 - RNA, 13 nt, Mycobacterium bovis subsp bovis AF2122/97
gggcgugugcagu

SEQ ID NO: 1190889 - RNA, 23 nt, Mycobacterium bovis subsp bovis AF2122/97
gggcgcgugggcgugcaggcugg

SEQ ID NO: 1190890 - RNA, 22 nt, Mycobacterium bovis subsp bovis AF2122/97
gggcgcugaugcgcugggccag

SEQ ID NO: 1190891 - RNA, 23 nt, Mycobacterium bovis subsp bovis AF2122/97
gggcgcucgcgcgcugggcgcgc

SEQ ID NO: 1190892 - RNA, 12 nt, Mycobacterium bovis subsp bovis AF2122/97
gggcgcggggcg

SEQ ID NO: 1190893 - RNA, 16 nt, Mycobacterium bovis subsp bovis AF2122/97
gggcgcggggcggccu

SEQ ID NO: 1190894 - RNA, 22 nt, Mycobacterium bovis subsp bovis AF2122/97
gggcgcguagcucagcgguaga

SEQ ID NO: 1190895 - RNA, 20 nt, Mycobacterium bovis subsp bovis AF2122/97
gggcgcgggugaccaggcgg

SEQ ID NO: 1190896 - RNA, 18 nt, Mycobacterium bovis subsp bovis AF2122/97
gggcggucgcguugcaga

SEQ ID NO: 1190897 - RNA, 16 nt, Mycobacterium bovis subsp bovis AF2122/97
gggcggucggccggcu

SEQ ID NO: 1190898 - RNA, 15 nt, Mycobacterium bovis subsp bovis AF2122/97
gggcguccgccggcg

SEQ ID NO: 1190899 - RNA, 17 nt, Mycobacterium bovis subsp bovis AF2122/97
gggcguccacgcugacc

SEQ ID NO: 1190900 - RNA, 14 nt, Mycobacterium bovis subsp bovis AF2122/97
gggcugcggccgcg

SEQ ID NO: 1190901 - RNA, 19 nt, Mycobacterium bovis subsp bovis AF2122/97
gggcugcugcucggccugg

SEQ ID NO: 1190902 - RNA, 21 nt, Mycobacterium bovis subsp bovis AF2122/97
gggcugccaaggccuucagcg

SEQ ID NO: 1190903 - RNA, 13 nt, Mycobacterium bovis subsp bovis AF2122/97
gggcuuggcugug

SEQ ID NO: 1190904 - RNA, 16 nt, Mycobacterium bovis subsp bovis AF2122/97
gggcuugucgccggca

SEQ ID NO: 1190905 - RNA, 17 nt, Mycobacterium bovis subsp bovis AF2122/97
gggcuugccgcgcacca

SEQ ID NO: 1190906 - RNA, 22 nt, Mycobacterium bovis subsp bovis AF2122/97
gggcuggguaugcacccaggca

SEQ ID NO: 1190907 - RNA, 13 nt, Mycobacterium bovis subsp bovis AF2122/97
ggggaagccugcg

SEQ ID NO: 1190908 - RNA, 17 nt, Mycobacterium bovis subsp bovis AF2122/97
ggggaagccugcgggcc

SEQ ID NO: 1190909 - RNA, 19 nt, Mycobacterium bovis subsp bovis AF2122/97
ggggaaguuggcugagcag

SEQ ID NO: 1190910 - RNA, 24 nt, Mycobacterium bovis subsp bovis AF2122/97
ggggaaguuggcugagcagcgcgg

SEQ ID NO: 1190911 - RNA, 14 nt, Mycobacterium bovis subsp bovis AF2122/97
ggggaaagccgcag

SEQ ID NO: 1190912 - RNA, 18 nt, Mycobacterium bovis subsp bovis AF2122/97
ggggaaagccgcagccgc

SEQ ID NO: 1190913 - RNA, 16 nt, Mycobacterium bovis subsp bovis AF2122/97
ggggaacagcagcgca

SEQ ID NO: 1190914 - RNA, 19 nt, Mycobacterium bovis subsp bovis AF2122/97
ggggaagaucucggccagg

SEQ ID NO: 1190915 - RNA, 22 nt, Mycobacterium bovis subsp bovis AF2122/97
gggcuuuugcgucugcucgcca

SEQ ID NO: 1190916 - RNA, 20 nt, Mycobacterium bovis subsp bovis AF2122/97
ggggaaaccggccagccgac

SEQ ID NO: 1190917 - RNA, 20 nt, Mycobacterium bovis subsp bovis AF2122/97
gggcuuuagugucugcucgc

SEQ ID NO: 1190918 - RNA, 18 nt, Mycobacterium bovis subsp bovis AF2122/97
gggcgcgcaucugcucgg

SEQ ID NO: 1190919 - RNA, 17 nt, Mycobacterium bovis subsp bovis AF2122/97
gggcgccuuccaggcgg

SEQ ID NO: 1190920 - RNA, 13 nt, Mycobacterium bovis subsp bovis AF2122/97
gggcgcggaucug

SEQ ID NO: 1190921 - RNA, 18 nt, Mycobacterium bovis subsp bovis AF2122/97
gggcgcggaucugcagca

SEQ ID NO: 1190922 - RNA, 16 nt, Mycobacterium bovis subsp bovis AF2122/97
gggcgcagagucaacg

SEQ ID NO: 1190923 - RNA, 18 nt, Mycobacterium bovis subsp bovis AF2122/97
gggcgccaucccgccgcc

SEQ ID NO: 1190924 - RNA, 13 nt, Mycobacterium bovis subsp bovis AF2122/97
gggcgcagguugg

SEQ ID NO: 1190925 - RNA, 16 nt, Mycobacterium bovis subsp bovis AF2122/97
gggcgcaagcagcccg

SEQ ID NO: 1190926 - RNA, 17 nt, Mycobacterium bovis subsp bovis AF2122/97
gggcgauggucgggaug

SEQ ID NO: 1190927 - RNA, 22 nt, Mycobacterium bovis subsp bovis AF2122/97
gggcgauuuugcgucugcucgc

SEQ ID NO: 1190928 - RNA, 17 nt, Mycobacterium bovis subsp bovis AF2122/97
gggcgagucccggcggu

SEQ ID NO: 1190929 - RNA, 20 nt, Mycobacterium bovis subsp bovis AF2122/97
gggcgagucgggggccgcgu

SEQ ID NO: 1190930 - RNA, 16 nt, Mycobacterium bovis subsp bovis AF2122/97
gggcgaguacaggcgc

SEQ ID NO: 1190931 - RNA, 21 nt, Mycobacterium bovis subsp bovis AF2122/97
gggcgaucgcggcgagcacca

SEQ ID NO: 1190932 - RNA, 15 nt, Mycobacterium bovis subsp bovis AF2122/97
gggcgaugcugggcg

SEQ ID NO: 1190933 - RNA, 20 nt, Mycobacterium bovis subsp bovis AF2122/97
gggccggaugacgcccaggg

SEQ ID NO: 1190934 - RNA, 16 nt, Mycobacterium bovis subsp bovis AF2122/97
gggccggcaccgcagc

SEQ ID NO: 1190935 - RNA, 14 nt, Mycobacterium bovis subsp bovis AF2122/97
gggccggccgagcg

SEQ ID NO: 1190936 - RNA, 23 nt, Mycobacterium bovis subsp bovis AF2122/97
gggccggaugucgacgagcaccg

SEQ ID NO: 1190937 - RNA, 16 nt, Mycobacterium bovis subsp bovis AF2122/97
gggccggccgagcgca

SEQ ID NO: 1190938 - RNA, 17 nt, Mycobacterium bovis subsp bovis AF2122/97
gggccuggaagacggug

SEQ ID NO: 1190939 - RNA, 16 nt, Mycobacterium bovis subsp bovis AF2122/97
gggccuggccacacuc

SEQ ID NO: 1190940 - RNA, 16 nt, Mycobacterium bovis subsp bovis AF2122/97
gggccuggcccacgcc

SEQ ID NO: 1190941 - RNA, 20 nt, Mycobacterium bovis subsp bovis AF2122/97
gggccuggccugcccagcac

SEQ ID NO: 1190942 - RNA, 14 nt, Mycobacterium bovis subsp bovis AF2122/97
gggcgagaccgcga

SEQ ID NO: 1190943 - RNA, 15 nt, Mycobacterium bovis subsp bovis AF2122/97
gggcgagcgcggccu

SEQ ID NO: 1190944 - RNA, 20 nt, Mycobacterium bovis subsp bovis AF2122/97
gggcgagccaguaccaggua

SEQ ID NO: 1190945 - RNA, 12 nt, Mycobacterium bovis subsp bovis AF2122/97
gggcgaccuggu

SEQ ID NO: 1190946 - RNA, 20 nt, Mycobacterium bovis subsp bovis AF2122/97
gggcgaccugguggacucgg

SEQ ID NO: 1190947 - RNA, 15 nt, Mycobacterium bovis subsp bovis AF2122/97
gggcgacagcggcga

SEQ ID NO: 1190948 - RNA, 16 nt, Mycobacterium bovis subsp bovis AF2122/97
gggcgaauccggcggg

SEQ ID NO: 1190949 - RNA, 17 nt, Mycobacterium bovis subsp bovis AF2122/97
gggcgaauccggcgggu

SEQ ID NO: 1190950 - RNA, 15 nt, Mycobacterium bovis subsp bovis AF2122/97
gggcgaacggcaccg

SEQ ID NO: 1190951 - RNA, 14 nt, Mycobacterium bovis subsp bovis AF2122/97
gggcacaaggguca

SEQ ID NO: 1190952 - RNA, 19 nt, Mycobacterium bovis subsp bovis AF2122/97
gggcacaccgacgccgcca

SEQ ID NO: 1190953 - RNA, 15 nt, Mycobacterium bovis subsp bovis AF2122/97
gggaugugcggcugc

SEQ ID NO: 1190954 - RNA, 18 nt, Mycobacterium bovis subsp bovis AF2122/97
gggaucugggucuguggu

SEQ ID NO: 1190955 - RNA, 20 nt, Mycobacterium bovis subsp bovis AF2122/97
gggcacaccgguggcgcccu

SEQ ID NO: 1190956 - RNA, 17 nt, Mycobacterium bovis subsp bovis AF2122/97
gggcacaucgggcgugg

SEQ ID NO: 1190957 - RNA, 22 nt, Mycobacterium bovis subsp bovis AF2122/97
gggcaccacgcugugcucgacg

SEQ ID NO: 1190958 - RNA, 22 nt, Mycobacterium bovis subsp bovis AF2122/97
gggcaccagcgaauccagccgc

SEQ ID NO: 1190959 - RNA, 14 nt, Mycobacterium bovis subsp bovis AF2122/97
gggcaccagucgcc

SEQ ID NO: 1190960 - RNA, 17 nt, Mycobacterium bovis subsp bovis AF2122/97
gggcaccagucgcccca

SEQ ID NO: 1190961 - RNA, 22 nt, Mycobacterium bovis subsp bovis AF2122/97
gggcaccgguuugacguccagg

SEQ ID NO: 1190962 - RNA, 16 nt, Mycobacterium bovis subsp bovis AF2122/97
gggcaccgagcugagc

SEQ ID NO: 1190963 - RNA, 20 nt, Mycobacterium bovis subsp bovis AF2122/97
gggaugcaugucuuguggug

SEQ ID NO: 1190964 - RNA, 20 nt, Mycobacterium bovis subsp bovis AF2122/97
gggaugaagaacgcgagcgc

SEQ ID NO: 1190965 - RNA, 21 nt, Mycobacterium bovis subsp bovis AF2122/97
gggauaggccguggucgaggg

SEQ ID NO: 1190966 - RNA, 19 nt, Mycobacterium bovis subsp bovis AF2122/97
gggaguugaucuccacggc

SEQ ID NO: 1190967 - RNA, 20 nt, Mycobacterium bovis subsp bovis AF2122/97
gggaguugcuugcagggcca

SEQ ID NO: 1190968 - RNA, 19 nt, Mycobacterium bovis subsp bovis AF2122/97
gggaaccgacaucccaacc

SEQ ID NO: 1190969 - RNA, 22 nt, Mycobacterium bovis subsp bovis AF2122/97
gggaacguccagccguggcggc

SEQ ID NO: 1190970 - RNA, 12 nt, Mycobacterium bovis subsp bovis AF2122/97
gggaaccaccag

SEQ ID NO: 1190971 - RNA, 15 nt, Mycobacterium bovis subsp bovis AF2122/97
gggaaacccggccag

SEQ ID NO: 1190972 - RNA, 21 nt, Mycobacterium bovis subsp bovis AF2122/97
gggaaaguuguaucgcagcau

SEQ ID NO: 1190973 - RNA, 22 nt, Mycobacterium bovis subsp bovis AF2122/97
gggaggcggcgccgcacccaca

SEQ ID NO: 1190974 - RNA, 22 nt, Mycobacterium bovis subsp bovis AF2122/97
gggagguacccccagcacccgg

SEQ ID NO: 1190975 - RNA, 22 nt, Mycobacterium bovis subsp bovis AF2122/97
gggaguucggggugcgcccagg

SEQ ID NO: 1190976 - RNA, 23 nt, Mycobacterium bovis subsp bovis AF2122/97
gggaguguguccgaaggcuuguc

SEQ ID NO: 1190977 - RNA, 20 nt, Mycobacterium bovis subsp bovis AF2122/97
gggaguccggccgacccgga

SEQ ID NO: 1190978 - RNA, 23 nt, Mycobacterium bovis subsp bovis AF2122/97
gggagucgucguguuggccgggu

SEQ ID NO: 1190979 - RNA, 21 nt, Mycobacterium bovis subsp bovis AF2122/97
gggagugcgccggcuggcggc

SEQ ID NO: 1190980 - RNA, 13 nt, Mycobacterium bovis subsp bovis AF2122/97
gggagcgaacggc

SEQ ID NO: 1190981 - RNA, 20 nt, Mycobacterium bovis subsp bovis AF2122/97
gggaggcgcggucgaccuga

SEQ ID NO: 1190982 - RNA, 15 nt, Mycobacterium bovis subsp bovis AF2122/97
gggagcggcugcacg

SEQ ID NO: 1190983 - RNA, 14 nt, Mycobacterium bovis subsp bovis AF2122/97
gggagcggcugcgg

SEQ ID NO: 1190984 - RNA, 14 nt, Mycobacterium bovis subsp bovis AF2122/97
gggagcggcguguc

SEQ ID NO: 1190985 - RNA, 12 nt, Mycobacterium bovis subsp bovis AF2122/97
gggagcggcugc

SEQ ID NO: 1190986 - RNA, 18 nt, Mycobacterium bovis subsp bovis AF2122/97
gggccaccacgcgccgca

SEQ ID NO: 1190987 - RNA, 19 nt, Mycobacterium bovis subsp bovis AF2122/97
gggccaccaccacggccag

SEQ ID NO: 1190988 - RNA, 16 nt, Mycobacterium bovis subsp bovis AF2122/97
gggccaccgccgccug

SEQ ID NO: 1190989 - RNA, 21 nt, Mycobacterium bovis subsp bovis AF2122/97
gggccaccgcugucagccgac

SEQ ID NO: 1190990 - RNA, 23 nt, Mycobacterium bovis subsp bovis AF2122/97
gggccacugagccacagggaagc

SEQ ID NO: 1190991 - RNA, 15 nt, Mycobacterium bovis subsp bovis AF2122/97
gggccacguagcagc

SEQ ID NO: 1190992 - RNA, 21 nt, Mycobacterium bovis subsp bovis AF2122/97
gggccacguccugcccgucgu

SEQ ID NO: 1190993 - RNA, 13 nt, Mycobacterium bovis subsp bovis AF2122/97
gggccaacucauu

SEQ ID NO: 1190994 - RNA, 16 nt, Mycobacterium bovis subsp bovis AF2122/97
gggccaccaccacggc

SEQ ID NO: 1190995 - RNA, 17 nt, Mycobacterium bovis subsp bovis AF2122/97
gggccaccaccacggcc

SEQ ID NO: 1190996 - RNA, 18 nt, Mycobacterium bovis subsp bovis AF2122/97
gggcauucccgcucgcag

SEQ ID NO: 1190997 - RNA, 16 nt, Mycobacterium bovis subsp bovis AF2122/97
gggcccgcgcggcggu

SEQ ID NO: 1190998 - RNA, 13 nt, Mycobacterium bovis subsp bovis AF2122/97
gggccgcgcggcg

SEQ ID NO: 1190999 - RNA, 20 nt, Mycobacterium bovis subsp bovis AF2122/97
gggcccuccacugcgagcgc

SEQ ID NO: 1191000 - RNA, 20 nt, Mycobacterium bovis subsp bovis AF2122/97
gggcccucuaugcgggcagc

SEQ ID NO: 1191001 - RNA, 22 nt, Mycobacterium bovis subsp bovis AF2122/97
gggccagauuucugggagccgg

SEQ ID NO: 1191002 - RNA, 14 nt, Mycobacterium bovis subsp bovis AF2122/97
gggccacggcugcg

SEQ ID NO: 1191003 - RNA, 22 nt, Mycobacterium bovis subsp bovis AF2122/97
gggcccgccgucuuggcccggu

SEQ ID NO: 1191004 - RNA, 16 nt, Mycobacterium bovis subsp bovis AF2122/97
gggccccgccgaugcg

SEQ ID NO: 1191005 - RNA, 13 nt, Mycobacterium bovis subsp bovis AF2122/97
gggcccgaugagg

SEQ ID NO: 1191006 - RNA, 21 nt, Mycobacterium bovis subsp bovis AF2122/97
gggcccgaccuguccacccag

SEQ ID NO: 1191007 - RNA, 19 nt, Mycobacterium bovis subsp bovis AF2122/97
gggcaccuuggccaggaag

SEQ ID NO: 1191008 - RNA, 22 nt, Mycobacterium bovis subsp bovis AF2122/97
gggcaccuuggccggccccgcc

SEQ ID NO: 1191009 - RNA, 12 nt, Mycobacterium bovis subsp bovis AF2122/97
gggcagcugggc

SEQ ID NO: 1191010 - RNA, 16 nt, Mycobacterium bovis subsp bovis AF2122/97
gggcagcugggcagga

SEQ ID NO: 1191011 - RNA, 14 nt, Mycobacterium bovis subsp bovis AF2122/97
gggcaggcggccag

SEQ ID NO: 1191012 - RNA, 13 nt, Mycobacterium bovis subsp bovis AF2122/97
gggcaggccccac

SEQ ID NO: 1191013 - RNA, 15 nt, Mycobacterium bovis subsp bovis AF2122/97
gggcaugauguugaa

SEQ ID NO: 1191014 - RNA, 14 nt, Mycobacterium bovis subsp bovis AF2122/97
gggcaucgucgccg

SEQ ID NO: 1191015 - RNA, 18 nt, Mycobacterium bovis subsp bovis AF2122/97
gggcaucgucgccgagcg

SEQ ID NO: 1191016 - RNA, 23 nt, Mycobacterium bovis subsp bovis AF2122/97
gggcaucgcgaauauagcggcgu

SEQ ID NO: 1191017 - RNA, 13 nt, Mycobacterium bovis subsp bovis AF2122/97
gggcauggcggcg

SEQ ID NO: 1191018 - RNA, 14 nt, Mycobacterium bovis subsp bovis AF2122/97
gggcauggcggcgu

SEQ ID NO: 1191019 - RNA, 14 nt, Mycobacterium bovis subsp bovis AF2122/97
gggcauggucgccg

SEQ ID NO: 1191020 - RNA, 14 nt, Mycobacterium bovis subsp bovis AF2122/97
gggcauccuucacc

SEQ ID NO: 1191021 - RNA, 20 nt, Mycobacterium bovis subsp bovis AF2122/97
gggcaucagcagagccccgg

SEQ ID NO: 1191022 - RNA, 19 nt, Mycobacterium bovis subsp bovis AF2122/97
gggcaucagcagagccccg

SEQ ID NO: 1191023 - RNA, 22 nt, Mycobacterium bovis subsp bovis AF2122/97
gggcaguuguugacagacacag

SEQ ID NO: 1191024 - RNA, 19 nt, Mycobacterium bovis subsp bovis AF2122/97
gggcaguuuggcggcaggu

SEQ ID NO: 1191025 - RNA, 21 nt, Mycobacterium bovis subsp bovis AF2122/97
gggcagucaggccuagcgcgg

SEQ ID NO: 1191026 - RNA, 15 nt, Mycobacterium bovis subsp bovis AF2122/97
gggucuugccgagca

SEQ ID NO: 1191027 - RNA, 21 nt, Mycobacterium bovis subsp bovis AF2122/97
gggugaacaacucauagacca

SEQ ID NO: 1191028 - RNA, 22 nt, Mycobacterium bovis subsp bovis AF2122/97
gggugaagagaagucucgcggc

SEQ ID NO: 1191029 - RNA, 15 nt, Mycobacterium bovis subsp bovis AF2122/97
gggugacgggaaacu

SEQ ID NO: 1191030 - RNA, 15 nt, Mycobacterium bovis subsp bovis AF2122/97
gggugcgcugcagcg

SEQ ID NO: 1191031 - RNA, 21 nt, Mycobacterium bovis subsp bovis AF2122/97
gggugcgccgucagcccaggu

SEQ ID NO: 1191032 - RNA, 18 nt, Mycobacterium bovis subsp bovis AF2122/97
gggugcgcgaggucggcg

SEQ ID NO: 1191033 - RNA, 15 nt, Mycobacterium bovis subsp bovis AF2122/97
gggugcgccgcagca

SEQ ID NO: 1191034 - RNA, 15 nt, Mycobacterium bovis subsp bovis AF2122/97
gggucgggcaccgcg

SEQ ID NO: 1191035 - RNA, 22 nt, Mycobacterium bovis subsp bovis AF2122/97
gggucgggcaaccugccgggcc

SEQ ID NO: 1191036 - RNA, 20 nt, Mycobacterium bovis subsp bovis AF2122/97
ggguccguuuuaccucggcc

SEQ ID NO: 1191037 - RNA, 18 nt, Mycobacterium bovis subsp bovis AF2122/97
gggucgucauugcccuug

SEQ ID NO: 1191038 - RNA, 19 nt, Mycobacterium bovis subsp bovis AF2122/97
gggucgggucccagccugg

SEQ ID NO: 1191039 - RNA, 19 nt, Mycobacterium bovis subsp bovis AF2122/97
gggucguccgccugcaccg

SEQ ID NO: 1191040 - RNA, 14 nt, Mycobacterium bovis subsp bovis AF2122/97
gggucgggucccag

SEQ ID NO: 1191041 - RNA, 14 nt, Mycobacterium bovis subsp bovis AF2122/97
gggucgugccagca

SEQ ID NO: 1191042 - RNA, 16 nt, Mycobacterium bovis subsp bovis AF2122/97
gggucguuggcggcgg

SEQ ID NO: 1191043 - RNA, 21 nt, Mycobacterium bovis subsp bovis AF2122/97
gggucugcgccgccggcggcg

SEQ ID NO: 1191044 - RNA, 16 nt, Mycobacterium bovis subsp bovis AF2122/97
ggguccgccgggcccc

SEQ ID NO: 1191045 - RNA, 23 nt, Mycobacterium bovis subsp bovis AF2122/97
ggguccgacgguguagccgccgg

SEQ ID NO: 1191046 - RNA, 13 nt, Mycobacterium bovis subsp bovis AF2122/97
gggucccggccgg

SEQ ID NO: 1191047 - RNA, 22 nt, Mycobacterium bovis subsp bovis AF2122/97
gggucccggccgggucuuccgg

SEQ ID NO: 1191048 - RNA, 23 nt, Mycobacterium bovis subsp bovis AF2122/97
ggguccgaaguacuggccgccgc

SEQ ID NO: 1191049 - RNA, 16 nt, Mycobacterium bovis subsp bovis AF2122/97
ggguccaucggggccg

SEQ ID NO: 1191050 - RNA, 22 nt, Mycobacterium bovis subsp bovis AF2122/97
gggucccaaucgucggccagca

SEQ ID NO: 1191051 - RNA, 20 nt, Mycobacterium bovis subsp bovis AF2122/97
ggguccccguaaauaucggg

SEQ ID NO: 1191052 - RNA, 19 nt, Mycobacterium bovis subsp bovis AF2122/97
ggguccagcccggaacccg

SEQ ID NO: 1191053 - RNA, 14 nt, Mycobacterium bovis subsp bovis AF2122/97
gggucaucagccgc

SEQ ID NO: 1191054 - RNA, 17 nt, Mycobacterium bovis subsp bovis AF2122/97
gggucaguaggcggauc

SEQ ID NO: 1191055 - RNA, 21 nt, Mycobacterium bovis subsp bovis AF2122/97
ggguagcugccgcggccggcg

SEQ ID NO: 1191056 - RNA, 15 nt, Mycobacterium bovis subsp bovis AF2122/97
ggggagccggugacg

SEQ ID NO: 1191057 - RNA, 16 nt, Mycobacterium bovis subsp bovis AF2122/97
ggggacggcggcaagg

SEQ ID NO: 1191058 - RNA, 16 nt, Mycobacterium bovis subsp bovis AF2122/97
ggggacggcggcgagg

SEQ ID NO: 1191059 - RNA, 17 nt, Mycobacterium bovis subsp bovis AF2122/97
ggggacgggcggccagg

SEQ ID NO: 1191060 - RNA, 21 nt, Mycobacterium bovis subsp bovis AF2122/97
ggggacucugccacccagcac

SEQ ID NO: 1191061 - RNA, 13 nt, Mycobacterium bovis subsp bovis AF2122/97
ggggacagcccgg

SEQ ID NO: 1191062 - RNA, 16 nt, Mycobacterium bovis subsp bovis AF2122/97
ggggaccacgccgacg

SEQ ID NO: 1191063 - RNA, 16 nt, Mycobacterium bovis subsp bovis AF2122/97
ggggaccccgccagcc

SEQ ID NO: 1191064 - RNA, 22 nt, Mycobacterium bovis subsp bovis AF2122/97
ggggacccgcuccaagcgcggu

SEQ ID NO: 1191065 - RNA, 14 nt, Mycobacterium bovis subsp bovis AF2122/97
ggguagccaaccug

SEQ ID NO: 1191066 - RNA, 24 nt, Mycobacterium bovis subsp bovis AF2122/97
ggguacgucaccggguccggugaa

SEQ ID NO: 1191067 - RNA, 15 nt, Mycobacterium bovis subsp bovis AF2122/97
ggguagccgcccagc

SEQ ID NO: 1191068 - RNA, 16 nt, Mycobacterium bovis subsp bovis AF2122/97
ggguagccgcccagcg

SEQ ID NO: 1191069 - RNA, 13 nt, Mycobacterium bovis subsp bovis AF2122/97
ggguaggccgccg

SEQ ID NO: 1191070 - RNA, 13 nt, Mycobacterium bovis subsp bovis AF2122/97
ggguaggcuccca

SEQ ID NO: 1191071 - RNA, 23 nt, Mycobacterium bovis subsp bovis AF2122/97
ggguagggcaucgucgccgagcg

SEQ ID NO: 1191072 - RNA, 14 nt, Mycobacterium bovis subsp bovis AF2122/97
ggguggaaucaggg

SEQ ID NO: 1191073 - RNA, 20 nt, Mycobacterium bovis subsp bovis AF2122/97
gggugcugcgcgcggcggcc

SEQ ID NO: 1191074 - RNA, 14 nt, Mycobacterium bovis subsp bovis AF2122/97
gggugcuggcagga

SEQ ID NO: 1191075 - RNA, 16 nt, Mycobacterium bovis subsp bovis AF2122/97
gggugcgucugggcau

SEQ ID NO: 1191076 - RNA, 13 nt, Mycobacterium bovis subsp bovis AF2122/97
ggguggacaccug

SEQ ID NO: 1191077 - RNA, 17 nt, Mycobacterium bovis subsp bovis AF2122/97
ggguggccacgcccagg

SEQ ID NO: 1191078 - RNA, 19 nt, Mycobacterium bovis subsp bovis AF2122/97
ggguggaguuggcugccgg

SEQ ID NO: 1191079 - RNA, 15 nt, Mycobacterium bovis subsp bovis AF2122/97
ggguggaucuucacc

SEQ ID NO: 1191080 - RNA, 16 nt, Mycobacterium bovis subsp bovis AF2122/97
ggguggcgaggcagca

SEQ ID NO: 1191081 - RNA, 22 nt, Mycobacterium bovis subsp bovis AF2122/97
ggguggcgccggugcggcgggc

SEQ ID NO: 1191082 - RNA, 19 nt, Mycobacterium bovis subsp bovis AF2122/97
ggguguuugucgcgguggu

SEQ ID NO: 1191083 - RNA, 18 nt, Mycobacterium bovis subsp bovis AF2122/97
ggguuccacuccccagcc

SEQ ID NO: 1191084 - RNA, 18 nt, Mycobacterium bovis subsp bovis AF2122/97
ggguucacguucggugga

SEQ ID NO: 1191085 - RNA, 20 nt, Mycobacterium bovis subsp bovis AF2122/97
ggguucuucgacgcggcgga

SEQ ID NO: 1191086 - RNA, 19 nt, Mycobacterium bovis subsp bovis AF2122/97
ggguugacguaggcggcgg

SEQ ID NO: 1191087 - RNA, 14 nt, Mycobacterium bovis subsp bovis AF2122/97
ggguugcggucacc

SEQ ID NO: 1191088 - RNA, 14 nt, Mycobacterium bovis subsp bovis AF2122/97
ggguugggcggagc

SEQ ID NO: 1191089 - RNA, 14 nt, Mycobacterium bovis subsp bovis AF2122/97
ggguuggccggcgc

SEQ ID NO: 1191090 - RNA, 23 nt, Mycobacterium bovis subsp bovis AF2122/97
ggguuucgaucuucucgcggacg

SEQ ID NO: 1191091 - RNA, 11 nt, Mycobacterium bovis subsp bovis AF2122/97
gguaacugucc

SEQ ID NO: 1191092 - RNA, 17 nt, Mycobacterium bovis subsp bovis AF2122/97
gguaacgcgacaagguc

SEQ ID NO: 1191093 - RNA, 12 nt, Mycobacterium bovis subsp bovis AF2122/97
ggucaccuucuu

SEQ ID NO: 1191094 - RNA, 20 nt, Mycobacterium bovis subsp bovis AF2122/97
ggucaccgauucggccagcg

SEQ ID NO: 1191095 - RNA, 17 nt, Mycobacterium bovis subsp bovis AF2122/97
ggucacgcagucgggca

SEQ ID NO: 1191096 - RNA, 16 nt, Mycobacterium bovis subsp bovis AF2122/97
ggucacgcagcacccu

SEQ ID NO: 1191097 - RNA, 22 nt, Mycobacterium bovis subsp bovis AF2122/97
ggucacgcagucgggcagcgcu

SEQ ID NO: 1191098 - RNA, 15 nt, Mycobacterium bovis subsp bovis AF2122/97
ggucagccuuuccac

SEQ ID NO: 1191099 - RNA, 12 nt, Mycobacterium bovis subsp bovis AF2122/97
ggucagcgccga

SEQ ID NO: 1191100 - RNA, 21 nt, Mycobacterium bovis subsp bovis AF2122/97
ggucagccccaugaucuggug

SEQ ID NO: 1191101 - RNA, 21 nt, Mycobacterium bovis subsp bovis AF2122/97
ggucacgguucgcccgucgcc

SEQ ID NO: 1191102 - RNA, 17 nt, Mycobacterium bovis subsp bovis AF2122/97
ggucacgguagcguucg

SEQ ID NO: 1191103 - RNA, 20 nt, Mycobacterium bovis subsp bovis AF2122/97
ggucaccauggcgccgcgcc

SEQ ID NO: 1191104 - RNA, 20 nt, Mycobacterium bovis subsp bovis AF2122/97
ggucacccccggccagcguc

SEQ ID NO: 1191105 - RNA, 13 nt, Mycobacterium bovis subsp bovis AF2122/97
gguauggcggcga

SEQ ID NO: 1191106 - RNA, 14 nt, Mycobacterium bovis subsp bovis AF2122/97
gguaggcggccagc

SEQ ID NO: 1191107 - RNA, 16 nt, Mycobacterium bovis subsp bovis AF2122/97
gguaggagcggguggc

SEQ ID NO: 1191108 - RNA, 23 nt, Mycobacterium bovis subsp bovis AF2122/97
gguagcugugguggugaugggca

SEQ ID NO: 1191109 - RNA, 21 nt, Mycobacterium bovis subsp bovis AF2122/97
gguagcguucaaggucuccag

SEQ ID NO: 1191110 - RNA, 14 nt, Mycobacterium bovis subsp bovis AF2122/97
gguagcacggucug

SEQ ID NO: 1191111 - RNA, 17 nt, Mycobacterium bovis subsp bovis AF2122/97
gguagaucagcgccugg

SEQ ID NO: 1191112 - RNA, 23 nt, Mycobacterium bovis subsp bovis AF2122/97
gguagcaccgauuuuggcaagcu

SEQ ID NO: 1191113 - RNA, 16 nt, Mycobacterium bovis subsp bovis AF2122/97
gguagucggccuccuc

SEQ ID NO: 1191114 - RNA, 13 nt, Mycobacterium bovis subsp bovis AF2122/97
gguaguagcugac

SEQ ID NO: 1191115 - RNA, 14 nt, Mycobacterium bovis subsp bovis AF2122/97
gguaguugaggccg

SEQ ID NO: 1191116 - RNA, 17 nt, Mycobacterium bovis subsp bovis AF2122/97
gguaguugucccgccgc

SEQ ID NO: 1191117 - RNA, 21 nt, Mycobacterium bovis subsp bovis AF2122/97
gguaguucuuggucaggcugg

SEQ ID NO: 1191118 - RNA, 23 nt, Mycobacterium bovis subsp bovis AF2122/97
gguacggaccguggcagcugcuc

SEQ ID NO: 1191119 - RNA, 19 nt, Mycobacterium bovis subsp bovis AF2122/97
gguacgccggucggugcgg

SEQ ID NO: 1191120 - RNA, 17 nt, Mycobacterium bovis subsp bovis AF2122/97
gguaccaucaccgcgcc

SEQ ID NO: 1191121 - RNA, 13 nt, Mycobacterium bovis subsp bovis AF2122/97
gguaccccagcgc

SEQ ID NO: 1191122 - RNA, 17 nt, Mycobacterium bovis subsp bovis AF2122/97
gguaccgccgcugccgg

SEQ ID NO: 1191123 - RNA, 15 nt, Mycobacterium bovis subsp bovis AF2122/97
gguaccgcgguguuc

SEQ ID NO: 1191124 - RNA, 23 nt, Mycobacterium bovis subsp bovis AF2122/97
gguaccgggacgaaucccgcgcc

SEQ ID NO: 1191125 - RNA, 13 nt, Mycobacterium bovis subsp bovis AF2122/97
gguaccggcggcg

SEQ ID NO: 1191126 - RNA, 17 nt, Mycobacterium bovis subsp bovis AF2122/97
gguaccggcggcgccgg

SEQ ID NO: 1191127 - RNA, 20 nt, Mycobacterium bovis subsp bovis AF2122/97
gguaccggcggcgccggccu

SEQ ID NO: 1191128 - RNA, 12 nt, Mycobacterium bovis subsp bovis AF2122/97
gguagagguugu

SEQ ID NO: 1191129 - RNA, 15 nt, Mycobacterium bovis subsp bovis AF2122/97
gguagacauggguga

SEQ ID NO: 1191130 - RNA, 13 nt, Mycobacterium bovis subsp bovis AF2122/97
gguacaucccggu

SEQ ID NO: 1191131 - RNA, 21 nt, Mycobacterium bovis subsp bovis AF2122/97
gguacaucgaggccacgccag

SEQ ID NO: 1191132 - RNA, 17 nt, Mycobacterium bovis subsp bovis AF2122/97
gguacacccgcucgccc

SEQ ID NO: 1191133 - RNA, 13 nt, Mycobacterium bovis subsp bovis AF2122/97
gguacacguccag

SEQ ID NO: 1191134 - RNA, 13 nt, Mycobacterium bovis subsp bovis AF2122/97
gguaauccgggca

SEQ ID NO: 1191135 - RNA, 14 nt, Mycobacterium bovis subsp bovis AF2122/97
gguaaugccagcgg

SEQ ID NO: 1191136 - RNA, 18 nt, Mycobacterium bovis subsp bovis AF2122/97
gguaaucaccuggcuggu

SEQ ID NO: 1191137 - RNA, 14 nt, Mycobacterium bovis subsp bovis AF2122/97
gguggucagguugg

SEQ ID NO: 1191138 - RNA, 21 nt, Mycobacterium bovis subsp bovis AF2122/97
gguggucagguuggcacgcug

SEQ ID NO: 1191139 - RNA, 15 nt, Mycobacterium bovis subsp bovis AF2122/97
ggugggccagcagca

SEQ ID NO: 1191140 - RNA, 18 nt, Mycobacterium bovis subsp bovis AF2122/97
ggugguagcugacgcugc

SEQ ID NO: 1191141 - RNA, 14 nt, Mycobacterium bovis subsp bovis AF2122/97
ggugguaggccggg

SEQ ID NO: 1191142 - RNA, 17 nt, Mycobacterium bovis subsp bovis AF2122/97
gguggucucgguaggcg

SEQ ID NO: 1191143 - RNA, 23 nt, Mycobacterium bovis subsp bovis AF2122/97
gguggucugccaaaagggcggca

SEQ ID NO: 1191144 - RNA, 21 nt, Mycobacterium bovis subsp bovis AF2122/97
gguggugacacgacgugcagg

SEQ ID NO: 1191145 - RNA, 14 nt, Mycobacterium bovis subsp bovis AF2122/97
gguggugacgucga

SEQ ID NO: 1191146 - RNA, 14 nt, Mycobacterium bovis subsp bovis AF2122/97
ggugggcagcaggc

SEQ ID NO: 1191147 - RNA, 12 nt, Mycobacterium bovis subsp bovis AF2122/97
ggugggcagcag

SEQ ID NO: 1191148 - RNA, 19 nt, Mycobacterium bovis subsp bovis AF2122/97
ggugggacaggucggggcg

SEQ ID NO: 1191149 - RNA, 13 nt, Mycobacterium bovis subsp bovis AF2122/97
ggugggagcagcc

SEQ ID NO: 1191150 - RNA, 22 nt, Mycobacterium bovis subsp bovis AF2122/97
gguggcuucaacccgggcagca

SEQ ID NO: 1191151 - RNA, 14 nt, Mycobacterium bovis subsp bovis AF2122/97
gguggcgggcuugc

SEQ ID NO: 1191152 - RNA, 23 nt, Mycobacterium bovis subsp bovis AF2122/97
gguggcguccagggcgccgaucg

SEQ ID NO: 1191153 - RNA, 18 nt, Mycobacterium bovis subsp bovis AF2122/97
gguggcguuugaugcggg

SEQ ID NO: 1191154 - RNA, 15 nt, Mycobacterium bovis subsp bovis AF2122/97
gguggcggcggcggc

SEQ ID NO: 1191155 - RNA, 19 nt, Mycobacterium bovis subsp bovis AF2122/97
ggugucgaugcugaacacg

SEQ ID NO: 1191156 - RNA, 16 nt, Mycobacterium bovis subsp bovis AF2122/97
ggugucgacgcgggcg

SEQ ID NO: 1191157 - RNA, 21 nt, Mycobacterium bovis subsp bovis AF2122/97
ggugucucccuugccgccauu

SEQ ID NO: 1191158 - RNA, 22 nt, Mycobacterium bovis subsp bovis AF2122/97
ggugucggcuggucgcugcugc

SEQ ID NO: 1191159 - RNA, 19 nt, Mycobacterium bovis subsp bovis AF2122/97
ggugucgguggccgcggcg

SEQ ID NO: 1191160 - RNA, 22 nt, Mycobacterium bovis subsp bovis AF2122/97
ggugucggugguaccggcggcg

SEQ ID NO: 1191161 - RNA, 15 nt, Mycobacterium bovis subsp bovis AF2122/97
ggugguggccggggu

SEQ ID NO: 1191162 - RNA, 17 nt, Mycobacterium bovis subsp bovis AF2122/97
ggugguggccggggugc

SEQ ID NO: 1191163 - RNA, 20 nt, Mycobacterium bovis subsp bovis AF2122/97
gguggugggccguggguguc

SEQ ID NO: 1191164 - RNA, 14 nt, Mycobacterium bovis subsp bovis AF2122/97
gguggagagccgac

SEQ ID NO: 1191165 - RNA, 17 nt, Mycobacterium bovis subsp bovis AF2122/97
gguggaguuggcugccg

SEQ ID NO: 1191166 - RNA, 23 nt, Mycobacterium bovis subsp bovis AF2122/97
gguggacgaccgcgcggcacuug

SEQ ID NO: 1191167 - RNA, 16 nt, Mycobacterium bovis subsp bovis AF2122/97
gguggacgaucuggca

SEQ ID NO: 1191168 - RNA, 21 nt, Mycobacterium bovis subsp bovis AF2122/97
gguggacgugcagccgcaggu

SEQ ID NO: 1191169 - RNA, 23 nt, Mycobacterium bovis subsp bovis AF2122/97
gguggaaaaagcccgacacgaaa

SEQ ID NO: 1191170 - RNA, 15 nt, Mycobacterium bovis subsp bovis AF2122/97
gguggaaacccugca

SEQ ID NO: 1191171 - RNA, 21 nt, Mycobacterium bovis subsp bovis AF2122/97
gguggaaacugaugucgccga

SEQ ID NO: 1191172 - RNA, 21 nt, Mycobacterium bovis subsp bovis AF2122/97
gguggcgccguugucggcggu

SEQ ID NO: 1191173 - RNA, 22 nt, Mycobacterium bovis subsp bovis AF2122/97
gguggcgccaugaagccgggcg

SEQ ID NO: 1191174 - RNA, 22 nt, Mycobacterium bovis subsp bovis AF2122/97
gguggaguuuccgaagcccggg

SEQ ID NO: 1191175 - RNA, 21 nt, Mycobacterium bovis subsp bovis AF2122/97
gguggcaacgggucggcauug

SEQ ID NO: 1191176 - RNA, 20 nt, Mycobacterium bovis subsp bovis AF2122/97
gguggaguuuccgaagcccg

SEQ ID NO: 1191177 - RNA, 13 nt, Mycobacterium bovis subsp bovis AF2122/97
ggugcggggccgg

SEQ ID NO: 1191178 - RNA, 22 nt, Mycobacterium bovis subsp bovis AF2122/97
ggugcgggcgugguaaccaggg

SEQ ID NO: 1191179 - RNA, 16 nt, Mycobacterium bovis subsp bovis AF2122/97
ggugcgggugggcaca

SEQ ID NO: 1191180 - RNA, 15 nt, Mycobacterium bovis subsp bovis AF2122/97
ggugcgggguuggcc

SEQ ID NO: 1191181 - RNA, 14 nt, Mycobacterium bovis subsp bovis AF2122/97
ggugcgucugggca

SEQ ID NO: 1191182 - RNA, 20 nt, Mycobacterium bovis subsp bovis AF2122/97
ggugcguccaggccagggcg

SEQ ID NO: 1191183 - RNA, 22 nt, Mycobacterium bovis subsp bovis AF2122/97
ggugcguccaggccagggcggu

SEQ ID NO: 1191184 - RNA, 19 nt, Mycobacterium bovis subsp bovis AF2122/97
ggugcgguucgcugcggcg

SEQ ID NO: 1191185 - RNA, 21 nt, Mycobacterium bovis subsp bovis AF2122/97
ggugcgguucgcugcggcggu

SEQ ID NO: 1191186 - RNA, 21 nt, Mycobacterium bovis subsp bovis AF2122/97
ggugcuaccggcuuggcggga

SEQ ID NO: 1191187 - RNA, 15 nt, Mycobacterium bovis subsp bovis AF2122/97
ggugcuacugggugg

SEQ ID NO: 1191188 - RNA, 18 nt, Mycobacterium bovis subsp bovis AF2122/97
ggugcucagcggcucgcc

SEQ ID NO: 1191189 - RNA, 21 nt, Mycobacterium bovis subsp bovis AF2122/97
ggugccggcgccgccagcacc

SEQ ID NO: 1191190 - RNA, 21 nt, Mycobacterium bovis subsp bovis AF2122/97
ggugccggcgccgcccuugcc

SEQ ID NO: 1191191 - RNA, 13 nt, Mycobacterium bovis subsp bovis AF2122/97
ggugccggcggcg

SEQ ID NO: 1191192 - RNA, 16 nt, Mycobacterium bovis subsp bovis AF2122/97
ggugccggccaucgcc

SEQ ID NO: 1191193 - RNA, 21 nt, Mycobacterium bovis subsp bovis AF2122/97
ggugccggccguucgugggca

SEQ ID NO: 1191194 - RNA, 17 nt, Mycobacterium bovis subsp bovis AF2122/97
ggugccgucugcggggu

SEQ ID NO: 1191195 - RNA, 15 nt, Mycobacterium bovis subsp bovis AF2122/97
ggugccggcgucgcu

SEQ ID NO: 1191196 - RNA, 15 nt, Mycobacterium bovis subsp bovis AF2122/97
ggugccgggcaccac

SEQ ID NO: 1191197 - RNA, 13 nt, Mycobacterium bovis subsp bovis AF2122/97
ggugccugucaga

SEQ ID NO: 1191198 - RNA, 17 nt, Mycobacterium bovis subsp bovis AF2122/97
ggugccugucagaagga

SEQ ID NO: 1191199 - RNA, 15 nt, Mycobacterium bovis subsp bovis AF2122/97
ggugccgggguggcg

SEQ ID NO: 1191200 - RNA, 20 nt, Mycobacterium bovis subsp bovis AF2122/97
ggugccgugcucacggcagg

SEQ ID NO: 1191201 - RNA, 21 nt, Mycobacterium bovis subsp bovis AF2122/97
ggugccuacaccggcaagcca

SEQ ID NO: 1191202 - RNA, 13 nt, Mycobacterium bovis subsp bovis AF2122/97
ggugccggugcgc

SEQ ID NO: 1191203 - RNA, 18 nt, Mycobacterium bovis subsp bovis AF2122/97
ggugcgcuugcggccgcg

SEQ ID NO: 1191204 - RNA, 23 nt, Mycobacterium bovis subsp bovis AF2122/97
ggugcgcuugcggccgcgcgccg

SEQ ID NO: 1191205 - RNA, 22 nt, Mycobacterium bovis subsp bovis AF2122/97
ggugcggaacacgaugcgcggu

SEQ ID NO: 1191206 - RNA, 12 nt, Mycobacterium bovis subsp bovis AF2122/97
ggugcggccacu

SEQ ID NO: 1191207 - RNA, 13 nt, Mycobacterium bovis subsp bovis AF2122/97
ggugcgcgaagga

SEQ ID NO: 1191208 - RNA, 22 nt, Mycobacterium bovis subsp bovis AF2122/97
ggugcgcgugacgaccagcccc

SEQ ID NO: 1191209 - RNA, 14 nt, Mycobacterium bovis subsp bovis AF2122/97
ggugcgccgucagc

SEQ ID NO: 1191210 - RNA, 12 nt, Mycobacterium bovis subsp bovis AF2122/97
ggugcgcacggc

SEQ ID NO: 1191211 - RNA, 15 nt, Mycobacterium bovis subsp bovis AF2122/97
ggugcgcagggccug

SEQ ID NO: 1191212 - RNA, 14 nt, Mycobacterium bovis subsp bovis AF2122/97
ggugccgccgccgg

SEQ ID NO: 1191213 - RNA, 16 nt, Mycobacterium bovis subsp bovis AF2122/97
ggugccgccgccggcg

SEQ ID NO: 1191214 - RNA, 18 nt, Mycobacterium bovis subsp bovis AF2122/97
ggugccgccgcggccacc

SEQ ID NO: 1191215 - RNA, 15 nt, Mycobacterium bovis subsp bovis AF2122/97
ggugccgcccgcgcc

SEQ ID NO: 1191216 - RNA, 18 nt, Mycobacterium bovis subsp bovis AF2122/97
ggugccgcccgcgccucc

SEQ ID NO: 1191217 - RNA, 15 nt, Mycobacterium bovis subsp bovis AF2122/97
ggugccgccgucgcc

SEQ ID NO: 1191218 - RNA, 13 nt, Mycobacterium bovis subsp bovis AF2122/97
ggugccgcgcagc

SEQ ID NO: 1191219 - RNA, 17 nt, Mycobacterium bovis subsp bovis AF2122/97
ggugccgccgucgccgc

SEQ ID NO: 1191220 - RNA, 15 nt, Mycobacterium bovis subsp bovis AF2122/97
ggugccgccguuccc

SEQ ID NO: 1191221 - RNA, 18 nt, Mycobacterium bovis subsp bovis AF2122/97
ggugccggaaacgccagg

SEQ ID NO: 1191222 - RNA, 22 nt, Mycobacterium bovis subsp bovis AF2122/97
ggugccgcggcuaggccaagcc

SEQ ID NO: 1191223 - RNA, 18 nt, Mycobacterium bovis subsp bovis AF2122/97
ggugccgaucagcagugg

SEQ ID NO: 1191224 - RNA, 14 nt, Mycobacterium bovis subsp bovis AF2122/97
ggugccgacccgcc

SEQ ID NO: 1191225 - RNA, 20 nt, Mycobacterium bovis subsp bovis AF2122/97
ggugccgaagcugcccaacc

SEQ ID NO: 1191226 - RNA, 17 nt, Mycobacterium bovis subsp bovis AF2122/97
ggugcagcgugcagcgg

SEQ ID NO: 1191227 - RNA, 19 nt, Mycobacterium bovis subsp bovis AF2122/97
ggugcagcgugcagcggcg

SEQ ID NO: 1191228 - RNA, 13 nt, Mycobacterium bovis subsp bovis AF2122/97
ggugcagcgacuc

SEQ ID NO: 1191229 - RNA, 16 nt, Mycobacterium bovis subsp bovis AF2122/97
ggugcagcgccgacag

SEQ ID NO: 1191230 - RNA, 19 nt, Mycobacterium bovis subsp bovis AF2122/97
ggugcaccgaagauggcca

SEQ ID NO: 1191231 - RNA, 16 nt, Mycobacterium bovis subsp bovis AF2122/97
ggugcacgccuugagc

SEQ ID NO: 1191232 - RNA, 22 nt, Mycobacterium bovis subsp bovis AF2122/97
ggugcacgccuugagccgaggc

SEQ ID NO: 1191233 - RNA, 15 nt, Mycobacterium bovis subsp bovis AF2122/97
ggugcagcaccagcc

SEQ ID NO: 1191234 - RNA, 18 nt, Mycobacterium bovis subsp bovis AF2122/97
ggugcagaauucggcgcg

SEQ ID NO: 1191235 - RNA, 16 nt, Mycobacterium bovis subsp bovis AF2122/97
ggugcagaccaccgcc

SEQ ID NO: 1191236 - RNA, 15 nt, Mycobacterium bovis subsp bovis AF2122/97
ggugaucgggcagca

SEQ ID NO: 1191237 - RNA, 20 nt, Mycobacterium bovis subsp bovis AF2122/97
ggugcacaccgucgcaccca

SEQ ID NO: 1191238 - RNA, 20 nt, Mycobacterium bovis subsp bovis AF2122/97
ggucgccgaauggcugggcu

SEQ ID NO: 1191239 - RNA, 18 nt, Mycobacterium bovis subsp bovis AF2122/97
ggucgccggaccagagcc

SEQ ID NO: 1191240 - RNA, 18 nt, Mycobacterium bovis subsp bovis AF2122/97
ggucgcugcgacuggugc

SEQ ID NO: 1191241 - RNA, 19 nt, Mycobacterium bovis subsp bovis AF2122/97
ggucgcgacuaccaucgcc

SEQ ID NO: 1191242 - RNA, 17 nt, Mycobacterium bovis subsp bovis AF2122/97
ggucgccuccgggguga

SEQ ID NO: 1191243 - RNA, 17 nt, Mycobacterium bovis subsp bovis AF2122/97
ggucggcacgacccggg

SEQ ID NO: 1191244 - RNA, 11 nt, Mycobacterium bovis subsp bovis AF2122/97
ggucggccacc

SEQ ID NO: 1191245 - RNA, 17 nt, Mycobacterium bovis subsp bovis AF2122/97
ggucggcagcuccagca

SEQ ID NO: 1191246 - RNA, 19 nt, Mycobacterium bovis subsp bovis AF2122/97
ggucggaccacccggcgcg

SEQ ID NO: 1191247 - RNA, 17 nt, Mycobacterium bovis subsp bovis AF2122/97
ggucgcugugcagcggg

SEQ ID NO: 1191248 - RNA, 12 nt, Mycobacterium bovis subsp bovis AF2122/97
ggucgcccaggc

SEQ ID NO: 1191249 - RNA, 13 nt, Mycobacterium bovis subsp bovis AF2122/97
ggucgcccaggcc

SEQ ID NO: 1191250 - RNA, 14 nt, Mycobacterium bovis subsp bovis AF2122/97
ggucgcccgugucg

SEQ ID NO: 1191251 - RNA, 20 nt, Mycobacterium bovis subsp bovis AF2122/97
ggucgccaccgccggcagca

SEQ ID NO: 1191252 - RNA, 19 nt, Mycobacterium bovis subsp bovis AF2122/97
ggucgccaccgccggcagc

SEQ ID NO: 1191253 - RNA, 17 nt, Mycobacterium bovis subsp bovis AF2122/97
ggucgccaagugcaggg

SEQ ID NO: 1191254 - RNA, 13 nt, Mycobacterium bovis subsp bovis AF2122/97
ggucgaggugacu

SEQ ID NO: 1191255 - RNA, 18 nt, Mycobacterium bovis subsp bovis AF2122/97
ggucgagguggcgggcga

SEQ ID NO: 1191256 - RNA, 18 nt, Mycobacterium bovis subsp bovis AF2122/97
ggucgacugggacgacgc

SEQ ID NO: 1191257 - RNA, 14 nt, Mycobacterium bovis subsp bovis AF2122/97
ggucgaugcucagu

SEQ ID NO: 1191258 - RNA, 12 nt, Mycobacterium bovis subsp bovis AF2122/97
ggucgaugcugc

SEQ ID NO: 1191259 - RNA, 15 nt, Mycobacterium bovis subsp bovis AF2122/97
ggucgaugucggcga

SEQ ID NO: 1191260 - RNA, 20 nt, Mycobacterium bovis subsp bovis AF2122/97
ggucgacgaucucuccugga

SEQ ID NO: 1191261 - RNA, 19 nt, Mycobacterium bovis subsp bovis AF2122/97
ggucgacccaacgcagauc

SEQ ID NO: 1191262 - RNA, 19 nt, Mycobacterium bovis subsp bovis AF2122/97
ggucgacgaacaccccggg

SEQ ID NO: 1191263 - RNA, 20 nt, Mycobacterium bovis subsp bovis AF2122/97
ggucgacgagauccagcgcc

SEQ ID NO: 1191264 - RNA, 23 nt, Mycobacterium bovis subsp bovis AF2122/97
ggucgagauuggguccagcgagg

SEQ ID NO: 1191265 - RNA, 16 nt, Mycobacterium bovis subsp bovis AF2122/97
ggucgacgggucggcg

SEQ ID NO: 1191266 - RNA, 18 nt, Mycobacterium bovis subsp bovis AF2122/97
ggucgacgggucggcgcc

SEQ ID NO: 1191267 - RNA, 12 nt, Mycobacterium bovis subsp bovis AF2122/97
ggucgaagcugg

SEQ ID NO: 1191268 - RNA, 20 nt, Mycobacterium bovis subsp bovis AF2122/97
gguccuugucggccccggcc

SEQ ID NO: 1191269 - RNA, 13 nt, Mycobacterium bovis subsp bovis AF2122/97
ggucagcggcugg

SEQ ID NO: 1191270 - RNA, 16 nt, Mycobacterium bovis subsp bovis AF2122/97
ggucagcgcggcgacc

SEQ ID NO: 1191271 - RNA, 21 nt, Mycobacterium bovis subsp bovis AF2122/97
ggucagcgccgacuccaguuc

SEQ ID NO: 1191272 - RNA, 17 nt, Mycobacterium bovis subsp bovis AF2122/97
ggucagcgugcagguag

SEQ ID NO: 1191273 - RNA, 19 nt, Mycobacterium bovis subsp bovis AF2122/97
ggucagcgugcagguaggu

SEQ ID NO: 1191274 - RNA, 16 nt, Mycobacterium bovis subsp bovis AF2122/97
ggucagcucgagcgcc

SEQ ID NO: 1191275 - RNA, 17 nt, Mycobacterium bovis subsp bovis AF2122/97
ggucagcgggcuugccg

SEQ ID NO: 1191276 - RNA, 13 nt, Mycobacterium bovis subsp bovis AF2122/97
ggucagggugggc

SEQ ID NO: 1191277 - RNA, 23 nt, Mycobacterium bovis subsp bovis AF2122/97
ggucaggucugacagaccgggca

SEQ ID NO: 1191278 - RNA, 17 nt, Mycobacterium bovis subsp bovis AF2122/97
ggugacggcgguaccgc

SEQ ID NO: 1191279 - RNA, 13 nt, Mycobacterium bovis subsp bovis AF2122/97
ggugacuccggcu

SEQ ID NO: 1191280 - RNA, 23 nt, Mycobacterium bovis subsp bovis AF2122/97
ggugacuucgcugcggugggcca

SEQ ID NO: 1191281 - RNA, 21 nt, Mycobacterium bovis subsp bovis AF2122/97
ggugacuucguggccuugaca

SEQ ID NO: 1191282 - RNA, 22 nt, Mycobacterium bovis subsp bovis AF2122/97
ggugaccuucgcuauggcggcu

SEQ ID NO: 1191283 - RNA, 17 nt, Mycobacterium bovis subsp bovis AF2122/97
ggugacgcgccguaaca

SEQ ID NO: 1191284 - RNA, 17 nt, Mycobacterium bovis subsp bovis AF2122/97
ggugacggaguuggccc

SEQ ID NO: 1191285 - RNA, 14 nt, Mycobacterium bovis subsp bovis AF2122/97
ggugacgcccgcuc

SEQ ID NO: 1191286 - RNA, 23 nt, Mycobacterium bovis subsp bovis AF2122/97
ggugaguucgccggaggcaagca

SEQ ID NO: 1191287 - RNA, 23 nt, Mycobacterium bovis subsp bovis AF2122/97
ggugaccgguguuccgcccagcg

SEQ ID NO: 1191288 - RNA, 23 nt, Mycobacterium bovis subsp bovis AF2122/97
ggugaccucgugguucugcaggu

SEQ ID NO: 1191289 - RNA, 22 nt, Mycobacterium bovis subsp bovis AF2122/97
ggugacgaagagcaccgcgccc

SEQ ID NO: 1191290 - RNA, 19 nt, Mycobacterium bovis subsp bovis AF2122/97
ggugaacuucuccaccagc

SEQ ID NO: 1191291 - RNA, 22 nt, Mycobacterium bovis subsp bovis AF2122/97
ggugaacgucacguggucggcc

SEQ ID NO: 1191292 - RNA, 13 nt, Mycobacterium bovis subsp bovis AF2122/97
ggugaaggcaaac

SEQ ID NO: 1191293 - RNA, 15 nt, Mycobacterium bovis subsp bovis AF2122/97
ggugaaccccgccgg

SEQ ID NO: 1191294 - RNA, 14 nt, Mycobacterium bovis subsp bovis AF2122/97
ggugaacccgccgg

SEQ ID NO: 1191295 - RNA, 15 nt, Mycobacterium bovis subsp bovis AF2122/97
ggugaacgguagcac

SEQ ID NO: 1191296 - RNA, 15 nt, Mycobacterium bovis subsp bovis AF2122/97
ggugaacggcagcac

SEQ ID NO: 1191297 - RNA, 18 nt, Mycobacterium bovis subsp bovis AF2122/97
ggucggccugcggcaccg

SEQ ID NO: 1191298 - RNA, 17 nt, Mycobacterium bovis subsp bovis AF2122/97
ggucggcgaacgcggcg

SEQ ID NO: 1191299 - RNA, 15 nt, Mycobacterium bovis subsp bovis AF2122/97
ggucggcgaccgcgc

SEQ ID NO: 1191300 - RNA, 22 nt, Mycobacterium bovis subsp bovis AF2122/97
ggucggcgaugaugacggcggc

SEQ ID NO: 1191301 - RNA, 18 nt, Mycobacterium bovis subsp bovis AF2122/97
ggucgucgaacggcagcc

SEQ ID NO: 1191302 - RNA, 20 nt, Mycobacterium bovis subsp bovis AF2122/97
ggucgugcaggcgacggcuc

SEQ ID NO: 1191303 - RNA, 14 nt, Mycobacterium bovis subsp bovis AF2122/97
ggucgugccagcag

SEQ ID NO: 1191304 - RNA, 18 nt, Mycobacterium bovis subsp bovis AF2122/97
ggucgugaaaccacaccu

SEQ ID NO: 1191305 - RNA, 14 nt, Mycobacterium bovis subsp bovis AF2122/97
ggucguucaccgau

SEQ ID NO: 1191306 - RNA, 14 nt, Mycobacterium bovis subsp bovis AF2122/97
ggucguugaggccg

SEQ ID NO: 1191307 - RNA, 21 nt, Mycobacterium bovis subsp bovis AF2122/97
ggucuucuucaccgccuuggu

SEQ ID NO: 1191308 - RNA, 19 nt, Mycobacterium bovis subsp bovis AF2122/97
ggucuuggcgauccaggcc

SEQ ID NO: 1191309 - RNA, 15 nt, Mycobacterium bovis subsp bovis AF2122/97
ggucuguuggugaca

SEQ ID NO: 1191310 - RNA, 15 nt, Mycobacterium bovis subsp bovis AF2122/97
ggucguugaggccgg

SEQ ID NO: 1191311 - RNA, 16 nt, Mycobacterium bovis subsp bovis AF2122/97
ggucguugaggccggu

SEQ ID NO: 1191312 - RNA, 17 nt, Mycobacterium bovis subsp bovis AF2122/97
ggucguuggcggcgguc

SEQ ID NO: 1191313 - RNA, 18 nt, Mycobacterium bovis subsp bovis AF2122/97
ggucuuugcucucggucu

SEQ ID NO: 1191314 - RNA, 14 nt, Mycobacterium bovis subsp bovis AF2122/97
ggucuugccgcagg

SEQ ID NO: 1191315 - RNA, 16 nt, Mycobacterium bovis subsp bovis AF2122/97
ggucuugcaucgccaa

SEQ ID NO: 1191316 - RNA, 22 nt, Mycobacterium bovis subsp bovis AF2122/97
ggucuuggugcucuugcgggga

SEQ ID NO: 1191317 - RNA, 15 nt, Mycobacterium bovis subsp bovis AF2122/97
ggucuuugagccggu

SEQ ID NO: 1191318 - RNA, 15 nt, Mycobacterium bovis subsp bovis AF2122/97
ggugaaaaaggcgac

SEQ ID NO: 1191319 - RNA, 12 nt, Mycobacterium bovis subsp bovis AF2122/97
guaagcaugccg

SEQ ID NO: 1191320 - RNA, 17 nt, Mycobacterium bovis subsp bovis AF2122/97
guaagcaccagccagcc

SEQ ID NO: 1191321 - RNA, 12 nt, Mycobacterium bovis subsp bovis AF2122/97
guaagcggaugu

SEQ ID NO: 1191322 - RNA, 22 nt, Mycobacterium bovis subsp bovis AF2122/97
guaagcgccaaggcgauggucu

SEQ ID NO: 1191323 - RNA, 16 nt, Mycobacterium bovis subsp bovis AF2122/97
guaaggcacggguguu

SEQ ID NO: 1191324 - RNA, 21 nt, Mycobacterium bovis subsp bovis AF2122/97
guaaguuauccgaccacucca

SEQ ID NO: 1191325 - RNA, 12 nt, Mycobacterium bovis subsp bovis AF2122/97
guaaccuccucg

SEQ ID NO: 1191326 - RNA, 14 nt, Mycobacterium bovis subsp bovis AF2122/97
guaaccggcagcgg

SEQ ID NO: 1191327 - RNA, 16 nt, Mycobacterium bovis subsp bovis AF2122/97
guaaccagcgccacga

SEQ ID NO: 1191328 - RNA, 15 nt, Mycobacterium bovis subsp bovis AF2122/97
guaacugcccgcggc

SEQ ID NO: 1191329 - RNA, 17 nt, Mycobacterium bovis subsp bovis AF2122/97
gguguuuaugguugugc

SEQ ID NO: 1191330 - RNA, 11 nt, Mycobacterium bovis subsp bovis AF2122/97
gguguuuuugu

SEQ ID NO: 1191331 - RNA, 17 nt, Mycobacterium bovis subsp bovis AF2122/97
guaaacaaacccaacac

SEQ ID NO: 1191332 - RNA, 15 nt, Mycobacterium bovis subsp bovis AF2122/97
guaaagccaacuggu

SEQ ID NO: 1191333 - RNA, 15 nt, Mycobacterium bovis subsp bovis AF2122/97
guacccaucugcuca

SEQ ID NO: 1191334 - RNA, 14 nt, Mycobacterium bovis subsp bovis AF2122/97
guacccccagcacc

SEQ ID NO: 1191335 - RNA, 15 nt, Mycobacterium bovis subsp bovis AF2122/97
guaccccccagcgac

SEQ ID NO: 1191336 - RNA, 15 nt, Mycobacterium bovis subsp bovis AF2122/97
guacccgaccagcac

SEQ ID NO: 1191337 - RNA, 16 nt, Mycobacterium bovis subsp bovis AF2122/97
guacccgaccagcacc

SEQ ID NO: 1191338 - RNA, 12 nt, Mycobacterium bovis subsp bovis AF2122/97
guacccaccucc

SEQ ID NO: 1191339 - RNA, 22 nt, Mycobacterium bovis subsp bovis AF2122/97
guacccaccucccgcagccggg

SEQ ID NO: 1191340 - RNA, 16 nt, Mycobacterium bovis subsp bovis AF2122/97
guaccaauccaggcca

SEQ ID NO: 1191341 - RNA, 14 nt, Mycobacterium bovis subsp bovis AF2122/97
guaccgcuggacag

SEQ ID NO: 1191342 - RNA, 17 nt, Mycobacterium bovis subsp bovis AF2122/97
guacccguagcaccaca

SEQ ID NO: 1191343 - RNA, 15 nt, Mycobacterium bovis subsp bovis AF2122/97
guaccgauagccugc

SEQ ID NO: 1191344 - RNA, 13 nt, Mycobacterium bovis subsp bovis AF2122/97
guacaugggcaga

SEQ ID NO: 1191345 - RNA, 22 nt, Mycobacterium bovis subsp bovis AF2122/97
guaauggccgccgguccaugga

SEQ ID NO: 1191346 - RNA, 20 nt, Mycobacterium bovis subsp bovis AF2122/97
guaaucgguggugugcagcc

SEQ ID NO: 1191347 - RNA, 18 nt, Mycobacterium bovis subsp bovis AF2122/97
guagacguugccaacacc

SEQ ID NO: 1191348 - RNA, 16 nt, Mycobacterium bovis subsp bovis AF2122/97
guagacggcacccccg

SEQ ID NO: 1191349 - RNA, 15 nt, Mycobacterium bovis subsp bovis AF2122/97
guagaccaggcccag

SEQ ID NO: 1191350 - RNA, 22 nt, Mycobacterium bovis subsp bovis AF2122/97
guagacccacaucaggucggcg

SEQ ID NO: 1191351 - RNA, 21 nt, Mycobacterium bovis subsp bovis AF2122/97
guagagcgggccaacucggcg

SEQ ID NO: 1191352 - RNA, 20 nt, Mycobacterium bovis subsp bovis AF2122/97
guagagcucaccgucgaggu

SEQ ID NO: 1191353 - RNA, 15 nt, Mycobacterium bovis subsp bovis AF2122/97
guagacuugcugcuc

SEQ ID NO: 1191354 - RNA, 16 nt, Mycobacterium bovis subsp bovis AF2122/97
guacuugaccguccac

SEQ ID NO: 1191355 - RNA, 18 nt, Mycobacterium bovis subsp bovis AF2122/97
guacuugagggucuugaa

SEQ ID NO: 1191356 - RNA, 18 nt, Mycobacterium bovis subsp bovis AF2122/97
guacugugccgcccccgg

SEQ ID NO: 1191357 - RNA, 21 nt, Mycobacterium bovis subsp bovis AF2122/97
guacucccgcgaucgcgacac

SEQ ID NO: 1191358 - RNA, 13 nt, Mycobacterium bovis subsp bovis AF2122/97
guacuccauggca

SEQ ID NO: 1191359 - RNA, 16 nt, Mycobacterium bovis subsp bovis AF2122/97
guacucccaggccgcc

SEQ ID NO: 1191360 - RNA, 21 nt, Mycobacterium bovis subsp bovis AF2122/97
guacucccccgaaccugcggc

SEQ ID NO: 1191361 - RNA, 14 nt, Mycobacterium bovis subsp bovis AF2122/97
guacgggcaggccg

SEQ ID NO: 1191362 - RNA, 19 nt, Mycobacterium bovis subsp bovis AF2122/97
guaccgguugacgggcucg

SEQ ID NO: 1191363 - RNA, 18 nt, Mycobacterium bovis subsp bovis AF2122/97
guaccggcggcgccggcc

SEQ ID NO: 1191364 - RNA, 19 nt, Mycobacterium bovis subsp bovis AF2122/97
guaccguagcucuuugagu

SEQ ID NO: 1191365 - RNA, 16 nt, Mycobacterium bovis subsp bovis AF2122/97
guaccuaaggcucacc

SEQ ID NO: 1191366 - RNA, 21 nt, Mycobacterium bovis subsp bovis AF2122/97
guacuaacaacaccaccagca

SEQ ID NO: 1191367 - RNA, 17 nt, Mycobacterium bovis subsp bovis AF2122/97
guacgggcaggccgcug

SEQ ID NO: 1191368 - RNA, 22 nt, Mycobacterium bovis subsp bovis AF2122/97
guacgggcaggccgcugggccg

SEQ ID NO: 1191369 - RNA, 18 nt, Mycobacterium bovis subsp bovis AF2122/97
guaggugcaugucgauga

SEQ ID NO: 1191370 - RNA, 22 nt, Mycobacterium bovis subsp bovis AF2122/97
guagguggccggcuugcaguga

SEQ ID NO: 1191371 - RNA, 18 nt, Mycobacterium bovis subsp bovis AF2122/97
guagguggggcacuucca

SEQ ID NO: 1191372 - RNA, 17 nt, Mycobacterium bovis subsp bovis AF2122/97
guagguuuucggcggcu

SEQ ID NO: 1191373 - RNA, 14 nt, Mycobacterium bovis subsp bovis AF2122/97
guagucgaugcuga

SEQ ID NO: 1191374 - RNA, 15 nt, Mycobacterium bovis subsp bovis AF2122/97
guagucgaugcugac

SEQ ID NO: 1191375 - RNA, 16 nt, Mycobacterium bovis subsp bovis AF2122/97
guagucgaugcugacg

SEQ ID NO: 1191376 - RNA, 16 nt, Mycobacterium bovis subsp bovis AF2122/97
guaguccugcgggccg

SEQ ID NO: 1191377 - RNA, 19 nt, Mycobacterium bovis subsp bovis AF2122/97
guagucgggcaaggcggcg

SEQ ID NO: 1191378 - RNA, 19 nt, Mycobacterium bovis subsp bovis AF2122/97
guaguccgcgccgacggcc

SEQ ID NO: 1191379 - RNA, 23 nt, Mycobacterium bovis subsp bovis AF2122/97
guagucccucaucaccucuccgu

SEQ ID NO: 1191380 - RNA, 23 nt, Mycobacterium bovis subsp bovis AF2122/97
guagugcguaaggcugugccggc

SEQ ID NO: 1191381 - RNA, 23 nt, Mycobacterium bovis subsp bovis AF2122/97
guaggcuggccgccuccgcggca

SEQ ID NO: 1191382 - RNA, 15 nt, Mycobacterium bovis subsp bovis AF2122/97
guaggcuggccgccu

SEQ ID NO: 1191383 - RNA, 15 nt, Mycobacterium bovis subsp bovis AF2122/97
guaggcuuccagcuc

SEQ ID NO: 1191384 - RNA, 22 nt, Mycobacterium bovis subsp bovis AF2122/97
guaggcuucgaccguggugguc

SEQ ID NO: 1191385 - RNA, 11 nt, Mycobacterium bovis subsp bovis AF2122/97
guagggacgcc

SEQ ID NO: 1191386 - RNA, 13 nt, Mycobacterium bovis subsp bovis AF2122/97
guaggcgccgcga

SEQ ID NO: 1191387 - RNA, 13 nt, Mycobacterium bovis subsp bovis AF2122/97
guaggcggcggcc

SEQ ID NO: 1191388 - RNA, 11 nt, Mycobacterium bovis subsp bovis AF2122/97
guaggggucug

SEQ ID NO: 1191389 - RNA, 17 nt, Mycobacterium bovis subsp bovis AF2122/97
guagggcagcgccaggc

SEQ ID NO: 1191390 - RNA, 15 nt, Mycobacterium bovis subsp bovis AF2122/97
guagggauagcagug

SEQ ID NO: 1191391 - RNA, 17 nt, Mycobacterium bovis subsp bovis AF2122/97
guagggauagcagugca

SEQ ID NO: 1191392 - RNA, 19 nt, Mycobacterium bovis subsp bovis AF2122/97
guagggauagcagugcagc

SEQ ID NO: 1191393 - RNA, 21 nt, Mycobacterium bovis subsp bovis AF2122/97
guagguccacguucggcugcg

SEQ ID NO: 1191394 - RNA, 18 nt, Mycobacterium bovis subsp bovis AF2122/97
guaggucgccgcuuugga

SEQ ID NO: 1191395 - RNA, 23 nt, Mycobacterium bovis subsp bovis AF2122/97
guaggucagcgcgucguccaggg

SEQ ID NO: 1191396 - RNA, 14 nt, Mycobacterium bovis subsp bovis AF2122/97
guaggggcaggcca

SEQ ID NO: 1191397 - RNA, 17 nt, Mycobacterium bovis subsp bovis AF2122/97
guaggcaauggcgugcg

SEQ ID NO: 1191398 - RNA, 17 nt, Mycobacterium bovis subsp bovis AF2122/97
guaggcgaaccgcucca

SEQ ID NO: 1191399 - RNA, 15 nt, Mycobacterium bovis subsp bovis AF2122/97
guaggccuggccccg

SEQ ID NO: 1191400 - RNA, 16 nt, Mycobacterium bovis subsp bovis AF2122/97
guaggccucggcagca

SEQ ID NO: 1191401 - RNA, 23 nt, Mycobacterium bovis subsp bovis AF2122/97
guaggccugcccccggcgcggcg

SEQ ID NO: 1191402 - RNA, 15 nt, Mycobacterium bovis subsp bovis AF2122/97
guagcugacggccug

SEQ ID NO: 1191403 - RNA, 16 nt, Mycobacterium bovis subsp bovis AF2122/97
guagcucgucgaggaa

SEQ ID NO: 1191404 - RNA, 20 nt, Mycobacterium bovis subsp bovis AF2122/97
guagcucgucgaggaagauc

SEQ ID NO: 1191405 - RNA, 15 nt, Mycobacterium bovis subsp bovis AF2122/97
guagcguucccacac

SEQ ID NO: 1191406 - RNA, 18 nt, Mycobacterium bovis subsp bovis AF2122/97
guagcgcaaugcggcccg

SEQ ID NO: 1191407 - RNA, 22 nt, Mycobacterium bovis subsp bovis AF2122/97
guagcgcaaugcggcccgggug

SEQ ID NO: 1191408 - RNA, 19 nt, Mycobacterium bovis subsp bovis AF2122/97
guagaucagcgccuggucc

SEQ ID NO: 1191409 - RNA, 16 nt, Mycobacterium bovis subsp bovis AF2122/97
gucgccacacccgcga

SEQ ID NO: 1191410 - RNA, 17 nt, Mycobacterium bovis subsp bovis AF2122/97
gucgccaagaucgggug

SEQ ID NO: 1191411 - RNA, 13 nt, Mycobacterium bovis subsp bovis AF2122/97
gucgccagggccg

SEQ ID NO: 1191412 - RNA, 18 nt, Mycobacterium bovis subsp bovis AF2122/97
gucgccauccucgagcug

SEQ ID NO: 1191413 - RNA, 15 nt, Mycobacterium bovis subsp bovis AF2122/97
gucgcccagccgagc

SEQ ID NO: 1191414 - RNA, 13 nt, Mycobacterium bovis subsp bovis AF2122/97
gucgccaggucau

SEQ ID NO: 1191415 - RNA, 12 nt, Mycobacterium bovis subsp bovis AF2122/97
gucgccgcccgu

SEQ ID NO: 1191416 - RNA, 20 nt, Mycobacterium bovis subsp bovis AF2122/97
gucgccgccauugccgccgg

SEQ ID NO: 1191417 - RNA, 16 nt, Mycobacterium bovis subsp bovis AF2122/97
gucgccgccggcgccg

SEQ ID NO: 1191418 - RNA, 14 nt, Mycobacterium bovis subsp bovis AF2122/97
gucgccgccuucuu

SEQ ID NO: 1191419 - RNA, 21 nt, Mycobacterium bovis subsp bovis AF2122/97
gucgccgccuucuuggcggcc

SEQ ID NO: 1191420 - RNA, 18 nt, Mycobacterium bovis subsp bovis AF2122/97
gucgccgccaccagcgca

SEQ ID NO: 1191421 - RNA, 17 nt, Mycobacterium bovis subsp bovis AF2122/97
gucgccgccagguugcc

SEQ ID NO: 1191422 - RNA, 18 nt, Mycobacterium bovis subsp bovis AF2122/97
gucgccgcaucggcggug

SEQ ID NO: 1191423 - RNA, 14 nt, Mycobacterium bovis subsp bovis AF2122/97
gucgccgccaaagc

SEQ ID NO: 1191424 - RNA, 15 nt, Mycobacterium bovis subsp bovis AF2122/97
gucgccgccaccagc

SEQ ID NO: 1191425 - RNA, 18 nt, Mycobacterium bovis subsp bovis AF2122/97
gucgccgacccgggggcg

SEQ ID NO: 1191426 - RNA, 22 nt, Mycobacterium bovis subsp bovis AF2122/97
gucgccgaucaugaccaucugc

SEQ ID NO: 1191427 - RNA, 21 nt, Mycobacterium bovis subsp bovis AF2122/97
gucgccgaacgccaccaccuc

SEQ ID NO: 1191428 - RNA, 18 nt, Mycobacterium bovis subsp bovis AF2122/97
gucgccgaaguuccagcc

SEQ ID NO: 1191429 - RNA, 12 nt, Mycobacterium bovis subsp bovis AF2122/97
gucgcggccucg

SEQ ID NO: 1191430 - RNA, 21 nt, Mycobacterium bovis subsp bovis AF2122/97
gucgcggcuauggcgccgcgg

SEQ ID NO: 1191431 - RNA, 22 nt, Mycobacterium bovis subsp bovis AF2122/97
gucgcgaaacaccagacacugg

SEQ ID NO: 1191432 - RNA, 20 nt, Mycobacterium bovis subsp bovis AF2122/97
gucgccuucuuggcaggugc

SEQ ID NO: 1191433 - RNA, 19 nt, Mycobacterium bovis subsp bovis AF2122/97
gucgcggaucagcccgcgc

SEQ ID NO: 1191434 - RNA, 18 nt, Mycobacterium bovis subsp bovis AF2122/97
gucgccggaguucugcga

SEQ ID NO: 1191435 - RNA, 18 nt, Mycobacterium bovis subsp bovis AF2122/97
gucgccggauagcgcagc

SEQ ID NO: 1191436 - RNA, 22 nt, Mycobacterium bovis subsp bovis AF2122/97
gucgccgcuuucuuggcgggcg

SEQ ID NO: 1191437 - RNA, 18 nt, Mycobacterium bovis subsp bovis AF2122/97
gucgccggaccagagcca

SEQ ID NO: 1191438 - RNA, 15 nt, Mycobacterium bovis subsp bovis AF2122/97
gucgccgcggcggca

SEQ ID NO: 1191439 - RNA, 14 nt, Mycobacterium bovis subsp bovis AF2122/97
gucgccggcugggg

SEQ ID NO: 1191440 - RNA, 13 nt, Mycobacterium bovis subsp bovis AF2122/97
gucgccggcggcg

SEQ ID NO: 1191441 - RNA, 18 nt, Mycobacterium bovis subsp bovis AF2122/97
gucgccggucaggccgcc

SEQ ID NO: 1191442 - RNA, 12 nt, Mycobacterium bovis subsp bovis AF2122/97
gucgccggugcc

SEQ ID NO: 1191443 - RNA, 16 nt, Mycobacterium bovis subsp bovis AF2122/97
gucgccggucaucgcc

SEQ ID NO: 1191444 - RNA, 18 nt, Mycobacterium bovis subsp bovis AF2122/97
gucgccgucgugccaccg

SEQ ID NO: 1191445 - RNA, 19 nt, Mycobacterium bovis subsp bovis AF2122/97
gucgccgucggugccgccg

SEQ ID NO: 1191446 - RNA, 15 nt, Mycobacterium bovis subsp bovis AF2122/97
guccugggccgccgc

SEQ ID NO: 1191447 - RNA, 22 nt, Mycobacterium bovis subsp bovis AF2122/97
guccuguccgggcugcaugcgg

SEQ ID NO: 1191448 - RNA, 20 nt, Mycobacterium bovis subsp bovis AF2122/97
guccuucuuguuggucccga

SEQ ID NO: 1191449 - RNA, 16 nt, Mycobacterium bovis subsp bovis AF2122/97
gucgagcugaccacgg

SEQ ID NO: 1191450 - RNA, 23 nt, Mycobacterium bovis subsp bovis AF2122/97
gucgaggcaggccucggcgccgc

SEQ ID NO: 1191451 - RNA, 18 nt, Mycobacterium bovis subsp bovis AF2122/97
gucgagguucucccgcgc

SEQ ID NO: 1191452 - RNA, 15 nt, Mycobacterium bovis subsp bovis AF2122/97
gucgagguggggugg

SEQ ID NO: 1191453 - RNA, 18 nt, Mycobacterium bovis subsp bovis AF2122/97
gucgaggugggguggugg

SEQ ID NO: 1191454 - RNA, 22 nt, Mycobacterium bovis subsp bovis AF2122/97
gucgagucgguccugccaaugc

SEQ ID NO: 1191455 - RNA, 22 nt, Mycobacterium bovis subsp bovis AF2122/97
gucgagugcggacuucgccgcc

SEQ ID NO: 1191456 - RNA, 14 nt, Mycobacterium bovis subsp bovis AF2122/97
gucgaggugacuug

SEQ ID NO: 1191457 - RNA, 18 nt, Mycobacterium bovis subsp bovis AF2122/97
gucgagguccucgagguc

SEQ ID NO: 1191458 - RNA, 12 nt, Mycobacterium bovis subsp bovis AF2122/97
gucgaggucggc

SEQ ID NO: 1191459 - RNA, 16 nt, Mycobacterium bovis subsp bovis AF2122/97
gucgaggucagcuccc

SEQ ID NO: 1191460 - RNA, 16 nt, Mycobacterium bovis subsp bovis AF2122/97
gucgagggagcgccgc

SEQ ID NO: 1191461 - RNA, 19 nt, Mycobacterium bovis subsp bovis AF2122/97
gucgagguacacgccgagg

SEQ ID NO: 1191462 - RNA, 13 nt, Mycobacterium bovis subsp bovis AF2122/97
gucgcagcugccg

SEQ ID NO: 1191463 - RNA, 15 nt, Mycobacterium bovis subsp bovis AF2122/97
gucgcagugcaagcg

SEQ ID NO: 1191464 - RNA, 16 nt, Mycobacterium bovis subsp bovis AF2122/97
gucgaucauggcggca

SEQ ID NO: 1191465 - RNA, 18 nt, Mycobacterium bovis subsp bovis AF2122/97
gucgaucacguacgccgc

SEQ ID NO: 1191466 - RNA, 21 nt, Mycobacterium bovis subsp bovis AF2122/97
gucgaucacgucgucagccac

SEQ ID NO: 1191467 - RNA, 19 nt, Mycobacterium bovis subsp bovis AF2122/97
gucgaucagcggcagcacc

SEQ ID NO: 1191468 - RNA, 20 nt, Mycobacterium bovis subsp bovis AF2122/97
gucgaguucgcagucgauga

SEQ ID NO: 1191469 - RNA, 22 nt, Mycobacterium bovis subsp bovis AF2122/97
gucgaguucgcagucgaugagu

SEQ ID NO: 1191470 - RNA, 22 nt, Mycobacterium bovis subsp bovis AF2122/97
gucgaucaacaacagccgcagc

SEQ ID NO: 1191471 - RNA, 14 nt, Mycobacterium bovis subsp bovis AF2122/97
gucgauaaccuggc

SEQ ID NO: 1191472 - RNA, 15 nt, Mycobacterium bovis subsp bovis AF2122/97
gucgauaccggcgug

SEQ ID NO: 1191473 - RNA, 22 nt, Mycobacterium bovis subsp bovis AF2122/97
gucgauccgucggcggagagca

SEQ ID NO: 1191474 - RNA, 21 nt, Mycobacterium bovis subsp bovis AF2122/97
gucgaucucggcagagacgua

SEQ ID NO: 1191475 - RNA, 18 nt, Mycobacterium bovis subsp bovis AF2122/97
gucgauucgucgaaggga

SEQ ID NO: 1191476 - RNA, 20 nt, Mycobacterium bovis subsp bovis AF2122/97
gucgauugccaccgagauca

SEQ ID NO: 1191477 - RNA, 19 nt, Mycobacterium bovis subsp bovis AF2122/97
guccccgacaacggcggca

SEQ ID NO: 1191478 - RNA, 17 nt, Mycobacterium bovis subsp bovis AF2122/97
gucccauggugagcugu

SEQ ID NO: 1191479 - RNA, 18 nt, Mycobacterium bovis subsp bovis AF2122/97
gucccauuugccuugagc

SEQ ID NO: 1191480 - RNA, 19 nt, Mycobacterium bovis subsp bovis AF2122/97
guccccgccggccuccucg

SEQ ID NO: 1191481 - RNA, 15 nt, Mycobacterium bovis subsp bovis AF2122/97
guccccgcagcgccu

SEQ ID NO: 1191482 - RNA, 23 nt, Mycobacterium bovis subsp bovis AF2122/97
guccccgcuuggcgagccacggc

SEQ ID NO: 1191483 - RNA, 18 nt, Mycobacterium bovis subsp bovis AF2122/97
gucccagccgaucacggg

SEQ ID NO: 1191484 - RNA, 17 nt, Mycobacterium bovis subsp bovis AF2122/97
gucccagcgccgcagug

SEQ ID NO: 1191485 - RNA, 18 nt, Mycobacterium bovis subsp bovis AF2122/97
gucccacugccggugcug

SEQ ID NO: 1191486 - RNA, 15 nt, Mycobacterium bovis subsp bovis AF2122/97
gucccacugggccgg

SEQ ID NO: 1191487 - RNA, 20 nt, Mycobacterium bovis subsp bovis AF2122/97
gucccagggcacaucgggcg

SEQ ID NO: 1191488 - RNA, 16 nt, Mycobacterium bovis subsp bovis AF2122/97
gucccagcugaccagc

SEQ ID NO: 1191489 - RNA, 18 nt, Mycobacterium bovis subsp bovis AF2122/97
gucccagcugaccagcgu

SEQ ID NO: 1191490 - RNA, 15 nt, Mycobacterium bovis subsp bovis AF2122/97
gucccagggcugccg

SEQ ID NO: 1191491 - RNA, 23 nt, Mycobacterium bovis subsp bovis AF2122/97
guccaucgcgcugcggcccacac

SEQ ID NO: 1191492 - RNA, 19 nt, Mycobacterium bovis subsp bovis AF2122/97
guccaucgcgcggcugugc

SEQ ID NO: 1191493 - RNA, 19 nt, Mycobacterium bovis subsp bovis AF2122/97
guccauccgcagcagguga

SEQ ID NO: 1191494 - RNA, 16 nt, Mycobacterium bovis subsp bovis AF2122/97
guccaucgccaccgcg

SEQ ID NO: 1191495 - RNA, 17 nt, Mycobacterium bovis subsp bovis AF2122/97
guccaucaccggcggcc

SEQ ID NO: 1191496 - RNA, 20 nt, Mycobacterium bovis subsp bovis AF2122/97
guccaucaccggcggcccca

SEQ ID NO: 1191497 - RNA, 16 nt, Mycobacterium bovis subsp bovis AF2122/97
guccaucaccggcggc

SEQ ID NO: 1191498 - RNA, 22 nt, Mycobacterium bovis subsp bovis AF2122/97
guccaucaccggcggccccagg

SEQ ID NO: 1191499 - RNA, 19 nt, Mycobacterium bovis subsp bovis AF2122/97
guccauauagaucacugcu

SEQ ID NO: 1191500 - RNA, 21 nt, Mycobacterium bovis subsp bovis AF2122/97
guccggcccccgacuccggca

SEQ ID NO: 1191501 - RNA, 19 nt, Mycobacterium bovis subsp bovis AF2122/97
guccggcucauccgacggg

SEQ ID NO: 1191502 - RNA, 14 nt, Mycobacterium bovis subsp bovis AF2122/97
guccggcggccgcc

SEQ ID NO: 1191503 - RNA, 22 nt, Mycobacterium bovis subsp bovis AF2122/97
guccggcggccgccaucagccg

SEQ ID NO: 1191504 - RNA, 16 nt, Mycobacterium bovis subsp bovis AF2122/97
guccggcuuggcggcg

SEQ ID NO: 1191505 - RNA, 23 nt, Mycobacterium bovis subsp bovis AF2122/97
guccggaugcgcaaccgcggccc

SEQ ID NO: 1191506 - RNA, 12 nt, Mycobacterium bovis subsp bovis AF2122/97
guccgcccagca

SEQ ID NO: 1191507 - RNA, 21 nt, Mycobacterium bovis subsp bovis AF2122/97
guccggaaauuccggcgcggc

SEQ ID NO: 1191508 - RNA, 12 nt, Mycobacterium bovis subsp bovis AF2122/97
guccgccgcaga

SEQ ID NO: 1191509 - RNA, 16 nt, Mycobacterium bovis subsp bovis AF2122/97
guccgccgcagacgcc

SEQ ID NO: 1191510 - RNA, 21 nt, Mycobacterium bovis subsp bovis AF2122/97
guccgcacgaucugcaggccc

SEQ ID NO: 1191511 - RNA, 20 nt, Mycobacterium bovis subsp bovis AF2122/97
guccgccaaguacugggcca

SEQ ID NO: 1191512 - RNA, 19 nt, Mycobacterium bovis subsp bovis AF2122/97
guccgcagcguccagcgcc

SEQ ID NO: 1191513 - RNA, 18 nt, Mycobacterium bovis subsp bovis AF2122/97
gucccgcgggccagcacc

SEQ ID NO: 1191514 - RNA, 22 nt, Mycobacterium bovis subsp bovis AF2122/97
gucccgccgaccgacaccacca

SEQ ID NO: 1191515 - RNA, 15 nt, Mycobacterium bovis subsp bovis AF2122/97
gucccgcgagcagcc

SEQ ID NO: 1191516 - RNA, 19 nt, Mycobacterium bovis subsp bovis AF2122/97
guccgagcuuggccgccgc

SEQ ID NO: 1191517 - RNA, 18 nt, Mycobacterium bovis subsp bovis AF2122/97
gucccgauacggccggcc

SEQ ID NO: 1191518 - RNA, 19 nt, Mycobacterium bovis subsp bovis AF2122/97
gucccgauggcgguggggc

SEQ ID NO: 1191519 - RNA, 15 nt, Mycobacterium bovis subsp bovis AF2122/97
guccuggaucagcca

SEQ ID NO: 1191520 - RNA, 19 nt, Mycobacterium bovis subsp bovis AF2122/97
guccugcggauagugguug

SEQ ID NO: 1191521 - RNA, 19 nt, Mycobacterium bovis subsp bovis AF2122/97
guccugcggguaggugacg

SEQ ID NO: 1191522 - RNA, 21 nt, Mycobacterium bovis subsp bovis AF2122/97
guccugccagaagaccuggcg

SEQ ID NO: 1191523 - RNA, 16 nt, Mycobacterium bovis subsp bovis AF2122/97
guccugcgccgcacgc

SEQ ID NO: 1191524 - RNA, 21 nt, Mycobacterium bovis subsp bovis AF2122/97
guccugaaucgguucggccag

SEQ ID NO: 1191525 - RNA, 22 nt, Mycobacterium bovis subsp bovis AF2122/97
guccugaaucgguucggccaga

SEQ ID NO: 1191526 - RNA, 20 nt, Mycobacterium bovis subsp bovis AF2122/97
guccucgucgucgagguccu

SEQ ID NO: 1191527 - RNA, 20 nt, Mycobacterium bovis subsp bovis AF2122/97
guccuccaaggcggucacca

SEQ ID NO: 1191528 - RNA, 19 nt, Mycobacterium bovis subsp bovis AF2122/97
guccguucaccgucugcgg

SEQ ID NO: 1191529 - RNA, 16 nt, Mycobacterium bovis subsp bovis AF2122/97
guccguucgaugccag

SEQ ID NO: 1191530 - RNA, 16 nt, Mycobacterium bovis subsp bovis AF2122/97
gucaagaaggagaucg

SEQ ID NO: 1191531 - RNA, 17 nt, Mycobacterium bovis subsp bovis AF2122/97
gucaacuugggcccgcu

SEQ ID NO: 1191532 - RNA, 14 nt, Mycobacterium bovis subsp bovis AF2122/97
gucaagcacacugg

SEQ ID NO: 1191533 - RNA, 16 nt, Mycobacterium bovis subsp bovis AF2122/97
gucaaugacaccgggg

SEQ ID NO: 1191534 - RNA, 21 nt, Mycobacterium bovis subsp bovis AF2122/97
gucaacgacgacgacaagugc

SEQ ID NO: 1191535 - RNA, 17 nt, Mycobacterium bovis subsp bovis AF2122/97
gucaacccguaaaagcc

SEQ ID NO: 1191536 - RNA, 11 nt, Mycobacterium bovis subsp bovis AF2122/97
gucaaccugcg

SEQ ID NO: 1191537 - RNA, 18 nt, Mycobacterium bovis subsp bovis AF2122/97
gucaacacccgcccgggc

SEQ ID NO: 1191538 - RNA, 14 nt, Mycobacterium bovis subsp bovis AF2122/97
gucaacaccgcggc

SEQ ID NO: 1191539 - RNA, 17 nt, Mycobacterium bovis subsp bovis AF2122/97
gucaacagauaaggauc

SEQ ID NO: 1191540 - RNA, 12 nt, Mycobacterium bovis subsp bovis AF2122/97
gucaacaggacc

SEQ ID NO: 1191541 - RNA, 18 nt, Mycobacterium bovis subsp bovis AF2122/97
gucaaccaagcgugccug

SEQ ID NO: 1191542 - RNA, 18 nt, Mycobacterium bovis subsp bovis AF2122/97
gucaaccagggugccggc

SEQ ID NO: 1191543 - RNA, 18 nt, Mycobacterium bovis subsp bovis AF2122/97
gucaacccgcaccccggc

SEQ ID NO: 1191544 - RNA, 20 nt, Mycobacterium bovis subsp bovis AF2122/97
gucagaacaccggccaggcc

SEQ ID NO: 1191545 - RNA, 22 nt, Mycobacterium bovis subsp bovis AF2122/97
gucagaauugugugcagcagca

SEQ ID NO: 1191546 - RNA, 14 nt, Mycobacterium bovis subsp bovis AF2122/97
gucagaacggcggc

SEQ ID NO: 1191547 - RNA, 15 nt, Mycobacterium bovis subsp bovis AF2122/97
gucagacgacgauga

SEQ ID NO: 1191548 - RNA, 19 nt, Mycobacterium bovis subsp bovis AF2122/97
gucagacgacgaugaugcc

SEQ ID NO: 1191549 - RNA, 19 nt, Mycobacterium bovis subsp bovis AF2122/97
gucacuacuccggucccgc

SEQ ID NO: 1191550 - RNA, 15 nt, Mycobacterium bovis subsp bovis AF2122/97
gucacucaccccaac

SEQ ID NO: 1191551 - RNA, 22 nt, Mycobacterium bovis subsp bovis AF2122/97
gucacugcccugauugaagccc

SEQ ID NO: 1191552 - RNA, 14 nt, Mycobacterium bovis subsp bovis AF2122/97
gucaccgcgggcau

SEQ ID NO: 1191553 - RNA, 18 nt, Mycobacterium bovis subsp bovis AF2122/97
gucaccgcggguggaugu

SEQ ID NO: 1191554 - RNA, 22 nt, Mycobacterium bovis subsp bovis AF2122/97
gucacccggccguugggccacc

SEQ ID NO: 1191555 - RNA, 22 nt, Mycobacterium bovis subsp bovis AF2122/97
gucaccccuucgccagcgccac

SEQ ID NO: 1191556 - RNA, 20 nt, Mycobacterium bovis subsp bovis AF2122/97
gucacccaucucgaagguga

SEQ ID NO: 1191557 - RNA, 19 nt, Mycobacterium bovis subsp bovis AF2122/97
gucaccccgauucgugucg

SEQ ID NO: 1191558 - RNA, 17 nt, Mycobacterium bovis subsp bovis AF2122/97
gucaccccggcucggcc

SEQ ID NO: 1191559 - RNA, 19 nt, Mycobacterium bovis subsp bovis AF2122/97
gucaccccggucccgccga

SEQ ID NO: 1191560 - RNA, 19 nt, Mycobacterium bovis subsp bovis AF2122/97
gucacaacgcgugaccagg

SEQ ID NO: 1191561 - RNA, 15 nt, Mycobacterium bovis subsp bovis AF2122/97
gucaccgggugcacc

SEQ ID NO: 1191562 - RNA, 14 nt, Mycobacterium bovis subsp bovis AF2122/97
gucaccggcgcacc

SEQ ID NO: 1191563 - RNA, 18 nt, Mycobacterium bovis subsp bovis AF2122/97
gucaccgccguugccgcc

SEQ ID NO: 1191564 - RNA, 23 nt, Mycobacterium bovis subsp bovis AF2122/97
gucaccgcccuugccgccggccc

SEQ ID NO: 1191565 - RNA, 15 nt, Mycobacterium bovis subsp bovis AF2122/97
gucacgcgaccaccg

SEQ ID NO: 1191566 - RNA, 16 nt, Mycobacterium bovis subsp bovis AF2122/97
gucacgggcguuguua

SEQ ID NO: 1191567 - RNA, 13 nt, Mycobacterium bovis subsp bovis AF2122/97
gucacgguggugu

SEQ ID NO: 1191568 - RNA, 18 nt, Mycobacterium bovis subsp bovis AF2122/97
gucaggcccucggguguc

SEQ ID NO: 1191569 - RNA, 19 nt, Mycobacterium bovis subsp bovis AF2122/97
gucaggcagcuccgccgcc

SEQ ID NO: 1191570 - RNA, 16 nt, Mycobacterium bovis subsp bovis AF2122/97
gucaggccuccaaaau

SEQ ID NO: 1191571 - RNA, 17 nt, Mycobacterium bovis subsp bovis AF2122/97
gucaggccuccaaaauc

SEQ ID NO: 1191572 - RNA, 20 nt, Mycobacterium bovis subsp bovis AF2122/97
gucaggccgacuaaccacug

SEQ ID NO: 1191573 - RNA, 17 nt, Mycobacterium bovis subsp bovis AF2122/97
gucaggcuggaggugaa

SEQ ID NO: 1191574 - RNA, 14 nt, Mycobacterium bovis subsp bovis AF2122/97
gucaggcggcuggc

SEQ ID NO: 1191575 - RNA, 22 nt, Mycobacterium bovis subsp bovis AF2122/97
gucaggcucacacucggccggg

SEQ ID NO: 1191576 - RNA, 15 nt, Mycobacterium bovis subsp bovis AF2122/97
gucaggcucauccgc

SEQ ID NO: 1191577 - RNA, 16 nt, Mycobacterium bovis subsp bovis AF2122/97
gucaggcgaaccuggu

SEQ ID NO: 1191578 - RNA, 20 nt, Mycobacterium bovis subsp bovis AF2122/97
gucaggcgugccggggauau

SEQ ID NO: 1191579 - RNA, 13 nt, Mycobacterium bovis subsp bovis AF2122/97
gucaggcggcgga

SEQ ID NO: 1191580 - RNA, 17 nt, Mycobacterium bovis subsp bovis AF2122/97
gucagcggcucggcggg

SEQ ID NO: 1191581 - RNA, 22 nt, Mycobacterium bovis subsp bovis AF2122/97
gucagcggcucggcgggggacc

SEQ ID NO: 1191582 - RNA, 14 nt, Mycobacterium bovis subsp bovis AF2122/97
gucagcggcugggc

SEQ ID NO: 1191583 - RNA, 18 nt, Mycobacterium bovis subsp bovis AF2122/97
gucagcggcugggcgguc

SEQ ID NO: 1191584 - RNA, 16 nt, Mycobacterium bovis subsp bovis AF2122/97
gucagcgcggcgcaca

SEQ ID NO: 1191585 - RNA, 14 nt, Mycobacterium bovis subsp bovis AF2122/97
gucagcgggcagca

SEQ ID NO: 1191586 - RNA, 12 nt, Mycobacterium bovis subsp bovis AF2122/97
gucagcgcgucg

SEQ ID NO: 1191587 - RNA, 14 nt, Mycobacterium bovis subsp bovis AF2122/97
gucagcgugcaggu

SEQ ID NO: 1191588 - RNA, 20 nt, Mycobacterium bovis subsp bovis AF2122/97
gucagcguggacgcccgccc

SEQ ID NO: 1191589 - RNA, 20 nt, Mycobacterium bovis subsp bovis AF2122/97
gucagccugccagguacuca

SEQ ID NO: 1191590 - RNA, 12 nt, Mycobacterium bovis subsp bovis AF2122/97
gucagccgaugg

SEQ ID NO: 1191591 - RNA, 15 nt, Mycobacterium bovis subsp bovis AF2122/97
gucagccugccaggu

SEQ ID NO: 1191592 - RNA, 20 nt, Mycobacterium bovis subsp bovis AF2122/97
gucagcgaacggccaggaca

SEQ ID NO: 1191593 - RNA, 14 nt, Mycobacterium bovis subsp bovis AF2122/97
gucagcagaugggc

SEQ ID NO: 1191594 - RNA, 16 nt, Mycobacterium bovis subsp bovis AF2122/97
gucagcaccaccagca

SEQ ID NO: 1191595 - RNA, 23 nt, Mycobacterium bovis subsp bovis AF2122/97
gucagcacaugguccaaccagca

SEQ ID NO: 1191596 - RNA, 24 nt, Mycobacterium bovis subsp bovis AF2122/97
gucagcaauacggcggcgccgccc

SEQ ID NO: 1191597 - RNA, 22 nt, Mycobacterium bovis subsp bovis AF2122/97
gucagcacccaacccggcggca

SEQ ID NO: 1191598 - RNA, 17 nt, Mycobacterium bovis subsp bovis AF2122/97
gucagcagcuccacugg

SEQ ID NO: 1191599 - RNA, 21 nt, Mycobacterium bovis subsp bovis AF2122/97
gucagcaugggaauccgcugu

SEQ ID NO: 1191600 - RNA, 19 nt, Mycobacterium bovis subsp bovis AF2122/97
gucagccaccaucuggaug

SEQ ID NO: 1191601 - RNA, 21 nt, Mycobacterium bovis subsp bovis AF2122/97
gucagcccgauacgggugugg

SEQ ID NO: 1191602 - RNA, 13 nt, Mycobacterium bovis subsp bovis AF2122/97
gucagcccggcgc

SEQ ID NO: 1191603 - RNA, 17 nt, Mycobacterium bovis subsp bovis AF2122/97
gucagccccgacugcgc

SEQ ID NO: 1191604 - RNA, 17 nt, Mycobacterium bovis subsp bovis AF2122/97
gucagggucagcuggga

SEQ ID NO: 1191605 - RNA, 16 nt, Mycobacterium bovis subsp bovis AF2122/97
gucagggucaccugcg

SEQ ID NO: 1191606 - RNA, 15 nt, Mycobacterium bovis subsp bovis AF2122/97
gucagguacaucccg

SEQ ID NO: 1191607 - RNA, 16 nt, Mycobacterium bovis subsp bovis AF2122/97
gucagguggccaaugc

SEQ ID NO: 1191608 - RNA, 13 nt, Mycobacterium bovis subsp bovis AF2122/97
gucaguagccacg

SEQ ID NO: 1191609 - RNA, 14 nt, Mycobacterium bovis subsp bovis AF2122/97
gucagucaccaacc

SEQ ID NO: 1191610 - RNA, 17 nt, Mycobacterium bovis subsp bovis AF2122/97
gucagugccccgcccgg

SEQ ID NO: 1191611 - RNA, 14 nt, Mycobacterium bovis subsp bovis AF2122/97
gucauacccagcuc

SEQ ID NO: 1191612 - RNA, 19 nt, Mycobacterium bovis subsp bovis AF2122/97
gugcgggggcgaccuggug

SEQ ID NO: 1191613 - RNA, 23 nt, Mycobacterium bovis subsp bovis AF2122/97
gugcggucauauaggagcgggug

SEQ ID NO: 1191614 - RNA, 19 nt, Mycobacterium bovis subsp bovis AF2122/97
gugcggguaauacggcgcc

SEQ ID NO: 1191615 - RNA, 12 nt, Mycobacterium bovis subsp bovis AF2122/97
gugcggcggcug

SEQ ID NO: 1191616 - RNA, 24 nt, Mycobacterium bovis subsp bovis AF2122/97
gugcggcguuaucgucggcuugcu

SEQ ID NO: 1191617 - RNA, 13 nt, Mycobacterium bovis subsp bovis AF2122/97
gugcggcucgccg

SEQ ID NO: 1191618 - RNA, 14 nt, Mycobacterium bovis subsp bovis AF2122/97
gugcggcggcugcc

SEQ ID NO: 1191619 - RNA, 15 nt, Mycobacterium bovis subsp bovis AF2122/97
gugcggccgcggcga

SEQ ID NO: 1191620 - RNA, 21 nt, Mycobacterium bovis subsp bovis AF2122/97
gugcggccguggcguggcuug

SEQ ID NO: 1191621 - RNA, 17 nt, Mycobacterium bovis subsp bovis AF2122/97
gugcggcgaagguagua

SEQ ID NO: 1191622 - RNA, 17 nt, Mycobacterium bovis subsp bovis AF2122/97
gugcgcgaccacccgcc

SEQ ID NO: 1191623 - RNA, 18 nt, Mycobacterium bovis subsp bovis AF2122/97
gugcgcgcaauccugcgg

SEQ ID NO: 1191624 - RNA, 13 nt, Mycobacterium bovis subsp bovis AF2122/97
gugcgcuggaugu

SEQ ID NO: 1191625 - RNA, 23 nt, Mycobacterium bovis subsp bovis AF2122/97
gugcgcuggaugugggcgcucgc

SEQ ID NO: 1191626 - RNA, 15 nt, Mycobacterium bovis subsp bovis AF2122/97
gugcggaacaccgcc

SEQ ID NO: 1191627 - RNA, 20 nt, Mycobacterium bovis subsp bovis AF2122/97
gugcggaagcaucggcugcg

SEQ ID NO: 1191628 - RNA, 13 nt, Mycobacterium bovis subsp bovis AF2122/97
gugcggcagcccg

SEQ ID NO: 1191629 - RNA, 15 nt, Mycobacterium bovis subsp bovis AF2122/97
gugcggcagcccgcu

SEQ ID NO: 1191630 - RNA, 19 nt, Mycobacterium bovis subsp bovis AF2122/97
gugcggaaaccgcuggggg

SEQ ID NO: 1191631 - RNA, 14 nt, Mycobacterium bovis subsp bovis AF2122/97
gugcggacaguucc

SEQ ID NO: 1191632 - RNA, 12 nt, Mycobacterium bovis subsp bovis AF2122/97
gugccgcggcca

SEQ ID NO: 1191633 - RNA, 13 nt, Mycobacterium bovis subsp bovis AF2122/97
gugccgcggccac

SEQ ID NO: 1191634 - RNA, 15 nt, Mycobacterium bovis subsp bovis AF2122/97
gugccgcggccaccg

SEQ ID NO: 1191635 - RNA, 14 nt, Mycobacterium bovis subsp bovis AF2122/97
gugccgcgcagcug

SEQ ID NO: 1191636 - RNA, 23 nt, Mycobacterium bovis subsp bovis AF2122/97
gugccgccugcgccgccagcgcc

SEQ ID NO: 1191637 - RNA, 17 nt, Mycobacterium bovis subsp bovis AF2122/97
gugccgccuccgccugc

SEQ ID NO: 1191638 - RNA, 20 nt, Mycobacterium bovis subsp bovis AF2122/97
gugccgcccaccacacagcc

SEQ ID NO: 1191639 - RNA, 14 nt, Mycobacterium bovis subsp bovis AF2122/97
gugccgccgccggc

SEQ ID NO: 1191640 - RNA, 13 nt, Mycobacterium bovis subsp bovis AF2122/97
gugccgccgaugu

SEQ ID NO: 1191641 - RNA, 15 nt, Mycobacterium bovis subsp bovis AF2122/97
gugccgccggccagu

SEQ ID NO: 1191642 - RNA, 17 nt, Mycobacterium bovis subsp bovis AF2122/97
gugccgccgacaccacc

SEQ ID NO: 1191643 - RNA, 18 nt, Mycobacterium bovis subsp bovis AF2122/97
gugccgcccccggcacag

SEQ ID NO: 1191644 - RNA, 20 nt, Mycobacterium bovis subsp bovis AF2122/97
gugccgcccgccucugucuu

SEQ ID NO: 1191645 - RNA, 17 nt, Mycobacterium bovis subsp bovis AF2122/97
gugccgcccucaccgcc

SEQ ID NO: 1191646 - RNA, 19 nt, Mycobacterium bovis subsp bovis AF2122/97
gugcgacucugcgucugcu

SEQ ID NO: 1191647 - RNA, 19 nt, Mycobacterium bovis subsp bovis AF2122/97
gugcgccggcuggcggccu

SEQ ID NO: 1191648 - RNA, 13 nt, Mycobacterium bovis subsp bovis AF2122/97
gugcgcccgccgg

SEQ ID NO: 1191649 - RNA, 24 nt, Mycobacterium bovis subsp bovis AF2122/97
gugcgccgaauggcggugggcuug

SEQ ID NO: 1191650 - RNA, 23 nt, Mycobacterium bovis subsp bovis AF2122/97
gugcugccaccggccggcgcagu

SEQ ID NO: 1191651 - RNA, 14 nt, Mycobacterium bovis subsp bovis AF2122/97
gugcugcgcgcggc

SEQ ID NO: 1191652 - RNA, 17 nt, Mycobacterium bovis subsp bovis AF2122/97
gugcugcgcugucuugc

SEQ ID NO: 1191653 - RNA, 14 nt, Mycobacterium bovis subsp bovis AF2122/97
gugcugcuagccag

SEQ ID NO: 1191654 - RNA, 18 nt, Mycobacterium bovis subsp bovis AF2122/97
gugcuggucgccgcggca

SEQ ID NO: 1191655 - RNA, 20 nt, Mycobacterium bovis subsp bovis AF2122/97
gugcuggggguaccucccgc

SEQ ID NO: 1191656 - RNA, 11 nt, Mycobacterium bovis subsp bovis AF2122/97
gugcuggcagg

SEQ ID NO: 1191657 - RNA, 21 nt, Mycobacterium bovis subsp bovis AF2122/97
gugcugagucgguucagccac

SEQ ID NO: 1191658 - RNA, 15 nt, Mycobacterium bovis subsp bovis AF2122/97
gugcugaccccgccg

SEQ ID NO: 1191659 - RNA, 17 nt, Mycobacterium bovis subsp bovis AF2122/97
gugcugaccccgccggc

SEQ ID NO: 1191660 - RNA, 18 nt, Mycobacterium bovis subsp bovis AF2122/97
gugcugcaccgauucggg

SEQ ID NO: 1191661 - RNA, 20 nt, Mycobacterium bovis subsp bovis AF2122/97
gugcucggucgaugcucagu

SEQ ID NO: 1191662 - RNA, 22 nt, Mycobacterium bovis subsp bovis AF2122/97
gugcucggucgaugcucagugc

SEQ ID NO: 1191663 - RNA, 17 nt, Mycobacterium bovis subsp bovis AF2122/97
gugcucgucguacaugg

SEQ ID NO: 1191664 - RNA, 21 nt, Mycobacterium bovis subsp bovis AF2122/97
gugcucggaggcgaucaggau

SEQ ID NO: 1191665 - RNA, 22 nt, Mycobacterium bovis subsp bovis AF2122/97
gugcucggaucggcucgccacc

SEQ ID NO: 1191666 - RNA, 13 nt, Mycobacterium bovis subsp bovis AF2122/97
gugcguccgcaac

SEQ ID NO: 1191667 - RNA, 14 nt, Mycobacterium bovis subsp bovis AF2122/97
gugcguccggugcu

SEQ ID NO: 1191668 - RNA, 17 nt, Mycobacterium bovis subsp bovis AF2122/97
gugcguccggugcuggu

SEQ ID NO: 1191669 - RNA, 20 nt, Mycobacterium bovis subsp bovis AF2122/97
gugcguagcccacccgggug

SEQ ID NO: 1191670 - RNA, 16 nt, Mycobacterium bovis subsp bovis AF2122/97
gugcggugaccgugaa

SEQ ID NO: 1191671 - RNA, 18 nt, Mycobacterium bovis subsp bovis AF2122/97
gugcggugccguggugga

SEQ ID NO: 1191672 - RNA, 13 nt, Mycobacterium bovis subsp bovis AF2122/97
gugcgguggcagg

SEQ ID NO: 1191673 - RNA, 16 nt, Mycobacterium bovis subsp bovis AF2122/97
gugcguuggaugaagu

SEQ ID NO: 1191674 - RNA, 15 nt, Mycobacterium bovis subsp bovis AF2122/97
gugcguugucggcug

SEQ ID NO: 1191675 - RNA, 18 nt, Mycobacterium bovis subsp bovis AF2122/97
gugcguguaccugcccag

SEQ ID NO: 1191676 - RNA, 21 nt, Mycobacterium bovis subsp bovis AF2122/97
gugcuacccauucggcggcgg

SEQ ID NO: 1191677 - RNA, 15 nt, Mycobacterium bovis subsp bovis AF2122/97
gugccagcagcagcg

SEQ ID NO: 1191678 - RNA, 15 nt, Mycobacterium bovis subsp bovis AF2122/97
gugcccaggaaggcg

SEQ ID NO: 1191679 - RNA, 15 nt, Mycobacterium bovis subsp bovis AF2122/97
gugcccaugaugcuc

SEQ ID NO: 1191680 - RNA, 11 nt, Mycobacterium bovis subsp bovis AF2122/97
gugccccgccg

SEQ ID NO: 1191681 - RNA, 14 nt, Mycobacterium bovis subsp bovis AF2122/97
gugccccgccgagc

SEQ ID NO: 1191682 - RNA, 19 nt, Mycobacterium bovis subsp bovis AF2122/97
gugcccgcacugccgccgg

SEQ ID NO: 1191683 - RNA, 20 nt, Mycobacterium bovis subsp bovis AF2122/97
gugcccgccagucccccgcu

SEQ ID NO: 1191684 - RNA, 11 nt, Mycobacterium bovis subsp bovis AF2122/97
gugcccgccgg

SEQ ID NO: 1191685 - RNA, 20 nt, Mycobacterium bovis subsp bovis AF2122/97
gugccccggcgguaccggag

SEQ ID NO: 1191686 - RNA, 19 nt, Mycobacterium bovis subsp bovis AF2122/97
gugccgcccaccacacagc

SEQ ID NO: 1191687 - RNA, 15 nt, Mycobacterium bovis subsp bovis AF2122/97
gugccgaaguggagc

SEQ ID NO: 1191688 - RNA, 19 nt, Mycobacterium bovis subsp bovis AF2122/97
gugcccugccggcagcggc

SEQ ID NO: 1191689 - RNA, 21 nt, Mycobacterium bovis subsp bovis AF2122/97
gugcccuguccggcgccgagg

SEQ ID NO: 1191690 - RNA, 16 nt, Mycobacterium bovis subsp bovis AF2122/97
gugccgaacgccagac

SEQ ID NO: 1191691 - RNA, 23 nt, Mycobacterium bovis subsp bovis AF2122/97
gugcccgcgaacgaucccgccga

SEQ ID NO: 1191692 - RNA, 21 nt, Mycobacterium bovis subsp bovis AF2122/97
gugcccgcgcggcgcauuccg

SEQ ID NO: 1191693 - RNA, 16 nt, Mycobacterium bovis subsp bovis AF2122/97
gugcccgcguugccaa

SEQ ID NO: 1191694 - RNA, 16 nt, Mycobacterium bovis subsp bovis AF2122/97
gugcccggccaaaaug

SEQ ID NO: 1191695 - RNA, 17 nt, Mycobacterium bovis subsp bovis AF2122/97
gugcccgggaccauagc

SEQ ID NO: 1191696 - RNA, 21 nt, Mycobacterium bovis subsp bovis AF2122/97
gugccaaagcggcaugcagau

SEQ ID NO: 1191697 - RNA, 19 nt, Mycobacterium bovis subsp bovis AF2122/97
gugccaauuccagcccccc

SEQ ID NO: 1191698 - RNA, 16 nt, Mycobacterium bovis subsp bovis AF2122/97
gugccaccgcgacggc

SEQ ID NO: 1191699 - RNA, 20 nt, Mycobacterium bovis subsp bovis AF2122/97
gugccaccgcgacggcaggc

SEQ ID NO: 1191700 - RNA, 20 nt, Mycobacterium bovis subsp bovis AF2122/97
gugccacuucuucacuggcg

SEQ ID NO: 1191701 - RNA, 15 nt, Mycobacterium bovis subsp bovis AF2122/97
gugccaccggcuggu

SEQ ID NO: 1191702 - RNA, 17 nt, Mycobacterium bovis subsp bovis AF2122/97
gugccaccggcuggugc

SEQ ID NO: 1191703 - RNA, 17 nt, Mycobacterium bovis subsp bovis AF2122/97
gugccaccugggcgggc

SEQ ID NO: 1191704 - RNA, 15 nt, Mycobacterium bovis subsp bovis AF2122/97
gugccacgaucggcg

SEQ ID NO: 1191705 - RNA, 20 nt, Mycobacterium bovis subsp bovis AF2122/97
gugccagcaggccgaagaaa

SEQ ID NO: 1191706 - RNA, 14 nt, Mycobacterium bovis subsp bovis AF2122/97
gugccagcagggga

SEQ ID NO: 1191707 - RNA, 21 nt, Mycobacterium bovis subsp bovis AF2122/97
gugcagacaggcggcggccug

SEQ ID NO: 1191708 - RNA, 22 nt, Mycobacterium bovis subsp bovis AF2122/97
gugcagacaggcggcggccugg

SEQ ID NO: 1191709 - RNA, 19 nt, Mycobacterium bovis subsp bovis AF2122/97
gugcagaccaccgccugga

SEQ ID NO: 1191710 - RNA, 15 nt, Mycobacterium bovis subsp bovis AF2122/97
gugcagcagcgcgcg

SEQ ID NO: 1191711 - RNA, 17 nt, Mycobacterium bovis subsp bovis AF2122/97
gugcagcaccagccacg

SEQ ID NO: 1191712 - RNA, 14 nt, Mycobacterium bovis subsp bovis AF2122/97
gugcagcaccagcc

SEQ ID NO: 1191713 - RNA, 16 nt, Mycobacterium bovis subsp bovis AF2122/97
gugcagaucgucgccg

SEQ ID NO: 1191714 - RNA, 23 nt, Mycobacterium bovis subsp bovis AF2122/97
gugcagcaggaaguagccgagcc

SEQ ID NO: 1191715 - RNA, 14 nt, Mycobacterium bovis subsp bovis AF2122/97
gugcacaacgccca

SEQ ID NO: 1191716 - RNA, 15 nt, Mycobacterium bovis subsp bovis AF2122/97
gugauggugugcagc

SEQ ID NO: 1191717 - RNA, 22 nt, Mycobacterium bovis subsp bovis AF2122/97
gugauggugacuucgguggcgg

SEQ ID NO: 1191718 - RNA, 21 nt, Mycobacterium bovis subsp bovis AF2122/97
gugaugguucaaugccauguu

SEQ ID NO: 1191719 - RNA, 17 nt, Mycobacterium bovis subsp bovis AF2122/97
gugauguagggcugcuc

SEQ ID NO: 1191720 - RNA, 15 nt, Mycobacterium bovis subsp bovis AF2122/97
gugauucggccugag

SEQ ID NO: 1191721 - RNA, 16 nt, Mycobacterium bovis subsp bovis AF2122/97
gugauugagcucaggu

SEQ ID NO: 1191722 - RNA, 19 nt, Mycobacterium bovis subsp bovis AF2122/97
gugauugcgcgggcaucgu

SEQ ID NO: 1191723 - RNA, 19 nt, Mycobacterium bovis subsp bovis AF2122/97
gugaugggggagccgguga

SEQ ID NO: 1191724 - RNA, 22 nt, Mycobacterium bovis subsp bovis AF2122/97
gugaugggggagccggugacgg

SEQ ID NO: 1191725 - RNA, 18 nt, Mycobacterium bovis subsp bovis AF2122/97
gugaugccacggcgucgc

SEQ ID NO: 1191726 - RNA, 17 nt, Mycobacterium bovis subsp bovis AF2122/97
gugaugcccugggggug

SEQ ID NO: 1191727 - RNA, 19 nt, Mycobacterium bovis subsp bovis AF2122/97
gugaugcccuggggguggc

SEQ ID NO: 1191728 - RNA, 17 nt, Mycobacterium bovis subsp bovis AF2122/97
gugaugcaugcuaggca

SEQ ID NO: 1191729 - RNA, 14 nt, Mycobacterium bovis subsp bovis AF2122/97
gugaugagucaggc

SEQ ID NO: 1191730 - RNA, 19 nt, Mycobacterium bovis subsp bovis AF2122/97
gugaugaauucgcuugcag

SEQ ID NO: 1191731 - RNA, 19 nt, Mycobacterium bovis subsp bovis AF2122/97
gucgcugccgccgccggcg

SEQ ID NO: 1191732 - RNA, 15 nt, Mycobacterium bovis subsp bovis AF2122/97
gucgcugcggcgcug

SEQ ID NO: 1191733 - RNA, 20 nt, Mycobacterium bovis subsp bovis AF2122/97
gucgcugcggcgcuggccag

SEQ ID NO: 1191734 - RNA, 19 nt, Mycobacterium bovis subsp bovis AF2122/97
gucgcgggcgauggcgagc

SEQ ID NO: 1191735 - RNA, 21 nt, Mycobacterium bovis subsp bovis AF2122/97
gucgcgggcgauggcgagcug

SEQ ID NO: 1191736 - RNA, 15 nt, Mycobacterium bovis subsp bovis AF2122/97
gucgcgggccaccgc

SEQ ID NO: 1191737 - RNA, 19 nt, Mycobacterium bovis subsp bovis AF2122/97
gucgcugacgcccuccugg

SEQ ID NO: 1191738 - RNA, 15 nt, Mycobacterium bovis subsp bovis AF2122/97
gucgcugggaggcgc

SEQ ID NO: 1191739 - RNA, 21 nt, Mycobacterium bovis subsp bovis AF2122/97
gucgcugcugccgcaccggug

SEQ ID NO: 1191740 - RNA, 15 nt, Mycobacterium bovis subsp bovis AF2122/97
gucgcuguccacugc

SEQ ID NO: 1191741 - RNA, 22 nt, Mycobacterium bovis subsp bovis AF2122/97
guggcgauuucggcgccuggcg

SEQ ID NO: 1191742 - RNA, 12 nt, Mycobacterium bovis subsp bovis AF2122/97
guggcgacggcg

SEQ ID NO: 1191743 - RNA, 13 nt, Mycobacterium bovis subsp bovis AF2122/97
guggcgagcgccu

SEQ ID NO: 1191744 - RNA, 14 nt, Mycobacterium bovis subsp bovis AF2122/97
guggcccccgccgg

SEQ ID NO: 1191745 - RNA, 19 nt, Mycobacterium bovis subsp bovis AF2122/97
guggcccccgccggccacg

SEQ ID NO: 1191746 - RNA, 19 nt, Mycobacterium bovis subsp bovis AF2122/97
guggcccgaccgggaacca

SEQ ID NO: 1191747 - RNA, 23 nt, Mycobacterium bovis subsp bovis AF2122/97
guggccagaucgaacgcagccag

SEQ ID NO: 1191748 - RNA, 13 nt, Mycobacterium bovis subsp bovis AF2122/97
guggccuucuggu

SEQ ID NO: 1191749 - RNA, 14 nt, Mycobacterium bovis subsp bovis AF2122/97
guggcccgcgguga

SEQ ID NO: 1191750 - RNA, 13 nt, Mycobacterium bovis subsp bovis AF2122/97
guggcggacggcg

SEQ ID NO: 1191751 - RNA, 12 nt, Mycobacterium bovis subsp bovis AF2122/97
guggcggccucc

SEQ ID NO: 1191752 - RNA, 12 nt, Mycobacterium bovis subsp bovis AF2122/97
guggcggccagu

SEQ ID NO: 1191753 - RNA, 12 nt, Mycobacterium bovis subsp bovis AF2122/97
guggcgcgggcc

SEQ ID NO: 1191754 - RNA, 20 nt, Mycobacterium bovis subsp bovis AF2122/97
guggcgccgaacgccagcag

SEQ ID NO: 1191755 - RNA, 14 nt, Mycobacterium bovis subsp bovis AF2122/97
guggcgccacggca

SEQ ID NO: 1191756 - RNA, 21 nt, Mycobacterium bovis subsp bovis AF2122/97
guggcgccauccccgccggcg

SEQ ID NO: 1191757 - RNA, 19 nt, Mycobacterium bovis subsp bovis AF2122/97
guggaugccgacggcgggc

SEQ ID NO: 1191758 - RNA, 23 nt, Mycobacterium bovis subsp bovis AF2122/97
guggaugcgccgcacggcgacgc

SEQ ID NO: 1191759 - RNA, 13 nt, Mycobacterium bovis subsp bovis AF2122/97
guggaucugaaga

SEQ ID NO: 1191760 - RNA, 16 nt, Mycobacterium bovis subsp bovis AF2122/97
guggaugaacaccuca

SEQ ID NO: 1191761 - RNA, 15 nt, Mycobacterium bovis subsp bovis AF2122/97
gugcuggugggccgg

SEQ ID NO: 1191762 - RNA, 21 nt, Mycobacterium bovis subsp bovis AF2122/97
gugcuggugggccggaccuug

SEQ ID NO: 1191763 - RNA, 22 nt, Mycobacterium bovis subsp bovis AF2122/97
gugcuguuugguugcgccagga

SEQ ID NO: 1191764 - RNA, 14 nt, Mycobacterium bovis subsp bovis AF2122/97
guggccagcaggcg

SEQ ID NO: 1191765 - RNA, 13 nt, Mycobacterium bovis subsp bovis AF2122/97
guggccagcgcgg

SEQ ID NO: 1191766 - RNA, 14 nt, Mycobacterium bovis subsp bovis AF2122/97
guggcaaucgagga

SEQ ID NO: 1191767 - RNA, 16 nt, Mycobacterium bovis subsp bovis AF2122/97
guggccaaccaaccgg

SEQ ID NO: 1191768 - RNA, 18 nt, Mycobacterium bovis subsp bovis AF2122/97
guggccaauccggcggcg

SEQ ID NO: 1191769 - RNA, 19 nt, Mycobacterium bovis subsp bovis AF2122/97
guggauggccgccaggcgc

SEQ ID NO: 1191770 - RNA, 15 nt, Mycobacterium bovis subsp bovis AF2122/97
guggaugugugaguc

SEQ ID NO: 1191771 - RNA, 18 nt, Mycobacterium bovis subsp bovis AF2122/97
guggauucgaucaggccu

SEQ ID NO: 1191772 - RNA, 21 nt, Mycobacterium bovis subsp bovis AF2122/97
guggauucgaucaggccuugg

SEQ ID NO: 1191773 - RNA, 15 nt, Mycobacterium bovis subsp bovis AF2122/97
gugggguugcgcggu

SEQ ID NO: 1191774 - RNA, 14 nt, Mycobacterium bovis subsp bovis AF2122/97
gugggguggggagc

SEQ ID NO: 1191775 - RNA, 20 nt, Mycobacterium bovis subsp bovis AF2122/97
gugggucaacgucaggcccu

SEQ ID NO: 1191776 - RNA, 20 nt, Mycobacterium bovis subsp bovis AF2122/97
gugggugaaccggaccuggg

SEQ ID NO: 1191777 - RNA, 16 nt, Mycobacterium bovis subsp bovis AF2122/97
gugguaccggcggcgc

SEQ ID NO: 1191778 - RNA, 23 nt, Mycobacterium bovis subsp bovis AF2122/97
gugguaccaacgcuucugccugc

SEQ ID NO: 1191779 - RNA, 21 nt, Mycobacterium bovis subsp bovis AF2122/97
gugguagcgacgauguuggug

SEQ ID NO: 1191780 - RNA, 21 nt, Mycobacterium bovis subsp bovis AF2122/97
guggguuuacgcugccgcagc

SEQ ID NO: 1191781 - RNA, 19 nt, Mycobacterium bovis subsp bovis AF2122/97
guggguguugaugggcagc

SEQ ID NO: 1191782 - RNA, 22 nt, Mycobacterium bovis subsp bovis AF2122/97
guggguguuuuugcgggugguc

SEQ ID NO: 1191783 - RNA, 20 nt, Mycobacterium bovis subsp bovis AF2122/97
guggcuauuccgacucgagu

SEQ ID NO: 1191784 - RNA, 23 nt, Mycobacterium bovis subsp bovis AF2122/97
guggcucggcggguauauggugc

SEQ ID NO: 1191785 - RNA, 14 nt, Mycobacterium bovis subsp bovis AF2122/97
guggcucggguggu

SEQ ID NO: 1191786 - RNA, 19 nt, Mycobacterium bovis subsp bovis AF2122/97
guggcugaucccggccagg

SEQ ID NO: 1191787 - RNA, 22 nt, Mycobacterium bovis subsp bovis AF2122/97
guggcugcgauuuucggcacgg

SEQ ID NO: 1191788 - RNA, 14 nt, Mycobacterium bovis subsp bovis AF2122/97
guggcugcuggcgc

SEQ ID NO: 1191789 - RNA, 16 nt, Mycobacterium bovis subsp bovis AF2122/97
guggcuuugacugcug

SEQ ID NO: 1191790 - RNA, 20 nt, Mycobacterium bovis subsp bovis AF2122/97
guggcuuugacugcuggggg

SEQ ID NO: 1191791 - RNA, 17 nt, Mycobacterium bovis subsp bovis AF2122/97
gugggcuuggcuguggu

SEQ ID NO: 1191792 - RNA, 21 nt, Mycobacterium bovis subsp bovis AF2122/97
guggggaucacgaucacacca

SEQ ID NO: 1191793 - RNA, 14 nt, Mycobacterium bovis subsp bovis AF2122/97
guggggccggcggu

SEQ ID NO: 1191794 - RNA, 17 nt, Mycobacterium bovis subsp bovis AF2122/97
guggggccggggucggc

SEQ ID NO: 1191795 - RNA, 22 nt, Mycobacterium bovis subsp bovis AF2122/97
guggggccguguucuaccugca

SEQ ID NO: 1191796 - RNA, 15 nt, Mycobacterium bovis subsp bovis AF2122/97
guggggcgcgccggc

SEQ ID NO: 1191797 - RNA, 22 nt, Mycobacterium bovis subsp bovis AF2122/97
guggucaccccuucgccagcgc

SEQ ID NO: 1191798 - RNA, 21 nt, Mycobacterium bovis subsp bovis AF2122/97
guggucuuggcgguggcccga

SEQ ID NO: 1191799 - RNA, 13 nt, Mycobacterium bovis subsp bovis AF2122/97
guggugaguacca

SEQ ID NO: 1191800 - RNA, 23 nt, Mycobacterium bovis subsp bovis AF2122/97
guggugcaccgauuccagcggaa

SEQ ID NO: 1191801 - RNA, 22 nt, Mycobacterium bovis subsp bovis AF2122/97
guggugauccagccgucggcgc

SEQ ID NO: 1191802 - RNA, 16 nt, Mycobacterium bovis subsp bovis AF2122/97
gugguggacgaugcgg

SEQ ID NO: 1191803 - RNA, 16 nt, Mycobacterium bovis subsp bovis AF2122/97
guggugccaaccuggg

SEQ ID NO: 1191804 - RNA, 12 nt, Mycobacterium bovis subsp bovis AF2122/97
gugguucccggc

SEQ ID NO: 1191805 - RNA, 18 nt, Mycobacterium bovis subsp bovis AF2122/97
gugguuccggcugguggg

SEQ ID NO: 1191806 - RNA, 15 nt, Mycobacterium bovis subsp bovis AF2122/97
guggugggcguggcu

SEQ ID NO: 1191807 - RNA, 20 nt, Mycobacterium bovis subsp bovis AF2122/97
gugguguccaccgcaucggu

SEQ ID NO: 1191808 - RNA, 16 nt, Mycobacterium bovis subsp bovis AF2122/97
gugguggugaugggca

SEQ ID NO: 1191809 - RNA, 14 nt, Mycobacterium bovis subsp bovis AF2122/97
gugguguuccaggu

SEQ ID NO: 1191810 - RNA, 13 nt, Mycobacterium bovis subsp bovis AF2122/97
guguacuggucug

SEQ ID NO: 1191811 - RNA, 12 nt, Mycobacterium bovis subsp bovis AF2122/97
guguacccgccu

SEQ ID NO: 1191812 - RNA, 14 nt, Mycobacterium bovis subsp bovis AF2122/97
gugugacggcggcc

SEQ ID NO: 1191813 - RNA, 16 nt, Mycobacterium bovis subsp bovis AF2122/97
gugugcgcaugguggg

SEQ ID NO: 1191814 - RNA, 12 nt, Mycobacterium bovis subsp bovis AF2122/97
gugugcgugcgg

SEQ ID NO: 1191815 - RNA, 16 nt, Mycobacterium bovis subsp bovis AF2122/97
gugugcgugcggucga

SEQ ID NO: 1191816 - RNA, 16 nt, Mycobacterium bovis subsp bovis AF2122/97
gugugggccccgccga

SEQ ID NO: 1191817 - RNA, 16 nt, Mycobacterium bovis subsp bovis AF2122/97
gugugggggucagggg

SEQ ID NO: 1191818 - RNA, 17 nt, Mycobacterium bovis subsp bovis AF2122/97
guguggucauuggggug

SEQ ID NO: 1191819 - RNA, 22 nt, Mycobacterium bovis subsp bovis AF2122/97
guguggucccggcacgaccacc

SEQ ID NO: 1191820 - RNA, 17 nt, Mycobacterium bovis subsp bovis AF2122/97
guguggucggcuguggu

SEQ ID NO: 1191821 - RNA, 18 nt, Mycobacterium bovis subsp bovis AF2122/97
guguggucggcuguggug

SEQ ID NO: 1191822 - RNA, 22 nt, Mycobacterium bovis subsp bovis AF2122/97
gugugugcaagccgaacaccgu

SEQ ID NO: 1191823 - RNA, 18 nt, Mycobacterium bovis subsp bovis AF2122/97
guguuucgugccaugguu

SEQ ID NO: 1191824 - RNA, 16 nt, Mycobacterium bovis subsp bovis AF2122/97
guguuuggguuuuguu

SEQ ID NO: 1191825 - RNA, 15 nt, Mycobacterium bovis subsp bovis AF2122/97
guguuguuagccccg

SEQ ID NO: 1191826 - RNA, 15 nt, Mycobacterium bovis subsp bovis AF2122/97
guguuuaugguugug

SEQ ID NO: 1191827 - RNA, 14 nt, Mycobacterium bovis subsp bovis AF2122/97
guguuaaagaagcc

SEQ ID NO: 1191828 - RNA, 15 nt, Mycobacterium bovis subsp bovis AF2122/97
guguguuuggugguu

SEQ ID NO: 1191829 - RNA, 13 nt, Mycobacterium bovis subsp bovis AF2122/97
guguugcgguggg

SEQ ID NO: 1191830 - RNA, 14 nt, Mycobacterium bovis subsp bovis AF2122/97
guguugcucccggc

SEQ ID NO: 1191831 - RNA, 21 nt, Mycobacterium bovis subsp bovis AF2122/97
guguugcgcugcggccagcgc

SEQ ID NO: 1191832 - RNA, 24 nt, Mycobacterium bovis subsp bovis AF2122/97
guguugcccgaccacaccgggaug

SEQ ID NO: 1191833 - RNA, 19 nt, Mycobacterium bovis subsp bovis AF2122/97
guguugacgauccggucgg

SEQ ID NO: 1191834 - RNA, 20 nt, Mycobacterium bovis subsp bovis AF2122/97
guuacguuguacucgugcgg

SEQ ID NO: 1191835 - RNA, 21 nt, Mycobacterium bovis subsp bovis AF2122/97
guucgaguccccuuagcucca

SEQ ID NO: 1191836 - RNA, 15 nt, Mycobacterium bovis subsp bovis AF2122/97
guucgaugaaaaugc

SEQ ID NO: 1191837 - RNA, 14 nt, Mycobacterium bovis subsp bovis AF2122/97
guucgauagcggcg

SEQ ID NO: 1191838 - RNA, 23 nt, Mycobacterium bovis subsp bovis AF2122/97
guucgcccgcccgucuuccagcc

SEQ ID NO: 1191839 - RNA, 21 nt, Mycobacterium bovis subsp bovis AF2122/97
guucgcccgucgccaaucugc

SEQ ID NO: 1191840 - RNA, 19 nt, Mycobacterium bovis subsp bovis AF2122/97
guucgccgcgcagcgugcg

SEQ ID NO: 1191841 - RNA, 14 nt, Mycobacterium bovis subsp bovis AF2122/97
guucgccuggucac

SEQ ID NO: 1191842 - RNA, 19 nt, Mycobacterium bovis subsp bovis AF2122/97
guucgcgggugcgcugcag

SEQ ID NO: 1191843 - RNA, 12 nt, Mycobacterium bovis subsp bovis AF2122/97
guucgcuccccc

SEQ ID NO: 1191844 - RNA, 15 nt, Mycobacterium bovis subsp bovis AF2122/97
guucgcucccccgcu

SEQ ID NO: 1191845 - RNA, 16 nt, Mycobacterium bovis subsp bovis AF2122/97
guucccgcucgggcaa

SEQ ID NO: 1191846 - RNA, 16 nt, Mycobacterium bovis subsp bovis AF2122/97
guucccgggcagccgc

SEQ ID NO: 1191847 - RNA, 15 nt, Mycobacterium bovis subsp bovis AF2122/97
guucccgccggcgcc

SEQ ID NO: 1191848 - RNA, 22 nt, Mycobacterium bovis subsp bovis AF2122/97
guuccgugcagaaaccaggacc

SEQ ID NO: 1191849 - RNA, 19 nt, Mycobacterium bovis subsp bovis AF2122/97
guuccgugcgggucguccg

SEQ ID NO: 1191850 - RNA, 16 nt, Mycobacterium bovis subsp bovis AF2122/97
guuccccgucgccagg

SEQ ID NO: 1191851 - RNA, 16 nt, Mycobacterium bovis subsp bovis AF2122/97
guucccccggcaccgc

SEQ ID NO: 1191852 - RNA, 21 nt, Mycobacterium bovis subsp bovis AF2122/97
guuccccgagaacggcgggcg

SEQ ID NO: 1191853 - RNA, 18 nt, Mycobacterium bovis subsp bovis AF2122/97
guuccaccgcgcaggugc

SEQ ID NO: 1191854 - RNA, 15 nt, Mycobacterium bovis subsp bovis AF2122/97
guuccacccgguggc

SEQ ID NO: 1191855 - RNA, 16 nt, Mycobacterium bovis subsp bovis AF2122/97
guuccacgacaaccgu

SEQ ID NO: 1191856 - RNA, 14 nt, Mycobacterium bovis subsp bovis AF2122/97
guuccaacuccugc

SEQ ID NO: 1191857 - RNA, 16 nt, Mycobacterium bovis subsp bovis AF2122/97
guuccacacccaguug

SEQ ID NO: 1191858 - RNA, 17 nt, Mycobacterium bovis subsp bovis AF2122/97
guuccaacuccugcagc

SEQ ID NO: 1191859 - RNA, 20 nt, Mycobacterium bovis subsp bovis AF2122/97
guuccaacuccugcagcccg

SEQ ID NO: 1191860 - RNA, 14 nt, Mycobacterium bovis subsp bovis AF2122/97
guucagcgcuggca

SEQ ID NO: 1191861 - RNA, 21 nt, Mycobacterium bovis subsp bovis AF2122/97
guucagcgcuggcaggccggg

SEQ ID NO: 1191862 - RNA, 17 nt, Mycobacterium bovis subsp bovis AF2122/97
guucagccaggccgcaa

SEQ ID NO: 1191863 - RNA, 13 nt, Mycobacterium bovis subsp bovis AF2122/97
guucagcaggccc

SEQ ID NO: 1191864 - RNA, 19 nt, Mycobacterium bovis subsp bovis AF2122/97
guucagcaggcccuucagu

SEQ ID NO: 1191865 - RNA, 20 nt, Mycobacterium bovis subsp bovis AF2122/97
guucacguucggcgcugcca

SEQ ID NO: 1191866 - RNA, 20 nt, Mycobacterium bovis subsp bovis AF2122/97
guuagcagccgcugaucugc

SEQ ID NO: 1191867 - RNA, 14 nt, Mycobacterium bovis subsp bovis AF2122/97
guucaugcggcggc

SEQ ID NO: 1191868 - RNA, 22 nt, Mycobacterium bovis subsp bovis AF2122/97
guucagcgccacguccaucacc

SEQ ID NO: 1191869 - RNA, 15 nt, Mycobacterium bovis subsp bovis AF2122/97
guucagcgucgacug

SEQ ID NO: 1191870 - RNA, 19 nt, Mycobacterium bovis subsp bovis AF2122/97
guugauguugccggaguug

SEQ ID NO: 1191871 - RNA, 14 nt, Mycobacterium bovis subsp bovis AF2122/97
guugaucgcggaca

SEQ ID NO: 1191872 - RNA, 18 nt, Mycobacterium bovis subsp bovis AF2122/97
guugcacguucggcgugu

SEQ ID NO: 1191873 - RNA, 13 nt, Mycobacterium bovis subsp bovis AF2122/97
guugcacugcugg

SEQ ID NO: 1191874 - RNA, 15 nt, Mycobacterium bovis subsp bovis AF2122/97
guugcaggcgcagcu

SEQ ID NO: 1191875 - RNA, 19 nt, Mycobacterium bovis subsp bovis AF2122/97
guugacgccgguccccgcc

SEQ ID NO: 1191876 - RNA, 19 nt, Mycobacterium bovis subsp bovis AF2122/97
guugagcagcuugguggcg

SEQ ID NO: 1191877 - RNA, 23 nt, Mycobacterium bovis subsp bovis AF2122/97
guugaggacgagguucugccgcg

SEQ ID NO: 1191878 - RNA, 17 nt, Mycobacterium bovis subsp bovis AF2122/97
guugaggacguggacuu

SEQ ID NO: 1191879 - RNA, 19 nt, Mycobacterium bovis subsp bovis AF2122/97
guugaucgacaucaccacc

SEQ ID NO: 1191880 - RNA, 13 nt, Mycobacterium bovis subsp bovis AF2122/97
guugaucggccac

SEQ ID NO: 1191881 - RNA, 12 nt, Mycobacterium bovis subsp bovis AF2122/97
guugaucagcca

SEQ ID NO: 1191882 - RNA, 14 nt, Mycobacterium bovis subsp bovis AF2122/97
guugauccugcagu

SEQ ID NO: 1191883 - RNA, 16 nt, Mycobacterium bovis subsp bovis AF2122/97
guucuucuccaccacc

SEQ ID NO: 1191884 - RNA, 15 nt, Mycobacterium bovis subsp bovis AF2122/97
guucgucgggcaugc

SEQ ID NO: 1191885 - RNA, 16 nt, Mycobacterium bovis subsp bovis AF2122/97
guucgugacgugcaug

SEQ ID NO: 1191886 - RNA, 20 nt, Mycobacterium bovis subsp bovis AF2122/97
guugaccagaaccuggagcc

SEQ ID NO: 1191887 - RNA, 22 nt, Mycobacterium bovis subsp bovis AF2122/97
guugaccucuucgggcagcgcg

SEQ ID NO: 1191888 - RNA, 20 nt, Mycobacterium bovis subsp bovis AF2122/97
guugaccaaugucagugccc

SEQ ID NO: 1191889 - RNA, 13 nt, Mycobacterium bovis subsp bovis AF2122/97
guugaaggcuugu

SEQ ID NO: 1191890 - RNA, 21 nt, Mycobacterium bovis subsp bovis AF2122/97
guugaaucccagauaugcagg

SEQ ID NO: 1191891 - RNA, 18 nt, Mycobacterium bovis subsp bovis AF2122/97
guugaacgccgccagcag

SEQ ID NO: 1191892 - RNA, 14 nt, Mycobacterium bovis subsp bovis AF2122/97
guugaacgcgugcu

SEQ ID NO: 1191893 - RNA, 22 nt, Mycobacterium bovis subsp bovis AF2122/97
guugaagaagcccgaguuguuc

SEQ ID NO: 1191894 - RNA, 22 nt, Mycobacterium bovis subsp bovis AF2122/97
guugaagaagccgguguugaug

SEQ ID NO: 1191895 - RNA, 23 nt, Mycobacterium bovis subsp bovis AF2122/97
guugcgcuccaacaacuccagca

SEQ ID NO: 1191896 - RNA, 13 nt, Mycobacterium bovis subsp bovis AF2122/97
guugcgcggauga

SEQ ID NO: 1191897 - RNA, 14 nt, Mycobacterium bovis subsp bovis AF2122/97
guugcgggccaggc

SEQ ID NO: 1191898 - RNA, 19 nt, Mycobacterium bovis subsp bovis AF2122/97
guugcgaagaagaaggcga

SEQ ID NO: 1191899 - RNA, 19 nt, Mycobacterium bovis subsp bovis AF2122/97
guugcucccacggcaccca

SEQ ID NO: 1191900 - RNA, 17 nt, Mycobacterium bovis subsp bovis AF2122/97
guugcuaaacuccgugc

SEQ ID NO: 1191901 - RNA, 22 nt, Mycobacterium bovis subsp bovis AF2122/97
guugcuaaacuccgugccgagc

SEQ ID NO: 1191902 - RNA, 21 nt, Mycobacterium bovis subsp bovis AF2122/97
guugccgcgccacuguagggc

SEQ ID NO: 1191903 - RNA, 14 nt, Mycobacterium bovis subsp bovis AF2122/97
guugccgccgccuc

SEQ ID NO: 1191904 - RNA, 15 nt, Mycobacterium bovis subsp bovis AF2122/97
guugccgccggugcc

SEQ ID NO: 1191905 - RNA, 18 nt, Mycobacterium bovis subsp bovis AF2122/97
guugccggacaaccuggg

SEQ ID NO: 1191906 - RNA, 19 nt, Mycobacterium bovis subsp bovis AF2122/97
guugccguuggugccgccu

SEQ ID NO: 1191907 - RNA, 18 nt, Mycobacterium bovis subsp bovis AF2122/97
guugccgucagggucagc

SEQ ID NO: 1191908 - RNA, 20 nt, Mycobacterium bovis subsp bovis AF2122/97
guugccgaucucgcccagcg

SEQ ID NO: 1191909 - RNA, 18 nt, Mycobacterium bovis subsp bovis AF2122/97
guugccgaucaacccccc

SEQ ID NO: 1191910 - RNA, 22 nt, Mycobacterium bovis subsp bovis AF2122/97
guugccgauccccaggccgcuu

SEQ ID NO: 1191911 - RNA, 19 nt, Mycobacterium bovis subsp bovis AF2122/97
guugccgccauuggcaggc

SEQ ID NO: 1191912 - RNA, 14 nt, Mycobacterium bovis subsp bovis AF2122/97
guugccccgaagcg

SEQ ID NO: 1191913 - RNA, 17 nt, Mycobacterium bovis subsp bovis AF2122/97
guugccccgaccgccgu

SEQ ID NO: 1191914 - RNA, 20 nt, Mycobacterium bovis subsp bovis AF2122/97
guugcccccauugccgccgu

SEQ ID NO: 1191915 - RNA, 16 nt, Mycobacterium bovis subsp bovis AF2122/97
guugcccgacccgccg

SEQ ID NO: 1191916 - RNA, 14 nt, Mycobacterium bovis subsp bovis AF2122/97
guugccaacaacau

SEQ ID NO: 1191917 - RNA, 14 nt, Mycobacterium bovis subsp bovis AF2122/97
guugccaggugcug

SEQ ID NO: 1191918 - RNA, 19 nt, Mycobacterium bovis subsp bovis AF2122/97
guuggccggaucgaagacc

SEQ ID NO: 1191919 - RNA, 23 nt, Mycobacterium bovis subsp bovis AF2122/97
guuggccguggucgagguggggu

SEQ ID NO: 1191920 - RNA, 18 nt, Mycobacterium bovis subsp bovis AF2122/97
guuggcgaacugguagcc

SEQ ID NO: 1191921 - RNA, 19 nt, Mycobacterium bovis subsp bovis AF2122/97
guuggccaccagcuggcga

SEQ ID NO: 1191922 - RNA, 16 nt, Mycobacterium bovis subsp bovis AF2122/97
guuggaucccagcccg

SEQ ID NO: 1191923 - RNA, 21 nt, Mycobacterium bovis subsp bovis AF2122/97
guuggcaaagacgcuggccac

SEQ ID NO: 1191924 - RNA, 13 nt, Mycobacterium bovis subsp bovis AF2122/97
guuggcagggcca

SEQ ID NO: 1191925 - RNA, 20 nt, Mycobacterium bovis subsp bovis AF2122/97
guuggcaaugaccccggcgu

SEQ ID NO: 1191926 - RNA, 14 nt, Mycobacterium bovis subsp bovis AF2122/97
guuggcagcccucu

SEQ ID NO: 1191927 - RNA, 17 nt, Mycobacterium bovis subsp bovis AF2122/97
guugcuggcuggguggc

SEQ ID NO: 1191928 - RNA, 19 nt, Mycobacterium bovis subsp bovis AF2122/97
guugcugaacugguuggug

SEQ ID NO: 1191929 - RNA, 19 nt, Mycobacterium bovis subsp bovis AF2122/97
guugcugcccugguuggug

SEQ ID NO: 1191930 - RNA, 17 nt, Mycobacterium bovis subsp bovis AF2122/97
guuggaagucccgccgu

SEQ ID NO: 1191931 - RNA, 14 nt, Mycobacterium bovis subsp bovis AF2122/97
guuggccugcaacg

SEQ ID NO: 1191932 - RNA, 18 nt, Mycobacterium bovis subsp bovis AF2122/97
guuggcgauccgcggcgu

SEQ ID NO: 1191933 - RNA, 12 nt, Mycobacterium bovis subsp bovis AF2122/97
guuggcggccuc

SEQ ID NO: 1191934 - RNA, 22 nt, Mycobacterium bovis subsp bovis AF2122/97
guuggcguugucgguuggcagc

SEQ ID NO: 1191935 - RNA, 12 nt, Mycobacterium bovis subsp bovis AF2122/97
guugggcggggu

SEQ ID NO: 1191936 - RNA, 17 nt, Mycobacterium bovis subsp bovis AF2122/97
guuggcucggcgcagca

SEQ ID NO: 1191937 - RNA, 19 nt, Mycobacterium bovis subsp bovis AF2122/97
guugguagagcaccagguu

SEQ ID NO: 1191938 - RNA, 17 nt, Mycobacterium bovis subsp bovis AF2122/97
guugguauuagggccgg

SEQ ID NO: 1191939 - RNA, 18 nt, Mycobacterium bovis subsp bovis AF2122/97
guuggucaccaccuggug

SEQ ID NO: 1191940 - RNA, 20 nt, Mycobacterium bovis subsp bovis AF2122/97
guugguggucggcccuccac

SEQ ID NO: 1191941 - RNA, 17 nt, Mycobacterium bovis subsp bovis AF2122/97
guuggugcgggguuggc

SEQ ID NO: 1191942 - RNA, 19 nt, Mycobacterium bovis subsp bovis AF2122/97
guuggucgucgcgugcauc

SEQ ID NO: 1191943 - RNA, 19 nt, Mycobacterium bovis subsp bovis AF2122/97
guuuccgccgccgccgcca

SEQ ID NO: 1191944 - RNA, 19 nt, Mycobacterium bovis subsp bovis AF2122/97
guuuccuccggcagcagca

SEQ ID NO: 1191945 - RNA, 20 nt, Mycobacterium bovis subsp bovis AF2122/97
guuucugagcgcgcuggcca

SEQ ID NO: 1191946 - RNA, 16 nt, Mycobacterium bovis subsp bovis AF2122/97
guuguaccccagcauc

SEQ ID NO: 1191947 - RNA, 22 nt, Mycobacterium bovis subsp bovis AF2122/97
guugucagcgaacggccaggac

SEQ ID NO: 1191948 - RNA, 16 nt, Mycobacterium bovis subsp bovis AF2122/97
guuguuggugccagcc

SEQ ID NO: 1191949 - RNA, 22 nt, Mycobacterium bovis subsp bovis AF2122/97
guuguugggcgagggugaagac

SEQ ID NO: 1191950 - RNA, 22 nt, Mycobacterium bovis subsp bovis AF2122/97
guuuagcaacuacucauccaga

SEQ ID NO: 1191951 - RNA, 16 nt, Mycobacterium bovis subsp bovis AF2122/97
guuugaucgcaacgau

SEQ ID NO: 1191952 - RNA, 23 nt, Mycobacterium bovis subsp bovis AF2122/97
guuugaucuccaccuucuggucc

SEQ ID NO: 1191953 - RNA, 19 nt, Mycobacterium bovis subsp bovis AF2122/97
guuugaggcagcguagugc

SEQ ID NO: 1191954 - RNA, 20 nt, Mycobacterium bovis subsp bovis AF2122/97
uaaaaaggcaggacugaaca

SEQ ID NO: 1191955 - RNA, 23 nt, Mycobacterium bovis subsp bovis AF2122/97
uaaaacucgggggcugcacgcuc

SEQ ID NO: 1191956 - RNA, 21 nt, Mycobacterium bovis subsp bovis AF2122/97
uaaacaaacccaacaccagca

SEQ ID NO: 1191957 - RNA, 22 nt, Mycobacterium bovis subsp bovis AF2122/97
uaaagaucguugccucgucgcc

SEQ ID NO: 1191958 - RNA, 20 nt, Mycobacterium bovis subsp bovis AF2122/97
uaaaccgauaucgcugcgga

SEQ ID NO: 1191959 - RNA, 12 nt, Mycobacterium bovis subsp bovis AF2122/97
uaaaccaggugg

SEQ ID NO: 1191960 - RNA, 22 nt, Mycobacterium bovis subsp bovis AF2122/97
uaaacggcacacgaguacagau

SEQ ID NO: 1191961 - RNA, 13 nt, Mycobacterium bovis subsp bovis AF2122/97
uaacccagcacca

SEQ ID NO: 1191962 - RNA, 13 nt, Mycobacterium bovis subsp bovis AF2122/97
uaacccagcggcg

SEQ ID NO: 1191963 - RNA, 15 nt, Mycobacterium bovis subsp bovis AF2122/97
uaacccagcggcgcc

SEQ ID NO: 1191964 - RNA, 14 nt, Mycobacterium bovis subsp bovis AF2122/97
uaacuggcccggac

SEQ ID NO: 1191965 - RNA, 19 nt, Mycobacterium bovis subsp bovis AF2122/97
uaacacucgaagucgccca

SEQ ID NO: 1191966 - RNA, 16 nt, Mycobacterium bovis subsp bovis AF2122/97
uaaccacggugugcua

SEQ ID NO: 1191967 - RNA, 22 nt, Mycobacterium bovis subsp bovis AF2122/97
uaagccuucggugucgccgaac

SEQ ID NO: 1191968 - RNA, 21 nt, Mycobacterium bovis subsp bovis AF2122/97
uaagcagccagcaacaccaga

SEQ ID NO: 1191969 - RNA, 12 nt, Mycobacterium bovis subsp bovis AF2122/97
uaagcaccagcc

SEQ ID NO: 1191970 - RNA, 17 nt, Mycobacterium bovis subsp bovis AF2122/97
uaagcauucagcgcgcc

SEQ ID NO: 1191971 - RNA, 19 nt, Mycobacterium bovis subsp bovis AF2122/97
uaagcccggucgcugaucc

SEQ ID NO: 1191972 - RNA, 21 nt, Mycobacterium bovis subsp bovis AF2122/97
uaagggucaucgccagcggca

SEQ ID NO: 1191973 - RNA, 14 nt, Mycobacterium bovis subsp bovis AF2122/97
uaagggcacuccac

SEQ ID NO: 1191974 - RNA, 22 nt, Mycobacterium bovis subsp bovis AF2122/97
uaagggcgggcuuggggucccg

SEQ ID NO: 1191975 - RNA, 21 nt, Mycobacterium bovis subsp bovis AF2122/97
uaaggaucagaacgcggccuc

SEQ ID NO: 1191976 - RNA, 16 nt, Mycobacterium bovis subsp bovis AF2122/97
uaaugcugcugcagca

SEQ ID NO: 1191977 - RNA, 15 nt, Mycobacterium bovis subsp bovis AF2122/97
uaauuggcaacacag

SEQ ID NO: 1191978 - RNA, 13 nt, Mycobacterium bovis subsp bovis AF2122/97
uaauugccagccu

SEQ ID NO: 1191979 - RNA, 22 nt, Mycobacterium bovis subsp bovis AF2122/97
uaaucaaggugaucagcaggau

SEQ ID NO: 1191980 - RNA, 13 nt, Mycobacterium bovis subsp bovis AF2122/97
uaaucaagcagcg

SEQ ID NO: 1191981 - RNA, 24 nt, Mycobacterium bovis subsp bovis AF2122/97
uaaucgcgagaccaacauacagca

SEQ ID NO: 1191982 - RNA, 13 nt, Mycobacterium bovis subsp bovis AF2122/97
uaaucguuccgca

SEQ ID NO: 1191983 - RNA, 13 nt, Mycobacterium bovis subsp bovis AF2122/97
uacagcgccaggg

SEQ ID NO: 1191984 - RNA, 15 nt, Mycobacterium bovis subsp bovis AF2122/97
uacagcaauccgcaa

SEQ ID NO: 1191985 - RNA, 16 nt, Mycobacterium bovis subsp bovis AF2122/97
uacagcacauccagcc

SEQ ID NO: 1191986 - RNA, 14 nt, Mycobacterium bovis subsp bovis AF2122/97
uacacuuugcccgc

SEQ ID NO: 1191987 - RNA, 24 nt, Mycobacterium bovis subsp bovis AF2122/97
uacaacgccgucgucguagaacug

SEQ ID NO: 1191988 - RNA, 15 nt, Mycobacterium bovis subsp bovis AF2122/97
uacaacgccgucguc

SEQ ID NO: 1191989 - RNA, 23 nt, Mycobacterium bovis subsp bovis AF2122/97
uacaggcccgccagcagggccag

SEQ ID NO: 1191990 - RNA, 16 nt, Mycobacterium bovis subsp bovis AF2122/97
uaccaauccaggccac

SEQ ID NO: 1191991 - RNA, 20 nt, Mycobacterium bovis subsp bovis AF2122/97
uaccaauucccgcgcggcgu

SEQ ID NO: 1191992 - RNA, 21 nt, Mycobacterium bovis subsp bovis AF2122/97
uaccggcgaucugcugugucg

SEQ ID NO: 1191993 - RNA, 19 nt, Mycobacterium bovis subsp bovis AF2122/97
uaccggcgcauaccggcgu

SEQ ID NO: 1191994 - RNA, 15 nt, Mycobacterium bovis subsp bovis AF2122/97
uaccggcagcugcuc

SEQ ID NO: 1191995 - RNA, 14 nt, Mycobacterium bovis subsp bovis AF2122/97
uaccggcccggguu

SEQ ID NO: 1191996 - RNA, 15 nt, Mycobacterium bovis subsp bovis AF2122/97
uaccguuccacgucg

SEQ ID NO: 1191997 - RNA, 14 nt, Mycobacterium bovis subsp bovis AF2122/97
uaccggcgugcagu

SEQ ID NO: 1191998 - RNA, 18 nt, Mycobacterium bovis subsp bovis AF2122/97
uaccggcgaucugcugug

SEQ ID NO: 1191999 - RNA, 23 nt, Mycobacterium bovis subsp bovis AF2122/97
uaccgucaguagccacgcccaca

SEQ ID NO: 1192000 - RNA, 14 nt, Mycobacterium bovis subsp bovis AF2122/97
uaccggaccccaac

SEQ ID NO: 1192001 - RNA, 19 nt, Mycobacterium bovis subsp bovis AF2122/97
uaccgagauugggcuggga

SEQ ID NO: 1192002 - RNA, 17 nt, Mycobacterium bovis subsp bovis AF2122/97
uaccgagaucaccgcca

SEQ ID NO: 1192003 - RNA, 14 nt, Mycobacterium bovis subsp bovis AF2122/97
uaccgacgcaccuc

SEQ ID NO: 1192004 - RNA, 19 nt, Mycobacterium bovis subsp bovis AF2122/97
uaccucggccgccagcccc

SEQ ID NO: 1192005 - RNA, 13 nt, Mycobacterium bovis subsp bovis AF2122/97
uacccgcagcgug

SEQ ID NO: 1192006 - RNA, 13 nt, Mycobacterium bovis subsp bovis AF2122/97
uacccgccgcgau

SEQ ID NO: 1192007 - RNA, 21 nt, Mycobacterium bovis subsp bovis AF2122/97
uacccgccgcgaugccaccca

SEQ ID NO: 1192008 - RNA, 23 nt, Mycobacterium bovis subsp bovis AF2122/97
uaccccagcaucuuuggcggccg

SEQ ID NO: 1192009 - RNA, 20 nt, Mycobacterium bovis subsp bovis AF2122/97
uaccccagaccgccacacgg

SEQ ID NO: 1192010 - RNA, 12 nt, Mycobacterium bovis subsp bovis AF2122/97
uacccgcuggcc

SEQ ID NO: 1192011 - RNA, 22 nt, Mycobacterium bovis subsp bovis AF2122/97
uacccgcggggaaucacccacu

SEQ ID NO: 1192012 - RNA, 15 nt, Mycobacterium bovis subsp bovis AF2122/97
uacccguagcaccac

SEQ ID NO: 1192013 - RNA, 20 nt, Mycobacterium bovis subsp bovis AF2122/97
uacccguagcaccacaucgg

SEQ ID NO: 1192014 - RNA, 14 nt, Mycobacterium bovis subsp bovis AF2122/97
uacccgggccaggc

SEQ ID NO: 1192015 - RNA, 16 nt, Mycobacterium bovis subsp bovis AF2122/97
uacccgggccaggcug

SEQ ID NO: 1192016 - RNA, 17 nt, Mycobacterium bovis subsp bovis AF2122/97
uacccagcgcagcagcg

SEQ ID NO: 1192017 - RNA, 17 nt, Mycobacterium bovis subsp bovis AF2122/97
uacccaucaacaucggc

SEQ ID NO: 1192018 - RNA, 17 nt, Mycobacterium bovis subsp bovis AF2122/97
uacccaucgccacaccc

SEQ ID NO: 1192019 - RNA, 15 nt, Mycobacterium bovis subsp bovis AF2122/97
uaccacauaccccga

SEQ ID NO: 1192020 - RNA, 21 nt, Mycobacterium bovis subsp bovis AF2122/97
uacgacuuggugcagcgcagg

SEQ ID NO: 1192021 - RNA, 20 nt, Mycobacterium bovis subsp bovis AF2122/97
uacgccggccgcgcugguga

SEQ ID NO: 1192022 - RNA, 14 nt, Mycobacterium bovis subsp bovis AF2122/97
uacgcgacgggccg

SEQ ID NO: 1192023 - RNA, 18 nt, Mycobacterium bovis subsp bovis AF2122/97
uacgccgccgaucaccag

SEQ ID NO: 1192024 - RNA, 17 nt, Mycobacterium bovis subsp bovis AF2122/97
uacgcccacuccagcag

SEQ ID NO: 1192025 - RNA, 19 nt, Mycobacterium bovis subsp bovis AF2122/97
uacgcccacuccagcagcu

SEQ ID NO: 1192026 - RNA, 17 nt, Mycobacterium bovis subsp bovis AF2122/97
uacgccaaccgcuucca

SEQ ID NO: 1192027 - RNA, 12 nt, Mycobacterium bovis subsp bovis AF2122/97
uacguuccuagc

SEQ ID NO: 1192028 - RNA, 21 nt, Mycobacterium bovis subsp bovis AF2122/97
uacggugguaagacgccgaac

SEQ ID NO: 1192029 - RNA, 21 nt, Mycobacterium bovis subsp bovis AF2122/97
uacgcuccgaugaccaggguc

SEQ ID NO: 1192030 - RNA, 14 nt, Mycobacterium bovis subsp bovis AF2122/97
uagguauugccgca

SEQ ID NO: 1192031 - RNA, 18 nt, Mycobacterium bovis subsp bovis AF2122/97
uaggucagcgggcuugcc

SEQ ID NO: 1192032 - RNA, 21 nt, Mycobacterium bovis subsp bovis AF2122/97
uagucggcggugcagaucggc

SEQ ID NO: 1192033 - RNA, 14 nt, Mycobacterium bovis subsp bovis AF2122/97
uagucgggcaaggc

SEQ ID NO: 1192034 - RNA, 13 nt, Mycobacterium bovis subsp bovis AF2122/97
uaguguguuuggu

SEQ ID NO: 1192035 - RNA, 14 nt, Mycobacterium bovis subsp bovis AF2122/97
uaguuaacccaggg

SEQ ID NO: 1192036 - RNA, 15 nt, Mycobacterium bovis subsp bovis AF2122/97
uauaccgcuggggcu

SEQ ID NO: 1192037 - RNA, 20 nt, Mycobacterium bovis subsp bovis AF2122/97
uauaggcccgggcggccagc

SEQ ID NO: 1192038 - RNA, 15 nt, Mycobacterium bovis subsp bovis AF2122/97
uauaggccgcaugcc

SEQ ID NO: 1192039 - RNA, 15 nt, Mycobacterium bovis subsp bovis AF2122/97
uauccagucgauccu

SEQ ID NO: 1192040 - RNA, 14 nt, Mycobacterium bovis subsp bovis AF2122/97
uaucgacaccacca

SEQ ID NO: 1192041 - RNA, 22 nt, Mycobacterium bovis subsp bovis AF2122/97
uaucgagcggcacaucagccau

SEQ ID NO: 1192042 - RNA, 20 nt, Mycobacterium bovis subsp bovis AF2122/97
uaucucggugacgaugaacu

SEQ ID NO: 1192043 - RNA, 15 nt, Mycobacterium bovis subsp bovis AF2122/97
uagccgccggugccg

SEQ ID NO: 1192044 - RNA, 15 nt, Mycobacterium bovis subsp bovis AF2122/97
uagccgccggcgccg

SEQ ID NO: 1192045 - RNA, 23 nt, Mycobacterium bovis subsp bovis AF2122/97
uagccaugggauucggccagacg

SEQ ID NO: 1192046 - RNA, 19 nt, Mycobacterium bovis subsp bovis AF2122/97
uagccgcagcuuggccuca

SEQ ID NO: 1192047 - RNA, 20 nt, Mycobacterium bovis subsp bovis AF2122/97
uagccacgcaugggccaggu

SEQ ID NO: 1192048 - RNA, 19 nt, Mycobacterium bovis subsp bovis AF2122/97
uagccagcgucucaaggcc

SEQ ID NO: 1192049 - RNA, 15 nt, Mycobacterium bovis subsp bovis AF2122/97
uagccagcagcggcu

SEQ ID NO: 1192050 - RNA, 17 nt, Mycobacterium bovis subsp bovis AF2122/97
uagccgcugccuggccg

SEQ ID NO: 1192051 - RNA, 20 nt, Mycobacterium bovis subsp bovis AF2122/97
uagccggcgugcacucccuu

SEQ ID NO: 1192052 - RNA, 19 nt, Mycobacterium bovis subsp bovis AF2122/97
uagccgugacaaggugcgc

SEQ ID NO: 1192053 - RNA, 18 nt, Mycobacterium bovis subsp bovis AF2122/97
uagccguugccgccgaac

SEQ ID NO: 1192054 - RNA, 23 nt, Mycobacterium bovis subsp bovis AF2122/97
uagccguugccgccgaacagcug

SEQ ID NO: 1192055 - RNA, 19 nt, Mycobacterium bovis subsp bovis AF2122/97
uagcgaaugaucuugccac

SEQ ID NO: 1192056 - RNA, 19 nt, Mycobacterium bovis subsp bovis AF2122/97
uagccugcguggagcgcuu

SEQ ID NO: 1192057 - RNA, 13 nt, Mycobacterium bovis subsp bovis AF2122/97
uagaucagcgccu

SEQ ID NO: 1192058 - RNA, 15 nt, Mycobacterium bovis subsp bovis AF2122/97
uagauccaaacaccc

SEQ ID NO: 1192059 - RNA, 11 nt, Mycobacterium bovis subsp bovis AF2122/97
uagcacaccga

SEQ ID NO: 1192060 - RNA, 15 nt, Mycobacterium bovis subsp bovis AF2122/97
uagcaauccgcacag

SEQ ID NO: 1192061 - RNA, 12 nt, Mycobacterium bovis subsp bovis AF2122/97
uagcaccacauc

SEQ ID NO: 1192062 - RNA, 16 nt, Mycobacterium bovis subsp bovis AF2122/97
uagcaccgcgccgaac

SEQ ID NO: 1192063 - RNA, 21 nt, Mycobacterium bovis subsp bovis AF2122/97
uagcaccgcgccgaacacgca

SEQ ID NO: 1192064 - RNA, 14 nt, Mycobacterium bovis subsp bovis AF2122/97
uagcagaaggccgc

SEQ ID NO: 1192065 - RNA, 14 nt, Mycobacterium bovis subsp bovis AF2122/97
uagcgacagcagcg

SEQ ID NO: 1192066 - RNA, 22 nt, Mycobacterium bovis subsp bovis AF2122/97
uagcucaggguguucacguuca

SEQ ID NO: 1192067 - RNA, 18 nt, Mycobacterium bovis subsp bovis AF2122/97
uagcucacgguggccgca

SEQ ID NO: 1192068 - RNA, 20 nt, Mycobacterium bovis subsp bovis AF2122/97
uagcucacguuugaggaccu

SEQ ID NO: 1192069 - RNA, 12 nt, Mycobacterium bovis subsp bovis AF2122/97
uagcugccggcc

SEQ ID NO: 1192070 - RNA, 22 nt, Mycobacterium bovis subsp bovis AF2122/97
uagcugcggucgaacaucaucg

SEQ ID NO: 1192071 - RNA, 16 nt, Mycobacterium bovis subsp bovis AF2122/97
uagcugcguccggaac

SEQ ID NO: 1192072 - RNA, 17 nt, Mycobacterium bovis subsp bovis AF2122/97
uaggcgaaauagcccaa

SEQ ID NO: 1192073 - RNA, 16 nt, Mycobacterium bovis subsp bovis AF2122/97
uaggcgaaccgcucca

SEQ ID NO: 1192074 - RNA, 14 nt, Mycobacterium bovis subsp bovis AF2122/97
uaggcgaccagaua

SEQ ID NO: 1192075 - RNA, 21 nt, Mycobacterium bovis subsp bovis AF2122/97
uaggaucggauggcggccaca

SEQ ID NO: 1192076 - RNA, 14 nt, Mycobacterium bovis subsp bovis AF2122/97
uaggccgcgcggcg

SEQ ID NO: 1192077 - RNA, 22 nt, Mycobacterium bovis subsp bovis AF2122/97
uaggccgcgcggcggcgccggc

SEQ ID NO: 1192078 - RNA, 21 nt, Mycobacterium bovis subsp bovis AF2122/97
uaggccgcggcaccuggcuug

SEQ ID NO: 1192079 - RNA, 11 nt, Mycobacterium bovis subsp bovis AF2122/97
uagggccgcgu

SEQ ID NO: 1192080 - RNA, 12 nt, Mycobacterium bovis subsp bovis AF2122/97
uagggcagcgcc

SEQ ID NO: 1192081 - RNA, 18 nt, Mycobacterium bovis subsp bovis AF2122/97
uagggauagcagugcagc

SEQ ID NO: 1192082 - RNA, 17 nt, Mycobacterium bovis subsp bovis AF2122/97
uaggcgauggcggcgcg

SEQ ID NO: 1192083 - RNA, 22 nt, Mycobacterium bovis subsp bovis AF2122/97
uaggguggcgauccacaggcug

SEQ ID NO: 1192084 - RNA, 21 nt, Mycobacterium bovis subsp bovis AF2122/97
uagggcugaccgaagaagccc

SEQ ID NO: 1192085 - RNA, 20 nt, Mycobacterium bovis subsp bovis AF2122/97
uagggcuguccgaccucgcc

SEQ ID NO: 1192086 - RNA, 17 nt, Mycobacterium bovis subsp bovis AF2122/97
uagacaggaccgguggg

SEQ ID NO: 1192087 - RNA, 13 nt, Mycobacterium bovis subsp bovis AF2122/97
uagacaaggccaa

SEQ ID NO: 1192088 - RNA, 21 nt, Mycobacterium bovis subsp bovis AF2122/97
uagaccuuggugcccagcagg

SEQ ID NO: 1192089 - RNA, 17 nt, Mycobacterium bovis subsp bovis AF2122/97
uagaccacgccggugac

SEQ ID NO: 1192090 - RNA, 17 nt, Mycobacterium bovis subsp bovis AF2122/97
uagaccucgccggugac

SEQ ID NO: 1192091 - RNA, 18 nt, Mycobacterium bovis subsp bovis AF2122/97
uagacauuggcuccgaac

SEQ ID NO: 1192092 - RNA, 21 nt, Mycobacterium bovis subsp bovis AF2122/97
uagacggcgaaaaucccgcuc

SEQ ID NO: 1192093 - RNA, 22 nt, Mycobacterium bovis subsp bovis AF2122/97
uagacguuguugaaggcuugug

SEQ ID NO: 1192094 - RNA, 19 nt, Mycobacterium bovis subsp bovis AF2122/97
uagaggacugcggucugga

SEQ ID NO: 1192095 - RNA, 16 nt, Mycobacterium bovis subsp bovis AF2122/97
uagaggauggucagca

SEQ ID NO: 1192096 - RNA, 19 nt, Mycobacterium bovis subsp bovis AF2122/97
uagaggauggucagcagcu

SEQ ID NO: 1192097 - RNA, 22 nt, Mycobacterium bovis subsp bovis AF2122/97
uagaggauggucagcagcucca

SEQ ID NO: 1192098 - RNA, 21 nt, Mycobacterium bovis subsp bovis AF2122/97
uacuaggcccagcacggucaa

SEQ ID NO: 1192099 - RNA, 17 nt, Mycobacterium bovis subsp bovis AF2122/97
uagaacgucuggguugc

SEQ ID NO: 1192100 - RNA, 14 nt, Mycobacterium bovis subsp bovis AF2122/97
gccccggcucucuu

SEQ ID NO: 1192101 - RNA, 15 nt, Mycobacterium bovis subsp bovis AF2122/97
gccccggcucucuuc

SEQ ID NO: 1192102 - RNA, 21 nt, Mycobacterium bovis subsp bovis AF2122/97
gccccggcucucuucgcgcgc

SEQ ID NO: 1192103 - RNA, 23 nt, Mycobacterium bovis subsp bovis AF2122/97
gccccggcgcuggugcgccacgc

SEQ ID NO: 1192104 - RNA, 14 nt, Mycobacterium bovis subsp bovis AF2122/97
gccccggcggcggc

SEQ ID NO: 1192105 - RNA, 18 nt, Mycobacterium bovis subsp bovis AF2122/97
gccccggcgguaccggag

SEQ ID NO: 1192106 - RNA, 22 nt, Mycobacterium bovis subsp bovis AF2122/97
gccccggcgguaccggagcagc

SEQ ID NO: 1192107 - RNA, 18 nt, Mycobacterium bovis subsp bovis AF2122/97
gccccgggcggugaggca

SEQ ID NO: 1192108 - RNA, 14 nt, Mycobacterium bovis subsp bovis AF2122/97
gccccgggccacca

SEQ ID NO: 1192109 - RNA, 19 nt, Mycobacterium bovis subsp bovis AF2122/97
gccccgggccaccaguugu

SEQ ID NO: 1192110 - RNA, 20 nt, Mycobacterium bovis subsp bovis AF2122/97
gccccuggcaccucgcccuc

SEQ ID NO: 1192111 - RNA, 15 nt, Mycobacterium bovis subsp bovis AF2122/97
gccccuggccgccgc

SEQ ID NO: 1192112 - RNA, 16 nt, Mycobacterium bovis subsp bovis AF2122/97
gccccuggccgccgca

SEQ ID NO: 1192113 - RNA, 13 nt, Mycobacterium bovis subsp bovis AF2122/97
gccccugcgcggc

SEQ ID NO: 1192114 - RNA, 18 nt, Mycobacterium bovis subsp bovis AF2122/97
gccccugcgcggccaccu

SEQ ID NO: 1192115 - RNA, 14 nt, Mycobacterium bovis subsp bovis AF2122/97
gcccgacccgccga

SEQ ID NO: 1192116 - RNA, 17 nt, Mycobacterium bovis subsp bovis AF2122/97
gcccgacccgccgacgc

SEQ ID NO: 1192117 - RNA, 15 nt, Mycobacterium bovis subsp bovis AF2122/97
gcccgacccaucacc

SEQ ID NO: 1192118 - RNA, 22 nt, Mycobacterium bovis subsp bovis AF2122/97
gcccgacccaucaccagcggcu

SEQ ID NO: 1192119 - RNA, 23 nt, Mycobacterium bovis subsp bovis AF2122/97
gcccgaccacaccgggaugggag

SEQ ID NO: 1192120 - RNA, 20 nt, Mycobacterium bovis subsp bovis AF2122/97
gcccgacaccguccagcagc

SEQ ID NO: 1192121 - RNA, 22 nt, Mycobacterium bovis subsp bovis AF2122/97
gcccgacgagauugccgggccg

SEQ ID NO: 1192122 - RNA, 22 nt, Mycobacterium bovis subsp bovis AF2122/97
gcccgacgagucgccgcgggca

SEQ ID NO: 1192123 - RNA, 19 nt, Mycobacterium bovis subsp bovis AF2122/97
gcccgaccgggaaccacgg

SEQ ID NO: 1192124 - RNA, 14 nt, Mycobacterium bovis subsp bovis AF2122/97
gcccgacccggccg

SEQ ID NO: 1192125 - RNA, 15 nt, Mycobacterium bovis subsp bovis AF2122/97
gcccgacccggccga

SEQ ID NO: 1192126 - RNA, 19 nt, Mycobacterium bovis subsp bovis AF2122/97
gccccuucaaagcggccuc

SEQ ID NO: 1192127 - RNA, 12 nt, Mycobacterium bovis subsp bovis AF2122/97
gcccgacacccg

SEQ ID NO: 1192128 - RNA, 18 nt, Mycobacterium bovis subsp bovis AF2122/97
gcccgacacccgcauggc

SEQ ID NO: 1192129 - RNA, 17 nt, Mycobacterium bovis subsp bovis AF2122/97
gcccgacaccgccccgc

SEQ ID NO: 1192130 - RNA, 15 nt, Mycobacterium bovis subsp bovis AF2122/97
gccccggccaggaca

SEQ ID NO: 1192131 - RNA, 18 nt, Mycobacterium bovis subsp bovis AF2122/97
gccccggacuccaaagcc

SEQ ID NO: 1192132 - RNA, 21 nt, Mycobacterium bovis subsp bovis AF2122/97
gccccggcauugcccgagccc

SEQ ID NO: 1192133 - RNA, 14 nt, Mycobacterium bovis subsp bovis AF2122/97
gccccggccaggac

SEQ ID NO: 1192134 - RNA, 12 nt, Mycobacterium bovis subsp bovis AF2122/97
gccccggcggcg

SEQ ID NO: 1192135 - RNA, 14 nt, Mycobacterium bovis subsp bovis AF2122/97
gccccggcgcggcc

SEQ ID NO: 1192136 - RNA, 15 nt, Mycobacterium bovis subsp bovis AF2122/97
gccccggcgcggcca

SEQ ID NO: 1192137 - RNA, 21 nt, Mycobacterium bovis subsp bovis AF2122/97
gccccggccuuuacccgggcg

SEQ ID NO: 1192138 - RNA, 23 nt, Mycobacterium bovis subsp bovis AF2122/97
gccccgcucgguuugcguccugg

SEQ ID NO: 1192139 - RNA, 20 nt, Mycobacterium bovis subsp bovis AF2122/97
gccccgcggccagcaccggg

SEQ ID NO: 1192140 - RNA, 14 nt, Mycobacterium bovis subsp bovis AF2122/97
gccccgcggcgccg

SEQ ID NO: 1192141 - RNA, 17 nt, Mycobacterium bovis subsp bovis AF2122/97
gccccgcggcgccgcca

SEQ ID NO: 1192142 - RNA, 18 nt, Mycobacterium bovis subsp bovis AF2122/97
gccccgcggcgccgccac

SEQ ID NO: 1192143 - RNA, 15 nt, Mycobacterium bovis subsp bovis AF2122/97
gccccgcgcguucgg

SEQ ID NO: 1192144 - RNA, 12 nt, Mycobacterium bovis subsp bovis AF2122/97
gccccgcggcca

SEQ ID NO: 1192145 - RNA, 14 nt, Mycobacterium bovis subsp bovis AF2122/97
gccccgcggccagc

SEQ ID NO: 1192146 - RNA, 15 nt, Mycobacterium bovis subsp bovis AF2122/97
gccccgcggccagca

SEQ ID NO: 1192147 - RNA, 13 nt, Mycobacterium bovis subsp bovis AF2122/97
gccccgcgccggc

SEQ ID NO: 1192148 - RNA, 14 nt, Mycobacterium bovis subsp bovis AF2122/97
gccccgcgccggcc

SEQ ID NO: 1192149 - RNA, 15 nt, Mycobacterium bovis subsp bovis AF2122/97
gccccgcgccggccg

SEQ ID NO: 1192150 - RNA, 14 nt, Mycobacterium bovis subsp bovis AF2122/97
gccccgccgcccuc

SEQ ID NO: 1192151 - RNA, 13 nt, Mycobacterium bovis subsp bovis AF2122/97
gccccgccgccgg

SEQ ID NO: 1192152 - RNA, 16 nt, Mycobacterium bovis subsp bovis AF2122/97
gcccgagccgcguggg

SEQ ID NO: 1192153 - RNA, 16 nt, Mycobacterium bovis subsp bovis AF2122/97
gcccgagcccagcgcc

SEQ ID NO: 1192154 - RNA, 17 nt, Mycobacterium bovis subsp bovis AF2122/97
gcccgagcccagcgccu

SEQ ID NO: 1192155 - RNA, 21 nt, Mycobacterium bovis subsp bovis AF2122/97
gcccgagcccagcgccuccag

SEQ ID NO: 1192156 - RNA, 14 nt, Mycobacterium bovis subsp bovis AF2122/97
gcccgagcccagcc

SEQ ID NO: 1192157 - RNA, 17 nt, Mycobacterium bovis subsp bovis AF2122/97
gcccgagcccagccggg

SEQ ID NO: 1192158 - RNA, 15 nt, Mycobacterium bovis subsp bovis AF2122/97
gcccgcaccaccggc

SEQ ID NO: 1192159 - RNA, 18 nt, Mycobacterium bovis subsp bovis AF2122/97
gcccgcaccaccggcccc

SEQ ID NO: 1192160 - RNA, 17 nt, Mycobacterium bovis subsp bovis AF2122/97
gcccgagacgguguugc

SEQ ID NO: 1192161 - RNA, 20 nt, Mycobacterium bovis subsp bovis AF2122/97
gcccgacgcguggcauccag

SEQ ID NO: 1192162 - RNA, 19 nt, Mycobacterium bovis subsp bovis AF2122/97
gcccgacggcgcccagcgc

SEQ ID NO: 1192163 - RNA, 14 nt, Mycobacterium bovis subsp bovis AF2122/97
gcccgcaccagcug

SEQ ID NO: 1192164 - RNA, 18 nt, Mycobacterium bovis subsp bovis AF2122/97
gcccgcaccgcguucugg

SEQ ID NO: 1192165 - RNA, 13 nt, Mycobacterium bovis subsp bovis AF2122/97
gcccgcagcccgc

SEQ ID NO: 1192166 - RNA, 14 nt, Mycobacterium bovis subsp bovis AF2122/97
gcccgcauccgcac

SEQ ID NO: 1192167 - RNA, 18 nt, Mycobacterium bovis subsp bovis AF2122/97
gcccgcaggacgcugccg

SEQ ID NO: 1192168 - RNA, 18 nt, Mycobacterium bovis subsp bovis AF2122/97
gcccgcaggucggccacc

SEQ ID NO: 1192169 - RNA, 15 nt, Mycobacterium bovis subsp bovis AF2122/97
gcccgccaccggcgc

SEQ ID NO: 1192170 - RNA, 13 nt, Mycobacterium bovis subsp bovis AF2122/97
gcccgccaccggg

SEQ ID NO: 1192171 - RNA, 13 nt, Mycobacterium bovis subsp bovis AF2122/97
gcccgccaccccg

SEQ ID NO: 1192172 - RNA, 23 nt, Mycobacterium bovis subsp bovis AF2122/97
gcccgccacaacggcggcgcagu

SEQ ID NO: 1192173 - RNA, 13 nt, Mycobacterium bovis subsp bovis AF2122/97
gcccgccagcgcc

SEQ ID NO: 1192174 - RNA, 21 nt, Mycobacterium bovis subsp bovis AF2122/97
gcccgccggauccgccagacc

SEQ ID NO: 1192175 - RNA, 17 nt, Mycobacterium bovis subsp bovis AF2122/97
gcccgccagcagggcca

SEQ ID NO: 1192176 - RNA, 15 nt, Mycobacterium bovis subsp bovis AF2122/97
gcccgccagcgccgc

SEQ ID NO: 1192177 - RNA, 18 nt, Mycobacterium bovis subsp bovis AF2122/97
gcccgccgccaccagcug

SEQ ID NO: 1192178 - RNA, 23 nt, Mycobacterium bovis subsp bovis AF2122/97
gcccgcgccgccgcuacccccga

SEQ ID NO: 1192179 - RNA, 16 nt, Mycobacterium bovis subsp bovis AF2122/97
gcccgcgccgccgcca

SEQ ID NO: 1192180 - RNA, 18 nt, Mycobacterium bovis subsp bovis AF2122/97
gcccgcgccgccgccacc

SEQ ID NO: 1192181 - RNA, 22 nt, Mycobacterium bovis subsp bovis AF2122/97
gcccgcgccgccgcuacccccg

SEQ ID NO: 1192182 - RNA, 16 nt, Mycobacterium bovis subsp bovis AF2122/97
gcccgcgaucgggccg

SEQ ID NO: 1192183 - RNA, 17 nt, Mycobacterium bovis subsp bovis AF2122/97
gcccgcgaucgggccga

SEQ ID NO: 1192184 - RNA, 23 nt, Mycobacterium bovis subsp bovis AF2122/97
gcccgcgcagcgguccgccgccu

SEQ ID NO: 1192185 - RNA, 17 nt, Mycobacterium bovis subsp bovis AF2122/97
gcccgggguccaucggg

SEQ ID NO: 1192186 - RNA, 18 nt, Mycobacterium bovis subsp bovis AF2122/97
gcccggggcgcacagcug

SEQ ID NO: 1192187 - RNA, 20 nt, Mycobacterium bovis subsp bovis AF2122/97
gcccgggcgugggcaccccg

SEQ ID NO: 1192188 - RNA, 16 nt, Mycobacterium bovis subsp bovis AF2122/97
gcccgggcggccagcu

SEQ ID NO: 1192189 - RNA, 17 nt, Mycobacterium bovis subsp bovis AF2122/97
gcccgggcggccagcug

SEQ ID NO: 1192190 - RNA, 18 nt, Mycobacterium bovis subsp bovis AF2122/97
gcccgggcggccagcugc

SEQ ID NO: 1192191 - RNA, 21 nt, Mycobacterium bovis subsp bovis AF2122/97
gcccguccaggcgcugcagca

SEQ ID NO: 1192192 - RNA, 18 nt, Mycobacterium bovis subsp bovis AF2122/97
gcccguagacgccgagca

SEQ ID NO: 1192193 - RNA, 18 nt, Mycobacterium bovis subsp bovis AF2122/97
gcccgggugagacaaagg

SEQ ID NO: 1192194 - RNA, 16 nt, Mycobacterium bovis subsp bovis AF2122/97
gcccgucacaaugccc

SEQ ID NO: 1192195 - RNA, 18 nt, Mycobacterium bovis subsp bovis AF2122/97
gcccggccuugccgccgg

SEQ ID NO: 1192196 - RNA, 19 nt, Mycobacterium bovis subsp bovis AF2122/97
gcccggccuugccgccggc

SEQ ID NO: 1192197 - RNA, 20 nt, Mycobacterium bovis subsp bovis AF2122/97
gcccggccuugccgccggcg

SEQ ID NO: 1192198 - RNA, 21 nt, Mycobacterium bovis subsp bovis AF2122/97
gcccggccuugccgccggcgc

SEQ ID NO: 1192199 - RNA, 19 nt, Mycobacterium bovis subsp bovis AF2122/97
gcccggcggaucccgaggc

SEQ ID NO: 1192200 - RNA, 11 nt, Mycobacterium bovis subsp bovis AF2122/97
gcccggcggca

SEQ ID NO: 1192201 - RNA, 14 nt, Mycobacterium bovis subsp bovis AF2122/97
gcccggcggccgcu

SEQ ID NO: 1192202 - RNA, 14 nt, Mycobacterium bovis subsp bovis AF2122/97
gcccggcggcccga

SEQ ID NO: 1192203 - RNA, 13 nt, Mycobacterium bovis subsp bovis AF2122/97
gcccggcggccgc

SEQ ID NO: 1192204 - RNA, 11 nt, Mycobacterium bovis subsp bovis AF2122/97
gcccggcggcg

SEQ ID NO: 1192205 - RNA, 16 nt, Mycobacterium bovis subsp bovis AF2122/97
gcccggcuacgacggc

SEQ ID NO: 1192206 - RNA, 23 nt, Mycobacterium bovis subsp bovis AF2122/97
gcccggcuaggagaucagcaccg

SEQ ID NO: 1192207 - RNA, 13 nt, Mycobacterium bovis subsp bovis AF2122/97
gcccgggccgcgu

SEQ ID NO: 1192208 - RNA, 20 nt, Mycobacterium bovis subsp bovis AF2122/97
gcccgggccgaagcgcgcgc

SEQ ID NO: 1192209 - RNA, 19 nt, Mycobacterium bovis subsp bovis AF2122/97
gcccggcgugucgccgcca

SEQ ID NO: 1192210 - RNA, 22 nt, Mycobacterium bovis subsp bovis AF2122/97
gcccggcguuguugaccagcac

SEQ ID NO: 1192211 - RNA, 16 nt, Mycobacterium bovis subsp bovis AF2122/97
gcccggcguggugagc

SEQ ID NO: 1192212 - RNA, 18 nt, Mycobacterium bovis subsp bovis AF2122/97
gcccggcgugucgccgcc

SEQ ID NO: 1192213 - RNA, 17 nt, Mycobacterium bovis subsp bovis AF2122/97
gcccggccccgcggcca

SEQ ID NO: 1192214 - RNA, 17 nt, Mycobacterium bovis subsp bovis AF2122/97
gcccggcggccgcuucg

SEQ ID NO: 1192215 - RNA, 14 nt, Mycobacterium bovis subsp bovis AF2122/97
gcccgcuucagcac

SEQ ID NO: 1192216 - RNA, 16 nt, Mycobacterium bovis subsp bovis AF2122/97
gcccgcugggcucgcu

SEQ ID NO: 1192217 - RNA, 12 nt, Mycobacterium bovis subsp bovis AF2122/97
gcccggccccgc

SEQ ID NO: 1192218 - RNA, 14 nt, Mycobacterium bovis subsp bovis AF2122/97
gcccggccgccagc

SEQ ID NO: 1192219 - RNA, 15 nt, Mycobacterium bovis subsp bovis AF2122/97
gcccggccaugauga

SEQ ID NO: 1192220 - RNA, 15 nt, Mycobacterium bovis subsp bovis AF2122/97
gcccggccgcgcccc

SEQ ID NO: 1192221 - RNA, 17 nt, Mycobacterium bovis subsp bovis AF2122/97
gcccggccgcgccccau

SEQ ID NO: 1192222 - RNA, 19 nt, Mycobacterium bovis subsp bovis AF2122/97
gcccgcucggagaucgcca

SEQ ID NO: 1192223 - RNA, 16 nt, Mycobacterium bovis subsp bovis AF2122/97
gcccgcucggaugagu

SEQ ID NO: 1192224 - RNA, 17 nt, Mycobacterium bovis subsp bovis AF2122/97
gcccgcucggccgcagc

SEQ ID NO: 1192225 - RNA, 21 nt, Mycobacterium bovis subsp bovis AF2122/97
gcccgcucggccgcagccagc

SEQ ID NO: 1192226 - RNA, 13 nt, Mycobacterium bovis subsp bovis AF2122/97
gcccgcugagcac

SEQ ID NO: 1192227 - RNA, 15 nt, Mycobacterium bovis subsp bovis AF2122/97
gcccgcugagccagc

SEQ ID NO: 1192228 - RNA, 14 nt, Mycobacterium bovis subsp bovis AF2122/97
gcccgcuccgggac

SEQ ID NO: 1192229 - RNA, 14 nt, Mycobacterium bovis subsp bovis AF2122/97
gcccgcucccugca

SEQ ID NO: 1192230 - RNA, 22 nt, Mycobacterium bovis subsp bovis AF2122/97
gcccgcuccgccgucgccgccg

SEQ ID NO: 1192231 - RNA, 17 nt, Mycobacterium bovis subsp bovis AF2122/97
gcccgcucgaucggcag

SEQ ID NO: 1192232 - RNA, 19 nt, Mycobacterium bovis subsp bovis AF2122/97
gcccgcguuugcgaagccc

SEQ ID NO: 1192233 - RNA, 15 nt, Mycobacterium bovis subsp bovis AF2122/97
gcccgcucagccguc

SEQ ID NO: 1192234 - RNA, 20 nt, Mycobacterium bovis subsp bovis AF2122/97
gcccgcgugcgcaucccgaa

SEQ ID NO: 1192235 - RNA, 20 nt, Mycobacterium bovis subsp bovis AF2122/97
gcccgcgugacgcuuggcca

SEQ ID NO: 1192236 - RNA, 20 nt, Mycobacterium bovis subsp bovis AF2122/97
gcccgcguucagggcacgcu

SEQ ID NO: 1192237 - RNA, 21 nt, Mycobacterium bovis subsp bovis AF2122/97
gcccgcguucagggcacgcug

SEQ ID NO: 1192238 - RNA, 16 nt, Mycobacterium bovis subsp bovis AF2122/97
gcccgcuaggcgaagc

SEQ ID NO: 1192239 - RNA, 15 nt, Mycobacterium bovis subsp bovis AF2122/97
gcccgcucaccuugg

SEQ ID NO: 1192240 - RNA, 13 nt, Mycobacterium bovis subsp bovis AF2122/97
gcccgcucagccg

SEQ ID NO: 1192241 - RNA, 21 nt, Mycobacterium bovis subsp bovis AF2122/97
gcccgcucagccguccgggcg

SEQ ID NO: 1192242 - RNA, 14 nt, Mycobacterium bovis subsp bovis AF2122/97
gcccuggcggcccg

SEQ ID NO: 1192243 - RNA, 23 nt, Mycobacterium bovis subsp bovis AF2122/97
gcccugcuccucgcgggcggcgu

SEQ ID NO: 1192244 - RNA, 22 nt, Mycobacterium bovis subsp bovis AF2122/97
gcccuggggguggcagcgcggc

SEQ ID NO: 1192245 - RNA, 15 nt, Mycobacterium bovis subsp bovis AF2122/97
gcccugggcgccggc

SEQ ID NO: 1192246 - RNA, 14 nt, Mycobacterium bovis subsp bovis AF2122/97
gcccugcggccacg

SEQ ID NO: 1192247 - RNA, 20 nt, Mycobacterium bovis subsp bovis AF2122/97
gcccugccgacgcuccaggg

SEQ ID NO: 1192248 - RNA, 14 nt, Mycobacterium bovis subsp bovis AF2122/97
gcccugcgcagccg

SEQ ID NO: 1192249 - RNA, 17 nt, Mycobacterium bovis subsp bovis AF2122/97
gcccugcgcagccgccu

SEQ ID NO: 1192250 - RNA, 14 nt, Mycobacterium bovis subsp bovis AF2122/97
gcccugccgccggc

SEQ ID NO: 1192251 - RNA, 14 nt, Mycobacterium bovis subsp bovis AF2122/97
gcccugacacccau

SEQ ID NO: 1192252 - RNA, 18 nt, Mycobacterium bovis subsp bovis AF2122/97
gcccugaagggccgccuc

SEQ ID NO: 1192253 - RNA, 17 nt, Mycobacterium bovis subsp bovis AF2122/97
gcccucuaugcgggcag

SEQ ID NO: 1192254 - RNA, 23 nt, Mycobacterium bovis subsp bovis AF2122/97
gcccucguuaucgaccgccgcga

SEQ ID NO: 1192255 - RNA, 21 nt, Mycobacterium bovis subsp bovis AF2122/97
gcccguguggucccggcacga

SEQ ID NO: 1192256 - RNA, 18 nt, Mycobacterium bovis subsp bovis AF2122/97
gcccguguuaaagaagcc

SEQ ID NO: 1192257 - RNA, 19 nt, Mycobacterium bovis subsp bovis AF2122/97
gcccguguuaaagaagccu

SEQ ID NO: 1192258 - RNA, 15 nt, Mycobacterium bovis subsp bovis AF2122/97
gcccguguugaagaa

SEQ ID NO: 1192259 - RNA, 23 nt, Mycobacterium bovis subsp bovis AF2122/97
gcccguguugaagaagcccgagu

SEQ ID NO: 1192260 - RNA, 20 nt, Mycobacterium bovis subsp bovis AF2122/97
gcccgucccgcucgagcagc

SEQ ID NO: 1192261 - RNA, 17 nt, Mycobacterium bovis subsp bovis AF2122/97
gcccguuuccucagcug

SEQ ID NO: 1192262 - RNA, 21 nt, Mycobacterium bovis subsp bovis AF2122/97
gcccguuggccaagaaugugg

SEQ ID NO: 1192263 - RNA, 15 nt, Mycobacterium bovis subsp bovis AF2122/97
gcccguuugccgguu

SEQ ID NO: 1192264 - RNA, 20 nt, Mycobacterium bovis subsp bovis AF2122/97
gcccguuggcagcacaggcu

SEQ ID NO: 1192265 - RNA, 18 nt, Mycobacterium bovis subsp bovis AF2122/97
gcccguucaugcggcggc

SEQ ID NO: 1192266 - RNA, 21 nt, Mycobacterium bovis subsp bovis AF2122/97
gcccguucaugcggcggcgcu

SEQ ID NO: 1192267 - RNA, 16 nt, Mycobacterium bovis subsp bovis AF2122/97
gcccguucugcccagg

SEQ ID NO: 1192268 - RNA, 23 nt, Mycobacterium bovis subsp bovis AF2122/97
gcccuccagggcccugcuggccc

SEQ ID NO: 1192269 - RNA, 13 nt, Mycobacterium bovis subsp bovis AF2122/97
gcccuccaccggu

SEQ ID NO: 1192270 - RNA, 22 nt, Mycobacterium bovis subsp bovis AF2122/97
gcccuccacugcgagcgccggc

SEQ ID NO: 1192271 - RNA, 15 nt, Mycobacterium bovis subsp bovis AF2122/97
gcccucagccgcggc

SEQ ID NO: 1192272 - RNA, 21 nt, Mycobacterium bovis subsp bovis AF2122/97
gcccuccgggcccaucgcccg

SEQ ID NO: 1192273 - RNA, 17 nt, Mycobacterium bovis subsp bovis AF2122/97
gcccucccgggcccgcu

SEQ ID NO: 1192274 - RNA, 21 nt, Mycobacterium bovis subsp bovis AF2122/97
gcccucccgggcccgcugggc

SEQ ID NO: 1192275 - RNA, 19 nt, Mycobacterium bovis subsp bovis AF2122/97
gcccuccucgaccgcggcc

SEQ ID NO: 1192276 - RNA, 20 nt, Mycobacterium bovis subsp bovis AF2122/97
gcccuccggguauggcggcg

SEQ ID NO: 1192277 - RNA, 23 nt, Mycobacterium bovis subsp bovis AF2122/97
gcccuccgugggcagcgcgcccg

SEQ ID NO: 1192278 - RNA, 24 nt, Mycobacterium bovis subsp bovis AF2122/97
gcccuccucgaccgcggccuuggc

SEQ ID NO: 1192279 - RNA, 23 nt, Mycobacterium bovis subsp bovis AF2122/97
gcccaguacggugguaagacgcc

SEQ ID NO: 1192280 - RNA, 13 nt, Mycobacterium bovis subsp bovis AF2122/97
gcccagucgccgc

SEQ ID NO: 1192281 - RNA, 17 nt, Mycobacterium bovis subsp bovis AF2122/97
gcccaggucgaugcggg

SEQ ID NO: 1192282 - RNA, 17 nt, Mycobacterium bovis subsp bovis AF2122/97
gcccaggugacgcccgc

SEQ ID NO: 1192283 - RNA, 22 nt, Mycobacterium bovis subsp bovis AF2122/97
gcccaggucuccaucaaccgcg

SEQ ID NO: 1192284 - RNA, 18 nt, Mycobacterium bovis subsp bovis AF2122/97
gcccaggugcguccaggc

SEQ ID NO: 1192285 - RNA, 20 nt, Mycobacterium bovis subsp bovis AF2122/97
gcccaggugaucgcgaggcu

SEQ ID NO: 1192286 - RNA, 22 nt, Mycobacterium bovis subsp bovis AF2122/97
gcccagguugauccagugcugg

SEQ ID NO: 1192287 - RNA, 14 nt, Mycobacterium bovis subsp bovis AF2122/97
gcccagguugccaa

SEQ ID NO: 1192288 - RNA, 22 nt, Mycobacterium bovis subsp bovis AF2122/97
gcccaggugggccgagagcagc

SEQ ID NO: 1192289 - RNA, 11 nt, Mycobacterium bovis subsp bovis AF2122/97
gcccagggugg

SEQ ID NO: 1192290 - RNA, 22 nt, Mycobacterium bovis subsp bovis AF2122/97
gcccaggcgugucgucgcggcc

SEQ ID NO: 1192291 - RNA, 17 nt, Mycobacterium bovis subsp bovis AF2122/97
gcccaggcguccaucag

SEQ ID NO: 1192292 - RNA, 22 nt, Mycobacterium bovis subsp bovis AF2122/97
gcccaggcguccaucagagaca

SEQ ID NO: 1192293 - RNA, 17 nt, Mycobacterium bovis subsp bovis AF2122/97
gcccaggcgaccgcuga

SEQ ID NO: 1192294 - RNA, 19 nt, Mycobacterium bovis subsp bovis AF2122/97
gcccaggcgaucgcccggc

SEQ ID NO: 1192295 - RNA, 21 nt, Mycobacterium bovis subsp bovis AF2122/97
gcccaggcgaucgcccggccc

SEQ ID NO: 1192296 - RNA, 22 nt, Mycobacterium bovis subsp bovis AF2122/97
gcccaggcgaucgcccggcccc

SEQ ID NO: 1192297 - RNA, 17 nt, Mycobacterium bovis subsp bovis AF2122/97
gcccaucacacccggua

SEQ ID NO: 1192298 - RNA, 18 nt, Mycobacterium bovis subsp bovis AF2122/97
gcccauacgugccgccga

SEQ ID NO: 1192299 - RNA, 14 nt, Mycobacterium bovis subsp bovis AF2122/97
gcccauagcaccuc

SEQ ID NO: 1192300 - RNA, 12 nt, Mycobacterium bovis subsp bovis AF2122/97
gcccaguugggc

SEQ ID NO: 1192301 - RNA, 14 nt, Mycobacterium bovis subsp bovis AF2122/97
gcccaguugggccu

SEQ ID NO: 1192302 - RNA, 17 nt, Mycobacterium bovis subsp bovis AF2122/97
gcccauaacagcuggcg

SEQ ID NO: 1192303 - RNA, 22 nt, Mycobacterium bovis subsp bovis AF2122/97
gcccauaacagcuggcggcagc

SEQ ID NO: 1192304 - RNA, 22 nt, Mycobacterium bovis subsp bovis AF2122/97
gcccagugcgcaacccagccgc

SEQ ID NO: 1192305 - RNA, 13 nt, Mycobacterium bovis subsp bovis AF2122/97
gcccaguucugca

SEQ ID NO: 1192306 - RNA, 13 nt, Mycobacterium bovis subsp bovis AF2122/97
gcccaucccggcc

SEQ ID NO: 1192307 - RNA, 15 nt, Mycobacterium bovis subsp bovis AF2122/97
gcccaucccggccga

SEQ ID NO: 1192308 - RNA, 22 nt, Mycobacterium bovis subsp bovis AF2122/97
gcccaucgcgacuagacgccgc

SEQ ID NO: 1192309 - RNA, 15 nt, Mycobacterium bovis subsp bovis AF2122/97
gcccaucgcaagcug

SEQ ID NO: 1192310 - RNA, 15 nt, Mycobacterium bovis subsp bovis AF2122/97
gcccagcggccgcga

SEQ ID NO: 1192311 - RNA, 18 nt, Mycobacterium bovis subsp bovis AF2122/97
gcccaggccaagguggcc

SEQ ID NO: 1192312 - RNA, 23 nt, Mycobacterium bovis subsp bovis AF2122/97
gcccaggccaccggcugcaacca

SEQ ID NO: 1192313 - RNA, 16 nt, Mycobacterium bovis subsp bovis AF2122/97
gcccagcagaccaagu

SEQ ID NO: 1192314 - RNA, 21 nt, Mycobacterium bovis subsp bovis AF2122/97
gcccagcacguaacccagucc

SEQ ID NO: 1192315 - RNA, 16 nt, Mycobacterium bovis subsp bovis AF2122/97
gcccagccgcgggccg

SEQ ID NO: 1192316 - RNA, 15 nt, Mycobacterium bovis subsp bovis AF2122/97
gcccagccgccagcc

SEQ ID NO: 1192317 - RNA, 14 nt, Mycobacterium bovis subsp bovis AF2122/97
gcccagccgcagca

SEQ ID NO: 1192318 - RNA, 22 nt, Mycobacterium bovis subsp bovis AF2122/97
gcccagcgacccggccagcggc

SEQ ID NO: 1192319 - RNA, 19 nt, Mycobacterium bovis subsp bovis AF2122/97
gcccagcgaccgcugcaga

SEQ ID NO: 1192320 - RNA, 21 nt, Mycobacterium bovis subsp bovis AF2122/97
gcccagccggaccgcgacggc

SEQ ID NO: 1192321 - RNA, 15 nt, Mycobacterium bovis subsp bovis AF2122/97
gcccagcgacaacac

SEQ ID NO: 1192322 - RNA, 19 nt, Mycobacterium bovis subsp bovis AF2122/97
gcccagcgacaacaccacg

SEQ ID NO: 1192323 - RNA, 19 nt, Mycobacterium bovis subsp bovis AF2122/97
gcccagcgacccggccagc

SEQ ID NO: 1192324 - RNA, 19 nt, Mycobacterium bovis subsp bovis AF2122/97
gccaugcgcaccaguccag

SEQ ID NO: 1192325 - RNA, 20 nt, Mycobacterium bovis subsp bovis AF2122/97
gccaugcgcaccaguccagc

SEQ ID NO: 1192326 - RNA, 22 nt, Mycobacterium bovis subsp bovis AF2122/97
gccaugcgggugucgggcagca

SEQ ID NO: 1192327 - RNA, 17 nt, Mycobacterium bovis subsp bovis AF2122/97
gcccacggcgaccagga

SEQ ID NO: 1192328 - RNA, 21 nt, Mycobacterium bovis subsp bovis AF2122/97
gccaugcgguuugccggugcg

SEQ ID NO: 1192329 - RNA, 20 nt, Mycobacterium bovis subsp bovis AF2122/97
gccaugcuaggaccaccagc

SEQ ID NO: 1192330 - RNA, 20 nt, Mycobacterium bovis subsp bovis AF2122/97
gccaugcucgucuugggccg

SEQ ID NO: 1192331 - RNA, 15 nt, Mycobacterium bovis subsp bovis AF2122/97
gcccacguggggccg

SEQ ID NO: 1192332 - RNA, 23 nt, Mycobacterium bovis subsp bovis AF2122/97
gcccacguuggccaggcccgagu

SEQ ID NO: 1192333 - RNA, 19 nt, Mycobacterium bovis subsp bovis AF2122/97
gcccacguuggccccgcgg

SEQ ID NO: 1192334 - RNA, 22 nt, Mycobacterium bovis subsp bovis AF2122/97
gcccacggugccggcacccgag

SEQ ID NO: 1192335 - RNA, 23 nt, Mycobacterium bovis subsp bovis AF2122/97
gcccacuagcagggggacccgga

SEQ ID NO: 1192336 - RNA, 15 nt, Mycobacterium bovis subsp bovis AF2122/97
gcccacuccagcagc

SEQ ID NO: 1192337 - RNA, 15 nt, Mycobacterium bovis subsp bovis AF2122/97
gcccagcacgcuggc

SEQ ID NO: 1192338 - RNA, 16 nt, Mycobacterium bovis subsp bovis AF2122/97
gcccagcacgcuggcg

SEQ ID NO: 1192339 - RNA, 19 nt, Mycobacterium bovis subsp bovis AF2122/97
gcccagcaccaccacccga

SEQ ID NO: 1192340 - RNA, 18 nt, Mycobacterium bovis subsp bovis AF2122/97
gcccagcaaccgcucggc

SEQ ID NO: 1192341 - RNA, 15 nt, Mycobacterium bovis subsp bovis AF2122/97
gcccaugauggucac

SEQ ID NO: 1192342 - RNA, 19 nt, Mycobacterium bovis subsp bovis AF2122/97
gcccaucucgggcaggccg

SEQ ID NO: 1192343 - RNA, 14 nt, Mycobacterium bovis subsp bovis AF2122/97
gcccaucucaugca

SEQ ID NO: 1192344 - RNA, 19 nt, Mycobacterium bovis subsp bovis AF2122/97
gcccaugguggcgaucugg

SEQ ID NO: 1192345 - RNA, 20 nt, Mycobacterium bovis subsp bovis AF2122/97
gcccaugccgggauugccgu

SEQ ID NO: 1192346 - RNA, 15 nt, Mycobacterium bovis subsp bovis AF2122/97
gcccauuggccaggu

SEQ ID NO: 1192347 - RNA, 19 nt, Mycobacterium bovis subsp bovis AF2122/97
gcccauuggguaaccagcg

SEQ ID NO: 1192348 - RNA, 21 nt, Mycobacterium bovis subsp bovis AF2122/97
gcccauuggguaaccagcgcc

SEQ ID NO: 1192349 - RNA, 23 nt, Mycobacterium bovis subsp bovis AF2122/97
gcccauugucgaucaccugcagc

SEQ ID NO: 1192350 - RNA, 22 nt, Mycobacterium bovis subsp bovis AF2122/97
gcccauucauaggcccgcacga

SEQ ID NO: 1192351 - RNA, 22 nt, Mycobacterium bovis subsp bovis AF2122/97
gcccauucccagaggcccgcgg

SEQ ID NO: 1192352 - RNA, 20 nt, Mycobacterium bovis subsp bovis AF2122/97
gccccagcguucccgccggc

SEQ ID NO: 1192353 - RNA, 20 nt, Mycobacterium bovis subsp bovis AF2122/97
gccccaccauucgcgggccg

SEQ ID NO: 1192354 - RNA, 23 nt, Mycobacterium bovis subsp bovis AF2122/97
gccccaccauucgcgggccgagg

SEQ ID NO: 1192355 - RNA, 23 nt, Mycobacterium bovis subsp bovis AF2122/97
gccccacaccuuggcggucggca

SEQ ID NO: 1192356 - RNA, 15 nt, Mycobacterium bovis subsp bovis AF2122/97
gccccacaacaugcu

SEQ ID NO: 1192357 - RNA, 19 nt, Mycobacterium bovis subsp bovis AF2122/97
gccccacaacaugcuggag

SEQ ID NO: 1192358 - RNA, 19 nt, Mycobacterium bovis subsp bovis AF2122/97
gccccaagcgugcugccgc

SEQ ID NO: 1192359 - RNA, 16 nt, Mycobacterium bovis subsp bovis AF2122/97
gccccacuggugcagc

SEQ ID NO: 1192360 - RNA, 14 nt, Mycobacterium bovis subsp bovis AF2122/97
gccccaccgcgccg

SEQ ID NO: 1192361 - RNA, 21 nt, Mycobacterium bovis subsp bovis AF2122/97
gccccaccgguaccgccacuu

SEQ ID NO: 1192362 - RNA, 18 nt, Mycobacterium bovis subsp bovis AF2122/97
gccccacccgcaugcccu

SEQ ID NO: 1192363 - RNA, 16 nt, Mycobacterium bovis subsp bovis AF2122/97
gccccacccgcggcgc

SEQ ID NO: 1192364 - RNA, 18 nt, Mycobacterium bovis subsp bovis AF2122/97
gccccaccgacagcccca

SEQ ID NO: 1192365 - RNA, 15 nt, Mycobacterium bovis subsp bovis AF2122/97
gccccgaccagcaga

SEQ ID NO: 1192366 - RNA, 16 nt, Mycobacterium bovis subsp bovis AF2122/97
gccccgaccagcagac

SEQ ID NO: 1192367 - RNA, 21 nt, Mycobacterium bovis subsp bovis AF2122/97
gccccgacauacgucggggcc

SEQ ID NO: 1192368 - RNA, 16 nt, Mycobacterium bovis subsp bovis AF2122/97
gcccccguugccgccu

SEQ ID NO: 1192369 - RNA, 21 nt, Mycobacterium bovis subsp bovis AF2122/97
gcccccgugggguguggcggc

SEQ ID NO: 1192370 - RNA, 20 nt, Mycobacterium bovis subsp bovis AF2122/97
gcccccgccauugccgccgg

SEQ ID NO: 1192371 - RNA, 17 nt, Mycobacterium bovis subsp bovis AF2122/97
gcccccgacguugcugg

SEQ ID NO: 1192372 - RNA, 15 nt, Mycobacterium bovis subsp bovis AF2122/97
gcccccgacuccggc

SEQ ID NO: 1192373 - RNA, 14 nt, Mycobacterium bovis subsp bovis AF2122/97
gcccccgcgggggc

SEQ ID NO: 1192374 - RNA, 21 nt, Mycobacterium bovis subsp bovis AF2122/97
gcccccgcgggggcggccggc

SEQ ID NO: 1192375 - RNA, 15 nt, Mycobacterium bovis subsp bovis AF2122/97
gcccccgccggccgc

SEQ ID NO: 1192376 - RNA, 20 nt, Mycobacterium bovis subsp bovis AF2122/97
gcccccguagaugguggugg

SEQ ID NO: 1192377 - RNA, 19 nt, Mycobacterium bovis subsp bovis AF2122/97
gcccccggcuuuuccggca

SEQ ID NO: 1192378 - RNA, 16 nt, Mycobacterium bovis subsp bovis AF2122/97
gcccccggccauggcg

SEQ ID NO: 1192379 - RNA, 14 nt, Mycobacterium bovis subsp bovis AF2122/97
gcccccggcgcggc

SEQ ID NO: 1192380 - RNA, 18 nt, Mycobacterium bovis subsp bovis AF2122/97
gccccgagcugccgucgc

SEQ ID NO: 1192381 - RNA, 22 nt, Mycobacterium bovis subsp bovis AF2122/97
gccccgacauacgucggggccg

SEQ ID NO: 1192382 - RNA, 23 nt, Mycobacterium bovis subsp bovis AF2122/97
gccccgaccgcguacaggccggc

SEQ ID NO: 1192383 - RNA, 15 nt, Mycobacterium bovis subsp bovis AF2122/97
gccccgacugcgccc

SEQ ID NO: 1192384 - RNA, 20 nt, Mycobacterium bovis subsp bovis AF2122/97
gccccgauaaaaaccacccc

SEQ ID NO: 1192385 - RNA, 19 nt, Mycobacterium bovis subsp bovis AF2122/97
gccccgcaggggguggugu

SEQ ID NO: 1192386 - RNA, 11 nt, Mycobacterium bovis subsp bovis AF2122/97
gccccgcccgg

SEQ ID NO: 1192387 - RNA, 19 nt, Mycobacterium bovis subsp bovis AF2122/97
gccccgccaccucgccggc

SEQ ID NO: 1192388 - RNA, 14 nt, Mycobacterium bovis subsp bovis AF2122/97
gccccgccagcgcc

SEQ ID NO: 1192389 - RNA, 14 nt, Mycobacterium bovis subsp bovis AF2122/97
gccccgccagcggc

SEQ ID NO: 1192390 - RNA, 18 nt, Mycobacterium bovis subsp bovis AF2122/97
gccccauacuugcgccga

SEQ ID NO: 1192391 - RNA, 16 nt, Mycobacterium bovis subsp bovis AF2122/97
gccccaucaccaccgg

SEQ ID NO: 1192392 - RNA, 17 nt, Mycobacterium bovis subsp bovis AF2122/97
gccccaucaccaccggc

SEQ ID NO: 1192393 - RNA, 18 nt, Mycobacterium bovis subsp bovis AF2122/97
gccccaugcaacacaccg

SEQ ID NO: 1192394 - RNA, 18 nt, Mycobacterium bovis subsp bovis AF2122/97
gccccaugccgaccggca

SEQ ID NO: 1192395 - RNA, 16 nt, Mycobacterium bovis subsp bovis AF2122/97
gccccaugggggaacc

SEQ ID NO: 1192396 - RNA, 15 nt, Mycobacterium bovis subsp bovis AF2122/97
gccccagugcucauc

SEQ ID NO: 1192397 - RNA, 14 nt, Mycobacterium bovis subsp bovis AF2122/97
gccccagugugcgu

SEQ ID NO: 1192398 - RNA, 17 nt, Mycobacterium bovis subsp bovis AF2122/97
gccccaguccgaagcug

SEQ ID NO: 1192399 - RNA, 12 nt, Mycobacterium bovis subsp bovis AF2122/97
gccccccggcga

SEQ ID NO: 1192400 - RNA, 16 nt, Mycobacterium bovis subsp bovis AF2122/97
gccccccggcgacggc

SEQ ID NO: 1192401 - RNA, 18 nt, Mycobacterium bovis subsp bovis AF2122/97
gccccccggggccgcaac

SEQ ID NO: 1192402 - RNA, 17 nt, Mycobacterium bovis subsp bovis AF2122/97
gccccccgcgccugccu

SEQ ID NO: 1192403 - RNA, 16 nt, Mycobacterium bovis subsp bovis AF2122/97
gcccccauugccgccg

SEQ ID NO: 1192404 - RNA, 17 nt, Mycobacterium bovis subsp bovis AF2122/97
gcccccauugccgccgu

SEQ ID NO: 1192405 - RNA, 21 nt, Mycobacterium bovis subsp bovis AF2122/97
gcccccauugccgccgucgcc

SEQ ID NO: 1192406 - RNA, 16 nt, Mycobacterium bovis subsp bovis AF2122/97
gccccauugccgucgc

SEQ ID NO: 1192407 - RNA, 16 nt, Mycobacterium bovis subsp bovis AF2122/97
gccccauugcgggagc

SEQ ID NO: 1192408 - RNA, 23 nt, Mycobacterium bovis subsp bovis AF2122/97
gccccauucguaucccgcaaacc

SEQ ID NO: 1192409 - RNA, 16 nt, Mycobacterium bovis subsp bovis AF2122/97
gcccccaaaccggcgg

SEQ ID NO: 1192410 - RNA, 18 nt, Mycobacterium bovis subsp bovis AF2122/97
gccagccucaucugaggc

SEQ ID NO: 1192411 - RNA, 23 nt, Mycobacterium bovis subsp bovis AF2122/97
gccagcgaugugaaccgggcacc

SEQ ID NO: 1192412 - RNA, 17 nt, Mycobacterium bovis subsp bovis AF2122/97
gccagccguuuuccuga

SEQ ID NO: 1192413 - RNA, 14 nt, Mycobacterium bovis subsp bovis AF2122/97
gccagccgugcagg

SEQ ID NO: 1192414 - RNA, 21 nt, Mycobacterium bovis subsp bovis AF2122/97
gccagccggauguuggucggc

SEQ ID NO: 1192415 - RNA, 14 nt, Mycobacterium bovis subsp bovis AF2122/97
gccagcagugcggu

SEQ ID NO: 1192416 - RNA, 21 nt, Mycobacterium bovis subsp bovis AF2122/97
gccagcaggggacgggcggcc

SEQ ID NO: 1192417 - RNA, 15 nt, Mycobacterium bovis subsp bovis AF2122/97
gccagcagggccaga

SEQ ID NO: 1192418 - RNA, 18 nt, Mycobacterium bovis subsp bovis AF2122/97
gccagccgcugccacagg

SEQ ID NO: 1192419 - RNA, 19 nt, Mycobacterium bovis subsp bovis AF2122/97
gccagcagguauuugccgu

SEQ ID NO: 1192420 - RNA, 13 nt, Mycobacterium bovis subsp bovis AF2122/97
gccagcagggcca

SEQ ID NO: 1192421 - RNA, 14 nt, Mycobacterium bovis subsp bovis AF2122/97
gccagcagggccac

SEQ ID NO: 1192422 - RNA, 22 nt, Mycobacterium bovis subsp bovis AF2122/97
gccagcagggccaccaccacgg

SEQ ID NO: 1192423 - RNA, 13 nt, Mycobacterium bovis subsp bovis AF2122/97
gccagcaggauga

SEQ ID NO: 1192424 - RNA, 23 nt, Mycobacterium bovis subsp bovis AF2122/97
gccagcaggcggcugaacggcag

SEQ ID NO: 1192425 - RNA, 17 nt, Mycobacterium bovis subsp bovis AF2122/97
gccagcaggaugaugac

SEQ ID NO: 1192426 - RNA, 11 nt, Mycobacterium bovis subsp bovis AF2122/97
gccagcagcag

SEQ ID NO: 1192427 - RNA, 21 nt, Mycobacterium bovis subsp bovis AF2122/97
gccagcagcaaucagccgccu

SEQ ID NO: 1192428 - RNA, 20 nt, Mycobacterium bovis subsp bovis AF2122/97
gccagcagauuaccgagcug

SEQ ID NO: 1192429 - RNA, 13 nt, Mycobacterium bovis subsp bovis AF2122/97
gccagcgcagcac

SEQ ID NO: 1192430 - RNA, 16 nt, Mycobacterium bovis subsp bovis AF2122/97
gccagcgcagccaggc

SEQ ID NO: 1192431 - RNA, 19 nt, Mycobacterium bovis subsp bovis AF2122/97
gccagcgcagccaggcugc

SEQ ID NO: 1192432 - RNA, 12 nt, Mycobacterium bovis subsp bovis AF2122/97
gccagcgcgcgc

SEQ ID NO: 1192433 - RNA, 14 nt, Mycobacterium bovis subsp bovis AF2122/97
gccagcgcgcccgc

SEQ ID NO: 1192434 - RNA, 13 nt, Mycobacterium bovis subsp bovis AF2122/97
gccagcgcggcga

SEQ ID NO: 1192435 - RNA, 23 nt, Mycobacterium bovis subsp bovis AF2122/97
gccagcgcggcgcgcggggccuc

SEQ ID NO: 1192436 - RNA, 16 nt, Mycobacterium bovis subsp bovis AF2122/97
gccagcggcgcgaccg

SEQ ID NO: 1192437 - RNA, 13 nt, Mycobacterium bovis subsp bovis AF2122/97
gccagcggcugcc

SEQ ID NO: 1192438 - RNA, 15 nt, Mycobacterium bovis subsp bovis AF2122/97
gccagcgggcgauga

SEQ ID NO: 1192439 - RNA, 13 nt, Mycobacterium bovis subsp bovis AF2122/97
gccagcgguggac

SEQ ID NO: 1192440 - RNA, 13 nt, Mycobacterium bovis subsp bovis AF2122/97
gccagcuugaggu

SEQ ID NO: 1192441 - RNA, 21 nt, Mycobacterium bovis subsp bovis AF2122/97
gccagcgucaacagcguggag

SEQ ID NO: 1192442 - RNA, 24 nt, Mycobacterium bovis subsp bovis AF2122/97
gccagcgucagcuguuugccggcu

SEQ ID NO: 1192443 - RNA, 14 nt, Mycobacterium bovis subsp bovis AF2122/97
gccagcucccgggc

SEQ ID NO: 1192444 - RNA, 22 nt, Mycobacterium bovis subsp bovis AF2122/97
gccagcucccgggcggcggccu

SEQ ID NO: 1192445 - RNA, 16 nt, Mycobacterium bovis subsp bovis AF2122/97
gccaggaacucggccc

SEQ ID NO: 1192446 - RNA, 23 nt, Mycobacterium bovis subsp bovis AF2122/97
gccaggaaucccucggccgcagg

SEQ ID NO: 1192447 - RNA, 14 nt, Mycobacterium bovis subsp bovis AF2122/97
gccaggcccagcua

SEQ ID NO: 1192448 - RNA, 12 nt, Mycobacterium bovis subsp bovis AF2122/97
gccaggcccccu

SEQ ID NO: 1192449 - RNA, 19 nt, Mycobacterium bovis subsp bovis AF2122/97
gccagggaucagccgugcg

SEQ ID NO: 1192450 - RNA, 21 nt, Mycobacterium bovis subsp bovis AF2122/97
gccagggaucagccgugcggg

SEQ ID NO: 1192451 - RNA, 14 nt, Mycobacterium bovis subsp bovis AF2122/97
gccagggccgccga

SEQ ID NO: 1192452 - RNA, 20 nt, Mycobacterium bovis subsp bovis AF2122/97
gccaggguguugaucucgcc

SEQ ID NO: 1192453 - RNA, 19 nt, Mycobacterium bovis subsp bovis AF2122/97
gccagguacucaguguucc

SEQ ID NO: 1192454 - RNA, 20 nt, Mycobacterium bovis subsp bovis AF2122/97
gccaggucgagcaccggcug

SEQ ID NO: 1192455 - RNA, 22 nt, Mycobacterium bovis subsp bovis AF2122/97
gccaggucgauaccggcgugca

SEQ ID NO: 1192456 - RNA, 14 nt, Mycobacterium bovis subsp bovis AF2122/97
gccagguccgccgg

SEQ ID NO: 1192457 - RNA, 15 nt, Mycobacterium bovis subsp bovis AF2122/97
gccaggucagcucca

SEQ ID NO: 1192458 - RNA, 17 nt, Mycobacterium bovis subsp bovis AF2122/97
gccaggucggccaccgu

SEQ ID NO: 1192459 - RNA, 19 nt, Mycobacterium bovis subsp bovis AF2122/97
gccagugucccgcgcggau

SEQ ID NO: 1192460 - RNA, 20 nt, Mycobacterium bovis subsp bovis AF2122/97
gccaguucggcggccgccgc

SEQ ID NO: 1192461 - RNA, 22 nt, Mycobacterium bovis subsp bovis AF2122/97
gccaguucggcgucguccgcgc

SEQ ID NO: 1192462 - RNA, 21 nt, Mycobacterium bovis subsp bovis AF2122/97
gccaguucggccuugaucgug

SEQ ID NO: 1192463 - RNA, 19 nt, Mycobacterium bovis subsp bovis AF2122/97
gccaguugcguuguccacc

SEQ ID NO: 1192464 - RNA, 18 nt, Mycobacterium bovis subsp bovis AF2122/97
gccaguuuccagaugcac

SEQ ID NO: 1192465 - RNA, 17 nt, Mycobacterium bovis subsp bovis AF2122/97
gccagucgaucgcggcc

SEQ ID NO: 1192466 - RNA, 23 nt, Mycobacterium bovis subsp bovis AF2122/97
gccagucgaucgcggcccgcagc

SEQ ID NO: 1192467 - RNA, 22 nt, Mycobacterium bovis subsp bovis AF2122/97
gccagugcccgcacugccgccg

SEQ ID NO: 1192468 - RNA, 23 nt, Mycobacterium bovis subsp bovis AF2122/97
gccagugcccgcacugccgccgg

SEQ ID NO: 1192469 - RNA, 13 nt, Mycobacterium bovis subsp bovis AF2122/97
gccagugccaccu

SEQ ID NO: 1192470 - RNA, 18 nt, Mycobacterium bovis subsp bovis AF2122/97
gccagugcgcagaacacc

SEQ ID NO: 1192471 - RNA, 13 nt, Mycobacterium bovis subsp bovis AF2122/97
gccagugcgcagc

SEQ ID NO: 1192472 - RNA, 22 nt, Mycobacterium bovis subsp bovis AF2122/97
gccagugcugcaccgauucggg

SEQ ID NO: 1192473 - RNA, 19 nt, Mycobacterium bovis subsp bovis AF2122/97
gccagugaacgcgcgugca

SEQ ID NO: 1192474 - RNA, 21 nt, Mycobacterium bovis subsp bovis AF2122/97
gccaucccgaucccggccagc

SEQ ID NO: 1192475 - RNA, 22 nt, Mycobacterium bovis subsp bovis AF2122/97
gccaucccgaucccggccagcu

SEQ ID NO: 1192476 - RNA, 15 nt, Mycobacterium bovis subsp bovis AF2122/97
gccauccccgccggc

SEQ ID NO: 1192477 - RNA, 15 nt, Mycobacterium bovis subsp bovis AF2122/97
gccauagcgccgcgc

SEQ ID NO: 1192478 - RNA, 19 nt, Mycobacterium bovis subsp bovis AF2122/97
gccauacagcaccccgccg

SEQ ID NO: 1192479 - RNA, 13 nt, Mycobacterium bovis subsp bovis AF2122/97
gccauacuccgag

SEQ ID NO: 1192480 - RNA, 16 nt, Mycobacterium bovis subsp bovis AF2122/97
gccauaccggccgcca

SEQ ID NO: 1192481 - RNA, 22 nt, Mycobacterium bovis subsp bovis AF2122/97
gccauaccggccgccaucaucg

SEQ ID NO: 1192482 - RNA, 18 nt, Mycobacterium bovis subsp bovis AF2122/97
gccauaauucgcccgcuc

SEQ ID NO: 1192483 - RNA, 20 nt, Mycobacterium bovis subsp bovis AF2122/97
gccaucggcuaggccggccg

SEQ ID NO: 1192484 - RNA, 22 nt, Mycobacterium bovis subsp bovis AF2122/97
gccaucgggauggacaccaccu

SEQ ID NO: 1192485 - RNA, 16 nt, Mycobacterium bovis subsp bovis AF2122/97
gccaucgccuccagcc

SEQ ID NO: 1192486 - RNA, 18 nt, Mycobacterium bovis subsp bovis AF2122/97
gccaucgccuccagccgg

SEQ ID NO: 1192487 - RNA, 20 nt, Mycobacterium bovis subsp bovis AF2122/97
gccaucgccuccagccggcg

SEQ ID NO: 1192488 - RNA, 15 nt, Mycobacterium bovis subsp bovis AF2122/97
gccaucggcaccagc

SEQ ID NO: 1192489 - RNA, 15 nt, Mycobacterium bovis subsp bovis AF2122/97
gccaugccgcucggc

SEQ ID NO: 1192490 - RNA, 20 nt, Mycobacterium bovis subsp bovis AF2122/97
gccaugccaagcuccaacca

SEQ ID NO: 1192491 - RNA, 13 nt, Mycobacterium bovis subsp bovis AF2122/97
gccaucgggcgcg

SEQ ID NO: 1192492 - RNA, 15 nt, Mycobacterium bovis subsp bovis AF2122/97
gccaucggugguggc

SEQ ID NO: 1192493 - RNA, 15 nt, Mycobacterium bovis subsp bovis AF2122/97
gccagauaaccggcu

SEQ ID NO: 1192494 - RNA, 19 nt, Mycobacterium bovis subsp bovis AF2122/97
gccagaucuccccgaccgc

SEQ ID NO: 1192495 - RNA, 21 nt, Mycobacterium bovis subsp bovis AF2122/97
gccagaucgaacgcagccagc

SEQ ID NO: 1192496 - RNA, 20 nt, Mycobacterium bovis subsp bovis AF2122/97
gccagaucgaagcgcagcac

SEQ ID NO: 1192497 - RNA, 15 nt, Mycobacterium bovis subsp bovis AF2122/97
gccagaucgcuagga

SEQ ID NO: 1192498 - RNA, 14 nt, Mycobacterium bovis subsp bovis AF2122/97
gccagauaggcacc

SEQ ID NO: 1192499 - RNA, 21 nt, Mycobacterium bovis subsp bovis AF2122/97
gccagaucagcaccgacagcc

SEQ ID NO: 1192500 - RNA, 23 nt, Mycobacterium bovis subsp bovis AF2122/97
gccagaucagcaccgacagcccg

SEQ ID NO: 1192501 - RNA, 16 nt, Mycobacterium bovis subsp bovis AF2122/97
gccagaucagccgccg

SEQ ID NO: 1192502 - RNA, 22 nt, Mycobacterium bovis subsp bovis AF2122/97
gccagcacgguguugcgcaccc

SEQ ID NO: 1192503 - RNA, 16 nt, Mycobacterium bovis subsp bovis AF2122/97
gccagcacgcccgcgc

SEQ ID NO: 1192504 - RNA, 14 nt, Mycobacterium bovis subsp bovis AF2122/97
gccagcacgccgcc

SEQ ID NO: 1192505 - RNA, 15 nt, Mycobacterium bovis subsp bovis AF2122/97
gccagcacgccgccg

SEQ ID NO: 1192506 - RNA, 21 nt, Mycobacterium bovis subsp bovis AF2122/97
gccagcacgccgccggccgcc

SEQ ID NO: 1192507 - RNA, 19 nt, Mycobacterium bovis subsp bovis AF2122/97
gccagauuggcgcugcccg

SEQ ID NO: 1192508 - RNA, 13 nt, Mycobacterium bovis subsp bovis AF2122/97
gccagaccgcggc

SEQ ID NO: 1192509 - RNA, 13 nt, Mycobacterium bovis subsp bovis AF2122/97
gccagaccagggc

SEQ ID NO: 1192510 - RNA, 15 nt, Mycobacterium bovis subsp bovis AF2122/97
gccagaccagggcag

SEQ ID NO: 1192511 - RNA, 19 nt, Mycobacterium bovis subsp bovis AF2122/97
gccagaccagggcagcggc

SEQ ID NO: 1192512 - RNA, 24 nt, Mycobacterium bovis subsp bovis AF2122/97
gccagacccgaauccaccagcugg

SEQ ID NO: 1192513 - RNA, 13 nt, Mycobacterium bovis subsp bovis AF2122/97
gccagaccgcacc

SEQ ID NO: 1192514 - RNA, 19 nt, Mycobacterium bovis subsp bovis AF2122/97
gccagaccgcaccauugcu

SEQ ID NO: 1192515 - RNA, 14 nt, Mycobacterium bovis subsp bovis AF2122/97
gccagaccgcgcgc

SEQ ID NO: 1192516 - RNA, 16 nt, Mycobacterium bovis subsp bovis AF2122/97
gccacugccggugggc

SEQ ID NO: 1192517 - RNA, 13 nt, Mycobacterium bovis subsp bovis AF2122/97
gccacugccagcc

SEQ ID NO: 1192518 - RNA, 14 nt, Mycobacterium bovis subsp bovis AF2122/97
gccacucuggucac

SEQ ID NO: 1192519 - RNA, 12 nt, Mycobacterium bovis subsp bovis AF2122/97
gccacugagcca

SEQ ID NO: 1192520 - RNA, 19 nt, Mycobacterium bovis subsp bovis AF2122/97
gccacgcguuccuccagca

SEQ ID NO: 1192521 - RNA, 18 nt, Mycobacterium bovis subsp bovis AF2122/97
gccacgcugucccgcggg

SEQ ID NO: 1192522 - RNA, 18 nt, Mycobacterium bovis subsp bovis AF2122/97
gccacgccugagccacca

SEQ ID NO: 1192523 - RNA, 13 nt, Mycobacterium bovis subsp bovis AF2122/97
gccacgccgccgg

SEQ ID NO: 1192524 - RNA, 13 nt, Mycobacterium bovis subsp bovis AF2122/97
gccacggcgccua

SEQ ID NO: 1192525 - RNA, 20 nt, Mycobacterium bovis subsp bovis AF2122/97
gccacggcgucggccacccg

SEQ ID NO: 1192526 - RNA, 21 nt, Mycobacterium bovis subsp bovis AF2122/97
gccacgcuucuuccgcgcgcc

SEQ ID NO: 1192527 - RNA, 22 nt, Mycobacterium bovis subsp bovis AF2122/97
gccacgcuucuuccgcgcgccg

SEQ ID NO: 1192528 - RNA, 15 nt, Mycobacterium bovis subsp bovis AF2122/97
gccacggcagcgccc

SEQ ID NO: 1192529 - RNA, 18 nt, Mycobacterium bovis subsp bovis AF2122/97
gccacggcaaaggcgcuc

SEQ ID NO: 1192530 - RNA, 15 nt, Mycobacterium bovis subsp bovis AF2122/97
gccacggcaucggcc

SEQ ID NO: 1192531 - RNA, 19 nt, Mycobacterium bovis subsp bovis AF2122/97
gccacgguucgggcagcac

SEQ ID NO: 1192532 - RNA, 21 nt, Mycobacterium bovis subsp bovis AF2122/97
gccacgguucgggcagcaccc

SEQ ID NO: 1192533 - RNA, 23 nt, Mycobacterium bovis subsp bovis AF2122/97
gccacguccaucaccggcggccc

SEQ ID NO: 1192534 - RNA, 19 nt, Mycobacterium bovis subsp bovis AF2122/97
gccacgucgaugugcgccc

SEQ ID NO: 1192535 - RNA, 21 nt, Mycobacterium bovis subsp bovis AF2122/97
gccacguccaucaccggcggc

SEQ ID NO: 1192536 - RNA, 19 nt, Mycobacterium bovis subsp bovis AF2122/97
gccacguagcagcgccggc

SEQ ID NO: 1192537 - RNA, 21 nt, Mycobacterium bovis subsp bovis AF2122/97
gccacguagcagcgccggcac

SEQ ID NO: 1192538 - RNA, 16 nt, Mycobacterium bovis subsp bovis AF2122/97
gccacgguacauccag

SEQ ID NO: 1192539 - RNA, 12 nt, Mycobacterium bovis subsp bovis AF2122/97
gccacggcggcu

SEQ ID NO: 1192540 - RNA, 18 nt, Mycobacterium bovis subsp bovis AF2122/97
gccacgggcggccaccgc

SEQ ID NO: 1192541 - RNA, 18 nt, Mycobacterium bovis subsp bovis AF2122/97
gccacggguagcugccgc

SEQ ID NO: 1192542 - RNA, 20 nt, Mycobacterium bovis subsp bovis AF2122/97
gccacggguagcugccgcgg

SEQ ID NO: 1192543 - RNA, 22 nt, Mycobacterium bovis subsp bovis AF2122/97
gccacgguccggcccaccagcg

SEQ ID NO: 1192544 - RNA, 20 nt, Mycobacterium bovis subsp bovis AF2122/97
gccacggugacccugguggu

SEQ ID NO: 1192545 - RNA, 21 nt, Mycobacterium bovis subsp bovis AF2122/97
gccacguuacgcucgcgggcc

SEQ ID NO: 1192546 - RNA, 13 nt, Mycobacterium bovis subsp bovis AF2122/97
gccacgucgccgg

SEQ ID NO: 1192547 - RNA, 20 nt, Mycobacterium bovis subsp bovis AF2122/97
gccacugaccgcgaucgccg

SEQ ID NO: 1192548 - RNA, 13 nt, Mycobacterium bovis subsp bovis AF2122/97
gccacucgcccga

SEQ ID NO: 1192549 - RNA, 16 nt, Mycobacterium bovis subsp bovis AF2122/97
gccacucgcccgcugc

SEQ ID NO: 1192550 - RNA, 13 nt, Mycobacterium bovis subsp bovis AF2122/97
gccacucgcgcac

SEQ ID NO: 1192551 - RNA, 15 nt, Mycobacterium bovis subsp bovis AF2122/97
gccacuccaggagcc

SEQ ID NO: 1192552 - RNA, 14 nt, Mycobacterium bovis subsp bovis AF2122/97
gccacucccagcca

SEQ ID NO: 1192553 - RNA, 15 nt, Mycobacterium bovis subsp bovis AF2122/97
gccacuccgguggcc

SEQ ID NO: 1192554 - RNA, 17 nt, Mycobacterium bovis subsp bovis AF2122/97
gccacuccucggugugc

SEQ ID NO: 1192555 - RNA, 18 nt, Mycobacterium bovis subsp bovis AF2122/97
gccaccaccgccgccggc

SEQ ID NO: 1192556 - RNA, 21 nt, Mycobacterium bovis subsp bovis AF2122/97
gccaccaccgugaagcccugg

SEQ ID NO: 1192557 - RNA, 17 nt, Mycobacterium bovis subsp bovis AF2122/97
gccaccaccuccgcguc

SEQ ID NO: 1192558 - RNA, 13 nt, Mycobacterium bovis subsp bovis AF2122/97
gccacaugccaca

SEQ ID NO: 1192559 - RNA, 17 nt, Mycobacterium bovis subsp bovis AF2122/97
gccacaucgccagcagc

SEQ ID NO: 1192560 - RNA, 15 nt, Mycobacterium bovis subsp bovis AF2122/97
gccaccagaaccacu

SEQ ID NO: 1192561 - RNA, 20 nt, Mycobacterium bovis subsp bovis AF2122/97
gccaccacggucaagccggc

SEQ ID NO: 1192562 - RNA, 17 nt, Mycobacterium bovis subsp bovis AF2122/97
gccaccacgccgucgac

SEQ ID NO: 1192563 - RNA, 18 nt, Mycobacterium bovis subsp bovis AF2122/97
gccaccacgcuccccagc

SEQ ID NO: 1192564 - RNA, 21 nt, Mycobacterium bovis subsp bovis AF2122/97
gccaccacgcaugcgcgcgcc

SEQ ID NO: 1192565 - RNA, 23 nt, Mycobacterium bovis subsp bovis AF2122/97
gccaccaccucggugaccaggcc

SEQ ID NO: 1192566 - RNA, 15 nt, Mycobacterium bovis subsp bovis AF2122/97
gccaccagggccacc

SEQ ID NO: 1192567 - RNA, 20 nt, Mycobacterium bovis subsp bovis AF2122/97
gccaccagucacgcccacca

SEQ ID NO: 1192568 - RNA, 21 nt, Mycobacterium bovis subsp bovis AF2122/97
gccaccaggggaccgcggcgc

SEQ ID NO: 1192569 - RNA, 21 nt, Mycobacterium bovis subsp bovis AF2122/97
gccaccgagaucaugccggcg

SEQ ID NO: 1192570 - RNA, 16 nt, Mycobacterium bovis subsp bovis AF2122/97
gccaccagacaacgcc

SEQ ID NO: 1192571 - RNA, 22 nt, Mycobacterium bovis subsp bovis AF2122/97
gccacagucgucgagcgcuccc

SEQ ID NO: 1192572 - RNA, 18 nt, Mycobacterium bovis subsp bovis AF2122/97
gccacaggcguuuccgcu

SEQ ID NO: 1192573 - RNA, 15 nt, Mycobacterium bovis subsp bovis AF2122/97
gccacagggaagcaa

SEQ ID NO: 1192574 - RNA, 16 nt, Mycobacterium bovis subsp bovis AF2122/97
gcauacagcgcccgga

SEQ ID NO: 1192575 - RNA, 19 nt, Mycobacterium bovis subsp bovis AF2122/97
gcauagccacgcaagcaaa

SEQ ID NO: 1192576 - RNA, 17 nt, Mycobacterium bovis subsp bovis AF2122/97
gccacgccgaucaacau

SEQ ID NO: 1192577 - RNA, 19 nt, Mycobacterium bovis subsp bovis AF2122/97
gccacgccgaugggaaccg

SEQ ID NO: 1192578 - RNA, 17 nt, Mycobacterium bovis subsp bovis AF2122/97
gccacgcccgacgccag

SEQ ID NO: 1192579 - RNA, 21 nt, Mycobacterium bovis subsp bovis AF2122/97
gccacgccaccgcggucaccg

SEQ ID NO: 1192580 - RNA, 17 nt, Mycobacterium bovis subsp bovis AF2122/97
gccacgccagcucgccg

SEQ ID NO: 1192581 - RNA, 19 nt, Mycobacterium bovis subsp bovis AF2122/97
gccacgccagcucgccggc

SEQ ID NO: 1192582 - RNA, 20 nt, Mycobacterium bovis subsp bovis AF2122/97
gccacgccagcucgccggcc

SEQ ID NO: 1192583 - RNA, 18 nt, Mycobacterium bovis subsp bovis AF2122/97
gccacgcaugggccaggu

SEQ ID NO: 1192584 - RNA, 16 nt, Mycobacterium bovis subsp bovis AF2122/97
gccacgcccaggcaag

SEQ ID NO: 1192585 - RNA, 20 nt, Mycobacterium bovis subsp bovis AF2122/97
gccacgcccacaggggcagc

SEQ ID NO: 1192586 - RNA, 13 nt, Mycobacterium bovis subsp bovis AF2122/97
gccacgaacugau

SEQ ID NO: 1192587 - RNA, 15 nt, Mycobacterium bovis subsp bovis AF2122/97
gccacgcaccgggug

SEQ ID NO: 1192588 - RNA, 13 nt, Mycobacterium bovis subsp bovis AF2122/97
gccacgacccagc

SEQ ID NO: 1192589 - RNA, 16 nt, Mycobacterium bovis subsp bovis AF2122/97
gccacgacccagcaug

SEQ ID NO: 1192590 - RNA, 17 nt, Mycobacterium bovis subsp bovis AF2122/97
gccacgacgaacaccag

SEQ ID NO: 1192591 - RNA, 14 nt, Mycobacterium bovis subsp bovis AF2122/97
gccaccgcacgcug

SEQ ID NO: 1192592 - RNA, 16 nt, Mycobacterium bovis subsp bovis AF2122/97
gccaccgagcccucca

SEQ ID NO: 1192593 - RNA, 14 nt, Mycobacterium bovis subsp bovis AF2122/97
gccaccgccagcgu

SEQ ID NO: 1192594 - RNA, 13 nt, Mycobacterium bovis subsp bovis AF2122/97
gccaccgccgccg

SEQ ID NO: 1192595 - RNA, 14 nt, Mycobacterium bovis subsp bovis AF2122/97
gccaccgccgccgc

SEQ ID NO: 1192596 - RNA, 16 nt, Mycobacterium bovis subsp bovis AF2122/97
gccaccgccgccgcca

SEQ ID NO: 1192597 - RNA, 15 nt, Mycobacterium bovis subsp bovis AF2122/97
gccaccgccgccugc

SEQ ID NO: 1192598 - RNA, 23 nt, Mycobacterium bovis subsp bovis AF2122/97
gccaccgccgccgccgacgccgc

SEQ ID NO: 1192599 - RNA, 17 nt, Mycobacterium bovis subsp bovis AF2122/97
gccaccgccgccugccc

SEQ ID NO: 1192600 - RNA, 17 nt, Mycobacterium bovis subsp bovis AF2122/97
gccaccggcugcaacca

SEQ ID NO: 1192601 - RNA, 22 nt, Mycobacterium bovis subsp bovis AF2122/97
gccaccggcugcaaccagcggc

SEQ ID NO: 1192602 - RNA, 15 nt, Mycobacterium bovis subsp bovis AF2122/97
gccaccggguggaac

SEQ ID NO: 1192603 - RNA, 20 nt, Mycobacterium bovis subsp bovis AF2122/97
gccaccgguaccgccggcuc

SEQ ID NO: 1192604 - RNA, 18 nt, Mycobacterium bovis subsp bovis AF2122/97
gccaccggugagcgcagc

SEQ ID NO: 1192605 - RNA, 17 nt, Mycobacterium bovis subsp bovis AF2122/97
gccaccgggacgauucu

SEQ ID NO: 1192606 - RNA, 14 nt, Mycobacterium bovis subsp bovis AF2122/97
gccaccggcggugc

SEQ ID NO: 1192607 - RNA, 14 nt, Mycobacterium bovis subsp bovis AF2122/97
gccaccgucaugcc

SEQ ID NO: 1192608 - RNA, 13 nt, Mycobacterium bovis subsp bovis AF2122/97
gccaccgugugca

SEQ ID NO: 1192609 - RNA, 15 nt, Mycobacterium bovis subsp bovis AF2122/97
gccaccguugccgcc

SEQ ID NO: 1192610 - RNA, 16 nt, Mycobacterium bovis subsp bovis AF2122/97
gccaccguugccgccg

SEQ ID NO: 1192611 - RNA, 17 nt, Mycobacterium bovis subsp bovis AF2122/97
gccaccguugccgccgu

SEQ ID NO: 1192612 - RNA, 16 nt, Mycobacterium bovis subsp bovis AF2122/97
gccaccucaucgccau

SEQ ID NO: 1192613 - RNA, 17 nt, Mycobacterium bovis subsp bovis AF2122/97
gccaccgucauggcggg

SEQ ID NO: 1192614 - RNA, 15 nt, Mycobacterium bovis subsp bovis AF2122/97
gccaccgucgcugcc

SEQ ID NO: 1192615 - RNA, 19 nt, Mycobacterium bovis subsp bovis AF2122/97
gccaccgucaccgccguca

SEQ ID NO: 1192616 - RNA, 18 nt, Mycobacterium bovis subsp bovis AF2122/97
gccaccgucagcgcgacc

SEQ ID NO: 1192617 - RNA, 22 nt, Mycobacterium bovis subsp bovis AF2122/97
gccaccuuggacaccacgagcg

SEQ ID NO: 1192618 - RNA, 18 nt, Mycobacterium bovis subsp bovis AF2122/97
gccaccuuagcgcuugcc

SEQ ID NO: 1192619 - RNA, 21 nt, Mycobacterium bovis subsp bovis AF2122/97
gccaccuuagcgcuugccgcu

SEQ ID NO: 1192620 - RNA, 14 nt, Mycobacterium bovis subsp bovis AF2122/97
gccaccugaaagcu

SEQ ID NO: 1192621 - RNA, 22 nt, Mycobacterium bovis subsp bovis AF2122/97
gccaccugacaaacggcuuggc

SEQ ID NO: 1192622 - RNA, 20 nt, Mycobacterium bovis subsp bovis AF2122/97
gccgcccaauugccuccgcu

SEQ ID NO: 1192623 - RNA, 18 nt, Mycobacterium bovis subsp bovis AF2122/97
gccgcccaagccgccggc

SEQ ID NO: 1192624 - RNA, 22 nt, Mycobacterium bovis subsp bovis AF2122/97
gccgccauugagcucccgcaac

SEQ ID NO: 1192625 - RNA, 13 nt, Mycobacterium bovis subsp bovis AF2122/97
gccgccauugccg

SEQ ID NO: 1192626 - RNA, 16 nt, Mycobacterium bovis subsp bovis AF2122/97
gccgccauugccgccg

SEQ ID NO: 1192627 - RNA, 20 nt, Mycobacterium bovis subsp bovis AF2122/97
gccgccauuggacagcgcga

SEQ ID NO: 1192628 - RNA, 13 nt, Mycobacterium bovis subsp bovis AF2122/97
gccgccauuggcu

SEQ ID NO: 1192629 - RNA, 16 nt, Mycobacterium bovis subsp bovis AF2122/97
gccgccauuccagccg

SEQ ID NO: 1192630 - RNA, 16 nt, Mycobacterium bovis subsp bovis AF2122/97
gccgccaugcgcacca

SEQ ID NO: 1192631 - RNA, 13 nt, Mycobacterium bovis subsp bovis AF2122/97
gccgccaucaucg

SEQ ID NO: 1192632 - RNA, 13 nt, Mycobacterium bovis subsp bovis AF2122/97
gccgccagccugg

SEQ ID NO: 1192633 - RNA, 15 nt, Mycobacterium bovis subsp bovis AF2122/97
gccgccagccggcgc

SEQ ID NO: 1192634 - RNA, 12 nt, Mycobacterium bovis subsp bovis AF2122/97
gccgccagcauu

SEQ ID NO: 1192635 - RNA, 17 nt, Mycobacterium bovis subsp bovis AF2122/97
gccgccagccggcgcac

SEQ ID NO: 1192636 - RNA, 13 nt, Mycobacterium bovis subsp bovis AF2122/97
gccgccagcgcgc

SEQ ID NO: 1192637 - RNA, 12 nt, Mycobacterium bovis subsp bovis AF2122/97
gccgccagcggc

SEQ ID NO: 1192638 - RNA, 15 nt, Mycobacterium bovis subsp bovis AF2122/97
gccgccagcgcgccg

SEQ ID NO: 1192639 - RNA, 21 nt, Mycobacterium bovis subsp bovis AF2122/97
gccgccagcgcggccauuagc

SEQ ID NO: 1192640 - RNA, 21 nt, Mycobacterium bovis subsp bovis AF2122/97
gccgccagggcccuagccggc

SEQ ID NO: 1192641 - RNA, 15 nt, Mycobacterium bovis subsp bovis AF2122/97
gccgccaggcggccg

SEQ ID NO: 1192642 - RNA, 23 nt, Mycobacterium bovis subsp bovis AF2122/97
gccgccaucaacaaggggcagca

SEQ ID NO: 1192643 - RNA, 17 nt, Mycobacterium bovis subsp bovis AF2122/97
gccgccaucaccgccgu

SEQ ID NO: 1192644 - RNA, 15 nt, Mycobacterium bovis subsp bovis AF2122/97
gccgccaucagcccu

SEQ ID NO: 1192645 - RNA, 14 nt, Mycobacterium bovis subsp bovis AF2122/97
gccgccaucagccg

SEQ ID NO: 1192646 - RNA, 23 nt, Mycobacterium bovis subsp bovis AF2122/97
gccgccaguccggacggcagccg

SEQ ID NO: 1192647 - RNA, 22 nt, Mycobacterium bovis subsp bovis AF2122/97
gccgcccgcccggacgcaacac

SEQ ID NO: 1192648 - RNA, 19 nt, Mycobacterium bovis subsp bovis AF2122/97
gccgcccggacccaaagca

SEQ ID NO: 1192649 - RNA, 17 nt, Mycobacterium bovis subsp bovis AF2122/97
gccgcccgugccgcccu

SEQ ID NO: 1192650 - RNA, 21 nt, Mycobacterium bovis subsp bovis AF2122/97
gccgcccuggccgcccagacc

SEQ ID NO: 1192651 - RNA, 20 nt, Mycobacterium bovis subsp bovis AF2122/97
gccgcccgcuccgccgucgc

SEQ ID NO: 1192652 - RNA, 20 nt, Mycobacterium bovis subsp bovis AF2122/97
gccgcccgcagggccgccgc

SEQ ID NO: 1192653 - RNA, 23 nt, Mycobacterium bovis subsp bovis AF2122/97
gccgcccgcgccgccgcuacccc

SEQ ID NO: 1192654 - RNA, 17 nt, Mycobacterium bovis subsp bovis AF2122/97
gccgcccgcagggccgc

SEQ ID NO: 1192655 - RNA, 18 nt, Mycobacterium bovis subsp bovis AF2122/97
gccgccccggcgcuggug

SEQ ID NO: 1192656 - RNA, 14 nt, Mycobacterium bovis subsp bovis AF2122/97
gccgccccggcgcu

SEQ ID NO: 1192657 - RNA, 15 nt, Mycobacterium bovis subsp bovis AF2122/97
gccgccccggcgcug

SEQ ID NO: 1192658 - RNA, 22 nt, Mycobacterium bovis subsp bovis AF2122/97
gccgcccgaguuguggacgccc

SEQ ID NO: 1192659 - RNA, 12 nt, Mycobacterium bovis subsp bovis AF2122/97
gccgcccccgcc

SEQ ID NO: 1192660 - RNA, 20 nt, Mycobacterium bovis subsp bovis AF2122/97
gccgccccauacuugcgccg

SEQ ID NO: 1192661 - RNA, 12 nt, Mycobacterium bovis subsp bovis AF2122/97
gccgcccaucac

SEQ ID NO: 1192662 - RNA, 17 nt, Mycobacterium bovis subsp bovis AF2122/97
gccgcccaucaccccga

SEQ ID NO: 1192663 - RNA, 13 nt, Mycobacterium bovis subsp bovis AF2122/97
gccgcccagcgac

SEQ ID NO: 1192664 - RNA, 13 nt, Mycobacterium bovis subsp bovis AF2122/97
gccgcccaggagc

SEQ ID NO: 1192665 - RNA, 20 nt, Mycobacterium bovis subsp bovis AF2122/97
gccgccguuaccgccgcugc

SEQ ID NO: 1192666 - RNA, 17 nt, Mycobacterium bovis subsp bovis AF2122/97
gccgccguucccgccgg

SEQ ID NO: 1192667 - RNA, 18 nt, Mycobacterium bovis subsp bovis AF2122/97
gccgccguucccgccggc

SEQ ID NO: 1192668 - RNA, 22 nt, Mycobacterium bovis subsp bovis AF2122/97
gccgccguugccggcuuggccu

SEQ ID NO: 1192669 - RNA, 22 nt, Mycobacterium bovis subsp bovis AF2122/97
gccgccguugccauugccuccc

SEQ ID NO: 1192670 - RNA, 16 nt, Mycobacterium bovis subsp bovis AF2122/97
gccgccguugccgcca

SEQ ID NO: 1192671 - RNA, 17 nt, Mycobacterium bovis subsp bovis AF2122/97
gccgccguugccgccau

SEQ ID NO: 1192672 - RNA, 17 nt, Mycobacterium bovis subsp bovis AF2122/97
gccgccguugccgccgg

SEQ ID NO: 1192673 - RNA, 16 nt, Mycobacterium bovis subsp bovis AF2122/97
gccgccguugccggcu

SEQ ID NO: 1192674 - RNA, 17 nt, Mycobacterium bovis subsp bovis AF2122/97
gccgccuccgccgaggc

SEQ ID NO: 1192675 - RNA, 13 nt, Mycobacterium bovis subsp bovis AF2122/97
gccgccuccgcgg

SEQ ID NO: 1192676 - RNA, 14 nt, Mycobacterium bovis subsp bovis AF2122/97
gccgccuccgcggc

SEQ ID NO: 1192677 - RNA, 16 nt, Mycobacterium bovis subsp bovis AF2122/97
gccgccucgggcaccu

SEQ ID NO: 1192678 - RNA, 17 nt, Mycobacterium bovis subsp bovis AF2122/97
gccgccucgggcaccug

SEQ ID NO: 1192679 - RNA, 20 nt, Mycobacterium bovis subsp bovis AF2122/97
gccgcgacgcacugccccgc

SEQ ID NO: 1192680 - RNA, 17 nt, Mycobacterium bovis subsp bovis AF2122/97
gccgcgaccagcgccgc

SEQ ID NO: 1192681 - RNA, 21 nt, Mycobacterium bovis subsp bovis AF2122/97
gccgcgaccgcgagcaucugg

SEQ ID NO: 1192682 - RNA, 14 nt, Mycobacterium bovis subsp bovis AF2122/97
gccgcgacgcggcg

SEQ ID NO: 1192683 - RNA, 16 nt, Mycobacterium bovis subsp bovis AF2122/97
gccgcgacugcaccug

SEQ ID NO: 1192684 - RNA, 14 nt, Mycobacterium bovis subsp bovis AF2122/97
gccgcgcaccaaca

SEQ ID NO: 1192685 - RNA, 23 nt, Mycobacterium bovis subsp bovis AF2122/97
gccgcgaaggggugcccggcggc

SEQ ID NO: 1192686 - RNA, 18 nt, Mycobacterium bovis subsp bovis AF2122/97
gccgcgacauccgcggca

SEQ ID NO: 1192687 - RNA, 16 nt, Mycobacterium bovis subsp bovis AF2122/97
gccgcgaaugucgccg

SEQ ID NO: 1192688 - RNA, 19 nt, Mycobacterium bovis subsp bovis AF2122/97
gccgcgaaugucgccgccu

SEQ ID NO: 1192689 - RNA, 20 nt, Mycobacterium bovis subsp bovis AF2122/97
gccgcgaaugucgccgccug

SEQ ID NO: 1192690 - RNA, 14 nt, Mycobacterium bovis subsp bovis AF2122/97
gccgcgaagcgcuc

SEQ ID NO: 1192691 - RNA, 14 nt, Mycobacterium bovis subsp bovis AF2122/97
gccgccggcgccgc

SEQ ID NO: 1192692 - RNA, 17 nt, Mycobacterium bovis subsp bovis AF2122/97
gccgccggcgccgccau

SEQ ID NO: 1192693 - RNA, 16 nt, Mycobacterium bovis subsp bovis AF2122/97
gccgccggcgccgccc

SEQ ID NO: 1192694 - RNA, 17 nt, Mycobacterium bovis subsp bovis AF2122/97
gccgccggcgccgccgu

SEQ ID NO: 1192695 - RNA, 22 nt, Mycobacterium bovis subsp bovis AF2122/97
gccgccggcgccggagccgccc

SEQ ID NO: 1192696 - RNA, 13 nt, Mycobacterium bovis subsp bovis AF2122/97
gccgccggcgcug

SEQ ID NO: 1192697 - RNA, 17 nt, Mycobacterium bovis subsp bovis AF2122/97
gccgccggcuccacccu

SEQ ID NO: 1192698 - RNA, 15 nt, Mycobacterium bovis subsp bovis AF2122/97
gccgccggcucgccg

SEQ ID NO: 1192699 - RNA, 15 nt, Mycobacterium bovis subsp bovis AF2122/97
gccgccggcggcggu

SEQ ID NO: 1192700 - RNA, 12 nt, Mycobacterium bovis subsp bovis AF2122/97
gccgccgucccc

SEQ ID NO: 1192701 - RNA, 20 nt, Mycobacterium bovis subsp bovis AF2122/97
gccgccguccccgccgacgc

SEQ ID NO: 1192702 - RNA, 16 nt, Mycobacterium bovis subsp bovis AF2122/97
gccgccgucgccgcca

SEQ ID NO: 1192703 - RNA, 16 nt, Mycobacterium bovis subsp bovis AF2122/97
gccgccgucgccgccg

SEQ ID NO: 1192704 - RNA, 17 nt, Mycobacterium bovis subsp bovis AF2122/97
gccgccgucgccgccgu

SEQ ID NO: 1192705 - RNA, 15 nt, Mycobacterium bovis subsp bovis AF2122/97
gccgccgucgccgcc

SEQ ID NO: 1192706 - RNA, 22 nt, Mycobacterium bovis subsp bovis AF2122/97
gccgccguccagcgccgcggcc

SEQ ID NO: 1192707 - RNA, 20 nt, Mycobacterium bovis subsp bovis AF2122/97
gccgccggcgccggcgcugc

SEQ ID NO: 1192708 - RNA, 21 nt, Mycobacterium bovis subsp bovis AF2122/97
gccgccgggcaguucaacgag

SEQ ID NO: 1192709 - RNA, 17 nt, Mycobacterium bovis subsp bovis AF2122/97
gccgccgucaccgcccu

SEQ ID NO: 1192710 - RNA, 12 nt, Mycobacterium bovis subsp bovis AF2122/97
gccgccgcccgg

SEQ ID NO: 1192711 - RNA, 14 nt, Mycobacterium bovis subsp bovis AF2122/97
gccgccgccccggc

SEQ ID NO: 1192712 - RNA, 12 nt, Mycobacterium bovis subsp bovis AF2122/97
gccgccggccgg

SEQ ID NO: 1192713 - RNA, 13 nt, Mycobacterium bovis subsp bovis AF2122/97
gccgccgccgcca

SEQ ID NO: 1192714 - RNA, 13 nt, Mycobacterium bovis subsp bovis AF2122/97
gccgccggcgccc

SEQ ID NO: 1192715 - RNA, 17 nt, Mycobacterium bovis subsp bovis AF2122/97
gccgccggcgcccaggc

SEQ ID NO: 1192716 - RNA, 13 nt, Mycobacterium bovis subsp bovis AF2122/97
gccgccggcgcca

SEQ ID NO: 1192717 - RNA, 15 nt, Mycobacterium bovis subsp bovis AF2122/97
gccgccggcgccacc

SEQ ID NO: 1192718 - RNA, 15 nt, Mycobacterium bovis subsp bovis AF2122/97
gccgccggcgccagc

SEQ ID NO: 1192719 - RNA, 19 nt, Mycobacterium bovis subsp bovis AF2122/97
gccgccgccaccggcgccg

SEQ ID NO: 1192720 - RNA, 20 nt, Mycobacterium bovis subsp bovis AF2122/97
gccgccgccaccggcgccgc

SEQ ID NO: 1192721 - RNA, 15 nt, Mycobacterium bovis subsp bovis AF2122/97
gccgccgcacaucug

SEQ ID NO: 1192722 - RNA, 18 nt, Mycobacterium bovis subsp bovis AF2122/97
gccgcccugguccaggcc

SEQ ID NO: 1192723 - RNA, 19 nt, Mycobacterium bovis subsp bovis AF2122/97
gccgccacagcacccacgc

SEQ ID NO: 1192724 - RNA, 15 nt, Mycobacterium bovis subsp bovis AF2122/97
gccgccacaccgccg

SEQ ID NO: 1192725 - RNA, 18 nt, Mycobacterium bovis subsp bovis AF2122/97
gccgccaaccgcaggccg

SEQ ID NO: 1192726 - RNA, 20 nt, Mycobacterium bovis subsp bovis AF2122/97
gccgccaacuccagcacccg

SEQ ID NO: 1192727 - RNA, 23 nt, Mycobacterium bovis subsp bovis AF2122/97
gccgccaacuccucagccgccug

SEQ ID NO: 1192728 - RNA, 21 nt, Mycobacterium bovis subsp bovis AF2122/97
gccgccaacuucaccacccug

SEQ ID NO: 1192729 - RNA, 14 nt, Mycobacterium bovis subsp bovis AF2122/97
gccgcaugcucagc

SEQ ID NO: 1192730 - RNA, 16 nt, Mycobacterium bovis subsp bovis AF2122/97
gccgccaccggcgccg

SEQ ID NO: 1192731 - RNA, 20 nt, Mycobacterium bovis subsp bovis AF2122/97
gccgccacgguacauccaga

SEQ ID NO: 1192732 - RNA, 21 nt, Mycobacterium bovis subsp bovis AF2122/97
gccgccaccuuggcugggccc

SEQ ID NO: 1192733 - RNA, 15 nt, Mycobacterium bovis subsp bovis AF2122/97
gccgccaccgcacgc

SEQ ID NO: 1192734 - RNA, 21 nt, Mycobacterium bovis subsp bovis AF2122/97
gccgccacgguacauccagag

SEQ ID NO: 1192735 - RNA, 18 nt, Mycobacterium bovis subsp bovis AF2122/97
gccgccaccccgcgcgcc

SEQ ID NO: 1192736 - RNA, 17 nt, Mycobacterium bovis subsp bovis AF2122/97
gccgccacccggcgggc

SEQ ID NO: 1192737 - RNA, 15 nt, Mycobacterium bovis subsp bovis AF2122/97
gccgccaccaccggc

SEQ ID NO: 1192738 - RNA, 21 nt, Mycobacterium bovis subsp bovis AF2122/97
gccgccagcaccucggccagc

SEQ ID NO: 1192739 - RNA, 18 nt, Mycobacterium bovis subsp bovis AF2122/97
gccgccagcaccaccggc

SEQ ID NO: 1192740 - RNA, 12 nt, Mycobacterium bovis subsp bovis AF2122/97
gccgccagcccc

SEQ ID NO: 1192741 - RNA, 18 nt, Mycobacterium bovis subsp bovis AF2122/97
gccgccagauuggcgcug

SEQ ID NO: 1192742 - RNA, 22 nt, Mycobacterium bovis subsp bovis AF2122/97
gccgcagaugaaagugccagug

SEQ ID NO: 1192743 - RNA, 12 nt, Mycobacterium bovis subsp bovis AF2122/97
gccgcagccugc

SEQ ID NO: 1192744 - RNA, 14 nt, Mycobacterium bovis subsp bovis AF2122/97
gccgcagcggcggc

SEQ ID NO: 1192745 - RNA, 15 nt, Mycobacterium bovis subsp bovis AF2122/97
gccgcaggcuugccg

SEQ ID NO: 1192746 - RNA, 16 nt, Mycobacterium bovis subsp bovis AF2122/97
gccgcaggccauggga

SEQ ID NO: 1192747 - RNA, 20 nt, Mycobacterium bovis subsp bovis AF2122/97
gccgcaggcucucuuugagc

SEQ ID NO: 1192748 - RNA, 15 nt, Mycobacterium bovis subsp bovis AF2122/97
gccgcauaucacccg

SEQ ID NO: 1192749 - RNA, 19 nt, Mycobacterium bovis subsp bovis AF2122/97
gccgcauaggccccgccag

SEQ ID NO: 1192750 - RNA, 23 nt, Mycobacterium bovis subsp bovis AF2122/97
gccgcaucgacgcucaucucggg

SEQ ID NO: 1192751 - RNA, 18 nt, Mycobacterium bovis subsp bovis AF2122/97
gccgaucacugucgggua

SEQ ID NO: 1192752 - RNA, 21 nt, Mycobacterium bovis subsp bovis AF2122/97
gccgaucagcgaaccaccggc

SEQ ID NO: 1192753 - RNA, 12 nt, Mycobacterium bovis subsp bovis AF2122/97
gccgaucggcac

SEQ ID NO: 1192754 - RNA, 19 nt, Mycobacterium bovis subsp bovis AF2122/97
gccgaucucgcccagcgag

SEQ ID NO: 1192755 - RNA, 18 nt, Mycobacterium bovis subsp bovis AF2122/97
gccgaucucuccggcggc

SEQ ID NO: 1192756 - RNA, 16 nt, Mycobacterium bovis subsp bovis AF2122/97
gccgaugaccgcaacc

SEQ ID NO: 1192757 - RNA, 16 nt, Mycobacterium bovis subsp bovis AF2122/97
gccgaucugcucgccg

SEQ ID NO: 1192758 - RNA, 13 nt, Mycobacterium bovis subsp bovis AF2122/97
gccgaugaccugc

SEQ ID NO: 1192759 - RNA, 16 nt, Mycobacterium bovis subsp bovis AF2122/97
gccgaugaccugcccg

SEQ ID NO: 1192760 - RNA, 20 nt, Mycobacterium bovis subsp bovis AF2122/97
gccgaugacgaugccgccga

SEQ ID NO: 1192761 - RNA, 15 nt, Mycobacterium bovis subsp bovis AF2122/97
gcccugguccaggcc

SEQ ID NO: 1192762 - RNA, 18 nt, Mycobacterium bovis subsp bovis AF2122/97
gcccugguccaggcccug

SEQ ID NO: 1192763 - RNA, 20 nt, Mycobacterium bovis subsp bovis AF2122/97
gcccugggugauggccgcgc

SEQ ID NO: 1192764 - RNA, 19 nt, Mycobacterium bovis subsp bovis AF2122/97
gccgaucaaccccccgggc

SEQ ID NO: 1192765 - RNA, 15 nt, Mycobacterium bovis subsp bovis AF2122/97
gccgaucaccaccgg

SEQ ID NO: 1192766 - RNA, 16 nt, Mycobacterium bovis subsp bovis AF2122/97
gccgaucaccaccggc

SEQ ID NO: 1192767 - RNA, 23 nt, Mycobacterium bovis subsp bovis AF2122/97
gccgaucaccgccggggcuggug

SEQ ID NO: 1192768 - RNA, 16 nt, Mycobacterium bovis subsp bovis AF2122/97
gccgaucaccgcugug

SEQ ID NO: 1192769 - RNA, 15 nt, Mycobacterium bovis subsp bovis AF2122/97
gccgauaucugccac

SEQ ID NO: 1192770 - RNA, 21 nt, Mycobacterium bovis subsp bovis AF2122/97
gccgauaugcgugagcugcuc

SEQ ID NO: 1192771 - RNA, 19 nt, Mycobacterium bovis subsp bovis AF2122/97
gccgauaccggcggcgagc

SEQ ID NO: 1192772 - RNA, 14 nt, Mycobacterium bovis subsp bovis AF2122/97
gccgcaccagcauu

SEQ ID NO: 1192773 - RNA, 19 nt, Mycobacterium bovis subsp bovis AF2122/97
gccgcaccagaucgucggg

SEQ ID NO: 1192774 - RNA, 17 nt, Mycobacterium bovis subsp bovis AF2122/97
gccgcacaugagcugga

SEQ ID NO: 1192775 - RNA, 20 nt, Mycobacterium bovis subsp bovis AF2122/97
gccgcacauugguguccacc

SEQ ID NO: 1192776 - RNA, 21 nt, Mycobacterium bovis subsp bovis AF2122/97
gccgcacauugguguccacca

SEQ ID NO: 1192777 - RNA, 17 nt, Mycobacterium bovis subsp bovis AF2122/97
gccgauggugauggggg

SEQ ID NO: 1192778 - RNA, 15 nt, Mycobacterium bovis subsp bovis AF2122/97
gccgaugcugccgcc

SEQ ID NO: 1192779 - RNA, 18 nt, Mycobacterium bovis subsp bovis AF2122/97
gccgaugcugccgccgcc

SEQ ID NO: 1192780 - RNA, 18 nt, Mycobacterium bovis subsp bovis AF2122/97
gccgaugcugcgggcggu

SEQ ID NO: 1192781 - RNA, 18 nt, Mycobacterium bovis subsp bovis AF2122/97
gccgaugcgacccgcaga

SEQ ID NO: 1192782 - RNA, 21 nt, Mycobacterium bovis subsp bovis AF2122/97
gccgauggcuaccccagggag

SEQ ID NO: 1192783 - RNA, 16 nt, Mycobacterium bovis subsp bovis AF2122/97
gccgcacccgcucccg

SEQ ID NO: 1192784 - RNA, 14 nt, Mycobacterium bovis subsp bovis AF2122/97
gccgcaccgccacc

SEQ ID NO: 1192785 - RNA, 20 nt, Mycobacterium bovis subsp bovis AF2122/97
gccgcaccgccugcucggcg

SEQ ID NO: 1192786 - RNA, 13 nt, Mycobacterium bovis subsp bovis AF2122/97
gccgcaccgcugu

SEQ ID NO: 1192787 - RNA, 15 nt, Mycobacterium bovis subsp bovis AF2122/97
gccgcacgcuagccg

SEQ ID NO: 1192788 - RNA, 17 nt, Mycobacterium bovis subsp bovis AF2122/97
gccgcacgggcccagga

SEQ ID NO: 1192789 - RNA, 19 nt, Mycobacterium bovis subsp bovis AF2122/97
gccgcaccggugcucgucg

SEQ ID NO: 1192790 - RNA, 21 nt, Mycobacterium bovis subsp bovis AF2122/97
gccgcacucggucgggggugc

SEQ ID NO: 1192791 - RNA, 15 nt, Mycobacterium bovis subsp bovis AF2122/97
gccgcacuuucuucc

SEQ ID NO: 1192792 - RNA, 18 nt, Mycobacterium bovis subsp bovis AF2122/97
gccgcagaaucccaacuc

SEQ ID NO: 1192793 - RNA, 21 nt, Mycobacterium bovis subsp bovis AF2122/97
gccgcagaaucccaacuccuc

SEQ ID NO: 1192794 - RNA, 22 nt, Mycobacterium bovis subsp bovis AF2122/97
gccgcagaaucccaacuccucc

SEQ ID NO: 1192795 - RNA, 21 nt, Mycobacterium bovis subsp bovis AF2122/97
gccggcauccgguucgccgcc

SEQ ID NO: 1192796 - RNA, 23 nt, Mycobacterium bovis subsp bovis AF2122/97
gccggcauccgguucgccgccgu

SEQ ID NO: 1192797 - RNA, 21 nt, Mycobacterium bovis subsp bovis AF2122/97
gccggcaucgucgacgcccga

SEQ ID NO: 1192798 - RNA, 21 nt, Mycobacterium bovis subsp bovis AF2122/97
gccggcauugacccauccggc

SEQ ID NO: 1192799 - RNA, 17 nt, Mycobacterium bovis subsp bovis AF2122/97
gccggccauacgcgcgc

SEQ ID NO: 1192800 - RNA, 22 nt, Mycobacterium bovis subsp bovis AF2122/97
gccggccauacgcgcgcggucg

SEQ ID NO: 1192801 - RNA, 15 nt, Mycobacterium bovis subsp bovis AF2122/97
gccggcccagagauu

SEQ ID NO: 1192802 - RNA, 22 nt, Mycobacterium bovis subsp bovis AF2122/97
gccggccccgccgaugccgccg

SEQ ID NO: 1192803 - RNA, 13 nt, Mycobacterium bovis subsp bovis AF2122/97
gccggccccgcca

SEQ ID NO: 1192804 - RNA, 17 nt, Mycobacterium bovis subsp bovis AF2122/97
gccggccccgcccgcgc

SEQ ID NO: 1192805 - RNA, 22 nt, Mycobacterium bovis subsp bovis AF2122/97
gccggcccgcaggcuuccccga

SEQ ID NO: 1192806 - RNA, 14 nt, Mycobacterium bovis subsp bovis AF2122/97
gccggccccgccgg

SEQ ID NO: 1192807 - RNA, 15 nt, Mycobacterium bovis subsp bovis AF2122/97
gccggccccgccggc

SEQ ID NO: 1192808 - RNA, 23 nt, Mycobacterium bovis subsp bovis AF2122/97
gccggccccgccggccccgccgu

SEQ ID NO: 1192809 - RNA, 16 nt, Mycobacterium bovis subsp bovis AF2122/97
gccggccccgccggcg

SEQ ID NO: 1192810 - RNA, 17 nt, Mycobacterium bovis subsp bovis AF2122/97
gccggccccgccgucgc

SEQ ID NO: 1192811 - RNA, 20 nt, Mycobacterium bovis subsp bovis AF2122/97
gccggcccggguaucgccag

SEQ ID NO: 1192812 - RNA, 14 nt, Mycobacterium bovis subsp bovis AF2122/97
gccggcccugcggc

SEQ ID NO: 1192813 - RNA, 19 nt, Mycobacterium bovis subsp bovis AF2122/97
gccggcccugcggccaaug

SEQ ID NO: 1192814 - RNA, 22 nt, Mycobacterium bovis subsp bovis AF2122/97
gccggcccugcucgccgucucg

SEQ ID NO: 1192815 - RNA, 16 nt, Mycobacterium bovis subsp bovis AF2122/97
gccggccgccagcgca

SEQ ID NO: 1192816 - RNA, 14 nt, Mycobacterium bovis subsp bovis AF2122/97
gccggccgccgcgg

SEQ ID NO: 1192817 - RNA, 14 nt, Mycobacterium bovis subsp bovis AF2122/97
gccggccgcgcaga

SEQ ID NO: 1192818 - RNA, 21 nt, Mycobacterium bovis subsp bovis AF2122/97
gccggccggcaaugccgcggc

SEQ ID NO: 1192819 - RNA, 16 nt, Mycobacterium bovis subsp bovis AF2122/97
gccggccggcccauuc

SEQ ID NO: 1192820 - RNA, 14 nt, Mycobacterium bovis subsp bovis AF2122/97
gccggccgcggggc

SEQ ID NO: 1192821 - RNA, 15 nt, Mycobacterium bovis subsp bovis AF2122/97
gccggccgcgcuggu

SEQ ID NO: 1192822 - RNA, 12 nt, Mycobacterium bovis subsp bovis AF2122/97
gccggccgcggg

SEQ ID NO: 1192823 - RNA, 13 nt, Mycobacterium bovis subsp bovis AF2122/97
gccggccggaacg

SEQ ID NO: 1192824 - RNA, 14 nt, Mycobacterium bovis subsp bovis AF2122/97
gccggcgauggccc

SEQ ID NO: 1192825 - RNA, 16 nt, Mycobacterium bovis subsp bovis AF2122/97
gccggcgaccaggauu

SEQ ID NO: 1192826 - RNA, 14 nt, Mycobacterium bovis subsp bovis AF2122/97
gccggcgagggcca

SEQ ID NO: 1192827 - RNA, 15 nt, Mycobacterium bovis subsp bovis AF2122/97
gccggcgagggccac

SEQ ID NO: 1192828 - RNA, 17 nt, Mycobacterium bovis subsp bovis AF2122/97
gccggcgagggccacgg

SEQ ID NO: 1192829 - RNA, 18 nt, Mycobacterium bovis subsp bovis AF2122/97
gccggcgaacucgcgccg

SEQ ID NO: 1192830 - RNA, 19 nt, Mycobacterium bovis subsp bovis AF2122/97
gccggcgacaccgcaggug

SEQ ID NO: 1192831 - RNA, 13 nt, Mycobacterium bovis subsp bovis AF2122/97
gccggcgaccggg

SEQ ID NO: 1192832 - RNA, 22 nt, Mycobacterium bovis subsp bovis AF2122/97
gccggcgaccgggcccccaggu

SEQ ID NO: 1192833 - RNA, 18 nt, Mycobacterium bovis subsp bovis AF2122/97
gccggcgacgggucgggc

SEQ ID NO: 1192834 - RNA, 15 nt, Mycobacterium bovis subsp bovis AF2122/97
gccggcgccaccguc

SEQ ID NO: 1192835 - RNA, 19 nt, Mycobacterium bovis subsp bovis AF2122/97
gccggcgccacccgcgccg

SEQ ID NO: 1192836 - RNA, 17 nt, Mycobacterium bovis subsp bovis AF2122/97
gccggcgccacccgcgc

SEQ ID NO: 1192837 - RNA, 12 nt, Mycobacterium bovis subsp bovis AF2122/97
gccggcgcccgc

SEQ ID NO: 1192838 - RNA, 14 nt, Mycobacterium bovis subsp bovis AF2122/97
gccggccgggugua

SEQ ID NO: 1192839 - RNA, 13 nt, Mycobacterium bovis subsp bovis AF2122/97
gccggccucugga

SEQ ID NO: 1192840 - RNA, 16 nt, Mycobacterium bovis subsp bovis AF2122/97
gccggccuagccgaug

SEQ ID NO: 1192841 - RNA, 21 nt, Mycobacterium bovis subsp bovis AF2122/97
gccggccuagccgauggcuac

SEQ ID NO: 1192842 - RNA, 17 nt, Mycobacterium bovis subsp bovis AF2122/97
gccggccuugagcaccc

SEQ ID NO: 1192843 - RNA, 12 nt, Mycobacterium bovis subsp bovis AF2122/97
gccggcgccgcc

SEQ ID NO: 1192844 - RNA, 18 nt, Mycobacterium bovis subsp bovis AF2122/97
gccggcgccgccagcacc

SEQ ID NO: 1192845 - RNA, 15 nt, Mycobacterium bovis subsp bovis AF2122/97
gccggcgcccgccgc

SEQ ID NO: 1192846 - RNA, 15 nt, Mycobacterium bovis subsp bovis AF2122/97
gccggcgcggcggcg

SEQ ID NO: 1192847 - RNA, 23 nt, Mycobacterium bovis subsp bovis AF2122/97
gccggcggcaaagaacagccggc

SEQ ID NO: 1192848 - RNA, 17 nt, Mycobacterium bovis subsp bovis AF2122/97
gccggcgcugcccgggc

SEQ ID NO: 1192849 - RNA, 15 nt, Mycobacterium bovis subsp bovis AF2122/97
gccggcgcucgcggc

SEQ ID NO: 1192850 - RNA, 21 nt, Mycobacterium bovis subsp bovis AF2122/97
gccggcggacgcccggcgcac

SEQ ID NO: 1192851 - RNA, 14 nt, Mycobacterium bovis subsp bovis AF2122/97
gccggcggccgccc

SEQ ID NO: 1192852 - RNA, 14 nt, Mycobacterium bovis subsp bovis AF2122/97
gccggcggcccgcu

SEQ ID NO: 1192853 - RNA, 15 nt, Mycobacterium bovis subsp bovis AF2122/97
gccggcuccacccuu

SEQ ID NO: 1192854 - RNA, 16 nt, Mycobacterium bovis subsp bovis AF2122/97
gccggcuccgccguug

SEQ ID NO: 1192855 - RNA, 14 nt, Mycobacterium bovis subsp bovis AF2122/97
gccggcugacaacg

SEQ ID NO: 1192856 - RNA, 18 nt, Mycobacterium bovis subsp bovis AF2122/97
gccggcugcauccuccuc

SEQ ID NO: 1192857 - RNA, 21 nt, Mycobacterium bovis subsp bovis AF2122/97
gccggcuuaaggcccuggccg

SEQ ID NO: 1192858 - RNA, 22 nt, Mycobacterium bovis subsp bovis AF2122/97
gccggcuucgcccagagccgcu

SEQ ID NO: 1192859 - RNA, 16 nt, Mycobacterium bovis subsp bovis AF2122/97
gccggcuucggcgagc

SEQ ID NO: 1192860 - RNA, 20 nt, Mycobacterium bovis subsp bovis AF2122/97
gccggcuucggugagcgggc

SEQ ID NO: 1192861 - RNA, 17 nt, Mycobacterium bovis subsp bovis AF2122/97
gccgggcaaccagcagc

SEQ ID NO: 1192862 - RNA, 18 nt, Mycobacterium bovis subsp bovis AF2122/97
gccgggcaaccagcagca

SEQ ID NO: 1192863 - RNA, 19 nt, Mycobacterium bovis subsp bovis AF2122/97
gccgggcaaccagcagcag

SEQ ID NO: 1192864 - RNA, 13 nt, Mycobacterium bovis subsp bovis AF2122/97
gccgggcaccacc

SEQ ID NO: 1192865 - RNA, 18 nt, Mycobacterium bovis subsp bovis AF2122/97
gccgggcaccaccacacc

SEQ ID NO: 1192866 - RNA, 15 nt, Mycobacterium bovis subsp bovis AF2122/97
gccgggccgccgagc

SEQ ID NO: 1192867 - RNA, 16 nt, Mycobacterium bovis subsp bovis AF2122/97
gccgggccgccgagcg

SEQ ID NO: 1192868 - RNA, 11 nt, Mycobacterium bovis subsp bovis AF2122/97
gccgggcccag

SEQ ID NO: 1192869 - RNA, 15 nt, Mycobacterium bovis subsp bovis AF2122/97
gccgggccgcgcggg

SEQ ID NO: 1192870 - RNA, 17 nt, Mycobacterium bovis subsp bovis AF2122/97
gccgggccguguccgcc

SEQ ID NO: 1192871 - RNA, 19 nt, Mycobacterium bovis subsp bovis AF2122/97
gccgggcaguuuggcggca

SEQ ID NO: 1192872 - RNA, 12 nt, Mycobacterium bovis subsp bovis AF2122/97
gccgggccaggc

SEQ ID NO: 1192873 - RNA, 14 nt, Mycobacterium bovis subsp bovis AF2122/97
gccgggggcgccgc

SEQ ID NO: 1192874 - RNA, 15 nt, Mycobacterium bovis subsp bovis AF2122/97
gccgggggcgccgcc

SEQ ID NO: 1192875 - RNA, 19 nt, Mycobacterium bovis subsp bovis AF2122/97
gccggggcgucgcaacccg

SEQ ID NO: 1192876 - RNA, 21 nt, Mycobacterium bovis subsp bovis AF2122/97
gccggggccccaugccgaccg

SEQ ID NO: 1192877 - RNA, 21 nt, Mycobacterium bovis subsp bovis AF2122/97
gccggggcgaugucggcuggu

SEQ ID NO: 1192878 - RNA, 18 nt, Mycobacterium bovis subsp bovis AF2122/97
gccggggccgcuggcggu

SEQ ID NO: 1192879 - RNA, 17 nt, Mycobacterium bovis subsp bovis AF2122/97
gccgggcgcacgcccgc

SEQ ID NO: 1192880 - RNA, 22 nt, Mycobacterium bovis subsp bovis AF2122/97
gccgggcgaguacaggcgcagc

SEQ ID NO: 1192881 - RNA, 17 nt, Mycobacterium bovis subsp bovis AF2122/97
gccgggcgaugcugggc

SEQ ID NO: 1192882 - RNA, 15 nt, Mycobacterium bovis subsp bovis AF2122/97
gccggggccccaugc

SEQ ID NO: 1192883 - RNA, 15 nt, Mycobacterium bovis subsp bovis AF2122/97
gccggggcaaacggg

SEQ ID NO: 1192884 - RNA, 18 nt, Mycobacterium bovis subsp bovis AF2122/97
gccggggacgccgcggcg

SEQ ID NO: 1192885 - RNA, 20 nt, Mycobacterium bovis subsp bovis AF2122/97
gccgcucguuacgccgagca

SEQ ID NO: 1192886 - RNA, 15 nt, Mycobacterium bovis subsp bovis AF2122/97
gccgcugagcccugc

SEQ ID NO: 1192887 - RNA, 17 nt, Mycobacterium bovis subsp bovis AF2122/97
gccgcugagcccugcgc

SEQ ID NO: 1192888 - RNA, 20 nt, Mycobacterium bovis subsp bovis AF2122/97
gccgcuggcaaucccgcggu

SEQ ID NO: 1192889 - RNA, 22 nt, Mycobacterium bovis subsp bovis AF2122/97
gccgcuggcaaucccgcggucg

SEQ ID NO: 1192890 - RNA, 22 nt, Mycobacterium bovis subsp bovis AF2122/97
gccgcugaucaaggcgcucccg

SEQ ID NO: 1192891 - RNA, 18 nt, Mycobacterium bovis subsp bovis AF2122/97
gccgcugaucugccgccg

SEQ ID NO: 1192892 - RNA, 21 nt, Mycobacterium bovis subsp bovis AF2122/97
gccgcugaucugccgccgcgg

SEQ ID NO: 1192893 - RNA, 22 nt, Mycobacterium bovis subsp bovis AF2122/97
gccgcugaucugccgccgcggc

SEQ ID NO: 1192894 - RNA, 14 nt, Mycobacterium bovis subsp bovis AF2122/97
gccgcuggccagca

SEQ ID NO: 1192895 - RNA, 20 nt, Mycobacterium bovis subsp bovis AF2122/97
gccgcuggagaucacgccga

SEQ ID NO: 1192896 - RNA, 18 nt, Mycobacterium bovis subsp bovis AF2122/97
gccgcuaggacggcgcga

SEQ ID NO: 1192897 - RNA, 17 nt, Mycobacterium bovis subsp bovis AF2122/97
gccgcuaccgcccgcgc

SEQ ID NO: 1192898 - RNA, 20 nt, Mycobacterium bovis subsp bovis AF2122/97
gccgcuaccgcccgcgccac

SEQ ID NO: 1192899 - RNA, 21 nt, Mycobacterium bovis subsp bovis AF2122/97
gccgcuaccgcccgcgccacc

SEQ ID NO: 1192900 - RNA, 21 nt, Mycobacterium bovis subsp bovis AF2122/97
gccgcguaccaauucccgcgc

SEQ ID NO: 1192901 - RNA, 20 nt, Mycobacterium bovis subsp bovis AF2122/97
gccgcguaaaccggcugacc

SEQ ID NO: 1192902 - RNA, 16 nt, Mycobacterium bovis subsp bovis AF2122/97
gccgcguugccggucg

SEQ ID NO: 1192903 - RNA, 12 nt, Mycobacterium bovis subsp bovis AF2122/97
gccgcgggcgcg

SEQ ID NO: 1192904 - RNA, 13 nt, Mycobacterium bovis subsp bovis AF2122/97
gccgcgggcgccg

SEQ ID NO: 1192905 - RNA, 14 nt, Mycobacterium bovis subsp bovis AF2122/97
gccgcgggcgcggc

SEQ ID NO: 1192906 - RNA, 17 nt, Mycobacterium bovis subsp bovis AF2122/97
gccgcgggcuccccggc

SEQ ID NO: 1192907 - RNA, 15 nt, Mycobacterium bovis subsp bovis AF2122/97
gccgcgggugcggca

SEQ ID NO: 1192908 - RNA, 17 nt, Mycobacterium bovis subsp bovis AF2122/97
gccgcgguagacgccgc

SEQ ID NO: 1192909 - RNA, 17 nt, Mycobacterium bovis subsp bovis AF2122/97
gccgcggucggcgugca

SEQ ID NO: 1192910 - RNA, 19 nt, Mycobacterium bovis subsp bovis AF2122/97
gccgcggucggcgugcagg

SEQ ID NO: 1192911 - RNA, 20 nt, Mycobacterium bovis subsp bovis AF2122/97
gccgcggucggcgugcaggg

SEQ ID NO: 1192912 - RNA, 19 nt, Mycobacterium bovis subsp bovis AF2122/97
gccgcgguagacgccgccg

SEQ ID NO: 1192913 - RNA, 15 nt, Mycobacterium bovis subsp bovis AF2122/97
gccgcggucggccac

SEQ ID NO: 1192914 - RNA, 16 nt, Mycobacterium bovis subsp bovis AF2122/97
gccgcggucggccacc

SEQ ID NO: 1192915 - RNA, 21 nt, Mycobacterium bovis subsp bovis AF2122/97
gccgcggucgugaucagcagg

SEQ ID NO: 1192916 - RNA, 21 nt, Mycobacterium bovis subsp bovis AF2122/97
gccgcggcuacaucggcggcg

SEQ ID NO: 1192917 - RNA, 23 nt, Mycobacterium bovis subsp bovis AF2122/97
gccgcgggacagauggcggccga

SEQ ID NO: 1192918 - RNA, 22 nt, Mycobacterium bovis subsp bovis AF2122/97
gccgcgggacaccaccgcccgc

SEQ ID NO: 1192919 - RNA, 23 nt, Mycobacterium bovis subsp bovis AF2122/97
gccgcggcuggugucgggcguca

SEQ ID NO: 1192920 - RNA, 19 nt, Mycobacterium bovis subsp bovis AF2122/97
gccgcgcccaaugcgggcu

SEQ ID NO: 1192921 - RNA, 11 nt, Mycobacterium bovis subsp bovis AF2122/97
gccgcggcggu

SEQ ID NO: 1192922 - RNA, 14 nt, Mycobacterium bovis subsp bovis AF2122/97
gccgcgcagcgagg

SEQ ID NO: 1192923 - RNA, 22 nt, Mycobacterium bovis subsp bovis AF2122/97
gccggcaaccgggaggccaccg

SEQ ID NO: 1192924 - RNA, 22 nt, Mycobacterium bovis subsp bovis AF2122/97
gccggcaagaccgaacagcggc

SEQ ID NO: 1192925 - RNA, 18 nt, Mycobacterium bovis subsp bovis AF2122/97
gccggcaacggcgcgccg

SEQ ID NO: 1192926 - RNA, 17 nt, Mycobacterium bovis subsp bovis AF2122/97
gccggcaauaccgccag

SEQ ID NO: 1192927 - RNA, 17 nt, Mycobacterium bovis subsp bovis AF2122/97
gccggcaacgugcggug

SEQ ID NO: 1192928 - RNA, 13 nt, Mycobacterium bovis subsp bovis AF2122/97
gccggcaagcagu

SEQ ID NO: 1192929 - RNA, 20 nt, Mycobacterium bovis subsp bovis AF2122/97
gccggcaauaccgccagcgc

SEQ ID NO: 1192930 - RNA, 16 nt, Mycobacterium bovis subsp bovis AF2122/97
gccggcacccgucggg

SEQ ID NO: 1192931 - RNA, 16 nt, Mycobacterium bovis subsp bovis AF2122/97
gccggcaccccacggc

SEQ ID NO: 1192932 - RNA, 15 nt, Mycobacterium bovis subsp bovis AF2122/97
gccggcacccgccgu

SEQ ID NO: 1192933 - RNA, 13 nt, Mycobacterium bovis subsp bovis AF2122/97
gccggcaccaacc

SEQ ID NO: 1192934 - RNA, 17 nt, Mycobacterium bovis subsp bovis AF2122/97
gccggcacccaccagug

SEQ ID NO: 1192935 - RNA, 19 nt, Mycobacterium bovis subsp bovis AF2122/97
gccggcacccaccagugca

SEQ ID NO: 1192936 - RNA, 16 nt, Mycobacterium bovis subsp bovis AF2122/97
gccggcauagcggccc

SEQ ID NO: 1192937 - RNA, 13 nt, Mycobacterium bovis subsp bovis AF2122/97
gccggcagugagu

SEQ ID NO: 1192938 - RNA, 20 nt, Mycobacterium bovis subsp bovis AF2122/97
gccggcagugggggugguac

SEQ ID NO: 1192939 - RNA, 18 nt, Mycobacterium bovis subsp bovis AF2122/97
gccggcagcggcgcgcug

SEQ ID NO: 1192940 - RNA, 13 nt, Mycobacterium bovis subsp bovis AF2122/97
gccggcagcggcg

SEQ ID NO: 1192941 - RNA, 15 nt, Mycobacterium bovis subsp bovis AF2122/97
gccggcagcggcgag

SEQ ID NO: 1192942 - RNA, 22 nt, Mycobacterium bovis subsp bovis AF2122/97
gccggaucccugugccagcagc

SEQ ID NO: 1192943 - RNA, 20 nt, Mycobacterium bovis subsp bovis AF2122/97
gccggauucggcugccaccg

SEQ ID NO: 1192944 - RNA, 20 nt, Mycobacterium bovis subsp bovis AF2122/97
gccggauucuccgcccucag

SEQ ID NO: 1192945 - RNA, 12 nt, Mycobacterium bovis subsp bovis AF2122/97
gccggcaacagc

SEQ ID NO: 1192946 - RNA, 17 nt, Mycobacterium bovis subsp bovis AF2122/97
gccggcaacagcucgcc

SEQ ID NO: 1192947 - RNA, 15 nt, Mycobacterium bovis subsp bovis AF2122/97
gccggauagcgcagc

SEQ ID NO: 1192948 - RNA, 17 nt, Mycobacterium bovis subsp bovis AF2122/97
gccggauagcgcagcuc

SEQ ID NO: 1192949 - RNA, 20 nt, Mycobacterium bovis subsp bovis AF2122/97
gccggacagcucgcgcucgc

SEQ ID NO: 1192950 - RNA, 23 nt, Mycobacterium bovis subsp bovis AF2122/97
gccggacccaccgucacccccga

SEQ ID NO: 1192951 - RNA, 17 nt, Mycobacterium bovis subsp bovis AF2122/97
gccggacccggucgccg

SEQ ID NO: 1192952 - RNA, 21 nt, Mycobacterium bovis subsp bovis AF2122/97
gccggacccgucgagcagcau

SEQ ID NO: 1192953 - RNA, 20 nt, Mycobacterium bovis subsp bovis AF2122/97
gccggaccgcgacggcgccg

SEQ ID NO: 1192954 - RNA, 17 nt, Mycobacterium bovis subsp bovis AF2122/97
gccggacgacaacaggc

SEQ ID NO: 1192955 - RNA, 17 nt, Mycobacterium bovis subsp bovis AF2122/97
gccggaggaucgcuggu

SEQ ID NO: 1192956 - RNA, 17 nt, Mycobacterium bovis subsp bovis AF2122/97
gccggacgggugcagcg

SEQ ID NO: 1192957 - RNA, 16 nt, Mycobacterium bovis subsp bovis AF2122/97
gccggacgggugcggg

SEQ ID NO: 1192958 - RNA, 19 nt, Mycobacterium bovis subsp bovis AF2122/97
gccgcuuucgccggcgcca

SEQ ID NO: 1192959 - RNA, 15 nt, Mycobacterium bovis subsp bovis AF2122/97
gccgcuggggcgccc

SEQ ID NO: 1192960 - RNA, 14 nt, Mycobacterium bovis subsp bovis AF2122/97
gccgcuggugguga

SEQ ID NO: 1192961 - RNA, 14 nt, Mycobacterium bovis subsp bovis AF2122/97
gccgcugguggcgc

SEQ ID NO: 1192962 - RNA, 22 nt, Mycobacterium bovis subsp bovis AF2122/97
gccgcugucguaccgcucggcg

SEQ ID NO: 1192963 - RNA, 16 nt, Mycobacterium bovis subsp bovis AF2122/97
gccgcuuggcgcggcc

SEQ ID NO: 1192964 - RNA, 14 nt, Mycobacterium bovis subsp bovis AF2122/97
gccgcuugggccug

SEQ ID NO: 1192965 - RNA, 22 nt, Mycobacterium bovis subsp bovis AF2122/97
gccgcuugggccugggccgcac

SEQ ID NO: 1192966 - RNA, 13 nt, Mycobacterium bovis subsp bovis AF2122/97
gccucggcgcugc

SEQ ID NO: 1192967 - RNA, 16 nt, Mycobacterium bovis subsp bovis AF2122/97
gccucggcgccgccca

SEQ ID NO: 1192968 - RNA, 21 nt, Mycobacterium bovis subsp bovis AF2122/97
gccucggcgaugggccggucc

SEQ ID NO: 1192969 - RNA, 15 nt, Mycobacterium bovis subsp bovis AF2122/97
gccucggcgccgccc

SEQ ID NO: 1192970 - RNA, 18 nt, Mycobacterium bovis subsp bovis AF2122/97
gccucggcgccgcccagc

SEQ ID NO: 1192971 - RNA, 20 nt, Mycobacterium bovis subsp bovis AF2122/97
gccucggcggccagcucggc

SEQ ID NO: 1192972 - RNA, 23 nt, Mycobacterium bovis subsp bovis AF2122/97
gccucggcguaggcgauggcggc

SEQ ID NO: 1192973 - RNA, 18 nt, Mycobacterium bovis subsp bovis AF2122/97
gccucgggacucccgcgc

SEQ ID NO: 1192974 - RNA, 20 nt, Mycobacterium bovis subsp bovis AF2122/97
gccucgggaggcagcgcgag

SEQ ID NO: 1192975 - RNA, 14 nt, Mycobacterium bovis subsp bovis AF2122/97
gccucgggcaccug

SEQ ID NO: 1192976 - RNA, 18 nt, Mycobacterium bovis subsp bovis AF2122/97
gccucgggccggcguagc

SEQ ID NO: 1192977 - RNA, 21 nt, Mycobacterium bovis subsp bovis AF2122/97
gccucggagaucgagaucacc

SEQ ID NO: 1192978 - RNA, 23 nt, Mycobacterium bovis subsp bovis AF2122/97
gccucguuagaguaggccaccac

SEQ ID NO: 1192979 - RNA, 22 nt, Mycobacterium bovis subsp bovis AF2122/97
gccucgucgauguucgccgcgc

SEQ ID NO: 1192980 - RNA, 15 nt, Mycobacterium bovis subsp bovis AF2122/97
gccucggcaugcagc

SEQ ID NO: 1192981 - RNA, 18 nt, Mycobacterium bovis subsp bovis AF2122/97
gccucggcaugcagcccc

SEQ ID NO: 1192982 - RNA, 15 nt, Mycobacterium bovis subsp bovis AF2122/97
gccucgccggccacc

SEQ ID NO: 1192983 - RNA, 22 nt, Mycobacterium bovis subsp bovis AF2122/97
gccucgcggaugagcucggcca

SEQ ID NO: 1192984 - RNA, 21 nt, Mycobacterium bovis subsp bovis AF2122/97
gccucgcgggaagucccgagu

SEQ ID NO: 1192985 - RNA, 18 nt, Mycobacterium bovis subsp bovis AF2122/97
gccucgcgggcagggccu

SEQ ID NO: 1192986 - RNA, 19 nt, Mycobacterium bovis subsp bovis AF2122/97
gccucgauuguggccagcg

SEQ ID NO: 1192987 - RNA, 19 nt, Mycobacterium bovis subsp bovis AF2122/97
gccucgcccagcaaggccc

SEQ ID NO: 1192988 - RNA, 18 nt, Mycobacterium bovis subsp bovis AF2122/97
gccucgacacccagccgc

SEQ ID NO: 1192989 - RNA, 21 nt, Mycobacterium bovis subsp bovis AF2122/97
gccucgacacccagccgcagc

SEQ ID NO: 1192990 - RNA, 21 nt, Mycobacterium bovis subsp bovis AF2122/97
gccucgagguauucgcgcagc

SEQ ID NO: 1192991 - RNA, 13 nt, Mycobacterium bovis subsp bovis AF2122/97
gccucgaucgacu

SEQ ID NO: 1192992 - RNA, 22 nt, Mycobacterium bovis subsp bovis AF2122/97
gccucgauccgcaucaugucga

SEQ ID NO: 1192993 - RNA, 18 nt, Mycobacterium bovis subsp bovis AF2122/97
gccuccgcugccgcccgc

SEQ ID NO: 1192994 - RNA, 21 nt, Mycobacterium bovis subsp bovis AF2122/97
gccuccucgacgucggcgagc

SEQ ID NO: 1192995 - RNA, 13 nt, Mycobacterium bovis subsp bovis AF2122/97
gccuccucgugca

SEQ ID NO: 1192996 - RNA, 21 nt, Mycobacterium bovis subsp bovis AF2122/97
gccuccucuuggguccacaac

SEQ ID NO: 1192997 - RNA, 15 nt, Mycobacterium bovis subsp bovis AF2122/97
gccuccugccgccgc

SEQ ID NO: 1192998 - RNA, 15 nt, Mycobacterium bovis subsp bovis AF2122/97
gccucgaccgccagc

SEQ ID NO: 1192999 - RNA, 14 nt, Mycobacterium bovis subsp bovis AF2122/97
gccucgacacccag

SEQ ID NO: 1193000 - RNA, 16 nt, Mycobacterium bovis subsp bovis AF2122/97
gccucgaacgccgccc

SEQ ID NO: 1193001 - RNA, 18 nt, Mycobacterium bovis subsp bovis AF2122/97
gccucgaacgccgcccgc

SEQ ID NO: 1193002 - RNA, 13 nt, Mycobacterium bovis subsp bovis AF2122/97
gccuccauggccu

SEQ ID NO: 1193003 - RNA, 15 nt, Mycobacterium bovis subsp bovis AF2122/97
gccucccuuuuccaa

SEQ ID NO: 1193004 - RNA, 13 nt, Mycobacterium bovis subsp bovis AF2122/97
gccucccgggccg

SEQ ID NO: 1193005 - RNA, 19 nt, Mycobacterium bovis subsp bovis AF2122/97
gccucccgggccgccgcga

SEQ ID NO: 1193006 - RNA, 16 nt, Mycobacterium bovis subsp bovis AF2122/97
gccuccccgaccugca

SEQ ID NO: 1193007 - RNA, 21 nt, Mycobacterium bovis subsp bovis AF2122/97
gccuccacucuucgggcggcg

SEQ ID NO: 1193008 - RNA, 15 nt, Mycobacterium bovis subsp bovis AF2122/97
gccuccacccgccac

SEQ ID NO: 1193009 - RNA, 18 nt, Mycobacterium bovis subsp bovis AF2122/97
gccuccaccgcguccagg

SEQ ID NO: 1193010 - RNA, 14 nt, Mycobacterium bovis subsp bovis AF2122/97
gccuccaagcccgc

SEQ ID NO: 1193011 - RNA, 18 nt, Mycobacterium bovis subsp bovis AF2122/97
gccuccaagcccgccgga

SEQ ID NO: 1193012 - RNA, 19 nt, Mycobacterium bovis subsp bovis AF2122/97
gccuccaaaaucgcggcca

SEQ ID NO: 1193013 - RNA, 21 nt, Mycobacterium bovis subsp bovis AF2122/97
gccuccaaaaucgcggccaca

SEQ ID NO: 1193014 - RNA, 13 nt, Mycobacterium bovis subsp bovis AF2122/97
gccuccagccggc

SEQ ID NO: 1193015 - RNA, 13 nt, Mycobacterium bovis subsp bovis AF2122/97
gccuccagcaccc

SEQ ID NO: 1193016 - RNA, 20 nt, Mycobacterium bovis subsp bovis AF2122/97
gccuccagauucgccgccca

SEQ ID NO: 1193017 - RNA, 21 nt, Mycobacterium bovis subsp bovis AF2122/97
gccuccagcagguccgcggcc

SEQ ID NO: 1193018 - RNA, 23 nt, Mycobacterium bovis subsp bovis AF2122/97
gccuccagcagguccgcggccgc

SEQ ID NO: 1193019 - RNA, 19 nt, Mycobacterium bovis subsp bovis AF2122/97
gccucagcuaccccggcgg

SEQ ID NO: 1193020 - RNA, 21 nt, Mycobacterium bovis subsp bovis AF2122/97
gccucaucugaggcuuccagc

SEQ ID NO: 1193021 - RNA, 19 nt, Mycobacterium bovis subsp bovis AF2122/97
gccucaucggacagcgccu

SEQ ID NO: 1193022 - RNA, 21 nt, Mycobacterium bovis subsp bovis AF2122/97
gccucaucggcaaacuccugc

SEQ ID NO: 1193023 - RNA, 19 nt, Mycobacterium bovis subsp bovis AF2122/97
gccguggucgagggcggcg

SEQ ID NO: 1193024 - RNA, 16 nt, Mycobacterium bovis subsp bovis AF2122/97
gccgugggccuguugc

SEQ ID NO: 1193025 - RNA, 17 nt, Mycobacterium bovis subsp bovis AF2122/97
gccguguuccagguaca

SEQ ID NO: 1193026 - RNA, 18 nt, Mycobacterium bovis subsp bovis AF2122/97
gccgugucaccgggugca

SEQ ID NO: 1193027 - RNA, 14 nt, Mycobacterium bovis subsp bovis AF2122/97
gccgugucgggcgc

SEQ ID NO: 1193028 - RNA, 20 nt, Mycobacterium bovis subsp bovis AF2122/97
gccguggugaaaugccgaga

SEQ ID NO: 1193029 - RNA, 23 nt, Mycobacterium bovis subsp bovis AF2122/97
gccgugguggucucgagggugaa

SEQ ID NO: 1193030 - RNA, 14 nt, Mycobacterium bovis subsp bovis AF2122/97
gccguguccgccgg

SEQ ID NO: 1193031 - RNA, 17 nt, Mycobacterium bovis subsp bovis AF2122/97
gccguucgucgcgggug

SEQ ID NO: 1193032 - RNA, 22 nt, Mycobacterium bovis subsp bovis AF2122/97
gccgugcccaggccaccggcug

SEQ ID NO: 1193033 - RNA, 15 nt, Mycobacterium bovis subsp bovis AF2122/97
gccgugccgugguga

SEQ ID NO: 1193034 - RNA, 15 nt, Mycobacterium bovis subsp bovis AF2122/97
gccgugccgccagca

SEQ ID NO: 1193035 - RNA, 16 nt, Mycobacterium bovis subsp bovis AF2122/97
gccguggcggacggcg

SEQ ID NO: 1193036 - RNA, 18 nt, Mycobacterium bovis subsp bovis AF2122/97
gccgugccucgaggacgg

SEQ ID NO: 1193037 - RNA, 21 nt, Mycobacterium bovis subsp bovis AF2122/97
gccgugcaauagcucgggcgc

SEQ ID NO: 1193038 - RNA, 16 nt, Mycobacterium bovis subsp bovis AF2122/97
gccgugcaccagcgac

SEQ ID NO: 1193039 - RNA, 21 nt, Mycobacterium bovis subsp bovis AF2122/97
gccgucgucgucgcuguaggc

SEQ ID NO: 1193040 - RNA, 17 nt, Mycobacterium bovis subsp bovis AF2122/97
gccgucuagcacacgcu

SEQ ID NO: 1193041 - RNA, 20 nt, Mycobacterium bovis subsp bovis AF2122/97
gccgucguccgcugacccgc

SEQ ID NO: 1193042 - RNA, 14 nt, Mycobacterium bovis subsp bovis AF2122/97
gccgucgucgccgu

SEQ ID NO: 1193043 - RNA, 23 nt, Mycobacterium bovis subsp bovis AF2122/97
gccgucguacucgaccgcgagca

SEQ ID NO: 1193044 - RNA, 20 nt, Mycobacterium bovis subsp bovis AF2122/97
gccgucgggugcagcacggc

SEQ ID NO: 1193045 - RNA, 17 nt, Mycobacterium bovis subsp bovis AF2122/97
gccgucggugccgccgc

SEQ ID NO: 1193046 - RNA, 18 nt, Mycobacterium bovis subsp bovis AF2122/97
gccgucggugccgccgcc

SEQ ID NO: 1193047 - RNA, 19 nt, Mycobacterium bovis subsp bovis AF2122/97
gccgucggugccgccgccg

SEQ ID NO: 1193048 - RNA, 17 nt, Mycobacterium bovis subsp bovis AF2122/97
gccgucgggcagcagca

SEQ ID NO: 1193049 - RNA, 23 nt, Mycobacterium bovis subsp bovis AF2122/97
gccgucggggaguucgcgcagca

SEQ ID NO: 1193050 - RNA, 18 nt, Mycobacterium bovis subsp bovis AF2122/97
gccgguacacguccagug

SEQ ID NO: 1193051 - RNA, 22 nt, Mycobacterium bovis subsp bovis AF2122/97
gccgguacacguccaguggcag

SEQ ID NO: 1193052 - RNA, 19 nt, Mycobacterium bovis subsp bovis AF2122/97
gccgucggcguacagcgcc

SEQ ID NO: 1193053 - RNA, 14 nt, Mycobacterium bovis subsp bovis AF2122/97
gccgucggcgugca

SEQ ID NO: 1193054 - RNA, 17 nt, Mycobacterium bovis subsp bovis AF2122/97
gccggguuaucggcagc

SEQ ID NO: 1193055 - RNA, 15 nt, Mycobacterium bovis subsp bovis AF2122/97
gccgucggcgccggc

SEQ ID NO: 1193056 - RNA, 23 nt, Mycobacterium bovis subsp bovis AF2122/97
gccgggucgaacaggccggccgc

SEQ ID NO: 1193057 - RNA, 22 nt, Mycobacterium bovis subsp bovis AF2122/97
gccgggucagcccggcgcgauc

SEQ ID NO: 1193058 - RNA, 14 nt, Mycobacterium bovis subsp bovis AF2122/97
gccgggugcgagcg

SEQ ID NO: 1193059 - RNA, 16 nt, Mycobacterium bovis subsp bovis AF2122/97
gccgggugcgccguug

SEQ ID NO: 1193060 - RNA, 21 nt, Mycobacterium bovis subsp bovis AF2122/97
gccgggugcgccguugccgcc

SEQ ID NO: 1193061 - RNA, 20 nt, Mycobacterium bovis subsp bovis AF2122/97
gccgggguagacgccccgga

SEQ ID NO: 1193062 - RNA, 18 nt, Mycobacterium bovis subsp bovis AF2122/97
gccgggguaggggucgag

SEQ ID NO: 1193063 - RNA, 18 nt, Mycobacterium bovis subsp bovis AF2122/97
gccggggcggaaccuguc

SEQ ID NO: 1193064 - RNA, 19 nt, Mycobacterium bovis subsp bovis AF2122/97
gccgggucagcccggcgcg

SEQ ID NO: 1193065 - RNA, 16 nt, Mycobacterium bovis subsp bovis AF2122/97
gccgggguggcgcgcc

SEQ ID NO: 1193066 - RNA, 13 nt, Mycobacterium bovis subsp bovis AF2122/97
gccggggugugca

SEQ ID NO: 1193067 - RNA, 15 nt, Mycobacterium bovis subsp bovis AF2122/97
gccggggugugcggg

SEQ ID NO: 1193068 - RNA, 16 nt, Mycobacterium bovis subsp bovis AF2122/97
gccguugccauugccu

SEQ ID NO: 1193069 - RNA, 22 nt, Mycobacterium bovis subsp bovis AF2122/97
gccguugccgaucagcccggcc

SEQ ID NO: 1193070 - RNA, 18 nt, Mycobacterium bovis subsp bovis AF2122/97
gccguugauucggccgcc

SEQ ID NO: 1193071 - RNA, 13 nt, Mycobacterium bovis subsp bovis AF2122/97
gccguuggcggcg

SEQ ID NO: 1193072 - RNA, 22 nt, Mycobacterium bovis subsp bovis AF2122/97
gccguugggaaccgacuugguu

SEQ ID NO: 1193073 - RNA, 22 nt, Mycobacterium bovis subsp bovis AF2122/97
gccguugggcaccguguagcug

SEQ ID NO: 1193074 - RNA, 21 nt, Mycobacterium bovis subsp bovis AF2122/97
gccguugcuauucgccagcgc

SEQ ID NO: 1193075 - RNA, 21 nt, Mycobacterium bovis subsp bovis AF2122/97
gccuaaguucgccacgcccga

SEQ ID NO: 1193076 - RNA, 17 nt, Mycobacterium bovis subsp bovis AF2122/97
gccuaacucgccugcac

SEQ ID NO: 1193077 - RNA, 18 nt, Mycobacterium bovis subsp bovis AF2122/97
gccuaccggccuuuccag

SEQ ID NO: 1193078 - RNA, 23 nt, Mycobacterium bovis subsp bovis AF2122/97
gccuaccggccuuuccagcaccc

SEQ ID NO: 1193079 - RNA, 14 nt, Mycobacterium bovis subsp bovis AF2122/97
gccuaccagcaccg

SEQ ID NO: 1193080 - RNA, 17 nt, Mycobacterium bovis subsp bovis AF2122/97
gccucaccggcgcgagc

SEQ ID NO: 1193081 - RNA, 18 nt, Mycobacterium bovis subsp bovis AF2122/97
gccucaccgacgucgcca

SEQ ID NO: 1193082 - RNA, 18 nt, Mycobacterium bovis subsp bovis AF2122/97
gccucaaugaccaccggg

SEQ ID NO: 1193083 - RNA, 14 nt, Mycobacterium bovis subsp bovis AF2122/97
gccuaggacaccgg

SEQ ID NO: 1193084 - RNA, 14 nt, Mycobacterium bovis subsp bovis AF2122/97
gccuagugguucga

SEQ ID NO: 1193085 - RNA, 21 nt, Mycobacterium bovis subsp bovis AF2122/97
gccuaguccggcacugcggcc

SEQ ID NO: 1193086 - RNA, 16 nt, Mycobacterium bovis subsp bovis AF2122/97
gccuagggcggcggcg

SEQ ID NO: 1193087 - RNA, 23 nt, Mycobacterium bovis subsp bovis AF2122/97
gccuaggucgacgccgaccaccc

SEQ ID NO: 1193088 - RNA, 13 nt, Mycobacterium bovis subsp bovis AF2122/97
gccuagccgcagc

SEQ ID NO: 1193089 - RNA, 14 nt, Mycobacterium bovis subsp bovis AF2122/97
gccuagccgcggca

SEQ ID NO: 1193090 - RNA, 16 nt, Mycobacterium bovis subsp bovis AF2122/97
gccuagccgcggcacc

SEQ ID NO: 1193091 - RNA, 15 nt, Mycobacterium bovis subsp bovis AF2122/97
gccugagcgccgcgg

SEQ ID NO: 1193092 - RNA, 14 nt, Mycobacterium bovis subsp bovis AF2122/97
gccugauaaagccc

SEQ ID NO: 1193093 - RNA, 23 nt, Mycobacterium bovis subsp bovis AF2122/97
gccugauaaagcccggcggcaug

SEQ ID NO: 1193094 - RNA, 18 nt, Mycobacterium bovis subsp bovis AF2122/97
gccugacgcgucagcggc

SEQ ID NO: 1193095 - RNA, 14 nt, Mycobacterium bovis subsp bovis AF2122/97
gccugaugcggccg

SEQ ID NO: 1193096 - RNA, 15 nt, Mycobacterium bovis subsp bovis AF2122/97
gccucugcucagccg

SEQ ID NO: 1193097 - RNA, 22 nt, Mycobacterium bovis subsp bovis AF2122/97
gccucucuucccaaccgcccgu

SEQ ID NO: 1193098 - RNA, 17 nt, Mycobacterium bovis subsp bovis AF2122/97
gccucugaccagccggu

SEQ ID NO: 1193099 - RNA, 18 nt, Mycobacterium bovis subsp bovis AF2122/97
gccucucgaccucagaca

SEQ ID NO: 1193100 - RNA, 21 nt, Mycobacterium bovis subsp bovis AF2122/97
gccucucgggggccgagccga

SEQ ID NO: 1193101 - RNA, 14 nt, Mycobacterium bovis subsp bovis AF2122/97
gccugcgcccagcc

SEQ ID NO: 1193102 - RNA, 13 nt, Mycobacterium bovis subsp bovis AF2122/97
gccugcgccgccc

SEQ ID NO: 1193103 - RNA, 13 nt, Mycobacterium bovis subsp bovis AF2122/97
gccugcgcagacu

SEQ ID NO: 1193104 - RNA, 15 nt, Mycobacterium bovis subsp bovis AF2122/97
gccugcgccacccgc

SEQ ID NO: 1193105 - RNA, 21 nt, Mycobacterium bovis subsp bovis AF2122/97
gccugcgcgaugcgauucugc

SEQ ID NO: 1193106 - RNA, 17 nt, Mycobacterium bovis subsp bovis AF2122/97
gccugcgccgcccgcgc

SEQ ID NO: 1193107 - RNA, 13 nt, Mycobacterium bovis subsp bovis AF2122/97
gccugcgccgcgc

SEQ ID NO: 1193108 - RNA, 13 nt, Mycobacterium bovis subsp bovis AF2122/97
gccugcgcacgac

SEQ ID NO: 1193109 - RNA, 18 nt, Mycobacterium bovis subsp bovis AF2122/97
gccugcgaaacgcuggcc

SEQ ID NO: 1193110 - RNA, 15 nt, Mycobacterium bovis subsp bovis AF2122/97
gccugccgaugacga

SEQ ID NO: 1193111 - RNA, 16 nt, Mycobacterium bovis subsp bovis AF2122/97
gccugccgaugacgau

SEQ ID NO: 1193112 - RNA, 17 nt, Mycobacterium bovis subsp bovis AF2122/97
gccugccccacccgcgg

SEQ ID NO: 1193113 - RNA, 14 nt, Mycobacterium bovis subsp bovis AF2122/97
gccugcccccgcgc

SEQ ID NO: 1193114 - RNA, 17 nt, Mycobacterium bovis subsp bovis AF2122/97
gccugcccccgcgcgca

SEQ ID NO: 1193115 - RNA, 20 nt, Mycobacterium bovis subsp bovis AF2122/97
gccugcccccgcgcgcacgg

SEQ ID NO: 1193116 - RNA, 13 nt, Mycobacterium bovis subsp bovis AF2122/97
gccugcccgccgu

SEQ ID NO: 1193117 - RNA, 21 nt, Mycobacterium bovis subsp bovis AF2122/97
gccugccgaaacgccgaccgc

SEQ ID NO: 1193118 - RNA, 18 nt, Mycobacterium bovis subsp bovis AF2122/97
gccugccgacggcaucaa

SEQ ID NO: 1193119 - RNA, 22 nt, Mycobacterium bovis subsp bovis AF2122/97
gccugcagcgaaacaccggcca

SEQ ID NO: 1193120 - RNA, 23 nt, Mycobacterium bovis subsp bovis AF2122/97
gccugcagcgaaacaccggccag

SEQ ID NO: 1193121 - RNA, 13 nt, Mycobacterium bovis subsp bovis AF2122/97
gccugcacgccgg

SEQ ID NO: 1193122 - RNA, 15 nt, Mycobacterium bovis subsp bovis AF2122/97
gccugcaagacaaag

SEQ ID NO: 1193123 - RNA, 16 nt, Mycobacterium bovis subsp bovis AF2122/97
gccugcaccgccgccg

SEQ ID NO: 1193124 - RNA, 16 nt, Mycobacterium bovis subsp bovis AF2122/97
gccugccaccggcgcu

SEQ ID NO: 1193125 - RNA, 12 nt, Mycobacterium bovis subsp bovis AF2122/97
gccugcaggccg

SEQ ID NO: 1193126 - RNA, 19 nt, Mycobacterium bovis subsp bovis AF2122/97
gccugcaggccgccggcca

SEQ ID NO: 1193127 - RNA, 19 nt, Mycobacterium bovis subsp bovis AF2122/97
gccugcagguuuccggccu

SEQ ID NO: 1193128 - RNA, 19 nt, Mycobacterium bovis subsp bovis AF2122/97
gccugguguccgagcggcc

SEQ ID NO: 1193129 - RNA, 22 nt, Mycobacterium bovis subsp bovis AF2122/97
gccuggguuggugauugcggcc

SEQ ID NO: 1193130 - RNA, 15 nt, Mycobacterium bovis subsp bovis AF2122/97
gccugggcggccagc

SEQ ID NO: 1193131 - RNA, 17 nt, Mycobacterium bovis subsp bovis AF2122/97
gccugggccagccgcuc

SEQ ID NO: 1193132 - RNA, 17 nt, Mycobacterium bovis subsp bovis AF2122/97
gccugggccgcacaagu

SEQ ID NO: 1193133 - RNA, 20 nt, Mycobacterium bovis subsp bovis AF2122/97
gccuggcuacgcgcgcccga

SEQ ID NO: 1193134 - RNA, 23 nt, Mycobacterium bovis subsp bovis AF2122/97
gccuggcuaguugggugggugca

SEQ ID NO: 1193135 - RNA, 13 nt, Mycobacterium bovis subsp bovis AF2122/97
gccuggcuggcca

SEQ ID NO: 1193136 - RNA, 15 nt, Mycobacterium bovis subsp bovis AF2122/97
gccuggcuggccagc

SEQ ID NO: 1193137 - RNA, 15 nt, Mycobacterium bovis subsp bovis AF2122/97
gccuggcggcgccgc

SEQ ID NO: 1193138 - RNA, 20 nt, Mycobacterium bovis subsp bovis AF2122/97
gccuggucuuguugcgcagc

SEQ ID NO: 1193139 - RNA, 15 nt, Mycobacterium bovis subsp bovis AF2122/97
gccuguacggcggcu

SEQ ID NO: 1193140 - RNA, 13 nt, Mycobacterium bovis subsp bovis AF2122/97
gccugugccgccg

SEQ ID NO: 1193141 - RNA, 19 nt, Mycobacterium bovis subsp bovis AF2122/97
gccuguccacguccagccc

SEQ ID NO: 1193142 - RNA, 15 nt, Mycobacterium bovis subsp bovis AF2122/97
gccugcggcaccggc

SEQ ID NO: 1193143 - RNA, 13 nt, Mycobacterium bovis subsp bovis AF2122/97
gccugcggcagca

SEQ ID NO: 1193144 - RNA, 14 nt, Mycobacterium bovis subsp bovis AF2122/97
gccugcggcagcac

SEQ ID NO: 1193145 - RNA, 12 nt, Mycobacterium bovis subsp bovis AF2122/97
gccugcggcggu

SEQ ID NO: 1193146 - RNA, 22 nt, Mycobacterium bovis subsp bovis AF2122/97
gccugcugcacaucgcauccac

SEQ ID NO: 1193147 - RNA, 17 nt, Mycobacterium bovis subsp bovis AF2122/97
gccugcucgcagcgggc

SEQ ID NO: 1193148 - RNA, 17 nt, Mycobacterium bovis subsp bovis AF2122/97
gccugcuccucggccag

SEQ ID NO: 1193149 - RNA, 21 nt, Mycobacterium bovis subsp bovis AF2122/97
gccugcuccucggccagcgug

SEQ ID NO: 1193150 - RNA, 16 nt, Mycobacterium bovis subsp bovis AF2122/97
gccugcuccucggcca

SEQ ID NO: 1193151 - RNA, 13 nt, Mycobacterium bovis subsp bovis AF2122/97
gccugcuccugcg

SEQ ID NO: 1193152 - RNA, 20 nt, Mycobacterium bovis subsp bovis AF2122/97
gccugcuccugcguccagau

SEQ ID NO: 1193153 - RNA, 18 nt, Mycobacterium bovis subsp bovis AF2122/97
gccugcggucagggcuua

SEQ ID NO: 1193154 - RNA, 15 nt, Mycobacterium bovis subsp bovis AF2122/97
gccugcguggagcgc

SEQ ID NO: 1193155 - RNA, 20 nt, Mycobacterium bovis subsp bovis AF2122/97
gccugcuaaccacggugugc

SEQ ID NO: 1193156 - RNA, 13 nt, Mycobacterium bovis subsp bovis AF2122/97
gccugcuuggcca

SEQ ID NO: 1193157 - RNA, 20 nt, Mycobacterium bovis subsp bovis AF2122/97
gccugcugcugcagcgaugc

SEQ ID NO: 1193158 - RNA, 22 nt, Mycobacterium bovis subsp bovis AF2122/97
gccuggccggaauacccgcugg

SEQ ID NO: 1193159 - RNA, 14 nt, Mycobacterium bovis subsp bovis AF2122/97
gccuggcccgucgg

SEQ ID NO: 1193160 - RNA, 16 nt, Mycobacterium bovis subsp bovis AF2122/97
gccuggccaccugguu

SEQ ID NO: 1193161 - RNA, 14 nt, Mycobacterium bovis subsp bovis AF2122/97
gccuggcagggugg

SEQ ID NO: 1193162 - RNA, 16 nt, Mycobacterium bovis subsp bovis AF2122/97
gccuggcagggugggg

SEQ ID NO: 1193163 - RNA, 15 nt, Mycobacterium bovis subsp bovis AF2122/97
gccuggaagaucacg

SEQ ID NO: 1193164 - RNA, 22 nt, Mycobacterium bovis subsp bovis AF2122/97
gccuugcagcgcguucggcacc

SEQ ID NO: 1193165 - RNA, 15 nt, Mycobacterium bovis subsp bovis AF2122/97
gccuugccaccggua

SEQ ID NO: 1193166 - RNA, 13 nt, Mycobacterium bovis subsp bovis AF2122/97
gccuugcccagcg

SEQ ID NO: 1193167 - RNA, 18 nt, Mycobacterium bovis subsp bovis AF2122/97
gccuugaucugagcgcgg

SEQ ID NO: 1193168 - RNA, 15 nt, Mycobacterium bovis subsp bovis AF2122/97
gccuugaccagcagc

SEQ ID NO: 1193169 - RNA, 13 nt, Mycobacterium bovis subsp bovis AF2122/97
gccuugagccgcc

SEQ ID NO: 1193170 - RNA, 15 nt, Mycobacterium bovis subsp bovis AF2122/97
gccuugagccgcccc

SEQ ID NO: 1193171 - RNA, 18 nt, Mycobacterium bovis subsp bovis AF2122/97
gccuugacagcuuucuug

SEQ ID NO: 1193172 - RNA, 14 nt, Mycobacterium bovis subsp bovis AF2122/97
gccuugaccagcag

SEQ ID NO: 1193173 - RNA, 22 nt, Mycobacterium bovis subsp bovis AF2122/97
gccuucuuggcaggugccuucu

SEQ ID NO: 1193174 - RNA, 19 nt, Mycobacterium bovis subsp bovis AF2122/97
gccuucuucgcuaccuucu

SEQ ID NO: 1193175 - RNA, 14 nt, Mycobacterium bovis subsp bovis AF2122/97
gccuucucgcugac

SEQ ID NO: 1193176 - RNA, 22 nt, Mycobacterium bovis subsp bovis AF2122/97
gccuucuccggcgucacggcgu

SEQ ID NO: 1193177 - RNA, 14 nt, Mycobacterium bovis subsp bovis AF2122/97
gccuugccgccggc

SEQ ID NO: 1193178 - RNA, 19 nt, Mycobacterium bovis subsp bovis AF2122/97
gccuugccgaucagcuggc

SEQ ID NO: 1193179 - RNA, 16 nt, Mycobacterium bovis subsp bovis AF2122/97
gccuuggccaccaucg

SEQ ID NO: 1193180 - RNA, 21 nt, Mycobacterium bovis subsp bovis AF2122/97
gccuuggccaccaucgccgcc

SEQ ID NO: 1193181 - RNA, 20 nt, Mycobacterium bovis subsp bovis AF2122/97
gccuuggcacccuccgccgg

SEQ ID NO: 1193182 - RNA, 13 nt, Mycobacterium bovis subsp bovis AF2122/97
gccuuggcagccc

SEQ ID NO: 1193183 - RNA, 14 nt, Mycobacterium bovis subsp bovis AF2122/97
gccuuggcagccca

SEQ ID NO: 1193184 - RNA, 16 nt, Mycobacterium bovis subsp bovis AF2122/97
gccuuggcaguccagc

SEQ ID NO: 1193185 - RNA, 16 nt, Mycobacterium bovis subsp bovis AF2122/97
gccuuggucaccuucu

SEQ ID NO: 1193186 - RNA, 14 nt, Mycobacterium bovis subsp bovis AF2122/97
gccuuggcgcccgc

SEQ ID NO: 1193187 - RNA, 12 nt, Mycobacterium bovis subsp bovis AF2122/97
gccuuggcggcc

SEQ ID NO: 1193188 - RNA, 22 nt, Mycobacterium bovis subsp bovis AF2122/97
gccuuguuccagcgcaucgagc

SEQ ID NO: 1193189 - RNA, 14 nt, Mycobacterium bovis subsp bovis AF2122/97
gccuuggucgccgg

SEQ ID NO: 1193190 - RNA, 23 nt, Mycobacterium bovis subsp bovis AF2122/97
gccuucacgcuggccuccagcuu

SEQ ID NO: 1193191 - RNA, 21 nt, Mycobacterium bovis subsp bovis AF2122/97
gccuuacgcgggugaccaaca

SEQ ID NO: 1193192 - RNA, 13 nt, Mycobacterium bovis subsp bovis AF2122/97
gccuuagcugcca

SEQ ID NO: 1193193 - RNA, 16 nt, Mycobacterium bovis subsp bovis AF2122/97
gccuuccaggcgggcg

SEQ ID NO: 1193194 - RNA, 21 nt, Mycobacterium bovis subsp bovis AF2122/97
gccuuccaggcgggcggcacc

SEQ ID NO: 1193195 - RNA, 17 nt, Mycobacterium bovis subsp bovis AF2122/97
gccuucguagaaggacc

SEQ ID NO: 1193196 - RNA, 17 nt, Mycobacterium bovis subsp bovis AF2122/97
gccuucguagcggccgc

SEQ ID NO: 1193197 - RNA, 20 nt, Mycobacterium bovis subsp bovis AF2122/97
gccuuccuggcgggcgccuu

SEQ ID NO: 1193198 - RNA, 12 nt, Mycobacterium bovis subsp bovis AF2122/97
gcgacagcagcg

SEQ ID NO: 1193199 - RNA, 24 nt, Mycobacterium bovis subsp bovis AF2122/97
gcgacagacagcaccgccggugcg

SEQ ID NO: 1193200 - RNA, 21 nt, Mycobacterium bovis subsp bovis AF2122/97
gcgacacucacgggugcuggc

SEQ ID NO: 1193201 - RNA, 17 nt, Mycobacterium bovis subsp bovis AF2122/97
gcgacagaugccgggcu

SEQ ID NO: 1193202 - RNA, 13 nt, Mycobacterium bovis subsp bovis AF2122/97
gcgacagcgcggc

SEQ ID NO: 1193203 - RNA, 15 nt, Mycobacterium bovis subsp bovis AF2122/97
gcgaccaggcgcggc

SEQ ID NO: 1193204 - RNA, 13 nt, Mycobacterium bovis subsp bovis AF2122/97
gcgaccagcuggc

SEQ ID NO: 1193205 - RNA, 17 nt, Mycobacterium bovis subsp bovis AF2122/97
gcgaccaucgcgacggc

SEQ ID NO: 1193206 - RNA, 18 nt, Mycobacterium bovis subsp bovis AF2122/97
gcgaccaucugaucgggc

SEQ ID NO: 1193207 - RNA, 21 nt, Mycobacterium bovis subsp bovis AF2122/97
gcgaccaucugaucgggcccg

SEQ ID NO: 1193208 - RNA, 16 nt, Mycobacterium bovis subsp bovis AF2122/97
gcgaccccgccgagcg

SEQ ID NO: 1193209 - RNA, 15 nt, Mycobacterium bovis subsp bovis AF2122/97
gcgaccccggcugcg

SEQ ID NO: 1193210 - RNA, 23 nt, Mycobacterium bovis subsp bovis AF2122/97
gcgaccggugccugcaacgccag

SEQ ID NO: 1193211 - RNA, 23 nt, Mycobacterium bovis subsp bovis AF2122/97
gcgacccguccaacuacgccagc

SEQ ID NO: 1193212 - RNA, 20 nt, Mycobacterium bovis subsp bovis AF2122/97
gcgacccgucccccgcacgc

SEQ ID NO: 1193213 - RNA, 19 nt, Mycobacterium bovis subsp bovis AF2122/97
gcgaccgucccagcgccgc

SEQ ID NO: 1193214 - RNA, 19 nt, Mycobacterium bovis subsp bovis AF2122/97
gcgacacguuggcggaugc

SEQ ID NO: 1193215 - RNA, 18 nt, Mycobacterium bovis subsp bovis AF2122/97
gcgacacgccagccgugc

SEQ ID NO: 1193216 - RNA, 16 nt, Mycobacterium bovis subsp bovis AF2122/97
gcgacaccacgaaucc

SEQ ID NO: 1193217 - RNA, 16 nt, Mycobacterium bovis subsp bovis AF2122/97
gcgaagugcgcgcugg

SEQ ID NO: 1193218 - RNA, 16 nt, Mycobacterium bovis subsp bovis AF2122/97
gcgaaguugcggguga

SEQ ID NO: 1193219 - RNA, 15 nt, Mycobacterium bovis subsp bovis AF2122/97
gcgaagucgcauggc

SEQ ID NO: 1193220 - RNA, 18 nt, Mycobacterium bovis subsp bovis AF2122/97
gcgaagucuugaccgcac

SEQ ID NO: 1193221 - RNA, 15 nt, Mycobacterium bovis subsp bovis AF2122/97
gcgaaggaccagagc

SEQ ID NO: 1193222 - RNA, 18 nt, Mycobacterium bovis subsp bovis AF2122/97
gcgaacgucaaccgggcg

SEQ ID NO: 1193223 - RNA, 23 nt, Mycobacterium bovis subsp bovis AF2122/97
gcgaacuuaacuacggugcccug

SEQ ID NO: 1193224 - RNA, 14 nt, Mycobacterium bovis subsp bovis AF2122/97
gcgaacggccagga

SEQ ID NO: 1193225 - RNA, 18 nt, Mycobacterium bovis subsp bovis AF2122/97
gcgaacaaguggccagcg

SEQ ID NO: 1193226 - RNA, 19 nt, Mycobacterium bovis subsp bovis AF2122/97
gcgaaccgucagcgcgccg

SEQ ID NO: 1193227 - RNA, 22 nt, Mycobacterium bovis subsp bovis AF2122/97
gcgaacgauuucggcccacucc

SEQ ID NO: 1193228 - RNA, 16 nt, Mycobacterium bovis subsp bovis AF2122/97
gcgaacgaucccgccg

SEQ ID NO: 1193229 - RNA, 22 nt, Mycobacterium bovis subsp bovis AF2122/97
gcgaaauagcugcggaggguuc

SEQ ID NO: 1193230 - RNA, 20 nt, Mycobacterium bovis subsp bovis AF2122/97
gcgaaauuacuucggccaca

SEQ ID NO: 1193231 - RNA, 23 nt, Mycobacterium bovis subsp bovis AF2122/97
gcgaaaucaguucccgaaccccg

SEQ ID NO: 1193232 - RNA, 22 nt, Mycobacterium bovis subsp bovis AF2122/97
gcgaaauccccugcgcugcagc

SEQ ID NO: 1193233 - RNA, 17 nt, Mycobacterium bovis subsp bovis AF2122/97
gccuuugcccgccgcgu

SEQ ID NO: 1193234 - RNA, 16 nt, Mycobacterium bovis subsp bovis AF2122/97
gccuuuggucgcggcu

SEQ ID NO: 1193235 - RNA, 16 nt, Mycobacterium bovis subsp bovis AF2122/97
gccuuugucgccuucu

SEQ ID NO: 1193236 - RNA, 18 nt, Mycobacterium bovis subsp bovis AF2122/97
gccuuugucgccuucuug

SEQ ID NO: 1193237 - RNA, 21 nt, Mycobacterium bovis subsp bovis AF2122/97
gccuuugguaguaggccuggc

SEQ ID NO: 1193238 - RNA, 23 nt, Mycobacterium bovis subsp bovis AF2122/97
gccuuuccagcaccccgaucugg

SEQ ID NO: 1193239 - RNA, 16 nt, Mycobacterium bovis subsp bovis AF2122/97
gccuuuauuaauacug

SEQ ID NO: 1193240 - RNA, 13 nt, Mycobacterium bovis subsp bovis AF2122/97
gccuuguuguccu

SEQ ID NO: 1193241 - RNA, 16 nt, Mycobacterium bovis subsp bovis AF2122/97
gcgaucgcgagcgagc

SEQ ID NO: 1193242 - RNA, 18 nt, Mycobacterium bovis subsp bovis AF2122/97
gcgaucgcgagcgagcca

SEQ ID NO: 1193243 - RNA, 16 nt, Mycobacterium bovis subsp bovis AF2122/97
gcgaucgcuccgcggc

SEQ ID NO: 1193244 - RNA, 22 nt, Mycobacterium bovis subsp bovis AF2122/97
gcgaugacgaucgcguccgcgc

SEQ ID NO: 1193245 - RNA, 19 nt, Mycobacterium bovis subsp bovis AF2122/97
gcgaugaccacgccgacga

SEQ ID NO: 1193246 - RNA, 19 nt, Mycobacterium bovis subsp bovis AF2122/97
gcgaugaugacggcggccc

SEQ ID NO: 1193247 - RNA, 22 nt, Mycobacterium bovis subsp bovis AF2122/97
gcgaugaucaugaacgcaagca

SEQ ID NO: 1193248 - RNA, 19 nt, Mycobacterium bovis subsp bovis AF2122/97
gcgauccugaccagccagg

SEQ ID NO: 1193249 - RNA, 14 nt, Mycobacterium bovis subsp bovis AF2122/97
gcgauccggucggc

SEQ ID NO: 1193250 - RNA, 15 nt, Mycobacterium bovis subsp bovis AF2122/97
gcgauccugaccagc

SEQ ID NO: 1193251 - RNA, 13 nt, Mycobacterium bovis subsp bovis AF2122/97
gcgaucgccuggg

SEQ ID NO: 1193252 - RNA, 18 nt, Mycobacterium bovis subsp bovis AF2122/97
gcgaucgccgcgcugguc

SEQ ID NO: 1193253 - RNA, 22 nt, Mycobacterium bovis subsp bovis AF2122/97
gcgaucgccggccgcgugacgu

SEQ ID NO: 1193254 - RNA, 21 nt, Mycobacterium bovis subsp bovis AF2122/97
gcgaucgcagugagcagccgg

SEQ ID NO: 1193255 - RNA, 19 nt, Mycobacterium bovis subsp bovis AF2122/97
gcgauccggucggccaggc

SEQ ID NO: 1193256 - RNA, 15 nt, Mycobacterium bovis subsp bovis AF2122/97
gcgaucccgccgggg

SEQ ID NO: 1193257 - RNA, 22 nt, Mycobacterium bovis subsp bovis AF2122/97
gcgaucccgccggggcccuggg

SEQ ID NO: 1193258 - RNA, 15 nt, Mycobacterium bovis subsp bovis AF2122/97
gcgauccagggccga

SEQ ID NO: 1193259 - RNA, 20 nt, Mycobacterium bovis subsp bovis AF2122/97
gcgaggugcccaaggccagg

SEQ ID NO: 1193260 - RNA, 21 nt, Mycobacterium bovis subsp bovis AF2122/97
gcgaggugauuggucacaccc

SEQ ID NO: 1193261 - RNA, 20 nt, Mycobacterium bovis subsp bovis AF2122/97
gcgagguauaaacgcggcgc

SEQ ID NO: 1193262 - RNA, 15 nt, Mycobacterium bovis subsp bovis AF2122/97
gcgaggucggcggcg

SEQ ID NO: 1193263 - RNA, 18 nt, Mycobacterium bovis subsp bovis AF2122/97
gcgauacagacggggauc

SEQ ID NO: 1193264 - RNA, 16 nt, Mycobacterium bovis subsp bovis AF2122/97
gcgauaccgaggaucu

SEQ ID NO: 1193265 - RNA, 19 nt, Mycobacterium bovis subsp bovis AF2122/97
gcgaggucccggccgagcg

SEQ ID NO: 1193266 - RNA, 13 nt, Mycobacterium bovis subsp bovis AF2122/97
gcgagguccagca

SEQ ID NO: 1193267 - RNA, 21 nt, Mycobacterium bovis subsp bovis AF2122/97
gcgagggugagcauggcuagg

SEQ ID NO: 1193268 - RNA, 22 nt, Mycobacterium bovis subsp bovis AF2122/97
gcgagggcuaccggcgccgcgc

SEQ ID NO: 1193269 - RNA, 23 nt, Mycobacterium bovis subsp bovis AF2122/97
gcgagggcuaccggcgccgcgcg

SEQ ID NO: 1193270 - RNA, 19 nt, Mycobacterium bovis subsp bovis AF2122/97
gcgauagaugcgugcggca

SEQ ID NO: 1193271 - RNA, 14 nt, Mycobacterium bovis subsp bovis AF2122/97
gcgaucaggcugcc

SEQ ID NO: 1193272 - RNA, 14 nt, Mycobacterium bovis subsp bovis AF2122/97
gcgauaggcccggu

SEQ ID NO: 1193273 - RNA, 18 nt, Mycobacterium bovis subsp bovis AF2122/97
gcgaucaguucgugacgu

SEQ ID NO: 1193274 - RNA, 16 nt, Mycobacterium bovis subsp bovis AF2122/97
gcgagauagcaccagu

SEQ ID NO: 1193275 - RNA, 23 nt, Mycobacterium bovis subsp bovis AF2122/97
gcgagaucggauggugugucggg

SEQ ID NO: 1193276 - RNA, 19 nt, Mycobacterium bovis subsp bovis AF2122/97
gcgagaucgggccggccgc

SEQ ID NO: 1193277 - RNA, 21 nt, Mycobacterium bovis subsp bovis AF2122/97
gcgagcaacucguccagcagu

SEQ ID NO: 1193278 - RNA, 13 nt, Mycobacterium bovis subsp bovis AF2122/97
gcgagcccagcug

SEQ ID NO: 1193279 - RNA, 18 nt, Mycobacterium bovis subsp bovis AF2122/97
gcgagcccagcugcgccg

SEQ ID NO: 1193280 - RNA, 13 nt, Mycobacterium bovis subsp bovis AF2122/97
gcgagcgcacacc

SEQ ID NO: 1193281 - RNA, 24 nt, Mycobacterium bovis subsp bovis AF2122/97
gcgagcgccaggucagcucgagcg

SEQ ID NO: 1193282 - RNA, 13 nt, Mycobacterium bovis subsp bovis AF2122/97
gcgagccgcgccc

SEQ ID NO: 1193283 - RNA, 19 nt, Mycobacterium bovis subsp bovis AF2122/97
gcgagccggcgccgggucg

SEQ ID NO: 1193284 - RNA, 14 nt, Mycobacterium bovis subsp bovis AF2122/97
gcgagccggcgcgc

SEQ ID NO: 1193285 - RNA, 16 nt, Mycobacterium bovis subsp bovis AF2122/97
gcgaggcagcacccgc

SEQ ID NO: 1193286 - RNA, 12 nt, Mycobacterium bovis subsp bovis AF2122/97
gcgaggccagcg

SEQ ID NO: 1193287 - RNA, 22 nt, Mycobacterium bovis subsp bovis AF2122/97
gcgaggccagcgguaaugccag

SEQ ID NO: 1193288 - RNA, 22 nt, Mycobacterium bovis subsp bovis AF2122/97
gcgaggcgcucacccgccgcgg

SEQ ID NO: 1193289 - RNA, 19 nt, Mycobacterium bovis subsp bovis AF2122/97
gcgaggcucccccaccagg

SEQ ID NO: 1193290 - RNA, 18 nt, Mycobacterium bovis subsp bovis AF2122/97
gcgagcgccggccgcggc

SEQ ID NO: 1193291 - RNA, 19 nt, Mycobacterium bovis subsp bovis AF2122/97
gcgagcgccggccgcggcg

SEQ ID NO: 1193292 - RNA, 14 nt, Mycobacterium bovis subsp bovis AF2122/97
gcgagcgccggcuu

SEQ ID NO: 1193293 - RNA, 21 nt, Mycobacterium bovis subsp bovis AF2122/97
gcgagcgccggccgcggcggc

SEQ ID NO: 1193294 - RNA, 16 nt, Mycobacterium bovis subsp bovis AF2122/97
gcgaggaacgccgggg

SEQ ID NO: 1193295 - RNA, 18 nt, Mycobacterium bovis subsp bovis AF2122/97
gcgaggaugcugagcgcc

SEQ ID NO: 1193296 - RNA, 14 nt, Mycobacterium bovis subsp bovis AF2122/97
gcgagacuugguga

SEQ ID NO: 1193297 - RNA, 15 nt, Mycobacterium bovis subsp bovis AF2122/97
gcgagagccucggcc

SEQ ID NO: 1193298 - RNA, 13 nt, Mycobacterium bovis subsp bovis AF2122/97
gcgagagccggcg

SEQ ID NO: 1193299 - RNA, 16 nt, Mycobacterium bovis subsp bovis AF2122/97
gcgagagccggcggcg

SEQ ID NO: 1193300 - RNA, 15 nt, Mycobacterium bovis subsp bovis AF2122/97
gcgagagccuccaug

SEQ ID NO: 1193301 - RNA, 20 nt, Mycobacterium bovis subsp bovis AF2122/97
gcgacgacccgggucggcac

SEQ ID NO: 1193302 - RNA, 20 nt, Mycobacterium bovis subsp bovis AF2122/97
gcgacgaccgucggcuccag

SEQ ID NO: 1193303 - RNA, 18 nt, Mycobacterium bovis subsp bovis AF2122/97
gcgacgagaucagccucg

SEQ ID NO: 1193304 - RNA, 20 nt, Mycobacterium bovis subsp bovis AF2122/97
gcgacgaacugaagccccuu

SEQ ID NO: 1193305 - RNA, 15 nt, Mycobacterium bovis subsp bovis AF2122/97
gcgacgaagaagaac

SEQ ID NO: 1193306 - RNA, 21 nt, Mycobacterium bovis subsp bovis AF2122/97
gcgacgcaaagcagcgcaaug

SEQ ID NO: 1193307 - RNA, 14 nt, Mycobacterium bovis subsp bovis AF2122/97
gcgacgaugcaggu

SEQ ID NO: 1193308 - RNA, 22 nt, Mycobacterium bovis subsp bovis AF2122/97
gcgacucugcgucugcucacca

SEQ ID NO: 1193309 - RNA, 17 nt, Mycobacterium bovis subsp bovis AF2122/97
gcgacgaucucgccgcc

SEQ ID NO: 1193310 - RNA, 23 nt, Mycobacterium bovis subsp bovis AF2122/97
gcgacgaucucgccgccagcgcu

SEQ ID NO: 1193311 - RNA, 19 nt, Mycobacterium bovis subsp bovis AF2122/97
gcgacgaguugcgaaccau

SEQ ID NO: 1193312 - RNA, 12 nt, Mycobacterium bovis subsp bovis AF2122/97
gcgacgagaucu

SEQ ID NO: 1193313 - RNA, 14 nt, Mycobacterium bovis subsp bovis AF2122/97
gcgacgagcagcaa

SEQ ID NO: 1193314 - RNA, 22 nt, Mycobacterium bovis subsp bovis AF2122/97
gcgcacggcgucggccaccgcc

SEQ ID NO: 1193315 - RNA, 12 nt, Mycobacterium bovis subsp bovis AF2122/97
gcgcacucuagc

SEQ ID NO: 1193316 - RNA, 16 nt, Mycobacterium bovis subsp bovis AF2122/97
gcgcacucuagccggg

SEQ ID NO: 1193317 - RNA, 18 nt, Mycobacterium bovis subsp bovis AF2122/97
gcgcagcaacugggcggc

SEQ ID NO: 1193318 - RNA, 19 nt, Mycobacterium bovis subsp bovis AF2122/97
gcgcagcaacugggcggcc

SEQ ID NO: 1193319 - RNA, 20 nt, Mycobacterium bovis subsp bovis AF2122/97
gcgcagcacugcggcagcga

SEQ ID NO: 1193320 - RNA, 17 nt, Mycobacterium bovis subsp bovis AF2122/97
gcgcagcaccagggugg

SEQ ID NO: 1193321 - RNA, 18 nt, Mycobacterium bovis subsp bovis AF2122/97
gcgcagcaccaggguggc

SEQ ID NO: 1193322 - RNA, 14 nt, Mycobacterium bovis subsp bovis AF2122/97
gcgcacggcgccga

SEQ ID NO: 1193323 - RNA, 17 nt, Mycobacterium bovis subsp bovis AF2122/97
gcgcacggcccgagccg

SEQ ID NO: 1193324 - RNA, 18 nt, Mycobacterium bovis subsp bovis AF2122/97
gcgcacggcccgagccgc

SEQ ID NO: 1193325 - RNA, 18 nt, Mycobacterium bovis subsp bovis AF2122/97
gcgcacgccaccgggacg

SEQ ID NO: 1193326 - RNA, 20 nt, Mycobacterium bovis subsp bovis AF2122/97
gcgcaaugcaucgcggcggc

SEQ ID NO: 1193327 - RNA, 17 nt, Mycobacterium bovis subsp bovis AF2122/97
gcgcaaugcgcgacggu

SEQ ID NO: 1193328 - RNA, 14 nt, Mycobacterium bovis subsp bovis AF2122/97
gcgcaaugcggccc

SEQ ID NO: 1193329 - RNA, 17 nt, Mycobacterium bovis subsp bovis AF2122/97
gcgcaaugcggcccggg

SEQ ID NO: 1193330 - RNA, 16 nt, Mycobacterium bovis subsp bovis AF2122/97
gcgcagccaggcugcg

SEQ ID NO: 1193331 - RNA, 13 nt, Mycobacterium bovis subsp bovis AF2122/97
gcgcagccgccgc

SEQ ID NO: 1193332 - RNA, 22 nt, Mycobacterium bovis subsp bovis AF2122/97
gcgcagccgccgcgccccgcgg

SEQ ID NO: 1193333 - RNA, 19 nt, Mycobacterium bovis subsp bovis AF2122/97
gcgcagcgcgaugucgccg

SEQ ID NO: 1193334 - RNA, 14 nt, Mycobacterium bovis subsp bovis AF2122/97
gcgcagcaucggcg

SEQ ID NO: 1193335 - RNA, 13 nt, Mycobacterium bovis subsp bovis AF2122/97
gcgcagcggacgg

SEQ ID NO: 1193336 - RNA, 14 nt, Mycobacterium bovis subsp bovis AF2122/97
gcgcagccgcagcc

SEQ ID NO: 1193337 - RNA, 14 nt, Mycobacterium bovis subsp bovis AF2122/97
gcgcagcgugagug

SEQ ID NO: 1193338 - RNA, 19 nt, Mycobacterium bovis subsp bovis AF2122/97
gcgcagcguguugagggcu

SEQ ID NO: 1193339 - RNA, 19 nt, Mycobacterium bovis subsp bovis AF2122/97
gcgcagcugcgggucgugc

SEQ ID NO: 1193340 - RNA, 12 nt, Mycobacterium bovis subsp bovis AF2122/97
gcgcagcugccg

SEQ ID NO: 1193341 - RNA, 21 nt, Mycobacterium bovis subsp bovis AF2122/97
gcgcagcugccgcacccccuc

SEQ ID NO: 1193342 - RNA, 16 nt, Mycobacterium bovis subsp bovis AF2122/97
gcgcagcugggugcgc

SEQ ID NO: 1193343 - RNA, 23 nt, Mycobacterium bovis subsp bovis AF2122/97
gcgaugguggccgccaccuccca

SEQ ID NO: 1193344 - RNA, 15 nt, Mycobacterium bovis subsp bovis AF2122/97
gcgaugguaucgccg

SEQ ID NO: 1193345 - RNA, 18 nt, Mycobacterium bovis subsp bovis AF2122/97
gcgaugggagcccggcgg

SEQ ID NO: 1193346 - RNA, 15 nt, Mycobacterium bovis subsp bovis AF2122/97
gcgaugggcccagcg

SEQ ID NO: 1193347 - RNA, 19 nt, Mycobacterium bovis subsp bovis AF2122/97
gcgaugggcccagcggccg

SEQ ID NO: 1193348 - RNA, 17 nt, Mycobacterium bovis subsp bovis AF2122/97
gcgaugggccgguccgg

SEQ ID NO: 1193349 - RNA, 22 nt, Mycobacterium bovis subsp bovis AF2122/97
gcgauggccccugucauguccu

SEQ ID NO: 1193350 - RNA, 17 nt, Mycobacterium bovis subsp bovis AF2122/97
gcgauggcaccggcgug

SEQ ID NO: 1193351 - RNA, 20 nt, Mycobacterium bovis subsp bovis AF2122/97
gcgaugugaaccgggcacca

SEQ ID NO: 1193352 - RNA, 13 nt, Mycobacterium bovis subsp bovis AF2122/97
gcgaugucgccgg

SEQ ID NO: 1193353 - RNA, 21 nt, Mycobacterium bovis subsp bovis AF2122/97
gcgauucacacucgggcggcu

SEQ ID NO: 1193354 - RNA, 23 nt, Mycobacterium bovis subsp bovis AF2122/97
gcgauugcgcacacccugcagcu

SEQ ID NO: 1193355 - RNA, 14 nt, Mycobacterium bovis subsp bovis AF2122/97
gcgauugauccggu

SEQ ID NO: 1193356 - RNA, 13 nt, Mycobacterium bovis subsp bovis AF2122/97
gcgauucccaacc

SEQ ID NO: 1193357 - RNA, 22 nt, Mycobacterium bovis subsp bovis AF2122/97
gcgauuccggcggccacgccgg

SEQ ID NO: 1193358 - RNA, 18 nt, Mycobacterium bovis subsp bovis AF2122/97
gcgauucugcgucugcuc

SEQ ID NO: 1193359 - RNA, 22 nt, Mycobacterium bovis subsp bovis AF2122/97
gcgauucugcgucugcucgccg

SEQ ID NO: 1193360 - RNA, 23 nt, Mycobacterium bovis subsp bovis AF2122/97
gcgauucugggcuucaucggcga

SEQ ID NO: 1193361 - RNA, 18 nt, Mycobacterium bovis subsp bovis AF2122/97
gcgauucugugucugcuc

SEQ ID NO: 1193362 - RNA, 13 nt, Mycobacterium bovis subsp bovis AF2122/97
gcgauuggcuggg

SEQ ID NO: 1193363 - RNA, 19 nt, Mycobacterium bovis subsp bovis AF2122/97
gcgauuuugugucugcucg

SEQ ID NO: 1193364 - RNA, 22 nt, Mycobacterium bovis subsp bovis AF2122/97
gcgauuuugugucugcucgccg

SEQ ID NO: 1193365 - RNA, 19 nt, Mycobacterium bovis subsp bovis AF2122/97
gcgauuuugcgucugcucg

SEQ ID NO: 1193366 - RNA, 18 nt, Mycobacterium bovis subsp bovis AF2122/97
gcgauuuggcgucgccga

SEQ ID NO: 1193367 - RNA, 14 nt, Mycobacterium bovis subsp bovis AF2122/97
gcgcaaccgcucau

SEQ ID NO: 1193368 - RNA, 17 nt, Mycobacterium bovis subsp bovis AF2122/97
gcgcaacgccgccagcc

SEQ ID NO: 1193369 - RNA, 22 nt, Mycobacterium bovis subsp bovis AF2122/97
gcgcaacgggucgguccacuuc

SEQ ID NO: 1193370 - RNA, 16 nt, Mycobacterium bovis subsp bovis AF2122/97
gcgcaacguagccagc

SEQ ID NO: 1193371 - RNA, 19 nt, Mycobacterium bovis subsp bovis AF2122/97
gcgcaacguagccagcagc

SEQ ID NO: 1193372 - RNA, 15 nt, Mycobacterium bovis subsp bovis AF2122/97
gcgcaacacauccag

SEQ ID NO: 1193373 - RNA, 21 nt, Mycobacterium bovis subsp bovis AF2122/97
gcgcaaccagcaaugccgacu

SEQ ID NO: 1193374 - RNA, 17 nt, Mycobacterium bovis subsp bovis AF2122/97
gcgcaacccagccgcgc

SEQ ID NO: 1193375 - RNA, 18 nt, Mycobacterium bovis subsp bovis AF2122/97
gcgcaaaugccugcuggu

SEQ ID NO: 1193376 - RNA, 13 nt, Mycobacterium bovis subsp bovis AF2122/97
gcgcgaacacccg

SEQ ID NO: 1193377 - RNA, 16 nt, Mycobacterium bovis subsp bovis AF2122/97
gcgccuaccagcaccg

SEQ ID NO: 1193378 - RNA, 15 nt, Mycobacterium bovis subsp bovis AF2122/97
gcgccuaccagcacc

SEQ ID NO: 1193379 - RNA, 13 nt, Mycobacterium bovis subsp bovis AF2122/97
gcgccuacccuuc

SEQ ID NO: 1193380 - RNA, 15 nt, Mycobacterium bovis subsp bovis AF2122/97
gcgccguugccaccg

SEQ ID NO: 1193381 - RNA, 16 nt, Mycobacterium bovis subsp bovis AF2122/97
gcgccguugcccccgu

SEQ ID NO: 1193382 - RNA, 15 nt, Mycobacterium bovis subsp bovis AF2122/97
gcgccguugccgccg

SEQ ID NO: 1193383 - RNA, 16 nt, Mycobacterium bovis subsp bovis AF2122/97
gcgccguugccgccgu

SEQ ID NO: 1193384 - RNA, 15 nt, Mycobacterium bovis subsp bovis AF2122/97
gcgccguucgcuccc

SEQ ID NO: 1193385 - RNA, 21 nt, Mycobacterium bovis subsp bovis AF2122/97
gcgccguucacccuggugguc

SEQ ID NO: 1193386 - RNA, 20 nt, Mycobacterium bovis subsp bovis AF2122/97
gcgccgugucaccgggugca

SEQ ID NO: 1193387 - RNA, 19 nt, Mycobacterium bovis subsp bovis AF2122/97
gcgccguuagcgucgccuu

SEQ ID NO: 1193388 - RNA, 17 nt, Mycobacterium bovis subsp bovis AF2122/97
gcgccguggcaucgccu

SEQ ID NO: 1193389 - RNA, 15 nt, Mycobacterium bovis subsp bovis AF2122/97
gcgccguggcgcggu

SEQ ID NO: 1193390 - RNA, 17 nt, Mycobacterium bovis subsp bovis AF2122/97
gcgcgaccccaggcgcu

SEQ ID NO: 1193391 - RNA, 16 nt, Mycobacterium bovis subsp bovis AF2122/97
gcgcgaccacccgccg

SEQ ID NO: 1193392 - RNA, 20 nt, Mycobacterium bovis subsp bovis AF2122/97
gcgcgaauggcggacagggc

SEQ ID NO: 1193393 - RNA, 15 nt, Mycobacterium bovis subsp bovis AF2122/97
gcgcgaauggucagc

SEQ ID NO: 1193394 - RNA, 20 nt, Mycobacterium bovis subsp bovis AF2122/97
gcgcgaaccugcucggcgcg

SEQ ID NO: 1193395 - RNA, 18 nt, Mycobacterium bovis subsp bovis AF2122/97
gcgcgaacgucaaccggg

SEQ ID NO: 1193396 - RNA, 15 nt, Mycobacterium bovis subsp bovis AF2122/97
gcgcgcaucugcucg

SEQ ID NO: 1193397 - RNA, 15 nt, Mycobacterium bovis subsp bovis AF2122/97
gcgcgccacccagca

SEQ ID NO: 1193398 - RNA, 13 nt, Mycobacterium bovis subsp bovis AF2122/97
gcgcgccagcucg

SEQ ID NO: 1193399 - RNA, 23 nt, Mycobacterium bovis subsp bovis AF2122/97
gcgcgccagcuugucgggcaccg

SEQ ID NO: 1193400 - RNA, 12 nt, Mycobacterium bovis subsp bovis AF2122/97
gcgcgccgcaca

SEQ ID NO: 1193401 - RNA, 20 nt, Mycobacterium bovis subsp bovis AF2122/97
gcgcgccauuggcgccgccg

SEQ ID NO: 1193402 - RNA, 13 nt, Mycobacterium bovis subsp bovis AF2122/97
gcgcgacggcgcu

SEQ ID NO: 1193403 - RNA, 17 nt, Mycobacterium bovis subsp bovis AF2122/97
gcgcgagcagacacaga

SEQ ID NO: 1193404 - RNA, 22 nt, Mycobacterium bovis subsp bovis AF2122/97
gcgcgacggucccuucgucacc

SEQ ID NO: 1193405 - RNA, 11 nt, Mycobacterium bovis subsp bovis AF2122/97
gcgcgagauca

SEQ ID NO: 1193406 - RNA, 15 nt, Mycobacterium bovis subsp bovis AF2122/97
gcgcgagaacacccg

SEQ ID NO: 1193407 - RNA, 13 nt, Mycobacterium bovis subsp bovis AF2122/97
gcgcgagccgcuc

SEQ ID NO: 1193408 - RNA, 20 nt, Mycobacterium bovis subsp bovis AF2122/97
gcgcgaggaacgccggggcg

SEQ ID NO: 1193409 - RNA, 15 nt, Mycobacterium bovis subsp bovis AF2122/97
gcgcgagcagcuaca

SEQ ID NO: 1193410 - RNA, 22 nt, Mycobacterium bovis subsp bovis AF2122/97
gcgcgaggaggcuuacaugccc

SEQ ID NO: 1193411 - RNA, 18 nt, Mycobacterium bovis subsp bovis AF2122/97
gcgcgauaggugcucgcg

SEQ ID NO: 1193412 - RNA, 16 nt, Mycobacterium bovis subsp bovis AF2122/97
gcgcgaggucggcggc

SEQ ID NO: 1193413 - RNA, 14 nt, Mycobacterium bovis subsp bovis AF2122/97
gcgcgccggcgucg

SEQ ID NO: 1193414 - RNA, 22 nt, Mycobacterium bovis subsp bovis AF2122/97
gcgcgccggcuagggcccuggc

SEQ ID NO: 1193415 - RNA, 19 nt, Mycobacterium bovis subsp bovis AF2122/97
gcgcgcugaaaugccgucg

SEQ ID NO: 1193416 - RNA, 20 nt, Mycobacterium bovis subsp bovis AF2122/97
gcgcgcugagguggcggugc

SEQ ID NO: 1193417 - RNA, 15 nt, Mycobacterium bovis subsp bovis AF2122/97
gcgcgcugauuucuu

SEQ ID NO: 1193418 - RNA, 15 nt, Mycobacterium bovis subsp bovis AF2122/97
gcgcgcuugggcacu

SEQ ID NO: 1193419 - RNA, 13 nt, Mycobacterium bovis subsp bovis AF2122/97
gcgcgcuuggggu

SEQ ID NO: 1193420 - RNA, 23 nt, Mycobacterium bovis subsp bovis AF2122/97
gcgcgcuugggguugggcggggu

SEQ ID NO: 1193421 - RNA, 15 nt, Mycobacterium bovis subsp bovis AF2122/97
gcgcggacccagcac

SEQ ID NO: 1193422 - RNA, 21 nt, Mycobacterium bovis subsp bovis AF2122/97
gcgcgcugggcccgagcgcgc

SEQ ID NO: 1193423 - RNA, 23 nt, Mycobacterium bovis subsp bovis AF2122/97
gcgcgcugggcccgagcgcgcgc

SEQ ID NO: 1193424 - RNA, 12 nt, Mycobacterium bovis subsp bovis AF2122/97
gcgcgcugggcg

SEQ ID NO: 1193425 - RNA, 14 nt, Mycobacterium bovis subsp bovis AF2122/97
gcgcgcugggcgcg

SEQ ID NO: 1193426 - RNA, 15 nt, Mycobacterium bovis subsp bovis AF2122/97
gcgcgcuggcgggcg

SEQ ID NO: 1193427 - RNA, 13 nt, Mycobacterium bovis subsp bovis AF2122/97
gcgcggcgagcac

SEQ ID NO: 1193428 - RNA, 21 nt, Mycobacterium bovis subsp bovis AF2122/97
gcgcggcgaccauaagcucgu

SEQ ID NO: 1193429 - RNA, 20 nt, Mycobacterium bovis subsp bovis AF2122/97
gcgcggcgacgacggccugc

SEQ ID NO: 1193430 - RNA, 12 nt, Mycobacterium bovis subsp bovis AF2122/97
gcgcgggccacc

SEQ ID NO: 1193431 - RNA, 14 nt, Mycobacterium bovis subsp bovis AF2122/97
gcgcggccagcagc

SEQ ID NO: 1193432 - RNA, 18 nt, Mycobacterium bovis subsp bovis AF2122/97
gcgcggccagcagcagau

SEQ ID NO: 1193433 - RNA, 19 nt, Mycobacterium bovis subsp bovis AF2122/97
gcgcggccuuggugggcag

SEQ ID NO: 1193434 - RNA, 20 nt, Mycobacterium bovis subsp bovis AF2122/97
gcgcggccaauugcgccgcc

SEQ ID NO: 1193435 - RNA, 13 nt, Mycobacterium bovis subsp bovis AF2122/97
gcgcggagacccc

SEQ ID NO: 1193436 - RNA, 14 nt, Mycobacterium bovis subsp bovis AF2122/97
gcgcggagagccug

SEQ ID NO: 1193437 - RNA, 14 nt, Mycobacterium bovis subsp bovis AF2122/97
gcgcggcaggccug

SEQ ID NO: 1193438 - RNA, 17 nt, Mycobacterium bovis subsp bovis AF2122/97
gcgcggcaggccuggcg

SEQ ID NO: 1193439 - RNA, 20 nt, Mycobacterium bovis subsp bovis AF2122/97
gcgcggcaggccuggcgagc

SEQ ID NO: 1193440 - RNA, 23 nt, Mycobacterium bovis subsp bovis AF2122/97
gcgcucgucuaccccgagccuug

SEQ ID NO: 1193441 - RNA, 23 nt, Mycobacterium bovis subsp bovis AF2122/97
gcgcucgaacuccccggucgccg

SEQ ID NO: 1193442 - RNA, 19 nt, Mycobacterium bovis subsp bovis AF2122/97
gcgcucccguacgccggcg

SEQ ID NO: 1193443 - RNA, 20 nt, Mycobacterium bovis subsp bovis AF2122/97
gcgcucauugcaucugccaa

SEQ ID NO: 1193444 - RNA, 18 nt, Mycobacterium bovis subsp bovis AF2122/97
gcgcuccaacaacuccag

SEQ ID NO: 1193445 - RNA, 15 nt, Mycobacterium bovis subsp bovis AF2122/97
gcgcucaucugcgcg

SEQ ID NO: 1193446 - RNA, 18 nt, Mycobacterium bovis subsp bovis AF2122/97
gcgcucaucugcgcgcgg

SEQ ID NO: 1193447 - RNA, 19 nt, Mycobacterium bovis subsp bovis AF2122/97
gcgcucaucugcgcgcgga

SEQ ID NO: 1193448 - RNA, 23 nt, Mycobacterium bovis subsp bovis AF2122/97
gcgcuccaacaacuccagcaggu

SEQ ID NO: 1193449 - RNA, 19 nt, Mycobacterium bovis subsp bovis AF2122/97
gcgcuccaacaaugccagc

SEQ ID NO: 1193450 - RNA, 18 nt, Mycobacterium bovis subsp bovis AF2122/97
gcgcugaugcuggccaug

SEQ ID NO: 1193451 - RNA, 19 nt, Mycobacterium bovis subsp bovis AF2122/97
gcgcucucauagcgacggc

SEQ ID NO: 1193452 - RNA, 16 nt, Mycobacterium bovis subsp bovis AF2122/97
gcgcugcccacgccgg

SEQ ID NO: 1193453 - RNA, 17 nt, Mycobacterium bovis subsp bovis AF2122/97
gcgcugcagcauggcuc

SEQ ID NO: 1193454 - RNA, 21 nt, Mycobacterium bovis subsp bovis AF2122/97
gcgcugcccgggcugccgccc

SEQ ID NO: 1193455 - RNA, 11 nt, Mycobacterium bovis subsp bovis AF2122/97
gcgcugcagca

SEQ ID NO: 1193456 - RNA, 15 nt, Mycobacterium bovis subsp bovis AF2122/97
gcgcugccggccgcg

SEQ ID NO: 1193457 - RNA, 11 nt, Mycobacterium bovis subsp bovis AF2122/97
gcgcugcgcag

SEQ ID NO: 1193458 - RNA, 14 nt, Mycobacterium bovis subsp bovis AF2122/97
gcgcugcgcaccgc

SEQ ID NO: 1193459 - RNA, 20 nt, Mycobacterium bovis subsp bovis AF2122/97
gcgcugcggaucguggcgcc

SEQ ID NO: 1193460 - RNA, 13 nt, Mycobacterium bovis subsp bovis AF2122/97
gcgcugcggccag

SEQ ID NO: 1193461 - RNA, 19 nt, Mycobacterium bovis subsp bovis AF2122/97
gcgcugcggcccacaccag

SEQ ID NO: 1193462 - RNA, 13 nt, Mycobacterium bovis subsp bovis AF2122/97
gcgcgggccggcg

SEQ ID NO: 1193463 - RNA, 16 nt, Mycobacterium bovis subsp bovis AF2122/97
gcgcgggcgccgggaa

SEQ ID NO: 1193464 - RNA, 15 nt, Mycobacterium bovis subsp bovis AF2122/97
gcgcgggcucggugg

SEQ ID NO: 1193465 - RNA, 22 nt, Mycobacterium bovis subsp bovis AF2122/97
gcgcggggaucacaccccaggc

SEQ ID NO: 1193466 - RNA, 14 nt, Mycobacterium bovis subsp bovis AF2122/97
gcgcguccgggcag

SEQ ID NO: 1193467 - RNA, 15 nt, Mycobacterium bovis subsp bovis AF2122/97
gcgcggggcggccug

SEQ ID NO: 1193468 - RNA, 15 nt, Mycobacterium bovis subsp bovis AF2122/97
gcgcguccccagcgc

SEQ ID NO: 1193469 - RNA, 11 nt, Mycobacterium bovis subsp bovis AF2122/97
gcgcggggccg

SEQ ID NO: 1193470 - RNA, 15 nt, Mycobacterium bovis subsp bovis AF2122/97
gcgcggggccgccgc

SEQ ID NO: 1193471 - RNA, 22 nt, Mycobacterium bovis subsp bovis AF2122/97
gcgcguccucgccgcacgccgg

SEQ ID NO: 1193472 - RNA, 18 nt, Mycobacterium bovis subsp bovis AF2122/97
gcgcgucgcgaguagcug

SEQ ID NO: 1193473 - RNA, 15 nt, Mycobacterium bovis subsp bovis AF2122/97
gcgcgucucgagcgc

SEQ ID NO: 1193474 - RNA, 14 nt, Mycobacterium bovis subsp bovis AF2122/97
gcgcgucgcccagu

SEQ ID NO: 1193475 - RNA, 18 nt, Mycobacterium bovis subsp bovis AF2122/97
gcgcguggcagugcaggc

SEQ ID NO: 1193476 - RNA, 14 nt, Mycobacterium bovis subsp bovis AF2122/97
gcgcguuccagcac

SEQ ID NO: 1193477 - RNA, 15 nt, Mycobacterium bovis subsp bovis AF2122/97
gcgcguggucgggaa

SEQ ID NO: 1193478 - RNA, 15 nt, Mycobacterium bovis subsp bovis AF2122/97
gcgcucagcgcggcc

SEQ ID NO: 1193479 - RNA, 15 nt, Mycobacterium bovis subsp bovis AF2122/97
gcgcucaucacccag

SEQ ID NO: 1193480 - RNA, 15 nt, Mycobacterium bovis subsp bovis AF2122/97
gcgcucacugcagcg

SEQ ID NO: 1193481 - RNA, 14 nt, Mycobacterium bovis subsp bovis AF2122/97
gcgcucagcgcggc

SEQ ID NO: 1193482 - RNA, 14 nt, Mycobacterium bovis subsp bovis AF2122/97
gcgcuacgcggccg

SEQ ID NO: 1193483 - RNA, 16 nt, Mycobacterium bovis subsp bovis AF2122/97
gcgcuagccgggcgcg

SEQ ID NO: 1193484 - RNA, 20 nt, Mycobacterium bovis subsp bovis AF2122/97
gcgcuagccgggcgcgccgg

SEQ ID NO: 1193485 - RNA, 18 nt, Mycobacterium bovis subsp bovis AF2122/97
gcgcguugcugcagcagc

SEQ ID NO: 1193486 - RNA, 18 nt, Mycobacterium bovis subsp bovis AF2122/97
gcgcguugcuggucgccg

SEQ ID NO: 1193487 - RNA, 18 nt, Mycobacterium bovis subsp bovis AF2122/97
gcgcguucggcgagcagc

SEQ ID NO: 1193488 - RNA, 14 nt, Mycobacterium bovis subsp bovis AF2122/97
gcgcguucggcgcu

SEQ ID NO: 1193489 - RNA, 20 nt, Mycobacterium bovis subsp bovis AF2122/97
gcgcguuugguuuucccggc

SEQ ID NO: 1193490 - RNA, 19 nt, Mycobacterium bovis subsp bovis AF2122/97
gcgccgacccgcgcgccgg

SEQ ID NO: 1193491 - RNA, 23 nt, Mycobacterium bovis subsp bovis AF2122/97
gcgccgaaguagccgaccggcag

SEQ ID NO: 1193492 - RNA, 17 nt, Mycobacterium bovis subsp bovis AF2122/97
gcgccgacgacuccggc

SEQ ID NO: 1193493 - RNA, 19 nt, Mycobacterium bovis subsp bovis AF2122/97
gcgccgaccucaucggcac

SEQ ID NO: 1193494 - RNA, 23 nt, Mycobacterium bovis subsp bovis AF2122/97
gcgccgagauccacgccagagcg

SEQ ID NO: 1193495 - RNA, 15 nt, Mycobacterium bovis subsp bovis AF2122/97
gcgccgagccagcac

SEQ ID NO: 1193496 - RNA, 17 nt, Mycobacterium bovis subsp bovis AF2122/97
gcgccgagcccgggccg

SEQ ID NO: 1193497 - RNA, 18 nt, Mycobacterium bovis subsp bovis AF2122/97
gcgccgagcccgggccug

SEQ ID NO: 1193498 - RNA, 18 nt, Mycobacterium bovis subsp bovis AF2122/97
gcgccgaacgccagcagc

SEQ ID NO: 1193499 - RNA, 17 nt, Mycobacterium bovis subsp bovis AF2122/97
gcgccgaaggccgccac

SEQ ID NO: 1193500 - RNA, 16 nt, Mycobacterium bovis subsp bovis AF2122/97
gcgccgacaccggcug

SEQ ID NO: 1193501 - RNA, 17 nt, Mycobacterium bovis subsp bovis AF2122/97
gcgccgacagccgaucc

SEQ ID NO: 1193502 - RNA, 24 nt, Mycobacterium bovis subsp bovis AF2122/97
gcgccgaaugccaccucgacgcac

SEQ ID NO: 1193503 - RNA, 19 nt, Mycobacterium bovis subsp bovis AF2122/97
gcgccgaauggcggugggc

SEQ ID NO: 1193504 - RNA, 23 nt, Mycobacterium bovis subsp bovis AF2122/97
gcgccgaauuggcccgggucucc

SEQ ID NO: 1193505 - RNA, 14 nt, Mycobacterium bovis subsp bovis AF2122/97
gcgccgaacucaac

SEQ ID NO: 1193506 - RNA, 19 nt, Mycobacterium bovis subsp bovis AF2122/97
gcgccgaacgcuccaggcc

SEQ ID NO: 1193507 - RNA, 15 nt, Mycobacterium bovis subsp bovis AF2122/97
gcgccgaacgccagc

SEQ ID NO: 1193508 - RNA, 14 nt, Mycobacterium bovis subsp bovis AF2122/97
gcgccgaaccagcg

SEQ ID NO: 1193509 - RNA, 22 nt, Mycobacterium bovis subsp bovis AF2122/97
gcgccgaacaccacaccgagca

SEQ ID NO: 1193510 - RNA, 23 nt, Mycobacterium bovis subsp bovis AF2122/97
gcgccgaacaccacaccgagcac

SEQ ID NO: 1193511 - RNA, 17 nt, Mycobacterium bovis subsp bovis AF2122/97
gcgccgaaaccacuucc

SEQ ID NO: 1193512 - RNA, 20 nt, Mycobacterium bovis subsp bovis AF2122/97
gcgccgccaccccgcgcgcc

SEQ ID NO: 1193513 - RNA, 14 nt, Mycobacterium bovis subsp bovis AF2122/97
gcgccgccagcacc

SEQ ID NO: 1193514 - RNA, 23 nt, Mycobacterium bovis subsp bovis AF2122/97
gcgccgccacggaucgcggcggc

SEQ ID NO: 1193515 - RNA, 14 nt, Mycobacterium bovis subsp bovis AF2122/97
gcgccgccagcgcc

SEQ ID NO: 1193516 - RNA, 19 nt, Mycobacterium bovis subsp bovis AF2122/97
gcgccgccagcgccgccgg

SEQ ID NO: 1193517 - RNA, 15 nt, Mycobacterium bovis subsp bovis AF2122/97
gcgccgcagggccgc

SEQ ID NO: 1193518 - RNA, 13 nt, Mycobacterium bovis subsp bovis AF2122/97
gcgccgcagagca

SEQ ID NO: 1193519 - RNA, 12 nt, Mycobacterium bovis subsp bovis AF2122/97
gcgccgcacggc

SEQ ID NO: 1193520 - RNA, 14 nt, Mycobacterium bovis subsp bovis AF2122/97
gcgccgcacggcga

SEQ ID NO: 1193521 - RNA, 17 nt, Mycobacterium bovis subsp bovis AF2122/97
gcgccgcaccaagcagc

SEQ ID NO: 1193522 - RNA, 16 nt, Mycobacterium bovis subsp bovis AF2122/97
gcgccgcacggcgacg

SEQ ID NO: 1193523 - RNA, 12 nt, Mycobacterium bovis subsp bovis AF2122/97
gcgccgccacag

SEQ ID NO: 1193524 - RNA, 13 nt, Mycobacterium bovis subsp bovis AF2122/97
gcgccgccacagc

SEQ ID NO: 1193525 - RNA, 14 nt, Mycobacterium bovis subsp bovis AF2122/97
gcgccgccacagca

SEQ ID NO: 1193526 - RNA, 23 nt, Mycobacterium bovis subsp bovis AF2122/97
gcgccgcaucauagacagggccg

SEQ ID NO: 1193527 - RNA, 21 nt, Mycobacterium bovis subsp bovis AF2122/97
gcgccgcauccagccgugcgg

SEQ ID NO: 1193528 - RNA, 21 nt, Mycobacterium bovis subsp bovis AF2122/97
gcgccgcacagagugaggcgc

SEQ ID NO: 1193529 - RNA, 18 nt, Mycobacterium bovis subsp bovis AF2122/97
gcgccgaucuucgcgcgc

SEQ ID NO: 1193530 - RNA, 20 nt, Mycobacterium bovis subsp bovis AF2122/97
gcgccgaucuucgcgcgcuc

SEQ ID NO: 1193531 - RNA, 21 nt, Mycobacterium bovis subsp bovis AF2122/97
gcgccgauaccggcggcgagc

SEQ ID NO: 1193532 - RNA, 18 nt, Mycobacterium bovis subsp bovis AF2122/97
gcgccgaucacggugggc

SEQ ID NO: 1193533 - RNA, 15 nt, Mycobacterium bovis subsp bovis AF2122/97
gcgccgcggcccgcu

SEQ ID NO: 1193534 - RNA, 14 nt, Mycobacterium bovis subsp bovis AF2122/97
gcgccgcguggcug

SEQ ID NO: 1193535 - RNA, 20 nt, Mycobacterium bovis subsp bovis AF2122/97
gcgccgcggcuacaucggcg

SEQ ID NO: 1193536 - RNA, 14 nt, Mycobacterium bovis subsp bovis AF2122/97
gcgccgcggcgacg

SEQ ID NO: 1193537 - RNA, 23 nt, Mycobacterium bovis subsp bovis AF2122/97
gcgccgcccaugccuccagaacc

SEQ ID NO: 1193538 - RNA, 15 nt, Mycobacterium bovis subsp bovis AF2122/97
gcgccgcccaacgcg

SEQ ID NO: 1193539 - RNA, 15 nt, Mycobacterium bovis subsp bovis AF2122/97
gcgccggcacgggcg

SEQ ID NO: 1193540 - RNA, 23 nt, Mycobacterium bovis subsp bovis AF2122/97
gcgccggcaucuccaccgucgcc

SEQ ID NO: 1193541 - RNA, 18 nt, Mycobacterium bovis subsp bovis AF2122/97
gcgccggccagccagcga

SEQ ID NO: 1193542 - RNA, 12 nt, Mycobacterium bovis subsp bovis AF2122/97
gcgccggccagg

SEQ ID NO: 1193543 - RNA, 14 nt, Mycobacterium bovis subsp bovis AF2122/97
gcgccggccaggcu

SEQ ID NO: 1193544 - RNA, 15 nt, Mycobacterium bovis subsp bovis AF2122/97
gcgccggccaugccu

SEQ ID NO: 1193545 - RNA, 14 nt, Mycobacterium bovis subsp bovis AF2122/97
gcgccggaggcggc

SEQ ID NO: 1193546 - RNA, 13 nt, Mycobacterium bovis subsp bovis AF2122/97
gcgccggucgccg

SEQ ID NO: 1193547 - RNA, 17 nt, Mycobacterium bovis subsp bovis AF2122/97
gcgccggucgccgacgg

SEQ ID NO: 1193548 - RNA, 18 nt, Mycobacterium bovis subsp bovis AF2122/97
gcgccggucgccgacggc

SEQ ID NO: 1193549 - RNA, 16 nt, Mycobacterium bovis subsp bovis AF2122/97
gcgccggugccgccgg

SEQ ID NO: 1193550 - RNA, 15 nt, Mycobacterium bovis subsp bovis AF2122/97
gcgccggugccgccu

SEQ ID NO: 1193551 - RNA, 17 nt, Mycobacterium bovis subsp bovis AF2122/97
gcgccggugcggcgggc

SEQ ID NO: 1193552 - RNA, 13 nt, Mycobacterium bovis subsp bovis AF2122/97
gcgccggccggca

SEQ ID NO: 1193553 - RNA, 14 nt, Mycobacterium bovis subsp bovis AF2122/97
gcgccggccgcugc

SEQ ID NO: 1193554 - RNA, 14 nt, Mycobacterium bovis subsp bovis AF2122/97
gcgccggccgcggc

SEQ ID NO: 1193555 - RNA, 12 nt, Mycobacterium bovis subsp bovis AF2122/97
gcgccggcgccc

SEQ ID NO: 1193556 - RNA, 13 nt, Mycobacterium bovis subsp bovis AF2122/97
gcgccggcgccuc

SEQ ID NO: 1193557 - RNA, 16 nt, Mycobacterium bovis subsp bovis AF2122/97
gcgccgucagcccagg

SEQ ID NO: 1193558 - RNA, 17 nt, Mycobacterium bovis subsp bovis AF2122/97
gcgccgucagcccaggu

SEQ ID NO: 1193559 - RNA, 17 nt, Mycobacterium bovis subsp bovis AF2122/97
gcgccguacagcggcgg

SEQ ID NO: 1193560 - RNA, 16 nt, Mycobacterium bovis subsp bovis AF2122/97
gcgccgucgcagccag

SEQ ID NO: 1193561 - RNA, 21 nt, Mycobacterium bovis subsp bovis AF2122/97
gcgccgucagcccaggugggc

SEQ ID NO: 1193562 - RNA, 19 nt, Mycobacterium bovis subsp bovis AF2122/97
gcgccgucgucgagcacca

SEQ ID NO: 1193563 - RNA, 17 nt, Mycobacterium bovis subsp bovis AF2122/97
gcgcccgaagccgggcc

SEQ ID NO: 1193564 - RNA, 21 nt, Mycobacterium bovis subsp bovis AF2122/97
gcgcccgccgcggcagcaucc

SEQ ID NO: 1193565 - RNA, 19 nt, Mycobacterium bovis subsp bovis AF2122/97
gcgcccgccaucagcccgg

SEQ ID NO: 1193566 - RNA, 21 nt, Mycobacterium bovis subsp bovis AF2122/97
gcgcccgccaucagcccggcg

SEQ ID NO: 1193567 - RNA, 15 nt, Mycobacterium bovis subsp bovis AF2122/97
gcgcccgccaucagc

SEQ ID NO: 1193568 - RNA, 21 nt, Mycobacterium bovis subsp bovis AF2122/97
gcgcccccgacgacggcaccg

SEQ ID NO: 1193569 - RNA, 14 nt, Mycobacterium bovis subsp bovis AF2122/97
gcgcccccggugcc

SEQ ID NO: 1193570 - RNA, 22 nt, Mycobacterium bovis subsp bovis AF2122/97
gcgccccaugggggaacccccu

SEQ ID NO: 1193571 - RNA, 13 nt, Mycobacterium bovis subsp bovis AF2122/97
gcgccccgcggca

SEQ ID NO: 1193572 - RNA, 14 nt, Mycobacterium bovis subsp bovis AF2122/97
gcgccccgcggucc

SEQ ID NO: 1193573 - RNA, 14 nt, Mycobacterium bovis subsp bovis AF2122/97
gcgccccgccgcac

SEQ ID NO: 1193574 - RNA, 17 nt, Mycobacterium bovis subsp bovis AF2122/97
gcgcccauggccaccag

SEQ ID NO: 1193575 - RNA, 22 nt, Mycobacterium bovis subsp bovis AF2122/97
gcgccccaccggcccgggaaau

SEQ ID NO: 1193576 - RNA, 16 nt, Mycobacterium bovis subsp bovis AF2122/97
gcgccccaccgcgccg

SEQ ID NO: 1193577 - RNA, 17 nt, Mycobacterium bovis subsp bovis AF2122/97
gcgcccgucuccagcac

SEQ ID NO: 1193578 - RNA, 16 nt, Mycobacterium bovis subsp bovis AF2122/97
gcgcccucagccgcgg

SEQ ID NO: 1193579 - RNA, 17 nt, Mycobacterium bovis subsp bovis AF2122/97
gcgcccucagccgcggc

SEQ ID NO: 1193580 - RNA, 24 nt, Mycobacterium bovis subsp bovis AF2122/97
gcgcccucagccgcggccacauga

SEQ ID NO: 1193581 - RNA, 16 nt, Mycobacterium bovis subsp bovis AF2122/97
gcgcccgggucccggc

SEQ ID NO: 1193582 - RNA, 20 nt, Mycobacterium bovis subsp bovis AF2122/97
gcgcccggcgcuagcgccgc

SEQ ID NO: 1193583 - RNA, 16 nt, Mycobacterium bovis subsp bovis AF2122/97
gcgcccugagccaccc

SEQ ID NO: 1193584 - RNA, 23 nt, Mycobacterium bovis subsp bovis AF2122/97
gcgcccuggcgugugugcgccuc

SEQ ID NO: 1193585 - RNA, 18 nt, Mycobacterium bovis subsp bovis AF2122/97
gcgcccuuaagccggcgc

SEQ ID NO: 1193586 - RNA, 21 nt, Mycobacterium bovis subsp bovis AF2122/97
gcgcccuuaagccggcgcggc

SEQ ID NO: 1193587 - RNA, 20 nt, Mycobacterium bovis subsp bovis AF2122/97
gcgcccggcgcaagcgccgc

SEQ ID NO: 1193588 - RNA, 14 nt, Mycobacterium bovis subsp bovis AF2122/97
gcgcccgccggcgc

SEQ ID NO: 1193589 - RNA, 21 nt, Mycobacterium bovis subsp bovis AF2122/97
gcgcccgccggcgcgagccgg

SEQ ID NO: 1193590 - RNA, 14 nt, Mycobacterium bovis subsp bovis AF2122/97
gcgcccgcgcgcuc

SEQ ID NO: 1193591 - RNA, 12 nt, Mycobacterium bovis subsp bovis AF2122/97
gcgcccgcgaaa

SEQ ID NO: 1193592 - RNA, 19 nt, Mycobacterium bovis subsp bovis AF2122/97
gcgcccgcguucagggcac

SEQ ID NO: 1193593 - RNA, 14 nt, Mycobacterium bovis subsp bovis AF2122/97
gcgcccgcucggcc

SEQ ID NO: 1193594 - RNA, 19 nt, Mycobacterium bovis subsp bovis AF2122/97
gcgcccgcuaacuggcccg

SEQ ID NO: 1193595 - RNA, 20 nt, Mycobacterium bovis subsp bovis AF2122/97
gcgcccgcugagccagcucc

SEQ ID NO: 1193596 - RNA, 22 nt, Mycobacterium bovis subsp bovis AF2122/97
gcgccagccuccaccaggucgu

SEQ ID NO: 1193597 - RNA, 13 nt, Mycobacterium bovis subsp bovis AF2122/97
gcgcaggccgccg

SEQ ID NO: 1193598 - RNA, 21 nt, Mycobacterium bovis subsp bovis AF2122/97
gcgcaggauguucaaucccuc

SEQ ID NO: 1193599 - RNA, 23 nt, Mycobacterium bovis subsp bovis AF2122/97
gcgcaggauucugcugaccauga

SEQ ID NO: 1193600 - RNA, 20 nt, Mycobacterium bovis subsp bovis AF2122/97
gcgccacuggaagccaagcu

SEQ ID NO: 1193601 - RNA, 23 nt, Mycobacterium bovis subsp bovis AF2122/97
gcgccacguccaucaccggcggc

SEQ ID NO: 1193602 - RNA, 20 nt, Mycobacterium bovis subsp bovis AF2122/97
gcgccacguggucgagcagg

SEQ ID NO: 1193603 - RNA, 18 nt, Mycobacterium bovis subsp bovis AF2122/97
gcgccagacacaaccgcu

SEQ ID NO: 1193604 - RNA, 18 nt, Mycobacterium bovis subsp bovis AF2122/97
gcgccagggucgguugcu

SEQ ID NO: 1193605 - RNA, 19 nt, Mycobacterium bovis subsp bovis AF2122/97
gcgccaguauggccgccac

SEQ ID NO: 1193606 - RNA, 22 nt, Mycobacterium bovis subsp bovis AF2122/97
gcgccaugcugucguagcgcga

SEQ ID NO: 1193607 - RNA, 15 nt, Mycobacterium bovis subsp bovis AF2122/97
gcgccaugcgccaac

SEQ ID NO: 1193608 - RNA, 23 nt, Mycobacterium bovis subsp bovis AF2122/97
gcgcccaggccgaucagcgcggc

SEQ ID NO: 1193609 - RNA, 18 nt, Mycobacterium bovis subsp bovis AF2122/97
gcgcccacagcccgggcg

SEQ ID NO: 1193610 - RNA, 17 nt, Mycobacterium bovis subsp bovis AF2122/97
gcguugacgaucagucc

SEQ ID NO: 1193611 - RNA, 20 nt, Mycobacterium bovis subsp bovis AF2122/97
gcguugacgucgagcagcgc

SEQ ID NO: 1193612 - RNA, 15 nt, Mycobacterium bovis subsp bovis AF2122/97
gcguugacucugcgu

SEQ ID NO: 1193613 - RNA, 16 nt, Mycobacterium bovis subsp bovis AF2122/97
gcguugaacugugcgg

SEQ ID NO: 1193614 - RNA, 20 nt, Mycobacterium bovis subsp bovis AF2122/97
gcguugaacugugcggcagc

SEQ ID NO: 1193615 - RNA, 21 nt, Mycobacterium bovis subsp bovis AF2122/97
gcguuucgaaccgcacgguga

SEQ ID NO: 1193616 - RNA, 21 nt, Mycobacterium bovis subsp bovis AF2122/97
gcguugcacagcagcgguuga

SEQ ID NO: 1193617 - RNA, 23 nt, Mycobacterium bovis subsp bovis AF2122/97
gcguucggucagugggacgggcg

SEQ ID NO: 1193618 - RNA, 15 nt, Mycobacterium bovis subsp bovis AF2122/97
gcguucggcgagcag

SEQ ID NO: 1193619 - RNA, 23 nt, Mycobacterium bovis subsp bovis AF2122/97
gcguucggcgcugaucgcgcgca

SEQ ID NO: 1193620 - RNA, 15 nt, Mycobacterium bovis subsp bovis AF2122/97
gcguucgccgcccgg

SEQ ID NO: 1193621 - RNA, 14 nt, Mycobacterium bovis subsp bovis AF2122/97
gcguucgaugccac

SEQ ID NO: 1193622 - RNA, 15 nt, Mycobacterium bovis subsp bovis AF2122/97
gcguucggccgggcc

SEQ ID NO: 1193623 - RNA, 24 nt, Mycobacterium bovis subsp bovis AF2122/97
gcguggucaccccuucgccagcgc

SEQ ID NO: 1193624 - RNA, 15 nt, Mycobacterium bovis subsp bovis AF2122/97
gcguggucgcgcggc

SEQ ID NO: 1193625 - RNA, 16 nt, Mycobacterium bovis subsp bovis AF2122/97
gcguggucgcgcggca

SEQ ID NO: 1193626 - RNA, 19 nt, Mycobacterium bovis subsp bovis AF2122/97
gcguuacccaucgccacac

SEQ ID NO: 1193627 - RNA, 15 nt, Mycobacterium bovis subsp bovis AF2122/97
gcgugcugccgccuu

SEQ ID NO: 1193628 - RNA, 21 nt, Mycobacterium bovis subsp bovis AF2122/97
gcgugcugccguauccaggcg

SEQ ID NO: 1193629 - RNA, 19 nt, Mycobacterium bovis subsp bovis AF2122/97
gcguggaacuugcgcaggu

SEQ ID NO: 1193630 - RNA, 19 nt, Mycobacterium bovis subsp bovis AF2122/97
gcgugcugugcucacgagc

SEQ ID NO: 1193631 - RNA, 15 nt, Mycobacterium bovis subsp bovis AF2122/97
gcgugcugugcucac

SEQ ID NO: 1193632 - RNA, 18 nt, Mycobacterium bovis subsp bovis AF2122/97
gcguggaauggcgccggc

SEQ ID NO: 1193633 - RNA, 14 nt, Mycobacterium bovis subsp bovis AF2122/97
gcguggacgcccgc

SEQ ID NO: 1193634 - RNA, 13 nt, Mycobacterium bovis subsp bovis AF2122/97
gcguggaucgcgc

SEQ ID NO: 1193635 - RNA, 15 nt, Mycobacterium bovis subsp bovis AF2122/97
gcguggaucuuggcc

SEQ ID NO: 1193636 - RNA, 14 nt, Mycobacterium bovis subsp bovis AF2122/97
gcgugggcgcggcg

SEQ ID NO: 1193637 - RNA, 21 nt, Mycobacterium bovis subsp bovis AF2122/97
gcgugcacugaccgcggcugu

SEQ ID NO: 1193638 - RNA, 16 nt, Mycobacterium bovis subsp bovis AF2122/97
gcgugcacaggucagc

SEQ ID NO: 1193639 - RNA, 19 nt, Mycobacterium bovis subsp bovis AF2122/97
gcgugaagucacggcggcu

SEQ ID NO: 1193640 - RNA, 24 nt, Mycobacterium bovis subsp bovis AF2122/97
gcgugccagcgccccgcgguccug

SEQ ID NO: 1193641 - RNA, 14 nt, Mycobacterium bovis subsp bovis AF2122/97
gcgugcaugagccg

SEQ ID NO: 1193642 - RNA, 16 nt, Mycobacterium bovis subsp bovis AF2122/97
gcgugcucgacgcgca

SEQ ID NO: 1193643 - RNA, 18 nt, Mycobacterium bovis subsp bovis AF2122/97
gcgugccgaccagcaucu

SEQ ID NO: 1193644 - RNA, 22 nt, Mycobacterium bovis subsp bovis AF2122/97
gcgucugcucgcgccggugagg

SEQ ID NO: 1193645 - RNA, 15 nt, Mycobacterium bovis subsp bovis AF2122/97
gcgucugcucggcgc

SEQ ID NO: 1193646 - RNA, 16 nt, Mycobacterium bovis subsp bovis AF2122/97
gcgucugcucgccagg

SEQ ID NO: 1193647 - RNA, 20 nt, Mycobacterium bovis subsp bovis AF2122/97
gcgucuucggucgcggccuc

SEQ ID NO: 1193648 - RNA, 18 nt, Mycobacterium bovis subsp bovis AF2122/97
gcgucuuccucggccacc

SEQ ID NO: 1193649 - RNA, 17 nt, Mycobacterium bovis subsp bovis AF2122/97
gcguaucccgugugcgg

SEQ ID NO: 1193650 - RNA, 18 nt, Mycobacterium bovis subsp bovis AF2122/97
gcgucucgccgggaaaca

SEQ ID NO: 1193651 - RNA, 22 nt, Mycobacterium bovis subsp bovis AF2122/97
gcguaugccaggacuggcaccg

SEQ ID NO: 1193652 - RNA, 16 nt, Mycobacterium bovis subsp bovis AF2122/97
gcgucugagcgccggc

SEQ ID NO: 1193653 - RNA, 17 nt, Mycobacterium bovis subsp bovis AF2122/97
gcgucugcagcgggcgu

SEQ ID NO: 1193654 - RNA, 17 nt, Mycobacterium bovis subsp bovis AF2122/97
gcuaccccggcggucag

SEQ ID NO: 1193655 - RNA, 17 nt, Mycobacterium bovis subsp bovis AF2122/97
gcuacccauucggcggc

SEQ ID NO: 1193656 - RNA, 21 nt, Mycobacterium bovis subsp bovis AF2122/97
gcuaccgaacaguaggccucc

SEQ ID NO: 1193657 - RNA, 22 nt, Mycobacterium bovis subsp bovis AF2122/97
gcuaccgaacaguaggccuccg

SEQ ID NO: 1193658 - RNA, 17 nt, Mycobacterium bovis subsp bovis AF2122/97
gcuacccgggccaggcu

SEQ ID NO: 1193659 - RNA, 22 nt, Mycobacterium bovis subsp bovis AF2122/97
gcuaccccagccggcagcagcg

SEQ ID NO: 1193660 - RNA, 14 nt, Mycobacterium bovis subsp bovis AF2122/97
gcuaccgcccgcgc

SEQ ID NO: 1193661 - RNA, 16 nt, Mycobacterium bovis subsp bovis AF2122/97
gcuaccggcgccgcgc

SEQ ID NO: 1193662 - RNA, 13 nt, Mycobacterium bovis subsp bovis AF2122/97
gcuaccuccgcca

SEQ ID NO: 1193663 - RNA, 13 nt, Mycobacterium bovis subsp bovis AF2122/97
gcuacuaugccaa

SEQ ID NO: 1193664 - RNA, 18 nt, Mycobacterium bovis subsp bovis AF2122/97
gcuacucgaaacccaugu

SEQ ID NO: 1193665 - RNA, 17 nt, Mycobacterium bovis subsp bovis AF2122/97
gcuacuaggcccagcac

SEQ ID NO: 1193666 - RNA, 20 nt, Mycobacterium bovis subsp bovis AF2122/97
gcuacucacggugaucguuc

SEQ ID NO: 1193667 - RNA, 17 nt, Mycobacterium bovis subsp bovis AF2122/97
gcuacgucaagccgugc

SEQ ID NO: 1193668 - RNA, 18 nt, Mycobacterium bovis subsp bovis AF2122/97
gcuacggcgacacgccag

SEQ ID NO: 1193669 - RNA, 20 nt, Mycobacterium bovis subsp bovis AF2122/97
gcuacgcgcgcucgcucacc

SEQ ID NO: 1193670 - RNA, 21 nt, Mycobacterium bovis subsp bovis AF2122/97
gcuacgcaacgggucgggucc

SEQ ID NO: 1193671 - RNA, 17 nt, Mycobacterium bovis subsp bovis AF2122/97
gcuacgcggccgagguc

SEQ ID NO: 1193672 - RNA, 14 nt, Mycobacterium bovis subsp bovis AF2122/97
gcuacaucggcggc

SEQ ID NO: 1193673 - RNA, 14 nt, Mycobacterium bovis subsp bovis AF2122/97
gcuaacuggcccgg

SEQ ID NO: 1193674 - RNA, 20 nt, Mycobacterium bovis subsp bovis AF2122/97
gcuaaacuccgugccgagcg

SEQ ID NO: 1193675 - RNA, 21 nt, Mycobacterium bovis subsp bovis AF2122/97
gcucggccgucaggguguugc

SEQ ID NO: 1193676 - RNA, 17 nt, Mycobacterium bovis subsp bovis AF2122/97
gcucggcccagcgcgcc

SEQ ID NO: 1193677 - RNA, 23 nt, Mycobacterium bovis subsp bovis AF2122/97
gcucggccccgccgccggugcgg

SEQ ID NO: 1193678 - RNA, 17 nt, Mycobacterium bovis subsp bovis AF2122/97
gcucggccgaggcgguc

SEQ ID NO: 1193679 - RNA, 14 nt, Mycobacterium bovis subsp bovis AF2122/97
gcucggccgaugcg

SEQ ID NO: 1193680 - RNA, 16 nt, Mycobacterium bovis subsp bovis AF2122/97
gcucggcacccgccgg

SEQ ID NO: 1193681 - RNA, 13 nt, Mycobacterium bovis subsp bovis AF2122/97
gcucggcaggccc

SEQ ID NO: 1193682 - RNA, 18 nt, Mycobacterium bovis subsp bovis AF2122/97
gcucggccaggcuggcca

SEQ ID NO: 1193683 - RNA, 13 nt, Mycobacterium bovis subsp bovis AF2122/97
gcucgcugcacca

SEQ ID NO: 1193684 - RNA, 18 nt, Mycobacterium bovis subsp bovis AF2122/97
gcucgcugcaccagcugc

SEQ ID NO: 1193685 - RNA, 17 nt, Mycobacterium bovis subsp bovis AF2122/97
gcucgcguggccgccgg

SEQ ID NO: 1193686 - RNA, 19 nt, Mycobacterium bovis subsp bovis AF2122/97
gcucgcucaccggcuggug

SEQ ID NO: 1193687 - RNA, 20 nt, Mycobacterium bovis subsp bovis AF2122/97
gcucgcucaccggcuggugc

SEQ ID NO: 1193688 - RNA, 17 nt, Mycobacterium bovis subsp bovis AF2122/97
gcucgcucugcgcggcu

SEQ ID NO: 1193689 - RNA, 15 nt, Mycobacterium bovis subsp bovis AF2122/97
gcucgcucacgccgu

SEQ ID NO: 1193690 - RNA, 14 nt, Mycobacterium bovis subsp bovis AF2122/97
gcucgcugaccuug

SEQ ID NO: 1193691 - RNA, 20 nt, Mycobacterium bovis subsp bovis AF2122/97
gcucgcugaucuggggcacc

SEQ ID NO: 1193692 - RNA, 20 nt, Mycobacterium bovis subsp bovis AF2122/97
gcucgcugaugcaucccaac

SEQ ID NO: 1193693 - RNA, 20 nt, Mycobacterium bovis subsp bovis AF2122/97
gcucgcgcucguuagcggcg

SEQ ID NO: 1193694 - RNA, 23 nt, Mycobacterium bovis subsp bovis AF2122/97
gcucgcggcuucaguccggcccc

SEQ ID NO: 1193695 - RNA, 14 nt, Mycobacterium bovis subsp bovis AF2122/97
gcucgcgcccgcua

SEQ ID NO: 1193696 - RNA, 20 nt, Mycobacterium bovis subsp bovis AF2122/97
gcucgcgcccgcuaacuggc

SEQ ID NO: 1193697 - RNA, 15 nt, Mycobacterium bovis subsp bovis AF2122/97
gcucgcgcgcugggc

SEQ ID NO: 1193698 - RNA, 14 nt, Mycobacterium bovis subsp bovis AF2122/97
gcucgcagcgggcg

SEQ ID NO: 1193699 - RNA, 13 nt, Mycobacterium bovis subsp bovis AF2122/97
gcucgcaucaucg

SEQ ID NO: 1193700 - RNA, 17 nt, Mycobacterium bovis subsp bovis AF2122/97
gcucgcaaucguuggcc

SEQ ID NO: 1193701 - RNA, 14 nt, Mycobacterium bovis subsp bovis AF2122/97
gcucgccagccggc

SEQ ID NO: 1193702 - RNA, 14 nt, Mycobacterium bovis subsp bovis AF2122/97
gcucgccagcgggg

SEQ ID NO: 1193703 - RNA, 13 nt, Mycobacterium bovis subsp bovis AF2122/97
gcucgccaccucg

SEQ ID NO: 1193704 - RNA, 14 nt, Mycobacterium bovis subsp bovis AF2122/97
gcucgccgugacca

SEQ ID NO: 1193705 - RNA, 21 nt, Mycobacterium bovis subsp bovis AF2122/97
gcucgccgugaccaggugcca

SEQ ID NO: 1193706 - RNA, 21 nt, Mycobacterium bovis subsp bovis AF2122/97
gcucgccguaagcaccagcca

SEQ ID NO: 1193707 - RNA, 19 nt, Mycobacterium bovis subsp bovis AF2122/97
gcucgccuaucgacucagu

SEQ ID NO: 1193708 - RNA, 18 nt, Mycobacterium bovis subsp bovis AF2122/97
gcucgccgguaggcggcc

SEQ ID NO: 1193709 - RNA, 20 nt, Mycobacterium bovis subsp bovis AF2122/97
gcucgccgguaggcggccag

SEQ ID NO: 1193710 - RNA, 21 nt, Mycobacterium bovis subsp bovis AF2122/97
gcucgccgguaggcggccagc

SEQ ID NO: 1193711 - RNA, 22 nt, Mycobacterium bovis subsp bovis AF2122/97
gcucgccgguaggcggccagcg

SEQ ID NO: 1193712 - RNA, 17 nt, Mycobacterium bovis subsp bovis AF2122/97
gcucgcgcaaggcgccg

SEQ ID NO: 1193713 - RNA, 18 nt, Mycobacterium bovis subsp bovis AF2122/97
gcucgcgcaaggcgccgc

SEQ ID NO: 1193714 - RNA, 14 nt, Mycobacterium bovis subsp bovis AF2122/97
gcucgauggcggcc

SEQ ID NO: 1193715 - RNA, 17 nt, Mycobacterium bovis subsp bovis AF2122/97
gcucgaugucagcggcc

SEQ ID NO: 1193716 - RNA, 15 nt, Mycobacterium bovis subsp bovis AF2122/97
gcucgauggcggcca

SEQ ID NO: 1193717 - RNA, 18 nt, Mycobacterium bovis subsp bovis AF2122/97
gcucgaugucagcggccg

SEQ ID NO: 1193718 - RNA, 14 nt, Mycobacterium bovis subsp bovis AF2122/97
gcucgaugucccga

SEQ ID NO: 1193719 - RNA, 21 nt, Mycobacterium bovis subsp bovis AF2122/97
gcucgacgaagaucgcgugcc

SEQ ID NO: 1193720 - RNA, 16 nt, Mycobacterium bovis subsp bovis AF2122/97
gcucgaccgcccggcu

SEQ ID NO: 1193721 - RNA, 16 nt, Mycobacterium bovis subsp bovis AF2122/97
gcuccucggccagcgu

SEQ ID NO: 1193722 - RNA, 16 nt, Mycobacterium bovis subsp bovis AF2122/97
gcuccucgcgcucgcc

SEQ ID NO: 1193723 - RNA, 17 nt, Mycobacterium bovis subsp bovis AF2122/97
gcucgaaacgcccuugu

SEQ ID NO: 1193724 - RNA, 20 nt, Mycobacterium bovis subsp bovis AF2122/97
gcuccucauagagcggcacc

SEQ ID NO: 1193725 - RNA, 16 nt, Mycobacterium bovis subsp bovis AF2122/97
gcuccucaucgugggg

SEQ ID NO: 1193726 - RNA, 15 nt, Mycobacterium bovis subsp bovis AF2122/97
gcuccgaugugccga

SEQ ID NO: 1193727 - RNA, 16 nt, Mycobacterium bovis subsp bovis AF2122/97
gcuccgauuccgaacu

SEQ ID NO: 1193728 - RNA, 13 nt, Mycobacterium bovis subsp bovis AF2122/97
gcuccggucgggu

SEQ ID NO: 1193729 - RNA, 21 nt, Mycobacterium bovis subsp bovis AF2122/97
gcuccgugguugccgaagccg

SEQ ID NO: 1193730 - RNA, 14 nt, Mycobacterium bovis subsp bovis AF2122/97
gcuccgucgcggcc

SEQ ID NO: 1193731 - RNA, 17 nt, Mycobacterium bovis subsp bovis AF2122/97
gcuccaguggcgccagg

SEQ ID NO: 1193732 - RNA, 18 nt, Mycobacterium bovis subsp bovis AF2122/97
gcuccaguggcgccaggg

SEQ ID NO: 1193733 - RNA, 20 nt, Mycobacterium bovis subsp bovis AF2122/97
gcuccaguggcgccagggcc

SEQ ID NO: 1193734 - RNA, 22 nt, Mycobacterium bovis subsp bovis AF2122/97
gcucccuacgagcccacgcgcc

SEQ ID NO: 1193735 - RNA, 12 nt, Mycobacterium bovis subsp bovis AF2122/97
gcuccauccccu

SEQ ID NO: 1193736 - RNA, 13 nt, Mycobacterium bovis subsp bovis AF2122/97
gcucccugcaccc

SEQ ID NO: 1193737 - RNA, 17 nt, Mycobacterium bovis subsp bovis AF2122/97
gcucccuuuuccaaagg

SEQ ID NO: 1193738 - RNA, 18 nt, Mycobacterium bovis subsp bovis AF2122/97
gcuccgaacauggccagc

SEQ ID NO: 1193739 - RNA, 21 nt, Mycobacterium bovis subsp bovis AF2122/97
gcuccgaacauggccagcauc

SEQ ID NO: 1193740 - RNA, 17 nt, Mycobacterium bovis subsp bovis AF2122/97
gcuaggugacgccgcca

SEQ ID NO: 1193741 - RNA, 21 nt, Mycobacterium bovis subsp bovis AF2122/97
gcuagggcgaugagggcuugu

SEQ ID NO: 1193742 - RNA, 13 nt, Mycobacterium bovis subsp bovis AF2122/97
gcucacaauggcu

SEQ ID NO: 1193743 - RNA, 21 nt, Mycobacterium bovis subsp bovis AF2122/97
gcuaggaucggauggcggcca

SEQ ID NO: 1193744 - RNA, 23 nt, Mycobacterium bovis subsp bovis AF2122/97
gcuaggucaguucccagaccacc

SEQ ID NO: 1193745 - RNA, 19 nt, Mycobacterium bovis subsp bovis AF2122/97
gcuagcuuggcggccagcg

SEQ ID NO: 1193746 - RNA, 14 nt, Mycobacterium bovis subsp bovis AF2122/97
gcuacuuggucagu

SEQ ID NO: 1193747 - RNA, 19 nt, Mycobacterium bovis subsp bovis AF2122/97
gcucacagcacagcgcagc

SEQ ID NO: 1193748 - RNA, 19 nt, Mycobacterium bovis subsp bovis AF2122/97
gcucacacucggccgggcu

SEQ ID NO: 1193749 - RNA, 13 nt, Mycobacterium bovis subsp bovis AF2122/97
gcucacacuggcu

SEQ ID NO: 1193750 - RNA, 17 nt, Mycobacterium bovis subsp bovis AF2122/97
gcucacagcacagcgca

SEQ ID NO: 1193751 - RNA, 17 nt, Mycobacterium bovis subsp bovis AF2122/97
gcucacauacagcaggc

SEQ ID NO: 1193752 - RNA, 22 nt, Mycobacterium bovis subsp bovis AF2122/97
gcucaccacgccggucgaggug

SEQ ID NO: 1193753 - RNA, 21 nt, Mycobacterium bovis subsp bovis AF2122/97
gcucaccagcggucagccggc

SEQ ID NO: 1193754 - RNA, 15 nt, Mycobacterium bovis subsp bovis AF2122/97
gcucaccaggcgagc

SEQ ID NO: 1193755 - RNA, 16 nt, Mycobacterium bovis subsp bovis AF2122/97
gcucacccaggcgccg

SEQ ID NO: 1193756 - RNA, 17 nt, Mycobacterium bovis subsp bovis AF2122/97
gcucacccggagcaccc

SEQ ID NO: 1193757 - RNA, 20 nt, Mycobacterium bovis subsp bovis AF2122/97
gcucacccuuggaauugaag

SEQ ID NO: 1193758 - RNA, 18 nt, Mycobacterium bovis subsp bovis AF2122/97
gcucaccgacggagaucg

SEQ ID NO: 1193759 - RNA, 19 nt, Mycobacterium bovis subsp bovis AF2122/97
gcucaggacgaacgcuggc

SEQ ID NO: 1193760 - RNA, 12 nt, Mycobacterium bovis subsp bovis AF2122/97
gcucagcauuca

SEQ ID NO: 1193761 - RNA, 13 nt, Mycobacterium bovis subsp bovis AF2122/97
gcucagaccaagg

SEQ ID NO: 1193762 - RNA, 20 nt, Mycobacterium bovis subsp bovis AF2122/97
gcucacuggcgauaucggcc

SEQ ID NO: 1193763 - RNA, 21 nt, Mycobacterium bovis subsp bovis AF2122/97
gcuccagcgcgcgccgcagcg

SEQ ID NO: 1193764 - RNA, 15 nt, Mycobacterium bovis subsp bovis AF2122/97
gcuccagcgcgcgcc

SEQ ID NO: 1193765 - RNA, 17 nt, Mycobacterium bovis subsp bovis AF2122/97
gcuccagcgcgcgccgc

SEQ ID NO: 1193766 - RNA, 20 nt, Mycobacterium bovis subsp bovis AF2122/97
gcuccagcgcgcgccgcagc

SEQ ID NO: 1193767 - RNA, 15 nt, Mycobacterium bovis subsp bovis AF2122/97
gcuccaguggcgcca

SEQ ID NO: 1193768 - RNA, 18 nt, Mycobacterium bovis subsp bovis AF2122/97
gcucauuagcccccgcgg

SEQ ID NO: 1193769 - RNA, 20 nt, Mycobacterium bovis subsp bovis AF2122/97
gcucaucgcggcgaacauca

SEQ ID NO: 1193770 - RNA, 18 nt, Mycobacterium bovis subsp bovis AF2122/97
gcuccaacgcacacaccg

SEQ ID NO: 1193771 - RNA, 20 nt, Mycobacterium bovis subsp bovis AF2122/97
gcuccaacaacuccagcagg

SEQ ID NO: 1193772 - RNA, 20 nt, Mycobacterium bovis subsp bovis AF2122/97
gcuccaacaaugccagcugu

SEQ ID NO: 1193773 - RNA, 17 nt, Mycobacterium bovis subsp bovis AF2122/97
gcuccaacacccgccgg

SEQ ID NO: 1193774 - RNA, 17 nt, Mycobacterium bovis subsp bovis AF2122/97
gcuccaauugcggccgc

SEQ ID NO: 1193775 - RNA, 20 nt, Mycobacterium bovis subsp bovis AF2122/97
gcuccaaaagccucagccgc

SEQ ID NO: 1193776 - RNA, 18 nt, Mycobacterium bovis subsp bovis AF2122/97
gcuccaacaacuccagca

SEQ ID NO: 1193777 - RNA, 19 nt, Mycobacterium bovis subsp bovis AF2122/97
gcucaucacccagcgccga

SEQ ID NO: 1193778 - RNA, 22 nt, Mycobacterium bovis subsp bovis AF2122/97
gcucaucccgacccuucgggcu

SEQ ID NO: 1193779 - RNA, 21 nt, Mycobacterium bovis subsp bovis AF2122/97
gcucauccgccgggccaggcc

SEQ ID NO: 1193780 - RNA, 20 nt, Mycobacterium bovis subsp bovis AF2122/97
gcucauaccgggaggacacc

SEQ ID NO: 1193781 - RNA, 24 nt, Mycobacterium bovis subsp bovis AF2122/97
gcucaggucgcagaccagacugca

SEQ ID NO: 1193782 - RNA, 23 nt, Mycobacterium bovis subsp bovis AF2122/97
gcucaggguguucacguucagcc

SEQ ID NO: 1193783 - RNA, 22 nt, Mycobacterium bovis subsp bovis AF2122/97
gcgggccucggcgaccaucuga

SEQ ID NO: 1193784 - RNA, 17 nt, Mycobacterium bovis subsp bovis AF2122/97
gcgggcccgaugaggac

SEQ ID NO: 1193785 - RNA, 23 nt, Mycobacterium bovis subsp bovis AF2122/97
gcgggccugcccgggaugcuccc

SEQ ID NO: 1193786 - RNA, 18 nt, Mycobacterium bovis subsp bovis AF2122/97
gcgggccugcacgccggc

SEQ ID NO: 1193787 - RNA, 13 nt, Mycobacterium bovis subsp bovis AF2122/97
gcgggccagcacc

SEQ ID NO: 1193788 - RNA, 16 nt, Mycobacterium bovis subsp bovis AF2122/97
gcgggccagcacccgc

SEQ ID NO: 1193789 - RNA, 19 nt, Mycobacterium bovis subsp bovis AF2122/97
gcgggccaccacgcgccgc

SEQ ID NO: 1193790 - RNA, 21 nt, Mycobacterium bovis subsp bovis AF2122/97
gcgggccaccacgcgccgcac

SEQ ID NO: 1193791 - RNA, 21 nt, Mycobacterium bovis subsp bovis AF2122/97
gcgggcgauuucggcgccggc

SEQ ID NO: 1193792 - RNA, 22 nt, Mycobacterium bovis subsp bovis AF2122/97
gcgggcgauuucggcgccggcg

SEQ ID NO: 1193793 - RNA, 15 nt, Mycobacterium bovis subsp bovis AF2122/97
gcgggcuugccguug

SEQ ID NO: 1193794 - RNA, 16 nt, Mycobacterium bovis subsp bovis AF2122/97
gcgggcgaugagcgcg

SEQ ID NO: 1193795 - RNA, 18 nt, Mycobacterium bovis subsp bovis AF2122/97
gcgggccuggcccacgcc

SEQ ID NO: 1193796 - RNA, 19 nt, Mycobacterium bovis subsp bovis AF2122/97
gcgggucgugccagcagca

SEQ ID NO: 1193797 - RNA, 20 nt, Mycobacterium bovis subsp bovis AF2122/97
gcgggucgugccccggcgcg

SEQ ID NO: 1193798 - RNA, 20 nt, Mycobacterium bovis subsp bovis AF2122/97
gcgggucgcugcgacuggug

SEQ ID NO: 1193799 - RNA, 22 nt, Mycobacterium bovis subsp bovis AF2122/97
gcgggucgcugcgacuggugcc

SEQ ID NO: 1193800 - RNA, 16 nt, Mycobacterium bovis subsp bovis AF2122/97
gcggguggcgccggug

SEQ ID NO: 1193801 - RNA, 23 nt, Mycobacterium bovis subsp bovis AF2122/97
gcgggugggacaccaucuccgcc

SEQ ID NO: 1193802 - RNA, 11 nt, Mycobacterium bovis subsp bovis AF2122/97
gcgggugguga

SEQ ID NO: 1193803 - RNA, 18 nt, Mycobacterium bovis subsp bovis AF2122/97
gcgggucagcgccgagag

SEQ ID NO: 1193804 - RNA, 20 nt, Mycobacterium bovis subsp bovis AF2122/97
gcggguccuucugccgggag

SEQ ID NO: 1193805 - RNA, 14 nt, Mycobacterium bovis subsp bovis AF2122/97
gcgggucgccgggc

SEQ ID NO: 1193806 - RNA, 15 nt, Mycobacterium bovis subsp bovis AF2122/97
gcgggucaggccagg

SEQ ID NO: 1193807 - RNA, 16 nt, Mycobacterium bovis subsp bovis AF2122/97
gcgggucaggccaggg

SEQ ID NO: 1193808 - RNA, 12 nt, Mycobacterium bovis subsp bovis AF2122/97
gcggggcggccu

SEQ ID NO: 1193809 - RNA, 15 nt, Mycobacterium bovis subsp bovis AF2122/97
gcggggcgaucccca

SEQ ID NO: 1193810 - RNA, 21 nt, Mycobacterium bovis subsp bovis AF2122/97
gcggggcuagucgggguggga

SEQ ID NO: 1193811 - RNA, 22 nt, Mycobacterium bovis subsp bovis AF2122/97
gcggggcugggcgccaugcgcc

SEQ ID NO: 1193812 - RNA, 15 nt, Mycobacterium bovis subsp bovis AF2122/97
gcgggggaccccgcc

SEQ ID NO: 1193813 - RNA, 22 nt, Mycobacterium bovis subsp bovis AF2122/97
gcgggggagcgaacggcgcagu

SEQ ID NO: 1193814 - RNA, 13 nt, Mycobacterium bovis subsp bovis AF2122/97
gcggggccggucg

SEQ ID NO: 1193815 - RNA, 13 nt, Mycobacterium bovis subsp bovis AF2122/97
gcggggccgggcg

SEQ ID NO: 1193816 - RNA, 16 nt, Mycobacterium bovis subsp bovis AF2122/97
gcggggccggcggcuc

SEQ ID NO: 1193817 - RNA, 15 nt, Mycobacterium bovis subsp bovis AF2122/97
gcggggccgccgcgg

SEQ ID NO: 1193818 - RNA, 21 nt, Mycobacterium bovis subsp bovis AF2122/97
gcggggccgccgcggccggcg

SEQ ID NO: 1193819 - RNA, 12 nt, Mycobacterium bovis subsp bovis AF2122/97
gcggggccggcg

SEQ ID NO: 1193820 - RNA, 19 nt, Mycobacterium bovis subsp bovis AF2122/97
gcggggcagaagucguugc

SEQ ID NO: 1193821 - RNA, 24 nt, Mycobacterium bovis subsp bovis AF2122/97
gcggggaaguuggcugagcagcgc

SEQ ID NO: 1193822 - RNA, 12 nt, Mycobacterium bovis subsp bovis AF2122/97
gcggcugagccg

SEQ ID NO: 1193823 - RNA, 12 nt, Mycobacterium bovis subsp bovis AF2122/97
gcggcugccagc

SEQ ID NO: 1193824 - RNA, 13 nt, Mycobacterium bovis subsp bovis AF2122/97
gcggcugccgguu

SEQ ID NO: 1193825 - RNA, 17 nt, Mycobacterium bovis subsp bovis AF2122/97
gcggcucguugcgggcg

SEQ ID NO: 1193826 - RNA, 18 nt, Mycobacterium bovis subsp bovis AF2122/97
gcggcucguugcgggcgg

SEQ ID NO: 1193827 - RNA, 18 nt, Mycobacterium bovis subsp bovis AF2122/97
gcggcucguuggcaaaga

SEQ ID NO: 1193828 - RNA, 21 nt, Mycobacterium bovis subsp bovis AF2122/97
gcggcucuagaucgccgagcg

SEQ ID NO: 1193829 - RNA, 20 nt, Mycobacterium bovis subsp bovis AF2122/97
gcggcucuauccggcgcagg

SEQ ID NO: 1193830 - RNA, 14 nt, Mycobacterium bovis subsp bovis AF2122/97
gcggcggcgcccgg

SEQ ID NO: 1193831 - RNA, 13 nt, Mycobacterium bovis subsp bovis AF2122/97
gcggcggcggcca

SEQ ID NO: 1193832 - RNA, 13 nt, Mycobacterium bovis subsp bovis AF2122/97
gcggcggcggccc

SEQ ID NO: 1193833 - RNA, 12 nt, Mycobacterium bovis subsp bovis AF2122/97
gcggcggcggca

SEQ ID NO: 1193834 - RNA, 24 nt, Mycobacterium bovis subsp bovis AF2122/97
gcggcggcuuuggccgccguggcg

SEQ ID NO: 1193835 - RNA, 12 nt, Mycobacterium bovis subsp bovis AF2122/97
gcggcgggcacg

SEQ ID NO: 1193836 - RNA, 13 nt, Mycobacterium bovis subsp bovis AF2122/97
gcggcggcgccgg

SEQ ID NO: 1193837 - RNA, 14 nt, Mycobacterium bovis subsp bovis AF2122/97
gcggcggcgcgauc

SEQ ID NO: 1193838 - RNA, 20 nt, Mycobacterium bovis subsp bovis AF2122/97
gcggcggaccguccgacggc

SEQ ID NO: 1193839 - RNA, 18 nt, Mycobacterium bovis subsp bovis AF2122/97
gcggcggccugggccagc

SEQ ID NO: 1193840 - RNA, 12 nt, Mycobacterium bovis subsp bovis AF2122/97
gcggcgcugguu

SEQ ID NO: 1193841 - RNA, 16 nt, Mycobacterium bovis subsp bovis AF2122/97
gcgggauggccgccga

SEQ ID NO: 1193842 - RNA, 16 nt, Mycobacterium bovis subsp bovis AF2122/97
gcgggauggggcccgc

SEQ ID NO: 1193843 - RNA, 13 nt, Mycobacterium bovis subsp bovis AF2122/97
gcgggauucuggc

SEQ ID NO: 1193844 - RNA, 15 nt, Mycobacterium bovis subsp bovis AF2122/97
gcgggaugcgcgccc

SEQ ID NO: 1193845 - RNA, 15 nt, Mycobacterium bovis subsp bovis AF2122/97
gcgggaucgguggcg

SEQ ID NO: 1193846 - RNA, 22 nt, Mycobacterium bovis subsp bovis AF2122/97
gcgggauccucgaaggcguucg

SEQ ID NO: 1193847 - RNA, 15 nt, Mycobacterium bovis subsp bovis AF2122/97
gcggcuuggaucuca

SEQ ID NO: 1193848 - RNA, 22 nt, Mycobacterium bovis subsp bovis AF2122/97
gcggcuuggccuagccgcggca

SEQ ID NO: 1193849 - RNA, 19 nt, Mycobacterium bovis subsp bovis AF2122/97
gcgggaguucggggugcgc

SEQ ID NO: 1193850 - RNA, 14 nt, Mycobacterium bovis subsp bovis AF2122/97
gcggcuugaucagc

SEQ ID NO: 1193851 - RNA, 22 nt, Mycobacterium bovis subsp bovis AF2122/97
gcggcuucguggcggcgcgcgc

SEQ ID NO: 1193852 - RNA, 15 nt, Mycobacterium bovis subsp bovis AF2122/97
gcggcuugaacagcu

SEQ ID NO: 1193853 - RNA, 23 nt, Mycobacterium bovis subsp bovis AF2122/97
gcggcuucacugcuaguggucug

SEQ ID NO: 1193854 - RNA, 13 nt, Mycobacterium bovis subsp bovis AF2122/97
gcgggcagcaggc

SEQ ID NO: 1193855 - RNA, 14 nt, Mycobacterium bovis subsp bovis AF2122/97
gcgggcagccgccc

SEQ ID NO: 1193856 - RNA, 19 nt, Mycobacterium bovis subsp bovis AF2122/97
gcgggcaguagcuguggcc

SEQ ID NO: 1193857 - RNA, 23 nt, Mycobacterium bovis subsp bovis AF2122/97
gcgggcaguagcuguggcccgcg

SEQ ID NO: 1193858 - RNA, 20 nt, Mycobacterium bovis subsp bovis AF2122/97
gcgggcaguuguugacagac

SEQ ID NO: 1193859 - RNA, 17 nt, Mycobacterium bovis subsp bovis AF2122/97
gcgggcacucagcaggg

SEQ ID NO: 1193860 - RNA, 18 nt, Mycobacterium bovis subsp bovis AF2122/97
gcgggcacgccgccgacg

SEQ ID NO: 1193861 - RNA, 19 nt, Mycobacterium bovis subsp bovis AF2122/97
gcgggcaaucaccgccggc

SEQ ID NO: 1193862 - RNA, 20 nt, Mycobacterium bovis subsp bovis AF2122/97
gcgggcaaucaccgccggcg

SEQ ID NO: 1193863 - RNA, 22 nt, Mycobacterium bovis subsp bovis AF2122/97
gcgggcaaucaccgccggcggc

SEQ ID NO: 1193864 - RNA, 23 nt, Mycobacterium bovis subsp bovis AF2122/97
gcgggcaagucgcccagccgagc

SEQ ID NO: 1193865 - RNA, 15 nt, Mycobacterium bovis subsp bovis AF2122/97
gcgggauugccgaga

SEQ ID NO: 1193866 - RNA, 16 nt, Mycobacterium bovis subsp bovis AF2122/97
gcgggauugcgcgcug

SEQ ID NO: 1193867 - RNA, 19 nt, Mycobacterium bovis subsp bovis AF2122/97
gcgguaucccccagccgcg

SEQ ID NO: 1193868 - RNA, 15 nt, Mycobacterium bovis subsp bovis AF2122/97
gcggucaacgacagc

SEQ ID NO: 1193869 - RNA, 19 nt, Mycobacterium bovis subsp bovis AF2122/97
gcggguucaacgcgcgcac

SEQ ID NO: 1193870 - RNA, 16 nt, Mycobacterium bovis subsp bovis AF2122/97
gcggguggugccggcg

SEQ ID NO: 1193871 - RNA, 19 nt, Mycobacterium bovis subsp bovis AF2122/97
gcgggugguuugcgcccug

SEQ ID NO: 1193872 - RNA, 20 nt, Mycobacterium bovis subsp bovis AF2122/97
gcgggugguuugcgcccuga

SEQ ID NO: 1193873 - RNA, 17 nt, Mycobacterium bovis subsp bovis AF2122/97
gcggucgcagcagacca

SEQ ID NO: 1193874 - RNA, 18 nt, Mycobacterium bovis subsp bovis AF2122/97
gcggucgcccgcuaccaa

SEQ ID NO: 1193875 - RNA, 18 nt, Mycobacterium bovis subsp bovis AF2122/97
gcggucgcgcccucagcc

SEQ ID NO: 1193876 - RNA, 16 nt, Mycobacterium bovis subsp bovis AF2122/97
gcggucgccaagaucg

SEQ ID NO: 1193877 - RNA, 15 nt, Mycobacterium bovis subsp bovis AF2122/97
gcggucgccacaccc

SEQ ID NO: 1193878 - RNA, 13 nt, Mycobacterium bovis subsp bovis AF2122/97
gcggucgccgcgc

SEQ ID NO: 1193879 - RNA, 21 nt, Mycobacterium bovis subsp bovis AF2122/97
gcggucgcgcccucagccgcg

SEQ ID NO: 1193880 - RNA, 19 nt, Mycobacterium bovis subsp bovis AF2122/97
gcggucaccggagagccgg

SEQ ID NO: 1193881 - RNA, 19 nt, Mycobacterium bovis subsp bovis AF2122/97
gcggucaucgagcugaccu

SEQ ID NO: 1193882 - RNA, 21 nt, Mycobacterium bovis subsp bovis AF2122/97
gcggucauauaggagcgggug

SEQ ID NO: 1193883 - RNA, 18 nt, Mycobacterium bovis subsp bovis AF2122/97
gcgguccaacagcgccag

SEQ ID NO: 1193884 - RNA, 20 nt, Mycobacterium bovis subsp bovis AF2122/97
gcgguccaacagcgccagua

SEQ ID NO: 1193885 - RNA, 12 nt, Mycobacterium bovis subsp bovis AF2122/97
gcggugcggcca

SEQ ID NO: 1193886 - RNA, 19 nt, Mycobacterium bovis subsp bovis AF2122/97
gcggugcgggcuucaacac

SEQ ID NO: 1193887 - RNA, 16 nt, Mycobacterium bovis subsp bovis AF2122/97
gcggugcggguggugc

SEQ ID NO: 1193888 - RNA, 21 nt, Mycobacterium bovis subsp bovis AF2122/97
gcgguggccacccggccgcgc

SEQ ID NO: 1193889 - RNA, 18 nt, Mycobacterium bovis subsp bovis AF2122/97
gcggugccgucgccgccc

SEQ ID NO: 1193890 - RNA, 22 nt, Mycobacterium bovis subsp bovis AF2122/97
gcggugccgucgccgcccuggc

SEQ ID NO: 1193891 - RNA, 16 nt, Mycobacterium bovis subsp bovis AF2122/97
gcggugccugcagcuu

SEQ ID NO: 1193892 - RNA, 17 nt, Mycobacterium bovis subsp bovis AF2122/97
gcggucggccaccaacu

SEQ ID NO: 1193893 - RNA, 16 nt, Mycobacterium bovis subsp bovis AF2122/97
gcggucgggcccggcg

SEQ ID NO: 1193894 - RNA, 13 nt, Mycobacterium bovis subsp bovis AF2122/97
gcgguggccggcg

SEQ ID NO: 1193895 - RNA, 13 nt, Mycobacterium bovis subsp bovis AF2122/97
gcgguggcggcgg

SEQ ID NO: 1193896 - RNA, 23 nt, Mycobacterium bovis subsp bovis AF2122/97
gcgguggcgucgucggcgggcug

SEQ ID NO: 1193897 - RNA, 22 nt, Mycobacterium bovis subsp bovis AF2122/97
gcgguggccagaucgaacgcag

SEQ ID NO: 1193898 - RNA, 18 nt, Mycobacterium bovis subsp bovis AF2122/97
gcgguggcuugccccgcc

SEQ ID NO: 1193899 - RNA, 17 nt, Mycobacterium bovis subsp bovis AF2122/97
gcgguggggcgcgccgg

SEQ ID NO: 1193900 - RNA, 19 nt, Mycobacterium bovis subsp bovis AF2122/97
gcggugucacaacgcguga

SEQ ID NO: 1193901 - RNA, 18 nt, Mycobacterium bovis subsp bovis AF2122/97
gcggugucacgacccaag

SEQ ID NO: 1193902 - RNA, 19 nt, Mycobacterium bovis subsp bovis AF2122/97
gcgguguagccgcgguaga

SEQ ID NO: 1193903 - RNA, 14 nt, Mycobacterium bovis subsp bovis AF2122/97
gcguacucccccga

SEQ ID NO: 1193904 - RNA, 22 nt, Mycobacterium bovis subsp bovis AF2122/97
gcguacccguuaugcgccgccc

SEQ ID NO: 1193905 - RNA, 14 nt, Mycobacterium bovis subsp bovis AF2122/97
gcguacggaaccac

SEQ ID NO: 1193906 - RNA, 18 nt, Mycobacterium bovis subsp bovis AF2122/97
gcguagucggcggugcag

SEQ ID NO: 1193907 - RNA, 15 nt, Mycobacterium bovis subsp bovis AF2122/97
gcguagagcagcagc

SEQ ID NO: 1193908 - RNA, 21 nt, Mycobacterium bovis subsp bovis AF2122/97
gcguagguggccagcgcggcg

SEQ ID NO: 1193909 - RNA, 15 nt, Mycobacterium bovis subsp bovis AF2122/97
gcguacaggccggcc

SEQ ID NO: 1193910 - RNA, 18 nt, Mycobacterium bovis subsp bovis AF2122/97
gcggugugcgcauggugg

SEQ ID NO: 1193911 - RNA, 20 nt, Mycobacterium bovis subsp bovis AF2122/97
gcgguguccuacuuuuccac

SEQ ID NO: 1193912 - RNA, 19 nt, Mycobacterium bovis subsp bovis AF2122/97
gcggugugcggcagcccgc

SEQ ID NO: 1193913 - RNA, 18 nt, Mycobacterium bovis subsp bovis AF2122/97
gcgguugccgucugcggu

SEQ ID NO: 1193914 - RNA, 20 nt, Mycobacterium bovis subsp bovis AF2122/97
gcgguuggcggcgaugguau

SEQ ID NO: 1193915 - RNA, 17 nt, Mycobacterium bovis subsp bovis AF2122/97
gcgguugacccacagca

SEQ ID NO: 1193916 - RNA, 13 nt, Mycobacterium bovis subsp bovis AF2122/97
gcgguuggugguu

SEQ ID NO: 1193917 - RNA, 16 nt, Mycobacterium bovis subsp bovis AF2122/97
gcgguuguccuccgac

SEQ ID NO: 1193918 - RNA, 18 nt, Mycobacterium bovis subsp bovis AF2122/97
gcggccugcucgggggcc

SEQ ID NO: 1193919 - RNA, 14 nt, Mycobacterium bovis subsp bovis AF2122/97
gcggccuggucggc

SEQ ID NO: 1193920 - RNA, 15 nt, Mycobacterium bovis subsp bovis AF2122/97
gcggccuucggccgg

SEQ ID NO: 1193921 - RNA, 23 nt, Mycobacterium bovis subsp bovis AF2122/97
gcggccuucggccggcguguucu

SEQ ID NO: 1193922 - RNA, 21 nt, Mycobacterium bovis subsp bovis AF2122/97
gcggccuugcgggcucucggc

SEQ ID NO: 1193923 - RNA, 17 nt, Mycobacterium bovis subsp bovis AF2122/97
gcggccuugcucagcac

SEQ ID NO: 1193924 - RNA, 16 nt, Mycobacterium bovis subsp bovis AF2122/97
gcggccuugccgggcc

SEQ ID NO: 1193925 - RNA, 15 nt, Mycobacterium bovis subsp bovis AF2122/97
gcggcgaaccagcgc

SEQ ID NO: 1193926 - RNA, 22 nt, Mycobacterium bovis subsp bovis AF2122/97
gcggcgaacucuacgguggugc

SEQ ID NO: 1193927 - RNA, 21 nt, Mycobacterium bovis subsp bovis AF2122/97
gcggcgaacucuacgguggug

SEQ ID NO: 1193928 - RNA, 15 nt, Mycobacterium bovis subsp bovis AF2122/97
gcggccugcucgacc

SEQ ID NO: 1193929 - RNA, 13 nt, Mycobacterium bovis subsp bovis AF2122/97
gcggccuuggcga

SEQ ID NO: 1193930 - RNA, 15 nt, Mycobacterium bovis subsp bovis AF2122/97
gcggccuuggcggcc

SEQ ID NO: 1193931 - RNA, 14 nt, Mycobacterium bovis subsp bovis AF2122/97
gcggcgacuaccca

SEQ ID NO: 1193932 - RNA, 21 nt, Mycobacterium bovis subsp bovis AF2122/97
gcggcgacggcggagucgcgc

SEQ ID NO: 1193933 - RNA, 15 nt, Mycobacterium bovis subsp bovis AF2122/97
gcggcgacggcggca

SEQ ID NO: 1193934 - RNA, 16 nt, Mycobacterium bovis subsp bovis AF2122/97
gcggcgacgccgcugg

SEQ ID NO: 1193935 - RNA, 17 nt, Mycobacterium bovis subsp bovis AF2122/97
gcggcgaccgcauccgg

SEQ ID NO: 1193936 - RNA, 19 nt, Mycobacterium bovis subsp bovis AF2122/97
gcggcgaccucggcggcgg

SEQ ID NO: 1193937 - RNA, 16 nt, Mycobacterium bovis subsp bovis AF2122/97
gcggcgagggcgguca

SEQ ID NO: 1193938 - RNA, 13 nt, Mycobacterium bovis subsp bovis AF2122/97
gcggcgagcgcga

SEQ ID NO: 1193939 - RNA, 15 nt, Mycobacterium bovis subsp bovis AF2122/97
gcggcgagcagagaa

SEQ ID NO: 1193940 - RNA, 15 nt, Mycobacterium bovis subsp bovis AF2122/97
gcggcgagcagcagg

SEQ ID NO: 1193941 - RNA, 14 nt, Mycobacterium bovis subsp bovis AF2122/97
gcggcgacauccac

SEQ ID NO: 1193942 - RNA, 16 nt, Mycobacterium bovis subsp bovis AF2122/97
gcggcgaagccgggug

SEQ ID NO: 1193943 - RNA, 17 nt, Mycobacterium bovis subsp bovis AF2122/97
gcggcgaagaagccggc

SEQ ID NO: 1193944 - RNA, 19 nt, Mycobacterium bovis subsp bovis AF2122/97
gcggcgaagauaucggcac

SEQ ID NO: 1193945 - RNA, 14 nt, Mycobacterium bovis subsp bovis AF2122/97
gcggcgcgggugcg

SEQ ID NO: 1193946 - RNA, 20 nt, Mycobacterium bovis subsp bovis AF2122/97
gcggcgcggucgaagcuggc

SEQ ID NO: 1193947 - RNA, 17 nt, Mycobacterium bovis subsp bovis AF2122/97
gcggcgcuggcugcggu

SEQ ID NO: 1193948 - RNA, 16 nt, Mycobacterium bovis subsp bovis AF2122/97
gcggcgcgcggggccu

SEQ ID NO: 1193949 - RNA, 13 nt, Mycobacterium bovis subsp bovis AF2122/97
gcggcgcgcagga

SEQ ID NO: 1193950 - RNA, 17 nt, Mycobacterium bovis subsp bovis AF2122/97
gcggcgcgcaacacauc

SEQ ID NO: 1193951 - RNA, 20 nt, Mycobacterium bovis subsp bovis AF2122/97
gcggcgaguuggccguggcg

SEQ ID NO: 1193952 - RNA, 19 nt, Mycobacterium bovis subsp bovis AF2122/97
gcggcgaucaggcggacgg

SEQ ID NO: 1193953 - RNA, 21 nt, Mycobacterium bovis subsp bovis AF2122/97
gcggcccucgaauucggccgg

SEQ ID NO: 1193954 - RNA, 20 nt, Mycobacterium bovis subsp bovis AF2122/97
gcggcccguuugccgguucg

SEQ ID NO: 1193955 - RNA, 16 nt, Mycobacterium bovis subsp bovis AF2122/97
gcggcccgguggacag

SEQ ID NO: 1193956 - RNA, 16 nt, Mycobacterium bovis subsp bovis AF2122/97
gcggcccuucaccagc

SEQ ID NO: 1193957 - RNA, 14 nt, Mycobacterium bovis subsp bovis AF2122/97
gcggccgacgggug

SEQ ID NO: 1193958 - RNA, 14 nt, Mycobacterium bovis subsp bovis AF2122/97
gcggccgcagccag

SEQ ID NO: 1193959 - RNA, 19 nt, Mycobacterium bovis subsp bovis AF2122/97
gcggccgcagcggccagcc

SEQ ID NO: 1193960 - RNA, 12 nt, Mycobacterium bovis subsp bovis AF2122/97
gcggccgccauc

SEQ ID NO: 1193961 - RNA, 20 nt, Mycobacterium bovis subsp bovis AF2122/97
gcggccgccaucagccgcug

SEQ ID NO: 1193962 - RNA, 17 nt, Mycobacterium bovis subsp bovis AF2122/97
gcggccgcagcggccag

SEQ ID NO: 1193963 - RNA, 13 nt, Mycobacterium bovis subsp bovis AF2122/97
gcggccgccgcgg

SEQ ID NO: 1193964 - RNA, 15 nt, Mycobacterium bovis subsp bovis AF2122/97
gcggccgccgcggcu

SEQ ID NO: 1193965 - RNA, 22 nt, Mycobacterium bovis subsp bovis AF2122/97
gcggccgcccggacccaaagca

SEQ ID NO: 1193966 - RNA, 16 nt, Mycobacterium bovis subsp bovis AF2122/97
gcggccgcgauggcgu

SEQ ID NO: 1193967 - RNA, 24 nt, Mycobacterium bovis subsp bovis AF2122/97
gcggccgcgaccagcgccgcaccc

SEQ ID NO: 1193968 - RNA, 14 nt, Mycobacterium bovis subsp bovis AF2122/97
gcggccgccuaccc

SEQ ID NO: 1193969 - RNA, 19 nt, Mycobacterium bovis subsp bovis AF2122/97
gcggccgccuacccguucu

SEQ ID NO: 1193970 - RNA, 15 nt, Mycobacterium bovis subsp bovis AF2122/97
gcggccgcgcgcauc

SEQ ID NO: 1193971 - RNA, 22 nt, Mycobacterium bovis subsp bovis AF2122/97
gcggccgcgcgcaucgcgccuu

SEQ ID NO: 1193972 - RNA, 23 nt, Mycobacterium bovis subsp bovis AF2122/97
gcggccgcucacauacagcaggc

SEQ ID NO: 1193973 - RNA, 12 nt, Mycobacterium bovis subsp bovis AF2122/97
gcggccgcuggg

SEQ ID NO: 1193974 - RNA, 14 nt, Mycobacterium bovis subsp bovis AF2122/97
gcggccgcggcagc

SEQ ID NO: 1193975 - RNA, 12 nt, Mycobacterium bovis subsp bovis AF2122/97
gcggccgcggcc

SEQ ID NO: 1193976 - RNA, 20 nt, Mycobacterium bovis subsp bovis AF2122/97
gcggccgcgcugcagcacgg

SEQ ID NO: 1193977 - RNA, 13 nt, Mycobacterium bovis subsp bovis AF2122/97
gcggccgcugggc

SEQ ID NO: 1193978 - RNA, 14 nt, Mycobacterium bovis subsp bovis AF2122/97
gcggccggcggccg

SEQ ID NO: 1193979 - RNA, 15 nt, Mycobacterium bovis subsp bovis AF2122/97
gcggccggcggccgc

SEQ ID NO: 1193980 - RNA, 18 nt, Mycobacterium bovis subsp bovis AF2122/97
gcggccggcgcucgcggc

SEQ ID NO: 1193981 - RNA, 17 nt, Mycobacterium bovis subsp bovis AF2122/97
gcggccgggcggccagg

SEQ ID NO: 1193982 - RNA, 20 nt, Mycobacterium bovis subsp bovis AF2122/97
gcggccgguacacguccagu

SEQ ID NO: 1193983 - RNA, 19 nt, Mycobacterium bovis subsp bovis AF2122/97
gcggccgucgauggucagc

SEQ ID NO: 1193984 - RNA, 19 nt, Mycobacterium bovis subsp bovis AF2122/97
gcggccgucaccggucggc

SEQ ID NO: 1193985 - RNA, 16 nt, Mycobacterium bovis subsp bovis AF2122/97
gcggccgucgcgggac

SEQ ID NO: 1193986 - RNA, 14 nt, Mycobacterium bovis subsp bovis AF2122/97
gcggccuccgggcc

SEQ ID NO: 1193987 - RNA, 15 nt, Mycobacterium bovis subsp bovis AF2122/97
gcggccucgccggcg

SEQ ID NO: 1193988 - RNA, 22 nt, Mycobacterium bovis subsp bovis AF2122/97
gcggccucgccggcgcgcagcc

SEQ ID NO: 1193989 - RNA, 16 nt, Mycobacterium bovis subsp bovis AF2122/97
gcggccucgcugcuca

SEQ ID NO: 1193990 - RNA, 13 nt, Mycobacterium bovis subsp bovis AF2122/97
gcggccguucgcc

SEQ ID NO: 1193991 - RNA, 18 nt, Mycobacterium bovis subsp bovis AF2122/97
gcggccgucgucggccag

SEQ ID NO: 1193992 - RNA, 16 nt, Mycobacterium bovis subsp bovis AF2122/97
gcggccgucgggacgg

SEQ ID NO: 1193993 - RNA, 17 nt, Mycobacterium bovis subsp bovis AF2122/97
gcggccguggcguggcu

SEQ ID NO: 1193994 - RNA, 15 nt, Mycobacterium bovis subsp bovis AF2122/97
gcggccgugucgggc

SEQ ID NO: 1193995 - RNA, 16 nt, Mycobacterium bovis subsp bovis AF2122/97
gcggccgugucgggcg

SEQ ID NO: 1193996 - RNA, 18 nt, Mycobacterium bovis subsp bovis AF2122/97
gcggccgugucgggcgcg

SEQ ID NO: 1193997 - RNA, 19 nt, Mycobacterium bovis subsp bovis AF2122/97
gcggccuagggcggcggcg

SEQ ID NO: 1193998 - RNA, 18 nt, Mycobacterium bovis subsp bovis AF2122/97
gcggccuccagcacccgg

SEQ ID NO: 1193999 - RNA, 22 nt, Mycobacterium bovis subsp bovis AF2122/97
gcggccuaacgaguaggcggcu

SEQ ID NO: 1194000 - RNA, 17 nt, Mycobacterium bovis subsp bovis AF2122/97
gcggccggcgugccagc

SEQ ID NO: 1194001 - RNA, 19 nt, Mycobacterium bovis subsp bovis AF2122/97
gcggccuaggacgccgccc

SEQ ID NO: 1194002 - RNA, 14 nt, Mycobacterium bovis subsp bovis AF2122/97
gcgcuguuguuguc

SEQ ID NO: 1194003 - RNA, 18 nt, Mycobacterium bovis subsp bovis AF2122/97
gcgcuguugcuggcgccc

SEQ ID NO: 1194004 - RNA, 22 nt, Mycobacterium bovis subsp bovis AF2122/97
gcgcuguugcuggcgcccccgc

SEQ ID NO: 1194005 - RNA, 18 nt, Mycobacterium bovis subsp bovis AF2122/97
gcgcuguagucgcgccuc

SEQ ID NO: 1194006 - RNA, 22 nt, Mycobacterium bovis subsp bovis AF2122/97
gcgcugguugaacauguccagu

SEQ ID NO: 1194007 - RNA, 20 nt, Mycobacterium bovis subsp bovis AF2122/97
gcgcuguacugccccagcac

SEQ ID NO: 1194008 - RNA, 22 nt, Mycobacterium bovis subsp bovis AF2122/97
gcgcugucguaccgcggaucgg

SEQ ID NO: 1194009 - RNA, 17 nt, Mycobacterium bovis subsp bovis AF2122/97
gcgcuggugcgccacgc

SEQ ID NO: 1194010 - RNA, 13 nt, Mycobacterium bovis subsp bovis AF2122/97
gcgcugguggcgg

SEQ ID NO: 1194011 - RNA, 21 nt, Mycobacterium bovis subsp bovis AF2122/97
gcgcuggucagccgugccgug

SEQ ID NO: 1194012 - RNA, 21 nt, Mycobacterium bovis subsp bovis AF2122/97
gcgcuggucgcgguggcggcg

SEQ ID NO: 1194013 - RNA, 16 nt, Mycobacterium bovis subsp bovis AF2122/97
gcgcuggucgcaaugg

SEQ ID NO: 1194014 - RNA, 17 nt, Mycobacterium bovis subsp bovis AF2122/97
gcggcaggguguuuaug

SEQ ID NO: 1194015 - RNA, 18 nt, Mycobacterium bovis subsp bovis AF2122/97
gcggcaggguguuuaugg

SEQ ID NO: 1194016 - RNA, 22 nt, Mycobacterium bovis subsp bovis AF2122/97
gcggcaggucgaugcugccagc

SEQ ID NO: 1194017 - RNA, 16 nt, Mycobacterium bovis subsp bovis AF2122/97
gcggcaggugcggcgg

SEQ ID NO: 1194018 - RNA, 16 nt, Mycobacterium bovis subsp bovis AF2122/97
gcggcauacauccagg

SEQ ID NO: 1194019 - RNA, 17 nt, Mycobacterium bovis subsp bovis AF2122/97
gcggcagcggcgccgcc

SEQ ID NO: 1194020 - RNA, 13 nt, Mycobacterium bovis subsp bovis AF2122/97
gcggcagcgcggc

SEQ ID NO: 1194021 - RNA, 14 nt, Mycobacterium bovis subsp bovis AF2122/97
gcggcagcggcggu

SEQ ID NO: 1194022 - RNA, 18 nt, Mycobacterium bovis subsp bovis AF2122/97
gcggcagcggugcuggug

SEQ ID NO: 1194023 - RNA, 15 nt, Mycobacterium bovis subsp bovis AF2122/97
gcggcaggccuggcg

SEQ ID NO: 1194024 - RNA, 22 nt, Mycobacterium bovis subsp bovis AF2122/97
gcggcagcuggcgcagccugcc

SEQ ID NO: 1194025 - RNA, 23 nt, Mycobacterium bovis subsp bovis AF2122/97
gcggcauucucgagcacccgcaa

SEQ ID NO: 1194026 - RNA, 14 nt, Mycobacterium bovis subsp bovis AF2122/97
gcggccagcucaug

SEQ ID NO: 1194027 - RNA, 23 nt, Mycobacterium bovis subsp bovis AF2122/97
gcggccaggaugccugccacccg

SEQ ID NO: 1194028 - RNA, 17 nt, Mycobacterium bovis subsp bovis AF2122/97
gcggccaggcgguacgg

SEQ ID NO: 1194029 - RNA, 14 nt, Mycobacterium bovis subsp bovis AF2122/97
gcggccaggcgcga

SEQ ID NO: 1194030 - RNA, 20 nt, Mycobacterium bovis subsp bovis AF2122/97
gcggccaucgggauggacac

SEQ ID NO: 1194031 - RNA, 14 nt, Mycobacterium bovis subsp bovis AF2122/97
gcggcccacaccag

SEQ ID NO: 1194032 - RNA, 21 nt, Mycobacterium bovis subsp bovis AF2122/97
gcggccauuagcagcacccgg

SEQ ID NO: 1194033 - RNA, 18 nt, Mycobacterium bovis subsp bovis AF2122/97
gcggccaugucagcggcc

SEQ ID NO: 1194034 - RNA, 15 nt, Mycobacterium bovis subsp bovis AF2122/97
gcggcccacaccagc

SEQ ID NO: 1194035 - RNA, 21 nt, Mycobacterium bovis subsp bovis AF2122/97
gcggcccacaccagcgcagca

SEQ ID NO: 1194036 - RNA, 23 nt, Mycobacterium bovis subsp bovis AF2122/97
gcggcccacucucgccacgccgu

SEQ ID NO: 1194037 - RNA, 19 nt, Mycobacterium bovis subsp bovis AF2122/97
gcggccccgacugccgcgg

SEQ ID NO: 1194038 - RNA, 23 nt, Mycobacterium bovis subsp bovis AF2122/97
gcggccccggcauugcccgagcc

SEQ ID NO: 1194039 - RNA, 13 nt, Mycobacterium bovis subsp bovis AF2122/97
gcggcccgcagcc

SEQ ID NO: 1194040 - RNA, 15 nt, Mycobacterium bovis subsp bovis AF2122/97
gcggcccgcagcccg

SEQ ID NO: 1194041 - RNA, 19 nt, Mycobacterium bovis subsp bovis AF2122/97
gcggcccgcagcccgccgg

SEQ ID NO: 1194042 - RNA, 17 nt, Mycobacterium bovis subsp bovis AF2122/97
gcggcccgcgaucgggc

SEQ ID NO: 1194043 - RNA, 23 nt, Mycobacterium bovis subsp bovis AF2122/97
gcggcccgccgaguucugcugga

SEQ ID NO: 1194044 - RNA, 13 nt, Mycobacterium bovis subsp bovis AF2122/97
gcggcccgcugug

SEQ ID NO: 1194045 - RNA, 20 nt, Mycobacterium bovis subsp bovis AF2122/97
gcggccaccagaucgcacac

SEQ ID NO: 1194046 - RNA, 18 nt, Mycobacterium bovis subsp bovis AF2122/97
gcggccaaucagcccgcc

SEQ ID NO: 1194047 - RNA, 20 nt, Mycobacterium bovis subsp bovis AF2122/97
gcggccaaucagcccgccgg

SEQ ID NO: 1194048 - RNA, 16 nt, Mycobacterium bovis subsp bovis AF2122/97
gcggccaauggugggc

SEQ ID NO: 1194049 - RNA, 13 nt, Mycobacterium bovis subsp bovis AF2122/97
gcggccaccaccg

SEQ ID NO: 1194050 - RNA, 16 nt, Mycobacterium bovis subsp bovis AF2122/97
gcggccagcagugcgg

SEQ ID NO: 1194051 - RNA, 18 nt, Mycobacterium bovis subsp bovis AF2122/97
gcggccagcaucgcggug

SEQ ID NO: 1194052 - RNA, 14 nt, Mycobacterium bovis subsp bovis AF2122/97
gcggccagagccgc

SEQ ID NO: 1194053 - RNA, 20 nt, Mycobacterium bovis subsp bovis AF2122/97
gcggccagagccgcgcgccg

SEQ ID NO: 1194054 - RNA, 19 nt, Mycobacterium bovis subsp bovis AF2122/97
gcggccacgguggcgcaag

SEQ ID NO: 1194055 - RNA, 15 nt, Mycobacterium bovis subsp bovis AF2122/97
gcggccacgccggcg

SEQ ID NO: 1194056 - RNA, 15 nt, Mycobacterium bovis subsp bovis AF2122/97
gcggccaccgccgcc

SEQ ID NO: 1194057 - RNA, 18 nt, Mycobacterium bovis subsp bovis AF2122/97
gcggcaucgcgggcggcg

SEQ ID NO: 1194058 - RNA, 14 nt, Mycobacterium bovis subsp bovis AF2122/97
gcggcaucggccag

SEQ ID NO: 1194059 - RNA, 14 nt, Mycobacterium bovis subsp bovis AF2122/97
gcggcaucggcggc

SEQ ID NO: 1194060 - RNA, 18 nt, Mycobacterium bovis subsp bovis AF2122/97
gcggcaucggcggcaagg

SEQ ID NO: 1194061 - RNA, 20 nt, Mycobacterium bovis subsp bovis AF2122/97
gcggcaucggcggcaagggu

SEQ ID NO: 1194062 - RNA, 18 nt, Mycobacterium bovis subsp bovis AF2122/97
gcggcaucucgcaccgcg

SEQ ID NO: 1194063 - RNA, 21 nt, Mycobacterium bovis subsp bovis AF2122/97
gcggcaugggcccugcacagc

SEQ ID NO: 1194064 - RNA, 18 nt, Mycobacterium bovis subsp bovis AF2122/97
gcggccaacagcacccgg

SEQ ID NO: 1194065 - RNA, 14 nt, Mycobacterium bovis subsp bovis AF2122/97
gcggcauugccagc

SEQ ID NO: 1194066 - RNA, 15 nt, Mycobacterium bovis subsp bovis AF2122/97
gcggcauucucgagc

SEQ ID NO: 1194067 - RNA, 22 nt, Mycobacterium bovis subsp bovis AF2122/97
gcggcauucucgagcacccgca

SEQ ID NO: 1194068 - RNA, 15 nt, Mycobacterium bovis subsp bovis AF2122/97
gcaagagccgcagcc

SEQ ID NO: 1194069 - RNA, 19 nt, Mycobacterium bovis subsp bovis AF2122/97
gcaagaccguuacaccauc

SEQ ID NO: 1194070 - RNA, 14 nt, Mycobacterium bovis subsp bovis AF2122/97
gcaagacgaugaca

SEQ ID NO: 1194071 - RNA, 16 nt, Mycobacterium bovis subsp bovis AF2122/97
gcaacugggcggccug

SEQ ID NO: 1194072 - RNA, 15 nt, Mycobacterium bovis subsp bovis AF2122/97
gcaacugggcggccu

SEQ ID NO: 1194073 - RNA, 15 nt, Mycobacterium bovis subsp bovis AF2122/97
gcaagaaucagcagc

SEQ ID NO: 1194074 - RNA, 21 nt, Mycobacterium bovis subsp bovis AF2122/97
gcaagcugagucgugacaacc

SEQ ID NO: 1194075 - RNA, 15 nt, Mycobacterium bovis subsp bovis AF2122/97
gcaagcguugggaca

SEQ ID NO: 1194076 - RNA, 21 nt, Mycobacterium bovis subsp bovis AF2122/97
gcaaggacguggcgcuggacc

SEQ ID NO: 1194077 - RNA, 21 nt, Mycobacterium bovis subsp bovis AF2122/97
gcaaggcauccaacgcggcgc

SEQ ID NO: 1194078 - RNA, 21 nt, Mycobacterium bovis subsp bovis AF2122/97
gcaacgugugcaccaucauca

SEQ ID NO: 1194079 - RNA, 20 nt, Mycobacterium bovis subsp bovis AF2122/97
gcaacggugaucagccaccg

SEQ ID NO: 1194080 - RNA, 22 nt, Mycobacterium bovis subsp bovis AF2122/97
gcaacguagccagcagcggcuc

SEQ ID NO: 1194081 - RNA, 16 nt, Mycobacterium bovis subsp bovis AF2122/97
gcaacuagccgcugcc

SEQ ID NO: 1194082 - RNA, 14 nt, Mycobacterium bovis subsp bovis AF2122/97
gcaacugggcggcc

SEQ ID NO: 1194083 - RNA, 22 nt, Mycobacterium bovis subsp bovis AF2122/97
gcaacucgccgaaaucggccag

SEQ ID NO: 1194084 - RNA, 22 nt, Mycobacterium bovis subsp bovis AF2122/97
gcaacucggccacggcgucggc

SEQ ID NO: 1194085 - RNA, 20 nt, Mycobacterium bovis subsp bovis AF2122/97
gcaaggcggaucuucucggu

SEQ ID NO: 1194086 - RNA, 19 nt, Mycobacterium bovis subsp bovis AF2122/97
gcaaguugagcagcuuggu

SEQ ID NO: 1194087 - RNA, 24 nt, Mycobacterium bovis subsp bovis AF2122/97
gcaauaagggagaccgcggccggc

SEQ ID NO: 1194088 - RNA, 22 nt, Mycobacterium bovis subsp bovis AF2122/97
gcaauacacguugccgaucccg

SEQ ID NO: 1194089 - RNA, 14 nt, Mycobacterium bovis subsp bovis AF2122/97
gcaauacccgccgc

SEQ ID NO: 1194090 - RNA, 16 nt, Mycobacterium bovis subsp bovis AF2122/97
gcaauacccgccgcga

SEQ ID NO: 1194091 - RNA, 18 nt, Mycobacterium bovis subsp bovis AF2122/97
gcaauacccgagcguccg

SEQ ID NO: 1194092 - RNA, 20 nt, Mycobacterium bovis subsp bovis AF2122/97
gcaauacggcggcgccgccc

SEQ ID NO: 1194093 - RNA, 22 nt, Mycobacterium bovis subsp bovis AF2122/97
gcaaucaugucagcgcugagcc

SEQ ID NO: 1194094 - RNA, 19 nt, Mycobacterium bovis subsp bovis AF2122/97
gcaauccugcgggacuggc

SEQ ID NO: 1194095 - RNA, 19 nt, Mycobacterium bovis subsp bovis AF2122/97
gcaaccgaugacgcguuca

SEQ ID NO: 1194096 - RNA, 19 nt, Mycobacterium bovis subsp bovis AF2122/97
gcaaccgacucgacaaggc

SEQ ID NO: 1194097 - RNA, 17 nt, Mycobacterium bovis subsp bovis AF2122/97
gcaacccugcggugcag

SEQ ID NO: 1194098 - RNA, 15 nt, Mycobacterium bovis subsp bovis AF2122/97
gcaaccgccgccauu

SEQ ID NO: 1194099 - RNA, 18 nt, Mycobacterium bovis subsp bovis AF2122/97
gcaaccggagaucccggu

SEQ ID NO: 1194100 - RNA, 17 nt, Mycobacterium bovis subsp bovis AF2122/97
gcaaccgggaucugcuc

SEQ ID NO: 1194101 - RNA, 16 nt, Mycobacterium bovis subsp bovis AF2122/97
gcaacgaagagggcgc

SEQ ID NO: 1194102 - RNA, 22 nt, Mycobacterium bovis subsp bovis AF2122/97
gcaacgaagagggcgccgcgcg

SEQ ID NO: 1194103 - RNA, 20 nt, Mycobacterium bovis subsp bovis AF2122/97
gcaaccgucccaaugcaaca

SEQ ID NO: 1194104 - RNA, 15 nt, Mycobacterium bovis subsp bovis AF2122/97
gcaaccggcgugucg

SEQ ID NO: 1194105 - RNA, 16 nt, Mycobacterium bovis subsp bovis AF2122/97
gcaaccugaauccaga

SEQ ID NO: 1194106 - RNA, 15 nt, Mycobacterium bovis subsp bovis AF2122/97
gcaaccugccgggcc

SEQ ID NO: 1194107 - RNA, 21 nt, Mycobacterium bovis subsp bovis AF2122/97
gcaaccugccgggccacggcu

SEQ ID NO: 1194108 - RNA, 22 nt, Mycobacterium bovis subsp bovis AF2122/97
gcaaccuggacugcagcgccuc

SEQ ID NO: 1194109 - RNA, 22 nt, Mycobacterium bovis subsp bovis AF2122/97
gcaacgcggccuugcgcacagg

SEQ ID NO: 1194110 - RNA, 16 nt, Mycobacterium bovis subsp bovis AF2122/97
gcaacgccgcggacca

SEQ ID NO: 1194111 - RNA, 16 nt, Mycobacterium bovis subsp bovis AF2122/97
gcaacgacauccagau

SEQ ID NO: 1194112 - RNA, 23 nt, Mycobacterium bovis subsp bovis AF2122/97
gcaacgaucagguuggcggcugc

SEQ ID NO: 1194113 - RNA, 22 nt, Mycobacterium bovis subsp bovis AF2122/97
gcaacggcggggccggcggcuc

SEQ ID NO: 1194114 - RNA, 18 nt, Mycobacterium bovis subsp bovis AF2122/97
gcaacggccagcgcugcu

SEQ ID NO: 1194115 - RNA, 13 nt, Mycobacterium bovis subsp bovis AF2122/97
gcaacggcggggc

SEQ ID NO: 1194116 - RNA, 15 nt, Mycobacterium bovis subsp bovis AF2122/97
gcaacggcggggccg

SEQ ID NO: 1194117 - RNA, 22 nt, Mycobacterium bovis subsp bovis AF2122/97
gcaacgggucgguccacuucag

SEQ ID NO: 1194118 - RNA, 12 nt, Mycobacterium bovis subsp bovis AF2122/97
gcaacggcggca

SEQ ID NO: 1194119 - RNA, 23 nt, Mycobacterium bovis subsp bovis AF2122/97
gcaacggcguuuucaauuucacu

SEQ ID NO: 1194120 - RNA, 16 nt, Mycobacterium bovis subsp bovis AF2122/97
gcaacgcggucugcuc

SEQ ID NO: 1194121 - RNA, 17 nt, Mycobacterium bovis subsp bovis AF2122/97
gcaacgcggucugcucc

SEQ ID NO: 1194122 - RNA, 19 nt, Mycobacterium bovis subsp bovis AF2122/97
gcaacgcggcgaagugcac

SEQ ID NO: 1194123 - RNA, 13 nt, Mycobacterium bovis subsp bovis AF2122/97
gcaacgcugcggc

SEQ ID NO: 1194124 - RNA, 16 nt, Mycobacterium bovis subsp bovis AF2122/97
gcaacgcuggaggcga

SEQ ID NO: 1194125 - RNA, 15 nt, Mycobacterium bovis subsp bovis AF2122/97
gcaacggcagcgagg

SEQ ID NO: 1194126 - RNA, 12 nt, Mycobacterium bovis subsp bovis AF2122/97
gcaacagcacca

SEQ ID NO: 1194127 - RNA, 20 nt, Mycobacterium bovis subsp bovis AF2122/97
gcaacaccggugucggccag

SEQ ID NO: 1194128 - RNA, 23 nt, Mycobacterium bovis subsp bovis AF2122/97
gcaacaccggugucggccagcaa

SEQ ID NO: 1194129 - RNA, 19 nt, Mycobacterium bovis subsp bovis AF2122/97
gcaacacgccggcccggug

SEQ ID NO: 1194130 - RNA, 18 nt, Mycobacterium bovis subsp bovis AF2122/97
gcaacacccgggcgaccu

SEQ ID NO: 1194131 - RNA, 12 nt, Mycobacterium bovis subsp bovis AF2122/97
gcaacaccaccu

SEQ ID NO: 1194132 - RNA, 20 nt, Mycobacterium bovis subsp bovis AF2122/97
gcaacaccagggccuccacc

SEQ ID NO: 1194133 - RNA, 22 nt, Mycobacterium bovis subsp bovis AF2122/97
gcaacacauuucuuugggcggc

SEQ ID NO: 1194134 - RNA, 22 nt, Mycobacterium bovis subsp bovis AF2122/97
gcaacacaccgcggaaggccag

SEQ ID NO: 1194135 - RNA, 23 nt, Mycobacterium bovis subsp bovis AF2122/97
gcaacacaccgcggaaggccagc

SEQ ID NO: 1194136 - RNA, 15 nt, Mycobacterium bovis subsp bovis AF2122/97
gcaacaacgccgcga

SEQ ID NO: 1194137 - RNA, 21 nt, Mycobacterium bovis subsp bovis AF2122/97
gcaacaacgucugcagccucg

SEQ ID NO: 1194138 - RNA, 19 nt, Mycobacterium bovis subsp bovis AF2122/97
gcaacaacgucugcagccu

SEQ ID NO: 1194139 - RNA, 22 nt, Mycobacterium bovis subsp bovis AF2122/97
gcaacaucggguucuucaacuc

SEQ ID NO: 1194140 - RNA, 15 nt, Mycobacterium bovis subsp bovis AF2122/97
gcaacaucagcagga

SEQ ID NO: 1194141 - RNA, 16 nt, Mycobacterium bovis subsp bovis AF2122/97
gcaacaucagcaggac

SEQ ID NO: 1194142 - RNA, 16 nt, Mycobacterium bovis subsp bovis AF2122/97
gcaacaggcccacggc

SEQ ID NO: 1194143 - RNA, 17 nt, Mycobacterium bovis subsp bovis AF2122/97
gcaacauuuucgcccgc

SEQ ID NO: 1194144 - RNA, 16 nt, Mycobacterium bovis subsp bovis AF2122/97
gcaacaugucaccugc

SEQ ID NO: 1194145 - RNA, 23 nt, Mycobacterium bovis subsp bovis AF2122/97
gcaaccaaagcgacgagcagcaa

SEQ ID NO: 1194146 - RNA, 12 nt, Mycobacterium bovis subsp bovis AF2122/97
gcaaccagcagc

SEQ ID NO: 1194147 - RNA, 17 nt, Mycobacterium bovis subsp bovis AF2122/97
gcaaccaccggccgcgc

SEQ ID NO: 1194148 - RNA, 19 nt, Mycobacterium bovis subsp bovis AF2122/97
gcaaccaccucgugggcca

SEQ ID NO: 1194149 - RNA, 19 nt, Mycobacterium bovis subsp bovis AF2122/97
gcaaccagcgagcccagcu

SEQ ID NO: 1194150 - RNA, 16 nt, Mycobacterium bovis subsp bovis AF2122/97
gcaaccagcagcaggu

SEQ ID NO: 1194151 - RNA, 18 nt, Mycobacterium bovis subsp bovis AF2122/97
gcacgcaugagggcaucg

SEQ ID NO: 1194152 - RNA, 12 nt, Mycobacterium bovis subsp bovis AF2122/97
gcacgcaugccg

SEQ ID NO: 1194153 - RNA, 16 nt, Mycobacterium bovis subsp bovis AF2122/97
gcacgccggcggcgga

SEQ ID NO: 1194154 - RNA, 12 nt, Mycobacterium bovis subsp bovis AF2122/97
gcacgccgggca

SEQ ID NO: 1194155 - RNA, 13 nt, Mycobacterium bovis subsp bovis AF2122/97
gcacgccggcgcu

SEQ ID NO: 1194156 - RNA, 17 nt, Mycobacterium bovis subsp bovis AF2122/97
gcacgccggcgcuggag

SEQ ID NO: 1194157 - RNA, 19 nt, Mycobacterium bovis subsp bovis AF2122/97
gcacgcaguucggucagcg

SEQ ID NO: 1194158 - RNA, 22 nt, Mycobacterium bovis subsp bovis AF2122/97
gcacgccguagcaucgggcgag

SEQ ID NO: 1194159 - RNA, 20 nt, Mycobacterium bovis subsp bovis AF2122/97
gcacgccuugagccgaggcg

SEQ ID NO: 1194160 - RNA, 13 nt, Mycobacterium bovis subsp bovis AF2122/97
gcacgaucgcggu

SEQ ID NO: 1194161 - RNA, 21 nt, Mycobacterium bovis subsp bovis AF2122/97
gcacgaucgcccgugagcgcc

SEQ ID NO: 1194162 - RNA, 23 nt, Mycobacterium bovis subsp bovis AF2122/97
gcacgacaucgucgcgacgacgu

SEQ ID NO: 1194163 - RNA, 14 nt, Mycobacterium bovis subsp bovis AF2122/97
gcacgaucgcccgu

SEQ ID NO: 1194164 - RNA, 18 nt, Mycobacterium bovis subsp bovis AF2122/97
gcacgacaccucgaaggc

SEQ ID NO: 1194165 - RNA, 18 nt, Mycobacterium bovis subsp bovis AF2122/97
gcacgaagcuggcgugca

SEQ ID NO: 1194166 - RNA, 20 nt, Mycobacterium bovis subsp bovis AF2122/97
gcacgaaucccccggacggc

SEQ ID NO: 1194167 - RNA, 18 nt, Mycobacterium bovis subsp bovis AF2122/97
gcacgaacgccugcucgu

SEQ ID NO: 1194168 - RNA, 21 nt, Mycobacterium bovis subsp bovis AF2122/97
gcaccuggucggccgcaaggc

SEQ ID NO: 1194169 - RNA, 16 nt, Mycobacterium bovis subsp bovis AF2122/97
gcacgaaaucagcccg

SEQ ID NO: 1194170 - RNA, 23 nt, Mycobacterium bovis subsp bovis AF2122/97
gcaccguuguaugcugcgcgccg

SEQ ID NO: 1194171 - RNA, 19 nt, Mycobacterium bovis subsp bovis AF2122/97
gcaccgugcggggggcagc

SEQ ID NO: 1194172 - RNA, 18 nt, Mycobacterium bovis subsp bovis AF2122/97
gcaccgugugggccccgc

SEQ ID NO: 1194173 - RNA, 22 nt, Mycobacterium bovis subsp bovis AF2122/97
gcaccgugugggccccgccgau

SEQ ID NO: 1194174 - RNA, 19 nt, Mycobacterium bovis subsp bovis AF2122/97
gcaccguuaccgccgucgc

SEQ ID NO: 1194175 - RNA, 15 nt, Mycobacterium bovis subsp bovis AF2122/97
gcaccggccgaaggc

SEQ ID NO: 1194176 - RNA, 17 nt, Mycobacterium bovis subsp bovis AF2122/97
gcaccggauacagccac

SEQ ID NO: 1194177 - RNA, 19 nt, Mycobacterium bovis subsp bovis AF2122/97
gcaccggcacccgcacggc

SEQ ID NO: 1194178 - RNA, 14 nt, Mycobacterium bovis subsp bovis AF2122/97
gcaccggaucgccg

SEQ ID NO: 1194179 - RNA, 14 nt, Mycobacterium bovis subsp bovis AF2122/97
gcaccuggccgccc

SEQ ID NO: 1194180 - RNA, 22 nt, Mycobacterium bovis subsp bovis AF2122/97
gcaccuggccgcccgcuccaac

SEQ ID NO: 1194181 - RNA, 12 nt, Mycobacterium bovis subsp bovis AF2122/97
gcaccugggcgc

SEQ ID NO: 1194182 - RNA, 20 nt, Mycobacterium bovis subsp bovis AF2122/97
gcaccugggcugccggccag

SEQ ID NO: 1194183 - RNA, 20 nt, Mycobacterium bovis subsp bovis AF2122/97
gcaccuggucggccgcaagg

SEQ ID NO: 1194184 - RNA, 15 nt, Mycobacterium bovis subsp bovis AF2122/97
gcaccugggcgcgcu

SEQ ID NO: 1194185 - RNA, 17 nt, Mycobacterium bovis subsp bovis AF2122/97
gcaccuauggucaaccg

SEQ ID NO: 1194186 - RNA, 21 nt, Mycobacterium bovis subsp bovis AF2122/97
gcaccuccaccgcgccggcgg

SEQ ID NO: 1194187 - RNA, 18 nt, Mycobacterium bovis subsp bovis AF2122/97
gcaccugcgcgcggccgc

SEQ ID NO: 1194188 - RNA, 17 nt, Mycobacterium bovis subsp bovis AF2122/97
gcaccgcugccgcugcc

SEQ ID NO: 1194189 - RNA, 20 nt, Mycobacterium bovis subsp bovis AF2122/97
gcaccgcuguugcaucgccg

SEQ ID NO: 1194190 - RNA, 23 nt, Mycobacterium bovis subsp bovis AF2122/97
gcaccgcggccagcgggaacaca

SEQ ID NO: 1194191 - RNA, 18 nt, Mycobacterium bovis subsp bovis AF2122/97
gcaccgcucgguccagcc

SEQ ID NO: 1194192 - RNA, 17 nt, Mycobacterium bovis subsp bovis AF2122/97
gcaccgcugaccgcaac

SEQ ID NO: 1194193 - RNA, 23 nt, Mycobacterium bovis subsp bovis AF2122/97
gcaccgcgggaucgguggcggca

SEQ ID NO: 1194194 - RNA, 23 nt, Mycobacterium bovis subsp bovis AF2122/97
gcaccgcggauaggccgcgcggc

SEQ ID NO: 1194195 - RNA, 16 nt, Mycobacterium bovis subsp bovis AF2122/97
gcaccgccugcgccgc

SEQ ID NO: 1194196 - RNA, 18 nt, Mycobacterium bovis subsp bovis AF2122/97
gcaccgagaaagugcagu

SEQ ID NO: 1194197 - RNA, 20 nt, Mycobacterium bovis subsp bovis AF2122/97
gcaccgaccgcaccgugccg

SEQ ID NO: 1194198 - RNA, 21 nt, Mycobacterium bovis subsp bovis AF2122/97
gcaccgccgguggcgccgggg

SEQ ID NO: 1194199 - RNA, 20 nt, Mycobacterium bovis subsp bovis AF2122/97
gcaccgaccagggccgccgc

SEQ ID NO: 1194200 - RNA, 13 nt, Mycobacterium bovis subsp bovis AF2122/97
gcaccgaagugca

SEQ ID NO: 1194201 - RNA, 24 nt, Mycobacterium bovis subsp bovis AF2122/97
gcaccgaauuacgcaccgaggccg

SEQ ID NO: 1194202 - RNA, 19 nt, Mycobacterium bovis subsp bovis AF2122/97
gcaccgaaacgccgaccuu

SEQ ID NO: 1194203 - RNA, 19 nt, Mycobacterium bovis subsp bovis AF2122/97
gcaccgaagauggccagcg

SEQ ID NO: 1194204 - RNA, 17 nt, Mycobacterium bovis subsp bovis AF2122/97
gcaccgaaaaacaccag

SEQ ID NO: 1194205 - RNA, 19 nt, Mycobacterium bovis subsp bovis AF2122/97
gcaccgaaaaacaccagcg

SEQ ID NO: 1194206 - RNA, 12 nt, Mycobacterium bovis subsp bovis AF2122/97
gcaccccgcggu

SEQ ID NO: 1194207 - RNA, 15 nt, Mycobacterium bovis subsp bovis AF2122/97
gcaccccggccgcgc

SEQ ID NO: 1194208 - RNA, 17 nt, Mycobacterium bovis subsp bovis AF2122/97
gcacccccgucgccacc

SEQ ID NO: 1194209 - RNA, 16 nt, Mycobacterium bovis subsp bovis AF2122/97
gcaccccgaucuggcg

SEQ ID NO: 1194210 - RNA, 16 nt, Mycobacterium bovis subsp bovis AF2122/97
gcaccccggcggcguc

SEQ ID NO: 1194211 - RNA, 22 nt, Mycobacterium bovis subsp bovis AF2122/97
gcacccgacucgucggccuggu

SEQ ID NO: 1194212 - RNA, 16 nt, Mycobacterium bovis subsp bovis AF2122/97
gcacccgagccgcaca

SEQ ID NO: 1194213 - RNA, 23 nt, Mycobacterium bovis subsp bovis AF2122/97
gcacccgaauuugucggcgaagc

SEQ ID NO: 1194214 - RNA, 17 nt, Mycobacterium bovis subsp bovis AF2122/97
gcaccccgccgggggca

SEQ ID NO: 1194215 - RNA, 23 nt, Mycobacterium bovis subsp bovis AF2122/97
gcacccgcgggucguccggcggc

SEQ ID NO: 1194216 - RNA, 23 nt, Mycobacterium bovis subsp bovis AF2122/97
gcacccgcgucgagugccgccac

SEQ ID NO: 1194217 - RNA, 17 nt, Mycobacterium bovis subsp bovis AF2122/97
gcacccgcucggcgcgc

SEQ ID NO: 1194218 - RNA, 14 nt, Mycobacterium bovis subsp bovis AF2122/97
gcacccgcagccgc

SEQ ID NO: 1194219 - RNA, 13 nt, Mycobacterium bovis subsp bovis AF2122/97
gcacccgcacggu

SEQ ID NO: 1194220 - RNA, 21 nt, Mycobacterium bovis subsp bovis AF2122/97
gcacccgaguuauagaagccg

SEQ ID NO: 1194221 - RNA, 22 nt, Mycobacterium bovis subsp bovis AF2122/97
gcacccgaguuauagaagccga

SEQ ID NO: 1194222 - RNA, 21 nt, Mycobacterium bovis subsp bovis AF2122/97
gcacccgauaguucuggcccg

SEQ ID NO: 1194223 - RNA, 20 nt, Mycobacterium bovis subsp bovis AF2122/97
gcaccccgaccaccagagcg

SEQ ID NO: 1194224 - RNA, 16 nt, Mycobacterium bovis subsp bovis AF2122/97
gcacccccgucgccac

SEQ ID NO: 1194225 - RNA, 20 nt, Mycobacterium bovis subsp bovis AF2122/97
gcaccccauacucggcggcu

SEQ ID NO: 1194226 - RNA, 21 nt, Mycobacterium bovis subsp bovis AF2122/97
gcacccacccguucggcugcg

SEQ ID NO: 1194227 - RNA, 18 nt, Mycobacterium bovis subsp bovis AF2122/97
gcacccagucggcgccgc

SEQ ID NO: 1194228 - RNA, 14 nt, Mycobacterium bovis subsp bovis AF2122/97
gcacccauacggca

SEQ ID NO: 1194229 - RNA, 14 nt, Mycobacterium bovis subsp bovis AF2122/97
gcacccaaugccac

SEQ ID NO: 1194230 - RNA, 15 nt, Mycobacterium bovis subsp bovis AF2122/97
gcacccaacuccauc

SEQ ID NO: 1194231 - RNA, 17 nt, Mycobacterium bovis subsp bovis AF2122/97
gcacccaaugccaccgc

SEQ ID NO: 1194232 - RNA, 21 nt, Mycobacterium bovis subsp bovis AF2122/97
gcacccaaugccaccgcggcc

SEQ ID NO: 1194233 - RNA, 23 nt, Mycobacterium bovis subsp bovis AF2122/97
gcacccaaugccaccgcggccgc

SEQ ID NO: 1194234 - RNA, 24 nt, Mycobacterium bovis subsp bovis AF2122/97
gcacccacgccgguggcacggccc

SEQ ID NO: 1194235 - RNA, 15 nt, Mycobacterium bovis subsp bovis AF2122/97
gcacccaccacacca

SEQ ID NO: 1194236 - RNA, 23 nt, Mycobacterium bovis subsp bovis AF2122/97
gcacccacaucagccgcaccagu

SEQ ID NO: 1194237 - RNA, 19 nt, Mycobacterium bovis subsp bovis AF2122/97
gcacccagacgauggccag

SEQ ID NO: 1194238 - RNA, 15 nt, Mycobacterium bovis subsp bovis AF2122/97
gcaaugacccgcggg

SEQ ID NO: 1194239 - RNA, 12 nt, Mycobacterium bovis subsp bovis AF2122/97
gcaaugaccugg

SEQ ID NO: 1194240 - RNA, 14 nt, Mycobacterium bovis subsp bovis AF2122/97
gcacaaacccaguu

SEQ ID NO: 1194241 - RNA, 23 nt, Mycobacterium bovis subsp bovis AF2122/97
gcacaaacgggcgugggccgcug

SEQ ID NO: 1194242 - RNA, 23 nt, Mycobacterium bovis subsp bovis AF2122/97
gcaaugccgacucaggucggugc

SEQ ID NO: 1194243 - RNA, 23 nt, Mycobacterium bovis subsp bovis AF2122/97
gcacaccggcacugcccagcaga

SEQ ID NO: 1194244 - RNA, 17 nt, Mycobacterium bovis subsp bovis AF2122/97
gcacaacgcgacgccgc

SEQ ID NO: 1194245 - RNA, 14 nt, Mycobacterium bovis subsp bovis AF2122/97
gcacacccgcaccg

SEQ ID NO: 1194246 - RNA, 18 nt, Mycobacterium bovis subsp bovis AF2122/97
gcacacccccgucugcgu

SEQ ID NO: 1194247 - RNA, 15 nt, Mycobacterium bovis subsp bovis AF2122/97
gcacacccaucaccg

SEQ ID NO: 1194248 - RNA, 19 nt, Mycobacterium bovis subsp bovis AF2122/97
gcacacccaucaccgccag

SEQ ID NO: 1194249 - RNA, 15 nt, Mycobacterium bovis subsp bovis AF2122/97
gcacaggcggccagc

SEQ ID NO: 1194250 - RNA, 15 nt, Mycobacterium bovis subsp bovis AF2122/97
gcacaggcgacggcc

SEQ ID NO: 1194251 - RNA, 23 nt, Mycobacterium bovis subsp bovis AF2122/97
gcacaggcaucguccgccgggcu

SEQ ID NO: 1194252 - RNA, 14 nt, Mycobacterium bovis subsp bovis AF2122/97
gcacaggauuuucu

SEQ ID NO: 1194253 - RNA, 22 nt, Mycobacterium bovis subsp bovis AF2122/97
gcacaggucagcgcugccaccg

SEQ ID NO: 1194254 - RNA, 18 nt, Mycobacterium bovis subsp bovis AF2122/97
gcacagcagcgguugaug

SEQ ID NO: 1194255 - RNA, 17 nt, Mycobacterium bovis subsp bovis AF2122/97
gcacagccauggugggc

SEQ ID NO: 1194256 - RNA, 14 nt, Mycobacterium bovis subsp bovis AF2122/97
gcacaccgguggac

SEQ ID NO: 1194257 - RNA, 15 nt, Mycobacterium bovis subsp bovis AF2122/97
gcacaccgggcacca

SEQ ID NO: 1194258 - RNA, 12 nt, Mycobacterium bovis subsp bovis AF2122/97
gcacagcaacaa

SEQ ID NO: 1194259 - RNA, 12 nt, Mycobacterium bovis subsp bovis AF2122/97
gcacagcaccac

SEQ ID NO: 1194260 - RNA, 16 nt, Mycobacterium bovis subsp bovis AF2122/97
gcacaccugcgcggcg

SEQ ID NO: 1194261 - RNA, 20 nt, Mycobacterium bovis subsp bovis AF2122/97
gcaccagcgaauccagccgc

SEQ ID NO: 1194262 - RNA, 23 nt, Mycobacterium bovis subsp bovis AF2122/97
gcaccaguuugugccgccgcggc

SEQ ID NO: 1194263 - RNA, 16 nt, Mycobacterium bovis subsp bovis AF2122/97
gcaccagcgaccaggu

SEQ ID NO: 1194264 - RNA, 17 nt, Mycobacterium bovis subsp bovis AF2122/97
gcaccagcgaauccagc

SEQ ID NO: 1194265 - RNA, 19 nt, Mycobacterium bovis subsp bovis AF2122/97
gcaccagccagccugcugg

SEQ ID NO: 1194266 - RNA, 15 nt, Mycobacterium bovis subsp bovis AF2122/97
gcaccaggggcgcgu

SEQ ID NO: 1194267 - RNA, 20 nt, Mycobacterium bovis subsp bovis AF2122/97
gcaccagguugcaaccuugg

SEQ ID NO: 1194268 - RNA, 18 nt, Mycobacterium bovis subsp bovis AF2122/97
gcaccagggcgcaacgga

SEQ ID NO: 1194269 - RNA, 23 nt, Mycobacterium bovis subsp bovis AF2122/97
gcaccagcgccuugaccagcagc

SEQ ID NO: 1194270 - RNA, 22 nt, Mycobacterium bovis subsp bovis AF2122/97
gcaccaucgguaucgagggcag

SEQ ID NO: 1194271 - RNA, 23 nt, Mycobacterium bovis subsp bovis AF2122/97
gcaccaucgguaucgagggcagc

SEQ ID NO: 1194272 - RNA, 14 nt, Mycobacterium bovis subsp bovis AF2122/97
gcaccaucgcggcc

SEQ ID NO: 1194273 - RNA, 14 nt, Mycobacterium bovis subsp bovis AF2122/97
gcaccauacucacc

SEQ ID NO: 1194274 - RNA, 16 nt, Mycobacterium bovis subsp bovis AF2122/97
gcaccauguacaggcu

SEQ ID NO: 1194275 - RNA, 12 nt, Mycobacterium bovis subsp bovis AF2122/97
gcacccaaccag

SEQ ID NO: 1194276 - RNA, 17 nt, Mycobacterium bovis subsp bovis AF2122/97
gcacccaacccggcggc

SEQ ID NO: 1194277 - RNA, 14 nt, Mycobacterium bovis subsp bovis AF2122/97
gcaccaccacaccg

SEQ ID NO: 1194278 - RNA, 22 nt, Mycobacterium bovis subsp bovis AF2122/97
gcaccacagugaaauccgagcc

SEQ ID NO: 1194279 - RNA, 23 nt, Mycobacterium bovis subsp bovis AF2122/97
gcaccaccaagguguggccuugc

SEQ ID NO: 1194280 - RNA, 22 nt, Mycobacterium bovis subsp bovis AF2122/97
gcaccacaccacgguggccgcu

SEQ ID NO: 1194281 - RNA, 14 nt, Mycobacterium bovis subsp bovis AF2122/97
gcaccacaccacgg

SEQ ID NO: 1194282 - RNA, 15 nt, Mycobacterium bovis subsp bovis AF2122/97
gcaccagcagcacca

SEQ ID NO: 1194283 - RNA, 14 nt, Mycobacterium bovis subsp bovis AF2122/97
gcaccaccagcagc

SEQ ID NO: 1194284 - RNA, 19 nt, Mycobacterium bovis subsp bovis AF2122/97
gcaccaaggccgugaugcc

SEQ ID NO: 1194285 - RNA, 20 nt, Mycobacterium bovis subsp bovis AF2122/97
gcaccaaggccgugaugcca

SEQ ID NO: 1194286 - RNA, 19 nt, Mycobacterium bovis subsp bovis AF2122/97
gcaccaaggucuucaggcc

SEQ ID NO: 1194287 - RNA, 13 nt, Mycobacterium bovis subsp bovis AF2122/97
gcacauucagcgc

SEQ ID NO: 1194288 - RNA, 15 nt, Mycobacterium bovis subsp bovis AF2122/97
gcacauccugcagcu

SEQ ID NO: 1194289 - RNA, 13 nt, Mycobacterium bovis subsp bovis AF2122/97
gcagagccccggc

SEQ ID NO: 1194290 - RNA, 16 nt, Mycobacterium bovis subsp bovis AF2122/97
gcagagucaacagaua

SEQ ID NO: 1194291 - RNA, 21 nt, Mycobacterium bovis subsp bovis AF2122/97
gcagagucgcacugcgccggc

SEQ ID NO: 1194292 - RNA, 21 nt, Mycobacterium bovis subsp bovis AF2122/97
gcagagaacuccgccaccauc

SEQ ID NO: 1194293 - RNA, 13 nt, Mycobacterium bovis subsp bovis AF2122/97
gcagacucgaggu

SEQ ID NO: 1194294 - RNA, 20 nt, Mycobacterium bovis subsp bovis AF2122/97
gcagacucgauaugcagcuc

SEQ ID NO: 1194295 - RNA, 19 nt, Mycobacterium bovis subsp bovis AF2122/97
gcagacucgccaccgcggc

SEQ ID NO: 1194296 - RNA, 14 nt, Mycobacterium bovis subsp bovis AF2122/97
gcagaccguccagc

SEQ ID NO: 1194297 - RNA, 13 nt, Mycobacterium bovis subsp bovis AF2122/97
gcagaccgccacc

SEQ ID NO: 1194298 - RNA, 17 nt, Mycobacterium bovis subsp bovis AF2122/97
gcagaccguccagcaac

SEQ ID NO: 1194299 - RNA, 15 nt, Mycobacterium bovis subsp bovis AF2122/97
gcagacgcaaaagcc

SEQ ID NO: 1194300 - RNA, 15 nt, Mycobacterium bovis subsp bovis AF2122/97
gcagacgucaugcgg

SEQ ID NO: 1194301 - RNA, 16 nt, Mycobacterium bovis subsp bovis AF2122/97
gcagacggcugccacg

SEQ ID NO: 1194302 - RNA, 24 nt, Mycobacterium bovis subsp bovis AF2122/97
gcagacgcguuucgucgaccgcgc

SEQ ID NO: 1194303 - RNA, 19 nt, Mycobacterium bovis subsp bovis AF2122/97
gcagacgcaaaagcccccu

SEQ ID NO: 1194304 - RNA, 21 nt, Mycobacterium bovis subsp bovis AF2122/97
gcagacgcaaaaucgcacggu

SEQ ID NO: 1194305 - RNA, 17 nt, Mycobacterium bovis subsp bovis AF2122/97
gcagacgcagagucgca

SEQ ID NO: 1194306 - RNA, 20 nt, Mycobacterium bovis subsp bovis AF2122/97
gcagacgcauaagcccccgc

SEQ ID NO: 1194307 - RNA, 17 nt, Mycobacterium bovis subsp bovis AF2122/97
gcagacauggcaaguca

SEQ ID NO: 1194308 - RNA, 16 nt, Mycobacterium bovis subsp bovis AF2122/97
gcagacaggcggcggc

SEQ ID NO: 1194309 - RNA, 14 nt, Mycobacterium bovis subsp bovis AF2122/97
gcagacacugcugc

SEQ ID NO: 1194310 - RNA, 18 nt, Mycobacterium bovis subsp bovis AF2122/97
gcagacacuaaagcccuc

SEQ ID NO: 1194311 - RNA, 20 nt, Mycobacterium bovis subsp bovis AF2122/97
gcagaagucguugcgcgguc

SEQ ID NO: 1194312 - RNA, 22 nt, Mycobacterium bovis subsp bovis AF2122/97
gcagaaucgcauugggcgggcu

SEQ ID NO: 1194313 - RNA, 13 nt, Mycobacterium bovis subsp bovis AF2122/97
gcagaaggccagc

SEQ ID NO: 1194314 - RNA, 14 nt, Mycobacterium bovis subsp bovis AF2122/97
gcagaaggccgcgg

SEQ ID NO: 1194315 - RNA, 15 nt, Mycobacterium bovis subsp bovis AF2122/97
gcagaauccugcgcu

SEQ ID NO: 1194316 - RNA, 16 nt, Mycobacterium bovis subsp bovis AF2122/97
gcagaauccugcgcug

SEQ ID NO: 1194317 - RNA, 19 nt, Mycobacterium bovis subsp bovis AF2122/97
gcagaacaguaucgccgga

SEQ ID NO: 1194318 - RNA, 22 nt, Mycobacterium bovis subsp bovis AF2122/97
gcagaaccgccaacauugguga

SEQ ID NO: 1194319 - RNA, 22 nt, Mycobacterium bovis subsp bovis AF2122/97
gcagaaacaacgucgccgcggc

SEQ ID NO: 1194320 - RNA, 22 nt, Mycobacterium bovis subsp bovis AF2122/97
gcagaaaaucugcuagcuuggc

SEQ ID NO: 1194321 - RNA, 19 nt, Mycobacterium bovis subsp bovis AF2122/97
gcacgcggaaaggcuuccg

SEQ ID NO: 1194322 - RNA, 12 nt, Mycobacterium bovis subsp bovis AF2122/97
gcacgcgggcac

SEQ ID NO: 1194323 - RNA, 15 nt, Mycobacterium bovis subsp bovis AF2122/97
gcacgcgcgcaggcc

SEQ ID NO: 1194324 - RNA, 16 nt, Mycobacterium bovis subsp bovis AF2122/97
gcacgcgcgcaggccg

SEQ ID NO: 1194325 - RNA, 14 nt, Mycobacterium bovis subsp bovis AF2122/97
gcacuucagcuucg

SEQ ID NO: 1194326 - RNA, 13 nt, Mycobacterium bovis subsp bovis AF2122/97
gcacuucagcuuc

SEQ ID NO: 1194327 - RNA, 16 nt, Mycobacterium bovis subsp bovis AF2122/97
gcacuugaucgacggc

SEQ ID NO: 1194328 - RNA, 19 nt, Mycobacterium bovis subsp bovis AF2122/97
gcacuuucuuccucggggc

SEQ ID NO: 1194329 - RNA, 19 nt, Mycobacterium bovis subsp bovis AF2122/97
gcagcccaaagcgccagca

SEQ ID NO: 1194330 - RNA, 22 nt, Mycobacterium bovis subsp bovis AF2122/97
gcagcccaaagcgccagcagcc

SEQ ID NO: 1194331 - RNA, 21 nt, Mycobacterium bovis subsp bovis AF2122/97
gcagcccaaaucccagagcau

SEQ ID NO: 1194332 - RNA, 23 nt, Mycobacterium bovis subsp bovis AF2122/97
gcagccccaaaucguaggggucu

SEQ ID NO: 1194333 - RNA, 16 nt, Mycobacterium bovis subsp bovis AF2122/97
gcagccaugcggcugc

SEQ ID NO: 1194334 - RNA, 17 nt, Mycobacterium bovis subsp bovis AF2122/97
gcagccagcugaacacg

SEQ ID NO: 1194335 - RNA, 14 nt, Mycobacterium bovis subsp bovis AF2122/97
gcagccaggcugcg

SEQ ID NO: 1194336 - RNA, 14 nt, Mycobacterium bovis subsp bovis AF2122/97
gcagccagcccagc

SEQ ID NO: 1194337 - RNA, 16 nt, Mycobacterium bovis subsp bovis AF2122/97
gcagccagaucuccag

SEQ ID NO: 1194338 - RNA, 23 nt, Mycobacterium bovis subsp bovis AF2122/97
gcagccagauucauuggccuggc

SEQ ID NO: 1194339 - RNA, 12 nt, Mycobacterium bovis subsp bovis AF2122/97
gcagccagcaag

SEQ ID NO: 1194340 - RNA, 19 nt, Mycobacterium bovis subsp bovis AF2122/97
gcagccacguagacaaggc

SEQ ID NO: 1194341 - RNA, 20 nt, Mycobacterium bovis subsp bovis AF2122/97
gcagccacguagacaaggcc

SEQ ID NO: 1194342 - RNA, 22 nt, Mycobacterium bovis subsp bovis AF2122/97
gcagcagggcgcgcaucugcuc

SEQ ID NO: 1194343 - RNA, 14 nt, Mycobacterium bovis subsp bovis AF2122/97
gcagccgccggccg

SEQ ID NO: 1194344 - RNA, 13 nt, Mycobacterium bovis subsp bovis AF2122/97
gcagccgccgcgc

SEQ ID NO: 1194345 - RNA, 18 nt, Mycobacterium bovis subsp bovis AF2122/97
gcagccgcccgccaggaa

SEQ ID NO: 1194346 - RNA, 16 nt, Mycobacterium bovis subsp bovis AF2122/97
gcagccgcccgcccac

SEQ ID NO: 1194347 - RNA, 16 nt, Mycobacterium bovis subsp bovis AF2122/97
gcagccgcaggccaug

SEQ ID NO: 1194348 - RNA, 19 nt, Mycobacterium bovis subsp bovis AF2122/97
gcagccgcauaggccccgc

SEQ ID NO: 1194349 - RNA, 10 nt, Mycobacterium bovis subsp bovis AF2122/97
gcagccgccc

SEQ ID NO: 1194350 - RNA, 14 nt, Mycobacterium bovis subsp bovis AF2122/97
gcagccgcagccgg

SEQ ID NO: 1194351 - RNA, 21 nt, Mycobacterium bovis subsp bovis AF2122/97
gcagccgauacaggccacgca

SEQ ID NO: 1194352 - RNA, 20 nt, Mycobacterium bovis subsp bovis AF2122/97
gcagccguagcugggcaccc

SEQ ID NO: 1194353 - RNA, 15 nt, Mycobacterium bovis subsp bovis AF2122/97
gcagccguagcuggg

SEQ ID NO: 1194354 - RNA, 17 nt, Mycobacterium bovis subsp bovis AF2122/97
gcagccguagcugggca

SEQ ID NO: 1194355 - RNA, 20 nt, Mycobacterium bovis subsp bovis AF2122/97
gcagcgaaagcgucgagcug

SEQ ID NO: 1194356 - RNA, 12 nt, Mycobacterium bovis subsp bovis AF2122/97
gcagcgaccagc

SEQ ID NO: 1194357 - RNA, 14 nt, Mycobacterium bovis subsp bovis AF2122/97
gcagccugcugcac

SEQ ID NO: 1194358 - RNA, 17 nt, Mycobacterium bovis subsp bovis AF2122/97
gcagauacuuguugaag

SEQ ID NO: 1194359 - RNA, 18 nt, Mycobacterium bovis subsp bovis AF2122/97
gcagauacgccaaccgcu

SEQ ID NO: 1194360 - RNA, 14 nt, Mycobacterium bovis subsp bovis AF2122/97
gcagauccccgcca

SEQ ID NO: 1194361 - RNA, 15 nt, Mycobacterium bovis subsp bovis AF2122/97
gcagauccccgccac

SEQ ID NO: 1194362 - RNA, 16 nt, Mycobacterium bovis subsp bovis AF2122/97
gcagaucaccgccagc

SEQ ID NO: 1194363 - RNA, 16 nt, Mycobacterium bovis subsp bovis AF2122/97
gcagaucacgggugug

SEQ ID NO: 1194364 - RNA, 14 nt, Mycobacterium bovis subsp bovis AF2122/97
gcagaucagggugg

SEQ ID NO: 1194365 - RNA, 20 nt, Mycobacterium bovis subsp bovis AF2122/97
gcagauggcauugcgcccac

SEQ ID NO: 1194366 - RNA, 13 nt, Mycobacterium bovis subsp bovis AF2122/97
gcagaugggccuc

SEQ ID NO: 1194367 - RNA, 19 nt, Mycobacterium bovis subsp bovis AF2122/97
gcagaugaugccguucgga

SEQ ID NO: 1194368 - RNA, 19 nt, Mycobacterium bovis subsp bovis AF2122/97
gcagaucgccccagccaug

SEQ ID NO: 1194369 - RNA, 20 nt, Mycobacterium bovis subsp bovis AF2122/97
gcagaucgaaaucagcccgc

SEQ ID NO: 1194370 - RNA, 15 nt, Mycobacterium bovis subsp bovis AF2122/97
gcagaucggccggau

SEQ ID NO: 1194371 - RNA, 16 nt, Mycobacterium bovis subsp bovis AF2122/97
gcagcacgauccagcu

SEQ ID NO: 1194372 - RNA, 22 nt, Mycobacterium bovis subsp bovis AF2122/97
gcagcaccgucggcaccagcag

SEQ ID NO: 1194373 - RNA, 21 nt, Mycobacterium bovis subsp bovis AF2122/97
gcagcaccgucgggcccagcc

SEQ ID NO: 1194374 - RNA, 15 nt, Mycobacterium bovis subsp bovis AF2122/97
gcagcacucgguguc

SEQ ID NO: 1194375 - RNA, 22 nt, Mycobacterium bovis subsp bovis AF2122/97
gcagcagacgacgaucagcccc

SEQ ID NO: 1194376 - RNA, 16 nt, Mycobacterium bovis subsp bovis AF2122/97
gcagcacugcggcagc

SEQ ID NO: 1194377 - RNA, 21 nt, Mycobacterium bovis subsp bovis AF2122/97
gcagcacuuccaagccgaccu

SEQ ID NO: 1194378 - RNA, 13 nt, Mycobacterium bovis subsp bovis AF2122/97
gcagcagcgggcg

SEQ ID NO: 1194379 - RNA, 12 nt, Mycobacterium bovis subsp bovis AF2122/97
gcagcagcggca

SEQ ID NO: 1194380 - RNA, 20 nt, Mycobacterium bovis subsp bovis AF2122/97
gcagcaggaaguagccgagc

SEQ ID NO: 1194381 - RNA, 18 nt, Mycobacterium bovis subsp bovis AF2122/97
gcagcaacgcggugccgg

SEQ ID NO: 1194382 - RNA, 16 nt, Mycobacterium bovis subsp bovis AF2122/97
gcagcaacugggcggc

SEQ ID NO: 1194383 - RNA, 21 nt, Mycobacterium bovis subsp bovis AF2122/97
gcagcaacugggcggccuggu

SEQ ID NO: 1194384 - RNA, 13 nt, Mycobacterium bovis subsp bovis AF2122/97
gcagauggugguc

SEQ ID NO: 1194385 - RNA, 16 nt, Mycobacterium bovis subsp bovis AF2122/97
gcaggccgcugggccg

SEQ ID NO: 1194386 - RNA, 12 nt, Mycobacterium bovis subsp bovis AF2122/97
gcaggccgggcg

SEQ ID NO: 1194387 - RNA, 14 nt, Mycobacterium bovis subsp bovis AF2122/97
gcaggccgcguucg

SEQ ID NO: 1194388 - RNA, 12 nt, Mycobacterium bovis subsp bovis AF2122/97
gcaggcccuuca

SEQ ID NO: 1194389 - RNA, 22 nt, Mycobacterium bovis subsp bovis AF2122/97
gcaggauguucaaucccuccgc

SEQ ID NO: 1194390 - RNA, 15 nt, Mycobacterium bovis subsp bovis AF2122/97
gcaggaucggcuugg

SEQ ID NO: 1194391 - RNA, 19 nt, Mycobacterium bovis subsp bovis AF2122/97
gcaggaucgccugagcgcc

SEQ ID NO: 1194392 - RNA, 16 nt, Mycobacterium bovis subsp bovis AF2122/97
gcaggaucuccggguc

SEQ ID NO: 1194393 - RNA, 21 nt, Mycobacterium bovis subsp bovis AF2122/97
gcaggaucggcuugggaaacc

SEQ ID NO: 1194394 - RNA, 12 nt, Mycobacterium bovis subsp bovis AF2122/97
gcaggaccugcg

SEQ ID NO: 1194395 - RNA, 15 nt, Mycobacterium bovis subsp bovis AF2122/97
gcaggcggccgccag

SEQ ID NO: 1194396 - RNA, 16 nt, Mycobacterium bovis subsp bovis AF2122/97
gcaggcucagcuggug

SEQ ID NO: 1194397 - RNA, 16 nt, Mycobacterium bovis subsp bovis AF2122/97
gcaggcgcagcugggu

SEQ ID NO: 1194398 - RNA, 22 nt, Mycobacterium bovis subsp bovis AF2122/97
gcaggcugucgagucgguccug

SEQ ID NO: 1194399 - RNA, 14 nt, Mycobacterium bovis subsp bovis AF2122/97
gcagggccagcggc

SEQ ID NO: 1194400 - RNA, 16 nt, Mycobacterium bovis subsp bovis AF2122/97
gcaggcuuagcuuccg

SEQ ID NO: 1194401 - RNA, 12 nt, Mycobacterium bovis subsp bovis AF2122/97
gcagggccuggc

SEQ ID NO: 1194402 - RNA, 20 nt, Mycobacterium bovis subsp bovis AF2122/97
gcagggccucggucgccaug

SEQ ID NO: 1194403 - RNA, 15 nt, Mycobacterium bovis subsp bovis AF2122/97
gcagggccgccgcga

SEQ ID NO: 1194404 - RNA, 21 nt, Mycobacterium bovis subsp bovis AF2122/97
gcaggaaaucguccuuggaca

SEQ ID NO: 1194405 - RNA, 12 nt, Mycobacterium bovis subsp bovis AF2122/97
gcagcuucucgc

SEQ ID NO: 1194406 - RNA, 14 nt, Mycobacterium bovis subsp bovis AF2122/97
gcagcugggcagga

SEQ ID NO: 1194407 - RNA, 18 nt, Mycobacterium bovis subsp bovis AF2122/97
gcagcuggcgcagccugc

SEQ ID NO: 1194408 - RNA, 20 nt, Mycobacterium bovis subsp bovis AF2122/97
gcagcuggcgcagccugccg

SEQ ID NO: 1194409 - RNA, 13 nt, Mycobacterium bovis subsp bovis AF2122/97
gcagcuggggcgg

SEQ ID NO: 1194410 - RNA, 14 nt, Mycobacterium bovis subsp bovis AF2122/97
gcagcuggucggug

SEQ ID NO: 1194411 - RNA, 12 nt, Mycobacterium bovis subsp bovis AF2122/97
gcagcuucaaca

SEQ ID NO: 1194412 - RNA, 16 nt, Mycobacterium bovis subsp bovis AF2122/97
gcaggaaucgggucag

SEQ ID NO: 1194413 - RNA, 21 nt, Mycobacterium bovis subsp bovis AF2122/97
gcaggaaucgggucagcacca

SEQ ID NO: 1194414 - RNA, 22 nt, Mycobacterium bovis subsp bovis AF2122/97
gcagcucggugacaagcggccc

SEQ ID NO: 1194415 - RNA, 22 nt, Mycobacterium bovis subsp bovis AF2122/97
gcagcucgccggcacgcagcca

SEQ ID NO: 1194416 - RNA, 16 nt, Mycobacterium bovis subsp bovis AF2122/97
gcagcucaucgcgcac

SEQ ID NO: 1194417 - RNA, 15 nt, Mycobacterium bovis subsp bovis AF2122/97
gcagcuccaccagga

SEQ ID NO: 1194418 - RNA, 13 nt, Mycobacterium bovis subsp bovis AF2122/97
gcagcuccccgac

SEQ ID NO: 1194419 - RNA, 16 nt, Mycobacterium bovis subsp bovis AF2122/97
gcagcuccccgccgga

SEQ ID NO: 1194420 - RNA, 19 nt, Mycobacterium bovis subsp bovis AF2122/97
gcagcgugaucuggccacg

SEQ ID NO: 1194421 - RNA, 15 nt, Mycobacterium bovis subsp bovis AF2122/97
gcagcgacggucagg

SEQ ID NO: 1194422 - RNA, 13 nt, Mycobacterium bovis subsp bovis AF2122/97
gcagcgacacguu

SEQ ID NO: 1194423 - RNA, 20 nt, Mycobacterium bovis subsp bovis AF2122/97
gcagcgacuccagcgcccgg

SEQ ID NO: 1194424 - RNA, 22 nt, Mycobacterium bovis subsp bovis AF2122/97
gcagcuacggggcggucgagcc

SEQ ID NO: 1194425 - RNA, 22 nt, Mycobacterium bovis subsp bovis AF2122/97
gcagcguugacggucagccgcg

SEQ ID NO: 1194426 - RNA, 16 nt, Mycobacterium bovis subsp bovis AF2122/97
gcaguacuugguugcg

SEQ ID NO: 1194427 - RNA, 21 nt, Mycobacterium bovis subsp bovis AF2122/97
gcaguacuaacaacaccacca

SEQ ID NO: 1194428 - RNA, 23 nt, Mycobacterium bovis subsp bovis AF2122/97
gcaguacuaacaacaccaccagc

SEQ ID NO: 1194429 - RNA, 15 nt, Mycobacterium bovis subsp bovis AF2122/97
gcagugacucgauca

SEQ ID NO: 1194430 - RNA, 22 nt, Mycobacterium bovis subsp bovis AF2122/97
gcagugacgccucgacacccag

SEQ ID NO: 1194431 - RNA, 19 nt, Mycobacterium bovis subsp bovis AF2122/97
gcauaaccggcgcgccccg

SEQ ID NO: 1194432 - RNA, 19 nt, Mycobacterium bovis subsp bovis AF2122/97
gcaguucaucgggcaccaa

SEQ ID NO: 1194433 - RNA, 21 nt, Mycobacterium bovis subsp bovis AF2122/97
gcaguucaucgggcaccaacc

SEQ ID NO: 1194434 - RNA, 12 nt, Mycobacterium bovis subsp bovis AF2122/97
gcaguugaacuc

SEQ ID NO: 1194435 - RNA, 13 nt, Mycobacterium bovis subsp bovis AF2122/97
gcaggugcugggc

SEQ ID NO: 1194436 - RNA, 15 nt, Mycobacterium bovis subsp bovis AF2122/97
gcaggugcugguugc

SEQ ID NO: 1194437 - RNA, 12 nt, Mycobacterium bovis subsp bovis AF2122/97
gcaggugucggu

SEQ ID NO: 1194438 - RNA, 18 nt, Mycobacterium bovis subsp bovis AF2122/97
gcagguucucggugccga

SEQ ID NO: 1194439 - RNA, 22 nt, Mycobacterium bovis subsp bovis AF2122/97
gcagguucgagggugaccccca

SEQ ID NO: 1194440 - RNA, 22 nt, Mycobacterium bovis subsp bovis AF2122/97
gcagguccaucuggcgcgccgu

SEQ ID NO: 1194441 - RNA, 16 nt, Mycobacterium bovis subsp bovis AF2122/97
gcaggucgacggccac

SEQ ID NO: 1194442 - RNA, 19 nt, Mycobacterium bovis subsp bovis AF2122/97
gcaggucgccugcccccgc

SEQ ID NO: 1194443 - RNA, 21 nt, Mycobacterium bovis subsp bovis AF2122/97
gcaggucgccugcccccgcgc

SEQ ID NO: 1194444 - RNA, 17 nt, Mycobacterium bovis subsp bovis AF2122/97
gcagguagcggguuggg

SEQ ID NO: 1194445 - RNA, 14 nt, Mycobacterium bovis subsp bovis AF2122/97
gcagggugaccagg

SEQ ID NO: 1194446 - RNA, 18 nt, Mycobacterium bovis subsp bovis AF2122/97
gcaggguggccagcaggc

SEQ ID NO: 1194447 - RNA, 17 nt, Mycobacterium bovis subsp bovis AF2122/97
gcagggugaccaggauc

SEQ ID NO: 1194448 - RNA, 20 nt, Mycobacterium bovis subsp bovis AF2122/97
gcaggguguuuauggcccug

SEQ ID NO: 1194449 - RNA, 14 nt, Mycobacterium bovis subsp bovis AF2122/97
gcagggugccggcg

SEQ ID NO: 1194450 - RNA, 21 nt, Mycobacterium bovis subsp bovis AF2122/97
gcaggguggggcgguggccgg

SEQ ID NO: 1194451 - RNA, 22 nt, Mycobacterium bovis subsp bovis AF2122/97
gcaggguugccccgaagcgggc

SEQ ID NO: 1194452 - RNA, 14 nt, Mycobacterium bovis subsp bovis AF2122/97
gcagggcggugcca

SEQ ID NO: 1194453 - RNA, 17 nt, Mycobacterium bovis subsp bovis AF2122/97
gaugugcacggugugca

SEQ ID NO: 1194454 - RNA, 13 nt, Mycobacterium bovis subsp bovis AF2122/97
gaugucgggaagg

SEQ ID NO: 1194455 - RNA, 17 nt, Mycobacterium bovis subsp bovis AF2122/97
gaugugguuggugcugg

SEQ ID NO: 1194456 - RNA, 23 nt, Mycobacterium bovis subsp bovis AF2122/97
gauguguagguggggcacuucca

SEQ ID NO: 1194457 - RNA, 16 nt, Mycobacterium bovis subsp bovis AF2122/97
gaugugggcggagccg

SEQ ID NO: 1194458 - RNA, 14 nt, Mycobacterium bovis subsp bovis AF2122/97
gauguggaugccgu

SEQ ID NO: 1194459 - RNA, 20 nt, Mycobacterium bovis subsp bovis AF2122/97
gaugugccgauuggccugcc

SEQ ID NO: 1194460 - RNA, 14 nt, Mycobacterium bovis subsp bovis AF2122/97
gaugugcucgguac

SEQ ID NO: 1194461 - RNA, 16 nt, Mycobacterium bovis subsp bovis AF2122/97
gaugugcgccaccucg

SEQ ID NO: 1194462 - RNA, 19 nt, Mycobacterium bovis subsp bovis AF2122/97
gauggcuggccagcacgcc

SEQ ID NO: 1194463 - RNA, 21 nt, Mycobacterium bovis subsp bovis AF2122/97
gauggcucaccagcuccucgu

SEQ ID NO: 1194464 - RNA, 23 nt, Mycobacterium bovis subsp bovis AF2122/97
gauggcuccggccgcguuggggu

SEQ ID NO: 1194465 - RNA, 13 nt, Mycobacterium bovis subsp bovis AF2122/97
gaugggaaucagu

SEQ ID NO: 1194466 - RNA, 18 nt, Mycobacterium bovis subsp bovis AF2122/97
gaugucgcgcgcuaggug

SEQ ID NO: 1194467 - RNA, 19 nt, Mycobacterium bovis subsp bovis AF2122/97
gaugucgcgcgcuaggugc

SEQ ID NO: 1194468 - RNA, 15 nt, Mycobacterium bovis subsp bovis AF2122/97
gaugucguuggccac

SEQ ID NO: 1194469 - RNA, 20 nt, Mycobacterium bovis subsp bovis AF2122/97
gaugucggugcguccggugc

SEQ ID NO: 1194470 - RNA, 17 nt, Mycobacterium bovis subsp bovis AF2122/97
gaugucucggcaccaca

SEQ ID NO: 1194471 - RNA, 18 nt, Mycobacterium bovis subsp bovis AF2122/97
gauguugccggaguugaa

SEQ ID NO: 1194472 - RNA, 21 nt, Mycobacterium bovis subsp bovis AF2122/97
gaugugucggcgagggcgcgc

SEQ ID NO: 1194473 - RNA, 16 nt, Mycobacterium bovis subsp bovis AF2122/97
gauguguucuccugcc

SEQ ID NO: 1194474 - RNA, 19 nt, Mycobacterium bovis subsp bovis AF2122/97
gauuacaugucacacccac

SEQ ID NO: 1194475 - RNA, 18 nt, Mycobacterium bovis subsp bovis AF2122/97
gauucccggcgcgguggc

SEQ ID NO: 1194476 - RNA, 15 nt, Mycobacterium bovis subsp bovis AF2122/97
gauuccccguccuuu

SEQ ID NO: 1194477 - RNA, 13 nt, Mycobacterium bovis subsp bovis AF2122/97
gauucccagucca

SEQ ID NO: 1194478 - RNA, 15 nt, Mycobacterium bovis subsp bovis AF2122/97
gauucccaguccagg

SEQ ID NO: 1194479 - RNA, 18 nt, Mycobacterium bovis subsp bovis AF2122/97
gauuccggcggccacgcc

SEQ ID NO: 1194480 - RNA, 22 nt, Mycobacterium bovis subsp bovis AF2122/97
gauucgaagccgagcuccucca

SEQ ID NO: 1194481 - RNA, 16 nt, Mycobacterium bovis subsp bovis AF2122/97
gauucgaaggcaccua

SEQ ID NO: 1194482 - RNA, 17 nt, Mycobacterium bovis subsp bovis AF2122/97
gauuccucuucaggccc

SEQ ID NO: 1194483 - RNA, 19 nt, Mycobacterium bovis subsp bovis AF2122/97
gauuccaccuuggccagac

SEQ ID NO: 1194484 - RNA, 15 nt, Mycobacterium bovis subsp bovis AF2122/97
gauucgagccacaug

SEQ ID NO: 1194485 - RNA, 14 nt, Mycobacterium bovis subsp bovis AF2122/97
gauucgcgcugcuu

SEQ ID NO: 1194486 - RNA, 18 nt, Mycobacterium bovis subsp bovis AF2122/97
gauucgggcgccgcagcg

SEQ ID NO: 1194487 - RNA, 22 nt, Mycobacterium bovis subsp bovis AF2122/97
gauugguggcccgggccaccgg

SEQ ID NO: 1194488 - RNA, 19 nt, Mycobacterium bovis subsp bovis AF2122/97
gauuggugggccagcagca

SEQ ID NO: 1194489 - RNA, 18 nt, Mycobacterium bovis subsp bovis AF2122/97
gauugccaggaccgcgcc

SEQ ID NO: 1194490 - RNA, 20 nt, Mycobacterium bovis subsp bovis AF2122/97
gauuggccaaccccauggcc

SEQ ID NO: 1194491 - RNA, 11 nt, Mycobacterium bovis subsp bovis AF2122/97
gauuggcccga

SEQ ID NO: 1194492 - RNA, 17 nt, Mycobacterium bovis subsp bovis AF2122/97
gauuggcgucagcagca

SEQ ID NO: 1194493 - RNA, 21 nt, Mycobacterium bovis subsp bovis AF2122/97
gauuggccugccauaggccca

SEQ ID NO: 1194494 - RNA, 20 nt, Mycobacterium bovis subsp bovis AF2122/97
gauugugagcaauggcgcga

SEQ ID NO: 1194495 - RNA, 14 nt, Mycobacterium bovis subsp bovis AF2122/97
gauuucccagcgca

SEQ ID NO: 1194496 - RNA, 20 nt, Mycobacterium bovis subsp bovis AF2122/97
gauuucccagcgcagugccu

SEQ ID NO: 1194497 - RNA, 18 nt, Mycobacterium bovis subsp bovis AF2122/97
gauuuggccgucaucucc

SEQ ID NO: 1194498 - RNA, 14 nt, Mycobacterium bovis subsp bovis AF2122/97
gauuuggagcuuuu

SEQ ID NO: 1194499 - RNA, 21 nt, Mycobacterium bovis subsp bovis AF2122/97
gaugccguucaugccauggau

SEQ ID NO: 1194500 - RNA, 22 nt, Mycobacterium bovis subsp bovis AF2122/97
gaugccucggcggccucgcugc

SEQ ID NO: 1194501 - RNA, 18 nt, Mycobacterium bovis subsp bovis AF2122/97
gaugccugcuagcagcag

SEQ ID NO: 1194502 - RNA, 12 nt, Mycobacterium bovis subsp bovis AF2122/97
gaugcgccgcac

SEQ ID NO: 1194503 - RNA, 15 nt, Mycobacterium bovis subsp bovis AF2122/97
gaugcgcucggccug

SEQ ID NO: 1194504 - RNA, 17 nt, Mycobacterium bovis subsp bovis AF2122/97
gaugcgcgggugguuca

SEQ ID NO: 1194505 - RNA, 14 nt, Mycobacterium bovis subsp bovis AF2122/97
gaugcgcuaggugc

SEQ ID NO: 1194506 - RNA, 15 nt, Mycobacterium bovis subsp bovis AF2122/97
gaugccccacggugc

SEQ ID NO: 1194507 - RNA, 20 nt, Mycobacterium bovis subsp bovis AF2122/97
gaugcccacggugccggcac

SEQ ID NO: 1194508 - RNA, 21 nt, Mycobacterium bovis subsp bovis AF2122/97
gaugccguaguaaggagccgg

SEQ ID NO: 1194509 - RNA, 20 nt, Mycobacterium bovis subsp bovis AF2122/97
gaugccggcgaaggccagca

SEQ ID NO: 1194510 - RNA, 15 nt, Mycobacterium bovis subsp bovis AF2122/97
gaugccguaggcggc

SEQ ID NO: 1194511 - RNA, 14 nt, Mycobacterium bovis subsp bovis AF2122/97
gaugccgggugugu

SEQ ID NO: 1194512 - RNA, 15 nt, Mycobacterium bovis subsp bovis AF2122/97
gaugccggacgccau

SEQ ID NO: 1194513 - RNA, 19 nt, Mycobacterium bovis subsp bovis AF2122/97
gaugccgcgcagcgcggcg

SEQ ID NO: 1194514 - RNA, 13 nt, Mycobacterium bovis subsp bovis AF2122/97
gauggccagguug

SEQ ID NO: 1194515 - RNA, 15 nt, Mycobacterium bovis subsp bovis AF2122/97
gauggccagcgcggc

SEQ ID NO: 1194516 - RNA, 13 nt, Mycobacterium bovis subsp bovis AF2122/97
gaugcugcgggcg

SEQ ID NO: 1194517 - RNA, 23 nt, Mycobacterium bovis subsp bovis AF2122/97
gauggccguccgaccgauaacac

SEQ ID NO: 1194518 - RNA, 15 nt, Mycobacterium bovis subsp bovis AF2122/97
gauggccugaucuuu

SEQ ID NO: 1194519 - RNA, 15 nt, Mycobacterium bovis subsp bovis AF2122/97
gauggcgguggcgag

SEQ ID NO: 1194520 - RNA, 20 nt, Mycobacterium bovis subsp bovis AF2122/97
gaugcgcugcucacgcagca

SEQ ID NO: 1194521 - RNA, 22 nt, Mycobacterium bovis subsp bovis AF2122/97
gaugcucagugccaaagcggca

SEQ ID NO: 1194522 - RNA, 17 nt, Mycobacterium bovis subsp bovis AF2122/97
gaugcagcgggucgccg

SEQ ID NO: 1194523 - RNA, 22 nt, Mycobacterium bovis subsp bovis AF2122/97
gaugcagcgguccagacaucag

SEQ ID NO: 1194524 - RNA, 14 nt, Mycobacterium bovis subsp bovis AF2122/97
gaugauguggugug

SEQ ID NO: 1194525 - RNA, 20 nt, Mycobacterium bovis subsp bovis AF2122/97
gaugauggcgcgaucggugc

SEQ ID NO: 1194526 - RNA, 19 nt, Mycobacterium bovis subsp bovis AF2122/97
gaugauguuuuccccgccc

SEQ ID NO: 1194527 - RNA, 11 nt, Mycobacterium bovis subsp bovis AF2122/97
gaugaccugcc

SEQ ID NO: 1194528 - RNA, 19 nt, Mycobacterium bovis subsp bovis AF2122/97
gaugaccugcccgucccgc

SEQ ID NO: 1194529 - RNA, 20 nt, Mycobacterium bovis subsp bovis AF2122/97
gaugaccgcguagagcagca

SEQ ID NO: 1194530 - RNA, 19 nt, Mycobacterium bovis subsp bovis AF2122/97
gaugaccgaaccuggucuu

SEQ ID NO: 1194531 - RNA, 22 nt, Mycobacterium bovis subsp bovis AF2122/97
gaugaaguguuuggcguugggc

SEQ ID NO: 1194532 - RNA, 14 nt, Mycobacterium bovis subsp bovis AF2122/97
gaugacccacugca

SEQ ID NO: 1194533 - RNA, 16 nt, Mycobacterium bovis subsp bovis AF2122/97
gaugacccacugcagg

SEQ ID NO: 1194534 - RNA, 17 nt, Mycobacterium bovis subsp bovis AF2122/97
gaugacggugccgaccg

SEQ ID NO: 1194535 - RNA, 21 nt, Mycobacterium bovis subsp bovis AF2122/97
gaugagggugcucgucaccaa

SEQ ID NO: 1194536 - RNA, 17 nt, Mycobacterium bovis subsp bovis AF2122/97
gaugacgccgucggcgc

SEQ ID NO: 1194537 - RNA, 19 nt, Mycobacterium bovis subsp bovis AF2122/97
gaugaccuuggccgugccc

SEQ ID NO: 1194538 - RNA, 17 nt, Mycobacterium bovis subsp bovis AF2122/97
gaugacgaucuggucaa

SEQ ID NO: 1194539 - RNA, 21 nt, Mycobacterium bovis subsp bovis AF2122/97
gaugacgaacaagaaaagcag

SEQ ID NO: 1194540 - RNA, 17 nt, Mycobacterium bovis subsp bovis AF2122/97
gaugaccuucccgucga

SEQ ID NO: 1194541 - RNA, 21 nt, Mycobacterium bovis subsp bovis AF2122/97
gaucucguggaucugccucuc

SEQ ID NO: 1194542 - RNA, 19 nt, Mycobacterium bovis subsp bovis AF2122/97
gaucucuccuggaaaggac

SEQ ID NO: 1194543 - RNA, 19 nt, Mycobacterium bovis subsp bovis AF2122/97
gaucugcagcacgcguggu

SEQ ID NO: 1194544 - RNA, 14 nt, Mycobacterium bovis subsp bovis AF2122/97
gaucugcccccgcc

SEQ ID NO: 1194545 - RNA, 18 nt, Mycobacterium bovis subsp bovis AF2122/97
gaucucgccgccagcgcu

SEQ ID NO: 1194546 - RNA, 20 nt, Mycobacterium bovis subsp bovis AF2122/97
gaucucgcccagcgagcgcc

SEQ ID NO: 1194547 - RNA, 16 nt, Mycobacterium bovis subsp bovis AF2122/97
gaucucgcccaccucc

SEQ ID NO: 1194548 - RNA, 19 nt, Mycobacterium bovis subsp bovis AF2122/97
gaucucgucccacugcgcg

SEQ ID NO: 1194549 - RNA, 17 nt, Mycobacterium bovis subsp bovis AF2122/97
gaucucggcggccgcgu

SEQ ID NO: 1194550 - RNA, 20 nt, Mycobacterium bovis subsp bovis AF2122/97
gaucucggucgacggguuca

SEQ ID NO: 1194551 - RNA, 17 nt, Mycobacterium bovis subsp bovis AF2122/97
gaucucguagccgccgu

SEQ ID NO: 1194552 - RNA, 20 nt, Mycobacterium bovis subsp bovis AF2122/97
gaucucguggaucugccucu

SEQ ID NO: 1194553 - RNA, 16 nt, Mycobacterium bovis subsp bovis AF2122/97
gaucucgaccagcgcc

SEQ ID NO: 1194554 - RNA, 23 nt, Mycobacterium bovis subsp bovis AF2122/97
gaucucgaccguauugaccagcg

SEQ ID NO: 1194555 - RNA, 15 nt, Mycobacterium bovis subsp bovis AF2122/97
gaucucgagcaggcg

SEQ ID NO: 1194556 - RNA, 16 nt, Mycobacterium bovis subsp bovis AF2122/97
gaucucgaucgacccg

SEQ ID NO: 1194557 - RNA, 15 nt, Mycobacterium bovis subsp bovis AF2122/97
gaucuccucgaguug

SEQ ID NO: 1194558 - RNA, 23 nt, Mycobacterium bovis subsp bovis AF2122/97
gaucuccucgaguugcgcggcag

SEQ ID NO: 1194559 - RNA, 16 nt, Mycobacterium bovis subsp bovis AF2122/97
gauccccgcaauuccc

SEQ ID NO: 1194560 - RNA, 20 nt, Mycobacterium bovis subsp bovis AF2122/97
gauccccaggccgcuugccc

SEQ ID NO: 1194561 - RNA, 19 nt, Mycobacterium bovis subsp bovis AF2122/97
gaucccagcgcagcggacg

SEQ ID NO: 1194562 - RNA, 19 nt, Mycobacterium bovis subsp bovis AF2122/97
gaucuccagcgguucggug

SEQ ID NO: 1194563 - RNA, 21 nt, Mycobacterium bovis subsp bovis AF2122/97
gaucucaucgggccacagcaa

SEQ ID NO: 1194564 - RNA, 15 nt, Mycobacterium bovis subsp bovis AF2122/97
gaucucaccuggagc

SEQ ID NO: 1194565 - RNA, 20 nt, Mycobacterium bovis subsp bovis AF2122/97
gaugaaccacggcaggcagg

SEQ ID NO: 1194566 - RNA, 12 nt, Mycobacterium bovis subsp bovis AF2122/97
gaugaaccaggc

SEQ ID NO: 1194567 - RNA, 17 nt, Mycobacterium bovis subsp bovis AF2122/97
gaugaaccacggcaggc

SEQ ID NO: 1194568 - RNA, 16 nt, Mycobacterium bovis subsp bovis AF2122/97
gaucuugugccaggcg

SEQ ID NO: 1194569 - RNA, 13 nt, Mycobacterium bovis subsp bovis AF2122/97
gaucuuggccacc

SEQ ID NO: 1194570 - RNA, 16 nt, Mycobacterium bovis subsp bovis AF2122/97
gaucugcuccgcagca

SEQ ID NO: 1194571 - RNA, 22 nt, Mycobacterium bovis subsp bovis AF2122/97
gaucugcgcgucaggccagcgc

SEQ ID NO: 1194572 - RNA, 14 nt, Mycobacterium bovis subsp bovis AF2122/97
gaucuuaggcacuc

SEQ ID NO: 1194573 - RNA, 21 nt, Mycobacterium bovis subsp bovis AF2122/97
gaucuggcguucagcggccag

SEQ ID NO: 1194574 - RNA, 17 nt, Mycobacterium bovis subsp bovis AF2122/97
gaucugggcugcggccg

SEQ ID NO: 1194575 - RNA, 15 nt, Mycobacterium bovis subsp bovis AF2122/97
gaucugggcuggcag

SEQ ID NO: 1194576 - RNA, 15 nt, Mycobacterium bovis subsp bovis AF2122/97
gaucuucggccgcac

SEQ ID NO: 1194577 - RNA, 18 nt, Mycobacterium bovis subsp bovis AF2122/97
gaucuucgacaggccacc

SEQ ID NO: 1194578 - RNA, 16 nt, Mycobacterium bovis subsp bovis AF2122/97
gaucuucugccuuggc

SEQ ID NO: 1194579 - RNA, 21 nt, Mycobacterium bovis subsp bovis AF2122/97
gaucuucugccuuggccggcu

SEQ ID NO: 1194580 - RNA, 17 nt, Mycobacterium bovis subsp bovis AF2122/97
gaucuugacgaaaucca

SEQ ID NO: 1194581 - RNA, 14 nt, Mycobacterium bovis subsp bovis AF2122/97
gaucaccugcagca

SEQ ID NO: 1194582 - RNA, 23 nt, Mycobacterium bovis subsp bovis AF2122/97
gaucaccguugcguuggcgccac

SEQ ID NO: 1194583 - RNA, 19 nt, Mycobacterium bovis subsp bovis AF2122/97
gaucaccgacaccguguug

SEQ ID NO: 1194584 - RNA, 15 nt, Mycobacterium bovis subsp bovis AF2122/97
gaucaccgccaccac

SEQ ID NO: 1194585 - RNA, 20 nt, Mycobacterium bovis subsp bovis AF2122/97
gaucaccgccaccaccaggg

SEQ ID NO: 1194586 - RNA, 21 nt, Mycobacterium bovis subsp bovis AF2122/97
gaucaccgcguaguccaggcc

SEQ ID NO: 1194587 - RNA, 14 nt, Mycobacterium bovis subsp bovis AF2122/97
gaucacccgcagcc

SEQ ID NO: 1194588 - RNA, 19 nt, Mycobacterium bovis subsp bovis AF2122/97
gaucaccauccagcccauc

SEQ ID NO: 1194589 - RNA, 21 nt, Mycobacterium bovis subsp bovis AF2122/97
gaucaccauccagcccauccc

SEQ ID NO: 1194590 - RNA, 15 nt, Mycobacterium bovis subsp bovis AF2122/97
gaucaaaccggcggc

SEQ ID NO: 1194591 - RNA, 16 nt, Mycobacterium bovis subsp bovis AF2122/97
gaucaaaccggcggcg

SEQ ID NO: 1194592 - RNA, 13 nt, Mycobacterium bovis subsp bovis AF2122/97
gaucaaugcgaug

SEQ ID NO: 1194593 - RNA, 17 nt, Mycobacterium bovis subsp bovis AF2122/97
gaucacaccccaggcac

SEQ ID NO: 1194594 - RNA, 22 nt, Mycobacterium bovis subsp bovis AF2122/97
gaucagcaacggcagcgaggcc

SEQ ID NO: 1194595 - RNA, 13 nt, Mycobacterium bovis subsp bovis AF2122/97
gaucagaucccgc

SEQ ID NO: 1194596 - RNA, 16 nt, Mycobacterium bovis subsp bovis AF2122/97
gaucagaucccgccgc

SEQ ID NO: 1194597 - RNA, 20 nt, Mycobacterium bovis subsp bovis AF2122/97
gaucagaugggauaccccuc

SEQ ID NO: 1194598 - RNA, 18 nt, Mycobacterium bovis subsp bovis AF2122/97
gaucaguucguggcuggc

SEQ ID NO: 1194599 - RNA, 20 nt, Mycobacterium bovis subsp bovis AF2122/97
gaucaguucguggcuggcau

SEQ ID NO: 1194600 - RNA, 16 nt, Mycobacterium bovis subsp bovis AF2122/97
gaucagacccagcgcg

SEQ ID NO: 1194601 - RNA, 16 nt, Mycobacterium bovis subsp bovis AF2122/97
gaucagaacgcggccu

SEQ ID NO: 1194602 - RNA, 17 nt, Mycobacterium bovis subsp bovis AF2122/97
gaucagaacgcggccuc

SEQ ID NO: 1194603 - RNA, 20 nt, Mycobacterium bovis subsp bovis AF2122/97
gaucaccuuggcaagcacgc

SEQ ID NO: 1194604 - RNA, 13 nt, Mycobacterium bovis subsp bovis AF2122/97
gaucacggcggcc

SEQ ID NO: 1194605 - RNA, 21 nt, Mycobacterium bovis subsp bovis AF2122/97
gaucaucauauccgccccagc

SEQ ID NO: 1194606 - RNA, 17 nt, Mycobacterium bovis subsp bovis AF2122/97
gaucaucgggagccgca

SEQ ID NO: 1194607 - RNA, 15 nt, Mycobacterium bovis subsp bovis AF2122/97
gaucaucuggcuggu

SEQ ID NO: 1194608 - RNA, 17 nt, Mycobacterium bovis subsp bovis AF2122/97
gaucaucuggcugguga

SEQ ID NO: 1194609 - RNA, 12 nt, Mycobacterium bovis subsp bovis AF2122/97
gauccagcugua

SEQ ID NO: 1194610 - RNA, 20 nt, Mycobacterium bovis subsp bovis AF2122/97
gauccaggacuucugcugca

SEQ ID NO: 1194611 - RNA, 16 nt, Mycobacterium bovis subsp bovis AF2122/97
gaucauggcgagcguu

SEQ ID NO: 1194612 - RNA, 23 nt, Mycobacterium bovis subsp bovis AF2122/97
gauccagggccuucgggccagga

SEQ ID NO: 1194613 - RNA, 23 nt, Mycobacterium bovis subsp bovis AF2122/97
gauaguucaccacaugggagccg

SEQ ID NO: 1194614 - RNA, 21 nt, Mycobacterium bovis subsp bovis AF2122/97
gauagcccagauagagcuggu

SEQ ID NO: 1194615 - RNA, 22 nt, Mycobacterium bovis subsp bovis AF2122/97
gauagcccagauagagcuggug

SEQ ID NO: 1194616 - RNA, 22 nt, Mycobacterium bovis subsp bovis AF2122/97
gauaggaccacgggaugcaugu

SEQ ID NO: 1194617 - RNA, 14 nt, Mycobacterium bovis subsp bovis AF2122/97
gauaggccccgagg

SEQ ID NO: 1194618 - RNA, 21 nt, Mycobacterium bovis subsp bovis AF2122/97
gauacucgaguggcgaacggg

SEQ ID NO: 1194619 - RNA, 22 nt, Mycobacterium bovis subsp bovis AF2122/97
gauacucgucgucggcaggcag

SEQ ID NO: 1194620 - RNA, 23 nt, Mycobacterium bovis subsp bovis AF2122/97
gauacgugaggucccggcuggga

SEQ ID NO: 1194621 - RNA, 14 nt, Mycobacterium bovis subsp bovis AF2122/97
gauaccucgccauc

SEQ ID NO: 1194622 - RNA, 19 nt, Mycobacterium bovis subsp bovis AF2122/97
gauagaacguagcgcccac

SEQ ID NO: 1194623 - RNA, 15 nt, Mycobacterium bovis subsp bovis AF2122/97
gauaccggcgugcag

SEQ ID NO: 1194624 - RNA, 22 nt, Mycobacterium bovis subsp bovis AF2122/97
gauaaggaccgcgcccagaccg

SEQ ID NO: 1194625 - RNA, 21 nt, Mycobacterium bovis subsp bovis AF2122/97
gauaaggcaaggcauccaacg

SEQ ID NO: 1194626 - RNA, 13 nt, Mycobacterium bovis subsp bovis AF2122/97
gauaaggaucaga

SEQ ID NO: 1194627 - RNA, 20 nt, Mycobacterium bovis subsp bovis AF2122/97
gagggccgucacaggccgcc

SEQ ID NO: 1194628 - RNA, 21 nt, Mycobacterium bovis subsp bovis AF2122/97
gagggcgccgggggcgccgcc

SEQ ID NO: 1194629 - RNA, 15 nt, Mycobacterium bovis subsp bovis AF2122/97
gagggcgggacccgu

SEQ ID NO: 1194630 - RNA, 20 nt, Mycobacterium bovis subsp bovis AF2122/97
gagggcggaaaaucggcugg

SEQ ID NO: 1194631 - RNA, 16 nt, Mycobacterium bovis subsp bovis AF2122/97
gagggcucgguggcgc

SEQ ID NO: 1194632 - RNA, 18 nt, Mycobacterium bovis subsp bovis AF2122/97
gagggcuaccggcgccgc

SEQ ID NO: 1194633 - RNA, 16 nt, Mycobacterium bovis subsp bovis AF2122/97
gagggcuugcaccugc

SEQ ID NO: 1194634 - RNA, 14 nt, Mycobacterium bovis subsp bovis AF2122/97
gagggugcguugga

SEQ ID NO: 1194635 - RNA, 14 nt, Mycobacterium bovis subsp bovis AF2122/97
gagggucccacggc

SEQ ID NO: 1194636 - RNA, 20 nt, Mycobacterium bovis subsp bovis AF2122/97
gagggggguguugaggccgg

SEQ ID NO: 1194637 - RNA, 24 nt, Mycobacterium bovis subsp bovis AF2122/97
gagggggguguugaggccggugaa

SEQ ID NO: 1194638 - RNA, 16 nt, Mycobacterium bovis subsp bovis AF2122/97
gagguacccccagcac

SEQ ID NO: 1194639 - RNA, 14 nt, Mycobacterium bovis subsp bovis AF2122/97
gaggguuuccaagu

SEQ ID NO: 1194640 - RNA, 21 nt, Mycobacterium bovis subsp bovis AF2122/97
gaggcuuucgauauagccgcc

SEQ ID NO: 1194641 - RNA, 21 nt, Mycobacterium bovis subsp bovis AF2122/97
gaggcugugccccagggcagu

SEQ ID NO: 1194642 - RNA, 23 nt, Mycobacterium bovis subsp bovis AF2122/97
gaggcugugccccagggcagugc

SEQ ID NO: 1194643 - RNA, 14 nt, Mycobacterium bovis subsp bovis AF2122/97
gaggcuugcaacac

SEQ ID NO: 1194644 - RNA, 13 nt, Mycobacterium bovis subsp bovis AF2122/97
gagggccagcagc

SEQ ID NO: 1194645 - RNA, 13 nt, Mycobacterium bovis subsp bovis AF2122/97
gagggccacggcu

SEQ ID NO: 1194646 - RNA, 21 nt, Mycobacterium bovis subsp bovis AF2122/97
gagggccacguagcagcagac

SEQ ID NO: 1194647 - RNA, 14 nt, Mycobacterium bovis subsp bovis AF2122/97
gagggaucacgcca

SEQ ID NO: 1194648 - RNA, 14 nt, Mycobacterium bovis subsp bovis AF2122/97
gagggagcgccgca

SEQ ID NO: 1194649 - RNA, 22 nt, Mycobacterium bovis subsp bovis AF2122/97
gagggagcgccgcagggucccg

SEQ ID NO: 1194650 - RNA, 15 nt, Mycobacterium bovis subsp bovis AF2122/97
gagggagcgccgcag

SEQ ID NO: 1194651 - RNA, 12 nt, Mycobacterium bovis subsp bovis AF2122/97
gaggcggcuggc

SEQ ID NO: 1194652 - RNA, 19 nt, Mycobacterium bovis subsp bovis AF2122/97
gaggcggcgccgcacccac

SEQ ID NO: 1194653 - RNA, 21 nt, Mycobacterium bovis subsp bovis AF2122/97
gaggcugaccguggcgccggu

SEQ ID NO: 1194654 - RNA, 17 nt, Mycobacterium bovis subsp bovis AF2122/97
gaggcugggcugagggu

SEQ ID NO: 1194655 - RNA, 15 nt, Mycobacterium bovis subsp bovis AF2122/97
gaggcucgggccgca

SEQ ID NO: 1194656 - RNA, 17 nt, Mycobacterium bovis subsp bovis AF2122/97
gaggcucggucggcagc

SEQ ID NO: 1194657 - RNA, 20 nt, Mycobacterium bovis subsp bovis AF2122/97
gaggugguucacggggacca

SEQ ID NO: 1194658 - RNA, 14 nt, Mycobacterium bovis subsp bovis AF2122/97
gagguggggcagga

SEQ ID NO: 1194659 - RNA, 12 nt, Mycobacterium bovis subsp bovis AF2122/97
gagguggcgggc

SEQ ID NO: 1194660 - RNA, 16 nt, Mycobacterium bovis subsp bovis AF2122/97
gagguggggcaggauc

SEQ ID NO: 1194661 - RNA, 16 nt, Mycobacterium bovis subsp bovis AF2122/97
gagguggggugguggu

SEQ ID NO: 1194662 - RNA, 19 nt, Mycobacterium bovis subsp bovis AF2122/97
gagguggccgcgcaggggc

SEQ ID NO: 1194663 - RNA, 19 nt, Mycobacterium bovis subsp bovis AF2122/97
gaggugcccaaggccagga

SEQ ID NO: 1194664 - RNA, 21 nt, Mycobacterium bovis subsp bovis AF2122/97
gaggugcccaaggccaggauc

SEQ ID NO: 1194665 - RNA, 13 nt, Mycobacterium bovis subsp bovis AF2122/97
gaggugccggcgc

SEQ ID NO: 1194666 - RNA, 14 nt, Mycobacterium bovis subsp bovis AF2122/97
gaggugccggcgcc

SEQ ID NO: 1194667 - RNA, 18 nt, Mycobacterium bovis subsp bovis AF2122/97
gaggugccgcgcagcugc

SEQ ID NO: 1194668 - RNA, 19 nt, Mycobacterium bovis subsp bovis AF2122/97
gaggugccgcgcagcugcc

SEQ ID NO: 1194669 - RNA, 22 nt, Mycobacterium bovis subsp bovis AF2122/97
gaggugccuguugcgaccaucc

SEQ ID NO: 1194670 - RNA, 18 nt, Mycobacterium bovis subsp bovis AF2122/97
gaggugcgccgcgggcug

SEQ ID NO: 1194671 - RNA, 14 nt, Mycobacterium bovis subsp bovis AF2122/97
gaggucagcucccg

SEQ ID NO: 1194672 - RNA, 13 nt, Mycobacterium bovis subsp bovis AF2122/97
gagguccagcaug

SEQ ID NO: 1194673 - RNA, 16 nt, Mycobacterium bovis subsp bovis AF2122/97
gaggucaacgccacgc

SEQ ID NO: 1194674 - RNA, 12 nt, Mycobacterium bovis subsp bovis AF2122/97
gaggucccggcc

SEQ ID NO: 1194675 - RNA, 22 nt, Mycobacterium bovis subsp bovis AF2122/97
gaggucgaucaggggcccaccc

SEQ ID NO: 1194676 - RNA, 17 nt, Mycobacterium bovis subsp bovis AF2122/97
gaggucaaaaucagggu

SEQ ID NO: 1194677 - RNA, 18 nt, Mycobacterium bovis subsp bovis AF2122/97
gaggucaaaaucagggug

SEQ ID NO: 1194678 - RNA, 14 nt, Mycobacterium bovis subsp bovis AF2122/97
gaggucggcggcgc

SEQ ID NO: 1194679 - RNA, 19 nt, Mycobacterium bovis subsp bovis AF2122/97
gaggucgcggucuuugagc

SEQ ID NO: 1194680 - RNA, 23 nt, Mycobacterium bovis subsp bovis AF2122/97
gaggucgcggucuuugagccggu

SEQ ID NO: 1194681 - RNA, 17 nt, Mycobacterium bovis subsp bovis AF2122/97
gaguaacacguggguga

SEQ ID NO: 1194682 - RNA, 13 nt, Mycobacterium bovis subsp bovis AF2122/97
gaguacaggcgca

SEQ ID NO: 1194683 - RNA, 16 nt, Mycobacterium bovis subsp bovis AF2122/97
gaguacuccagccgca

SEQ ID NO: 1194684 - RNA, 16 nt, Mycobacterium bovis subsp bovis AF2122/97
gaguacggcgaugcgg

SEQ ID NO: 1194685 - RNA, 19 nt, Mycobacterium bovis subsp bovis AF2122/97
gaguccugguaccccagca

SEQ ID NO: 1194686 - RNA, 20 nt, Mycobacterium bovis subsp bovis AF2122/97
gaguccgguagcuguggugg

SEQ ID NO: 1194687 - RNA, 21 nt, Mycobacterium bovis subsp bovis AF2122/97
gaguccgguagcugugguggu

SEQ ID NO: 1194688 - RNA, 21 nt, Mycobacterium bovis subsp bovis AF2122/97
gaguccgacaguccgcgccgg

SEQ ID NO: 1194689 - RNA, 20 nt, Mycobacterium bovis subsp bovis AF2122/97
gaguccgauuuugugagcca

SEQ ID NO: 1194690 - RNA, 18 nt, Mycobacterium bovis subsp bovis AF2122/97
gaguccggccgacccgga

SEQ ID NO: 1194691 - RNA, 17 nt, Mycobacterium bovis subsp bovis AF2122/97
gaguccgcugagcgggc

SEQ ID NO: 1194692 - RNA, 22 nt, Mycobacterium bovis subsp bovis AF2122/97
gagucccgucacucaccccaac

SEQ ID NO: 1194693 - RNA, 15 nt, Mycobacterium bovis subsp bovis AF2122/97
gaguaggugugcggg

SEQ ID NO: 1194694 - RNA, 18 nt, Mycobacterium bovis subsp bovis AF2122/97
gaguagucgcuggccaga

SEQ ID NO: 1194695 - RNA, 12 nt, Mycobacterium bovis subsp bovis AF2122/97
gagucgagcaca

SEQ ID NO: 1194696 - RNA, 20 nt, Mycobacterium bovis subsp bovis AF2122/97
gagucgacccugcccagcac

SEQ ID NO: 1194697 - RNA, 22 nt, Mycobacterium bovis subsp bovis AF2122/97
gagucgauugccaccgagauca

SEQ ID NO: 1194698 - RNA, 22 nt, Mycobacterium bovis subsp bovis AF2122/97
gagucugcgcagaaauguauug

SEQ ID NO: 1194699 - RNA, 19 nt, Mycobacterium bovis subsp bovis AF2122/97
gaguugguguuauugaugc

SEQ ID NO: 1194700 - RNA, 16 nt, Mycobacterium bovis subsp bovis AF2122/97
gaguugcuugcagggc

SEQ ID NO: 1194701 - RNA, 12 nt, Mycobacterium bovis subsp bovis AF2122/97
gaguuggccaag

SEQ ID NO: 1194702 - RNA, 23 nt, Mycobacterium bovis subsp bovis AF2122/97
gaguuggccaagcaggcggggga

SEQ ID NO: 1194703 - RNA, 20 nt, Mycobacterium bovis subsp bovis AF2122/97
gagugucuuagccagcagca

SEQ ID NO: 1194704 - RNA, 16 nt, Mycobacterium bovis subsp bovis AF2122/97
gagugucuuagccagc

SEQ ID NO: 1194705 - RNA, 21 nt, Mycobacterium bovis subsp bovis AF2122/97
gaguggucccguucgcccgcc

SEQ ID NO: 1194706 - RNA, 21 nt, Mycobacterium bovis subsp bovis AF2122/97
gaguggcgauuucggcgccug

SEQ ID NO: 1194707 - RNA, 22 nt, Mycobacterium bovis subsp bovis AF2122/97
gagugaggcgcuggcccgccag

SEQ ID NO: 1194708 - RNA, 16 nt, Mycobacterium bovis subsp bovis AF2122/97
gaguggaugcgccgca

SEQ ID NO: 1194709 - RNA, 22 nt, Mycobacterium bovis subsp bovis AF2122/97
gauaacccaaccgcgccaccuc

SEQ ID NO: 1194710 - RNA, 13 nt, Mycobacterium bovis subsp bovis AF2122/97
gauaacccagcac

SEQ ID NO: 1194711 - RNA, 17 nt, Mycobacterium bovis subsp bovis AF2122/97
gauaacccagcaccaca

SEQ ID NO: 1194712 - RNA, 14 nt, Mycobacterium bovis subsp bovis AF2122/97
gaguuuguuuuugc

SEQ ID NO: 1194713 - RNA, 17 nt, Mycobacterium bovis subsp bovis AF2122/97
gagcagaaggccagcga

SEQ ID NO: 1194714 - RNA, 17 nt, Mycobacterium bovis subsp bovis AF2122/97
gagcagagaacuccgcc

SEQ ID NO: 1194715 - RNA, 20 nt, Mycobacterium bovis subsp bovis AF2122/97
gagcagacgcauaagccccc

SEQ ID NO: 1194716 - RNA, 15 nt, Mycobacterium bovis subsp bovis AF2122/97
gagcacucccugguu

SEQ ID NO: 1194717 - RNA, 14 nt, Mycobacterium bovis subsp bovis AF2122/97
gagcacuccggagc

SEQ ID NO: 1194718 - RNA, 21 nt, Mycobacterium bovis subsp bovis AF2122/97
gagcacguucaccgcgcgcuc

SEQ ID NO: 1194719 - RNA, 20 nt, Mycobacterium bovis subsp bovis AF2122/97
gagcagaaacaacgucgccg

SEQ ID NO: 1194720 - RNA, 14 nt, Mycobacterium bovis subsp bovis AF2122/97
gagcacgccgacca

SEQ ID NO: 1194721 - RNA, 17 nt, Mycobacterium bovis subsp bovis AF2122/97
gagcacggcgcggcgga

SEQ ID NO: 1194722 - RNA, 15 nt, Mycobacterium bovis subsp bovis AF2122/97
gagcaccucggccuc

SEQ ID NO: 1194723 - RNA, 23 nt, Mycobacterium bovis subsp bovis AF2122/97
gagcacgccaacguugcgccagc

SEQ ID NO: 1194724 - RNA, 19 nt, Mycobacterium bovis subsp bovis AF2122/97
gagcaccuuggggugggcg

SEQ ID NO: 1194725 - RNA, 17 nt, Mycobacterium bovis subsp bovis AF2122/97
gagcaccgacaccggcc

SEQ ID NO: 1194726 - RNA, 22 nt, Mycobacterium bovis subsp bovis AF2122/97
gagcaccgacuucagcaacgca

SEQ ID NO: 1194727 - RNA, 14 nt, Mycobacterium bovis subsp bovis AF2122/97
gagcaccaccccag

SEQ ID NO: 1194728 - RNA, 20 nt, Mycobacterium bovis subsp bovis AF2122/97
gagcacaccgacagcaccca

SEQ ID NO: 1194729 - RNA, 15 nt, Mycobacterium bovis subsp bovis AF2122/97
gagcaauuccucagc

SEQ ID NO: 1194730 - RNA, 14 nt, Mycobacterium bovis subsp bovis AF2122/97
gagcaaguccugca

SEQ ID NO: 1194731 - RNA, 21 nt, Mycobacterium bovis subsp bovis AF2122/97
gagcaaaccagauugccgagc

SEQ ID NO: 1194732 - RNA, 23 nt, Mycobacterium bovis subsp bovis AF2122/97
gagcaacaccgucggcagcagcg

SEQ ID NO: 1194733 - RNA, 20 nt, Mycobacterium bovis subsp bovis AF2122/97
gagaugauugccaagcgggu

SEQ ID NO: 1194734 - RNA, 20 nt, Mycobacterium bovis subsp bovis AF2122/97
gagaucgcggcgacccgguc

SEQ ID NO: 1194735 - RNA, 19 nt, Mycobacterium bovis subsp bovis AF2122/97
gagauucggagucaccagc

SEQ ID NO: 1194736 - RNA, 15 nt, Mycobacterium bovis subsp bovis AF2122/97
gagauugggcuggga

SEQ ID NO: 1194737 - RNA, 15 nt, Mycobacterium bovis subsp bovis AF2122/97
gagauugcugugacu

SEQ ID NO: 1194738 - RNA, 15 nt, Mycobacterium bovis subsp bovis AF2122/97
gagauggucgggcgg

SEQ ID NO: 1194739 - RNA, 18 nt, Mycobacterium bovis subsp bovis AF2122/97
gagauggucgggcggcgu

SEQ ID NO: 1194740 - RNA, 19 nt, Mycobacterium bovis subsp bovis AF2122/97
gagauggucgggcggcguc

SEQ ID NO: 1194741 - RNA, 15 nt, Mycobacterium bovis subsp bovis AF2122/97
gagaucaugagguga

SEQ ID NO: 1194742 - RNA, 12 nt, Mycobacterium bovis subsp bovis AF2122/97
gagaucgcccga

SEQ ID NO: 1194743 - RNA, 22 nt, Mycobacterium bovis subsp bovis AF2122/97
gagauagcaacgaagccggcgc

SEQ ID NO: 1194744 - RNA, 22 nt, Mycobacterium bovis subsp bovis AF2122/97
gagauauugcgcgccugcgcca

SEQ ID NO: 1194745 - RNA, 15 nt, Mycobacterium bovis subsp bovis AF2122/97
gagaguaggaccucg

SEQ ID NO: 1194746 - RNA, 15 nt, Mycobacterium bovis subsp bovis AF2122/97
gagauacgggccacc

SEQ ID NO: 1194747 - RNA, 20 nt, Mycobacterium bovis subsp bovis AF2122/97
gagauagcaacgaagccggc

SEQ ID NO: 1194748 - RNA, 20 nt, Mycobacterium bovis subsp bovis AF2122/97
gagccggucuugcaucgcca

SEQ ID NO: 1194749 - RNA, 20 nt, Mycobacterium bovis subsp bovis AF2122/97
gagccggugacgguguuggu

SEQ ID NO: 1194750 - RNA, 19 nt, Mycobacterium bovis subsp bovis AF2122/97
gagccgguaaccgcgucga

SEQ ID NO: 1194751 - RNA, 14 nt, Mycobacterium bovis subsp bovis AF2122/97
gagccgguggcccg

SEQ ID NO: 1194752 - RNA, 13 nt, Mycobacterium bovis subsp bovis AF2122/97
gagccggcucaga

SEQ ID NO: 1194753 - RNA, 12 nt, Mycobacterium bovis subsp bovis AF2122/97
gagccggcggcc

SEQ ID NO: 1194754 - RNA, 17 nt, Mycobacterium bovis subsp bovis AF2122/97
gagccggcgccgggucg

SEQ ID NO: 1194755 - RNA, 16 nt, Mycobacterium bovis subsp bovis AF2122/97
gagccggcccugcucg

SEQ ID NO: 1194756 - RNA, 13 nt, Mycobacterium bovis subsp bovis AF2122/97
gagccggccaccu

SEQ ID NO: 1194757 - RNA, 18 nt, Mycobacterium bovis subsp bovis AF2122/97
gagccggacguucuggau

SEQ ID NO: 1194758 - RNA, 14 nt, Mycobacterium bovis subsp bovis AF2122/97
gagccgcugcggca

SEQ ID NO: 1194759 - RNA, 19 nt, Mycobacterium bovis subsp bovis AF2122/97
gagccgcaucuggccggcg

SEQ ID NO: 1194760 - RNA, 17 nt, Mycobacterium bovis subsp bovis AF2122/97
gagccgccggaucgcca

SEQ ID NO: 1194761 - RNA, 18 nt, Mycobacterium bovis subsp bovis AF2122/97
gagccgccggaucgccac

SEQ ID NO: 1194762 - RNA, 14 nt, Mycobacterium bovis subsp bovis AF2122/97
gagccgcgcgccgg

SEQ ID NO: 1194763 - RNA, 18 nt, Mycobacterium bovis subsp bovis AF2122/97
gagccgaggaauacucuc

SEQ ID NO: 1194764 - RNA, 16 nt, Mycobacterium bovis subsp bovis AF2122/97
gagccgacccgcccga

SEQ ID NO: 1194765 - RNA, 15 nt, Mycobacterium bovis subsp bovis AF2122/97
gagccgaucgcccgc

SEQ ID NO: 1194766 - RNA, 13 nt, Mycobacterium bovis subsp bovis AF2122/97
gagccgcagcacc

SEQ ID NO: 1194767 - RNA, 13 nt, Mycobacterium bovis subsp bovis AF2122/97
gagcccaccuggg

SEQ ID NO: 1194768 - RNA, 13 nt, Mycobacterium bovis subsp bovis AF2122/97
gagcccagccgcg

SEQ ID NO: 1194769 - RNA, 17 nt, Mycobacterium bovis subsp bovis AF2122/97
gagcccagccgcgggcc

SEQ ID NO: 1194770 - RNA, 23 nt, Mycobacterium bovis subsp bovis AF2122/97
gagcccaauccgcaacagcucgg

SEQ ID NO: 1194771 - RNA, 17 nt, Mycobacterium bovis subsp bovis AF2122/97
gagccccgaccagcaga

SEQ ID NO: 1194772 - RNA, 15 nt, Mycobacterium bovis subsp bovis AF2122/97
gagccccgacugcug

SEQ ID NO: 1194773 - RNA, 15 nt, Mycobacterium bovis subsp bovis AF2122/97
gagcccuccagggcc

SEQ ID NO: 1194774 - RNA, 18 nt, Mycobacterium bovis subsp bovis AF2122/97
gagccacugcggcauggc

SEQ ID NO: 1194775 - RNA, 18 nt, Mycobacterium bovis subsp bovis AF2122/97
gagccagcacccgcagcc

SEQ ID NO: 1194776 - RNA, 13 nt, Mycobacterium bovis subsp bovis AF2122/97
gagccaacucccg

SEQ ID NO: 1194777 - RNA, 14 nt, Mycobacterium bovis subsp bovis AF2122/97
gagccaccaccgcc

SEQ ID NO: 1194778 - RNA, 18 nt, Mycobacterium bovis subsp bovis AF2122/97
gagccacucggcccggca

SEQ ID NO: 1194779 - RNA, 10 nt, Mycobacterium bovis subsp bovis AF2122/97
gagccaggga

SEQ ID NO: 1194780 - RNA, 14 nt, Mycobacterium bovis subsp bovis AF2122/97
gagccaucaccgca

SEQ ID NO: 1194781 - RNA, 18 nt, Mycobacterium bovis subsp bovis AF2122/97
gagcaucuccucgccugc

SEQ ID NO: 1194782 - RNA, 14 nt, Mycobacterium bovis subsp bovis AF2122/97
gagcaucucgucgg

SEQ ID NO: 1194783 - RNA, 22 nt, Mycobacterium bovis subsp bovis AF2122/97
gagcaguucucggucccgccgg

SEQ ID NO: 1194784 - RNA, 16 nt, Mycobacterium bovis subsp bovis AF2122/97
gagcaugauguccucc

SEQ ID NO: 1194785 - RNA, 17 nt, Mycobacterium bovis subsp bovis AF2122/97
gagcaugcccagcgaau

SEQ ID NO: 1194786 - RNA, 15 nt, Mycobacterium bovis subsp bovis AF2122/97
gagcaugguccagca

SEQ ID NO: 1194787 - RNA, 18 nt, Mycobacterium bovis subsp bovis AF2122/97
gagcaugcgacgucaggg

SEQ ID NO: 1194788 - RNA, 15 nt, Mycobacterium bovis subsp bovis AF2122/97
gagcaugccgcccgc

SEQ ID NO: 1194789 - RNA, 18 nt, Mycobacterium bovis subsp bovis AF2122/97
gagcauuucggaugccgc

SEQ ID NO: 1194790 - RNA, 19 nt, Mycobacterium bovis subsp bovis AF2122/97
gagcagggugaccaggauc

SEQ ID NO: 1194791 - RNA, 20 nt, Mycobacterium bovis subsp bovis AF2122/97
gagcagguaggcgcgauaca

SEQ ID NO: 1194792 - RNA, 15 nt, Mycobacterium bovis subsp bovis AF2122/97
gagcaguggccgccg

SEQ ID NO: 1194793 - RNA, 16 nt, Mycobacterium bovis subsp bovis AF2122/97
gagcaguggccgccgg

SEQ ID NO: 1194794 - RNA, 14 nt, Mycobacterium bovis subsp bovis AF2122/97
gagcagggccggca

SEQ ID NO: 1194795 - RNA, 14 nt, Mycobacterium bovis subsp bovis AF2122/97
gagcagggcggcga

SEQ ID NO: 1194796 - RNA, 24 nt, Mycobacterium bovis subsp bovis AF2122/97
gagcagcuuagucagggccgaggu

SEQ ID NO: 1194797 - RNA, 22 nt, Mycobacterium bovis subsp bovis AF2122/97
gagcagcgcgccguucgccugg

SEQ ID NO: 1194798 - RNA, 17 nt, Mycobacterium bovis subsp bovis AF2122/97
gagcagcgugggaagag

SEQ ID NO: 1194799 - RNA, 16 nt, Mycobacterium bovis subsp bovis AF2122/97
gagcagcgcggccaga

SEQ ID NO: 1194800 - RNA, 12 nt, Mycobacterium bovis subsp bovis AF2122/97
gagcagccagcc

SEQ ID NO: 1194801 - RNA, 18 nt, Mycobacterium bovis subsp bovis AF2122/97
gagcagccgaaccggcac

SEQ ID NO: 1194802 - RNA, 23 nt, Mycobacterium bovis subsp bovis AF2122/97
gagcagccgaaccggcaccagcg

SEQ ID NO: 1194803 - RNA, 11 nt, Mycobacterium bovis subsp bovis AF2122/97
gagcagcgcac

SEQ ID NO: 1194804 - RNA, 12 nt, Mycobacterium bovis subsp bovis AF2122/97
gagcucgcgcag

SEQ ID NO: 1194805 - RNA, 17 nt, Mycobacterium bovis subsp bovis AF2122/97
gagcucggcgcccagcu

SEQ ID NO: 1194806 - RNA, 19 nt, Mycobacterium bovis subsp bovis AF2122/97
gagcucgaugucagcggcc

SEQ ID NO: 1194807 - RNA, 16 nt, Mycobacterium bovis subsp bovis AF2122/97
gagcuccgucgcggcc

SEQ ID NO: 1194808 - RNA, 20 nt, Mycobacterium bovis subsp bovis AF2122/97
gagcucagcgaugcggcccu

SEQ ID NO: 1194809 - RNA, 17 nt, Mycobacterium bovis subsp bovis AF2122/97
gagcucaccgcacaccu

SEQ ID NO: 1194810 - RNA, 14 nt, Mycobacterium bovis subsp bovis AF2122/97
gagcuagccguucg

SEQ ID NO: 1194811 - RNA, 20 nt, Mycobacterium bovis subsp bovis AF2122/97
gagcuauucggugucgccac

SEQ ID NO: 1194812 - RNA, 21 nt, Mycobacterium bovis subsp bovis AF2122/97
gagcuacgaccguugggauga

SEQ ID NO: 1194813 - RNA, 15 nt, Mycobacterium bovis subsp bovis AF2122/97
gagcugauccgggug

SEQ ID NO: 1194814 - RNA, 14 nt, Mycobacterium bovis subsp bovis AF2122/97
gagcugauccaagu

SEQ ID NO: 1194815 - RNA, 14 nt, Mycobacterium bovis subsp bovis AF2122/97
gagcugcucgccgg

SEQ ID NO: 1194816 - RNA, 19 nt, Mycobacterium bovis subsp bovis AF2122/97
gagcugcuggcgcgccugu

SEQ ID NO: 1194817 - RNA, 13 nt, Mycobacterium bovis subsp bovis AF2122/97
gagcugcggcggc

SEQ ID NO: 1194818 - RNA, 14 nt, Mycobacterium bovis subsp bovis AF2122/97
gagcugcggcggcc

SEQ ID NO: 1194819 - RNA, 16 nt, Mycobacterium bovis subsp bovis AF2122/97
gagcugaccugguucc

SEQ ID NO: 1194820 - RNA, 16 nt, Mycobacterium bovis subsp bovis AF2122/97
gagcugacgccgagcu

SEQ ID NO: 1194821 - RNA, 14 nt, Mycobacterium bovis subsp bovis AF2122/97
gagcucggcugcuc

SEQ ID NO: 1194822 - RNA, 12 nt, Mycobacterium bovis subsp bovis AF2122/97
gagcggccucgg

SEQ ID NO: 1194823 - RNA, 18 nt, Mycobacterium bovis subsp bovis AF2122/97
gagcggccucgggacucc

SEQ ID NO: 1194824 - RNA, 22 nt, Mycobacterium bovis subsp bovis AF2122/97
gagcggacucgagucugcgcag

SEQ ID NO: 1194825 - RNA, 14 nt, Mycobacterium bovis subsp bovis AF2122/97
gagcggagccggcg

SEQ ID NO: 1194826 - RNA, 20 nt, Mycobacterium bovis subsp bovis AF2122/97
gagcggauagcggcaaagcc

SEQ ID NO: 1194827 - RNA, 19 nt, Mycobacterium bovis subsp bovis AF2122/97
gagcggaucgucgucgugu

SEQ ID NO: 1194828 - RNA, 15 nt, Mycobacterium bovis subsp bovis AF2122/97
gagcggcggcacugg

SEQ ID NO: 1194829 - RNA, 17 nt, Mycobacterium bovis subsp bovis AF2122/97
gagcggcgcgggggugg

SEQ ID NO: 1194830 - RNA, 14 nt, Mycobacterium bovis subsp bovis AF2122/97
gagcgggugcgggc

SEQ ID NO: 1194831 - RNA, 15 nt, Mycobacterium bovis subsp bovis AF2122/97
gagcguaggccagcg

SEQ ID NO: 1194832 - RNA, 17 nt, Mycobacterium bovis subsp bovis AF2122/97
gagcgucaaccacggcc

SEQ ID NO: 1194833 - RNA, 15 nt, Mycobacterium bovis subsp bovis AF2122/97
gagcgguugccuucu

SEQ ID NO: 1194834 - RNA, 18 nt, Mycobacterium bovis subsp bovis AF2122/97
gagcguaaugcugcugca

SEQ ID NO: 1194835 - RNA, 19 nt, Mycobacterium bovis subsp bovis AF2122/97
gagcguggcaacgagcagg

SEQ ID NO: 1194836 - RNA, 17 nt, Mycobacterium bovis subsp bovis AF2122/97
gagcgugucggccggcc

SEQ ID NO: 1194837 - RNA, 19 nt, Mycobacterium bovis subsp bovis AF2122/97
gagcgugagccaugccgcu

SEQ ID NO: 1194838 - RNA, 15 nt, Mycobacterium bovis subsp bovis AF2122/97
gagcgugccgcagcg

SEQ ID NO: 1194839 - RNA, 21 nt, Mycobacterium bovis subsp bovis AF2122/97
gagcgcggcggagccggguga

SEQ ID NO: 1194840 - RNA, 15 nt, Mycobacterium bovis subsp bovis AF2122/97
gagcgcggcggcgga

SEQ ID NO: 1194841 - RNA, 14 nt, Mycobacterium bovis subsp bovis AF2122/97
gagcgcggcggcgg

SEQ ID NO: 1194842 - RNA, 18 nt, Mycobacterium bovis subsp bovis AF2122/97
gagcgcggugccgccacc

SEQ ID NO: 1194843 - RNA, 17 nt, Mycobacterium bovis subsp bovis AF2122/97
gagcgcgcguagcgggg

SEQ ID NO: 1194844 - RNA, 20 nt, Mycobacterium bovis subsp bovis AF2122/97
gagcgcgccuaugggccugc

SEQ ID NO: 1194845 - RNA, 14 nt, Mycobacterium bovis subsp bovis AF2122/97
gagcgcgcccaacc

SEQ ID NO: 1194846 - RNA, 14 nt, Mycobacterium bovis subsp bovis AF2122/97
gagcgcgcagcagu

SEQ ID NO: 1194847 - RNA, 19 nt, Mycobacterium bovis subsp bovis AF2122/97
gagcgcgccgaaggccgcc

SEQ ID NO: 1194848 - RNA, 19 nt, Mycobacterium bovis subsp bovis AF2122/97
gagcgcccgucguaggugg

SEQ ID NO: 1194849 - RNA, 14 nt, Mycobacterium bovis subsp bovis AF2122/97
gagcgccaggucag

SEQ ID NO: 1194850 - RNA, 16 nt, Mycobacterium bovis subsp bovis AF2122/97
gagcgccaggucagcu

SEQ ID NO: 1194851 - RNA, 20 nt, Mycobacterium bovis subsp bovis AF2122/97
gagcgccaggccgcacagca

SEQ ID NO: 1194852 - RNA, 13 nt, Mycobacterium bovis subsp bovis AF2122/97
gagcgccagcgcc

SEQ ID NO: 1194853 - RNA, 22 nt, Mycobacterium bovis subsp bovis AF2122/97
gagcgccaggccgcacagcacc

SEQ ID NO: 1194854 - RNA, 13 nt, Mycobacterium bovis subsp bovis AF2122/97
gagcgcaccugaa

SEQ ID NO: 1194855 - RNA, 16 nt, Mycobacterium bovis subsp bovis AF2122/97
gagcgcacucaccuug

SEQ ID NO: 1194856 - RNA, 12 nt, Mycobacterium bovis subsp bovis AF2122/97
gagcgcaccgcu

SEQ ID NO: 1194857 - RNA, 18 nt, Mycobacterium bovis subsp bovis AF2122/97
gagcgcaagagccguccg

SEQ ID NO: 1194858 - RNA, 18 nt, Mycobacterium bovis subsp bovis AF2122/97
gagcgcaucgauggccgc

SEQ ID NO: 1194859 - RNA, 22 nt, Mycobacterium bovis subsp bovis AF2122/97
gagcgccacgccgaggcguucg

SEQ ID NO: 1194860 - RNA, 21 nt, Mycobacterium bovis subsp bovis AF2122/97
gagcgaccgcgagggccagca

SEQ ID NO: 1194861 - RNA, 22 nt, Mycobacterium bovis subsp bovis AF2122/97
gagcgaacgggcuuccgacaug

SEQ ID NO: 1194862 - RNA, 14 nt, Mycobacterium bovis subsp bovis AF2122/97
gagcgagccaacuc

SEQ ID NO: 1194863 - RNA, 17 nt, Mycobacterium bovis subsp bovis AF2122/97
gagcgacgucggugaag

SEQ ID NO: 1194864 - RNA, 22 nt, Mycobacterium bovis subsp bovis AF2122/97
gagcgaggcucccccaccaggg

SEQ ID NO: 1194865 - RNA, 20 nt, Mycobacterium bovis subsp bovis AF2122/97
gagccgguggcccgccggca

SEQ ID NO: 1194866 - RNA, 20 nt, Mycobacterium bovis subsp bovis AF2122/97
gagccguccaauuccgcaga

SEQ ID NO: 1194867 - RNA, 22 nt, Mycobacterium bovis subsp bovis AF2122/97
gagccguccaauuccgcagaga

SEQ ID NO: 1194868 - RNA, 13 nt, Mycobacterium bovis subsp bovis AF2122/97
gagccgugccagc

SEQ ID NO: 1194869 - RNA, 18 nt, Mycobacterium bovis subsp bovis AF2122/97
gagccgucggcgccucgg

SEQ ID NO: 1194870 - RNA, 14 nt, Mycobacterium bovis subsp bovis AF2122/97
gagccuccauggcc

SEQ ID NO: 1194871 - RNA, 19 nt, Mycobacterium bovis subsp bovis AF2122/97
gagccugcaggccgccggc

SEQ ID NO: 1194872 - RNA, 16 nt, Mycobacterium bovis subsp bovis AF2122/97
gagccugauaaagccc

SEQ ID NO: 1194873 - RNA, 21 nt, Mycobacterium bovis subsp bovis AF2122/97
gaggaaccccggucgggguuu

SEQ ID NO: 1194874 - RNA, 19 nt, Mycobacterium bovis subsp bovis AF2122/97
gaggaaucguucggggugg

SEQ ID NO: 1194875 - RNA, 22 nt, Mycobacterium bovis subsp bovis AF2122/97
gaggaaguccagcuggccgggu

SEQ ID NO: 1194876 - RNA, 22 nt, Mycobacterium bovis subsp bovis AF2122/97
gaggacuggaaagcagcagcgg

SEQ ID NO: 1194877 - RNA, 23 nt, Mycobacterium bovis subsp bovis AF2122/97
gaggaccucgucaccggucagcg

SEQ ID NO: 1194878 - RNA, 12 nt, Mycobacterium bovis subsp bovis AF2122/97
gaggacgagguu

SEQ ID NO: 1194879 - RNA, 16 nt, Mycobacterium bovis subsp bovis AF2122/97
gaggaccugcucgggc

SEQ ID NO: 1194880 - RNA, 14 nt, Mycobacterium bovis subsp bovis AF2122/97
gaggacgccggcgc

SEQ ID NO: 1194881 - RNA, 21 nt, Mycobacterium bovis subsp bovis AF2122/97
gaggacgccggcgccgccauu

SEQ ID NO: 1194882 - RNA, 12 nt, Mycobacterium bovis subsp bovis AF2122/97
gaggacggcuug

SEQ ID NO: 1194883 - RNA, 14 nt, Mycobacterium bovis subsp bovis AF2122/97
gagcuggcgaccug

SEQ ID NO: 1194884 - RNA, 13 nt, Mycobacterium bovis subsp bovis AF2122/97
gagcuggugcaga

SEQ ID NO: 1194885 - RNA, 13 nt, Mycobacterium bovis subsp bovis AF2122/97
gagcuggaaucga

SEQ ID NO: 1194886 - RNA, 15 nt, Mycobacterium bovis subsp bovis AF2122/97
gagcuggaccuccga

SEQ ID NO: 1194887 - RNA, 14 nt, Mycobacterium bovis subsp bovis AF2122/97
gagcuggcagcucc

SEQ ID NO: 1194888 - RNA, 22 nt, Mycobacterium bovis subsp bovis AF2122/97
gagcuggcgcgcgggguggcgg

SEQ ID NO: 1194889 - RNA, 16 nt, Mycobacterium bovis subsp bovis AF2122/97
gagcuguaggucagcg

SEQ ID NO: 1194890 - RNA, 15 nt, Mycobacterium bovis subsp bovis AF2122/97
gagcuguaggucagc

SEQ ID NO: 1194891 - RNA, 17 nt, Mycobacterium bovis subsp bovis AF2122/97
gagcuucaucccggagc

SEQ ID NO: 1194892 - RNA, 17 nt, Mycobacterium bovis subsp bovis AF2122/97
gagcuuccgcgcgcaga

SEQ ID NO: 1194893 - RNA, 12 nt, Mycobacterium bovis subsp bovis AF2122/97
gagcuucgccgc

SEQ ID NO: 1194894 - RNA, 22 nt, Mycobacterium bovis subsp bovis AF2122/97
gagcuugggccggugcagcacg

SEQ ID NO: 1194895 - RNA, 15 nt, Mycobacterium bovis subsp bovis AF2122/97
gagcuuuaucugcau

SEQ ID NO: 1194896 - RNA, 16 nt, Mycobacterium bovis subsp bovis AF2122/97
gagcuugggccggugc

SEQ ID NO: 1194897 - RNA, 13 nt, Mycobacterium bovis subsp bovis AF2122/97
gaggccaccgcga

SEQ ID NO: 1194898 - RNA, 14 nt, Mycobacterium bovis subsp bovis AF2122/97
gaggccacgccagc

SEQ ID NO: 1194899 - RNA, 19 nt, Mycobacterium bovis subsp bovis AF2122/97
gaggccacggggauuggcg

SEQ ID NO: 1194900 - RNA, 15 nt, Mycobacterium bovis subsp bovis AF2122/97
gaggccaacccugcg

SEQ ID NO: 1194901 - RNA, 21 nt, Mycobacterium bovis subsp bovis AF2122/97
gaggccaaguugcagcgggcc

SEQ ID NO: 1194902 - RNA, 17 nt, Mycobacterium bovis subsp bovis AF2122/97
gaggcagcgcgaggcuc

SEQ ID NO: 1194903 - RNA, 19 nt, Mycobacterium bovis subsp bovis AF2122/97
gaggcagucguugaugcuu

SEQ ID NO: 1194904 - RNA, 12 nt, Mycobacterium bovis subsp bovis AF2122/97
gaggccccccgc

SEQ ID NO: 1194905 - RNA, 13 nt, Mycobacterium bovis subsp bovis AF2122/97
gaggccaucaucc

SEQ ID NO: 1194906 - RNA, 13 nt, Mycobacterium bovis subsp bovis AF2122/97
gaggcccgggugc

SEQ ID NO: 1194907 - RNA, 23 nt, Mycobacterium bovis subsp bovis AF2122/97
gaggcccgccacaacggcggcgc

SEQ ID NO: 1194908 - RNA, 22 nt, Mycobacterium bovis subsp bovis AF2122/97
gaggccgacgacauugggcgcg

SEQ ID NO: 1194909 - RNA, 18 nt, Mycobacterium bovis subsp bovis AF2122/97
gaggccgccaucgccgcc

SEQ ID NO: 1194910 - RNA, 17 nt, Mycobacterium bovis subsp bovis AF2122/97
gaggccgcugccagggu

SEQ ID NO: 1194911 - RNA, 17 nt, Mycobacterium bovis subsp bovis AF2122/97
gaggccuaccaggcgcg

SEQ ID NO: 1194912 - RNA, 20 nt, Mycobacterium bovis subsp bovis AF2122/97
gaggccuaccaggcgcggcc

SEQ ID NO: 1194913 - RNA, 15 nt, Mycobacterium bovis subsp bovis AF2122/97
gaggccgcugccagg

SEQ ID NO: 1194914 - RNA, 12 nt, Mycobacterium bovis subsp bovis AF2122/97
gaggcgcccaac

SEQ ID NO: 1194915 - RNA, 15 nt, Mycobacterium bovis subsp bovis AF2122/97
gaggcgcuucgccac

SEQ ID NO: 1194916 - RNA, 16 nt, Mycobacterium bovis subsp bovis AF2122/97
gaggcgcagcgccagc

SEQ ID NO: 1194917 - RNA, 14 nt, Mycobacterium bovis subsp bovis AF2122/97
gaggcgaucugcua

SEQ ID NO: 1194918 - RNA, 18 nt, Mycobacterium bovis subsp bovis AF2122/97
gaggauccgcugcggccc

SEQ ID NO: 1194919 - RNA, 22 nt, Mycobacterium bovis subsp bovis AF2122/97
gaggaugacgacggugaccggg

SEQ ID NO: 1194920 - RNA, 19 nt, Mycobacterium bovis subsp bovis AF2122/97
gaggauguaguuggugaug

SEQ ID NO: 1194921 - RNA, 12 nt, Mycobacterium bovis subsp bovis AF2122/97
gacgggccgucg

SEQ ID NO: 1194922 - RNA, 13 nt, Mycobacterium bovis subsp bovis AF2122/97
gacgggccgcgaa

SEQ ID NO: 1194923 - RNA, 15 nt, Mycobacterium bovis subsp bovis AF2122/97
gacgggcacgcggcg

SEQ ID NO: 1194924 - RNA, 17 nt, Mycobacterium bovis subsp bovis AF2122/97
gacgggcacaaccagau

SEQ ID NO: 1194925 - RNA, 17 nt, Mycobacterium bovis subsp bovis AF2122/97
gacgggucucgcgagcg

SEQ ID NO: 1194926 - RNA, 21 nt, Mycobacterium bovis subsp bovis AF2122/97
gacgggucggcagaauguucu

SEQ ID NO: 1194927 - RNA, 18 nt, Mycobacterium bovis subsp bovis AF2122/97
gacgggucggcgccgagc

SEQ ID NO: 1194928 - RNA, 22 nt, Mycobacterium bovis subsp bovis AF2122/97
gacggggucgcgaugcucaaug

SEQ ID NO: 1194929 - RNA, 20 nt, Mycobacterium bovis subsp bovis AF2122/97
gacgggcagaggcuggcgca

SEQ ID NO: 1194930 - RNA, 15 nt, Mycobacterium bovis subsp bovis AF2122/97
gacggggcaaaggag

SEQ ID NO: 1194931 - RNA, 16 nt, Mycobacterium bovis subsp bovis AF2122/97
gacggggcaaaggagc

SEQ ID NO: 1194932 - RNA, 21 nt, Mycobacterium bovis subsp bovis AF2122/97
gacggggcaaaggagccguug

SEQ ID NO: 1194933 - RNA, 14 nt, Mycobacterium bovis subsp bovis AF2122/97
gacggcggcgaggc

SEQ ID NO: 1194934 - RNA, 20 nt, Mycobacterium bovis subsp bovis AF2122/97
gacggcggccgcgauggcgu

SEQ ID NO: 1194935 - RNA, 14 nt, Mycobacterium bovis subsp bovis AF2122/97
gacggcggccuucg

SEQ ID NO: 1194936 - RNA, 14 nt, Mycobacterium bovis subsp bovis AF2122/97
gacggcgucacccg

SEQ ID NO: 1194937 - RNA, 14 nt, Mycobacterium bovis subsp bovis AF2122/97
gacggcgccaggca

SEQ ID NO: 1194938 - RNA, 22 nt, Mycobacterium bovis subsp bovis AF2122/97
gacggcgccauuggcgucccgc

SEQ ID NO: 1194939 - RNA, 23 nt, Mycobacterium bovis subsp bovis AF2122/97
gacggcgccgcccacggggcgug

SEQ ID NO: 1194940 - RNA, 18 nt, Mycobacterium bovis subsp bovis AF2122/97
gacggcggcaagggcggc

SEQ ID NO: 1194941 - RNA, 24 nt, Mycobacterium bovis subsp bovis AF2122/97
gacggcggcacgggcggccauggc

SEQ ID NO: 1194942 - RNA, 20 nt, Mycobacterium bovis subsp bovis AF2122/97
gacggcucagcgugcgcugg

SEQ ID NO: 1194943 - RNA, 13 nt, Mycobacterium bovis subsp bovis AF2122/97
gacggcugagaca

SEQ ID NO: 1194944 - RNA, 23 nt, Mycobacterium bovis subsp bovis AF2122/97
gacgggaaacuccgcggcgcgca

SEQ ID NO: 1194945 - RNA, 22 nt, Mycobacterium bovis subsp bovis AF2122/97
gacggcugccgucagccguucg

SEQ ID NO: 1194946 - RNA, 15 nt, Mycobacterium bovis subsp bovis AF2122/97
gacggguucacccug

SEQ ID NO: 1194947 - RNA, 19 nt, Mycobacterium bovis subsp bovis AF2122/97
gacggucaaaugaauggug

SEQ ID NO: 1194948 - RNA, 17 nt, Mycobacterium bovis subsp bovis AF2122/97
gacggucaaggugcgcc

SEQ ID NO: 1194949 - RNA, 14 nt, Mycobacterium bovis subsp bovis AF2122/97
gacggucacggugg

SEQ ID NO: 1194950 - RNA, 14 nt, Mycobacterium bovis subsp bovis AF2122/97
gacggucagccgcg

SEQ ID NO: 1194951 - RNA, 20 nt, Mycobacterium bovis subsp bovis AF2122/97
gacggucaaggugcgccgcc

SEQ ID NO: 1194952 - RNA, 14 nt, Mycobacterium bovis subsp bovis AF2122/97
gacggugauggggg

SEQ ID NO: 1194953 - RNA, 14 nt, Mycobacterium bovis subsp bovis AF2122/97
gacggucgucgauc

SEQ ID NO: 1194954 - RNA, 13 nt, Mycobacterium bovis subsp bovis AF2122/97
gacgguccguucg

SEQ ID NO: 1194955 - RNA, 21 nt, Mycobacterium bovis subsp bovis AF2122/97
gacgguccguucgaugccagu

SEQ ID NO: 1194956 - RNA, 20 nt, Mycobacterium bovis subsp bovis AF2122/97
gacggugcaggaccagaacu

SEQ ID NO: 1194957 - RNA, 13 nt, Mycobacterium bovis subsp bovis AF2122/97
gacggugccgucg

SEQ ID NO: 1194958 - RNA, 16 nt, Mycobacterium bovis subsp bovis AF2122/97
gacguagggcagcgcc

SEQ ID NO: 1194959 - RNA, 18 nt, Mycobacterium bovis subsp bovis AF2122/97
gacguauucguuggggcu

SEQ ID NO: 1194960 - RNA, 15 nt, Mycobacterium bovis subsp bovis AF2122/97
gacguauuggcgcag

SEQ ID NO: 1194961 - RNA, 15 nt, Mycobacterium bovis subsp bovis AF2122/97
gacguaggcggcggc

SEQ ID NO: 1194962 - RNA, 16 nt, Mycobacterium bovis subsp bovis AF2122/97
gacguacagcgcggcg

SEQ ID NO: 1194963 - RNA, 20 nt, Mycobacterium bovis subsp bovis AF2122/97
gacguagaagucgaucgccg

SEQ ID NO: 1194964 - RNA, 22 nt, Mycobacterium bovis subsp bovis AF2122/97
gacgguugguccgccgucgacc

SEQ ID NO: 1194965 - RNA, 22 nt, Mycobacterium bovis subsp bovis AF2122/97
gacgguggugaccgcgggcgcc

SEQ ID NO: 1194966 - RNA, 11 nt, Mycobacterium bovis subsp bovis AF2122/97
gacggugguga

SEQ ID NO: 1194967 - RNA, 15 nt, Mycobacterium bovis subsp bovis AF2122/97
gacgugcaggaacac

SEQ ID NO: 1194968 - RNA, 17 nt, Mycobacterium bovis subsp bovis AF2122/97
gacgugccggucccccc

SEQ ID NO: 1194969 - RNA, 19 nt, Mycobacterium bovis subsp bovis AF2122/97
gacgugccgguccccccgu

SEQ ID NO: 1194970 - RNA, 19 nt, Mycobacterium bovis subsp bovis AF2122/97
gacgucuuggaacacggcc

SEQ ID NO: 1194971 - RNA, 19 nt, Mycobacterium bovis subsp bovis AF2122/97
gacgugaagaugcccuucg

SEQ ID NO: 1194972 - RNA, 14 nt, Mycobacterium bovis subsp bovis AF2122/97
gacgugaagcagac

SEQ ID NO: 1194973 - RNA, 17 nt, Mycobacterium bovis subsp bovis AF2122/97
gacgugaaugguggugu

SEQ ID NO: 1194974 - RNA, 23 nt, Mycobacterium bovis subsp bovis AF2122/97
gacguggugggcuuggcuguggu

SEQ ID NO: 1194975 - RNA, 19 nt, Mycobacterium bovis subsp bovis AF2122/97
gacgucggcaucggcggcg

SEQ ID NO: 1194976 - RNA, 20 nt, Mycobacterium bovis subsp bovis AF2122/97
gacgucgucgaauccugccg

SEQ ID NO: 1194977 - RNA, 15 nt, Mycobacterium bovis subsp bovis AF2122/97
gacgucguggcgcuc

SEQ ID NO: 1194978 - RNA, 12 nt, Mycobacterium bovis subsp bovis AF2122/97
gacgucugccag

SEQ ID NO: 1194979 - RNA, 15 nt, Mycobacterium bovis subsp bovis AF2122/97
gacgucugccaggcg

SEQ ID NO: 1194980 - RNA, 13 nt, Mycobacterium bovis subsp bovis AF2122/97
gacgucaggcuga

SEQ ID NO: 1194981 - RNA, 15 nt, Mycobacterium bovis subsp bovis AF2122/97
gacgucagcaccauc

SEQ ID NO: 1194982 - RNA, 18 nt, Mycobacterium bovis subsp bovis AF2122/97
gacgucaggcagcuccgc

SEQ ID NO: 1194983 - RNA, 13 nt, Mycobacterium bovis subsp bovis AF2122/97
gacguccaucccg

SEQ ID NO: 1194984 - RNA, 23 nt, Mycobacterium bovis subsp bovis AF2122/97
gacgucgacgccggccagcggcc

SEQ ID NO: 1194985 - RNA, 15 nt, Mycobacterium bovis subsp bovis AF2122/97
gacguucuugggacc

SEQ ID NO: 1194986 - RNA, 21 nt, Mycobacterium bovis subsp bovis AF2122/97
gacguugccgaagccggaugc

SEQ ID NO: 1194987 - RNA, 13 nt, Mycobacterium bovis subsp bovis AF2122/97
gacguugaagccg

SEQ ID NO: 1194988 - RNA, 11 nt, Mycobacterium bovis subsp bovis AF2122/97
gacguugcgua

SEQ ID NO: 1194989 - RNA, 17 nt, Mycobacterium bovis subsp bovis AF2122/97
gacguugugccuuagcu

SEQ ID NO: 1194990 - RNA, 18 nt, Mycobacterium bovis subsp bovis AF2122/97
gacucugcgucugcucac

SEQ ID NO: 1194991 - RNA, 17 nt, Mycobacterium bovis subsp bovis AF2122/97
gacucugccacccagca

SEQ ID NO: 1194992 - RNA, 22 nt, Mycobacterium bovis subsp bovis AF2122/97
gacucgugucugccucggggcc

SEQ ID NO: 1194993 - RNA, 19 nt, Mycobacterium bovis subsp bovis AF2122/97
gacucgucgaugcgguggu

SEQ ID NO: 1194994 - RNA, 18 nt, Mycobacterium bovis subsp bovis AF2122/97
gacucgucgcaucaccag

SEQ ID NO: 1194995 - RNA, 20 nt, Mycobacterium bovis subsp bovis AF2122/97
gacucgguugaggacgaggu

SEQ ID NO: 1194996 - RNA, 19 nt, Mycobacterium bovis subsp bovis AF2122/97
gacugauccucgaugacau

SEQ ID NO: 1194997 - RNA, 20 nt, Mycobacterium bovis subsp bovis AF2122/97
gacugaccgucugcgacccg

SEQ ID NO: 1194998 - RNA, 19 nt, Mycobacterium bovis subsp bovis AF2122/97
gacugaaucgaccggaacu

SEQ ID NO: 1194999 - RNA, 16 nt, Mycobacterium bovis subsp bovis AF2122/97
gacuggcaccgccagc

SEQ ID NO: 1195000 - RNA, 14 nt, Mycobacterium bovis subsp bovis AF2122/97
gacugcuggggguc

SEQ ID NO: 1195001 - RNA, 13 nt, Mycobacterium bovis subsp bovis AF2122/97
gacugcgcggcuu

SEQ ID NO: 1195002 - RNA, 14 nt, Mycobacterium bovis subsp bovis AF2122/97
gacugcgccgccgg

SEQ ID NO: 1195003 - RNA, 13 nt, Mycobacterium bovis subsp bovis AF2122/97
gacugcgccgccg

SEQ ID NO: 1195004 - RNA, 16 nt, Mycobacterium bovis subsp bovis AF2122/97
gacugcgucggcggcu

SEQ ID NO: 1195005 - RNA, 16 nt, Mycobacterium bovis subsp bovis AF2122/97
gacugcgaaugcuggg

SEQ ID NO: 1195006 - RNA, 17 nt, Mycobacterium bovis subsp bovis AF2122/97
gacugccguucagcggc

SEQ ID NO: 1195007 - RNA, 16 nt, Mycobacterium bovis subsp bovis AF2122/97
gacugcagcccugcgc

SEQ ID NO: 1195008 - RNA, 14 nt, Mycobacterium bovis subsp bovis AF2122/97
gacugcacaccacc

SEQ ID NO: 1195009 - RNA, 22 nt, Mycobacterium bovis subsp bovis AF2122/97
gacugaucugugggugguugug

SEQ ID NO: 1195010 - RNA, 13 nt, Mycobacterium bovis subsp bovis AF2122/97
gacugcaccuggc

SEQ ID NO: 1195011 - RNA, 18 nt, Mycobacterium bovis subsp bovis AF2122/97
gacugcagaaacagccgc

SEQ ID NO: 1195012 - RNA, 21 nt, Mycobacterium bovis subsp bovis AF2122/97
gacugcagaaacagccgcagc

SEQ ID NO: 1195013 - RNA, 22 nt, Mycobacterium bovis subsp bovis AF2122/97
gacugcagaaacagccgcagcg

SEQ ID NO: 1195014 - RNA, 14 nt, Mycobacterium bovis subsp bovis AF2122/97
gacugcagcccugc

SEQ ID NO: 1195015 - RNA, 22 nt, Mycobacterium bovis subsp bovis AF2122/97
gacugcagcccugcgcagccgc

SEQ ID NO: 1195016 - RNA, 15 nt, Mycobacterium bovis subsp bovis AF2122/97
gacugcagcgaagcc

SEQ ID NO: 1195017 - RNA, 20 nt, Mycobacterium bovis subsp bovis AF2122/97
gacuccagcaaggccagcac

SEQ ID NO: 1195018 - RNA, 20 nt, Mycobacterium bovis subsp bovis AF2122/97
gacuccagcaccagcacggc

SEQ ID NO: 1195019 - RNA, 22 nt, Mycobacterium bovis subsp bovis AF2122/97
gacuccaaagccgugccagccc

SEQ ID NO: 1195020 - RNA, 21 nt, Mycobacterium bovis subsp bovis AF2122/97
gacucaccgugaaccgcccgc

SEQ ID NO: 1195021 - RNA, 15 nt, Mycobacterium bovis subsp bovis AF2122/97
gacucacgcagcgcc

SEQ ID NO: 1195022 - RNA, 18 nt, Mycobacterium bovis subsp bovis AF2122/97
gacucaggucggugcggu

SEQ ID NO: 1195023 - RNA, 12 nt, Mycobacterium bovis subsp bovis AF2122/97
gacuccugcggc

SEQ ID NO: 1195024 - RNA, 22 nt, Mycobacterium bovis subsp bovis AF2122/97
gacucccccucuaccuccgcca

SEQ ID NO: 1195025 - RNA, 17 nt, Mycobacterium bovis subsp bovis AF2122/97
gacuccgcgcgcugggc

SEQ ID NO: 1195026 - RNA, 23 nt, Mycobacterium bovis subsp bovis AF2122/97
gacuccggcaagcacaccgccag

SEQ ID NO: 1195027 - RNA, 16 nt, Mycobacterium bovis subsp bovis AF2122/97
gacuccggccgcacgc

SEQ ID NO: 1195028 - RNA, 15 nt, Mycobacterium bovis subsp bovis AF2122/97
gacucgcggucgaca

SEQ ID NO: 1195029 - RNA, 21 nt, Mycobacterium bovis subsp bovis AF2122/97
gacucggucucauagugcagg

SEQ ID NO: 1195030 - RNA, 17 nt, Mycobacterium bovis subsp bovis AF2122/97
gacucggcaccgcggcc

SEQ ID NO: 1195031 - RNA, 17 nt, Mycobacterium bovis subsp bovis AF2122/97
gacucggccgcaccagc

SEQ ID NO: 1195032 - RNA, 18 nt, Mycobacterium bovis subsp bovis AF2122/97
gacucggacgcgccggcg

SEQ ID NO: 1195033 - RNA, 20 nt, Mycobacterium bovis subsp bovis AF2122/97
gacuaccgccggcggcggcc

SEQ ID NO: 1195034 - RNA, 18 nt, Mycobacterium bovis subsp bovis AF2122/97
gacuagcuggggucaaag

SEQ ID NO: 1195035 - RNA, 21 nt, Mycobacterium bovis subsp bovis AF2122/97
gacuucgauggugugcccgca

SEQ ID NO: 1195036 - RNA, 18 nt, Mycobacterium bovis subsp bovis AF2122/97
gacuuccgcgucgccggc

SEQ ID NO: 1195037 - RNA, 15 nt, Mycobacterium bovis subsp bovis AF2122/97
gacuucacucguuga

SEQ ID NO: 1195038 - RNA, 18 nt, Mycobacterium bovis subsp bovis AF2122/97
gacuugcaggcgucccag

SEQ ID NO: 1195039 - RNA, 14 nt, Mycobacterium bovis subsp bovis AF2122/97
gacuugagcggcuu

SEQ ID NO: 1195040 - RNA, 14 nt, Mycobacterium bovis subsp bovis AF2122/97
gacuugcuggcccg

SEQ ID NO: 1195041 - RNA, 22 nt, Mycobacterium bovis subsp bovis AF2122/97
gacuucggaaaggucggccugc

SEQ ID NO: 1195042 - RNA, 18 nt, Mycobacterium bovis subsp bovis AF2122/97
gacuucggggucaccggc

SEQ ID NO: 1195043 - RNA, 23 nt, Mycobacterium bovis subsp bovis AF2122/97
gacuggugccugccgcacguucg

SEQ ID NO: 1195044 - RNA, 20 nt, Mycobacterium bovis subsp bovis AF2122/97
gacuggcgugaacguucuuc

SEQ ID NO: 1195045 - RNA, 23 nt, Mycobacterium bovis subsp bovis AF2122/97
gacuggccgcccggcgagcaggg

SEQ ID NO: 1195046 - RNA, 21 nt, Mycobacterium bovis subsp bovis AF2122/97
gacuggguggugcucaccucc

SEQ ID NO: 1195047 - RNA, 12 nt, Mycobacterium bovis subsp bovis AF2122/97
gacuguggcgcc

SEQ ID NO: 1195048 - RNA, 17 nt, Mycobacterium bovis subsp bovis AF2122/97
gacugugcgccgcagcc

SEQ ID NO: 1195049 - RNA, 17 nt, Mycobacterium bovis subsp bovis AF2122/97
gacuugugccacuucuu

SEQ ID NO: 1195050 - RNA, 19 nt, Mycobacterium bovis subsp bovis AF2122/97
gacuuguccaucacaucca

SEQ ID NO: 1195051 - RNA, 14 nt, Mycobacterium bovis subsp bovis AF2122/97
gacuuggccagcag

SEQ ID NO: 1195052 - RNA, 17 nt, Mycobacterium bovis subsp bovis AF2122/97
gacuugguugccgccuu

SEQ ID NO: 1195053 - RNA, 22 nt, Mycobacterium bovis subsp bovis AF2122/97
gacuugguuucgaugaagacgu

SEQ ID NO: 1195054 - RNA, 14 nt, Mycobacterium bovis subsp bovis AF2122/97
gagaaauggcccga

SEQ ID NO: 1195055 - RNA, 18 nt, Mycobacterium bovis subsp bovis AF2122/97
gagacgguguugccuaag

SEQ ID NO: 1195056 - RNA, 14 nt, Mycobacterium bovis subsp bovis AF2122/97
gagacuccagcaag

SEQ ID NO: 1195057 - RNA, 12 nt, Mycobacterium bovis subsp bovis AF2122/97
gagacugccgcc

SEQ ID NO: 1195058 - RNA, 12 nt, Mycobacterium bovis subsp bovis AF2122/97
gagaccccgcgc

SEQ ID NO: 1195059 - RNA, 21 nt, Mycobacterium bovis subsp bovis AF2122/97
gagaccgccucgucgaugccu

SEQ ID NO: 1195060 - RNA, 17 nt, Mycobacterium bovis subsp bovis AF2122/97
gagaccgcggccggccg

SEQ ID NO: 1195061 - RNA, 20 nt, Mycobacterium bovis subsp bovis AF2122/97
gagaccggccgggugaacca

SEQ ID NO: 1195062 - RNA, 21 nt, Mycobacterium bovis subsp bovis AF2122/97
gagaccucgucgucgaaguug

SEQ ID NO: 1195063 - RNA, 21 nt, Mycobacterium bovis subsp bovis AF2122/97
gagacgcaugucgggccaggc

SEQ ID NO: 1195064 - RNA, 16 nt, Mycobacterium bovis subsp bovis AF2122/97
gagacgcuccaguggc

SEQ ID NO: 1195065 - RNA, 13 nt, Mycobacterium bovis subsp bovis AF2122/97
gagacgaucgcca

SEQ ID NO: 1195066 - RNA, 18 nt, Mycobacterium bovis subsp bovis AF2122/97
gagacgcaaaaucgcccg

SEQ ID NO: 1195067 - RNA, 18 nt, Mycobacterium bovis subsp bovis AF2122/97
gagaccuucgggguaguu

SEQ ID NO: 1195068 - RNA, 15 nt, Mycobacterium bovis subsp bovis AF2122/97
gagaggcggugcagc

SEQ ID NO: 1195069 - RNA, 13 nt, Mycobacterium bovis subsp bovis AF2122/97
gagagccucggcc

SEQ ID NO: 1195070 - RNA, 22 nt, Mycobacterium bovis subsp bovis AF2122/97
gagagaucgucgacccaccaug

SEQ ID NO: 1195071 - RNA, 22 nt, Mycobacterium bovis subsp bovis AF2122/97
gagagcacugggcuggccagca

SEQ ID NO: 1195072 - RNA, 13 nt, Mycobacterium bovis subsp bovis AF2122/97
gagagcagccagc

SEQ ID NO: 1195073 - RNA, 19 nt, Mycobacterium bovis subsp bovis AF2122/97
gagagccccgaccagcaga

SEQ ID NO: 1195074 - RNA, 19 nt, Mycobacterium bovis subsp bovis AF2122/97
gagagccaaaggcggcuug

SEQ ID NO: 1195075 - RNA, 17 nt, Mycobacterium bovis subsp bovis AF2122/97
gagagcaugguccagca

SEQ ID NO: 1195076 - RNA, 17 nt, Mycobacterium bovis subsp bovis AF2122/97
gagaagguuucccgcuu

SEQ ID NO: 1195077 - RNA, 20 nt, Mycobacterium bovis subsp bovis AF2122/97
gagaacucaauaguguguuu

SEQ ID NO: 1195078 - RNA, 17 nt, Mycobacterium bovis subsp bovis AF2122/97
gagaacucugcgagaug

SEQ ID NO: 1195079 - RNA, 15 nt, Mycobacterium bovis subsp bovis AF2122/97
gagaacguagggugg

SEQ ID NO: 1195080 - RNA, 18 nt, Mycobacterium bovis subsp bovis AF2122/97
gagaacgcccgcugcaga

SEQ ID NO: 1195081 - RNA, 16 nt, Mycobacterium bovis subsp bovis AF2122/97
gagaacgcccgaguga

SEQ ID NO: 1195082 - RNA, 19 nt, Mycobacterium bovis subsp bovis AF2122/97
gagaacgcccgagugacca

SEQ ID NO: 1195083 - RNA, 21 nt, Mycobacterium bovis subsp bovis AF2122/97
gagacagcgccaugcccucgg

SEQ ID NO: 1195084 - RNA, 19 nt, Mycobacterium bovis subsp bovis AF2122/97
gagaaugcugacggugcag

SEQ ID NO: 1195085 - RNA, 21 nt, Mycobacterium bovis subsp bovis AF2122/97
gagaaugcugacggugcagga

SEQ ID NO: 1195086 - RNA, 16 nt, Mycobacterium bovis subsp bovis AF2122/97
gaccggcucggcggug

SEQ ID NO: 1195087 - RNA, 15 nt, Mycobacterium bovis subsp bovis AF2122/97
gaccggcucgucggg

SEQ ID NO: 1195088 - RNA, 17 nt, Mycobacterium bovis subsp bovis AF2122/97
gaccggcuuccccagca

SEQ ID NO: 1195089 - RNA, 19 nt, Mycobacterium bovis subsp bovis AF2122/97
gaccggcuuccccagcagu

SEQ ID NO: 1195090 - RNA, 22 nt, Mycobacterium bovis subsp bovis AF2122/97
gaccggcuuccccagcaguucg

SEQ ID NO: 1195091 - RNA, 19 nt, Mycobacterium bovis subsp bovis AF2122/97
gaccggcuaccggcguguc

SEQ ID NO: 1195092 - RNA, 20 nt, Mycobacterium bovis subsp bovis AF2122/97
gaccggccaacgccgccgca

SEQ ID NO: 1195093 - RNA, 18 nt, Mycobacterium bovis subsp bovis AF2122/97
gaccggccuggcucgucc

SEQ ID NO: 1195094 - RNA, 13 nt, Mycobacterium bovis subsp bovis AF2122/97
gaccggcgggcag

SEQ ID NO: 1195095 - RNA, 14 nt, Mycobacterium bovis subsp bovis AF2122/97
gaccggcaauuccg

SEQ ID NO: 1195096 - RNA, 23 nt, Mycobacterium bovis subsp bovis AF2122/97
gaccggacaaacaucgcacccac

SEQ ID NO: 1195097 - RNA, 16 nt, Mycobacterium bovis subsp bovis AF2122/97
gaccggcaggccggcg

SEQ ID NO: 1195098 - RNA, 20 nt, Mycobacterium bovis subsp bovis AF2122/97
gaccggaucugacggcgccg

SEQ ID NO: 1195099 - RNA, 18 nt, Mycobacterium bovis subsp bovis AF2122/97
gaccggaacguuccugca

SEQ ID NO: 1195100 - RNA, 23 nt, Mycobacterium bovis subsp bovis AF2122/97
gaccgggucgucauacagcgccc

SEQ ID NO: 1195101 - RNA, 17 nt, Mycobacterium bovis subsp bovis AF2122/97
gaccgggcucuggccag

SEQ ID NO: 1195102 - RNA, 16 nt, Mycobacterium bovis subsp bovis AF2122/97
gaccgggcuggccagc

SEQ ID NO: 1195103 - RNA, 21 nt, Mycobacterium bovis subsp bovis AF2122/97
gaccggggcgcccggccaggu

SEQ ID NO: 1195104 - RNA, 18 nt, Mycobacterium bovis subsp bovis AF2122/97
gaccggucacccgugcuu

SEQ ID NO: 1195105 - RNA, 17 nt, Mycobacterium bovis subsp bovis AF2122/97
gaccggcuugccgccgu

SEQ ID NO: 1195106 - RNA, 21 nt, Mycobacterium bovis subsp bovis AF2122/97
gaccggcuugcccuccgggua

SEQ ID NO: 1195107 - RNA, 18 nt, Mycobacterium bovis subsp bovis AF2122/97
gaccggucuggcgaugac

SEQ ID NO: 1195108 - RNA, 19 nt, Mycobacterium bovis subsp bovis AF2122/97
gaccgguccagccaacggg

SEQ ID NO: 1195109 - RNA, 22 nt, Mycobacterium bovis subsp bovis AF2122/97
gaccgguaauccguugccguug

SEQ ID NO: 1195110 - RNA, 16 nt, Mycobacterium bovis subsp bovis AF2122/97
gaccggugccagcagu

SEQ ID NO: 1195111 - RNA, 15 nt, Mycobacterium bovis subsp bovis AF2122/97
gaccggugcugucga

SEQ ID NO: 1195112 - RNA, 16 nt, Mycobacterium bovis subsp bovis AF2122/97
gaccguauugaccagc

SEQ ID NO: 1195113 - RNA, 18 nt, Mycobacterium bovis subsp bovis AF2122/97
gaccgucacaagucgaca

SEQ ID NO: 1195114 - RNA, 19 nt, Mycobacterium bovis subsp bovis AF2122/97
gaccgucacgcguacgucg

SEQ ID NO: 1195115 - RNA, 19 nt, Mycobacterium bovis subsp bovis AF2122/97
gaccgcgcacggcuggcgu

SEQ ID NO: 1195116 - RNA, 20 nt, Mycobacterium bovis subsp bovis AF2122/97
gaccgcgccaacagaugcca

SEQ ID NO: 1195117 - RNA, 15 nt, Mycobacterium bovis subsp bovis AF2122/97
gaccgcgcccagacc

SEQ ID NO: 1195118 - RNA, 19 nt, Mycobacterium bovis subsp bovis AF2122/97
gaccgcggucuucuucacc

SEQ ID NO: 1195119 - RNA, 18 nt, Mycobacterium bovis subsp bovis AF2122/97
gaccgcgggcgccuucca

SEQ ID NO: 1195120 - RNA, 20 nt, Mycobacterium bovis subsp bovis AF2122/97
gaccgcggggcagcgggccg

SEQ ID NO: 1195121 - RNA, 15 nt, Mycobacterium bovis subsp bovis AF2122/97
gaccgcgggucgugc

SEQ ID NO: 1195122 - RNA, 22 nt, Mycobacterium bovis subsp bovis AF2122/97
gaccgcggcugucacgccugcc

SEQ ID NO: 1195123 - RNA, 23 nt, Mycobacterium bovis subsp bovis AF2122/97
gaccgcggcugucacgccugcca

SEQ ID NO: 1195124 - RNA, 14 nt, Mycobacterium bovis subsp bovis AF2122/97
gaccgcggccuugg

SEQ ID NO: 1195125 - RNA, 16 nt, Mycobacterium bovis subsp bovis AF2122/97
gaccgcucugcggcca

SEQ ID NO: 1195126 - RNA, 13 nt, Mycobacterium bovis subsp bovis AF2122/97
gaccgcugcccag

SEQ ID NO: 1195127 - RNA, 23 nt, Mycobacterium bovis subsp bovis AF2122/97
gaccgcguuuugcaggcccgagu

SEQ ID NO: 1195128 - RNA, 20 nt, Mycobacterium bovis subsp bovis AF2122/97
gaccgcgggucgugccagca

SEQ ID NO: 1195129 - RNA, 16 nt, Mycobacterium bovis subsp bovis AF2122/97
gaccgcgucggcggcc

SEQ ID NO: 1195130 - RNA, 17 nt, Mycobacterium bovis subsp bovis AF2122/97
gaccgcgucgucccagu

SEQ ID NO: 1195131 - RNA, 22 nt, Mycobacterium bovis subsp bovis AF2122/97
gaccgcuggugugucccggggu

SEQ ID NO: 1195132 - RNA, 19 nt, Mycobacterium bovis subsp bovis AF2122/97
gaccgcgacggcgccggca

SEQ ID NO: 1195133 - RNA, 15 nt, Mycobacterium bovis subsp bovis AF2122/97
gaccgcgauccccac

SEQ ID NO: 1195134 - RNA, 20 nt, Mycobacterium bovis subsp bovis AF2122/97
gaccgcgaucgccgacgcca

SEQ ID NO: 1195135 - RNA, 14 nt, Mycobacterium bovis subsp bovis AF2122/97
gaccgcgacccggc

SEQ ID NO: 1195136 - RNA, 14 nt, Mycobacterium bovis subsp bovis AF2122/97
gaccgccuccucga

SEQ ID NO: 1195137 - RNA, 22 nt, Mycobacterium bovis subsp bovis AF2122/97
gaccgccuccucgauagcggcg

SEQ ID NO: 1195138 - RNA, 18 nt, Mycobacterium bovis subsp bovis AF2122/97
gaccgccggaccgccgca

SEQ ID NO: 1195139 - RNA, 16 nt, Mycobacterium bovis subsp bovis AF2122/97
gaccgccuccaccgcc

SEQ ID NO: 1195140 - RNA, 12 nt, Mycobacterium bovis subsp bovis AF2122/97
gaccgccgccga

SEQ ID NO: 1195141 - RNA, 18 nt, Mycobacterium bovis subsp bovis AF2122/97
gaccgccgcuaccccagc

SEQ ID NO: 1195142 - RNA, 22 nt, Mycobacterium bovis subsp bovis AF2122/97
gaccgcccgugccgucgcccuu

SEQ ID NO: 1195143 - RNA, 18 nt, Mycobacterium bovis subsp bovis AF2122/97
gaccgccgaagaagguga

SEQ ID NO: 1195144 - RNA, 20 nt, Mycobacterium bovis subsp bovis AF2122/97
gaccgccccggccaggacau

SEQ ID NO: 1195145 - RNA, 22 nt, Mycobacterium bovis subsp bovis AF2122/97
gaccucgucaaucaccaccgcc

SEQ ID NO: 1195146 - RNA, 20 nt, Mycobacterium bovis subsp bovis AF2122/97
gaccucgucgcgucgccaga

SEQ ID NO: 1195147 - RNA, 18 nt, Mycobacterium bovis subsp bovis AF2122/97
gaccucguugcugccggc

SEQ ID NO: 1195148 - RNA, 13 nt, Mycobacterium bovis subsp bovis AF2122/97
gaccucgaccugg

SEQ ID NO: 1195149 - RNA, 20 nt, Mycobacterium bovis subsp bovis AF2122/97
gaccucgaagcccagcacca

SEQ ID NO: 1195150 - RNA, 18 nt, Mycobacterium bovis subsp bovis AF2122/97
gaccucggcaaccaccuc

SEQ ID NO: 1195151 - RNA, 21 nt, Mycobacterium bovis subsp bovis AF2122/97
gaccuagucaccuugaccggg

SEQ ID NO: 1195152 - RNA, 22 nt, Mycobacterium bovis subsp bovis AF2122/97
gaccuccucgaccagagccgcg

SEQ ID NO: 1195153 - RNA, 23 nt, Mycobacterium bovis subsp bovis AF2122/97
gaccuccucgaccagagccgcga

SEQ ID NO: 1195154 - RNA, 22 nt, Mycobacterium bovis subsp bovis AF2122/97
gaccuccggauaacccagcggc

SEQ ID NO: 1195155 - RNA, 16 nt, Mycobacterium bovis subsp bovis AF2122/97
gaccucccacccccgg

SEQ ID NO: 1195156 - RNA, 15 nt, Mycobacterium bovis subsp bovis AF2122/97
gaccgucguggcggu

SEQ ID NO: 1195157 - RNA, 18 nt, Mycobacterium bovis subsp bovis AF2122/97
gaccgucugcgacccggg

SEQ ID NO: 1195158 - RNA, 20 nt, Mycobacterium bovis subsp bovis AF2122/97
gaccgucggcuccaggucca

SEQ ID NO: 1195159 - RNA, 20 nt, Mycobacterium bovis subsp bovis AF2122/97
gaccgucccggccucgaugu

SEQ ID NO: 1195160 - RNA, 23 nt, Mycobacterium bovis subsp bovis AF2122/97
gaccgugacguagggcagcgcca

SEQ ID NO: 1195161 - RNA, 19 nt, Mycobacterium bovis subsp bovis AF2122/97
gaccgugccgucggcgugc

SEQ ID NO: 1195162 - RNA, 17 nt, Mycobacterium bovis subsp bovis AF2122/97
gaccguggcgccggucg

SEQ ID NO: 1195163 - RNA, 22 nt, Mycobacterium bovis subsp bovis AF2122/97
gaccguggcugcgcucgcccgc

SEQ ID NO: 1195164 - RNA, 19 nt, Mycobacterium bovis subsp bovis AF2122/97
gaccugcucauccaccucg

SEQ ID NO: 1195165 - RNA, 14 nt, Mycobacterium bovis subsp bovis AF2122/97
gaccugcucgcugg

SEQ ID NO: 1195166 - RNA, 17 nt, Mycobacterium bovis subsp bovis AF2122/97
gaccugcgagaucggau

SEQ ID NO: 1195167 - RNA, 21 nt, Mycobacterium bovis subsp bovis AF2122/97
gaccugaggcaccucggccuu

SEQ ID NO: 1195168 - RNA, 20 nt, Mycobacterium bovis subsp bovis AF2122/97
gaccugaugagcucaccggg

SEQ ID NO: 1195169 - RNA, 21 nt, Mycobacterium bovis subsp bovis AF2122/97
gaccucucugcgccaggcggc

SEQ ID NO: 1195170 - RNA, 20 nt, Mycobacterium bovis subsp bovis AF2122/97
gaccuggaacugcauggugg

SEQ ID NO: 1195171 - RNA, 13 nt, Mycobacterium bovis subsp bovis AF2122/97
gacccgcggcggg

SEQ ID NO: 1195172 - RNA, 21 nt, Mycobacterium bovis subsp bovis AF2122/97
gacccgcuggucgaugccuuc

SEQ ID NO: 1195173 - RNA, 15 nt, Mycobacterium bovis subsp bovis AF2122/97
gacccgaugacccac

SEQ ID NO: 1195174 - RNA, 16 nt, Mycobacterium bovis subsp bovis AF2122/97
gacccgcagaccgcca

SEQ ID NO: 1195175 - RNA, 12 nt, Mycobacterium bovis subsp bovis AF2122/97
gacccgccaggg

SEQ ID NO: 1195176 - RNA, 14 nt, Mycobacterium bovis subsp bovis AF2122/97
gacccggccggccc

SEQ ID NO: 1195177 - RNA, 22 nt, Mycobacterium bovis subsp bovis AF2122/97
gacccggcgaugcagccgggaa

SEQ ID NO: 1195178 - RNA, 20 nt, Mycobacterium bovis subsp bovis AF2122/97
gacccggaccuucggcggug

SEQ ID NO: 1195179 - RNA, 19 nt, Mycobacterium bovis subsp bovis AF2122/97
gacccugggguccagcguc

SEQ ID NO: 1195180 - RNA, 18 nt, Mycobacterium bovis subsp bovis AF2122/97
gacccugcugcagggccu

SEQ ID NO: 1195181 - RNA, 14 nt, Mycobacterium bovis subsp bovis AF2122/97
gacccuuccgccgc

SEQ ID NO: 1195182 - RNA, 16 nt, Mycobacterium bovis subsp bovis AF2122/97
gacccugcccagcacc

SEQ ID NO: 1195183 - RNA, 19 nt, Mycobacterium bovis subsp bovis AF2122/97
gacccugcgccgccacagc

SEQ ID NO: 1195184 - RNA, 14 nt, Mycobacterium bovis subsp bovis AF2122/97
gacccuccagcacg

SEQ ID NO: 1195185 - RNA, 14 nt, Mycobacterium bovis subsp bovis AF2122/97
gacccgggaaggaa

SEQ ID NO: 1195186 - RNA, 21 nt, Mycobacterium bovis subsp bovis AF2122/97
gacccggggacgcccgugcgg

SEQ ID NO: 1195187 - RNA, 12 nt, Mycobacterium bovis subsp bovis AF2122/97
gacccggggccg

SEQ ID NO: 1195188 - RNA, 15 nt, Mycobacterium bovis subsp bovis AF2122/97
gacccguuccacgcc

SEQ ID NO: 1195189 - RNA, 18 nt, Mycobacterium bovis subsp bovis AF2122/97
gaccgagcuuccaaaccc

SEQ ID NO: 1195190 - RNA, 14 nt, Mycobacterium bovis subsp bovis AF2122/97
gaccgagacuugcu

SEQ ID NO: 1195191 - RNA, 13 nt, Mycobacterium bovis subsp bovis AF2122/97
gaccgauaacacc

SEQ ID NO: 1195192 - RNA, 15 nt, Mycobacterium bovis subsp bovis AF2122/97
gaccgauaacacccg

SEQ ID NO: 1195193 - RNA, 18 nt, Mycobacterium bovis subsp bovis AF2122/97
gaccgaucuuggccaccg

SEQ ID NO: 1195194 - RNA, 20 nt, Mycobacterium bovis subsp bovis AF2122/97
gaccgaccgcacgaccagcu

SEQ ID NO: 1195195 - RNA, 17 nt, Mycobacterium bovis subsp bovis AF2122/97
gaccgaauggccgccgc

SEQ ID NO: 1195196 - RNA, 14 nt, Mycobacterium bovis subsp bovis AF2122/97
gaccgacaccacca

SEQ ID NO: 1195197 - RNA, 17 nt, Mycobacterium bovis subsp bovis AF2122/97
gaccgaaagccgcacca

SEQ ID NO: 1195198 - RNA, 18 nt, Mycobacterium bovis subsp bovis AF2122/97
gaccgccagcggccgcuc

SEQ ID NO: 1195199 - RNA, 18 nt, Mycobacterium bovis subsp bovis AF2122/97
gaccgccauuucgcccga

SEQ ID NO: 1195200 - RNA, 19 nt, Mycobacterium bovis subsp bovis AF2122/97
gaccgccaccccgcuugga

SEQ ID NO: 1195201 - RNA, 21 nt, Mycobacterium bovis subsp bovis AF2122/97
gaccgcauccggucucggccg

SEQ ID NO: 1195202 - RNA, 18 nt, Mycobacterium bovis subsp bovis AF2122/97
gaccgcaucgucgagcca

SEQ ID NO: 1195203 - RNA, 19 nt, Mycobacterium bovis subsp bovis AF2122/97
gaccgcaucgucgagccac

SEQ ID NO: 1195204 - RNA, 16 nt, Mycobacterium bovis subsp bovis AF2122/97
gaccgccacacggggc

SEQ ID NO: 1195205 - RNA, 11 nt, Mycobacterium bovis subsp bovis AF2122/97
gaccgccaccc

SEQ ID NO: 1195206 - RNA, 12 nt, Mycobacterium bovis subsp bovis AF2122/97
gaccgccacccc

SEQ ID NO: 1195207 - RNA, 15 nt, Mycobacterium bovis subsp bovis AF2122/97
gaccgcaccggccgc

SEQ ID NO: 1195208 - RNA, 18 nt, Mycobacterium bovis subsp bovis AF2122/97
gaccgcaacgacggccgu

SEQ ID NO: 1195209 - RNA, 15 nt, Mycobacterium bovis subsp bovis AF2122/97
gaccgcacgaccagc

SEQ ID NO: 1195210 - RNA, 23 nt, Mycobacterium bovis subsp bovis AF2122/97
gaccccgcgcgcuugggcacuuc

SEQ ID NO: 1195211 - RNA, 22 nt, Mycobacterium bovis subsp bovis AF2122/97
gaccccgcuuuuucccggcggc

SEQ ID NO: 1195212 - RNA, 23 nt, Mycobacterium bovis subsp bovis AF2122/97
gaccccgcuuuuucccggcggcg

SEQ ID NO: 1195213 - RNA, 15 nt, Mycobacterium bovis subsp bovis AF2122/97
gaccccggcagcgcc

SEQ ID NO: 1195214 - RNA, 21 nt, Mycobacterium bovis subsp bovis AF2122/97
gaccccggcagcgcccuugga

SEQ ID NO: 1195215 - RNA, 21 nt, Mycobacterium bovis subsp bovis AF2122/97
gaccccgacgaugcgcacucc

SEQ ID NO: 1195216 - RNA, 22 nt, Mycobacterium bovis subsp bovis AF2122/97
gaccccacacgccgaacgugca

SEQ ID NO: 1195217 - RNA, 19 nt, Mycobacterium bovis subsp bovis AF2122/97
gacccccugccacagcgac

SEQ ID NO: 1195218 - RNA, 16 nt, Mycobacterium bovis subsp bovis AF2122/97
gaccccgucagcgggc

SEQ ID NO: 1195219 - RNA, 23 nt, Mycobacterium bovis subsp bovis AF2122/97
gaccccgucagcgggcagcaggc

SEQ ID NO: 1195220 - RNA, 20 nt, Mycobacterium bovis subsp bovis AF2122/97
gaccccggcguugccgccgu

SEQ ID NO: 1195221 - RNA, 13 nt, Mycobacterium bovis subsp bovis AF2122/97
gaccccggugguc

SEQ ID NO: 1195222 - RNA, 17 nt, Mycobacterium bovis subsp bovis AF2122/97
gaccccuggccgccggc

SEQ ID NO: 1195223 - RNA, 20 nt, Mycobacterium bovis subsp bovis AF2122/97
gaccccuggccgccggcgcc

SEQ ID NO: 1195224 - RNA, 18 nt, Mycobacterium bovis subsp bovis AF2122/97
gacccgaauccaccagcu

SEQ ID NO: 1195225 - RNA, 17 nt, Mycobacterium bovis subsp bovis AF2122/97
gacccgacagccgcugc

SEQ ID NO: 1195226 - RNA, 15 nt, Mycobacterium bovis subsp bovis AF2122/97
gacccgaccgucguc

SEQ ID NO: 1195227 - RNA, 22 nt, Mycobacterium bovis subsp bovis AF2122/97
gacccgacgaugccggcccgca

SEQ ID NO: 1195228 - RNA, 18 nt, Mycobacterium bovis subsp bovis AF2122/97
gacccaucaugguccggg

SEQ ID NO: 1195229 - RNA, 15 nt, Mycobacterium bovis subsp bovis AF2122/97
gacccaucgccagca

SEQ ID NO: 1195230 - RNA, 21 nt, Mycobacterium bovis subsp bovis AF2122/97
gacccauucucggccggcggc

SEQ ID NO: 1195231 - RNA, 23 nt, Mycobacterium bovis subsp bovis AF2122/97
gacccauucucggccggcggcgc

SEQ ID NO: 1195232 - RNA, 12 nt, Mycobacterium bovis subsp bovis AF2122/97
gacccagcaccc

SEQ ID NO: 1195233 - RNA, 22 nt, Mycobacterium bovis subsp bovis AF2122/97
gacccagccagcagcggcgagc

SEQ ID NO: 1195234 - RNA, 22 nt, Mycobacterium bovis subsp bovis AF2122/97
gacccaccgccccggcggcggc

SEQ ID NO: 1195235 - RNA, 15 nt, Mycobacterium bovis subsp bovis AF2122/97
gaccaucgccaggcc

SEQ ID NO: 1195236 - RNA, 12 nt, Mycobacterium bovis subsp bovis AF2122/97
gacccaaagcac

SEQ ID NO: 1195237 - RNA, 22 nt, Mycobacterium bovis subsp bovis AF2122/97
gacccacauuccguagccggcg

SEQ ID NO: 1195238 - RNA, 17 nt, Mycobacterium bovis subsp bovis AF2122/97
gacccacccgcaccgcc

SEQ ID NO: 1195239 - RNA, 20 nt, Mycobacterium bovis subsp bovis AF2122/97
gacccaccgccccggcggcg

SEQ ID NO: 1195240 - RNA, 19 nt, Mycobacterium bovis subsp bovis AF2122/97
gaccaucacacccaucacc

SEQ ID NO: 1195241 - RNA, 21 nt, Mycobacterium bovis subsp bovis AF2122/97
gaccaucaccacggccgccga

SEQ ID NO: 1195242 - RNA, 19 nt, Mycobacterium bovis subsp bovis AF2122/97
gaccauagucgccgucgug

SEQ ID NO: 1195243 - RNA, 24 nt, Mycobacterium bovis subsp bovis AF2122/97
gacgcgcaggaagccggcgugcuc

SEQ ID NO: 1195244 - RNA, 19 nt, Mycobacterium bovis subsp bovis AF2122/97
gacgcgagugcgugaucug

SEQ ID NO: 1195245 - RNA, 19 nt, Mycobacterium bovis subsp bovis AF2122/97
gacgcgacacacgccgccg

SEQ ID NO: 1195246 - RNA, 20 nt, Mycobacterium bovis subsp bovis AF2122/97
gacgcgaaauccccugcgcu

SEQ ID NO: 1195247 - RNA, 19 nt, Mycobacterium bovis subsp bovis AF2122/97
gacgccuugcacaagcuga

SEQ ID NO: 1195248 - RNA, 15 nt, Mycobacterium bovis subsp bovis AF2122/97
gacgcgccggcgugc

SEQ ID NO: 1195249 - RNA, 12 nt, Mycobacterium bovis subsp bovis AF2122/97
gacgcgccgguu

SEQ ID NO: 1195250 - RNA, 22 nt, Mycobacterium bovis subsp bovis AF2122/97
gacgcggaaucgcaucggcggg

SEQ ID NO: 1195251 - RNA, 21 nt, Mycobacterium bovis subsp bovis AF2122/97
gacgccguagccggccggccc

SEQ ID NO: 1195252 - RNA, 22 nt, Mycobacterium bovis subsp bovis AF2122/97
gacgccgguggcagagccgccg

SEQ ID NO: 1195253 - RNA, 24 nt, Mycobacterium bovis subsp bovis AF2122/97
gacgccgucaugcccaucuccaac

SEQ ID NO: 1195254 - RNA, 16 nt, Mycobacterium bovis subsp bovis AF2122/97
gacgccguugccgccg

SEQ ID NO: 1195255 - RNA, 13 nt, Mycobacterium bovis subsp bovis AF2122/97
gacgccgccguug

SEQ ID NO: 1195256 - RNA, 14 nt, Mycobacterium bovis subsp bovis AF2122/97
gacgccgccggccc

SEQ ID NO: 1195257 - RNA, 15 nt, Mycobacterium bovis subsp bovis AF2122/97
gacgccgccggcccc

SEQ ID NO: 1195258 - RNA, 15 nt, Mycobacterium bovis subsp bovis AF2122/97
gacgccgcgcagccg

SEQ ID NO: 1195259 - RNA, 14 nt, Mycobacterium bovis subsp bovis AF2122/97
gacgccggccuggc

SEQ ID NO: 1195260 - RNA, 15 nt, Mycobacterium bovis subsp bovis AF2122/97
gacgccggccuggcc

SEQ ID NO: 1195261 - RNA, 22 nt, Mycobacterium bovis subsp bovis AF2122/97
gacgccggcggguggcccccgc

SEQ ID NO: 1195262 - RNA, 21 nt, Mycobacterium bovis subsp bovis AF2122/97
gacgccgcucccgcacaagcc

SEQ ID NO: 1195263 - RNA, 14 nt, Mycobacterium bovis subsp bovis AF2122/97
gacgccgacgauga

SEQ ID NO: 1195264 - RNA, 17 nt, Mycobacterium bovis subsp bovis AF2122/97
gacgccgagaccgccgc

SEQ ID NO: 1195265 - RNA, 19 nt, Mycobacterium bovis subsp bovis AF2122/97
gacgccgccacccggcggg

SEQ ID NO: 1195266 - RNA, 16 nt, Mycobacterium bovis subsp bovis AF2122/97
gacgccgccagcaccu

SEQ ID NO: 1195267 - RNA, 16 nt, Mycobacterium bovis subsp bovis AF2122/97
gacgcccagggcgucg

SEQ ID NO: 1195268 - RNA, 18 nt, Mycobacterium bovis subsp bovis AF2122/97
gacgcccaggcauggccu

SEQ ID NO: 1195269 - RNA, 13 nt, Mycobacterium bovis subsp bovis AF2122/97
gacgccagcugcc

SEQ ID NO: 1195270 - RNA, 19 nt, Mycobacterium bovis subsp bovis AF2122/97
gacgccaucugcuggcugg

SEQ ID NO: 1195271 - RNA, 20 nt, Mycobacterium bovis subsp bovis AF2122/97
gacgccaucugcuggcuggg

SEQ ID NO: 1195272 - RNA, 21 nt, Mycobacterium bovis subsp bovis AF2122/97
gacgccaucugcuggcuggga

SEQ ID NO: 1195273 - RNA, 20 nt, Mycobacterium bovis subsp bovis AF2122/97
gacgccauuguugggccgcc

SEQ ID NO: 1195274 - RNA, 16 nt, Mycobacterium bovis subsp bovis AF2122/97
gacgccaccgccacca

SEQ ID NO: 1195275 - RNA, 21 nt, Mycobacterium bovis subsp bovis AF2122/97
gacgccaccgccaccacccag

SEQ ID NO: 1195276 - RNA, 23 nt, Mycobacterium bovis subsp bovis AF2122/97
gacgccaccgccaccacccaggc

SEQ ID NO: 1195277 - RNA, 15 nt, Mycobacterium bovis subsp bovis AF2122/97
gacgccaacgccagc

SEQ ID NO: 1195278 - RNA, 21 nt, Mycobacterium bovis subsp bovis AF2122/97
gacgccaaugccgcggaggcg

SEQ ID NO: 1195279 - RNA, 17 nt, Mycobacterium bovis subsp bovis AF2122/97
gacgcauaagcccccgc

SEQ ID NO: 1195280 - RNA, 23 nt, Mycobacterium bovis subsp bovis AF2122/97
gacggccggcggucgggcccggc

SEQ ID NO: 1195281 - RNA, 12 nt, Mycobacterium bovis subsp bovis AF2122/97
gacggccgggac

SEQ ID NO: 1195282 - RNA, 21 nt, Mycobacterium bovis subsp bovis AF2122/97
gacggccuggggcagccgggc

SEQ ID NO: 1195283 - RNA, 19 nt, Mycobacterium bovis subsp bovis AF2122/97
gacggcgacgacaucugcc

SEQ ID NO: 1195284 - RNA, 21 nt, Mycobacterium bovis subsp bovis AF2122/97
gacggcgacgugaaugguggu

SEQ ID NO: 1195285 - RNA, 17 nt, Mycobacterium bovis subsp bovis AF2122/97
gacggcgaacccgccga

SEQ ID NO: 1195286 - RNA, 14 nt, Mycobacterium bovis subsp bovis AF2122/97
gacggccagcagga

SEQ ID NO: 1195287 - RNA, 15 nt, Mycobacterium bovis subsp bovis AF2122/97
gacggccagcccagc

SEQ ID NO: 1195288 - RNA, 22 nt, Mycobacterium bovis subsp bovis AF2122/97
gacggccacguaagcgguuguc

SEQ ID NO: 1195289 - RNA, 22 nt, Mycobacterium bovis subsp bovis AF2122/97
gacggcauguaccgaccgcguu

SEQ ID NO: 1195290 - RNA, 15 nt, Mycobacterium bovis subsp bovis AF2122/97
gacggccauauccaa

SEQ ID NO: 1195291 - RNA, 16 nt, Mycobacterium bovis subsp bovis AF2122/97
gacggccagcccagca

SEQ ID NO: 1195292 - RNA, 17 nt, Mycobacterium bovis subsp bovis AF2122/97
gacggccagugcgcaga

SEQ ID NO: 1195293 - RNA, 18 nt, Mycobacterium bovis subsp bovis AF2122/97
gacggccgccagcagcuu

SEQ ID NO: 1195294 - RNA, 16 nt, Mycobacterium bovis subsp bovis AF2122/97
gacggacuucccgcgc

SEQ ID NO: 1195295 - RNA, 14 nt, Mycobacterium bovis subsp bovis AF2122/97
gacggacucccucg

SEQ ID NO: 1195296 - RNA, 21 nt, Mycobacterium bovis subsp bovis AF2122/97
gacggcaagccauucacgagc

SEQ ID NO: 1195297 - RNA, 19 nt, Mycobacterium bovis subsp bovis AF2122/97
gacggcaagggcauacagc

SEQ ID NO: 1195298 - RNA, 14 nt, Mycobacterium bovis subsp bovis AF2122/97
gacggcagccagcc

SEQ ID NO: 1195299 - RNA, 19 nt, Mycobacterium bovis subsp bovis AF2122/97
gacggcaucaacgcgggcg

SEQ ID NO: 1195300 - RNA, 19 nt, Mycobacterium bovis subsp bovis AF2122/97
gacgcuaggacggcugccg

SEQ ID NO: 1195301 - RNA, 15 nt, Mycobacterium bovis subsp bovis AF2122/97
gacgcucgaccugcc

SEQ ID NO: 1195302 - RNA, 19 nt, Mycobacterium bovis subsp bovis AF2122/97
gacgcucgccgagcagaca

SEQ ID NO: 1195303 - RNA, 20 nt, Mycobacterium bovis subsp bovis AF2122/97
gacgcucgcugcagcagggc

SEQ ID NO: 1195304 - RNA, 16 nt, Mycobacterium bovis subsp bovis AF2122/97
gacgcucggucgccac

SEQ ID NO: 1195305 - RNA, 20 nt, Mycobacterium bovis subsp bovis AF2122/97
gacgcucggucgccaccgcc

SEQ ID NO: 1195306 - RNA, 14 nt, Mycobacterium bovis subsp bovis AF2122/97
gacgcggcgccgcc

SEQ ID NO: 1195307 - RNA, 19 nt, Mycobacterium bovis subsp bovis AF2122/97
gacgcggccggccgcccgc

SEQ ID NO: 1195308 - RNA, 16 nt, Mycobacterium bovis subsp bovis AF2122/97
gacgcggucggcggcc

SEQ ID NO: 1195309 - RNA, 20 nt, Mycobacterium bovis subsp bovis AF2122/97
gacgcggcggacaugcaccu

SEQ ID NO: 1195310 - RNA, 17 nt, Mycobacterium bovis subsp bovis AF2122/97
gacgcuguccaggucug

SEQ ID NO: 1195311 - RNA, 18 nt, Mycobacterium bovis subsp bovis AF2122/97
gacgcugcgcgccagaca

SEQ ID NO: 1195312 - RNA, 17 nt, Mycobacterium bovis subsp bovis AF2122/97
gacgcuguggcucgacg

SEQ ID NO: 1195313 - RNA, 16 nt, Mycobacterium bovis subsp bovis AF2122/97
gacgaccagccccgcu

SEQ ID NO: 1195314 - RNA, 23 nt, Mycobacterium bovis subsp bovis AF2122/97
gacgaccauacuaauggcgccac

SEQ ID NO: 1195315 - RNA, 19 nt, Mycobacterium bovis subsp bovis AF2122/97
gacgacauuggugcugaca

SEQ ID NO: 1195316 - RNA, 13 nt, Mycobacterium bovis subsp bovis AF2122/97
gacgaccagcaga

SEQ ID NO: 1195317 - RNA, 15 nt, Mycobacterium bovis subsp bovis AF2122/97
gacgaccagcagauc

SEQ ID NO: 1195318 - RNA, 15 nt, Mycobacterium bovis subsp bovis AF2122/97
gacgaccgcgcggca

SEQ ID NO: 1195319 - RNA, 23 nt, Mycobacterium bovis subsp bovis AF2122/97
gacgaccuugguguggggcggcu

SEQ ID NO: 1195320 - RNA, 15 nt, Mycobacterium bovis subsp bovis AF2122/97
gacgacgaucaagcc

SEQ ID NO: 1195321 - RNA, 14 nt, Mycobacterium bovis subsp bovis AF2122/97
gacgaccaaccacc

SEQ ID NO: 1195322 - RNA, 19 nt, Mycobacterium bovis subsp bovis AF2122/97
gacgacgaugaugccgucg

SEQ ID NO: 1195323 - RNA, 22 nt, Mycobacterium bovis subsp bovis AF2122/97
gacgacggcauuucagcgcgcc

SEQ ID NO: 1195324 - RNA, 19 nt, Mycobacterium bovis subsp bovis AF2122/97
gacgacgucgccgccgcgg

SEQ ID NO: 1195325 - RNA, 16 nt, Mycobacterium bovis subsp bovis AF2122/97
gacgacgucgggggcu

SEQ ID NO: 1195326 - RNA, 14 nt, Mycobacterium bovis subsp bovis AF2122/97
gacgaagaagaacu

SEQ ID NO: 1195327 - RNA, 15 nt, Mycobacterium bovis subsp bovis AF2122/97
gacgaaguucuccag

SEQ ID NO: 1195328 - RNA, 18 nt, Mycobacterium bovis subsp bovis AF2122/97
gacgaauccacuggucaa

SEQ ID NO: 1195329 - RNA, 22 nt, Mycobacterium bovis subsp bovis AF2122/97
gacgaauccacuggucaacggg

SEQ ID NO: 1195330 - RNA, 14 nt, Mycobacterium bovis subsp bovis AF2122/97
gacgacaacaggcc

SEQ ID NO: 1195331 - RNA, 18 nt, Mycobacterium bovis subsp bovis AF2122/97
gacgacaacaggccgucg

SEQ ID NO: 1195332 - RNA, 17 nt, Mycobacterium bovis subsp bovis AF2122/97
gacgacaaccggccaga

SEQ ID NO: 1195333 - RNA, 15 nt, Mycobacterium bovis subsp bovis AF2122/97
gacgacaccagagcg

SEQ ID NO: 1195334 - RNA, 16 nt, Mycobacterium bovis subsp bovis AF2122/97
gacgacaucugcccag

SEQ ID NO: 1195335 - RNA, 21 nt, Mycobacterium bovis subsp bovis AF2122/97
gaccuugguguggggcggcuu

SEQ ID NO: 1195336 - RNA, 17 nt, Mycobacterium bovis subsp bovis AF2122/97
gaccuuggugcccagca

SEQ ID NO: 1195337 - RNA, 23 nt, Mycobacterium bovis subsp bovis AF2122/97
gaccuucuugacacccaccucgc

SEQ ID NO: 1195338 - RNA, 14 nt, Mycobacterium bovis subsp bovis AF2122/97
gaccuugcccugcg

SEQ ID NO: 1195339 - RNA, 19 nt, Mycobacterium bovis subsp bovis AF2122/97
gaccuugaucgagcagggu

SEQ ID NO: 1195340 - RNA, 23 nt, Mycobacterium bovis subsp bovis AF2122/97
gaccuugaucgagcagggugacc

SEQ ID NO: 1195341 - RNA, 20 nt, Mycobacterium bovis subsp bovis AF2122/97
gaccuucgcuauggcggcuu

SEQ ID NO: 1195342 - RNA, 14 nt, Mycobacterium bovis subsp bovis AF2122/97
gaccuucaccugga

SEQ ID NO: 1195343 - RNA, 22 nt, Mycobacterium bovis subsp bovis AF2122/97
gacgaacgacggggcaaaggag

SEQ ID NO: 1195344 - RNA, 15 nt, Mycobacterium bovis subsp bovis AF2122/97
gacgaacgaaccgcc

SEQ ID NO: 1195345 - RNA, 14 nt, Mycobacterium bovis subsp bovis AF2122/97
gacgaacuggucuc

SEQ ID NO: 1195346 - RNA, 14 nt, Mycobacterium bovis subsp bovis AF2122/97
gacgaacgccgucg

SEQ ID NO: 1195347 - RNA, 20 nt, Mycobacterium bovis subsp bovis AF2122/97
gacgaaauccgccgggcgcc

SEQ ID NO: 1195348 - RNA, 18 nt, Mycobacterium bovis subsp bovis AF2122/97
gacgaaauccgccgggcg

SEQ ID NO: 1195349 - RNA, 21 nt, Mycobacterium bovis subsp bovis AF2122/97
gaccuuuugcggcaagcgcac

SEQ ID NO: 1195350 - RNA, 23 nt, Mycobacterium bovis subsp bovis AF2122/97
gacgaugcggucaacgcugacgu

SEQ ID NO: 1195351 - RNA, 20 nt, Mycobacterium bovis subsp bovis AF2122/97
gacgaugccggcccgcaggc

SEQ ID NO: 1195352 - RNA, 15 nt, Mycobacterium bovis subsp bovis AF2122/97
gacgaugcaggugac

SEQ ID NO: 1195353 - RNA, 20 nt, Mycobacterium bovis subsp bovis AF2122/97
gacgauggccgccgcgagga

SEQ ID NO: 1195354 - RNA, 19 nt, Mycobacterium bovis subsp bovis AF2122/97
gacgaugaaccgggcagca

SEQ ID NO: 1195355 - RNA, 17 nt, Mycobacterium bovis subsp bovis AF2122/97
gacgauguccuggaagc

SEQ ID NO: 1195356 - RNA, 21 nt, Mycobacterium bovis subsp bovis AF2122/97
gacgauuccgcgcgggaaacg

SEQ ID NO: 1195357 - RNA, 15 nt, Mycobacterium bovis subsp bovis AF2122/97
gacgauucggcggcc

SEQ ID NO: 1195358 - RNA, 14 nt, Mycobacterium bovis subsp bovis AF2122/97
gacgauugccacca

SEQ ID NO: 1195359 - RNA, 21 nt, Mycobacterium bovis subsp bovis AF2122/97
gacgcagcuugcccgacggcg

SEQ ID NO: 1195360 - RNA, 20 nt, Mycobacterium bovis subsp bovis AF2122/97
gacgcaccuauggucaaccg

SEQ ID NO: 1195361 - RNA, 21 nt, Mycobacterium bovis subsp bovis AF2122/97
gacgcacgacugugcgccgca

SEQ ID NO: 1195362 - RNA, 24 nt, Mycobacterium bovis subsp bovis AF2122/97
gacgcacgacugugcgccgcagcc

SEQ ID NO: 1195363 - RNA, 15 nt, Mycobacterium bovis subsp bovis AF2122/97
gacgcagaagccccc

SEQ ID NO: 1195364 - RNA, 13 nt, Mycobacterium bovis subsp bovis AF2122/97
gacgcaacacccg

SEQ ID NO: 1195365 - RNA, 21 nt, Mycobacterium bovis subsp bovis AF2122/97
gacgcaaaauccccucgcaac

SEQ ID NO: 1195366 - RNA, 24 nt, Mycobacterium bovis subsp bovis AF2122/97
gacgcaaaagccaccgcacguucg

SEQ ID NO: 1195367 - RNA, 17 nt, Mycobacterium bovis subsp bovis AF2122/97
gacgcaaaagcccccua

SEQ ID NO: 1195368 - RNA, 14 nt, Mycobacterium bovis subsp bovis AF2122/97
gacgaucgacagcc

SEQ ID NO: 1195369 - RNA, 16 nt, Mycobacterium bovis subsp bovis AF2122/97
gacgaucaccccgcca

SEQ ID NO: 1195370 - RNA, 16 nt, Mycobacterium bovis subsp bovis AF2122/97
gacgaucgcggcgggc

SEQ ID NO: 1195371 - RNA, 14 nt, Mycobacterium bovis subsp bovis AF2122/97
gacgaucggcggcg

SEQ ID NO: 1195372 - RNA, 15 nt, Mycobacterium bovis subsp bovis AF2122/97
gacgaucugcagcac

SEQ ID NO: 1195373 - RNA, 21 nt, Mycobacterium bovis subsp bovis AF2122/97
gacgaguuccgugcagaaacc

SEQ ID NO: 1195374 - RNA, 16 nt, Mycobacterium bovis subsp bovis AF2122/97
gacgaucaagccuucg

SEQ ID NO: 1195375 - RNA, 18 nt, Mycobacterium bovis subsp bovis AF2122/97
gacgaucacaugcaagcc

SEQ ID NO: 1195376 - RNA, 15 nt, Mycobacterium bovis subsp bovis AF2122/97
gacgagucggcgggc

SEQ ID NO: 1195377 - RNA, 16 nt, Mycobacterium bovis subsp bovis AF2122/97
gacgagucggcgggcg

SEQ ID NO: 1195378 - RNA, 22 nt, Mycobacterium bovis subsp bovis AF2122/97
gacgagccaccaccgccgaccc

SEQ ID NO: 1195379 - RNA, 20 nt, Mycobacterium bovis subsp bovis AF2122/97
gacgagccacggcuucgccg

SEQ ID NO: 1195380 - RNA, 18 nt, Mycobacterium bovis subsp bovis AF2122/97
gacgacuggaaggcgggc

SEQ ID NO: 1195381 - RNA, 21 nt, Mycobacterium bovis subsp bovis AF2122/97
gacgagauugccgggccgccg

SEQ ID NO: 1195382 - RNA, 19 nt, Mycobacterium bovis subsp bovis AF2122/97
gacgagcacaugcucgacg

SEQ ID NO: 1195383 - RNA, 15 nt, Mycobacterium bovis subsp bovis AF2122/97
gacgacugggcgccc

SEQ ID NO: 1195384 - RNA, 19 nt, Mycobacterium bovis subsp bovis AF2122/97
gacaccgcggugccccgga

SEQ ID NO: 1195385 - RNA, 18 nt, Mycobacterium bovis subsp bovis AF2122/97
gacaccgcaacgcgugcg

SEQ ID NO: 1195386 - RNA, 15 nt, Mycobacterium bovis subsp bovis AF2122/97
gacaccgaccggguc

SEQ ID NO: 1195387 - RNA, 18 nt, Mycobacterium bovis subsp bovis AF2122/97
gacaccgaggaccucguc

SEQ ID NO: 1195388 - RNA, 15 nt, Mycobacterium bovis subsp bovis AF2122/97
gacaccggcggcauc

SEQ ID NO: 1195389 - RNA, 16 nt, Mycobacterium bovis subsp bovis AF2122/97
gacaccguccagcagc

SEQ ID NO: 1195390 - RNA, 17 nt, Mycobacterium bovis subsp bovis AF2122/97
gacaccguccagcagcu

SEQ ID NO: 1195391 - RNA, 17 nt, Mycobacterium bovis subsp bovis AF2122/97
gacaccggccaccagcc

SEQ ID NO: 1195392 - RNA, 16 nt, Mycobacterium bovis subsp bovis AF2122/97
gacacgagucgccaga

SEQ ID NO: 1195393 - RNA, 19 nt, Mycobacterium bovis subsp bovis AF2122/97
gacacgagucgccagaccg

SEQ ID NO: 1195394 - RNA, 22 nt, Mycobacterium bovis subsp bovis AF2122/97
gacaccggcuauaucccgcccc

SEQ ID NO: 1195395 - RNA, 20 nt, Mycobacterium bovis subsp bovis AF2122/97
gacaccguggaucggcagcc

SEQ ID NO: 1195396 - RNA, 18 nt, Mycobacterium bovis subsp bovis AF2122/97
gacaccuaccgagaucac

SEQ ID NO: 1195397 - RNA, 15 nt, Mycobacterium bovis subsp bovis AF2122/97
gacacgugcaucugu

SEQ ID NO: 1195398 - RNA, 13 nt, Mycobacterium bovis subsp bovis AF2122/97
gacacggcucgcc

SEQ ID NO: 1195399 - RNA, 23 nt, Mycobacterium bovis subsp bovis AF2122/97
gacacucccgggugcgacgcgac

SEQ ID NO: 1195400 - RNA, 19 nt, Mycobacterium bovis subsp bovis AF2122/97
gacacgccgaugccgaacu

SEQ ID NO: 1195401 - RNA, 22 nt, Mycobacterium bovis subsp bovis AF2122/97
gacacgccgauucgccgucgug

SEQ ID NO: 1195402 - RNA, 22 nt, Mycobacterium bovis subsp bovis AF2122/97
gacacgccgaacgugcgguggc

SEQ ID NO: 1195403 - RNA, 19 nt, Mycobacterium bovis subsp bovis AF2122/97
gacacgcccuaacccugcc

SEQ ID NO: 1195404 - RNA, 18 nt, Mycobacterium bovis subsp bovis AF2122/97
gacacgcugcaggcggcc

SEQ ID NO: 1195405 - RNA, 15 nt, Mycobacterium bovis subsp bovis AF2122/97
gacacggugaucuuc

SEQ ID NO: 1195406 - RNA, 21 nt, Mycobacterium bovis subsp bovis AF2122/97
gacacagcccacaggcggcgc

SEQ ID NO: 1195407 - RNA, 14 nt, Mycobacterium bovis subsp bovis AF2122/97
gacacauugaccag

SEQ ID NO: 1195408 - RNA, 22 nt, Mycobacterium bovis subsp bovis AF2122/97
gacacagaaucgcacgaaauca

SEQ ID NO: 1195409 - RNA, 12 nt, Mycobacterium bovis subsp bovis AF2122/97
gacacacaggcg

SEQ ID NO: 1195410 - RNA, 13 nt, Mycobacterium bovis subsp bovis AF2122/97
gacaccagcucga

SEQ ID NO: 1195411 - RNA, 18 nt, Mycobacterium bovis subsp bovis AF2122/97
gacaccaguaaugcccau

SEQ ID NO: 1195412 - RNA, 16 nt, Mycobacterium bovis subsp bovis AF2122/97
gacacccgagggccug

SEQ ID NO: 1195413 - RNA, 16 nt, Mycobacterium bovis subsp bovis AF2122/97
gacacccgcagcugug

SEQ ID NO: 1195414 - RNA, 16 nt, Mycobacterium bovis subsp bovis AF2122/97
gacacccugggugccg

SEQ ID NO: 1195415 - RNA, 15 nt, Mycobacterium bovis subsp bovis AF2122/97
gacacccaucgaccg

SEQ ID NO: 1195416 - RNA, 23 nt, Mycobacterium bovis subsp bovis AF2122/97
gacaccauuggccuaggacaccg

SEQ ID NO: 1195417 - RNA, 16 nt, Mycobacterium bovis subsp bovis AF2122/97
gacaccauaggccgac

SEQ ID NO: 1195418 - RNA, 23 nt, Mycobacterium bovis subsp bovis AF2122/97
gacaccaucuccgccgucgccac

SEQ ID NO: 1195419 - RNA, 14 nt, Mycobacterium bovis subsp bovis AF2122/97
gacacccagccgca

SEQ ID NO: 1195420 - RNA, 17 nt, Mycobacterium bovis subsp bovis AF2122/97
gacacccagccgcagcc

SEQ ID NO: 1195421 - RNA, 15 nt, Mycobacterium bovis subsp bovis AF2122/97
gacagccccgcggcc

SEQ ID NO: 1195422 - RNA, 16 nt, Mycobacterium bovis subsp bovis AF2122/97
gacagccccgccgccc

SEQ ID NO: 1195423 - RNA, 14 nt, Mycobacterium bovis subsp bovis AF2122/97
gacagccugcgcca

SEQ ID NO: 1195424 - RNA, 14 nt, Mycobacterium bovis subsp bovis AF2122/97
gacagccccgccgc

SEQ ID NO: 1195425 - RNA, 14 nt, Mycobacterium bovis subsp bovis AF2122/97
gacagcgcugggcc

SEQ ID NO: 1195426 - RNA, 22 nt, Mycobacterium bovis subsp bovis AF2122/97
gacagcggcaaucgggucugga

SEQ ID NO: 1195427 - RNA, 15 nt, Mycobacterium bovis subsp bovis AF2122/97
gacagcgcggcgguc

SEQ ID NO: 1195428 - RNA, 12 nt, Mycobacterium bovis subsp bovis AF2122/97
gacagcgcggcg

SEQ ID NO: 1195429 - RNA, 14 nt, Mycobacterium bovis subsp bovis AF2122/97
gacagcgccuggcc

SEQ ID NO: 1195430 - RNA, 17 nt, Mycobacterium bovis subsp bovis AF2122/97
gacagcgucucggaggc

SEQ ID NO: 1195431 - RNA, 20 nt, Mycobacterium bovis subsp bovis AF2122/97
gacagcuaucccaggggcac

SEQ ID NO: 1195432 - RNA, 20 nt, Mycobacterium bovis subsp bovis AF2122/97
gacagcgugccgaacaggga

SEQ ID NO: 1195433 - RNA, 18 nt, Mycobacterium bovis subsp bovis AF2122/97
gacagcugcacacagagg

SEQ ID NO: 1195434 - RNA, 20 nt, Mycobacterium bovis subsp bovis AF2122/97
gacagcuccuuggcuaacac

SEQ ID NO: 1195435 - RNA, 21 nt, Mycobacterium bovis subsp bovis AF2122/97
gacagcugguugugcugggga

SEQ ID NO: 1195436 - RNA, 23 nt, Mycobacterium bovis subsp bovis AF2122/97
gacagcugcacacagaggucggu

SEQ ID NO: 1195437 - RNA, 14 nt, Mycobacterium bovis subsp bovis AF2122/97
gacagacagcaccg

SEQ ID NO: 1195438 - RNA, 14 nt, Mycobacterium bovis subsp bovis AF2122/97
gacagcacccggcc

SEQ ID NO: 1195439 - RNA, 16 nt, Mycobacterium bovis subsp bovis AF2122/97
gacagcagcgccaccc

SEQ ID NO: 1195440 - RNA, 15 nt, Mycobacterium bovis subsp bovis AF2122/97
gacagaugcauccag

SEQ ID NO: 1195441 - RNA, 22 nt, Mycobacterium bovis subsp bovis AF2122/97
gacaaggccgauguacugugcc

SEQ ID NO: 1195442 - RNA, 17 nt, Mycobacterium bovis subsp bovis AF2122/97
gacaagucggcgcuggc

SEQ ID NO: 1195443 - RNA, 16 nt, Mycobacterium bovis subsp bovis AF2122/97
gacaaguggugcccuu

SEQ ID NO: 1195444 - RNA, 14 nt, Mycobacterium bovis subsp bovis AF2122/97
gacaaucucggccg

SEQ ID NO: 1195445 - RNA, 21 nt, Mycobacterium bovis subsp bovis AF2122/97
gacaaucucggcguugccgcc

SEQ ID NO: 1195446 - RNA, 15 nt, Mycobacterium bovis subsp bovis AF2122/97
gacaaccuggggcca

SEQ ID NO: 1195447 - RNA, 17 nt, Mycobacterium bovis subsp bovis AF2122/97
gacaacgacgucgccga

SEQ ID NO: 1195448 - RNA, 17 nt, Mycobacterium bovis subsp bovis AF2122/97
gacaacgcugggcggcu

SEQ ID NO: 1195449 - RNA, 21 nt, Mycobacterium bovis subsp bovis AF2122/97
gacaacaggccgucgaugauc

SEQ ID NO: 1195450 - RNA, 19 nt, Mycobacterium bovis subsp bovis AF2122/97
gacaaccggccagauggug

SEQ ID NO: 1195451 - RNA, 19 nt, Mycobacterium bovis subsp bovis AF2122/97
gacaacuaucgucgugucg

SEQ ID NO: 1195452 - RNA, 14 nt, Mycobacterium bovis subsp bovis AF2122/97
gacaacaccacggu

SEQ ID NO: 1195453 - RNA, 23 nt, Mycobacterium bovis subsp bovis AF2122/97
gacaacagagucaccgcgcuggu

SEQ ID NO: 1195454 - RNA, 12 nt, Mycobacterium bovis subsp bovis AF2122/97
gacaacagcaag

SEQ ID NO: 1195455 - RNA, 13 nt, Mycobacterium bovis subsp bovis AF2122/97
gacaacagccagc

SEQ ID NO: 1195456 - RNA, 13 nt, Mycobacterium bovis subsp bovis AF2122/97
gacaacagcuugg

SEQ ID NO: 1195457 - RNA, 15 nt, Mycobacterium bovis subsp bovis AF2122/97
gacaaagaagugguc

SEQ ID NO: 1195458 - RNA, 21 nt, Mycobacterium bovis subsp bovis AF2122/97
gacaaaaucagcagcccccgc

SEQ ID NO: 1195459 - RNA, 14 nt, Mycobacterium bovis subsp bovis AF2122/97
gacaaaagccaggg

SEQ ID NO: 1195460 - RNA, 13 nt, Mycobacterium bovis subsp bovis AF2122/97
cuuugggcugccg

SEQ ID NO: 1195461 - RNA, 19 nt, Mycobacterium bovis subsp bovis AF2122/97
cuuuggguagcaaaccccg

SEQ ID NO: 1195462 - RNA, 17 nt, Mycobacterium bovis subsp bovis AF2122/97
cuuuggguccgggcggc

SEQ ID NO: 1195463 - RNA, 13 nt, Mycobacterium bovis subsp bovis AF2122/97
cuuuggugucgcu

SEQ ID NO: 1195464 - RNA, 21 nt, Mycobacterium bovis subsp bovis AF2122/97
cuuugguugcccgcauugcca

SEQ ID NO: 1195465 - RNA, 19 nt, Mycobacterium bovis subsp bovis AF2122/97
gaccaccgaaauacccagc

SEQ ID NO: 1195466 - RNA, 15 nt, Mycobacterium bovis subsp bovis AF2122/97
gaccaccagcgccga

SEQ ID NO: 1195467 - RNA, 15 nt, Mycobacterium bovis subsp bovis AF2122/97
gaccaccgccggccc

SEQ ID NO: 1195468 - RNA, 22 nt, Mycobacterium bovis subsp bovis AF2122/97
gaccaccgccgacaggccggcc

SEQ ID NO: 1195469 - RNA, 20 nt, Mycobacterium bovis subsp bovis AF2122/97
gaccaccgcggcaugugaca

SEQ ID NO: 1195470 - RNA, 20 nt, Mycobacterium bovis subsp bovis AF2122/97
gaccaccgcgucgggccgca

SEQ ID NO: 1195471 - RNA, 12 nt, Mycobacterium bovis subsp bovis AF2122/97
gaccaccgggua

SEQ ID NO: 1195472 - RNA, 14 nt, Mycobacterium bovis subsp bovis AF2122/97
gaccaccugcugca

SEQ ID NO: 1195473 - RNA, 13 nt, Mycobacterium bovis subsp bovis AF2122/97
gaccaccugguuu

SEQ ID NO: 1195474 - RNA, 21 nt, Mycobacterium bovis subsp bovis AF2122/97
gaccaccuucugacgcggccg

SEQ ID NO: 1195475 - RNA, 17 nt, Mycobacterium bovis subsp bovis AF2122/97
gaccacgaauggggcca

SEQ ID NO: 1195476 - RNA, 23 nt, Mycobacterium bovis subsp bovis AF2122/97
gaccacgggaugcaugucuugug

SEQ ID NO: 1195477 - RNA, 18 nt, Mycobacterium bovis subsp bovis AF2122/97
gaccacgcaccgccccgc

SEQ ID NO: 1195478 - RNA, 21 nt, Mycobacterium bovis subsp bovis AF2122/97
gaccacgcaagggaauccgaa

SEQ ID NO: 1195479 - RNA, 14 nt, Mycobacterium bovis subsp bovis AF2122/97
gaccacgcaccgcc

SEQ ID NO: 1195480 - RNA, 16 nt, Mycobacterium bovis subsp bovis AF2122/97
gaccacgcaccgcccc

SEQ ID NO: 1195481 - RNA, 21 nt, Mycobacterium bovis subsp bovis AF2122/97
gaccacucgccgcgacugcac

SEQ ID NO: 1195482 - RNA, 22 nt, Mycobacterium bovis subsp bovis AF2122/97
gaccacucgccggcggacgccc

SEQ ID NO: 1195483 - RNA, 19 nt, Mycobacterium bovis subsp bovis AF2122/97
gaccacuugcagcacaacg

SEQ ID NO: 1195484 - RNA, 23 nt, Mycobacterium bovis subsp bovis AF2122/97
gaccaacauguugucgucgccgc

SEQ ID NO: 1195485 - RNA, 14 nt, Mycobacterium bovis subsp bovis AF2122/97
gaccaacgccaacg

SEQ ID NO: 1195486 - RNA, 13 nt, Mycobacterium bovis subsp bovis AF2122/97
gaccaacgcggug

SEQ ID NO: 1195487 - RNA, 13 nt, Mycobacterium bovis subsp bovis AF2122/97
gaccaccaccgcc

SEQ ID NO: 1195488 - RNA, 21 nt, Mycobacterium bovis subsp bovis AF2122/97
gaccaccacuaggucgccggc

SEQ ID NO: 1195489 - RNA, 17 nt, Mycobacterium bovis subsp bovis AF2122/97
gaccaaugcguugacgu

SEQ ID NO: 1195490 - RNA, 22 nt, Mycobacterium bovis subsp bovis AF2122/97
gaccaaugucagugccccgccc

SEQ ID NO: 1195491 - RNA, 21 nt, Mycobacterium bovis subsp bovis AF2122/97
gaccagucucguggcgcuggg

SEQ ID NO: 1195492 - RNA, 16 nt, Mycobacterium bovis subsp bovis AF2122/97
gaccagguagaccagg

SEQ ID NO: 1195493 - RNA, 22 nt, Mycobacterium bovis subsp bovis AF2122/97
gaccagguagaccaggugcagc

SEQ ID NO: 1195494 - RNA, 17 nt, Mycobacterium bovis subsp bovis AF2122/97
gaccaggugcagcacca

SEQ ID NO: 1195495 - RNA, 15 nt, Mycobacterium bovis subsp bovis AF2122/97
gaccagguaauggug

SEQ ID NO: 1195496 - RNA, 17 nt, Mycobacterium bovis subsp bovis AF2122/97
gaccagggaucgauuug

SEQ ID NO: 1195497 - RNA, 14 nt, Mycobacterium bovis subsp bovis AF2122/97
gaccaggcuccggc

SEQ ID NO: 1195498 - RNA, 21 nt, Mycobacterium bovis subsp bovis AF2122/97
gaccaggcuccggccggccag

SEQ ID NO: 1195499 - RNA, 19 nt, Mycobacterium bovis subsp bovis AF2122/97
gaccaggccgcgcgcaccg

SEQ ID NO: 1195500 - RNA, 15 nt, Mycobacterium bovis subsp bovis AF2122/97
gaccaggcggacgcc

SEQ ID NO: 1195501 - RNA, 22 nt, Mycobacterium bovis subsp bovis AF2122/97
gaccaggaaugucuccaguagc

SEQ ID NO: 1195502 - RNA, 22 nt, Mycobacterium bovis subsp bovis AF2122/97
gaccaggaaguagaugagcaga

SEQ ID NO: 1195503 - RNA, 18 nt, Mycobacterium bovis subsp bovis AF2122/97
gaccagcugagcuggcag

SEQ ID NO: 1195504 - RNA, 16 nt, Mycobacterium bovis subsp bovis AF2122/97
gaccagauguaccuca

SEQ ID NO: 1195505 - RNA, 13 nt, Mycobacterium bovis subsp bovis AF2122/97
gaccagcacaccg

SEQ ID NO: 1195506 - RNA, 13 nt, Mycobacterium bovis subsp bovis AF2122/97
gaccagcaaccac

SEQ ID NO: 1195507 - RNA, 23 nt, Mycobacterium bovis subsp bovis AF2122/97
gaccagcaaccaccccagggcaa

SEQ ID NO: 1195508 - RNA, 22 nt, Mycobacterium bovis subsp bovis AF2122/97
gaccagcacccgcucggccgcc

SEQ ID NO: 1195509 - RNA, 16 nt, Mycobacterium bovis subsp bovis AF2122/97
gaccagcagaccaagc

SEQ ID NO: 1195510 - RNA, 11 nt, Mycobacterium bovis subsp bovis AF2122/97
gaccagcggcg

SEQ ID NO: 1195511 - RNA, 19 nt, Mycobacterium bovis subsp bovis AF2122/97
gaccagccgaucaucaccg

SEQ ID NO: 1195512 - RNA, 18 nt, Mycobacterium bovis subsp bovis AF2122/97
gaccagccguggugguug

SEQ ID NO: 1195513 - RNA, 15 nt, Mycobacterium bovis subsp bovis AF2122/97
gaccagcguccagcc

SEQ ID NO: 1195514 - RNA, 18 nt, Mycobacterium bovis subsp bovis AF2122/97
gaccagcguccagccgcc

SEQ ID NO: 1195515 - RNA, 15 nt, Mycobacterium bovis subsp bovis AF2122/97
gacauugggcgcggu

SEQ ID NO: 1195516 - RNA, 15 nt, Mycobacterium bovis subsp bovis AF2122/97
gacauuggagacgac

SEQ ID NO: 1195517 - RNA, 17 nt, Mycobacterium bovis subsp bovis AF2122/97
gacauugcgagcgccuu

SEQ ID NO: 1195518 - RNA, 21 nt, Mycobacterium bovis subsp bovis AF2122/97
gacauucccgaguugcccucu

SEQ ID NO: 1195519 - RNA, 16 nt, Mycobacterium bovis subsp bovis AF2122/97
gacaugguccgaccag

SEQ ID NO: 1195520 - RNA, 18 nt, Mycobacterium bovis subsp bovis AF2122/97
gacaugguccgaccagcg

SEQ ID NO: 1195521 - RNA, 20 nt, Mycobacterium bovis subsp bovis AF2122/97
gacaugguccgaccagcggc

SEQ ID NO: 1195522 - RNA, 15 nt, Mycobacterium bovis subsp bovis AF2122/97
gacaugucaggccgu

SEQ ID NO: 1195523 - RNA, 13 nt, Mycobacterium bovis subsp bovis AF2122/97
gacaucggcggcc

SEQ ID NO: 1195524 - RNA, 16 nt, Mycobacterium bovis subsp bovis AF2122/97
gacaucgggccgccga

SEQ ID NO: 1195525 - RNA, 15 nt, Mycobacterium bovis subsp bovis AF2122/97
gacaucgggcggcac

SEQ ID NO: 1195526 - RNA, 18 nt, Mycobacterium bovis subsp bovis AF2122/97
gacaucgggcggcaccgc

SEQ ID NO: 1195527 - RNA, 20 nt, Mycobacterium bovis subsp bovis AF2122/97
gacauccgcuuacggguguc

SEQ ID NO: 1195528 - RNA, 12 nt, Mycobacterium bovis subsp bovis AF2122/97
gacauccagauc

SEQ ID NO: 1195529 - RNA, 22 nt, Mycobacterium bovis subsp bovis AF2122/97
gacauccacaccgcggcggcgc

SEQ ID NO: 1195530 - RNA, 21 nt, Mycobacterium bovis subsp bovis AF2122/97
gacauccagaugcccagcagg

SEQ ID NO: 1195531 - RNA, 13 nt, Mycobacterium bovis subsp bovis AF2122/97
gacaucaccaccg

SEQ ID NO: 1195532 - RNA, 16 nt, Mycobacterium bovis subsp bovis AF2122/97
gacaucgucgccaggg

SEQ ID NO: 1195533 - RNA, 22 nt, Mycobacterium bovis subsp bovis AF2122/97
gacaucugcccagcgguugccg

SEQ ID NO: 1195534 - RNA, 19 nt, Mycobacterium bovis subsp bovis AF2122/97
gacaugacagccccgccgc

SEQ ID NO: 1195535 - RNA, 22 nt, Mycobacterium bovis subsp bovis AF2122/97
gacaugagcgccacgccgaggc

SEQ ID NO: 1195536 - RNA, 19 nt, Mycobacterium bovis subsp bovis AF2122/97
gacaugcaggaauggguga

SEQ ID NO: 1195537 - RNA, 21 nt, Mycobacterium bovis subsp bovis AF2122/97
gacaugagcgccacgccgagg

SEQ ID NO: 1195538 - RNA, 22 nt, Mycobacterium bovis subsp bovis AF2122/97
gacagggcggcaaccucaugca

SEQ ID NO: 1195539 - RNA, 20 nt, Mycobacterium bovis subsp bovis AF2122/97
gacaggccggccaccagucc

SEQ ID NO: 1195540 - RNA, 20 nt, Mycobacterium bovis subsp bovis AF2122/97
gacaggcccgguggcggcuc

SEQ ID NO: 1195541 - RNA, 13 nt, Mycobacterium bovis subsp bovis AF2122/97
gacaggccgagca

SEQ ID NO: 1195542 - RNA, 18 nt, Mycobacterium bovis subsp bovis AF2122/97
gacaggccggccaccagu

SEQ ID NO: 1195543 - RNA, 23 nt, Mycobacterium bovis subsp bovis AF2122/97
gacaggucgcccaacaccgcgcc

SEQ ID NO: 1195544 - RNA, 20 nt, Mycobacterium bovis subsp bovis AF2122/97
gacagguagucgccggucag

SEQ ID NO: 1195545 - RNA, 22 nt, Mycobacterium bovis subsp bovis AF2122/97
gacagggugggggcaucagggu

SEQ ID NO: 1195546 - RNA, 18 nt, Mycobacterium bovis subsp bovis AF2122/97
gacaggugcuaggaggag

SEQ ID NO: 1195547 - RNA, 18 nt, Mycobacterium bovis subsp bovis AF2122/97
gacaggugccagaccagg

SEQ ID NO: 1195548 - RNA, 22 nt, Mycobacterium bovis subsp bovis AF2122/97
gacaggugccagaccagggcag

SEQ ID NO: 1195549 - RNA, 15 nt, Mycobacterium bovis subsp bovis AF2122/97
gacagucaacagggc

SEQ ID NO: 1195550 - RNA, 20 nt, Mycobacterium bovis subsp bovis AF2122/97
gacaguucguuaccacauac

SEQ ID NO: 1195551 - RNA, 14 nt, Mycobacterium bovis subsp bovis AF2122/97
gacaguucccggcc

SEQ ID NO: 1195552 - RNA, 19 nt, Mycobacterium bovis subsp bovis AF2122/97
gacaguuggcagcgcuggc

SEQ ID NO: 1195553 - RNA, 20 nt, Mycobacterium bovis subsp bovis AF2122/97
gacaguuggcagcgcuggcu

SEQ ID NO: 1195554 - RNA, 18 nt, Mycobacterium bovis subsp bovis AF2122/97
gacauacccgaucaaugc

SEQ ID NO: 1195555 - RNA, 19 nt, Mycobacterium bovis subsp bovis AF2122/97
gacauaggccaccuccgag

SEQ ID NO: 1195556 - RNA, 20 nt, Mycobacterium bovis subsp bovis AF2122/97
cguugccggcguugccgccg

SEQ ID NO: 1195557 - RNA, 15 nt, Mycobacterium bovis subsp bovis AF2122/97
cguugccggcuuggc

SEQ ID NO: 1195558 - RNA, 16 nt, Mycobacterium bovis subsp bovis AF2122/97
cguugccguacagccc

SEQ ID NO: 1195559 - RNA, 20 nt, Mycobacterium bovis subsp bovis AF2122/97
cguugccguacagcccggcc

SEQ ID NO: 1195560 - RNA, 13 nt, Mycobacterium bovis subsp bovis AF2122/97
cguugccggccac

SEQ ID NO: 1195561 - RNA, 20 nt, Mycobacterium bovis subsp bovis AF2122/97
cguugccgccggcgccgccg

SEQ ID NO: 1195562 - RNA, 16 nt, Mycobacterium bovis subsp bovis AF2122/97
cguugccgccgucccc

SEQ ID NO: 1195563 - RNA, 21 nt, Mycobacterium bovis subsp bovis AF2122/97
cguugccgccguuaccgccgc

SEQ ID NO: 1195564 - RNA, 15 nt, Mycobacterium bovis subsp bovis AF2122/97
cguugcggcaacagc

SEQ ID NO: 1195565 - RNA, 19 nt, Mycobacterium bovis subsp bovis AF2122/97
cguugccgaaacccgaguu

SEQ ID NO: 1195566 - RNA, 16 nt, Mycobacterium bovis subsp bovis AF2122/97
cguugcccuccuucuc

SEQ ID NO: 1195567 - RNA, 21 nt, Mycobacterium bovis subsp bovis AF2122/97
cguugcccccguugccgccug

SEQ ID NO: 1195568 - RNA, 22 nt, Mycobacterium bovis subsp bovis AF2122/97
cguugccgaucgcuccggcccu

SEQ ID NO: 1195569 - RNA, 18 nt, Mycobacterium bovis subsp bovis AF2122/97
cguugccgccgaagccga

SEQ ID NO: 1195570 - RNA, 17 nt, Mycobacterium bovis subsp bovis AF2122/97
cguugcccgcgaaggca

SEQ ID NO: 1195571 - RNA, 20 nt, Mycobacterium bovis subsp bovis AF2122/97
cguugcccccauugccgccg

SEQ ID NO: 1195572 - RNA, 13 nt, Mycobacterium bovis subsp bovis AF2122/97
cguugccauugcc

SEQ ID NO: 1195573 - RNA, 16 nt, Mycobacterium bovis subsp bovis AF2122/97
cguugccaaagcccac

SEQ ID NO: 1195574 - RNA, 20 nt, Mycobacterium bovis subsp bovis AF2122/97
cguugccaccguugccgccg

SEQ ID NO: 1195575 - RNA, 15 nt, Mycobacterium bovis subsp bovis AF2122/97
cguugcagccggcau

SEQ ID NO: 1195576 - RNA, 15 nt, Mycobacterium bovis subsp bovis AF2122/97
cguugcaucagcacg

SEQ ID NO: 1195577 - RNA, 13 nt, Mycobacterium bovis subsp bovis AF2122/97
cguugcaccauuc

SEQ ID NO: 1195578 - RNA, 15 nt, Mycobacterium bovis subsp bovis AF2122/97
cguugcacagcuugg

SEQ ID NO: 1195579 - RNA, 15 nt, Mycobacterium bovis subsp bovis AF2122/97
cguugauucgggagg

SEQ ID NO: 1195580 - RNA, 15 nt, Mycobacterium bovis subsp bovis AF2122/97
cguugcacagcagcg

SEQ ID NO: 1195581 - RNA, 22 nt, Mycobacterium bovis subsp bovis AF2122/97
cguugaugacguugcagccggc

SEQ ID NO: 1195582 - RNA, 16 nt, Mycobacterium bovis subsp bovis AF2122/97
cguugaugaccgccgc

SEQ ID NO: 1195583 - RNA, 21 nt, Mycobacterium bovis subsp bovis AF2122/97
cguugagguaggugagcgcgc

SEQ ID NO: 1195584 - RNA, 23 nt, Mycobacterium bovis subsp bovis AF2122/97
cguugagguaggugagcgcgcuc

SEQ ID NO: 1195585 - RNA, 17 nt, Mycobacterium bovis subsp bovis AF2122/97
cguugauccccagcucc

SEQ ID NO: 1195586 - RNA, 20 nt, Mycobacterium bovis subsp bovis AF2122/97
cguugaucgacaucaccacc

SEQ ID NO: 1195587 - RNA, 22 nt, Mycobacterium bovis subsp bovis AF2122/97
cguugacggcuucggcagccgc

SEQ ID NO: 1195588 - RNA, 14 nt, Mycobacterium bovis subsp bovis AF2122/97
cguugaccucuucg

SEQ ID NO: 1195589 - RNA, 15 nt, Mycobacterium bovis subsp bovis AF2122/97
cguugagcagcaccc

SEQ ID NO: 1195590 - RNA, 17 nt, Mycobacterium bovis subsp bovis AF2122/97
cguucgucggucccagg

SEQ ID NO: 1195591 - RNA, 14 nt, Mycobacterium bovis subsp bovis AF2122/97
cguucgugagcggc

SEQ ID NO: 1195592 - RNA, 23 nt, Mycobacterium bovis subsp bovis AF2122/97
cguugaccagaaccuggagccgu

SEQ ID NO: 1195593 - RNA, 18 nt, Mycobacterium bovis subsp bovis AF2122/97
cguugaagaauccggccc

SEQ ID NO: 1195594 - RNA, 19 nt, Mycobacterium bovis subsp bovis AF2122/97
cguugaagacggccaccgg

SEQ ID NO: 1195595 - RNA, 17 nt, Mycobacterium bovis subsp bovis AF2122/97
cguugaagcccaacagc

SEQ ID NO: 1195596 - RNA, 13 nt, Mycobacterium bovis subsp bovis AF2122/97
cguccaccgccga

SEQ ID NO: 1195597 - RNA, 15 nt, Mycobacterium bovis subsp bovis AF2122/97
cguccaccagccggu

SEQ ID NO: 1195598 - RNA, 14 nt, Mycobacterium bovis subsp bovis AF2122/97
cgucauucaccgcg

SEQ ID NO: 1195599 - RNA, 16 nt, Mycobacterium bovis subsp bovis AF2122/97
cguccaacagcgcucg

SEQ ID NO: 1195600 - RNA, 12 nt, Mycobacterium bovis subsp bovis AF2122/97
cguccaacccag

SEQ ID NO: 1195601 - RNA, 17 nt, Mycobacterium bovis subsp bovis AF2122/97
cguccaacuacgccagc

SEQ ID NO: 1195602 - RNA, 15 nt, Mycobacterium bovis subsp bovis AF2122/97
cguccaagccggcca

SEQ ID NO: 1195603 - RNA, 16 nt, Mycobacterium bovis subsp bovis AF2122/97
cguccaagccggcugc

SEQ ID NO: 1195604 - RNA, 20 nt, Mycobacterium bovis subsp bovis AF2122/97
cguccaagccguagaccagg

SEQ ID NO: 1195605 - RNA, 22 nt, Mycobacterium bovis subsp bovis AF2122/97
cguccaccacaccugcggcugc

SEQ ID NO: 1195606 - RNA, 23 nt, Mycobacterium bovis subsp bovis AF2122/97
cguucgagagccccgaccagcag

SEQ ID NO: 1195607 - RNA, 21 nt, Mycobacterium bovis subsp bovis AF2122/97
cguucgagugcggucgagagc

SEQ ID NO: 1195608 - RNA, 19 nt, Mycobacterium bovis subsp bovis AF2122/97
cguucggcgcugaucgcgc

SEQ ID NO: 1195609 - RNA, 18 nt, Mycobacterium bovis subsp bovis AF2122/97
cguucgggccguccuccc

SEQ ID NO: 1195610 - RNA, 23 nt, Mycobacterium bovis subsp bovis AF2122/97
cguucggggccccgcggcgccgc

SEQ ID NO: 1195611 - RNA, 16 nt, Mycobacterium bovis subsp bovis AF2122/97
cguucgaccguguaac

SEQ ID NO: 1195612 - RNA, 15 nt, Mycobacterium bovis subsp bovis AF2122/97
cguuccuccagcagc

SEQ ID NO: 1195613 - RNA, 21 nt, Mycobacterium bovis subsp bovis AF2122/97
cguuccugaucgagcgccagc

SEQ ID NO: 1195614 - RNA, 18 nt, Mycobacterium bovis subsp bovis AF2122/97
cguucaugaucggcagaa

SEQ ID NO: 1195615 - RNA, 15 nt, Mycobacterium bovis subsp bovis AF2122/97
cguucaugcggcggc

SEQ ID NO: 1195616 - RNA, 19 nt, Mycobacterium bovis subsp bovis AF2122/97
cguucagguguugacgcca

SEQ ID NO: 1195617 - RNA, 18 nt, Mycobacterium bovis subsp bovis AF2122/97
cguugucgaccuccucga

SEQ ID NO: 1195618 - RNA, 17 nt, Mycobacterium bovis subsp bovis AF2122/97
cguugcucccacggcac

SEQ ID NO: 1195619 - RNA, 20 nt, Mycobacterium bovis subsp bovis AF2122/97
cguuuuccugaucgcgcaga

SEQ ID NO: 1195620 - RNA, 16 nt, Mycobacterium bovis subsp bovis AF2122/97
cguuuucgucacccca

SEQ ID NO: 1195621 - RNA, 14 nt, Mycobacterium bovis subsp bovis AF2122/97
cguuuugcggcccg

SEQ ID NO: 1195622 - RNA, 18 nt, Mycobacterium bovis subsp bovis AF2122/97
cguuugagcggccaccgu

SEQ ID NO: 1195623 - RNA, 22 nt, Mycobacterium bovis subsp bovis AF2122/97
cuaaagcgugucgaugcgggcu

SEQ ID NO: 1195624 - RNA, 20 nt, Mycobacterium bovis subsp bovis AF2122/97
cuaaagcgugucgcccuguu

SEQ ID NO: 1195625 - RNA, 22 nt, Mycobacterium bovis subsp bovis AF2122/97
cuaccaacgcaacacgggcgcc

SEQ ID NO: 1195626 - RNA, 22 nt, Mycobacterium bovis subsp bovis AF2122/97
cuaccaaccgguacuccugggu

SEQ ID NO: 1195627 - RNA, 18 nt, Mycobacterium bovis subsp bovis AF2122/97
cuaccaaaucgacacccu

SEQ ID NO: 1195628 - RNA, 18 nt, Mycobacterium bovis subsp bovis AF2122/97
cuacaggguuggcagcca

SEQ ID NO: 1195629 - RNA, 22 nt, Mycobacterium bovis subsp bovis AF2122/97
cuacacccauuacugagcuucc

SEQ ID NO: 1195630 - RNA, 23 nt, Mycobacterium bovis subsp bovis AF2122/97
cuaaaucuggccgauuuaguggg

SEQ ID NO: 1195631 - RNA, 22 nt, Mycobacterium bovis subsp bovis AF2122/97
cuaacucgacccguaauugguu

SEQ ID NO: 1195632 - RNA, 15 nt, Mycobacterium bovis subsp bovis AF2122/97
cuacccgggccaggc

SEQ ID NO: 1195633 - RNA, 23 nt, Mycobacterium bovis subsp bovis AF2122/97
cuacucauccagaagccggccac

SEQ ID NO: 1195634 - RNA, 17 nt, Mycobacterium bovis subsp bovis AF2122/97
cuaccgcccgcgccacc

SEQ ID NO: 1195635 - RNA, 15 nt, Mycobacterium bovis subsp bovis AF2122/97
cuaccgaucgccaag

SEQ ID NO: 1195636 - RNA, 16 nt, Mycobacterium bovis subsp bovis AF2122/97
cuaccgagacgcccca

SEQ ID NO: 1195637 - RNA, 19 nt, Mycobacterium bovis subsp bovis AF2122/97
cuaccgagaucaccgccac

SEQ ID NO: 1195638 - RNA, 20 nt, Mycobacterium bovis subsp bovis AF2122/97
cuaccgagaucaccgccacc

SEQ ID NO: 1195639 - RNA, 16 nt, Mycobacterium bovis subsp bovis AF2122/97
cuacucgaaacccaug

SEQ ID NO: 1195640 - RNA, 17 nt, Mycobacterium bovis subsp bovis AF2122/97
cuagaccgggcgguugg

SEQ ID NO: 1195641 - RNA, 17 nt, Mycobacterium bovis subsp bovis AF2122/97
cuagcucggccugaagc

SEQ ID NO: 1195642 - RNA, 16 nt, Mycobacterium bovis subsp bovis AF2122/97
cuagcugcugaugcgg

SEQ ID NO: 1195643 - RNA, 18 nt, Mycobacterium bovis subsp bovis AF2122/97
cuagcuugacaacccugu

SEQ ID NO: 1195644 - RNA, 22 nt, Mycobacterium bovis subsp bovis AF2122/97
cuagcgguauuugaugagcaac

SEQ ID NO: 1195645 - RNA, 17 nt, Mycobacterium bovis subsp bovis AF2122/97
cuagcggcucaccgcgc

SEQ ID NO: 1195646 - RNA, 19 nt, Mycobacterium bovis subsp bovis AF2122/97
cuagugacugguauuuccc

SEQ ID NO: 1195647 - RNA, 16 nt, Mycobacterium bovis subsp bovis AF2122/97
cuaguccggcacugcg

SEQ ID NO: 1195648 - RNA, 13 nt, Mycobacterium bovis subsp bovis AF2122/97
cuagucaccuuga

SEQ ID NO: 1195649 - RNA, 23 nt, Mycobacterium bovis subsp bovis AF2122/97
cuagggcagcagcccgggcagcc

SEQ ID NO: 1195650 - RNA, 16 nt, Mycobacterium bovis subsp bovis AF2122/97
cuagggugagcccggg

SEQ ID NO: 1195651 - RNA, 19 nt, Mycobacterium bovis subsp bovis AF2122/97
cuagguccgaacuugacga

SEQ ID NO: 1195652 - RNA, 23 nt, Mycobacterium bovis subsp bovis AF2122/97
cuaggugugcgacgacggcgccg

SEQ ID NO: 1195653 - RNA, 19 nt, Mycobacterium bovis subsp bovis AF2122/97
cuagguucgaguccuggua

SEQ ID NO: 1195654 - RNA, 18 nt, Mycobacterium bovis subsp bovis AF2122/97
cuaucgggaagccgccgg

SEQ ID NO: 1195655 - RNA, 22 nt, Mycobacterium bovis subsp bovis AF2122/97
cuaguugcaacggguacacccg

SEQ ID NO: 1195656 - RNA, 16 nt, Mycobacterium bovis subsp bovis AF2122/97
cuaguugacgcagccc

SEQ ID NO: 1195657 - RNA, 16 nt, Mycobacterium bovis subsp bovis AF2122/97
cuaguucgagcugcca

SEQ ID NO: 1195658 - RNA, 12 nt, Mycobacterium bovis subsp bovis AF2122/97
cucacacuggcu

SEQ ID NO: 1195659 - RNA, 15 nt, Mycobacterium bovis subsp bovis AF2122/97
cucacacuggcuuug

SEQ ID NO: 1195660 - RNA, 16 nt, Mycobacterium bovis subsp bovis AF2122/97
cucacccgggcagccu

SEQ ID NO: 1195661 - RNA, 23 nt, Mycobacterium bovis subsp bovis AF2122/97
cucaccgaacgcgaugcgccauu

SEQ ID NO: 1195662 - RNA, 21 nt, Mycobacterium bovis subsp bovis AF2122/97
cucaccuuuggccgcgaccgg

SEQ ID NO: 1195663 - RNA, 22 nt, Mycobacterium bovis subsp bovis AF2122/97
cucacgcaggaaaaccccggcc

SEQ ID NO: 1195664 - RNA, 19 nt, Mycobacterium bovis subsp bovis AF2122/97
cucacgcugaagccgcugg

SEQ ID NO: 1195665 - RNA, 19 nt, Mycobacterium bovis subsp bovis AF2122/97
cucacgugcccgcgcggcg

SEQ ID NO: 1195666 - RNA, 21 nt, Mycobacterium bovis subsp bovis AF2122/97
cucacguggacugaccucguc

SEQ ID NO: 1195667 - RNA, 16 nt, Mycobacterium bovis subsp bovis AF2122/97
cucaacgacaccauag

SEQ ID NO: 1195668 - RNA, 16 nt, Mycobacterium bovis subsp bovis AF2122/97
cucaacgaucgcgccg

SEQ ID NO: 1195669 - RNA, 12 nt, Mycobacterium bovis subsp bovis AF2122/97
cucaacaccagg

SEQ ID NO: 1195670 - RNA, 18 nt, Mycobacterium bovis subsp bovis AF2122/97
cucaacaguucacgaccc

SEQ ID NO: 1195671 - RNA, 21 nt, Mycobacterium bovis subsp bovis AF2122/97
cucaagauuuccaucgcaaug

SEQ ID NO: 1195672 - RNA, 23 nt, Mycobacterium bovis subsp bovis AF2122/97
cucaucccgagaucaccuuggca

SEQ ID NO: 1195673 - RNA, 13 nt, Mycobacterium bovis subsp bovis AF2122/97
cucaugcuggaag

SEQ ID NO: 1195674 - RNA, 15 nt, Mycobacterium bovis subsp bovis AF2122/97
cucaugcccgggaug

SEQ ID NO: 1195675 - RNA, 17 nt, Mycobacterium bovis subsp bovis AF2122/97
cucaugcaucugcuucu

SEQ ID NO: 1195676 - RNA, 22 nt, Mycobacterium bovis subsp bovis AF2122/97
cucauccaccgauggcgcgcuc

SEQ ID NO: 1195677 - RNA, 20 nt, Mycobacterium bovis subsp bovis AF2122/97
cuccaacagguaagccacau

SEQ ID NO: 1195678 - RNA, 20 nt, Mycobacterium bovis subsp bovis AF2122/97
cuccaacaacuccagcaggu

SEQ ID NO: 1195679 - RNA, 14 nt, Mycobacterium bovis subsp bovis AF2122/97
cuccaacaacucca

SEQ ID NO: 1195680 - RNA, 18 nt, Mycobacterium bovis subsp bovis AF2122/97
cuccaauugcggccgcgc

SEQ ID NO: 1195681 - RNA, 21 nt, Mycobacterium bovis subsp bovis AF2122/97
cuccaagcaauuccaccgccg

SEQ ID NO: 1195682 - RNA, 19 nt, Mycobacterium bovis subsp bovis AF2122/97
cuccaaaaucgcggccaca

SEQ ID NO: 1195683 - RNA, 17 nt, Mycobacterium bovis subsp bovis AF2122/97
cucauuggcauugccca

SEQ ID NO: 1195684 - RNA, 17 nt, Mycobacterium bovis subsp bovis AF2122/97
cucauucgugcccgggc

SEQ ID NO: 1195685 - RNA, 12 nt, Mycobacterium bovis subsp bovis AF2122/97
cucagcgcggcc

SEQ ID NO: 1195686 - RNA, 13 nt, Mycobacterium bovis subsp bovis AF2122/97
cucagcgcgcgcc

SEQ ID NO: 1195687 - RNA, 20 nt, Mycobacterium bovis subsp bovis AF2122/97
cucagcgguggcguggugga

SEQ ID NO: 1195688 - RNA, 16 nt, Mycobacterium bovis subsp bovis AF2122/97
cucaguuuggcgggug

SEQ ID NO: 1195689 - RNA, 16 nt, Mycobacterium bovis subsp bovis AF2122/97
cucaguuuuccccugu

SEQ ID NO: 1195690 - RNA, 17 nt, Mycobacterium bovis subsp bovis AF2122/97
cucaguucacguucggc

SEQ ID NO: 1195691 - RNA, 22 nt, Mycobacterium bovis subsp bovis AF2122/97
cucaguguacaccgcgcccgcc

SEQ ID NO: 1195692 - RNA, 21 nt, Mycobacterium bovis subsp bovis AF2122/97
cucaguucugcacagugcggc

SEQ ID NO: 1195693 - RNA, 23 nt, Mycobacterium bovis subsp bovis AF2122/97
cucauagcgacggcgcucggcga

SEQ ID NO: 1195694 - RNA, 16 nt, Mycobacterium bovis subsp bovis AF2122/97
cucauagugcaggucg

SEQ ID NO: 1195695 - RNA, 20 nt, Mycobacterium bovis subsp bovis AF2122/97
cuccaccgaaaaguccgccg

SEQ ID NO: 1195696 - RNA, 14 nt, Mycobacterium bovis subsp bovis AF2122/97
cuccacccaggccg

SEQ ID NO: 1195697 - RNA, 14 nt, Mycobacterium bovis subsp bovis AF2122/97
cuccaccacgaccg

SEQ ID NO: 1195698 - RNA, 14 nt, Mycobacterium bovis subsp bovis AF2122/97
cuccacagcggcca

SEQ ID NO: 1195699 - RNA, 15 nt, Mycobacterium bovis subsp bovis AF2122/97
cuccaccgcgccguc

SEQ ID NO: 1195700 - RNA, 18 nt, Mycobacterium bovis subsp bovis AF2122/97
cuccccgaucagcaccga

SEQ ID NO: 1195701 - RNA, 18 nt, Mycobacterium bovis subsp bovis AF2122/97
cuccccgcuagcccacca

SEQ ID NO: 1195702 - RNA, 20 nt, Mycobacterium bovis subsp bovis AF2122/97
cuccccgcuagcccaccacu

SEQ ID NO: 1195703 - RNA, 17 nt, Mycobacterium bovis subsp bovis AF2122/97
cuccccggucgccgcgu

SEQ ID NO: 1195704 - RNA, 16 nt, Mycobacterium bovis subsp bovis AF2122/97
cuccccguccugccag

SEQ ID NO: 1195705 - RNA, 20 nt, Mycobacterium bovis subsp bovis AF2122/97
cuccgacgggggucgggcgu

SEQ ID NO: 1195706 - RNA, 14 nt, Mycobacterium bovis subsp bovis AF2122/97
cuccgacggccgcg

SEQ ID NO: 1195707 - RNA, 18 nt, Mycobacterium bovis subsp bovis AF2122/97
cuccgaaucugccggccg

SEQ ID NO: 1195708 - RNA, 17 nt, Mycobacterium bovis subsp bovis AF2122/97
cucccucuacacccgga

SEQ ID NO: 1195709 - RNA, 14 nt, Mycobacterium bovis subsp bovis AF2122/97
cuccgaaggccgcc

SEQ ID NO: 1195710 - RNA, 13 nt, Mycobacterium bovis subsp bovis AF2122/97
cucccgggccgcc

SEQ ID NO: 1195711 - RNA, 19 nt, Mycobacterium bovis subsp bovis AF2122/97
cucccgguugggguggcgg

SEQ ID NO: 1195712 - RNA, 14 nt, Mycobacterium bovis subsp bovis AF2122/97
cuccgccugccgcu

SEQ ID NO: 1195713 - RNA, 20 nt, Mycobacterium bovis subsp bovis AF2122/97
cuccgaugccgacggcgccc

SEQ ID NO: 1195714 - RNA, 16 nt, Mycobacterium bovis subsp bovis AF2122/97
cuccgccgucgccacc

SEQ ID NO: 1195715 - RNA, 20 nt, Mycobacterium bovis subsp bovis AF2122/97
cuccgccgucgccgccggcg

SEQ ID NO: 1195716 - RNA, 16 nt, Mycobacterium bovis subsp bovis AF2122/97
cuccgccgugaguuca

SEQ ID NO: 1195717 - RNA, 17 nt, Mycobacterium bovis subsp bovis AF2122/97
cuccgccguugccgccg

SEQ ID NO: 1195718 - RNA, 16 nt, Mycobacterium bovis subsp bovis AF2122/97
cuccgagggcugcgug

SEQ ID NO: 1195719 - RNA, 23 nt, Mycobacterium bovis subsp bovis AF2122/97
cuccgaugaccagggucugcuca

SEQ ID NO: 1195720 - RNA, 23 nt, Mycobacterium bovis subsp bovis AF2122/97
cuccgaugugccgauuggccugc

SEQ ID NO: 1195721 - RNA, 21 nt, Mycobacterium bovis subsp bovis AF2122/97
cuccgguggccaacaccgcca

SEQ ID NO: 1195722 - RNA, 22 nt, Mycobacterium bovis subsp bovis AF2122/97
cuccguaacgccaagcucggcc

SEQ ID NO: 1195723 - RNA, 16 nt, Mycobacterium bovis subsp bovis AF2122/97
cuccgucggccaggcc

SEQ ID NO: 1195724 - RNA, 19 nt, Mycobacterium bovis subsp bovis AF2122/97
cuccgucggccaggccacg

SEQ ID NO: 1195725 - RNA, 17 nt, Mycobacterium bovis subsp bovis AF2122/97
cuccguaacgccaagcu

SEQ ID NO: 1195726 - RNA, 13 nt, Mycobacterium bovis subsp bovis AF2122/97
cuccguugccacc

SEQ ID NO: 1195727 - RNA, 14 nt, Mycobacterium bovis subsp bovis AF2122/97
cuccguugagguag

SEQ ID NO: 1195728 - RNA, 17 nt, Mycobacterium bovis subsp bovis AF2122/97
cuccggcaacagcacca

SEQ ID NO: 1195729 - RNA, 22 nt, Mycobacterium bovis subsp bovis AF2122/97
cuccggcaagcacaccgccagc

SEQ ID NO: 1195730 - RNA, 19 nt, Mycobacterium bovis subsp bovis AF2122/97
cuccggcaccaacgccacc

SEQ ID NO: 1195731 - RNA, 13 nt, Mycobacterium bovis subsp bovis AF2122/97
cuccggaaccacu

SEQ ID NO: 1195732 - RNA, 19 nt, Mycobacterium bovis subsp bovis AF2122/97
cuccgcugccgcccgcgcc

SEQ ID NO: 1195733 - RNA, 13 nt, Mycobacterium bovis subsp bovis AF2122/97
cuccgcugccgcc

SEQ ID NO: 1195734 - RNA, 14 nt, Mycobacterium bovis subsp bovis AF2122/97
cuccgcugccgccc

SEQ ID NO: 1195735 - RNA, 14 nt, Mycobacterium bovis subsp bovis AF2122/97
cuccgcggcgcgca

SEQ ID NO: 1195736 - RNA, 19 nt, Mycobacterium bovis subsp bovis AF2122/97
cuccgcggcgcgcaacaca

SEQ ID NO: 1195737 - RNA, 18 nt, Mycobacterium bovis subsp bovis AF2122/97
cuccgcgguuguuucggc

SEQ ID NO: 1195738 - RNA, 20 nt, Mycobacterium bovis subsp bovis AF2122/97
cuccgcggcgaaccagcgcg

SEQ ID NO: 1195739 - RNA, 18 nt, Mycobacterium bovis subsp bovis AF2122/97
cuccgcggaacccagcac

SEQ ID NO: 1195740 - RNA, 17 nt, Mycobacterium bovis subsp bovis AF2122/97
cuccugcuggcccugcu

SEQ ID NO: 1195741 - RNA, 22 nt, Mycobacterium bovis subsp bovis AF2122/97
cuccuggaaaggacggccggcc

SEQ ID NO: 1195742 - RNA, 23 nt, Mycobacterium bovis subsp bovis AF2122/97
cuccuggaaaggacggccggccg

SEQ ID NO: 1195743 - RNA, 19 nt, Mycobacterium bovis subsp bovis AF2122/97
cuccugcucgucgagccga

SEQ ID NO: 1195744 - RNA, 21 nt, Mycobacterium bovis subsp bovis AF2122/97
cuccugcggcaccgcugagga

SEQ ID NO: 1195745 - RNA, 20 nt, Mycobacterium bovis subsp bovis AF2122/97
cuccucauagagcggcacca

SEQ ID NO: 1195746 - RNA, 23 nt, Mycobacterium bovis subsp bovis AF2122/97
cuccucagccaccgcggucagcu

SEQ ID NO: 1195747 - RNA, 19 nt, Mycobacterium bovis subsp bovis AF2122/97
cuccuccaccagugccccg

SEQ ID NO: 1195748 - RNA, 14 nt, Mycobacterium bovis subsp bovis AF2122/97
cuccuccagagaca

SEQ ID NO: 1195749 - RNA, 14 nt, Mycobacterium bovis subsp bovis AF2122/97
cuccuccggcacca

SEQ ID NO: 1195750 - RNA, 14 nt, Mycobacterium bovis subsp bovis AF2122/97
cuccucgguguaga

SEQ ID NO: 1195751 - RNA, 19 nt, Mycobacterium bovis subsp bovis AF2122/97
cuccucgucgacgucggca

SEQ ID NO: 1195752 - RNA, 14 nt, Mycobacterium bovis subsp bovis AF2122/97
cuccucgucgcucc

SEQ ID NO: 1195753 - RNA, 15 nt, Mycobacterium bovis subsp bovis AF2122/97
cuccucgugcacgca

SEQ ID NO: 1195754 - RNA, 23 nt, Mycobacterium bovis subsp bovis AF2122/97
cuccucgugcacgcacagcccga

SEQ ID NO: 1195755 - RNA, 23 nt, Mycobacterium bovis subsp bovis AF2122/97
cuccucgugcaggaccagcaccg

SEQ ID NO: 1195756 - RNA, 13 nt, Mycobacterium bovis subsp bovis AF2122/97
cucgaggaccugc

SEQ ID NO: 1195757 - RNA, 16 nt, Mycobacterium bovis subsp bovis AF2122/97
cucgaucaucgggagc

SEQ ID NO: 1195758 - RNA, 21 nt, Mycobacterium bovis subsp bovis AF2122/97
cucgagggauguagugcugcu

SEQ ID NO: 1195759 - RNA, 13 nt, Mycobacterium bovis subsp bovis AF2122/97
cucgagcgcgccg

SEQ ID NO: 1195760 - RNA, 14 nt, Mycobacterium bovis subsp bovis AF2122/97
cucgagcgcgccgc

SEQ ID NO: 1195761 - RNA, 13 nt, Mycobacterium bovis subsp bovis AF2122/97
cucgagcugcugg

SEQ ID NO: 1195762 - RNA, 19 nt, Mycobacterium bovis subsp bovis AF2122/97
cucgagcugcuggcgcgcc

SEQ ID NO: 1195763 - RNA, 12 nt, Mycobacterium bovis subsp bovis AF2122/97
cucgagccgccc

SEQ ID NO: 1195764 - RNA, 19 nt, Mycobacterium bovis subsp bovis AF2122/97
cucgagcccgcguucagga

SEQ ID NO: 1195765 - RNA, 15 nt, Mycobacterium bovis subsp bovis AF2122/97
cucgagcaugcccag

SEQ ID NO: 1195766 - RNA, 19 nt, Mycobacterium bovis subsp bovis AF2122/97
cucgacgaucugcagcacu

SEQ ID NO: 1195767 - RNA, 14 nt, Mycobacterium bovis subsp bovis AF2122/97
cucgcacagccgcu

SEQ ID NO: 1195768 - RNA, 15 nt, Mycobacterium bovis subsp bovis AF2122/97
cucgcacagcaccac

SEQ ID NO: 1195769 - RNA, 16 nt, Mycobacterium bovis subsp bovis AF2122/97
cucgcacagcaccacg

SEQ ID NO: 1195770 - RNA, 20 nt, Mycobacterium bovis subsp bovis AF2122/97
cucgcacccgcucggcgcgc

SEQ ID NO: 1195771 - RNA, 15 nt, Mycobacterium bovis subsp bovis AF2122/97
cucgcacucguugcc

SEQ ID NO: 1195772 - RNA, 23 nt, Mycobacterium bovis subsp bovis AF2122/97
cucgcacucguugccgaccaugc

SEQ ID NO: 1195773 - RNA, 24 nt, Mycobacterium bovis subsp bovis AF2122/97
cucgauccacugccgcgcgcccgc

SEQ ID NO: 1195774 - RNA, 15 nt, Mycobacterium bovis subsp bovis AF2122/97
cucgaucggcagcca

SEQ ID NO: 1195775 - RNA, 18 nt, Mycobacterium bovis subsp bovis AF2122/97
cucgaggucgagcgccgc

SEQ ID NO: 1195776 - RNA, 21 nt, Mycobacterium bovis subsp bovis AF2122/97
cucgaugacaucggucagcgg

SEQ ID NO: 1195777 - RNA, 17 nt, Mycobacterium bovis subsp bovis AF2122/97
cucgaucuugggccacg

SEQ ID NO: 1195778 - RNA, 20 nt, Mycobacterium bovis subsp bovis AF2122/97
cucgaugaugucgagcacac

SEQ ID NO: 1195779 - RNA, 12 nt, Mycobacterium bovis subsp bovis AF2122/97
cucgccgcgcgu

SEQ ID NO: 1195780 - RNA, 17 nt, Mycobacterium bovis subsp bovis AF2122/97
cucgccgcgacugcacc

SEQ ID NO: 1195781 - RNA, 14 nt, Mycobacterium bovis subsp bovis AF2122/97
cucgccgccgcugu

SEQ ID NO: 1195782 - RNA, 19 nt, Mycobacterium bovis subsp bovis AF2122/97
cucgccgcacgccggcaug

SEQ ID NO: 1195783 - RNA, 16 nt, Mycobacterium bovis subsp bovis AF2122/97
cucgccgaccuuggcg

SEQ ID NO: 1195784 - RNA, 14 nt, Mycobacterium bovis subsp bovis AF2122/97
cucgccgaccagcu

SEQ ID NO: 1195785 - RNA, 18 nt, Mycobacterium bovis subsp bovis AF2122/97
cucgccgagcagacacag

SEQ ID NO: 1195786 - RNA, 14 nt, Mycobacterium bovis subsp bovis AF2122/97
cucgccgagcucgg

SEQ ID NO: 1195787 - RNA, 23 nt, Mycobacterium bovis subsp bovis AF2122/97
cucgccgaggccuaccaggcgcg

SEQ ID NO: 1195788 - RNA, 18 nt, Mycobacterium bovis subsp bovis AF2122/97
cucgccgcacgccggcau

SEQ ID NO: 1195789 - RNA, 12 nt, Mycobacterium bovis subsp bovis AF2122/97
cucgccgccgcu

SEQ ID NO: 1195790 - RNA, 23 nt, Mycobacterium bovis subsp bovis AF2122/97
cucgcccgccgccaccagcugcg

SEQ ID NO: 1195791 - RNA, 13 nt, Mycobacterium bovis subsp bovis AF2122/97
cucgcccugcaga

SEQ ID NO: 1195792 - RNA, 22 nt, Mycobacterium bovis subsp bovis AF2122/97
cucgcccugagaacacguucgg

SEQ ID NO: 1195793 - RNA, 16 nt, Mycobacterium bovis subsp bovis AF2122/97
cucgcccuugaccgaa

SEQ ID NO: 1195794 - RNA, 21 nt, Mycobacterium bovis subsp bovis AF2122/97
cucgccgaaaagggcgacagc

SEQ ID NO: 1195795 - RNA, 21 nt, Mycobacterium bovis subsp bovis AF2122/97
cucgcaggaauucgccauagc

SEQ ID NO: 1195796 - RNA, 18 nt, Mycobacterium bovis subsp bovis AF2122/97
cucgcaggcgcagauucc

SEQ ID NO: 1195797 - RNA, 11 nt, Mycobacterium bovis subsp bovis AF2122/97
cucgcccaggg

SEQ ID NO: 1195798 - RNA, 23 nt, Mycobacterium bovis subsp bovis AF2122/97
cucgcaguucaucgggcaccaac

SEQ ID NO: 1195799 - RNA, 19 nt, Mycobacterium bovis subsp bovis AF2122/97
cucgcauguucuccacgcc

SEQ ID NO: 1195800 - RNA, 14 nt, Mycobacterium bovis subsp bovis AF2122/97
cucgccccagugcu

SEQ ID NO: 1195801 - RNA, 22 nt, Mycobacterium bovis subsp bovis AF2122/97
cucgcccccucuagcgccucgc

SEQ ID NO: 1195802 - RNA, 23 nt, Mycobacterium bovis subsp bovis AF2122/97
cuccuggcaaccgaauugaacug

SEQ ID NO: 1195803 - RNA, 14 nt, Mycobacterium bovis subsp bovis AF2122/97
cuccuggucaaccg

SEQ ID NO: 1195804 - RNA, 20 nt, Mycobacterium bovis subsp bovis AF2122/97
cuccuguaacugcuccuggu

SEQ ID NO: 1195805 - RNA, 22 nt, Mycobacterium bovis subsp bovis AF2122/97
cuccuuaucgucgacgccgauc

SEQ ID NO: 1195806 - RNA, 13 nt, Mycobacterium bovis subsp bovis AF2122/97
cuccuugagguca

SEQ ID NO: 1195807 - RNA, 17 nt, Mycobacterium bovis subsp bovis AF2122/97
cuccuugaaccgggaca

SEQ ID NO: 1195808 - RNA, 14 nt, Mycobacterium bovis subsp bovis AF2122/97
cuccuugaggucac

SEQ ID NO: 1195809 - RNA, 17 nt, Mycobacterium bovis subsp bovis AF2122/97
cuccuuggccguucggc

SEQ ID NO: 1195810 - RNA, 19 nt, Mycobacterium bovis subsp bovis AF2122/97
cucgaaaccguggccaucg

SEQ ID NO: 1195811 - RNA, 14 nt, Mycobacterium bovis subsp bovis AF2122/97
cucgaacgccgccc

SEQ ID NO: 1195812 - RNA, 22 nt, Mycobacterium bovis subsp bovis AF2122/97
cucgaagaugucgucaccgugg

SEQ ID NO: 1195813 - RNA, 18 nt, Mycobacterium bovis subsp bovis AF2122/97
cucgaccgcccggcuagg

SEQ ID NO: 1195814 - RNA, 17 nt, Mycobacterium bovis subsp bovis AF2122/97
cucgaccucagacagcu

SEQ ID NO: 1195815 - RNA, 14 nt, Mycobacterium bovis subsp bovis AF2122/97
cucgaauacaccuu

SEQ ID NO: 1195816 - RNA, 16 nt, Mycobacterium bovis subsp bovis AF2122/97
cucgaccgccagcccg

SEQ ID NO: 1195817 - RNA, 19 nt, Mycobacterium bovis subsp bovis AF2122/97
cucgccugcacgcccggcg

SEQ ID NO: 1195818 - RNA, 15 nt, Mycobacterium bovis subsp bovis AF2122/97
cucgcgacaucaccg

SEQ ID NO: 1195819 - RNA, 19 nt, Mycobacterium bovis subsp bovis AF2122/97
cucgcgaucgcagugagca

SEQ ID NO: 1195820 - RNA, 22 nt, Mycobacterium bovis subsp bovis AF2122/97
cucgcgaucugcucguagcggc

SEQ ID NO: 1195821 - RNA, 22 nt, Mycobacterium bovis subsp bovis AF2122/97
cucggcaagucgacgccgcagc

SEQ ID NO: 1195822 - RNA, 15 nt, Mycobacterium bovis subsp bovis AF2122/97
cucggcagccggcuu

SEQ ID NO: 1195823 - RNA, 11 nt, Mycobacterium bovis subsp bovis AF2122/97
cucggcaggcc

SEQ ID NO: 1195824 - RNA, 15 nt, Mycobacterium bovis subsp bovis AF2122/97
cucggcauccaggcu

SEQ ID NO: 1195825 - RNA, 22 nt, Mycobacterium bovis subsp bovis AF2122/97
cucggcgacugcgucggcggcu

SEQ ID NO: 1195826 - RNA, 20 nt, Mycobacterium bovis subsp bovis AF2122/97
cucggcgaaggccgcgcgca

SEQ ID NO: 1195827 - RNA, 21 nt, Mycobacterium bovis subsp bovis AF2122/97
cucggcgaccugccggaccgc

SEQ ID NO: 1195828 - RNA, 22 nt, Mycobacterium bovis subsp bovis AF2122/97
cucggccuguucggcggcugcc

SEQ ID NO: 1195829 - RNA, 15 nt, Mycobacterium bovis subsp bovis AF2122/97
cucggccagcacgcc

SEQ ID NO: 1195830 - RNA, 17 nt, Mycobacterium bovis subsp bovis AF2122/97
cucggccagcacgccgc

SEQ ID NO: 1195831 - RNA, 12 nt, Mycobacterium bovis subsp bovis AF2122/97
cucggccaccag

SEQ ID NO: 1195832 - RNA, 23 nt, Mycobacterium bovis subsp bovis AF2122/97
cucggccacgaacccucagccgc

SEQ ID NO: 1195833 - RNA, 22 nt, Mycobacterium bovis subsp bovis AF2122/97
cucggcggcgcggucgaagcug

SEQ ID NO: 1195834 - RNA, 12 nt, Mycobacterium bovis subsp bovis AF2122/97
cucggcggccuc

SEQ ID NO: 1195835 - RNA, 12 nt, Mycobacterium bovis subsp bovis AF2122/97
cucggcggccgc

SEQ ID NO: 1195836 - RNA, 21 nt, Mycobacterium bovis subsp bovis AF2122/97
cucggcgggggaccccgccag

SEQ ID NO: 1195837 - RNA, 18 nt, Mycobacterium bovis subsp bovis AF2122/97
cucggcggugccgcggcu

SEQ ID NO: 1195838 - RNA, 17 nt, Mycobacterium bovis subsp bovis AF2122/97
cucggcgguaaaugccu

SEQ ID NO: 1195839 - RNA, 14 nt, Mycobacterium bovis subsp bovis AF2122/97
cucggcggcccggc

SEQ ID NO: 1195840 - RNA, 19 nt, Mycobacterium bovis subsp bovis AF2122/97
cucggcggccagcucggcc

SEQ ID NO: 1195841 - RNA, 14 nt, Mycobacterium bovis subsp bovis AF2122/97
cucggcgaugcuga

SEQ ID NO: 1195842 - RNA, 13 nt, Mycobacterium bovis subsp bovis AF2122/97
cucggcggcagcg

SEQ ID NO: 1195843 - RNA, 16 nt, Mycobacterium bovis subsp bovis AF2122/97
cucggcggccaacagc

SEQ ID NO: 1195844 - RNA, 14 nt, Mycobacterium bovis subsp bovis AF2122/97
cucggcggccagcg

SEQ ID NO: 1195845 - RNA, 15 nt, Mycobacterium bovis subsp bovis AF2122/97
cucggcggccagcga

SEQ ID NO: 1195846 - RNA, 16 nt, Mycobacterium bovis subsp bovis AF2122/97
cucggcgaucaagccu

SEQ ID NO: 1195847 - RNA, 22 nt, Mycobacterium bovis subsp bovis AF2122/97
cucggcgaucaauugcccggca

SEQ ID NO: 1195848 - RNA, 17 nt, Mycobacterium bovis subsp bovis AF2122/97
cucggcgagcucaguga

SEQ ID NO: 1195849 - RNA, 20 nt, Mycobacterium bovis subsp bovis AF2122/97
cucgggugcauucugcggca

SEQ ID NO: 1195850 - RNA, 14 nt, Mycobacterium bovis subsp bovis AF2122/97
cucggggugguggu

SEQ ID NO: 1195851 - RNA, 23 nt, Mycobacterium bovis subsp bovis AF2122/97
cucggguacaucgaggccacgcc

SEQ ID NO: 1195852 - RNA, 12 nt, Mycobacterium bovis subsp bovis AF2122/97
cucgggggcugc

SEQ ID NO: 1195853 - RNA, 19 nt, Mycobacterium bovis subsp bovis AF2122/97
cucggugcagcagcgcgcg

SEQ ID NO: 1195854 - RNA, 23 nt, Mycobacterium bovis subsp bovis AF2122/97
cucggugauguagggcugcuccu

SEQ ID NO: 1195855 - RNA, 21 nt, Mycobacterium bovis subsp bovis AF2122/97
cucggucaacgcuucggcacg

SEQ ID NO: 1195856 - RNA, 19 nt, Mycobacterium bovis subsp bovis AF2122/97
cucgguagcauccagcgcg

SEQ ID NO: 1195857 - RNA, 16 nt, Mycobacterium bovis subsp bovis AF2122/97
cucgucggcgccggcg

SEQ ID NO: 1195858 - RNA, 21 nt, Mycobacterium bovis subsp bovis AF2122/97
cucgucggcgccggcggccgc

SEQ ID NO: 1195859 - RNA, 15 nt, Mycobacterium bovis subsp bovis AF2122/97
cucgucggucaccga

SEQ ID NO: 1195860 - RNA, 16 nt, Mycobacterium bovis subsp bovis AF2122/97
cucgucggccagugcg

SEQ ID NO: 1195861 - RNA, 21 nt, Mycobacterium bovis subsp bovis AF2122/97
cucgucggccgacaccgccac

SEQ ID NO: 1195862 - RNA, 24 nt, Mycobacterium bovis subsp bovis AF2122/97
cucgucggccugguacucccgcga

SEQ ID NO: 1195863 - RNA, 17 nt, Mycobacterium bovis subsp bovis AF2122/97
cucgucgcgggccaccg

SEQ ID NO: 1195864 - RNA, 18 nt, Mycobacterium bovis subsp bovis AF2122/97
cucgucgcgggccaccgc

SEQ ID NO: 1195865 - RNA, 20 nt, Mycobacterium bovis subsp bovis AF2122/97
cucguccaagccggccacgc

SEQ ID NO: 1195866 - RNA, 22 nt, Mycobacterium bovis subsp bovis AF2122/97
cucguccaagccggccacgcau

SEQ ID NO: 1195867 - RNA, 16 nt, Mycobacterium bovis subsp bovis AF2122/97
cucggugccggccgca

SEQ ID NO: 1195868 - RNA, 13 nt, Mycobacterium bovis subsp bovis AF2122/97
cucggugccgccc

SEQ ID NO: 1195869 - RNA, 13 nt, Mycobacterium bovis subsp bovis AF2122/97
cucggugccggcc

SEQ ID NO: 1195870 - RNA, 15 nt, Mycobacterium bovis subsp bovis AF2122/97
cucggugcgccagau

SEQ ID NO: 1195871 - RNA, 18 nt, Mycobacterium bovis subsp bovis AF2122/97
cucggugcggaacaccgc

SEQ ID NO: 1195872 - RNA, 13 nt, Mycobacterium bovis subsp bovis AF2122/97
cucggugcggcug

SEQ ID NO: 1195873 - RNA, 16 nt, Mycobacterium bovis subsp bovis AF2122/97
cucgguggccuucugg

SEQ ID NO: 1195874 - RNA, 19 nt, Mycobacterium bovis subsp bovis AF2122/97
cucggugccugucagaagg

SEQ ID NO: 1195875 - RNA, 19 nt, Mycobacterium bovis subsp bovis AF2122/97
cucggugcggugauuccag

SEQ ID NO: 1195876 - RNA, 19 nt, Mycobacterium bovis subsp bovis AF2122/97
cucguaggcguacaccagg

SEQ ID NO: 1195877 - RNA, 16 nt, Mycobacterium bovis subsp bovis AF2122/97
cucguaggugaagagc

SEQ ID NO: 1195878 - RNA, 20 nt, Mycobacterium bovis subsp bovis AF2122/97
cucguaggugaagagcacgu

SEQ ID NO: 1195879 - RNA, 15 nt, Mycobacterium bovis subsp bovis AF2122/97
cucguaggugccgaa

SEQ ID NO: 1195880 - RNA, 22 nt, Mycobacterium bovis subsp bovis AF2122/97
cucgguggugaccaaguagucg

SEQ ID NO: 1195881 - RNA, 14 nt, Mycobacterium bovis subsp bovis AF2122/97
cucguagagcaccg

SEQ ID NO: 1195882 - RNA, 15 nt, Mycobacterium bovis subsp bovis AF2122/97
cucgucggugucggu

SEQ ID NO: 1195883 - RNA, 15 nt, Mycobacterium bovis subsp bovis AF2122/97
cucgucguccggcca

SEQ ID NO: 1195884 - RNA, 16 nt, Mycobacterium bovis subsp bovis AF2122/97
cucgucgucgauccag

SEQ ID NO: 1195885 - RNA, 20 nt, Mycobacterium bovis subsp bovis AF2122/97
cucgucgucgauccagccca

SEQ ID NO: 1195886 - RNA, 20 nt, Mycobacterium bovis subsp bovis AF2122/97
cucguguccggggaccucgg

SEQ ID NO: 1195887 - RNA, 19 nt, Mycobacterium bovis subsp bovis AF2122/97
cucguguuguugaagcccg

SEQ ID NO: 1195888 - RNA, 22 nt, Mycobacterium bovis subsp bovis AF2122/97
cucguugcguugcaucagcacg

SEQ ID NO: 1195889 - RNA, 24 nt, Mycobacterium bovis subsp bovis AF2122/97
cucguucagcgucgacugaacggu

SEQ ID NO: 1195890 - RNA, 18 nt, Mycobacterium bovis subsp bovis AF2122/97
cucguguaccggagcggu

SEQ ID NO: 1195891 - RNA, 22 nt, Mycobacterium bovis subsp bovis AF2122/97
cucguugagcagcuggaccacc

SEQ ID NO: 1195892 - RNA, 20 nt, Mycobacterium bovis subsp bovis AF2122/97
cucguuagaguaggccacca

SEQ ID NO: 1195893 - RNA, 15 nt, Mycobacterium bovis subsp bovis AF2122/97
cucuagcaaagccag

SEQ ID NO: 1195894 - RNA, 23 nt, Mycobacterium bovis subsp bovis AF2122/97
cucuagcgccucgccggccaccc

SEQ ID NO: 1195895 - RNA, 14 nt, Mycobacterium bovis subsp bovis AF2122/97
cucugcgccaggcg

SEQ ID NO: 1195896 - RNA, 16 nt, Mycobacterium bovis subsp bovis AF2122/97
cucugcgucugcucac

SEQ ID NO: 1195897 - RNA, 22 nt, Mycobacterium bovis subsp bovis AF2122/97
cucugcgucugcucaccagcgg

SEQ ID NO: 1195898 - RNA, 20 nt, Mycobacterium bovis subsp bovis AF2122/97
cucuggugacggugaagccg

SEQ ID NO: 1195899 - RNA, 20 nt, Mycobacterium bovis subsp bovis AF2122/97
cucugguggcgcugaagccg

SEQ ID NO: 1195900 - RNA, 22 nt, Mycobacterium bovis subsp bovis AF2122/97
cucuggucgucgaacggcagcc

SEQ ID NO: 1195901 - RNA, 15 nt, Mycobacterium bovis subsp bovis AF2122/97
cucugaaccagcuga

SEQ ID NO: 1195902 - RNA, 19 nt, Mycobacterium bovis subsp bovis AF2122/97
cucugagcgggcgggccug

SEQ ID NO: 1195903 - RNA, 16 nt, Mycobacterium bovis subsp bovis AF2122/97
cucucuuugagcaggu

SEQ ID NO: 1195904 - RNA, 18 nt, Mycobacterium bovis subsp bovis AF2122/97
cucucguggauggccgcc

SEQ ID NO: 1195905 - RNA, 21 nt, Mycobacterium bovis subsp bovis AF2122/97
cucucuucgcgcgcugggcgc

SEQ ID NO: 1195906 - RNA, 17 nt, Mycobacterium bovis subsp bovis AF2122/97
cucucggcacccggcag

SEQ ID NO: 1195907 - RNA, 19 nt, Mycobacterium bovis subsp bovis AF2122/97
cucucggucaguuccucua

SEQ ID NO: 1195908 - RNA, 17 nt, Mycobacterium bovis subsp bovis AF2122/97
cucucggucaguuccuc

SEQ ID NO: 1195909 - RNA, 18 nt, Mycobacterium bovis subsp bovis AF2122/97
cucucggucaguuccucu

SEQ ID NO: 1195910 - RNA, 16 nt, Mycobacterium bovis subsp bovis AF2122/97
cucucgcagcuccucg

SEQ ID NO: 1195911 - RNA, 16 nt, Mycobacterium bovis subsp bovis AF2122/97
cucucggcacccggca

SEQ ID NO: 1195912 - RNA, 13 nt, Mycobacterium bovis subsp bovis AF2122/97
cucuccguccucg

SEQ ID NO: 1195913 - RNA, 20 nt, Mycobacterium bovis subsp bovis AF2122/97
cucuucgaucuguuccugca

SEQ ID NO: 1195914 - RNA, 20 nt, Mycobacterium bovis subsp bovis AF2122/97
cucuucgaugaagcugguga

SEQ ID NO: 1195915 - RNA, 13 nt, Mycobacterium bovis subsp bovis AF2122/97
cucuucagcuacc

SEQ ID NO: 1195916 - RNA, 22 nt, Mycobacterium bovis subsp bovis AF2122/97
cucuucaggcccucgggacugc

SEQ ID NO: 1195917 - RNA, 14 nt, Mycobacterium bovis subsp bovis AF2122/97
cucugucuucagcu

SEQ ID NO: 1195918 - RNA, 21 nt, Mycobacterium bovis subsp bovis AF2122/97
cucugguuuuacacaccagcg

SEQ ID NO: 1195919 - RNA, 16 nt, Mycobacterium bovis subsp bovis AF2122/97
cucugucgcguugugg

SEQ ID NO: 1195920 - RNA, 13 nt, Mycobacterium bovis subsp bovis AF2122/97
cucuugcaccagg

SEQ ID NO: 1195921 - RNA, 19 nt, Mycobacterium bovis subsp bovis AF2122/97
cucuugcacucggcgcccu

SEQ ID NO: 1195922 - RNA, 13 nt, Mycobacterium bovis subsp bovis AF2122/97
cucuugcccuucu

SEQ ID NO: 1195923 - RNA, 21 nt, Mycobacterium bovis subsp bovis AF2122/97
cucuugcgggcagccgcccgc

SEQ ID NO: 1195924 - RNA, 20 nt, Mycobacterium bovis subsp bovis AF2122/97
cucuucggucagggugggcu

SEQ ID NO: 1195925 - RNA, 21 nt, Mycobacterium bovis subsp bovis AF2122/97
cucuucggucagggugggcuc

SEQ ID NO: 1195926 - RNA, 17 nt, Mycobacterium bovis subsp bovis AF2122/97
cucuucgggugcagcca

SEQ ID NO: 1195927 - RNA, 16 nt, Mycobacterium bovis subsp bovis AF2122/97
cugaaaauugaccccc

SEQ ID NO: 1195928 - RNA, 23 nt, Mycobacterium bovis subsp bovis AF2122/97
cugaaaccuugcggcagaccaag

SEQ ID NO: 1195929 - RNA, 19 nt, Mycobacterium bovis subsp bovis AF2122/97
cugaaacgcuuggcccugg

SEQ ID NO: 1195930 - RNA, 13 nt, Mycobacterium bovis subsp bovis AF2122/97
cugaaaacaccgc

SEQ ID NO: 1195931 - RNA, 21 nt, Mycobacterium bovis subsp bovis AF2122/97
cugaacauacgaaacaugcgc

SEQ ID NO: 1195932 - RNA, 16 nt, Mycobacterium bovis subsp bovis AF2122/97
cugaacaccgugggcg

SEQ ID NO: 1195933 - RNA, 19 nt, Mycobacterium bovis subsp bovis AF2122/97
cugaaaucgguggccacca

SEQ ID NO: 1195934 - RNA, 13 nt, Mycobacterium bovis subsp bovis AF2122/97
cugaagagcaaug

SEQ ID NO: 1195935 - RNA, 18 nt, Mycobacterium bovis subsp bovis AF2122/97
cugaagccagcgcagcac

SEQ ID NO: 1195936 - RNA, 13 nt, Mycobacterium bovis subsp bovis AF2122/97
cugaagccagcgc

SEQ ID NO: 1195937 - RNA, 16 nt, Mycobacterium bovis subsp bovis AF2122/97
cugaaccguagcgccc

SEQ ID NO: 1195938 - RNA, 18 nt, Mycobacterium bovis subsp bovis AF2122/97
cugaacgguucggccggg

SEQ ID NO: 1195939 - RNA, 15 nt, Mycobacterium bovis subsp bovis AF2122/97
cugaacucaacacca

SEQ ID NO: 1195940 - RNA, 17 nt, Mycobacterium bovis subsp bovis AF2122/97
cugaacucaacaccagc

SEQ ID NO: 1195941 - RNA, 14 nt, Mycobacterium bovis subsp bovis AF2122/97
cugaccgccagcgg

SEQ ID NO: 1195942 - RNA, 22 nt, Mycobacterium bovis subsp bovis AF2122/97
cugaccgcuaccagcugggcga

SEQ ID NO: 1195943 - RNA, 13 nt, Mycobacterium bovis subsp bovis AF2122/97
cugaccggcuauu

SEQ ID NO: 1195944 - RNA, 12 nt, Mycobacterium bovis subsp bovis AF2122/97
cugaccccgccg

SEQ ID NO: 1195945 - RNA, 15 nt, Mycobacterium bovis subsp bovis AF2122/97
cugaccgaagaagcc

SEQ ID NO: 1195946 - RNA, 17 nt, Mycobacterium bovis subsp bovis AF2122/97
cugaccgaagaagcccg

SEQ ID NO: 1195947 - RNA, 18 nt, Mycobacterium bovis subsp bovis AF2122/97
cugaccgaagaagcccga

SEQ ID NO: 1195948 - RNA, 17 nt, Mycobacterium bovis subsp bovis AF2122/97
cugaccccccgaccccg

SEQ ID NO: 1195949 - RNA, 14 nt, Mycobacterium bovis subsp bovis AF2122/97
cugacccaccgccc

SEQ ID NO: 1195950 - RNA, 13 nt, Mycobacterium bovis subsp bovis AF2122/97
cugacauuuccac

SEQ ID NO: 1195951 - RNA, 20 nt, Mycobacterium bovis subsp bovis AF2122/97
cugaccaugaccgggcuggc

SEQ ID NO: 1195952 - RNA, 23 nt, Mycobacterium bovis subsp bovis AF2122/97
cugaccaucacacccaucacccu

SEQ ID NO: 1195953 - RNA, 13 nt, Mycobacterium bovis subsp bovis AF2122/97
cugaccagcgucc

SEQ ID NO: 1195954 - RNA, 22 nt, Mycobacterium bovis subsp bovis AF2122/97
cugaccacgucggacagcuuuc

SEQ ID NO: 1195955 - RNA, 21 nt, Mycobacterium bovis subsp bovis AF2122/97
cugacaacggccacaugccac

SEQ ID NO: 1195956 - RNA, 20 nt, Mycobacterium bovis subsp bovis AF2122/97
cugacaagccuuaccccgca

SEQ ID NO: 1195957 - RNA, 14 nt, Mycobacterium bovis subsp bovis AF2122/97
cugacaucggccaa

SEQ ID NO: 1195958 - RNA, 19 nt, Mycobacterium bovis subsp bovis AF2122/97
cugaaguggcacaagcugg

SEQ ID NO: 1195959 - RNA, 22 nt, Mycobacterium bovis subsp bovis AF2122/97
cugaaguggcacaagcugggga

SEQ ID NO: 1195960 - RNA, 13 nt, Mycobacterium bovis subsp bovis AF2122/97
cugaagggccgcc

SEQ ID NO: 1195961 - RNA, 17 nt, Mycobacterium bovis subsp bovis AF2122/97
cugaaggacggcagcuu

SEQ ID NO: 1195962 - RNA, 16 nt, Mycobacterium bovis subsp bovis AF2122/97
cugaaggccagccaac

SEQ ID NO: 1195963 - RNA, 20 nt, Mycobacterium bovis subsp bovis AF2122/97
cugaagcuuguccagauauc

SEQ ID NO: 1195964 - RNA, 16 nt, Mycobacterium bovis subsp bovis AF2122/97
cugacgccgagcuggu

SEQ ID NO: 1195965 - RNA, 19 nt, Mycobacterium bovis subsp bovis AF2122/97
cugacgccgagcugguuga

SEQ ID NO: 1195966 - RNA, 17 nt, Mycobacterium bovis subsp bovis AF2122/97
cugacgcccucauaggc

SEQ ID NO: 1195967 - RNA, 13 nt, Mycobacterium bovis subsp bovis AF2122/97
cugacgccauuca

SEQ ID NO: 1195968 - RNA, 20 nt, Mycobacterium bovis subsp bovis AF2122/97
cugacgaucauugcacccac

SEQ ID NO: 1195969 - RNA, 15 nt, Mycobacterium bovis subsp bovis AF2122/97
cugacgacugggcgc

SEQ ID NO: 1195970 - RNA, 20 nt, Mycobacterium bovis subsp bovis AF2122/97
cugacgacugggcgcccaag

SEQ ID NO: 1195971 - RNA, 13 nt, Mycobacterium bovis subsp bovis AF2122/97
cugacgaguugau

SEQ ID NO: 1195972 - RNA, 17 nt, Mycobacterium bovis subsp bovis AF2122/97
cugacgaccggcuaccg

SEQ ID NO: 1195973 - RNA, 16 nt, Mycobacterium bovis subsp bovis AF2122/97
cugacgaccaaccacc

SEQ ID NO: 1195974 - RNA, 21 nt, Mycobacterium bovis subsp bovis AF2122/97
cugacgagcagcuagcccggc

SEQ ID NO: 1195975 - RNA, 22 nt, Mycobacterium bovis subsp bovis AF2122/97
cugacgagcagcuagcccggca

SEQ ID NO: 1195976 - RNA, 21 nt, Mycobacterium bovis subsp bovis AF2122/97
cugaccucgucaaucaccacc

SEQ ID NO: 1195977 - RNA, 15 nt, Mycobacterium bovis subsp bovis AF2122/97
cugaccuucaggccc

SEQ ID NO: 1195978 - RNA, 17 nt, Mycobacterium bovis subsp bovis AF2122/97
cugaccuucaggcccug

SEQ ID NO: 1195979 - RNA, 21 nt, Mycobacterium bovis subsp bovis AF2122/97
cugaccuucucacgcaccaug

SEQ ID NO: 1195980 - RNA, 13 nt, Mycobacterium bovis subsp bovis AF2122/97
cugacgggccgcu

SEQ ID NO: 1195981 - RNA, 15 nt, Mycobacterium bovis subsp bovis AF2122/97
cugacggcuuccaac

SEQ ID NO: 1195982 - RNA, 13 nt, Mycobacterium bovis subsp bovis AF2122/97
cugacggugggga

SEQ ID NO: 1195983 - RNA, 14 nt, Mycobacterium bovis subsp bovis AF2122/97
cugacgguggggau

SEQ ID NO: 1195984 - RNA, 15 nt, Mycobacterium bovis subsp bovis AF2122/97
cugacgguggggaug

SEQ ID NO: 1195985 - RNA, 17 nt, Mycobacterium bovis subsp bovis AF2122/97
cugacggugcaggacca

SEQ ID NO: 1195986 - RNA, 18 nt, Mycobacterium bovis subsp bovis AF2122/97
cugacggccauggacgcc

SEQ ID NO: 1195987 - RNA, 19 nt, Mycobacterium bovis subsp bovis AF2122/97
cugacgcucggucgccacc

SEQ ID NO: 1195988 - RNA, 15 nt, Mycobacterium bovis subsp bovis AF2122/97
cugacgcggccgggc

SEQ ID NO: 1195989 - RNA, 22 nt, Mycobacterium bovis subsp bovis AF2122/97
cugacgcgucagcggcgagcag

SEQ ID NO: 1195990 - RNA, 21 nt, Mycobacterium bovis subsp bovis AF2122/97
cugacgucacguucggcgcaa

SEQ ID NO: 1195991 - RNA, 15 nt, Mycobacterium bovis subsp bovis AF2122/97
cugacgugaagcaga

SEQ ID NO: 1195992 - RNA, 22 nt, Mycobacterium bovis subsp bovis AF2122/97
cugacgguucggucggggagcu

SEQ ID NO: 1195993 - RNA, 13 nt, Mycobacterium bovis subsp bovis AF2122/97
cugacgugucggc

SEQ ID NO: 1195994 - RNA, 16 nt, Mycobacterium bovis subsp bovis AF2122/97
cugacuagggucaccg

SEQ ID NO: 1195995 - RNA, 21 nt, Mycobacterium bovis subsp bovis AF2122/97
cugagccgcaucuggccggcg

SEQ ID NO: 1195996 - RNA, 24 nt, Mycobacterium bovis subsp bovis AF2122/97
cugagcccgccgcgaccacgcacc

SEQ ID NO: 1195997 - RNA, 17 nt, Mycobacterium bovis subsp bovis AF2122/97
cugagcacggcgcggcg

SEQ ID NO: 1195998 - RNA, 16 nt, Mycobacterium bovis subsp bovis AF2122/97
cugagcgcggguggca

SEQ ID NO: 1195999 - RNA, 14 nt, Mycobacterium bovis subsp bovis AF2122/97
cugagcgacugcag

SEQ ID NO: 1196000 - RNA, 21 nt, Mycobacterium bovis subsp bovis AF2122/97
cugagcgaagugucgcugcaa

SEQ ID NO: 1196001 - RNA, 18 nt, Mycobacterium bovis subsp bovis AF2122/97
cugagcgccaggccgcac

SEQ ID NO: 1196002 - RNA, 23 nt, Mycobacterium bovis subsp bovis AF2122/97
cugagcgccaggccgcacagcac

SEQ ID NO: 1196003 - RNA, 13 nt, Mycobacterium bovis subsp bovis AF2122/97
cugagcagcgccg

SEQ ID NO: 1196004 - RNA, 16 nt, Mycobacterium bovis subsp bovis AF2122/97
cugagaugaugcguga

SEQ ID NO: 1196005 - RNA, 14 nt, Mycobacterium bovis subsp bovis AF2122/97
cugagacugccgcc

SEQ ID NO: 1196006 - RNA, 16 nt, Mycobacterium bovis subsp bovis AF2122/97
cugcccgaaccaccac

SEQ ID NO: 1196007 - RNA, 18 nt, Mycobacterium bovis subsp bovis AF2122/97
cugcccgagguccgcccu

SEQ ID NO: 1196008 - RNA, 12 nt, Mycobacterium bovis subsp bovis AF2122/97
cugccccuccgg

SEQ ID NO: 1196009 - RNA, 15 nt, Mycobacterium bovis subsp bovis AF2122/97
cugccccgccaccuc

SEQ ID NO: 1196010 - RNA, 17 nt, Mycobacterium bovis subsp bovis AF2122/97
cugcccccggcgcggcg

SEQ ID NO: 1196011 - RNA, 20 nt, Mycobacterium bovis subsp bovis AF2122/97
cugcccgccagcgccgccgc

SEQ ID NO: 1196012 - RNA, 15 nt, Mycobacterium bovis subsp bovis AF2122/97
cugcccgcccagccc

SEQ ID NO: 1196013 - RNA, 23 nt, Mycobacterium bovis subsp bovis AF2122/97
cugcccgcccagcccggcguugu

SEQ ID NO: 1196014 - RNA, 19 nt, Mycobacterium bovis subsp bovis AF2122/97
cugcccgccgacgccagau

SEQ ID NO: 1196015 - RNA, 20 nt, Mycobacterium bovis subsp bovis AF2122/97
cugcccgucgucggcaacca

SEQ ID NO: 1196016 - RNA, 19 nt, Mycobacterium bovis subsp bovis AF2122/97
cugcccguucugcccaggc

SEQ ID NO: 1196017 - RNA, 14 nt, Mycobacterium bovis subsp bovis AF2122/97
cugccgcacccggu

SEQ ID NO: 1196018 - RNA, 15 nt, Mycobacterium bovis subsp bovis AF2122/97
cugccgcacccgguc

SEQ ID NO: 1196019 - RNA, 15 nt, Mycobacterium bovis subsp bovis AF2122/97
cugccgcacgggccc

SEQ ID NO: 1196020 - RNA, 16 nt, Mycobacterium bovis subsp bovis AF2122/97
cugccgcacguucggc

SEQ ID NO: 1196021 - RNA, 15 nt, Mycobacterium bovis subsp bovis AF2122/97
cugccgcacugggcg

SEQ ID NO: 1196022 - RNA, 16 nt, Mycobacterium bovis subsp bovis AF2122/97
cugccgcacugggcga

SEQ ID NO: 1196023 - RNA, 19 nt, Mycobacterium bovis subsp bovis AF2122/97
cugccgcaguucaucgaga

SEQ ID NO: 1196024 - RNA, 18 nt, Mycobacterium bovis subsp bovis AF2122/97
cugccgcaccaaggccgc

SEQ ID NO: 1196025 - RNA, 13 nt, Mycobacterium bovis subsp bovis AF2122/97
cugcccugguugg

SEQ ID NO: 1196026 - RNA, 19 nt, Mycobacterium bovis subsp bovis AF2122/97
cugcccucaacgaucgcgc

SEQ ID NO: 1196027 - RNA, 17 nt, Mycobacterium bovis subsp bovis AF2122/97
cugccagcacccugaug

SEQ ID NO: 1196028 - RNA, 20 nt, Mycobacterium bovis subsp bovis AF2122/97
cugccagaucggucggccaa

SEQ ID NO: 1196029 - RNA, 18 nt, Mycobacterium bovis subsp bovis AF2122/97
cugcccaaaaggaagacc

SEQ ID NO: 1196030 - RNA, 20 nt, Mycobacterium bovis subsp bovis AF2122/97
cugcccaaaagcgcggcaac

SEQ ID NO: 1196031 - RNA, 23 nt, Mycobacterium bovis subsp bovis AF2122/97
cugcccacgcggauaucuugcgc

SEQ ID NO: 1196032 - RNA, 15 nt, Mycobacterium bovis subsp bovis AF2122/97
cugcccccgcgcgca

SEQ ID NO: 1196033 - RNA, 16 nt, Mycobacterium bovis subsp bovis AF2122/97
cugccagcguugcgga

SEQ ID NO: 1196034 - RNA, 13 nt, Mycobacterium bovis subsp bovis AF2122/97
cugccauugccug

SEQ ID NO: 1196035 - RNA, 16 nt, Mycobacterium bovis subsp bovis AF2122/97
cugccauugccugggc

SEQ ID NO: 1196036 - RNA, 18 nt, Mycobacterium bovis subsp bovis AF2122/97
cugcagcucgggcaggga

SEQ ID NO: 1196037 - RNA, 18 nt, Mycobacterium bovis subsp bovis AF2122/97
cugcagcgccucgauccg

SEQ ID NO: 1196038 - RNA, 19 nt, Mycobacterium bovis subsp bovis AF2122/97
cugcagcgaugacgaccaa

SEQ ID NO: 1196039 - RNA, 15 nt, Mycobacterium bovis subsp bovis AF2122/97
cugcagcgagaccuc

SEQ ID NO: 1196040 - RNA, 15 nt, Mycobacterium bovis subsp bovis AF2122/97
cugcagcccaugggc

SEQ ID NO: 1196041 - RNA, 16 nt, Mycobacterium bovis subsp bovis AF2122/97
cugcagcccaugggcg

SEQ ID NO: 1196042 - RNA, 16 nt, Mycobacterium bovis subsp bovis AF2122/97
cugcauccuccucguc

SEQ ID NO: 1196043 - RNA, 15 nt, Mycobacterium bovis subsp bovis AF2122/97
cugccaacgggccau

SEQ ID NO: 1196044 - RNA, 19 nt, Mycobacterium bovis subsp bovis AF2122/97
cugccaaaagggcggcagc

SEQ ID NO: 1196045 - RNA, 17 nt, Mycobacterium bovis subsp bovis AF2122/97
cugcaccgauucgggcu

SEQ ID NO: 1196046 - RNA, 18 nt, Mycobacterium bovis subsp bovis AF2122/97
cugcacccgccagggcgg

SEQ ID NO: 1196047 - RNA, 13 nt, Mycobacterium bovis subsp bovis AF2122/97
cugcaccuggccg

SEQ ID NO: 1196048 - RNA, 16 nt, Mycobacterium bovis subsp bovis AF2122/97
cugcaccuggcgcagc

SEQ ID NO: 1196049 - RNA, 23 nt, Mycobacterium bovis subsp bovis AF2122/97
cugcaccuggcgcagcaacucga

SEQ ID NO: 1196050 - RNA, 19 nt, Mycobacterium bovis subsp bovis AF2122/97
cugcagcacgacgugcguc

SEQ ID NO: 1196051 - RNA, 15 nt, Mycobacterium bovis subsp bovis AF2122/97
cugcacgccggcgcu

SEQ ID NO: 1196052 - RNA, 20 nt, Mycobacterium bovis subsp bovis AF2122/97
cugcacauaguccgagcggu

SEQ ID NO: 1196053 - RNA, 17 nt, Mycobacterium bovis subsp bovis AF2122/97
cugcacauucagcgccg

SEQ ID NO: 1196054 - RNA, 15 nt, Mycobacterium bovis subsp bovis AF2122/97
cugcacagcaggcuc

SEQ ID NO: 1196055 - RNA, 21 nt, Mycobacterium bovis subsp bovis AF2122/97
cugauuccacugggccugcca

SEQ ID NO: 1196056 - RNA, 21 nt, Mycobacterium bovis subsp bovis AF2122/97
cugauucgcaggcucagcugg

SEQ ID NO: 1196057 - RNA, 14 nt, Mycobacterium bovis subsp bovis AF2122/97
cugauggacggugc

SEQ ID NO: 1196058 - RNA, 14 nt, Mycobacterium bovis subsp bovis AF2122/97
cugaugcucuggga

SEQ ID NO: 1196059 - RNA, 21 nt, Mycobacterium bovis subsp bovis AF2122/97
cugaugaaccacggcaggcag

SEQ ID NO: 1196060 - RNA, 18 nt, Mycobacterium bovis subsp bovis AF2122/97
cugagcgggcgggccugc

SEQ ID NO: 1196061 - RNA, 19 nt, Mycobacterium bovis subsp bovis AF2122/97
cugaugacgguguggaaac

SEQ ID NO: 1196062 - RNA, 18 nt, Mycobacterium bovis subsp bovis AF2122/97
cugcggcgucguugagga

SEQ ID NO: 1196063 - RNA, 20 nt, Mycobacterium bovis subsp bovis AF2122/97
cugcggcgcccggucgagcc

SEQ ID NO: 1196064 - RNA, 16 nt, Mycobacterium bovis subsp bovis AF2122/97
cugcggcucagaaccc

SEQ ID NO: 1196065 - RNA, 13 nt, Mycobacterium bovis subsp bovis AF2122/97
cugcggcuccggc

SEQ ID NO: 1196066 - RNA, 20 nt, Mycobacterium bovis subsp bovis AF2122/97
cugcguaguugauggccccg

SEQ ID NO: 1196067 - RNA, 12 nt, Mycobacterium bovis subsp bovis AF2122/97
cugcggcugcuu

SEQ ID NO: 1196068 - RNA, 15 nt, Mycobacterium bovis subsp bovis AF2122/97
cugcggccgcgaggu

SEQ ID NO: 1196069 - RNA, 17 nt, Mycobacterium bovis subsp bovis AF2122/97
cugcggcccaugaucuc

SEQ ID NO: 1196070 - RNA, 15 nt, Mycobacterium bovis subsp bovis AF2122/97
cugcggcauggcagg

SEQ ID NO: 1196071 - RNA, 18 nt, Mycobacterium bovis subsp bovis AF2122/97
cugcggcccacaccagcg

SEQ ID NO: 1196072 - RNA, 21 nt, Mycobacterium bovis subsp bovis AF2122/97
cugcggaucggacaacacggc

SEQ ID NO: 1196073 - RNA, 18 nt, Mycobacterium bovis subsp bovis AF2122/97
cugcggaucguggcgccc

SEQ ID NO: 1196074 - RNA, 17 nt, Mycobacterium bovis subsp bovis AF2122/97
cugcggaugcgcggcgg

SEQ ID NO: 1196075 - RNA, 23 nt, Mycobacterium bovis subsp bovis AF2122/97
cugcggauuaagucggcggccuu

SEQ ID NO: 1196076 - RNA, 22 nt, Mycobacterium bovis subsp bovis AF2122/97
cugcgccucggcggccagcucg

SEQ ID NO: 1196077 - RNA, 13 nt, Mycobacterium bovis subsp bovis AF2122/97
cugcgcugcacca

SEQ ID NO: 1196078 - RNA, 16 nt, Mycobacterium bovis subsp bovis AF2122/97
cugcggauccaccacg

SEQ ID NO: 1196079 - RNA, 22 nt, Mycobacterium bovis subsp bovis AF2122/97
cugcggauccaccacgcuggcc

SEQ ID NO: 1196080 - RNA, 17 nt, Mycobacterium bovis subsp bovis AF2122/97
cugcgccaggggcacca

SEQ ID NO: 1196081 - RNA, 14 nt, Mycobacterium bovis subsp bovis AF2122/97
cugcgccaggucag

SEQ ID NO: 1196082 - RNA, 14 nt, Mycobacterium bovis subsp bovis AF2122/97
cugcgccgccggcg

SEQ ID NO: 1196083 - RNA, 16 nt, Mycobacterium bovis subsp bovis AF2122/97
cugcgccgcgcgcggc

SEQ ID NO: 1196084 - RNA, 21 nt, Mycobacterium bovis subsp bovis AF2122/97
cugcgccggugccggccaucg

SEQ ID NO: 1196085 - RNA, 19 nt, Mycobacterium bovis subsp bovis AF2122/97
cugcgccgguaacuguccg

SEQ ID NO: 1196086 - RNA, 19 nt, Mycobacterium bovis subsp bovis AF2122/97
cugcgccggugccggccau

SEQ ID NO: 1196087 - RNA, 16 nt, Mycobacterium bovis subsp bovis AF2122/97
cugcgccgugacccau

SEQ ID NO: 1196088 - RNA, 15 nt, Mycobacterium bovis subsp bovis AF2122/97
cugcgccguucgcuc

SEQ ID NO: 1196089 - RNA, 21 nt, Mycobacterium bovis subsp bovis AF2122/97
cugcgccagaaagcccagggg

SEQ ID NO: 1196090 - RNA, 18 nt, Mycobacterium bovis subsp bovis AF2122/97
cugcgccacccgcggugc

SEQ ID NO: 1196091 - RNA, 20 nt, Mycobacterium bovis subsp bovis AF2122/97
cugcgcaauagcgacagcag

SEQ ID NO: 1196092 - RNA, 12 nt, Mycobacterium bovis subsp bovis AF2122/97
cugcgcaccugg

SEQ ID NO: 1196093 - RNA, 17 nt, Mycobacterium bovis subsp bovis AF2122/97
cugcgcacgucgggccc

SEQ ID NO: 1196094 - RNA, 20 nt, Mycobacterium bovis subsp bovis AF2122/97
cugcgcaaauugcaacagag

SEQ ID NO: 1196095 - RNA, 23 nt, Mycobacterium bovis subsp bovis AF2122/97
cugcgcaacaccgugcaccagcu

SEQ ID NO: 1196096 - RNA, 15 nt, Mycobacterium bovis subsp bovis AF2122/97
cugcgacacaacggg

SEQ ID NO: 1196097 - RNA, 21 nt, Mycobacterium bovis subsp bovis AF2122/97
cugcgaaugcugggcccgcca

SEQ ID NO: 1196098 - RNA, 22 nt, Mycobacterium bovis subsp bovis AF2122/97
cugcgaccucgccggacgggug

SEQ ID NO: 1196099 - RNA, 19 nt, Mycobacterium bovis subsp bovis AF2122/97
cugcgagauguccucccau

SEQ ID NO: 1196100 - RNA, 18 nt, Mycobacterium bovis subsp bovis AF2122/97
cugcgacuaagggcacuc

SEQ ID NO: 1196101 - RNA, 18 nt, Mycobacterium bovis subsp bovis AF2122/97
cugccgccgcuccaugac

SEQ ID NO: 1196102 - RNA, 19 nt, Mycobacterium bovis subsp bovis AF2122/97
cugccgccgcuccaugaca

SEQ ID NO: 1196103 - RNA, 16 nt, Mycobacterium bovis subsp bovis AF2122/97
cugccgccgagcuggc

SEQ ID NO: 1196104 - RNA, 14 nt, Mycobacterium bovis subsp bovis AF2122/97
cugccgcgaugagc

SEQ ID NO: 1196105 - RNA, 14 nt, Mycobacterium bovis subsp bovis AF2122/97
cugccgccggcccc

SEQ ID NO: 1196106 - RNA, 18 nt, Mycobacterium bovis subsp bovis AF2122/97
cugccgccggccccgccg

SEQ ID NO: 1196107 - RNA, 13 nt, Mycobacterium bovis subsp bovis AF2122/97
cugccgccggccc

SEQ ID NO: 1196108 - RNA, 16 nt, Mycobacterium bovis subsp bovis AF2122/97
cugccgcacccccucc

SEQ ID NO: 1196109 - RNA, 19 nt, Mycobacterium bovis subsp bovis AF2122/97
cugccgcaugcgcuccggc

SEQ ID NO: 1196110 - RNA, 14 nt, Mycobacterium bovis subsp bovis AF2122/97
cugccgcagcucag

SEQ ID NO: 1196111 - RNA, 15 nt, Mycobacterium bovis subsp bovis AF2122/97
cugccgccaggcucg

SEQ ID NO: 1196112 - RNA, 15 nt, Mycobacterium bovis subsp bovis AF2122/97
cugccuuaccaaccg

SEQ ID NO: 1196113 - RNA, 13 nt, Mycobacterium bovis subsp bovis AF2122/97
cugccgcgcggcg

SEQ ID NO: 1196114 - RNA, 17 nt, Mycobacterium bovis subsp bovis AF2122/97
cugccuugggaccgcgc

SEQ ID NO: 1196115 - RNA, 13 nt, Mycobacterium bovis subsp bovis AF2122/97
cugcgaaacgcca

SEQ ID NO: 1196116 - RNA, 16 nt, Mycobacterium bovis subsp bovis AF2122/97
cugcgaaacgccaccg

SEQ ID NO: 1196117 - RNA, 23 nt, Mycobacterium bovis subsp bovis AF2122/97
cugcgaagaguccuuaaacgucg

SEQ ID NO: 1196118 - RNA, 13 nt, Mycobacterium bovis subsp bovis AF2122/97
cugcuggugacga

SEQ ID NO: 1196119 - RNA, 22 nt, Mycobacterium bovis subsp bovis AF2122/97
cugcuggugacgaaagcgccca

SEQ ID NO: 1196120 - RNA, 13 nt, Mycobacterium bovis subsp bovis AF2122/97
cugcuggucacca

SEQ ID NO: 1196121 - RNA, 16 nt, Mycobacterium bovis subsp bovis AF2122/97
cugcuggucaccauca

SEQ ID NO: 1196122 - RNA, 12 nt, Mycobacterium bovis subsp bovis AF2122/97
cugcuggcgcuc

SEQ ID NO: 1196123 - RNA, 19 nt, Mycobacterium bovis subsp bovis AF2122/97
cugcuggccgcggccucgu

SEQ ID NO: 1196124 - RNA, 13 nt, Mycobacterium bovis subsp bovis AF2122/97
cugcuggcagacc

SEQ ID NO: 1196125 - RNA, 12 nt, Mycobacterium bovis subsp bovis AF2122/97
cugcugcagcaa

SEQ ID NO: 1196126 - RNA, 16 nt, Mycobacterium bovis subsp bovis AF2122/97
cugcugcagggccugg

SEQ ID NO: 1196127 - RNA, 18 nt, Mycobacterium bovis subsp bovis AF2122/97
cugcugcagggccuggcc

SEQ ID NO: 1196128 - RNA, 19 nt, Mycobacterium bovis subsp bovis AF2122/97
cugcugcagggccuggcca

SEQ ID NO: 1196129 - RNA, 13 nt, Mycobacterium bovis subsp bovis AF2122/97
cugcugagcugcu

SEQ ID NO: 1196130 - RNA, 11 nt, Mycobacterium bovis subsp bovis AF2122/97
cugcugcucgg

SEQ ID NO: 1196131 - RNA, 16 nt, Mycobacterium bovis subsp bovis AF2122/97
cugcugcucggccugg

SEQ ID NO: 1196132 - RNA, 16 nt, Mycobacterium bovis subsp bovis AF2122/97
cugcugcggcagcgcg

SEQ ID NO: 1196133 - RNA, 16 nt, Mycobacterium bovis subsp bovis AF2122/97
cugcugccgcaccggu

SEQ ID NO: 1196134 - RNA, 19 nt, Mycobacterium bovis subsp bovis AF2122/97
cugcugccgcaccggugcu

SEQ ID NO: 1196135 - RNA, 14 nt, Mycobacterium bovis subsp bovis AF2122/97
cugcugccagccga

SEQ ID NO: 1196136 - RNA, 17 nt, Mycobacterium bovis subsp bovis AF2122/97
cugcucgauacggcccu

SEQ ID NO: 1196137 - RNA, 17 nt, Mycobacterium bovis subsp bovis AF2122/97
cugcucgcacagcacca

SEQ ID NO: 1196138 - RNA, 15 nt, Mycobacterium bovis subsp bovis AF2122/97
cugcucgccagccgg

SEQ ID NO: 1196139 - RNA, 16 nt, Mycobacterium bovis subsp bovis AF2122/97
cugcucgccaggccua

SEQ ID NO: 1196140 - RNA, 13 nt, Mycobacterium bovis subsp bovis AF2122/97
cugcuccuggaag

SEQ ID NO: 1196141 - RNA, 11 nt, Mycobacterium bovis subsp bovis AF2122/97
cugcuccugga

SEQ ID NO: 1196142 - RNA, 13 nt, Mycobacterium bovis subsp bovis AF2122/97
cugcuccucgguc

SEQ ID NO: 1196143 - RNA, 20 nt, Mycobacterium bovis subsp bovis AF2122/97
cugcuccucggucagcgggg

SEQ ID NO: 1196144 - RNA, 21 nt, Mycobacterium bovis subsp bovis AF2122/97
cugcuccucauagagcggcac

SEQ ID NO: 1196145 - RNA, 20 nt, Mycobacterium bovis subsp bovis AF2122/97
cugcuccucgcgggcggcgu

SEQ ID NO: 1196146 - RNA, 13 nt, Mycobacterium bovis subsp bovis AF2122/97
cugcuccaggcgc

SEQ ID NO: 1196147 - RNA, 14 nt, Mycobacterium bovis subsp bovis AF2122/97
cugcguccagaucu

SEQ ID NO: 1196148 - RNA, 22 nt, Mycobacterium bovis subsp bovis AF2122/97
cugcguccagcaaaugcggcgc

SEQ ID NO: 1196149 - RNA, 14 nt, Mycobacterium bovis subsp bovis AF2122/97
cugcgucguggaga

SEQ ID NO: 1196150 - RNA, 21 nt, Mycobacterium bovis subsp bovis AF2122/97
cugcgucugcucgccagccgg

SEQ ID NO: 1196151 - RNA, 21 nt, Mycobacterium bovis subsp bovis AF2122/97
cugcucggucaggcggcuggc

SEQ ID NO: 1196152 - RNA, 13 nt, Mycobacterium bovis subsp bovis AF2122/97
cugcugaacaacc

SEQ ID NO: 1196153 - RNA, 21 nt, Mycobacterium bovis subsp bovis AF2122/97
cugcucgucgugagacugggc

SEQ ID NO: 1196154 - RNA, 17 nt, Mycobacterium bovis subsp bovis AF2122/97
cugcucgucuuggcggc

SEQ ID NO: 1196155 - RNA, 20 nt, Mycobacterium bovis subsp bovis AF2122/97
cugcucgucgagccgaccgc

SEQ ID NO: 1196156 - RNA, 21 nt, Mycobacterium bovis subsp bovis AF2122/97
cugcucguagcggcggcgccc

SEQ ID NO: 1196157 - RNA, 17 nt, Mycobacterium bovis subsp bovis AF2122/97
cugcucggcggugccgc

SEQ ID NO: 1196158 - RNA, 21 nt, Mycobacterium bovis subsp bovis AF2122/97
cugcucggcggugccgcggcu

SEQ ID NO: 1196159 - RNA, 21 nt, Mycobacterium bovis subsp bovis AF2122/97
cugcucgcgcaaggcgccgca

SEQ ID NO: 1196160 - RNA, 15 nt, Mycobacterium bovis subsp bovis AF2122/97
cugcucgcgcccgcu

SEQ ID NO: 1196161 - RNA, 14 nt, Mycobacterium bovis subsp bovis AF2122/97
cugcucgccggcca

SEQ ID NO: 1196162 - RNA, 15 nt, Mycobacterium bovis subsp bovis AF2122/97
cugcucgccggccaa

SEQ ID NO: 1196163 - RNA, 24 nt, Mycobacterium bovis subsp bovis AF2122/97
cugcucgccggccaacugggccga

SEQ ID NO: 1196164 - RNA, 17 nt, Mycobacterium bovis subsp bovis AF2122/97
cugcucggcgcgccggu

SEQ ID NO: 1196165 - RNA, 15 nt, Mycobacterium bovis subsp bovis AF2122/97
cugcucggcgcggug

SEQ ID NO: 1196166 - RNA, 14 nt, Mycobacterium bovis subsp bovis AF2122/97
cugcucggcgaccg

SEQ ID NO: 1196167 - RNA, 15 nt, Mycobacterium bovis subsp bovis AF2122/97
cugcucggcgcagcu

SEQ ID NO: 1196168 - RNA, 18 nt, Mycobacterium bovis subsp bovis AF2122/97
cugcucggcgcagcuaac

SEQ ID NO: 1196169 - RNA, 13 nt, Mycobacterium bovis subsp bovis AF2122/97
cugcucgcgccgc

SEQ ID NO: 1196170 - RNA, 23 nt, Mycobacterium bovis subsp bovis AF2122/97
cuggccgaauaacagcaggcauu

SEQ ID NO: 1196171 - RNA, 17 nt, Mycobacterium bovis subsp bovis AF2122/97
cuggccagcagagcggc

SEQ ID NO: 1196172 - RNA, 18 nt, Mycobacterium bovis subsp bovis AF2122/97
cuggccagcgaaauacag

SEQ ID NO: 1196173 - RNA, 14 nt, Mycobacterium bovis subsp bovis AF2122/97
cuggccagcgcgcu

SEQ ID NO: 1196174 - RNA, 19 nt, Mycobacterium bovis subsp bovis AF2122/97
cuggccagcagagcggcac

SEQ ID NO: 1196175 - RNA, 13 nt, Mycobacterium bovis subsp bovis AF2122/97
cuggccaguccga

SEQ ID NO: 1196176 - RNA, 19 nt, Mycobacterium bovis subsp bovis AF2122/97
cuggcagccgaaguggcgc

SEQ ID NO: 1196177 - RNA, 15 nt, Mycobacterium bovis subsp bovis AF2122/97
cuggcagcggccucc

SEQ ID NO: 1196178 - RNA, 18 nt, Mycobacterium bovis subsp bovis AF2122/97
cuggcagcggccuccggg

SEQ ID NO: 1196179 - RNA, 18 nt, Mycobacterium bovis subsp bovis AF2122/97
cuggcagcuccucgcgcu

SEQ ID NO: 1196180 - RNA, 20 nt, Mycobacterium bovis subsp bovis AF2122/97
cuggccacggggcugccggu

SEQ ID NO: 1196181 - RNA, 21 nt, Mycobacterium bovis subsp bovis AF2122/97
cuggcaccucccgggcgagcc

SEQ ID NO: 1196182 - RNA, 16 nt, Mycobacterium bovis subsp bovis AF2122/97
cuggcacgcagagcca

SEQ ID NO: 1196183 - RNA, 16 nt, Mycobacterium bovis subsp bovis AF2122/97
cuggcagaccaacgcu

SEQ ID NO: 1196184 - RNA, 17 nt, Mycobacterium bovis subsp bovis AF2122/97
cuggcagaccaacgcuc

SEQ ID NO: 1196185 - RNA, 22 nt, Mycobacterium bovis subsp bovis AF2122/97
cuggccgauggcgucaagcaca

SEQ ID NO: 1196186 - RNA, 13 nt, Mycobacterium bovis subsp bovis AF2122/97
cuggccgccaccg

SEQ ID NO: 1196187 - RNA, 14 nt, Mycobacterium bovis subsp bovis AF2122/97
cuggccgcccggcg

SEQ ID NO: 1196188 - RNA, 11 nt, Mycobacterium bovis subsp bovis AF2122/97
cuggccgcgau

SEQ ID NO: 1196189 - RNA, 15 nt, Mycobacterium bovis subsp bovis AF2122/97
cuggccgccggcccc

SEQ ID NO: 1196190 - RNA, 20 nt, Mycobacterium bovis subsp bovis AF2122/97
cuggccgccggccccgccgu

SEQ ID NO: 1196191 - RNA, 15 nt, Mycobacterium bovis subsp bovis AF2122/97
cuggccgccgcgcac

SEQ ID NO: 1196192 - RNA, 16 nt, Mycobacterium bovis subsp bovis AF2122/97
cuggccgcgccgggga

SEQ ID NO: 1196193 - RNA, 12 nt, Mycobacterium bovis subsp bovis AF2122/97
cuggccgcgccu

SEQ ID NO: 1196194 - RNA, 16 nt, Mycobacterium bovis subsp bovis AF2122/97
cuggccgcgccucggu

SEQ ID NO: 1196195 - RNA, 16 nt, Mycobacterium bovis subsp bovis AF2122/97
cuggccgggaccgccc

SEQ ID NO: 1196196 - RNA, 12 nt, Mycobacterium bovis subsp bovis AF2122/97
cuggccgucagc

SEQ ID NO: 1196197 - RNA, 20 nt, Mycobacterium bovis subsp bovis AF2122/97
cuggccggugcgcagguacg

SEQ ID NO: 1196198 - RNA, 22 nt, Mycobacterium bovis subsp bovis AF2122/97
cuggccggugguagcggacagc

SEQ ID NO: 1196199 - RNA, 20 nt, Mycobacterium bovis subsp bovis AF2122/97
cuggccuuggcaguccagcc

SEQ ID NO: 1196200 - RNA, 22 nt, Mycobacterium bovis subsp bovis AF2122/97
cuggccuuugagcgcggccacc

SEQ ID NO: 1196201 - RNA, 16 nt, Mycobacterium bovis subsp bovis AF2122/97
cuggcgaaggacaaca

SEQ ID NO: 1196202 - RNA, 23 nt, Mycobacterium bovis subsp bovis AF2122/97
cuggcgaacucgaggucgagcgc

SEQ ID NO: 1196203 - RNA, 17 nt, Mycobacterium bovis subsp bovis AF2122/97
cuggcgaacucgcgcag

SEQ ID NO: 1196204 - RNA, 21 nt, Mycobacterium bovis subsp bovis AF2122/97
cuggcgaacucgcgcaggaag

SEQ ID NO: 1196205 - RNA, 22 nt, Mycobacterium bovis subsp bovis AF2122/97
cuggcgacggugcgcuggaugu

SEQ ID NO: 1196206 - RNA, 20 nt, Mycobacterium bovis subsp bovis AF2122/97
cuggcgacucgugucugccu

SEQ ID NO: 1196207 - RNA, 22 nt, Mycobacterium bovis subsp bovis AF2122/97
cuggcgaaugcgggccuccugc

SEQ ID NO: 1196208 - RNA, 23 nt, Mycobacterium bovis subsp bovis AF2122/97
cuggauguaguuggcgaccugcg

SEQ ID NO: 1196209 - RNA, 12 nt, Mycobacterium bovis subsp bovis AF2122/97
cuggauggcgcu

SEQ ID NO: 1196210 - RNA, 22 nt, Mycobacterium bovis subsp bovis AF2122/97
cuggcaacgacacgccgcuccc

SEQ ID NO: 1196211 - RNA, 20 nt, Mycobacterium bovis subsp bovis AF2122/97
cugcugugucguacccggca

SEQ ID NO: 1196212 - RNA, 21 nt, Mycobacterium bovis subsp bovis AF2122/97
cugcuguuccaucaaggucau

SEQ ID NO: 1196213 - RNA, 17 nt, Mycobacterium bovis subsp bovis AF2122/97
cugcuguuucggcagga

SEQ ID NO: 1196214 - RNA, 21 nt, Mycobacterium bovis subsp bovis AF2122/97
cuggaucaacccggccuucuc

SEQ ID NO: 1196215 - RNA, 18 nt, Mycobacterium bovis subsp bovis AF2122/97
cuggcuggugauggccau

SEQ ID NO: 1196216 - RNA, 19 nt, Mycobacterium bovis subsp bovis AF2122/97
cuggcuggugauggccauc

SEQ ID NO: 1196217 - RNA, 15 nt, Mycobacterium bovis subsp bovis AF2122/97
cuggcuucucgcagu

SEQ ID NO: 1196218 - RNA, 15 nt, Mycobacterium bovis subsp bovis AF2122/97
cuggcuggaccacuc

SEQ ID NO: 1196219 - RNA, 18 nt, Mycobacterium bovis subsp bovis AF2122/97
cuggcuggaccacucgcc

SEQ ID NO: 1196220 - RNA, 22 nt, Mycobacterium bovis subsp bovis AF2122/97
cuggcuggaccacucgccggcg

SEQ ID NO: 1196221 - RNA, 23 nt, Mycobacterium bovis subsp bovis AF2122/97
cuggcuggaccacucgccggcgg

SEQ ID NO: 1196222 - RNA, 18 nt, Mycobacterium bovis subsp bovis AF2122/97
cuggcgcccuugccggcg

SEQ ID NO: 1196223 - RNA, 18 nt, Mycobacterium bovis subsp bovis AF2122/97
cuggcgccggccagccag

SEQ ID NO: 1196224 - RNA, 21 nt, Mycobacterium bovis subsp bovis AF2122/97
cuggcgugucgccgccaccag

SEQ ID NO: 1196225 - RNA, 23 nt, Mycobacterium bovis subsp bovis AF2122/97
cuggcguuguugacgaucacccc

SEQ ID NO: 1196226 - RNA, 15 nt, Mycobacterium bovis subsp bovis AF2122/97
cuggcuacgccuccu

SEQ ID NO: 1196227 - RNA, 16 nt, Mycobacterium bovis subsp bovis AF2122/97
cuggcuacgggccgcg

SEQ ID NO: 1196228 - RNA, 17 nt, Mycobacterium bovis subsp bovis AF2122/97
cugggcggugaaggccc

SEQ ID NO: 1196229 - RNA, 15 nt, Mycobacterium bovis subsp bovis AF2122/97
cugggcgcgcuggcg

SEQ ID NO: 1196230 - RNA, 14 nt, Mycobacterium bovis subsp bovis AF2122/97
cugggcggccgggc

SEQ ID NO: 1196231 - RNA, 15 nt, Mycobacterium bovis subsp bovis AF2122/97
cugggcgcuggaggc

SEQ ID NO: 1196232 - RNA, 16 nt, Mycobacterium bovis subsp bovis AF2122/97
cugggccgccgcccug

SEQ ID NO: 1196233 - RNA, 18 nt, Mycobacterium bovis subsp bovis AF2122/97
cugggccgcuccaccacg

SEQ ID NO: 1196234 - RNA, 14 nt, Mycobacterium bovis subsp bovis AF2122/97
cugggccggggagg

SEQ ID NO: 1196235 - RNA, 22 nt, Mycobacterium bovis subsp bovis AF2122/97
cugggccggugcgaauggugca

SEQ ID NO: 1196236 - RNA, 19 nt, Mycobacterium bovis subsp bovis AF2122/97
cugggcccgagcgcgcgcu

SEQ ID NO: 1196237 - RNA, 16 nt, Mycobacterium bovis subsp bovis AF2122/97
cugggccgagcgcgcc

SEQ ID NO: 1196238 - RNA, 21 nt, Mycobacterium bovis subsp bovis AF2122/97
cugggcguaaaccguggccgc

SEQ ID NO: 1196239 - RNA, 17 nt, Mycobacterium bovis subsp bovis AF2122/97
cugggcuggcugaccga

SEQ ID NO: 1196240 - RNA, 13 nt, Mycobacterium bovis subsp bovis AF2122/97
cuggggugcugcg

SEQ ID NO: 1196241 - RNA, 20 nt, Mycobacterium bovis subsp bovis AF2122/97
cuggggugcugcgcgcggcg

SEQ ID NO: 1196242 - RNA, 21 nt, Mycobacterium bovis subsp bovis AF2122/97
cugggguagccaucggcuagg

SEQ ID NO: 1196243 - RNA, 15 nt, Mycobacterium bovis subsp bovis AF2122/97
cugggcaccggcggu

SEQ ID NO: 1196244 - RNA, 20 nt, Mycobacterium bovis subsp bovis AF2122/97
cugggcaccggcggucugca

SEQ ID NO: 1196245 - RNA, 19 nt, Mycobacterium bovis subsp bovis AF2122/97
cugggcagaccgaucggca

SEQ ID NO: 1196246 - RNA, 17 nt, Mycobacterium bovis subsp bovis AF2122/97
cugggccagcagccguu

SEQ ID NO: 1196247 - RNA, 19 nt, Mycobacterium bovis subsp bovis AF2122/97
cugggcaaacugggcaccg

SEQ ID NO: 1196248 - RNA, 19 nt, Mycobacterium bovis subsp bovis AF2122/97
cugggcaaugacuugcgac

SEQ ID NO: 1196249 - RNA, 15 nt, Mycobacterium bovis subsp bovis AF2122/97
cugggauucugggcg

SEQ ID NO: 1196250 - RNA, 14 nt, Mycobacterium bovis subsp bovis AF2122/97
cugggacggcggca

SEQ ID NO: 1196251 - RNA, 17 nt, Mycobacterium bovis subsp bovis AF2122/97
cugguguagccgagcac

SEQ ID NO: 1196252 - RNA, 19 nt, Mycobacterium bovis subsp bovis AF2122/97
cugguguccaccgcaaagg

SEQ ID NO: 1196253 - RNA, 13 nt, Mycobacterium bovis subsp bovis AF2122/97
cuggugggccauc

SEQ ID NO: 1196254 - RNA, 14 nt, Mycobacterium bovis subsp bovis AF2122/97
cuggugggccaucg

SEQ ID NO: 1196255 - RNA, 19 nt, Mycobacterium bovis subsp bovis AF2122/97
cugguggcggcacuggccc

SEQ ID NO: 1196256 - RNA, 20 nt, Mycobacterium bovis subsp bovis AF2122/97
cugguggcggcacuggcccc

SEQ ID NO: 1196257 - RNA, 19 nt, Mycobacterium bovis subsp bovis AF2122/97
cuggugggggagcggccgc

SEQ ID NO: 1196258 - RNA, 23 nt, Mycobacterium bovis subsp bovis AF2122/97
cugguggcgcugaagccgacgau

SEQ ID NO: 1196259 - RNA, 16 nt, Mycobacterium bovis subsp bovis AF2122/97
cugguggcagcgcacc

SEQ ID NO: 1196260 - RNA, 22 nt, Mycobacterium bovis subsp bovis AF2122/97
cugguggacucgggcgcugaug

SEQ ID NO: 1196261 - RNA, 16 nt, Mycobacterium bovis subsp bovis AF2122/97
cuggugcguagcccac

SEQ ID NO: 1196262 - RNA, 19 nt, Mycobacterium bovis subsp bovis AF2122/97
cuggugcguagcccacccg

SEQ ID NO: 1196263 - RNA, 21 nt, Mycobacterium bovis subsp bovis AF2122/97
cugguaaacggguggauugac

SEQ ID NO: 1196264 - RNA, 14 nt, Mycobacterium bovis subsp bovis AF2122/97
cuggguuggcaucc

SEQ ID NO: 1196265 - RNA, 22 nt, Mycobacterium bovis subsp bovis AF2122/97
cuggguuggugauugcggccgc

SEQ ID NO: 1196266 - RNA, 21 nt, Mycobacterium bovis subsp bovis AF2122/97
cuggguuugcacggcgcgcca

SEQ ID NO: 1196267 - RNA, 14 nt, Mycobacterium bovis subsp bovis AF2122/97
cuggguauccaccg

SEQ ID NO: 1196268 - RNA, 22 nt, Mycobacterium bovis subsp bovis AF2122/97
cugguugaacauguccagugcc

SEQ ID NO: 1196269 - RNA, 19 nt, Mycobacterium bovis subsp bovis AF2122/97
cugguuggcacgcaacacc

SEQ ID NO: 1196270 - RNA, 12 nt, Mycobacterium bovis subsp bovis AF2122/97
cugguuggugac

SEQ ID NO: 1196271 - RNA, 20 nt, Mycobacterium bovis subsp bovis AF2122/97
cugguucagccauucuaggu

SEQ ID NO: 1196272 - RNA, 15 nt, Mycobacterium bovis subsp bovis AF2122/97
cugguucaacaccgg

SEQ ID NO: 1196273 - RNA, 22 nt, Mycobacterium bovis subsp bovis AF2122/97
cugguucguuaggucacuccau

SEQ ID NO: 1196274 - RNA, 13 nt, Mycobacterium bovis subsp bovis AF2122/97
cuggugugucccg

SEQ ID NO: 1196275 - RNA, 20 nt, Mycobacterium bovis subsp bovis AF2122/97
cuggugugacgauccccauu

SEQ ID NO: 1196276 - RNA, 22 nt, Mycobacterium bovis subsp bovis AF2122/97
cuguaggccagcccggcgugca

SEQ ID NO: 1196277 - RNA, 15 nt, Mycobacterium bovis subsp bovis AF2122/97
cuguaggcgaccaga

SEQ ID NO: 1196278 - RNA, 15 nt, Mycobacterium bovis subsp bovis AF2122/97
cuguccaggucuggg

SEQ ID NO: 1196279 - RNA, 18 nt, Mycobacterium bovis subsp bovis AF2122/97
cuguccacugccaccgcg

SEQ ID NO: 1196280 - RNA, 22 nt, Mycobacterium bovis subsp bovis AF2122/97
cuguccaccgaggccugacuga

SEQ ID NO: 1196281 - RNA, 18 nt, Mycobacterium bovis subsp bovis AF2122/97
cugucauccccggccagc

SEQ ID NO: 1196282 - RNA, 17 nt, Mycobacterium bovis subsp bovis AF2122/97
cugucauguccugggcc

SEQ ID NO: 1196283 - RNA, 22 nt, Mycobacterium bovis subsp bovis AF2122/97
cuguagcgaaugaucuugccac

SEQ ID NO: 1196284 - RNA, 21 nt, Mycobacterium bovis subsp bovis AF2122/97
cuguagcgaaugaucuugcca

SEQ ID NO: 1196285 - RNA, 21 nt, Mycobacterium bovis subsp bovis AF2122/97
cuguaagacagcuaucccagg

SEQ ID NO: 1196286 - RNA, 17 nt, Mycobacterium bovis subsp bovis AF2122/97
cuguaacugcuccuggu

SEQ ID NO: 1196287 - RNA, 21 nt, Mycobacterium bovis subsp bovis AF2122/97
cuguccggguagcggcgccgc

SEQ ID NO: 1196288 - RNA, 21 nt, Mycobacterium bovis subsp bovis AF2122/97
cugucgauggacaaggugugg

SEQ ID NO: 1196289 - RNA, 18 nt, Mycobacterium bovis subsp bovis AF2122/97
cugugacgccgggcuggg

SEQ ID NO: 1196290 - RNA, 11 nt, Mycobacterium bovis subsp bovis AF2122/97
cugugagguca

SEQ ID NO: 1196291 - RNA, 16 nt, Mycobacterium bovis subsp bovis AF2122/97
cugugauccgacagug

SEQ ID NO: 1196292 - RNA, 18 nt, Mycobacterium bovis subsp bovis AF2122/97
cugugauccgacaguggc

SEQ ID NO: 1196293 - RNA, 20 nt, Mycobacterium bovis subsp bovis AF2122/97
cugugacacccgagggccug

SEQ ID NO: 1196294 - RNA, 21 nt, Mycobacterium bovis subsp bovis AF2122/97
cugugaaucucacgacgccuu

SEQ ID NO: 1196295 - RNA, 16 nt, Mycobacterium bovis subsp bovis AF2122/97
cugugccgcccccggc

SEQ ID NO: 1196296 - RNA, 21 nt, Mycobacterium bovis subsp bovis AF2122/97
cugugccgcugcauccgcagc

SEQ ID NO: 1196297 - RNA, 20 nt, Mycobacterium bovis subsp bovis AF2122/97
cugugccccagggcagugcg

SEQ ID NO: 1196298 - RNA, 16 nt, Mycobacterium bovis subsp bovis AF2122/97
cugugcccgaucagcc

SEQ ID NO: 1196299 - RNA, 22 nt, Mycobacterium bovis subsp bovis AF2122/97
cugugcccggcuccuccccggc

SEQ ID NO: 1196300 - RNA, 18 nt, Mycobacterium bovis subsp bovis AF2122/97
cugugcgcggacaccuuu

SEQ ID NO: 1196301 - RNA, 13 nt, Mycobacterium bovis subsp bovis AF2122/97
cugugcgccgcag

SEQ ID NO: 1196302 - RNA, 14 nt, Mycobacterium bovis subsp bovis AF2122/97
cugugcggagccgc

SEQ ID NO: 1196303 - RNA, 23 nt, Mycobacterium bovis subsp bovis AF2122/97
cugugcggagccgccauugacga

SEQ ID NO: 1196304 - RNA, 13 nt, Mycobacterium bovis subsp bovis AF2122/97
cuguggugacaga

SEQ ID NO: 1196305 - RNA, 21 nt, Mycobacterium bovis subsp bovis AF2122/97
cuguggugacagauccgcccc

SEQ ID NO: 1196306 - RNA, 16 nt, Mycobacterium bovis subsp bovis AF2122/97
cugugguggugauggg

SEQ ID NO: 1196307 - RNA, 23 nt, Mycobacterium bovis subsp bovis AF2122/97
cuguggacacggcgcugcccacg

SEQ ID NO: 1196308 - RNA, 22 nt, Mycobacterium bovis subsp bovis AF2122/97
cugugcucgccggaucuugccg

SEQ ID NO: 1196309 - RNA, 13 nt, Mycobacterium bovis subsp bovis AF2122/97
cuguggcgccgcc

SEQ ID NO: 1196310 - RNA, 13 nt, Mycobacterium bovis subsp bovis AF2122/97
cugugggauuugc

SEQ ID NO: 1196311 - RNA, 20 nt, Mycobacterium bovis subsp bovis AF2122/97
cugugggcgagucgggggcc

SEQ ID NO: 1196312 - RNA, 20 nt, Mycobacterium bovis subsp bovis AF2122/97
cuguuacuccgacggcccgg

SEQ ID NO: 1196313 - RNA, 21 nt, Mycobacterium bovis subsp bovis AF2122/97
cuguuacuccgacggcccggu

SEQ ID NO: 1196314 - RNA, 17 nt, Mycobacterium bovis subsp bovis AF2122/97
cuugacgcgcaacgccg

SEQ ID NO: 1196315 - RNA, 16 nt, Mycobacterium bovis subsp bovis AF2122/97
cuugaccgcugcccag

SEQ ID NO: 1196316 - RNA, 17 nt, Mycobacterium bovis subsp bovis AF2122/97
cuugaccgcugcccagu

SEQ ID NO: 1196317 - RNA, 15 nt, Mycobacterium bovis subsp bovis AF2122/97
cuugaccccuggccg

SEQ ID NO: 1196318 - RNA, 22 nt, Mycobacterium bovis subsp bovis AF2122/97
cuugaccgcggugacucggccu

SEQ ID NO: 1196319 - RNA, 21 nt, Mycobacterium bovis subsp bovis AF2122/97
cuugacccuugggcaccaccc

SEQ ID NO: 1196320 - RNA, 12 nt, Mycobacterium bovis subsp bovis AF2122/97
cuugaccgccug

SEQ ID NO: 1196321 - RNA, 17 nt, Mycobacterium bovis subsp bovis AF2122/97
cuugaccagcagcugaa

SEQ ID NO: 1196322 - RNA, 13 nt, Mycobacterium bovis subsp bovis AF2122/97
cuugaccagagca

SEQ ID NO: 1196323 - RNA, 13 nt, Mycobacterium bovis subsp bovis AF2122/97
cuugaccacagcg

SEQ ID NO: 1196324 - RNA, 20 nt, Mycobacterium bovis subsp bovis AF2122/97
cuugaagaaacccugcugcg

SEQ ID NO: 1196325 - RNA, 16 nt, Mycobacterium bovis subsp bovis AF2122/97
cuugacugcacaccac

SEQ ID NO: 1196326 - RNA, 13 nt, Mycobacterium bovis subsp bovis AF2122/97
cuugagacgccgg

SEQ ID NO: 1196327 - RNA, 20 nt, Mycobacterium bovis subsp bovis AF2122/97
cuugaucucggcgagcaccg

SEQ ID NO: 1196328 - RNA, 15 nt, Mycobacterium bovis subsp bovis AF2122/97
cuugaucgacggcca

SEQ ID NO: 1196329 - RNA, 15 nt, Mycobacterium bovis subsp bovis AF2122/97
cuugaucgagcaggg

SEQ ID NO: 1196330 - RNA, 16 nt, Mycobacterium bovis subsp bovis AF2122/97
cuugcccgcgcagcac

SEQ ID NO: 1196331 - RNA, 23 nt, Mycobacterium bovis subsp bovis AF2122/97
cuugcccgagcccagccgggcac

SEQ ID NO: 1196332 - RNA, 20 nt, Mycobacterium bovis subsp bovis AF2122/97
cuugccccgccuuggccacc

SEQ ID NO: 1196333 - RNA, 22 nt, Mycobacterium bovis subsp bovis AF2122/97
cuugcaacaccccgagccgcag

SEQ ID NO: 1196334 - RNA, 15 nt, Mycobacterium bovis subsp bovis AF2122/97
cuugcagugagguca

SEQ ID NO: 1196335 - RNA, 22 nt, Mycobacterium bovis subsp bovis AF2122/97
cuugccaaucgccgucagcacc

SEQ ID NO: 1196336 - RNA, 13 nt, Mycobacterium bovis subsp bovis AF2122/97
cuugggcaccacc

SEQ ID NO: 1196337 - RNA, 23 nt, Mycobacterium bovis subsp bovis AF2122/97
cuugggcagauauugccugccac

SEQ ID NO: 1196338 - RNA, 19 nt, Mycobacterium bovis subsp bovis AF2122/97
cuugggcucgaaaacaugu

SEQ ID NO: 1196339 - RNA, 21 nt, Mycobacterium bovis subsp bovis AF2122/97
cuugggcguacucggcgcgca

SEQ ID NO: 1196340 - RNA, 23 nt, Mycobacterium bovis subsp bovis AF2122/97
cuugggcgucgucuugaccgcuu

SEQ ID NO: 1196341 - RNA, 21 nt, Mycobacterium bovis subsp bovis AF2122/97
cuuggggcguuguugggcgag

SEQ ID NO: 1196342 - RNA, 12 nt, Mycobacterium bovis subsp bovis AF2122/97
cuugggcuucga

SEQ ID NO: 1196343 - RNA, 16 nt, Mycobacterium bovis subsp bovis AF2122/97
cuugguagccggccgc

SEQ ID NO: 1196344 - RNA, 14 nt, Mycobacterium bovis subsp bovis AF2122/97
cuugggucuccgga

SEQ ID NO: 1196345 - RNA, 13 nt, Mycobacterium bovis subsp bovis AF2122/97
cuuggcggcggca

SEQ ID NO: 1196346 - RNA, 17 nt, Mycobacterium bovis subsp bovis AF2122/97
cuuggcggccuuugucg

SEQ ID NO: 1196347 - RNA, 21 nt, Mycobacterium bovis subsp bovis AF2122/97
cuuggcgucgaucagggcccc

SEQ ID NO: 1196348 - RNA, 24 nt, Mycobacterium bovis subsp bovis AF2122/97
cuuggcgugaccuaccuccucggc

SEQ ID NO: 1196349 - RNA, 19 nt, Mycobacterium bovis subsp bovis AF2122/97
cuugggauugcgggccugc

SEQ ID NO: 1196350 - RNA, 22 nt, Mycobacterium bovis subsp bovis AF2122/97
cuuggcugugauguuguucagc

SEQ ID NO: 1196351 - RNA, 22 nt, Mycobacterium bovis subsp bovis AF2122/97
cuuggugcgcgucagccgcacc

SEQ ID NO: 1196352 - RNA, 15 nt, Mycobacterium bovis subsp bovis AF2122/97
cuuggugccauucga

SEQ ID NO: 1196353 - RNA, 15 nt, Mycobacterium bovis subsp bovis AF2122/97
cuugguggccagcca

SEQ ID NO: 1196354 - RNA, 16 nt, Mycobacterium bovis subsp bovis AF2122/97
cuugguggcguggccc

SEQ ID NO: 1196355 - RNA, 21 nt, Mycobacterium bovis subsp bovis AF2122/97
cuuggucagugugaacugucc

SEQ ID NO: 1196356 - RNA, 16 nt, Mycobacterium bovis subsp bovis AF2122/97
cuuggucgccaugucg

SEQ ID NO: 1196357 - RNA, 21 nt, Mycobacterium bovis subsp bovis AF2122/97
cuuggucgcccagccacugac

SEQ ID NO: 1196358 - RNA, 18 nt, Mycobacterium bovis subsp bovis AF2122/97
cuuggucgccgccuucuu

SEQ ID NO: 1196359 - RNA, 13 nt, Mycobacterium bovis subsp bovis AF2122/97
cuuggucgccgcu

SEQ ID NO: 1196360 - RNA, 14 nt, Mycobacterium bovis subsp bovis AF2122/97
cuuggucaccuucu

SEQ ID NO: 1196361 - RNA, 15 nt, Mycobacterium bovis subsp bovis AF2122/97
cuuggucaccuucuu

SEQ ID NO: 1196362 - RNA, 16 nt, Mycobacterium bovis subsp bovis AF2122/97
cuuggucaccuucuug

SEQ ID NO: 1196363 - RNA, 17 nt, Mycobacterium bovis subsp bovis AF2122/97
cuuggucaccuucuugg

SEQ ID NO: 1196364 - RNA, 21 nt, Mycobacterium bovis subsp bovis AF2122/97
cuuguaucccucggggaacac

SEQ ID NO: 1196365 - RNA, 20 nt, Mycobacterium bovis subsp bovis AF2122/97
cuugguuagccgcggcccgc

SEQ ID NO: 1196366 - RNA, 17 nt, Mycobacterium bovis subsp bovis AF2122/97
cuuggccggcaggucca

SEQ ID NO: 1196367 - RNA, 23 nt, Mycobacterium bovis subsp bovis AF2122/97
cuuggccuaugcugcccggcaac

SEQ ID NO: 1196368 - RNA, 22 nt, Mycobacterium bovis subsp bovis AF2122/97
cuuggccugcgcuucguccagc

SEQ ID NO: 1196369 - RNA, 19 nt, Mycobacterium bovis subsp bovis AF2122/97
cuuggcgacaugcagcgcc

SEQ ID NO: 1196370 - RNA, 21 nt, Mycobacterium bovis subsp bovis AF2122/97
cuuggcgaccuugacccgcaa

SEQ ID NO: 1196371 - RNA, 22 nt, Mycobacterium bovis subsp bovis AF2122/97
cuuggcggaacaagguauggcc

SEQ ID NO: 1196372 - RNA, 16 nt, Mycobacterium bovis subsp bovis AF2122/97
cuuggcgaucuccagc

SEQ ID NO: 1196373 - RNA, 14 nt, Mycobacterium bovis subsp bovis AF2122/97
cuuggccgccacuc

SEQ ID NO: 1196374 - RNA, 18 nt, Mycobacterium bovis subsp bovis AF2122/97
cuuggccgccccggccgc

SEQ ID NO: 1196375 - RNA, 14 nt, Mycobacterium bovis subsp bovis AF2122/97
cuuggccagcagcc

SEQ ID NO: 1196376 - RNA, 16 nt, Mycobacterium bovis subsp bovis AF2122/97
cuuggccagcagcgcg

SEQ ID NO: 1196377 - RNA, 16 nt, Mycobacterium bovis subsp bovis AF2122/97
cuuggccagccacucc

SEQ ID NO: 1196378 - RNA, 14 nt, Mycobacterium bovis subsp bovis AF2122/97
cuuggccaccaucg

SEQ ID NO: 1196379 - RNA, 13 nt, Mycobacterium bovis subsp bovis AF2122/97
cuuggcagcccag

SEQ ID NO: 1196380 - RNA, 21 nt, Mycobacterium bovis subsp bovis AF2122/97
cuuggaucgucgcuguggcuu

SEQ ID NO: 1196381 - RNA, 14 nt, Mycobacterium bovis subsp bovis AF2122/97
cuuggcaagccaag

SEQ ID NO: 1196382 - RNA, 14 nt, Mycobacterium bovis subsp bovis AF2122/97
cuuggaucgguugg

SEQ ID NO: 1196383 - RNA, 19 nt, Mycobacterium bovis subsp bovis AF2122/97
cuugccgccggccccgcca

SEQ ID NO: 1196384 - RNA, 19 nt, Mycobacterium bovis subsp bovis AF2122/97
cuugccgccggccccgccg

SEQ ID NO: 1196385 - RNA, 14 nt, Mycobacterium bovis subsp bovis AF2122/97
cuugccgccggccc

SEQ ID NO: 1196386 - RNA, 16 nt, Mycobacterium bovis subsp bovis AF2122/97
cuugccgccggccccg

SEQ ID NO: 1196387 - RNA, 14 nt, Mycobacterium bovis subsp bovis AF2122/97
cuugccgccagccc

SEQ ID NO: 1196388 - RNA, 18 nt, Mycobacterium bovis subsp bovis AF2122/97
cuugccgccagccccagc

SEQ ID NO: 1196389 - RNA, 14 nt, Mycobacterium bovis subsp bovis AF2122/97
cuugccgcaggccu

SEQ ID NO: 1196390 - RNA, 15 nt, Mycobacterium bovis subsp bovis AF2122/97
cuugccgcaggccug

SEQ ID NO: 1196391 - RNA, 13 nt, Mycobacterium bovis subsp bovis AF2122/97
cuugccgcuggug

SEQ ID NO: 1196392 - RNA, 23 nt, Mycobacterium bovis subsp bovis AF2122/97
cuugccgcugguggcgccauccc

SEQ ID NO: 1196393 - RNA, 19 nt, Mycobacterium bovis subsp bovis AF2122/97
cuugcgaccccggcugcgc

SEQ ID NO: 1196394 - RNA, 18 nt, Mycobacterium bovis subsp bovis AF2122/97
cuugccuuccgacccaac

SEQ ID NO: 1196395 - RNA, 18 nt, Mycobacterium bovis subsp bovis AF2122/97
cuugcgcagccgcagccg

SEQ ID NO: 1196396 - RNA, 13 nt, Mycobacterium bovis subsp bovis AF2122/97
cuugcugcuccuu

SEQ ID NO: 1196397 - RNA, 15 nt, Mycobacterium bovis subsp bovis AF2122/97
cuugucgaccccuga

SEQ ID NO: 1196398 - RNA, 13 nt, Mycobacterium bovis subsp bovis AF2122/97
cuugucgaggcgc

SEQ ID NO: 1196399 - RNA, 23 nt, Mycobacterium bovis subsp bovis AF2122/97
cuugucgggcaccgguuugacgu

SEQ ID NO: 1196400 - RNA, 20 nt, Mycobacterium bovis subsp bovis AF2122/97
cuuugacccguuccacgccg

SEQ ID NO: 1196401 - RNA, 16 nt, Mycobacterium bovis subsp bovis AF2122/97
cuuugacgcccggcac

SEQ ID NO: 1196402 - RNA, 20 nt, Mycobacterium bovis subsp bovis AF2122/97
cuuugacgcccggcaccccu

SEQ ID NO: 1196403 - RNA, 19 nt, Mycobacterium bovis subsp bovis AF2122/97
cuuuccagaguucccgaaa

SEQ ID NO: 1196404 - RNA, 19 nt, Mycobacterium bovis subsp bovis AF2122/97
cuuuccaccugaacggcaa

SEQ ID NO: 1196405 - RNA, 23 nt, Mycobacterium bovis subsp bovis AF2122/97
cuuuccaauuuagggauaacgac

SEQ ID NO: 1196406 - RNA, 22 nt, Mycobacterium bovis subsp bovis AF2122/97
cuuucguugguuaucccagacu

SEQ ID NO: 1196407 - RNA, 17 nt, Mycobacterium bovis subsp bovis AF2122/97
cuuucugcgcgugggca

SEQ ID NO: 1196408 - RNA, 15 nt, Mycobacterium bovis subsp bovis AF2122/97
cuuugccgccggcac

SEQ ID NO: 1196409 - RNA, 13 nt, Mycobacterium bovis subsp bovis AF2122/97
cuuugcccgccgc

SEQ ID NO: 1196410 - RNA, 23 nt, Mycobacterium bovis subsp bovis AF2122/97
cuuuggacgaugaaccgggcagc

SEQ ID NO: 1196411 - RNA, 14 nt, Mycobacterium bovis subsp bovis AF2122/97
cuuugcguucccau

SEQ ID NO: 1196412 - RNA, 18 nt, Mycobacterium bovis subsp bovis AF2122/97
cuuugcgguaagccggcg

SEQ ID NO: 1196413 - RNA, 17 nt, Mycobacterium bovis subsp bovis AF2122/97
cuuugcuugccgcauac

SEQ ID NO: 1196414 - RNA, 18 nt, Mycobacterium bovis subsp bovis AF2122/97
cuuagcgcgggccuggcc

SEQ ID NO: 1196415 - RNA, 21 nt, Mycobacterium bovis subsp bovis AF2122/97
cuuagcgcgggccuggcccac

SEQ ID NO: 1196416 - RNA, 17 nt, Mycobacterium bovis subsp bovis AF2122/97
cuuagcggaaaacccag

SEQ ID NO: 1196417 - RNA, 14 nt, Mycobacterium bovis subsp bovis AF2122/97
cuuagcggcuuggc

SEQ ID NO: 1196418 - RNA, 18 nt, Mycobacterium bovis subsp bovis AF2122/97
cuuaggacccaauguggu

SEQ ID NO: 1196419 - RNA, 16 nt, Mycobacterium bovis subsp bovis AF2122/97
cuuaggcacucccgga

SEQ ID NO: 1196420 - RNA, 18 nt, Mycobacterium bovis subsp bovis AF2122/97
cuuagaacgugcuggugg

SEQ ID NO: 1196421 - RNA, 16 nt, Mycobacterium bovis subsp bovis AF2122/97
cuuacuuccauccaca

SEQ ID NO: 1196422 - RNA, 16 nt, Mycobacterium bovis subsp bovis AF2122/97
cuuaacacaugcaagu

SEQ ID NO: 1196423 - RNA, 21 nt, Mycobacterium bovis subsp bovis AF2122/97
cuuaagcgaacccgagccgcc

SEQ ID NO: 1196424 - RNA, 17 nt, Mycobacterium bovis subsp bovis AF2122/97
cuuaagccggcgcggcg

SEQ ID NO: 1196425 - RNA, 21 nt, Mycobacterium bovis subsp bovis AF2122/97
cuucaacuuacgcgacgccgu

SEQ ID NO: 1196426 - RNA, 21 nt, Mycobacterium bovis subsp bovis AF2122/97
cuucaagauuaccgaagcccg

SEQ ID NO: 1196427 - RNA, 13 nt, Mycobacterium bovis subsp bovis AF2122/97
cuucaccuggugu

SEQ ID NO: 1196428 - RNA, 14 nt, Mycobacterium bovis subsp bovis AF2122/97
cuucaccagcugcg

SEQ ID NO: 1196429 - RNA, 17 nt, Mycobacterium bovis subsp bovis AF2122/97
cuucacccaaccccgcc

SEQ ID NO: 1196430 - RNA, 15 nt, Mycobacterium bovis subsp bovis AF2122/97
cuucaccccacuggc

SEQ ID NO: 1196431 - RNA, 11 nt, Mycobacterium bovis subsp bovis AF2122/97
cuucaaugucg

SEQ ID NO: 1196432 - RNA, 20 nt, Mycobacterium bovis subsp bovis AF2122/97
cuuauuggacugcagcgugu

SEQ ID NO: 1196433 - RNA, 19 nt, Mycobacterium bovis subsp bovis AF2122/97
cuucggguguucgcgcgcg

SEQ ID NO: 1196434 - RNA, 19 nt, Mycobacterium bovis subsp bovis AF2122/97
cuucgggguaaccggcgga

SEQ ID NO: 1196435 - RNA, 22 nt, Mycobacterium bovis subsp bovis AF2122/97
cuucggggugaaugcaacuccu

SEQ ID NO: 1196436 - RNA, 12 nt, Mycobacterium bovis subsp bovis AF2122/97
cuucgggcggcg

SEQ ID NO: 1196437 - RNA, 16 nt, Mycobacterium bovis subsp bovis AF2122/97
cuucggcggucgccgc

SEQ ID NO: 1196438 - RNA, 19 nt, Mycobacterium bovis subsp bovis AF2122/97
cuucggccuucuugaggua

SEQ ID NO: 1196439 - RNA, 12 nt, Mycobacterium bovis subsp bovis AF2122/97
cuucggccgcac

SEQ ID NO: 1196440 - RNA, 16 nt, Mycobacterium bovis subsp bovis AF2122/97
cuucggccagaucacg

SEQ ID NO: 1196441 - RNA, 15 nt, Mycobacterium bovis subsp bovis AF2122/97
cuucggccagaucac

SEQ ID NO: 1196442 - RNA, 19 nt, Mycobacterium bovis subsp bovis AF2122/97
cuucggacagcagccggcg

SEQ ID NO: 1196443 - RNA, 22 nt, Mycobacterium bovis subsp bovis AF2122/97
cuucgcuuucccgucggcggcg

SEQ ID NO: 1196444 - RNA, 18 nt, Mycobacterium bovis subsp bovis AF2122/97
cuucgcugcggugggcca

SEQ ID NO: 1196445 - RNA, 14 nt, Mycobacterium bovis subsp bovis AF2122/97
cuucgcuggaaacc

SEQ ID NO: 1196446 - RNA, 20 nt, Mycobacterium bovis subsp bovis AF2122/97
cuucgaucagcggcaguucc

SEQ ID NO: 1196447 - RNA, 18 nt, Mycobacterium bovis subsp bovis AF2122/97
cuucgaguuuggugucga

SEQ ID NO: 1196448 - RNA, 12 nt, Mycobacterium bovis subsp bovis AF2122/97
cuucgagcaccg

SEQ ID NO: 1196449 - RNA, 15 nt, Mycobacterium bovis subsp bovis AF2122/97
cuucgacguugcgga

SEQ ID NO: 1196450 - RNA, 15 nt, Mycobacterium bovis subsp bovis AF2122/97
cuucgagccggcggc

SEQ ID NO: 1196451 - RNA, 14 nt, Mycobacterium bovis subsp bovis AF2122/97
cuucgacggcggcc

SEQ ID NO: 1196452 - RNA, 21 nt, Mycobacterium bovis subsp bovis AF2122/97
cuucgaccgccguggcccgcu

SEQ ID NO: 1196453 - RNA, 14 nt, Mycobacterium bovis subsp bovis AF2122/97
cuucgaccucaccc

SEQ ID NO: 1196454 - RNA, 16 nt, Mycobacterium bovis subsp bovis AF2122/97
cuucgacgcuuccugg

SEQ ID NO: 1196455 - RNA, 22 nt, Mycobacterium bovis subsp bovis AF2122/97
cuucgaccaucaccacggccgc

SEQ ID NO: 1196456 - RNA, 21 nt, Mycobacterium bovis subsp bovis AF2122/97
cuucgaaccguuucgccggcg

SEQ ID NO: 1196457 - RNA, 15 nt, Mycobacterium bovis subsp bovis AF2122/97
cuucguagcggccgc

SEQ ID NO: 1196458 - RNA, 19 nt, Mycobacterium bovis subsp bovis AF2122/97
cuucggugacccgggcggc

SEQ ID NO: 1196459 - RNA, 16 nt, Mycobacterium bovis subsp bovis AF2122/97
cuucggucgcggccuc

SEQ ID NO: 1196460 - RNA, 14 nt, Mycobacterium bovis subsp bovis AF2122/97
cuucgguggcgggc

SEQ ID NO: 1196461 - RNA, 22 nt, Mycobacterium bovis subsp bovis AF2122/97
cuucggugguuccggcuggugg

SEQ ID NO: 1196462 - RNA, 16 nt, Mycobacterium bovis subsp bovis AF2122/97
cuucgguguagcccag

SEQ ID NO: 1196463 - RNA, 21 nt, Mycobacterium bovis subsp bovis AF2122/97
cuucgucauggccggccaucg

SEQ ID NO: 1196464 - RNA, 21 nt, Mycobacterium bovis subsp bovis AF2122/97
cuucgucgccgaacagcgacg

SEQ ID NO: 1196465 - RNA, 12 nt, Mycobacterium bovis subsp bovis AF2122/97
cuucgucggcca

SEQ ID NO: 1196466 - RNA, 15 nt, Mycobacterium bovis subsp bovis AF2122/97
cuucguugucggcgg

SEQ ID NO: 1196467 - RNA, 14 nt, Mycobacterium bovis subsp bovis AF2122/97
cuucgugcaccaca

SEQ ID NO: 1196468 - RNA, 20 nt, Mycobacterium bovis subsp bovis AF2122/97
cuucgucggccggcacccca

SEQ ID NO: 1196469 - RNA, 22 nt, Mycobacterium bovis subsp bovis AF2122/97
cuucgucggccggcaccccacg

SEQ ID NO: 1196470 - RNA, 15 nt, Mycobacterium bovis subsp bovis AF2122/97
cuucccccgguccgg

SEQ ID NO: 1196471 - RNA, 12 nt, Mycobacterium bovis subsp bovis AF2122/97
cuucccuccaga

SEQ ID NO: 1196472 - RNA, 17 nt, Mycobacterium bovis subsp bovis AF2122/97
cuucccgcgcgagccgc

SEQ ID NO: 1196473 - RNA, 19 nt, Mycobacterium bovis subsp bovis AF2122/97
cuuccuggguuggcaucca

SEQ ID NO: 1196474 - RNA, 14 nt, Mycobacterium bovis subsp bovis AF2122/97
cuuccuguacaacc

SEQ ID NO: 1196475 - RNA, 23 nt, Mycobacterium bovis subsp bovis AF2122/97
cuuccuggguugugccgcccugg

SEQ ID NO: 1196476 - RNA, 15 nt, Mycobacterium bovis subsp bovis AF2122/97
cuuccgguccagcgg

SEQ ID NO: 1196477 - RNA, 19 nt, Mycobacterium bovis subsp bovis AF2122/97
cuuccgguccagcggccgc

SEQ ID NO: 1196478 - RNA, 19 nt, Mycobacterium bovis subsp bovis AF2122/97
cuuccgguucaucggcaug

SEQ ID NO: 1196479 - RNA, 22 nt, Mycobacterium bovis subsp bovis AF2122/97
cuuccacggcguggucggcaaa

SEQ ID NO: 1196480 - RNA, 15 nt, Mycobacterium bovis subsp bovis AF2122/97
cuuccaacaccaacg

SEQ ID NO: 1196481 - RNA, 20 nt, Mycobacterium bovis subsp bovis AF2122/97
cuuccaacucggcggccagc

SEQ ID NO: 1196482 - RNA, 14 nt, Mycobacterium bovis subsp bovis AF2122/97
cgcagcgccgccac

SEQ ID NO: 1196483 - RNA, 12 nt, Mycobacterium bovis subsp bovis AF2122/97
cgcagcgccugc

SEQ ID NO: 1196484 - RNA, 13 nt, Mycobacterium bovis subsp bovis AF2122/97
cgcagcuugcccg

SEQ ID NO: 1196485 - RNA, 22 nt, Mycobacterium bovis subsp bovis AF2122/97
cgcagcuuggccagccacuccu

SEQ ID NO: 1196486 - RNA, 18 nt, Mycobacterium bovis subsp bovis AF2122/97
cgcaggauucccagucca

SEQ ID NO: 1196487 - RNA, 23 nt, Mycobacterium bovis subsp bovis AF2122/97
cgcaggauucugcugaccaugac

SEQ ID NO: 1196488 - RNA, 19 nt, Mycobacterium bovis subsp bovis AF2122/97
cgcaggaauucgccauagc

SEQ ID NO: 1196489 - RNA, 23 nt, Mycobacterium bovis subsp bovis AF2122/97
cgcaggaauucgccauagcgggc

SEQ ID NO: 1196490 - RNA, 13 nt, Mycobacterium bovis subsp bovis AF2122/97
cgcaguccgggug

SEQ ID NO: 1196491 - RNA, 21 nt, Mycobacterium bovis subsp bovis AF2122/97
cgcaguuggcaccagccggug

SEQ ID NO: 1196492 - RNA, 16 nt, Mycobacterium bovis subsp bovis AF2122/97
cgcaguuuggcggcgc

SEQ ID NO: 1196493 - RNA, 17 nt, Mycobacterium bovis subsp bovis AF2122/97
cgcaguaacgucgucgc

SEQ ID NO: 1196494 - RNA, 24 nt, Mycobacterium bovis subsp bovis AF2122/97
cgcaguaacgucgucgcgucgcca

SEQ ID NO: 1196495 - RNA, 22 nt, Mycobacterium bovis subsp bovis AF2122/97
cgcagguggucgaucagguacu

SEQ ID NO: 1196496 - RNA, 22 nt, Mycobacterium bovis subsp bovis AF2122/97
cgcaguacuugaccguccaccg

SEQ ID NO: 1196497 - RNA, 18 nt, Mycobacterium bovis subsp bovis AF2122/97
cgcaguagccgaccagga

SEQ ID NO: 1196498 - RNA, 19 nt, Mycobacterium bovis subsp bovis AF2122/97
cgcaguagccgaccaggac

SEQ ID NO: 1196499 - RNA, 21 nt, Mycobacterium bovis subsp bovis AF2122/97
cgcagggaucaccccggccgg

SEQ ID NO: 1196500 - RNA, 18 nt, Mycobacterium bovis subsp bovis AF2122/97
cgcagggacugugggggc

SEQ ID NO: 1196501 - RNA, 22 nt, Mycobacterium bovis subsp bovis AF2122/97
cgcaggcuuccagccacagccc

SEQ ID NO: 1196502 - RNA, 13 nt, Mycobacterium bovis subsp bovis AF2122/97
cgcaggcuucccc

SEQ ID NO: 1196503 - RNA, 15 nt, Mycobacterium bovis subsp bovis AF2122/97
cgcaggaucggcgga

SEQ ID NO: 1196504 - RNA, 13 nt, Mycobacterium bovis subsp bovis AF2122/97
cgcaggcucaccg

SEQ ID NO: 1196505 - RNA, 17 nt, Mycobacterium bovis subsp bovis AF2122/97
cgcaggcucaccgagcc

SEQ ID NO: 1196506 - RNA, 15 nt, Mycobacterium bovis subsp bovis AF2122/97
cgcaggcucagcugg

SEQ ID NO: 1196507 - RNA, 19 nt, Mycobacterium bovis subsp bovis AF2122/97
cgcagccgaucgagcagga

SEQ ID NO: 1196508 - RNA, 17 nt, Mycobacterium bovis subsp bovis AF2122/97
cgcagccgaugucgcgc

SEQ ID NO: 1196509 - RNA, 16 nt, Mycobacterium bovis subsp bovis AF2122/97
cgcagcccgucggcgc

SEQ ID NO: 1196510 - RNA, 19 nt, Mycobacterium bovis subsp bovis AF2122/97
cgcagccgcucgacggccc

SEQ ID NO: 1196511 - RNA, 14 nt, Mycobacterium bovis subsp bovis AF2122/97
cgcagccugcagcg

SEQ ID NO: 1196512 - RNA, 16 nt, Mycobacterium bovis subsp bovis AF2122/97
cgcagccuggucgcgc

SEQ ID NO: 1196513 - RNA, 20 nt, Mycobacterium bovis subsp bovis AF2122/97
cgcagccuggucgcgcagcu

SEQ ID NO: 1196514 - RNA, 18 nt, Mycobacterium bovis subsp bovis AF2122/97
cgcagccaggcugcggau

SEQ ID NO: 1196515 - RNA, 12 nt, Mycobacterium bovis subsp bovis AF2122/97
cgcagccagcgc

SEQ ID NO: 1196516 - RNA, 23 nt, Mycobacterium bovis subsp bovis AF2122/97
cgcagccacguuacgcucgcggg

SEQ ID NO: 1196517 - RNA, 21 nt, Mycobacterium bovis subsp bovis AF2122/97
cgcagccacguuacgcucgcg

SEQ ID NO: 1196518 - RNA, 13 nt, Mycobacterium bovis subsp bovis AF2122/97
cgcagccaacgcu

SEQ ID NO: 1196519 - RNA, 15 nt, Mycobacterium bovis subsp bovis AF2122/97
cgcagccaacgcugu

SEQ ID NO: 1196520 - RNA, 20 nt, Mycobacterium bovis subsp bovis AF2122/97
cgcagcaucgucgccacgau

SEQ ID NO: 1196521 - RNA, 17 nt, Mycobacterium bovis subsp bovis AF2122/97
cgcagcaucuccgccgg

SEQ ID NO: 1196522 - RNA, 18 nt, Mycobacterium bovis subsp bovis AF2122/97
cgcagcauccccgcagcg

SEQ ID NO: 1196523 - RNA, 14 nt, Mycobacterium bovis subsp bovis AF2122/97
cgcagcauugacca

SEQ ID NO: 1196524 - RNA, 15 nt, Mycobacterium bovis subsp bovis AF2122/97
cgcacugcgccggcc

SEQ ID NO: 1196525 - RNA, 19 nt, Mycobacterium bovis subsp bovis AF2122/97
cgcacugaugucacccgcc

SEQ ID NO: 1196526 - RNA, 20 nt, Mycobacterium bovis subsp bovis AF2122/97
cgcacugaugucacccgccc

SEQ ID NO: 1196527 - RNA, 18 nt, Mycobacterium bovis subsp bovis AF2122/97
cgcacucccggcucggcc

SEQ ID NO: 1196528 - RNA, 13 nt, Mycobacterium bovis subsp bovis AF2122/97
cgcacgcucgccc

SEQ ID NO: 1196529 - RNA, 23 nt, Mycobacterium bovis subsp bovis AF2122/97
cgcacuucuuucgaaaugagguc

SEQ ID NO: 1196530 - RNA, 17 nt, Mycobacterium bovis subsp bovis AF2122/97
cgcacuguugcguagcg

SEQ ID NO: 1196531 - RNA, 19 nt, Mycobacterium bovis subsp bovis AF2122/97
cgcacugggugcgucgacc

SEQ ID NO: 1196532 - RNA, 20 nt, Mycobacterium bovis subsp bovis AF2122/97
cgcacugguugggcgagacc

SEQ ID NO: 1196533 - RNA, 22 nt, Mycobacterium bovis subsp bovis AF2122/97
cgcagcaggggacgaccaugcc

SEQ ID NO: 1196534 - RNA, 21 nt, Mycobacterium bovis subsp bovis AF2122/97
cgcagcaggugagccaguugg

SEQ ID NO: 1196535 - RNA, 18 nt, Mycobacterium bovis subsp bovis AF2122/97
cgcagcaggugcaucgcc

SEQ ID NO: 1196536 - RNA, 17 nt, Mycobacterium bovis subsp bovis AF2122/97
cgcagcauccccgcagc

SEQ ID NO: 1196537 - RNA, 21 nt, Mycobacterium bovis subsp bovis AF2122/97
cgcagcauaaagaggucgggc

SEQ ID NO: 1196538 - RNA, 14 nt, Mycobacterium bovis subsp bovis AF2122/97
cgcacuuucuuccu

SEQ ID NO: 1196539 - RNA, 23 nt, Mycobacterium bovis subsp bovis AF2122/97
cgcacuuggcugcgagagcaccg

SEQ ID NO: 1196540 - RNA, 17 nt, Mycobacterium bovis subsp bovis AF2122/97
cgcacccguccggccgg

SEQ ID NO: 1196541 - RNA, 12 nt, Mycobacterium bovis subsp bovis AF2122/97
cgcacccgcucg

SEQ ID NO: 1196542 - RNA, 20 nt, Mycobacterium bovis subsp bovis AF2122/97
cgcacccgaaacaccgucug

SEQ ID NO: 1196543 - RNA, 19 nt, Mycobacterium bovis subsp bovis AF2122/97
cgcacccgaucgacggucg

SEQ ID NO: 1196544 - RNA, 18 nt, Mycobacterium bovis subsp bovis AF2122/97
cgcaccccgcuugcgcgg

SEQ ID NO: 1196545 - RNA, 14 nt, Mycobacterium bovis subsp bovis AF2122/97
cgcaccccggcaua

SEQ ID NO: 1196546 - RNA, 15 nt, Mycobacterium bovis subsp bovis AF2122/97
cgcaccccggccgcg

SEQ ID NO: 1196547 - RNA, 17 nt, Mycobacterium bovis subsp bovis AF2122/97
cgcacccccuccgcgau

SEQ ID NO: 1196548 - RNA, 14 nt, Mycobacterium bovis subsp bovis AF2122/97
cgcacccaacucca

SEQ ID NO: 1196549 - RNA, 16 nt, Mycobacterium bovis subsp bovis AF2122/97
cgcacccaccacacca

SEQ ID NO: 1196550 - RNA, 21 nt, Mycobacterium bovis subsp bovis AF2122/97
cgcaccccauacucggcggcu

SEQ ID NO: 1196551 - RNA, 18 nt, Mycobacterium bovis subsp bovis AF2122/97
cgcaccaucgcggccgcu

SEQ ID NO: 1196552 - RNA, 23 nt, Mycobacterium bovis subsp bovis AF2122/97
cgcaccaucggcgaggccucggc

SEQ ID NO: 1196553 - RNA, 21 nt, Mycobacterium bovis subsp bovis AF2122/97
cgcaccagcugucgggcagcu

SEQ ID NO: 1196554 - RNA, 12 nt, Mycobacterium bovis subsp bovis AF2122/97
cgcaccagcaca

SEQ ID NO: 1196555 - RNA, 12 nt, Mycobacterium bovis subsp bovis AF2122/97
cgcaccacgccc

SEQ ID NO: 1196556 - RNA, 15 nt, Mycobacterium bovis subsp bovis AF2122/97
cgcaccacgagcagc

SEQ ID NO: 1196557 - RNA, 19 nt, Mycobacterium bovis subsp bovis AF2122/97
cgcacaggugccaaacgcc

SEQ ID NO: 1196558 - RNA, 23 nt, Mycobacterium bovis subsp bovis AF2122/97
cgcacaggugccaaacgccgccc

SEQ ID NO: 1196559 - RNA, 22 nt, Mycobacterium bovis subsp bovis AF2122/97
cgcacaggaagcccauccccgc

SEQ ID NO: 1196560 - RNA, 21 nt, Mycobacterium bovis subsp bovis AF2122/97
cgcacagccgcuuggcgcggc

SEQ ID NO: 1196561 - RNA, 14 nt, Mycobacterium bovis subsp bovis AF2122/97
cgcacagcgacgag

SEQ ID NO: 1196562 - RNA, 14 nt, Mycobacterium bovis subsp bovis AF2122/97
cgcacacgcgugca

SEQ ID NO: 1196563 - RNA, 13 nt, Mycobacterium bovis subsp bovis AF2122/97
cgcacacuaccgc

SEQ ID NO: 1196564 - RNA, 13 nt, Mycobacterium bovis subsp bovis AF2122/97
cgcacgcgcgcag

SEQ ID NO: 1196565 - RNA, 16 nt, Mycobacterium bovis subsp bovis AF2122/97
cgcacgcgcgcaggcc

SEQ ID NO: 1196566 - RNA, 18 nt, Mycobacterium bovis subsp bovis AF2122/97
cgcacgcgguucaccacg

SEQ ID NO: 1196567 - RNA, 22 nt, Mycobacterium bovis subsp bovis AF2122/97
cgcacuccaagucacagcucac

SEQ ID NO: 1196568 - RNA, 14 nt, Mycobacterium bovis subsp bovis AF2122/97
cgcacuccacgauc

SEQ ID NO: 1196569 - RNA, 23 nt, Mycobacterium bovis subsp bovis AF2122/97
cgcacggcgucggccaccgccug

SEQ ID NO: 1196570 - RNA, 18 nt, Mycobacterium bovis subsp bovis AF2122/97
cgcacucaccuugucaaa

SEQ ID NO: 1196571 - RNA, 23 nt, Mycobacterium bovis subsp bovis AF2122/97
cgcacggaaggcccggcgcggcc

SEQ ID NO: 1196572 - RNA, 22 nt, Mycobacterium bovis subsp bovis AF2122/97
cgcacggaccaucgccaggccc

SEQ ID NO: 1196573 - RNA, 18 nt, Mycobacterium bovis subsp bovis AF2122/97
cgcacggcagacacgcug

SEQ ID NO: 1196574 - RNA, 13 nt, Mycobacterium bovis subsp bovis AF2122/97
cgcacggccaccg

SEQ ID NO: 1196575 - RNA, 15 nt, Mycobacterium bovis subsp bovis AF2122/97
cgcacggcgccgacc

SEQ ID NO: 1196576 - RNA, 22 nt, Mycobacterium bovis subsp bovis AF2122/97
cgcacccuggguauccaccgcg

SEQ ID NO: 1196577 - RNA, 21 nt, Mycobacterium bovis subsp bovis AF2122/97
cgcaccuccggcguggcuugu

SEQ ID NO: 1196578 - RNA, 13 nt, Mycobacterium bovis subsp bovis AF2122/97
cgcaccuccugcg

SEQ ID NO: 1196579 - RNA, 22 nt, Mycobacterium bovis subsp bovis AF2122/97
cgcaccgaaaccaugccgccga

SEQ ID NO: 1196580 - RNA, 18 nt, Mycobacterium bovis subsp bovis AF2122/97
cgcaccgaaacgccgacc

SEQ ID NO: 1196581 - RNA, 18 nt, Mycobacterium bovis subsp bovis AF2122/97
cgcaccuacccugcgcgu

SEQ ID NO: 1196582 - RNA, 14 nt, Mycobacterium bovis subsp bovis AF2122/97
cgcaccuaugguca

SEQ ID NO: 1196583 - RNA, 17 nt, Mycobacterium bovis subsp bovis AF2122/97
cgcacccggccgcgcac

SEQ ID NO: 1196584 - RNA, 19 nt, Mycobacterium bovis subsp bovis AF2122/97
cgcacccguugcgacaccu

SEQ ID NO: 1196585 - RNA, 21 nt, Mycobacterium bovis subsp bovis AF2122/97
cgcacccguugcucccacggc

SEQ ID NO: 1196586 - RNA, 17 nt, Mycobacterium bovis subsp bovis AF2122/97
cgcaccugcgcgcggcc

SEQ ID NO: 1196587 - RNA, 16 nt, Mycobacterium bovis subsp bovis AF2122/97
cgcaccuggcgcgcgc

SEQ ID NO: 1196588 - RNA, 17 nt, Mycobacterium bovis subsp bovis AF2122/97
cgcacgaaaccgcagcg

SEQ ID NO: 1196589 - RNA, 19 nt, Mycobacterium bovis subsp bovis AF2122/97
cgcaaguugagcagcuugg

SEQ ID NO: 1196590 - RNA, 13 nt, Mycobacterium bovis subsp bovis AF2122/97
cgcacacccugca

SEQ ID NO: 1196591 - RNA, 21 nt, Mycobacterium bovis subsp bovis AF2122/97
cgcaaucaacgucacccccuu

SEQ ID NO: 1196592 - RNA, 17 nt, Mycobacterium bovis subsp bovis AF2122/97
cgcaagugucuccggca

SEQ ID NO: 1196593 - RNA, 18 nt, Mycobacterium bovis subsp bovis AF2122/97
cgcaacgggucggguccc

SEQ ID NO: 1196594 - RNA, 22 nt, Mycobacterium bovis subsp bovis AF2122/97
cgcaacguacgcacgcagcccc

SEQ ID NO: 1196595 - RNA, 18 nt, Mycobacterium bovis subsp bovis AF2122/97
cgcaacgcuucggcagcu

SEQ ID NO: 1196596 - RNA, 21 nt, Mycobacterium bovis subsp bovis AF2122/97
cgcaacgcuucggcagcuccc

SEQ ID NO: 1196597 - RNA, 16 nt, Mycobacterium bovis subsp bovis AF2122/97
cgcaacucccagcacg

SEQ ID NO: 1196598 - RNA, 17 nt, Mycobacterium bovis subsp bovis AF2122/97
cgcaacucgaccacuuc

SEQ ID NO: 1196599 - RNA, 12 nt, Mycobacterium bovis subsp bovis AF2122/97
cgcaacaccccc

SEQ ID NO: 1196600 - RNA, 18 nt, Mycobacterium bovis subsp bovis AF2122/97
cgcaacaccccccgucca

SEQ ID NO: 1196601 - RNA, 14 nt, Mycobacterium bovis subsp bovis AF2122/97
cgcaacacauccag

SEQ ID NO: 1196602 - RNA, 17 nt, Mycobacterium bovis subsp bovis AF2122/97
cgcaaagacagcgcggg

SEQ ID NO: 1196603 - RNA, 22 nt, Mycobacterium bovis subsp bovis AF2122/97
cgcaaauacuucauguagcggu

SEQ ID NO: 1196604 - RNA, 20 nt, Mycobacterium bovis subsp bovis AF2122/97
cgcaaaguucgucaccacga

SEQ ID NO: 1196605 - RNA, 14 nt, Mycobacterium bovis subsp bovis AF2122/97
cgcaaaccacccgc

SEQ ID NO: 1196606 - RNA, 21 nt, Mycobacterium bovis subsp bovis AF2122/97
cgcaaacccgccgacaaaagc

SEQ ID NO: 1196607 - RNA, 14 nt, Mycobacterium bovis subsp bovis AF2122/97
cgcaaacaagauca

SEQ ID NO: 1196608 - RNA, 13 nt, Mycobacterium bovis subsp bovis AF2122/97
cgauucagccuga

SEQ ID NO: 1196609 - RNA, 19 nt, Mycobacterium bovis subsp bovis AF2122/97
cgaugacggugccgaccgc

SEQ ID NO: 1196610 - RNA, 16 nt, Mycobacterium bovis subsp bovis AF2122/97
cgaugagcacucccug

SEQ ID NO: 1196611 - RNA, 20 nt, Mycobacterium bovis subsp bovis AF2122/97
cgaugaccuugcccaccagu

SEQ ID NO: 1196612 - RNA, 18 nt, Mycobacterium bovis subsp bovis AF2122/97
cgaugaccucgucaaggu

SEQ ID NO: 1196613 - RNA, 14 nt, Mycobacterium bovis subsp bovis AF2122/97
cgaugaccgcaacc

SEQ ID NO: 1196614 - RNA, 19 nt, Mycobacterium bovis subsp bovis AF2122/97
cgaugaccgaagagcgcgc

SEQ ID NO: 1196615 - RNA, 18 nt, Mycobacterium bovis subsp bovis AF2122/97
cgaugacaucaccgacca

SEQ ID NO: 1196616 - RNA, 21 nt, Mycobacterium bovis subsp bovis AF2122/97
cgaugaauucuuuggggcgcg

SEQ ID NO: 1196617 - RNA, 14 nt, Mycobacterium bovis subsp bovis AF2122/97
cgaucuuggccacc

SEQ ID NO: 1196618 - RNA, 16 nt, Mycobacterium bovis subsp bovis AF2122/97
cgaucuugggccacgc

SEQ ID NO: 1196619 - RNA, 20 nt, Mycobacterium bovis subsp bovis AF2122/97
cgaucugcucgagagcaugg

SEQ ID NO: 1196620 - RNA, 14 nt, Mycobacterium bovis subsp bovis AF2122/97
cgaucugcucgccc

SEQ ID NO: 1196621 - RNA, 17 nt, Mycobacterium bovis subsp bovis AF2122/97
cgaucuggucaagaccc

SEQ ID NO: 1196622 - RNA, 16 nt, Mycobacterium bovis subsp bovis AF2122/97
cgaucucgccgccagc

SEQ ID NO: 1196623 - RNA, 18 nt, Mycobacterium bovis subsp bovis AF2122/97
cgaucucgcgaaccgaca

SEQ ID NO: 1196624 - RNA, 21 nt, Mycobacterium bovis subsp bovis AF2122/97
cgaucucguggaucugccucu

SEQ ID NO: 1196625 - RNA, 23 nt, Mycobacterium bovis subsp bovis AF2122/97
cgaucucgcccagcgagcgccag

SEQ ID NO: 1196626 - RNA, 18 nt, Mycobacterium bovis subsp bovis AF2122/97
cgaucugcaggcccaggc

SEQ ID NO: 1196627 - RNA, 14 nt, Mycobacterium bovis subsp bovis AF2122/97
cgaucucuccugga

SEQ ID NO: 1196628 - RNA, 22 nt, Mycobacterium bovis subsp bovis AF2122/97
cgaucgcggugaccggcucggc

SEQ ID NO: 1196629 - RNA, 16 nt, Mycobacterium bovis subsp bovis AF2122/97
cgaucgcguccgcgcu

SEQ ID NO: 1196630 - RNA, 19 nt, Mycobacterium bovis subsp bovis AF2122/97
cgaucgcguucugcaccag

SEQ ID NO: 1196631 - RNA, 14 nt, Mycobacterium bovis subsp bovis AF2122/97
cgaucggaccacca

SEQ ID NO: 1196632 - RNA, 22 nt, Mycobacterium bovis subsp bovis AF2122/97
cgaucggcagucccagcgccgc

SEQ ID NO: 1196633 - RNA, 19 nt, Mycobacterium bovis subsp bovis AF2122/97
cgaucggcggcgcgccgau

SEQ ID NO: 1196634 - RNA, 15 nt, Mycobacterium bovis subsp bovis AF2122/97
cgaucggugacgcgc

SEQ ID NO: 1196635 - RNA, 19 nt, Mycobacterium bovis subsp bovis AF2122/97
cgaucggugcgggcgccgc

SEQ ID NO: 1196636 - RNA, 19 nt, Mycobacterium bovis subsp bovis AF2122/97
cgaucgugccccuagaguu

SEQ ID NO: 1196637 - RNA, 14 nt, Mycobacterium bovis subsp bovis AF2122/97
cgauggcaccgugg

SEQ ID NO: 1196638 - RNA, 14 nt, Mycobacterium bovis subsp bovis AF2122/97
cgauggcaggggcg

SEQ ID NO: 1196639 - RNA, 13 nt, Mycobacterium bovis subsp bovis AF2122/97
cgauggcaucucg

SEQ ID NO: 1196640 - RNA, 16 nt, Mycobacterium bovis subsp bovis AF2122/97
cgauggccaggcuggc

SEQ ID NO: 1196641 - RNA, 20 nt, Mycobacterium bovis subsp bovis AF2122/97
cgaugcgggccgccaggcgg

SEQ ID NO: 1196642 - RNA, 22 nt, Mycobacterium bovis subsp bovis AF2122/97
cgaugcgggcgccccaccggcc

SEQ ID NO: 1196643 - RNA, 15 nt, Mycobacterium bovis subsp bovis AF2122/97
cgauggugugcagca

SEQ ID NO: 1196644 - RNA, 18 nt, Mycobacterium bovis subsp bovis AF2122/97
cgauggugccgacccgcc

SEQ ID NO: 1196645 - RNA, 20 nt, Mycobacterium bovis subsp bovis AF2122/97
cgauggugccgacccgccgc

SEQ ID NO: 1196646 - RNA, 20 nt, Mycobacterium bovis subsp bovis AF2122/97
cgauggugcggcccaaccgg

SEQ ID NO: 1196647 - RNA, 17 nt, Mycobacterium bovis subsp bovis AF2122/97
cgaugucacccucccgc

SEQ ID NO: 1196648 - RNA, 19 nt, Mycobacterium bovis subsp bovis AF2122/97
cgaugucagugaucaccaa

SEQ ID NO: 1196649 - RNA, 22 nt, Mycobacterium bovis subsp bovis AF2122/97
cgauguacugugccgcccccgg

SEQ ID NO: 1196650 - RNA, 15 nt, Mycobacterium bovis subsp bovis AF2122/97
cgauguagcgcugcg

SEQ ID NO: 1196651 - RNA, 16 nt, Mycobacterium bovis subsp bovis AF2122/97
cgaugguggccgccac

SEQ ID NO: 1196652 - RNA, 19 nt, Mycobacterium bovis subsp bovis AF2122/97
cgaugguguaacggcggcu

SEQ ID NO: 1196653 - RNA, 22 nt, Mycobacterium bovis subsp bovis AF2122/97
cgaugcgcugcucacgcagcag

SEQ ID NO: 1196654 - RNA, 12 nt, Mycobacterium bovis subsp bovis AF2122/97
cgaugcgccgga

SEQ ID NO: 1196655 - RNA, 13 nt, Mycobacterium bovis subsp bovis AF2122/97
cgaugccacccaa

SEQ ID NO: 1196656 - RNA, 12 nt, Mycobacterium bovis subsp bovis AF2122/97
cgaugccaccgc

SEQ ID NO: 1196657 - RNA, 22 nt, Mycobacterium bovis subsp bovis AF2122/97
cgaugcacaaccgcugcugcug

SEQ ID NO: 1196658 - RNA, 21 nt, Mycobacterium bovis subsp bovis AF2122/97
cgaugccacaucccacggugg

SEQ ID NO: 1196659 - RNA, 18 nt, Mycobacterium bovis subsp bovis AF2122/97
cgaugcaucggugcagcc

SEQ ID NO: 1196660 - RNA, 16 nt, Mycobacterium bovis subsp bovis AF2122/97
cgaugcagccacauac

SEQ ID NO: 1196661 - RNA, 21 nt, Mycobacterium bovis subsp bovis AF2122/97
cgaugcaacucgaauccggcc

SEQ ID NO: 1196662 - RNA, 17 nt, Mycobacterium bovis subsp bovis AF2122/97
cgaugaugcggcgcagc

SEQ ID NO: 1196663 - RNA, 15 nt, Mycobacterium bovis subsp bovis AF2122/97
cgaugauggacacca

SEQ ID NO: 1196664 - RNA, 24 nt, Mycobacterium bovis subsp bovis AF2122/97
cgaugaugacggcggcccgaucca

SEQ ID NO: 1196665 - RNA, 19 nt, Mycobacterium bovis subsp bovis AF2122/97
cgaugaucgccuucuuguu

SEQ ID NO: 1196666 - RNA, 18 nt, Mycobacterium bovis subsp bovis AF2122/97
cgaugaucucacccagcu

SEQ ID NO: 1196667 - RNA, 18 nt, Mycobacterium bovis subsp bovis AF2122/97
cgaugaucgaacacggca

SEQ ID NO: 1196668 - RNA, 14 nt, Mycobacterium bovis subsp bovis AF2122/97
cgaugaucccgcca

SEQ ID NO: 1196669 - RNA, 14 nt, Mycobacterium bovis subsp bovis AF2122/97
cgaugaucaggguc

SEQ ID NO: 1196670 - RNA, 16 nt, Mycobacterium bovis subsp bovis AF2122/97
cgaugagcccagccgc

SEQ ID NO: 1196671 - RNA, 17 nt, Mycobacterium bovis subsp bovis AF2122/97
cgaucagcgaguagccg

SEQ ID NO: 1196672 - RNA, 21 nt, Mycobacterium bovis subsp bovis AF2122/97
cgaucagcugcgcaucgccac

SEQ ID NO: 1196673 - RNA, 14 nt, Mycobacterium bovis subsp bovis AF2122/97
cgaucaggccuugg

SEQ ID NO: 1196674 - RNA, 20 nt, Mycobacterium bovis subsp bovis AF2122/97
cgaucaggccgacgucgacc

SEQ ID NO: 1196675 - RNA, 16 nt, Mycobacterium bovis subsp bovis AF2122/97
cgaucagacgcucgac

SEQ ID NO: 1196676 - RNA, 16 nt, Mycobacterium bovis subsp bovis AF2122/97
cgauaucggcccccaa

SEQ ID NO: 1196677 - RNA, 16 nt, Mycobacterium bovis subsp bovis AF2122/97
cgaucagaaucugccu

SEQ ID NO: 1196678 - RNA, 21 nt, Mycobacterium bovis subsp bovis AF2122/97
cgauccaccaagcucgcaacc

SEQ ID NO: 1196679 - RNA, 13 nt, Mycobacterium bovis subsp bovis AF2122/97
cgauccacaggcu

SEQ ID NO: 1196680 - RNA, 14 nt, Mycobacterium bovis subsp bovis AF2122/97
cgauccacccggca

SEQ ID NO: 1196681 - RNA, 15 nt, Mycobacterium bovis subsp bovis AF2122/97
cgauccacccggcau

SEQ ID NO: 1196682 - RNA, 15 nt, Mycobacterium bovis subsp bovis AF2122/97
cgaucaugagcagca

SEQ ID NO: 1196683 - RNA, 18 nt, Mycobacterium bovis subsp bovis AF2122/97
cgaucagguaccggcgga

SEQ ID NO: 1196684 - RNA, 15 nt, Mycobacterium bovis subsp bovis AF2122/97
cgaucaggggcccac

SEQ ID NO: 1196685 - RNA, 16 nt, Mycobacterium bovis subsp bovis AF2122/97
cgaucaucaccggcau

SEQ ID NO: 1196686 - RNA, 19 nt, Mycobacterium bovis subsp bovis AF2122/97
cgaucaggggcccacccga

SEQ ID NO: 1196687 - RNA, 20 nt, Mycobacterium bovis subsp bovis AF2122/97
cgaucagguuggcggcugca

SEQ ID NO: 1196688 - RNA, 18 nt, Mycobacterium bovis subsp bovis AF2122/97
cgaucagucgucuugaug

SEQ ID NO: 1196689 - RNA, 18 nt, Mycobacterium bovis subsp bovis AF2122/97
cgauccgauccgcucacc

SEQ ID NO: 1196690 - RNA, 21 nt, Mycobacterium bovis subsp bovis AF2122/97
cgauccggaucccaccaccgc

SEQ ID NO: 1196691 - RNA, 18 nt, Mycobacterium bovis subsp bovis AF2122/97
cgauccgcacccggccgc

SEQ ID NO: 1196692 - RNA, 15 nt, Mycobacterium bovis subsp bovis AF2122/97
cgaucccgaucgcgc

SEQ ID NO: 1196693 - RNA, 23 nt, Mycobacterium bovis subsp bovis AF2122/97
cgaucccgucgggcacaccgacg

SEQ ID NO: 1196694 - RNA, 16 nt, Mycobacterium bovis subsp bovis AF2122/97
cgaucccgccggggcc

SEQ ID NO: 1196695 - RNA, 17 nt, Mycobacterium bovis subsp bovis AF2122/97
cgaucccgcggccgggc

SEQ ID NO: 1196696 - RNA, 19 nt, Mycobacterium bovis subsp bovis AF2122/97
cgauccaguucaccgcgcu

SEQ ID NO: 1196697 - RNA, 15 nt, Mycobacterium bovis subsp bovis AF2122/97
cgauccagcaggccg

SEQ ID NO: 1196698 - RNA, 17 nt, Mycobacterium bovis subsp bovis AF2122/97
cgaucccaacgcccggg

SEQ ID NO: 1196699 - RNA, 13 nt, Mycobacterium bovis subsp bovis AF2122/97
cgauccagggccg

SEQ ID NO: 1196700 - RNA, 16 nt, Mycobacterium bovis subsp bovis AF2122/97
cgauccggucggcggg

SEQ ID NO: 1196701 - RNA, 20 nt, Mycobacterium bovis subsp bovis AF2122/97
cgaucgacacccgcucggcc

SEQ ID NO: 1196702 - RNA, 22 nt, Mycobacterium bovis subsp bovis AF2122/97
cgaucgacaccgugaccgccgc

SEQ ID NO: 1196703 - RNA, 22 nt, Mycobacterium bovis subsp bovis AF2122/97
cgaucgaggaguuggugcagcg

SEQ ID NO: 1196704 - RNA, 23 nt, Mycobacterium bovis subsp bovis AF2122/97
cgaucgcgagcgagccaacucca

SEQ ID NO: 1196705 - RNA, 20 nt, Mycobacterium bovis subsp bovis AF2122/97
cgaucgccgcuaacgcaccu

SEQ ID NO: 1196706 - RNA, 14 nt, Mycobacterium bovis subsp bovis AF2122/97
cgaucgccaggccg

SEQ ID NO: 1196707 - RNA, 13 nt, Mycobacterium bovis subsp bovis AF2122/97
cgauaaaugccgc

SEQ ID NO: 1196708 - RNA, 15 nt, Mycobacterium bovis subsp bovis AF2122/97
cgauauaccagggca

SEQ ID NO: 1196709 - RNA, 22 nt, Mycobacterium bovis subsp bovis AF2122/97
cgauaaccuggcggucccgcau

SEQ ID NO: 1196710 - RNA, 14 nt, Mycobacterium bovis subsp bovis AF2122/97
cgauacgcgcgucg

SEQ ID NO: 1196711 - RNA, 18 nt, Mycobacterium bovis subsp bovis AF2122/97
cgcccaccacgaacacgu

SEQ ID NO: 1196712 - RNA, 13 nt, Mycobacterium bovis subsp bovis AF2122/97
cgcccaccaugau

SEQ ID NO: 1196713 - RNA, 16 nt, Mycobacterium bovis subsp bovis AF2122/97
cgcccacaugcucagg

SEQ ID NO: 1196714 - RNA, 14 nt, Mycobacterium bovis subsp bovis AF2122/97
cgcccaccacacag

SEQ ID NO: 1196715 - RNA, 23 nt, Mycobacterium bovis subsp bovis AF2122/97
cgcccaccacacagccgcgcugc

SEQ ID NO: 1196716 - RNA, 13 nt, Mycobacterium bovis subsp bovis AF2122/97
cgcccacccgcgc

SEQ ID NO: 1196717 - RNA, 22 nt, Mycobacterium bovis subsp bovis AF2122/97
cgcccaccacgcgacgcggggc

SEQ ID NO: 1196718 - RNA, 13 nt, Mycobacterium bovis subsp bovis AF2122/97
cgcccaccgggcg

SEQ ID NO: 1196719 - RNA, 14 nt, Mycobacterium bovis subsp bovis AF2122/97
cgcccaccgggcgg

SEQ ID NO: 1196720 - RNA, 23 nt, Mycobacterium bovis subsp bovis AF2122/97
cgcccaccguugcgaagaagaag

SEQ ID NO: 1196721 - RNA, 20 nt, Mycobacterium bovis subsp bovis AF2122/97
cgcccaccucgaucgcgccg

SEQ ID NO: 1196722 - RNA, 18 nt, Mycobacterium bovis subsp bovis AF2122/97
cgcccacggcaccaccaa

SEQ ID NO: 1196723 - RNA, 15 nt, Mycobacterium bovis subsp bovis AF2122/97
cgcccacuggugauc

SEQ ID NO: 1196724 - RNA, 14 nt, Mycobacterium bovis subsp bovis AF2122/97
cgcccagccgagcg

SEQ ID NO: 1196725 - RNA, 21 nt, Mycobacterium bovis subsp bovis AF2122/97
cgcccagcagcaccugcaccg

SEQ ID NO: 1196726 - RNA, 18 nt, Mycobacterium bovis subsp bovis AF2122/97
cgcccagcgacccggcca

SEQ ID NO: 1196727 - RNA, 16 nt, Mycobacterium bovis subsp bovis AF2122/97
cgcccagcgacccggc

SEQ ID NO: 1196728 - RNA, 19 nt, Mycobacterium bovis subsp bovis AF2122/97
cgcccagagccgcugcggc

SEQ ID NO: 1196729 - RNA, 15 nt, Mycobacterium bovis subsp bovis AF2122/97
cgcccagcagcaccu

SEQ ID NO: 1196730 - RNA, 16 nt, Mycobacterium bovis subsp bovis AF2122/97
cgcccaggaagccgag

SEQ ID NO: 1196731 - RNA, 16 nt, Mycobacterium bovis subsp bovis AF2122/97
cgcccaggcgaccgcu

SEQ ID NO: 1196732 - RNA, 19 nt, Mycobacterium bovis subsp bovis AF2122/97
cgcccaggcgaccgcugag

SEQ ID NO: 1196733 - RNA, 19 nt, Mycobacterium bovis subsp bovis AF2122/97
cgcccaggcauggccuggg

SEQ ID NO: 1196734 - RNA, 13 nt, Mycobacterium bovis subsp bovis AF2122/97
cgcccagcucgau

SEQ ID NO: 1196735 - RNA, 20 nt, Mycobacterium bovis subsp bovis AF2122/97
cgcccauagcugccggccca

SEQ ID NO: 1196736 - RNA, 21 nt, Mycobacterium bovis subsp bovis AF2122/97
cgcccagugcgcaacccagcc

SEQ ID NO: 1196737 - RNA, 19 nt, Mycobacterium bovis subsp bovis AF2122/97
cgcccagugcgcaacccag

SEQ ID NO: 1196738 - RNA, 17 nt, Mycobacterium bovis subsp bovis AF2122/97
cgcccauggccaccagg

SEQ ID NO: 1196739 - RNA, 18 nt, Mycobacterium bovis subsp bovis AF2122/97
cgcccauggccaccaggg

SEQ ID NO: 1196740 - RNA, 13 nt, Mycobacterium bovis subsp bovis AF2122/97
cgcccaugccggg

SEQ ID NO: 1196741 - RNA, 19 nt, Mycobacterium bovis subsp bovis AF2122/97
cgcccaguugggccucagc

SEQ ID NO: 1196742 - RNA, 15 nt, Mycobacterium bovis subsp bovis AF2122/97
cgccauugacgccgu

SEQ ID NO: 1196743 - RNA, 22 nt, Mycobacterium bovis subsp bovis AF2122/97
cgccauugacgccguugccgcc

SEQ ID NO: 1196744 - RNA, 17 nt, Mycobacterium bovis subsp bovis AF2122/97
cgccauggucgcugcgu

SEQ ID NO: 1196745 - RNA, 13 nt, Mycobacterium bovis subsp bovis AF2122/97
cgccaugcggcgc

SEQ ID NO: 1196746 - RNA, 18 nt, Mycobacterium bovis subsp bovis AF2122/97
cgcccacauacagcggag

SEQ ID NO: 1196747 - RNA, 14 nt, Mycobacterium bovis subsp bovis AF2122/97
cgcccaagcgcagc

SEQ ID NO: 1196748 - RNA, 14 nt, Mycobacterium bovis subsp bovis AF2122/97
cgcccaacgcgggu

SEQ ID NO: 1196749 - RNA, 14 nt, Mycobacterium bovis subsp bovis AF2122/97
cgcccaaagaaaug

SEQ ID NO: 1196750 - RNA, 22 nt, Mycobacterium bovis subsp bovis AF2122/97
cgccauuucgcccgaggcaacg

SEQ ID NO: 1196751 - RNA, 18 nt, Mycobacterium bovis subsp bovis AF2122/97
cgccauuggcgccgccga

SEQ ID NO: 1196752 - RNA, 13 nt, Mycobacterium bovis subsp bovis AF2122/97
cgccauugccgcc

SEQ ID NO: 1196753 - RNA, 18 nt, Mycobacterium bovis subsp bovis AF2122/97
cgccaucagcccuucagc

SEQ ID NO: 1196754 - RNA, 22 nt, Mycobacterium bovis subsp bovis AF2122/97
cgccauccaugauggccgucag

SEQ ID NO: 1196755 - RNA, 16 nt, Mycobacterium bovis subsp bovis AF2122/97
cgccauccccgccggc

SEQ ID NO: 1196756 - RNA, 18 nt, Mycobacterium bovis subsp bovis AF2122/97
cgccaucguuucacccgg

SEQ ID NO: 1196757 - RNA, 24 nt, Mycobacterium bovis subsp bovis AF2122/97
cgccaucguuucacccgggcugcu

SEQ ID NO: 1196758 - RNA, 17 nt, Mycobacterium bovis subsp bovis AF2122/97
cgccaucucguaggggu

SEQ ID NO: 1196759 - RNA, 21 nt, Mycobacterium bovis subsp bovis AF2122/97
cgccaugagcgcgcccaaccu

SEQ ID NO: 1196760 - RNA, 22 nt, Mycobacterium bovis subsp bovis AF2122/97
cgccaugauggacagcugcggg

SEQ ID NO: 1196761 - RNA, 16 nt, Mycobacterium bovis subsp bovis AF2122/97
cgccaucgccuccagc

SEQ ID NO: 1196762 - RNA, 20 nt, Mycobacterium bovis subsp bovis AF2122/97
cgccaucgucgaagaccuca

SEQ ID NO: 1196763 - RNA, 15 nt, Mycobacterium bovis subsp bovis AF2122/97
cgccaucgguugacc

SEQ ID NO: 1196764 - RNA, 16 nt, Mycobacterium bovis subsp bovis AF2122/97
cgcccgcgcggccacu

SEQ ID NO: 1196765 - RNA, 13 nt, Mycobacterium bovis subsp bovis AF2122/97
cgcccgcgccucc

SEQ ID NO: 1196766 - RNA, 15 nt, Mycobacterium bovis subsp bovis AF2122/97
cgcccgcgcgguggc

SEQ ID NO: 1196767 - RNA, 17 nt, Mycobacterium bovis subsp bovis AF2122/97
cgcccgcggccgccagc

SEQ ID NO: 1196768 - RNA, 22 nt, Mycobacterium bovis subsp bovis AF2122/97
cgcccgcgggcaguggcagccc

SEQ ID NO: 1196769 - RNA, 15 nt, Mycobacterium bovis subsp bovis AF2122/97
cgcccgcgugacgcu

SEQ ID NO: 1196770 - RNA, 13 nt, Mycobacterium bovis subsp bovis AF2122/97
cgcccgcgccacc

SEQ ID NO: 1196771 - RNA, 13 nt, Mycobacterium bovis subsp bovis AF2122/97
cgcccgcgccgcc

SEQ ID NO: 1196772 - RNA, 19 nt, Mycobacterium bovis subsp bovis AF2122/97
cgcccgcgccgccgccacc

SEQ ID NO: 1196773 - RNA, 16 nt, Mycobacterium bovis subsp bovis AF2122/97
cgcccgcgccgccgcu

SEQ ID NO: 1196774 - RNA, 21 nt, Mycobacterium bovis subsp bovis AF2122/97
cgcccgccggugaucggcggc

SEQ ID NO: 1196775 - RNA, 13 nt, Mycobacterium bovis subsp bovis AF2122/97
cgcccgccggcau

SEQ ID NO: 1196776 - RNA, 17 nt, Mycobacterium bovis subsp bovis AF2122/97
cgcccgccucugucuuc

SEQ ID NO: 1196777 - RNA, 13 nt, Mycobacterium bovis subsp bovis AF2122/97
cgcccgcgagcug

SEQ ID NO: 1196778 - RNA, 13 nt, Mycobacterium bovis subsp bovis AF2122/97
cgcccgccgccac

SEQ ID NO: 1196779 - RNA, 12 nt, Mycobacterium bovis subsp bovis AF2122/97
cgcccgccccgc

SEQ ID NO: 1196780 - RNA, 16 nt, Mycobacterium bovis subsp bovis AF2122/97
cgcccgccaucagccc

SEQ ID NO: 1196781 - RNA, 17 nt, Mycobacterium bovis subsp bovis AF2122/97
cgcccgccaccggaggu

SEQ ID NO: 1196782 - RNA, 13 nt, Mycobacterium bovis subsp bovis AF2122/97
cgcccgcaccacc

SEQ ID NO: 1196783 - RNA, 18 nt, Mycobacterium bovis subsp bovis AF2122/97
cgcccgcaccaccggccc

SEQ ID NO: 1196784 - RNA, 22 nt, Mycobacterium bovis subsp bovis AF2122/97
cgcccgcaagucggacgggucu

SEQ ID NO: 1196785 - RNA, 16 nt, Mycobacterium bovis subsp bovis AF2122/97
cgcccgaugcgccagc

SEQ ID NO: 1196786 - RNA, 13 nt, Mycobacterium bovis subsp bovis AF2122/97
cgcccgcacacag

SEQ ID NO: 1196787 - RNA, 18 nt, Mycobacterium bovis subsp bovis AF2122/97
cgcccgggcaccggccgg

SEQ ID NO: 1196788 - RNA, 21 nt, Mycobacterium bovis subsp bovis AF2122/97
cgcccgggcgaauccggcggg

SEQ ID NO: 1196789 - RNA, 22 nt, Mycobacterium bovis subsp bovis AF2122/97
cgcccggggcggugggcgcuuc

SEQ ID NO: 1196790 - RNA, 17 nt, Mycobacterium bovis subsp bovis AF2122/97
cgcccggggcgcacagc

SEQ ID NO: 1196791 - RNA, 24 nt, Mycobacterium bovis subsp bovis AF2122/97
cgcccgggcguugggaucgcgcag

SEQ ID NO: 1196792 - RNA, 18 nt, Mycobacterium bovis subsp bovis AF2122/97
cgcccgggucccggcagc

SEQ ID NO: 1196793 - RNA, 19 nt, Mycobacterium bovis subsp bovis AF2122/97
cgcccgggucccggcagcu

SEQ ID NO: 1196794 - RNA, 20 nt, Mycobacterium bovis subsp bovis AF2122/97
cgcccggcgcaagcgccgcg

SEQ ID NO: 1196795 - RNA, 22 nt, Mycobacterium bovis subsp bovis AF2122/97
cgcccggcgcaagcgccgcgcu

SEQ ID NO: 1196796 - RNA, 17 nt, Mycobacterium bovis subsp bovis AF2122/97
cgcccggcguggugagc

SEQ ID NO: 1196797 - RNA, 18 nt, Mycobacterium bovis subsp bovis AF2122/97
cgcccggauguccgccga

SEQ ID NO: 1196798 - RNA, 20 nt, Mycobacterium bovis subsp bovis AF2122/97
cgcccggauguccgccgacg

SEQ ID NO: 1196799 - RNA, 13 nt, Mycobacterium bovis subsp bovis AF2122/97
cgcccggcccggc

SEQ ID NO: 1196800 - RNA, 21 nt, Mycobacterium bovis subsp bovis AF2122/97
cgcccgcucgcgagcggcuga

SEQ ID NO: 1196801 - RNA, 21 nt, Mycobacterium bovis subsp bovis AF2122/97
cgcccgcugagcacucaugau

SEQ ID NO: 1196802 - RNA, 22 nt, Mycobacterium bovis subsp bovis AF2122/97
cgcccgcucggagaucgccacu

SEQ ID NO: 1196803 - RNA, 21 nt, Mycobacterium bovis subsp bovis AF2122/97
cgcccggaaccggcgugcagc

SEQ ID NO: 1196804 - RNA, 22 nt, Mycobacterium bovis subsp bovis AF2122/97
cgcccggaaccggcgugcagca

SEQ ID NO: 1196805 - RNA, 13 nt, Mycobacterium bovis subsp bovis AF2122/97
cgcccgaucggcg

SEQ ID NO: 1196806 - RNA, 18 nt, Mycobacterium bovis subsp bovis AF2122/97
cgcccgagugaccagggu

SEQ ID NO: 1196807 - RNA, 13 nt, Mycobacterium bovis subsp bovis AF2122/97
cgcccgaguugaa

SEQ ID NO: 1196808 - RNA, 20 nt, Mycobacterium bovis subsp bovis AF2122/97
cgcccgaguugaagaagccg

SEQ ID NO: 1196809 - RNA, 20 nt, Mycobacterium bovis subsp bovis AF2122/97
cgcccgaguuguggacgccc

SEQ ID NO: 1196810 - RNA, 19 nt, Mycobacterium bovis subsp bovis AF2122/97
cgcccgacgugaagccaag

SEQ ID NO: 1196811 - RNA, 22 nt, Mycobacterium bovis subsp bovis AF2122/97
cgcccgacgagauugccgggcc

SEQ ID NO: 1196812 - RNA, 14 nt, Mycobacterium bovis subsp bovis AF2122/97
cgccccuggcaccu

SEQ ID NO: 1196813 - RNA, 18 nt, Mycobacterium bovis subsp bovis AF2122/97
cgcccgacgaacagcggu

SEQ ID NO: 1196814 - RNA, 14 nt, Mycobacterium bovis subsp bovis AF2122/97
cgcccgacacccgu

SEQ ID NO: 1196815 - RNA, 14 nt, Mycobacterium bovis subsp bovis AF2122/97
cgcccgaagccggg

SEQ ID NO: 1196816 - RNA, 17 nt, Mycobacterium bovis subsp bovis AF2122/97
cgcccgaagccgggccc

SEQ ID NO: 1196817 - RNA, 16 nt, Mycobacterium bovis subsp bovis AF2122/97
cgccccggcgcggcca

SEQ ID NO: 1196818 - RNA, 18 nt, Mycobacterium bovis subsp bovis AF2122/97
cgccccggcgcggccagc

SEQ ID NO: 1196819 - RNA, 12 nt, Mycobacterium bovis subsp bovis AF2122/97
cgccccggcggc

SEQ ID NO: 1196820 - RNA, 20 nt, Mycobacterium bovis subsp bovis AF2122/97
cgccccggcggcggcggccc

SEQ ID NO: 1196821 - RNA, 18 nt, Mycobacterium bovis subsp bovis AF2122/97
cgccccggggguccaccu

SEQ ID NO: 1196822 - RNA, 17 nt, Mycobacterium bovis subsp bovis AF2122/97
cgccccgcguuggacaa

SEQ ID NO: 1196823 - RNA, 11 nt, Mycobacterium bovis subsp bovis AF2122/97
cgccccgcucg

SEQ ID NO: 1196824 - RNA, 13 nt, Mycobacterium bovis subsp bovis AF2122/97
cgccccggccgcu

SEQ ID NO: 1196825 - RNA, 12 nt, Mycobacterium bovis subsp bovis AF2122/97
cgccccggcaua

SEQ ID NO: 1196826 - RNA, 14 nt, Mycobacterium bovis subsp bovis AF2122/97
cgccccaccggccc

SEQ ID NO: 1196827 - RNA, 17 nt, Mycobacterium bovis subsp bovis AF2122/97
cgccccaccggcccggg

SEQ ID NO: 1196828 - RNA, 16 nt, Mycobacterium bovis subsp bovis AF2122/97
cgccccaccgcgccga

SEQ ID NO: 1196829 - RNA, 17 nt, Mycobacterium bovis subsp bovis AF2122/97
cgccccaccgcgccgag

SEQ ID NO: 1196830 - RNA, 12 nt, Mycobacterium bovis subsp bovis AF2122/97
cgccccacccga

SEQ ID NO: 1196831 - RNA, 21 nt, Mycobacterium bovis subsp bovis AF2122/97
cgcccauggcgucgaaccagu

SEQ ID NO: 1196832 - RNA, 16 nt, Mycobacterium bovis subsp bovis AF2122/97
cgccccacaacaugcu

SEQ ID NO: 1196833 - RNA, 21 nt, Mycobacterium bovis subsp bovis AF2122/97
cgccccacaacaugcuggaga

SEQ ID NO: 1196834 - RNA, 16 nt, Mycobacterium bovis subsp bovis AF2122/97
cgccccaagcgccuga

SEQ ID NO: 1196835 - RNA, 22 nt, Mycobacterium bovis subsp bovis AF2122/97
cgcccauuggguaaccagcgcc

SEQ ID NO: 1196836 - RNA, 18 nt, Mycobacterium bovis subsp bovis AF2122/97
cgcccauugacguagacc

SEQ ID NO: 1196837 - RNA, 14 nt, Mycobacterium bovis subsp bovis AF2122/97
cgcccccgcugcca

SEQ ID NO: 1196838 - RNA, 22 nt, Mycobacterium bovis subsp bovis AF2122/97
cgcccccgccauugccgccggc

SEQ ID NO: 1196839 - RNA, 18 nt, Mycobacterium bovis subsp bovis AF2122/97
cgcccccucuagcgccuc

SEQ ID NO: 1196840 - RNA, 14 nt, Mycobacterium bovis subsp bovis AF2122/97
cgccccgaggaugc

SEQ ID NO: 1196841 - RNA, 21 nt, Mycobacterium bovis subsp bovis AF2122/97
cgccccgauaaaaaccacccc

SEQ ID NO: 1196842 - RNA, 22 nt, Mycobacterium bovis subsp bovis AF2122/97
cgccccgauaaaaaccaccccc

SEQ ID NO: 1196843 - RNA, 23 nt, Mycobacterium bovis subsp bovis AF2122/97
cgccccagggggcgugccgccgc

SEQ ID NO: 1196844 - RNA, 17 nt, Mycobacterium bovis subsp bovis AF2122/97
cgccccaugcaacacac

SEQ ID NO: 1196845 - RNA, 11 nt, Mycobacterium bovis subsp bovis AF2122/97
cgcccccgcca

SEQ ID NO: 1196846 - RNA, 17 nt, Mycobacterium bovis subsp bovis AF2122/97
cgccagccccgcgccca

SEQ ID NO: 1196847 - RNA, 14 nt, Mycobacterium bovis subsp bovis AF2122/97
cgccagcccagccc

SEQ ID NO: 1196848 - RNA, 16 nt, Mycobacterium bovis subsp bovis AF2122/97
cgccagccccacccgc

SEQ ID NO: 1196849 - RNA, 16 nt, Mycobacterium bovis subsp bovis AF2122/97
cgccagccccgcgccc

SEQ ID NO: 1196850 - RNA, 13 nt, Mycobacterium bovis subsp bovis AF2122/97
cgccagccgcgag

SEQ ID NO: 1196851 - RNA, 14 nt, Mycobacterium bovis subsp bovis AF2122/97
cgccagccgaccga

SEQ ID NO: 1196852 - RNA, 22 nt, Mycobacterium bovis subsp bovis AF2122/97
cgccagcccguccggcccccga

SEQ ID NO: 1196853 - RNA, 15 nt, Mycobacterium bovis subsp bovis AF2122/97
cgccagccggccgcg

SEQ ID NO: 1196854 - RNA, 22 nt, Mycobacterium bovis subsp bovis AF2122/97
cgccagccggcgcacucccgga

SEQ ID NO: 1196855 - RNA, 13 nt, Mycobacterium bovis subsp bovis AF2122/97
cgccagccgcgcu

SEQ ID NO: 1196856 - RNA, 17 nt, Mycobacterium bovis subsp bovis AF2122/97
cgccagccugugcugcc

SEQ ID NO: 1196857 - RNA, 13 nt, Mycobacterium bovis subsp bovis AF2122/97
cgccagccuccac

SEQ ID NO: 1196858 - RNA, 13 nt, Mycobacterium bovis subsp bovis AF2122/97
cgccagccaccac

SEQ ID NO: 1196859 - RNA, 15 nt, Mycobacterium bovis subsp bovis AF2122/97
cgccagccaaccguc

SEQ ID NO: 1196860 - RNA, 14 nt, Mycobacterium bovis subsp bovis AF2122/97
cgccagccaccaca

SEQ ID NO: 1196861 - RNA, 13 nt, Mycobacterium bovis subsp bovis AF2122/97
cgccagcccagca

SEQ ID NO: 1196862 - RNA, 23 nt, Mycobacterium bovis subsp bovis AF2122/97
cgccagcauugaagaagcccgaa

SEQ ID NO: 1196863 - RNA, 22 nt, Mycobacterium bovis subsp bovis AF2122/97
cgccagcauugaagaagcccga

SEQ ID NO: 1196864 - RNA, 20 nt, Mycobacterium bovis subsp bovis AF2122/97
cgccagcaccucggccagcu

SEQ ID NO: 1196865 - RNA, 21 nt, Mycobacterium bovis subsp bovis AF2122/97
cgccagcagaucuccggggcu

SEQ ID NO: 1196866 - RNA, 19 nt, Mycobacterium bovis subsp bovis AF2122/97
cgccacugccagccgugca

SEQ ID NO: 1196867 - RNA, 15 nt, Mycobacterium bovis subsp bovis AF2122/97
cgccacucgcccgcu

SEQ ID NO: 1196868 - RNA, 14 nt, Mycobacterium bovis subsp bovis AF2122/97
cgccacucagcccg

SEQ ID NO: 1196869 - RNA, 21 nt, Mycobacterium bovis subsp bovis AF2122/97
cgccaccuuggcugggcccgc

SEQ ID NO: 1196870 - RNA, 15 nt, Mycobacterium bovis subsp bovis AF2122/97
cgccacgaccgccga

SEQ ID NO: 1196871 - RNA, 13 nt, Mycobacterium bovis subsp bovis AF2122/97
cgccacgacaggu

SEQ ID NO: 1196872 - RNA, 15 nt, Mycobacterium bovis subsp bovis AF2122/97
cgccacgggcggcca

SEQ ID NO: 1196873 - RNA, 23 nt, Mycobacterium bovis subsp bovis AF2122/97
cgccacgggcggccaccgcacgc

SEQ ID NO: 1196874 - RNA, 23 nt, Mycobacterium bovis subsp bovis AF2122/97
cgccacguacuccaccgcgccgu

SEQ ID NO: 1196875 - RNA, 20 nt, Mycobacterium bovis subsp bovis AF2122/97
cgccacguacuuggacgacc

SEQ ID NO: 1196876 - RNA, 24 nt, Mycobacterium bovis subsp bovis AF2122/97
cgccacgguucgggcagcacccgc

SEQ ID NO: 1196877 - RNA, 19 nt, Mycobacterium bovis subsp bovis AF2122/97
cgccaccucgacgcacacc

SEQ ID NO: 1196878 - RNA, 19 nt, Mycobacterium bovis subsp bovis AF2122/97
cgccaccggguucaccgag

SEQ ID NO: 1196879 - RNA, 20 nt, Mycobacterium bovis subsp bovis AF2122/97
cgccaccggguucaccgagg

SEQ ID NO: 1196880 - RNA, 17 nt, Mycobacterium bovis subsp bovis AF2122/97
cgccaccgguaccggcg

SEQ ID NO: 1196881 - RNA, 18 nt, Mycobacterium bovis subsp bovis AF2122/97
cgccaccgguaccggcga

SEQ ID NO: 1196882 - RNA, 14 nt, Mycobacterium bovis subsp bovis AF2122/97
cgccaccggccgcg

SEQ ID NO: 1196883 - RNA, 17 nt, Mycobacterium bovis subsp bovis AF2122/97
cgccaccgucaccgccg

SEQ ID NO: 1196884 - RNA, 19 nt, Mycobacterium bovis subsp bovis AF2122/97
cgccaccgucgcugcccgc

SEQ ID NO: 1196885 - RNA, 22 nt, Mycobacterium bovis subsp bovis AF2122/97
cgccaccucgccggccgucagc

SEQ ID NO: 1196886 - RNA, 14 nt, Mycobacterium bovis subsp bovis AF2122/97
cgccaccggcgcca

SEQ ID NO: 1196887 - RNA, 18 nt, Mycobacterium bovis subsp bovis AF2122/97
cgccaccggcaccgccug

SEQ ID NO: 1196888 - RNA, 19 nt, Mycobacterium bovis subsp bovis AF2122/97
cgccaccggcaccgccugc

SEQ ID NO: 1196889 - RNA, 23 nt, Mycobacterium bovis subsp bovis AF2122/97
cgccaccggcgcgaccgcggcga

SEQ ID NO: 1196890 - RNA, 19 nt, Mycobacterium bovis subsp bovis AF2122/97
cgccaccggcguccagucc

SEQ ID NO: 1196891 - RNA, 21 nt, Mycobacterium bovis subsp bovis AF2122/97
cgccaccggcugauucgagcc

SEQ ID NO: 1196892 - RNA, 14 nt, Mycobacterium bovis subsp bovis AF2122/97
cgccaccgcggcga

SEQ ID NO: 1196893 - RNA, 19 nt, Mycobacterium bovis subsp bovis AF2122/97
cgccaccggcgccaccggc

SEQ ID NO: 1196894 - RNA, 24 nt, Mycobacterium bovis subsp bovis AF2122/97
cgccaccggcgccaccggcgccgc

SEQ ID NO: 1196895 - RNA, 15 nt, Mycobacterium bovis subsp bovis AF2122/97
cgccaccagcaccgc

SEQ ID NO: 1196896 - RNA, 13 nt, Mycobacterium bovis subsp bovis AF2122/97
cgccaccaccucc

SEQ ID NO: 1196897 - RNA, 13 nt, Mycobacterium bovis subsp bovis AF2122/97
cgccaccaaaucc

SEQ ID NO: 1196898 - RNA, 18 nt, Mycobacterium bovis subsp bovis AF2122/97
cgccaccacccaggccau

SEQ ID NO: 1196899 - RNA, 13 nt, Mycobacterium bovis subsp bovis AF2122/97
cgccaccacccgg

SEQ ID NO: 1196900 - RNA, 15 nt, Mycobacterium bovis subsp bovis AF2122/97
cgccaccagcgcacg

SEQ ID NO: 1196901 - RNA, 18 nt, Mycobacterium bovis subsp bovis AF2122/97
cgccaccaucaccgccuu

SEQ ID NO: 1196902 - RNA, 15 nt, Mycobacterium bovis subsp bovis AF2122/97
cgccaaugcccaggu

SEQ ID NO: 1196903 - RNA, 12 nt, Mycobacterium bovis subsp bovis AF2122/97
cgccacaaagaa

SEQ ID NO: 1196904 - RNA, 14 nt, Mycobacterium bovis subsp bovis AF2122/97
cgcauaagcccccg

SEQ ID NO: 1196905 - RNA, 18 nt, Mycobacterium bovis subsp bovis AF2122/97
cgcauaaccggcgcgccc

SEQ ID NO: 1196906 - RNA, 22 nt, Mycobacterium bovis subsp bovis AF2122/97
cgccacaccggggcggccgacc

SEQ ID NO: 1196907 - RNA, 16 nt, Mycobacterium bovis subsp bovis AF2122/97
cgccacagcacccacg

SEQ ID NO: 1196908 - RNA, 17 nt, Mycobacterium bovis subsp bovis AF2122/97
cgccacacggggccgcc

SEQ ID NO: 1196909 - RNA, 20 nt, Mycobacterium bovis subsp bovis AF2122/97
cgccacacggggccgccagc

SEQ ID NO: 1196910 - RNA, 13 nt, Mycobacterium bovis subsp bovis AF2122/97
cgccacaccauga

SEQ ID NO: 1196911 - RNA, 22 nt, Mycobacterium bovis subsp bovis AF2122/97
cgccacacccaaaccggcccgc

SEQ ID NO: 1196912 - RNA, 13 nt, Mycobacterium bovis subsp bovis AF2122/97
cgccacacccgcg

SEQ ID NO: 1196913 - RNA, 14 nt, Mycobacterium bovis subsp bovis AF2122/97
cgccacaccgccgc

SEQ ID NO: 1196914 - RNA, 22 nt, Mycobacterium bovis subsp bovis AF2122/97
cgccacauacaccggccggucc

SEQ ID NO: 1196915 - RNA, 21 nt, Mycobacterium bovis subsp bovis AF2122/97
cgccagggcccuagccggcgc

SEQ ID NO: 1196916 - RNA, 21 nt, Mycobacterium bovis subsp bovis AF2122/97
cgccagggaucuagaggcggc

SEQ ID NO: 1196917 - RNA, 22 nt, Mycobacterium bovis subsp bovis AF2122/97
cgccagggcccuagccggcgcg

SEQ ID NO: 1196918 - RNA, 14 nt, Mycobacterium bovis subsp bovis AF2122/97
cgccagggccgccg

SEQ ID NO: 1196919 - RNA, 18 nt, Mycobacterium bovis subsp bovis AF2122/97
cgccagggccgccgaagc

SEQ ID NO: 1196920 - RNA, 12 nt, Mycobacterium bovis subsp bovis AF2122/97
cgccagggcggc

SEQ ID NO: 1196921 - RNA, 19 nt, Mycobacterium bovis subsp bovis AF2122/97
cgccaggugcagcaccagc

SEQ ID NO: 1196922 - RNA, 22 nt, Mycobacterium bovis subsp bovis AF2122/97
cgccagucccggcgcacaaaca

SEQ ID NO: 1196923 - RNA, 18 nt, Mycobacterium bovis subsp bovis AF2122/97
cgccagugcccgcacugc

SEQ ID NO: 1196924 - RNA, 16 nt, Mycobacterium bovis subsp bovis AF2122/97
cgccaguccggacggc

SEQ ID NO: 1196925 - RNA, 20 nt, Mycobacterium bovis subsp bovis AF2122/97
cgccaguccggacggcagcc

SEQ ID NO: 1196926 - RNA, 18 nt, Mycobacterium bovis subsp bovis AF2122/97
cgccagucccacugggcc

SEQ ID NO: 1196927 - RNA, 16 nt, Mycobacterium bovis subsp bovis AF2122/97
cgccagucccggcgca

SEQ ID NO: 1196928 - RNA, 15 nt, Mycobacterium bovis subsp bovis AF2122/97
cgccaguaggcuucg

SEQ ID NO: 1196929 - RNA, 16 nt, Mycobacterium bovis subsp bovis AF2122/97
cgccaguauggccgcc

SEQ ID NO: 1196930 - RNA, 17 nt, Mycobacterium bovis subsp bovis AF2122/97
cgccaguauggccgcca

SEQ ID NO: 1196931 - RNA, 18 nt, Mycobacterium bovis subsp bovis AF2122/97
cgccauaccggccgccau

SEQ ID NO: 1196932 - RNA, 19 nt, Mycobacterium bovis subsp bovis AF2122/97
cgccauaccggccgccauc

SEQ ID NO: 1196933 - RNA, 21 nt, Mycobacterium bovis subsp bovis AF2122/97
cgccauagccgcgacccgcgc

SEQ ID NO: 1196934 - RNA, 16 nt, Mycobacterium bovis subsp bovis AF2122/97
cgccauagcgggcggu

SEQ ID NO: 1196935 - RNA, 18 nt, Mycobacterium bovis subsp bovis AF2122/97
cgccaguguugcgcugcg

SEQ ID NO: 1196936 - RNA, 22 nt, Mycobacterium bovis subsp bovis AF2122/97
cgccagugccucgcggggucug

SEQ ID NO: 1196937 - RNA, 12 nt, Mycobacterium bovis subsp bovis AF2122/97
cgccaguggcca

SEQ ID NO: 1196938 - RNA, 15 nt, Mycobacterium bovis subsp bovis AF2122/97
cgccaguucgcggcu

SEQ ID NO: 1196939 - RNA, 15 nt, Mycobacterium bovis subsp bovis AF2122/97
cgccaguucgcgcca

SEQ ID NO: 1196940 - RNA, 17 nt, Mycobacterium bovis subsp bovis AF2122/97
cgccagcggguccccgg

SEQ ID NO: 1196941 - RNA, 14 nt, Mycobacterium bovis subsp bovis AF2122/97
cgccagcggcagcg

SEQ ID NO: 1196942 - RNA, 13 nt, Mycobacterium bovis subsp bovis AF2122/97
cgccagcggccgc

SEQ ID NO: 1196943 - RNA, 14 nt, Mycobacterium bovis subsp bovis AF2122/97
cgccagcggccgcu

SEQ ID NO: 1196944 - RNA, 12 nt, Mycobacterium bovis subsp bovis AF2122/97
cgccagcggcgc

SEQ ID NO: 1196945 - RNA, 16 nt, Mycobacterium bovis subsp bovis AF2122/97
cgccagcggcgcgacc

SEQ ID NO: 1196946 - RNA, 13 nt, Mycobacterium bovis subsp bovis AF2122/97
cgccagcggcagc

SEQ ID NO: 1196947 - RNA, 14 nt, Mycobacterium bovis subsp bovis AF2122/97
cgccagcgcggugu

SEQ ID NO: 1196948 - RNA, 17 nt, Mycobacterium bovis subsp bovis AF2122/97
cgccagcgccgccaggu

SEQ ID NO: 1196949 - RNA, 19 nt, Mycobacterium bovis subsp bovis AF2122/97
cgccagcgccugcgcgcau

SEQ ID NO: 1196950 - RNA, 16 nt, Mycobacterium bovis subsp bovis AF2122/97
cgccagcgccgccacc

SEQ ID NO: 1196951 - RNA, 22 nt, Mycobacterium bovis subsp bovis AF2122/97
cgccagcgagcauaccgccgcu

SEQ ID NO: 1196952 - RNA, 17 nt, Mycobacterium bovis subsp bovis AF2122/97
cgccagcgccgccgcga

SEQ ID NO: 1196953 - RNA, 20 nt, Mycobacterium bovis subsp bovis AF2122/97
cgccagcgauaucggcggcu

SEQ ID NO: 1196954 - RNA, 21 nt, Mycobacterium bovis subsp bovis AF2122/97
cgccagcgagcauaccgccgc

SEQ ID NO: 1196955 - RNA, 21 nt, Mycobacterium bovis subsp bovis AF2122/97
cgccaggccgaccgcgcacau

SEQ ID NO: 1196956 - RNA, 13 nt, Mycobacterium bovis subsp bovis AF2122/97
cgccaggccacgu

SEQ ID NO: 1196957 - RNA, 23 nt, Mycobacterium bovis subsp bovis AF2122/97
cgccaggcaagccagcacugcca

SEQ ID NO: 1196958 - RNA, 14 nt, Mycobacterium bovis subsp bovis AF2122/97
cgccaggcaccacg

SEQ ID NO: 1196959 - RNA, 13 nt, Mycobacterium bovis subsp bovis AF2122/97
cgccaggcaagcc

SEQ ID NO: 1196960 - RNA, 19 nt, Mycobacterium bovis subsp bovis AF2122/97
cgccaggcuugcggcaccc

SEQ ID NO: 1196961 - RNA, 17 nt, Mycobacterium bovis subsp bovis AF2122/97
cgccaggccgcgcgaca

SEQ ID NO: 1196962 - RNA, 15 nt, Mycobacterium bovis subsp bovis AF2122/97
cgccaggccgucggg

SEQ ID NO: 1196963 - RNA, 15 nt, Mycobacterium bovis subsp bovis AF2122/97
cgccaggccgcgcga

SEQ ID NO: 1196964 - RNA, 18 nt, Mycobacterium bovis subsp bovis AF2122/97
cgccagcucgccggccgg

SEQ ID NO: 1196965 - RNA, 21 nt, Mycobacterium bovis subsp bovis AF2122/97
cgccagcucggcggcagcggc

SEQ ID NO: 1196966 - RNA, 14 nt, Mycobacterium bovis subsp bovis AF2122/97
cgccagcugcccga

SEQ ID NO: 1196967 - RNA, 14 nt, Mycobacterium bovis subsp bovis AF2122/97
cgccagcugcgcag

SEQ ID NO: 1196968 - RNA, 16 nt, Mycobacterium bovis subsp bovis AF2122/97
cgccagcuugucgggc

SEQ ID NO: 1196969 - RNA, 14 nt, Mycobacterium bovis subsp bovis AF2122/97
cgccaggaacccgu

SEQ ID NO: 1196970 - RNA, 19 nt, Mycobacterium bovis subsp bovis AF2122/97
cgccaggaucugguugaac

SEQ ID NO: 1196971 - RNA, 13 nt, Mycobacterium bovis subsp bovis AF2122/97
cgccaggagcgcg

SEQ ID NO: 1196972 - RNA, 17 nt, Mycobacterium bovis subsp bovis AF2122/97
cgccgaugaugcggcgc

SEQ ID NO: 1196973 - RNA, 15 nt, Mycobacterium bovis subsp bovis AF2122/97
cgccgaugccaccgc

SEQ ID NO: 1196974 - RNA, 19 nt, Mycobacterium bovis subsp bovis AF2122/97
cgccgaugcccgacaccgc

SEQ ID NO: 1196975 - RNA, 22 nt, Mycobacterium bovis subsp bovis AF2122/97
cgccgaucgacacccgcucggc

SEQ ID NO: 1196976 - RNA, 16 nt, Mycobacterium bovis subsp bovis AF2122/97
cgccgaugcugccgcc

SEQ ID NO: 1196977 - RNA, 18 nt, Mycobacterium bovis subsp bovis AF2122/97
cgccgauguggccggcga

SEQ ID NO: 1196978 - RNA, 20 nt, Mycobacterium bovis subsp bovis AF2122/97
cgccgauguuggcagggcca

SEQ ID NO: 1196979 - RNA, 16 nt, Mycobacterium bovis subsp bovis AF2122/97
cgccgaucuucgcgcg

SEQ ID NO: 1196980 - RNA, 18 nt, Mycobacterium bovis subsp bovis AF2122/97
cgccgaucuucgcgcgcu

SEQ ID NO: 1196981 - RNA, 15 nt, Mycobacterium bovis subsp bovis AF2122/97
cgccgaucccgccca

SEQ ID NO: 1196982 - RNA, 16 nt, Mycobacterium bovis subsp bovis AF2122/97
cgccgauaucggugac

SEQ ID NO: 1196983 - RNA, 15 nt, Mycobacterium bovis subsp bovis AF2122/97
cgccgaucaccgcug

SEQ ID NO: 1196984 - RNA, 22 nt, Mycobacterium bovis subsp bovis AF2122/97
cgccgaucagcgaaccaccggc

SEQ ID NO: 1196985 - RNA, 20 nt, Mycobacterium bovis subsp bovis AF2122/97
cgccgagcuggcaacgccgc

SEQ ID NO: 1196986 - RNA, 16 nt, Mycobacterium bovis subsp bovis AF2122/97
cgccgagcccgccggg

SEQ ID NO: 1196987 - RNA, 20 nt, Mycobacterium bovis subsp bovis AF2122/97
cgccgaggucgaaccgccgg

SEQ ID NO: 1196988 - RNA, 23 nt, Mycobacterium bovis subsp bovis AF2122/97
cgccgagugugacuaccgagacg

SEQ ID NO: 1196989 - RNA, 17 nt, Mycobacterium bovis subsp bovis AF2122/97
cgccgauaccggcggcg

SEQ ID NO: 1196990 - RNA, 15 nt, Mycobacterium bovis subsp bovis AF2122/97
cgccgauacccagcg

SEQ ID NO: 1196991 - RNA, 18 nt, Mycobacterium bovis subsp bovis AF2122/97
cgccgauaccgccggccc

SEQ ID NO: 1196992 - RNA, 19 nt, Mycobacterium bovis subsp bovis AF2122/97
cgccgauaccgccggcccc

SEQ ID NO: 1196993 - RNA, 13 nt, Mycobacterium bovis subsp bovis AF2122/97
cgccgcaccgccg

SEQ ID NO: 1196994 - RNA, 21 nt, Mycobacterium bovis subsp bovis AF2122/97
cgccgcagcaggugcaucgcc

SEQ ID NO: 1196995 - RNA, 13 nt, Mycobacterium bovis subsp bovis AF2122/97
cgccgcagcgucc

SEQ ID NO: 1196996 - RNA, 20 nt, Mycobacterium bovis subsp bovis AF2122/97
cgccgcagcuccccgaccga

SEQ ID NO: 1196997 - RNA, 17 nt, Mycobacterium bovis subsp bovis AF2122/97
cgccgcagacgccgacu

SEQ ID NO: 1196998 - RNA, 13 nt, Mycobacterium bovis subsp bovis AF2122/97
cgccgcacgcacu

SEQ ID NO: 1196999 - RNA, 13 nt, Mycobacterium bovis subsp bovis AF2122/97
cgccgcacccggg

SEQ ID NO: 1197000 - RNA, 15 nt, Mycobacterium bovis subsp bovis AF2122/97
cgccgauuccaccgc

SEQ ID NO: 1197001 - RNA, 15 nt, Mycobacterium bovis subsp bovis AF2122/97
cgccgccaccagcgc

SEQ ID NO: 1197002 - RNA, 20 nt, Mycobacterium bovis subsp bovis AF2122/97
cgccgccaagcucggccacc

SEQ ID NO: 1197003 - RNA, 18 nt, Mycobacterium bovis subsp bovis AF2122/97
cgccgccaccccgcgcgc

SEQ ID NO: 1197004 - RNA, 13 nt, Mycobacterium bovis subsp bovis AF2122/97
cgccgccacccgg

SEQ ID NO: 1197005 - RNA, 20 nt, Mycobacterium bovis subsp bovis AF2122/97
cgccgccacagcacccacgc

SEQ ID NO: 1197006 - RNA, 19 nt, Mycobacterium bovis subsp bovis AF2122/97
cgccgccaccagcgcacgc

SEQ ID NO: 1197007 - RNA, 14 nt, Mycobacterium bovis subsp bovis AF2122/97
cgccgccacccggc

SEQ ID NO: 1197008 - RNA, 15 nt, Mycobacterium bovis subsp bovis AF2122/97
cgccgccacccggcg

SEQ ID NO: 1197009 - RNA, 16 nt, Mycobacterium bovis subsp bovis AF2122/97
cgccgccacccggcgg

SEQ ID NO: 1197010 - RNA, 23 nt, Mycobacterium bovis subsp bovis AF2122/97
cgccgcauugcagaaccgccaac

SEQ ID NO: 1197011 - RNA, 15 nt, Mycobacterium bovis subsp bovis AF2122/97
cgccgcaucggcggg

SEQ ID NO: 1197012 - RNA, 18 nt, Mycobacterium bovis subsp bovis AF2122/97
cgccgcaucggcgggucu

SEQ ID NO: 1197013 - RNA, 14 nt, Mycobacterium bovis subsp bovis AF2122/97
cgccgcagggccgc

SEQ ID NO: 1197014 - RNA, 18 nt, Mycobacterium bovis subsp bovis AF2122/97
cgccgcagggccgcgcgc

SEQ ID NO: 1197015 - RNA, 18 nt, Mycobacterium bovis subsp bovis AF2122/97
cgccgcccgcuccuccgg

SEQ ID NO: 1197016 - RNA, 17 nt, Mycobacterium bovis subsp bovis AF2122/97
cgccgcccuugccgccg

SEQ ID NO: 1197017 - RNA, 18 nt, Mycobacterium bovis subsp bovis AF2122/97
cgccgcccuugccgccgg

SEQ ID NO: 1197018 - RNA, 19 nt, Mycobacterium bovis subsp bovis AF2122/97
cgccgccgaaaaccucgcc

SEQ ID NO: 1197019 - RNA, 17 nt, Mycobacterium bovis subsp bovis AF2122/97
cgccgcccuccgacggg

SEQ ID NO: 1197020 - RNA, 23 nt, Mycobacterium bovis subsp bovis AF2122/97
cgccgcccuugccgccggccccg

SEQ ID NO: 1197021 - RNA, 15 nt, Mycobacterium bovis subsp bovis AF2122/97
cgccgcccgcugggc

SEQ ID NO: 1197022 - RNA, 18 nt, Mycobacterium bovis subsp bovis AF2122/97
cgccgccauugccgccgg

SEQ ID NO: 1197023 - RNA, 15 nt, Mycobacterium bovis subsp bovis AF2122/97
cgccgccccggcgcu

SEQ ID NO: 1197024 - RNA, 19 nt, Mycobacterium bovis subsp bovis AF2122/97
cgccgccccugcgcggcca

SEQ ID NO: 1197025 - RNA, 18 nt, Mycobacterium bovis subsp bovis AF2122/97
cgccgcccccgccggccg

SEQ ID NO: 1197026 - RNA, 24 nt, Mycobacterium bovis subsp bovis AF2122/97
cgccgccccauacuugcgccgacu

SEQ ID NO: 1197027 - RNA, 20 nt, Mycobacterium bovis subsp bovis AF2122/97
cgccgccagguguucgccgg

SEQ ID NO: 1197028 - RNA, 13 nt, Mycobacterium bovis subsp bovis AF2122/97
cgccgccauugcc

SEQ ID NO: 1197029 - RNA, 23 nt, Mycobacterium bovis subsp bovis AF2122/97
cgccgccagguccgccggugccg

SEQ ID NO: 1197030 - RNA, 18 nt, Mycobacterium bovis subsp bovis AF2122/97
cgccgccagcgccgccgg

SEQ ID NO: 1197031 - RNA, 19 nt, Mycobacterium bovis subsp bovis AF2122/97
cgccgccagcaccucggcc

SEQ ID NO: 1197032 - RNA, 17 nt, Mycobacterium bovis subsp bovis AF2122/97
cgccgccagcaccaccg

SEQ ID NO: 1197033 - RNA, 22 nt, Mycobacterium bovis subsp bovis AF2122/97
cgccgccacggaucgcggcggc

SEQ ID NO: 1197034 - RNA, 13 nt, Mycobacterium bovis subsp bovis AF2122/97
cgccgccaccagg

SEQ ID NO: 1197035 - RNA, 18 nt, Mycobacterium bovis subsp bovis AF2122/97
cgccgccggcuccggcgg

SEQ ID NO: 1197036 - RNA, 13 nt, Mycobacterium bovis subsp bovis AF2122/97
cgccgccggcgcu

SEQ ID NO: 1197037 - RNA, 15 nt, Mycobacterium bovis subsp bovis AF2122/97
cgccgccggcgcuga

SEQ ID NO: 1197038 - RNA, 18 nt, Mycobacterium bovis subsp bovis AF2122/97
cgccgccggcgccgccgg

SEQ ID NO: 1197039 - RNA, 18 nt, Mycobacterium bovis subsp bovis AF2122/97
cgccgccggcgccggcgc

SEQ ID NO: 1197040 - RNA, 19 nt, Mycobacterium bovis subsp bovis AF2122/97
cgccgccggcgccggcgcu

SEQ ID NO: 1197041 - RNA, 13 nt, Mycobacterium bovis subsp bovis AF2122/97
cgccgccggcgcg

SEQ ID NO: 1197042 - RNA, 13 nt, Mycobacterium bovis subsp bovis AF2122/97
cgccgccggccgc

SEQ ID NO: 1197043 - RNA, 18 nt, Mycobacterium bovis subsp bovis AF2122/97
cgccgccggccccgccga

SEQ ID NO: 1197044 - RNA, 17 nt, Mycobacterium bovis subsp bovis AF2122/97
cgccgccggccgccagc

SEQ ID NO: 1197045 - RNA, 12 nt, Mycobacterium bovis subsp bovis AF2122/97
cgccgccggcga

SEQ ID NO: 1197046 - RNA, 14 nt, Mycobacterium bovis subsp bovis AF2122/97
cgccgccggcgcca

SEQ ID NO: 1197047 - RNA, 16 nt, Mycobacterium bovis subsp bovis AF2122/97
cgccgccggcgccacc

SEQ ID NO: 1197048 - RNA, 14 nt, Mycobacterium bovis subsp bovis AF2122/97
cgccgccggcgccc

SEQ ID NO: 1197049 - RNA, 14 nt, Mycobacterium bovis subsp bovis AF2122/97
cgccgccggucccc

SEQ ID NO: 1197050 - RNA, 16 nt, Mycobacterium bovis subsp bovis AF2122/97
cgccgccgguccccuc

SEQ ID NO: 1197051 - RNA, 21 nt, Mycobacterium bovis subsp bovis AF2122/97
cgccgccguuaccgccggcgc

SEQ ID NO: 1197052 - RNA, 21 nt, Mycobacterium bovis subsp bovis AF2122/97
cgccgccguccagcgccgcgg

SEQ ID NO: 1197053 - RNA, 16 nt, Mycobacterium bovis subsp bovis AF2122/97
cgccgccggugccacc

SEQ ID NO: 1197054 - RNA, 19 nt, Mycobacterium bovis subsp bovis AF2122/97
cgccgccggugccgcccga

SEQ ID NO: 1197055 - RNA, 12 nt, Mycobacterium bovis subsp bovis AF2122/97
cgccgccgcggg

SEQ ID NO: 1197056 - RNA, 12 nt, Mycobacterium bovis subsp bovis AF2122/97
cgccgccgcguu

SEQ ID NO: 1197057 - RNA, 18 nt, Mycobacterium bovis subsp bovis AF2122/97
cgccgccgcuaccgccgg

SEQ ID NO: 1197058 - RNA, 16 nt, Mycobacterium bovis subsp bovis AF2122/97
cgccgccgcugccgcc

SEQ ID NO: 1197059 - RNA, 17 nt, Mycobacterium bovis subsp bovis AF2122/97
cgccgccgcugccgccc

SEQ ID NO: 1197060 - RNA, 13 nt, Mycobacterium bovis subsp bovis AF2122/97
cgccgccggcccc

SEQ ID NO: 1197061 - RNA, 19 nt, Mycobacterium bovis subsp bovis AF2122/97
cgccgccggcaccgccggc

SEQ ID NO: 1197062 - RNA, 21 nt, Mycobacterium bovis subsp bovis AF2122/97
cgccgccggcaccgccggcgc

SEQ ID NO: 1197063 - RNA, 18 nt, Mycobacterium bovis subsp bovis AF2122/97
cgccgccggcaccgccgg

SEQ ID NO: 1197064 - RNA, 22 nt, Mycobacterium bovis subsp bovis AF2122/97
cgccgccggaagcgccggccga

SEQ ID NO: 1197065 - RNA, 12 nt, Mycobacterium bovis subsp bovis AF2122/97
cgccgccgccga

SEQ ID NO: 1197066 - RNA, 22 nt, Mycobacterium bovis subsp bovis AF2122/97
cgccgccgcgagcgccggccgc

SEQ ID NO: 1197067 - RNA, 14 nt, Mycobacterium bovis subsp bovis AF2122/97
cgccgccgccgcca

SEQ ID NO: 1197068 - RNA, 16 nt, Mycobacterium bovis subsp bovis AF2122/97
cgccgaccgacgucgc

SEQ ID NO: 1197069 - RNA, 15 nt, Mycobacterium bovis subsp bovis AF2122/97
cgccgaccgcgccgc

SEQ ID NO: 1197070 - RNA, 20 nt, Mycobacterium bovis subsp bovis AF2122/97
cgccgaccgcgccgcaucau

SEQ ID NO: 1197071 - RNA, 16 nt, Mycobacterium bovis subsp bovis AF2122/97
cgccgacccgggggcg

SEQ ID NO: 1197072 - RNA, 22 nt, Mycobacterium bovis subsp bovis AF2122/97
cgccgacccgggggcgcccggg

SEQ ID NO: 1197073 - RNA, 21 nt, Mycobacterium bovis subsp bovis AF2122/97
cgccgaccgguggcaccggcg

SEQ ID NO: 1197074 - RNA, 23 nt, Mycobacterium bovis subsp bovis AF2122/97
cgccgaccgguggcaccggcggc

SEQ ID NO: 1197075 - RNA, 15 nt, Mycobacterium bovis subsp bovis AF2122/97
cgccgaccuccuccu

SEQ ID NO: 1197076 - RNA, 12 nt, Mycobacterium bovis subsp bovis AF2122/97
cgccgaccugga

SEQ ID NO: 1197077 - RNA, 14 nt, Mycobacterium bovis subsp bovis AF2122/97
cgccgacgccagaa

SEQ ID NO: 1197078 - RNA, 16 nt, Mycobacterium bovis subsp bovis AF2122/97
cgccgacgccgccggc

SEQ ID NO: 1197079 - RNA, 20 nt, Mycobacterium bovis subsp bovis AF2122/97
cgccgacggcgccccgcgcu

SEQ ID NO: 1197080 - RNA, 12 nt, Mycobacterium bovis subsp bovis AF2122/97
cgccgacccgcc

SEQ ID NO: 1197081 - RNA, 20 nt, Mycobacterium bovis subsp bovis AF2122/97
cgccgacgauuaccagcggc

SEQ ID NO: 1197082 - RNA, 16 nt, Mycobacterium bovis subsp bovis AF2122/97
cgccgagagcaccgcu

SEQ ID NO: 1197083 - RNA, 23 nt, Mycobacterium bovis subsp bovis AF2122/97
cgccgagaacgauguccgcgcga

SEQ ID NO: 1197084 - RNA, 23 nt, Mycobacterium bovis subsp bovis AF2122/97
cgccgacucggcaccgcggccgc

SEQ ID NO: 1197085 - RNA, 17 nt, Mycobacterium bovis subsp bovis AF2122/97
cgccgacuccccgccgg

SEQ ID NO: 1197086 - RNA, 18 nt, Mycobacterium bovis subsp bovis AF2122/97
cgccgagcggaccaccgc

SEQ ID NO: 1197087 - RNA, 14 nt, Mycobacterium bovis subsp bovis AF2122/97
cgccgagcaccggg

SEQ ID NO: 1197088 - RNA, 22 nt, Mycobacterium bovis subsp bovis AF2122/97
cgccgagaugcugcacccggag

SEQ ID NO: 1197089 - RNA, 21 nt, Mycobacterium bovis subsp bovis AF2122/97
cgccgagcaaggggaucugag

SEQ ID NO: 1197090 - RNA, 14 nt, Mycobacterium bovis subsp bovis AF2122/97
cgccgacccgccgc

SEQ ID NO: 1197091 - RNA, 22 nt, Mycobacterium bovis subsp bovis AF2122/97
cgccgacccaacccgaucucug

SEQ ID NO: 1197092 - RNA, 12 nt, Mycobacterium bovis subsp bovis AF2122/97
cgccgaccagaa

SEQ ID NO: 1197093 - RNA, 19 nt, Mycobacterium bovis subsp bovis AF2122/97
cgccgaccacauuccgcag

SEQ ID NO: 1197094 - RNA, 14 nt, Mycobacterium bovis subsp bovis AF2122/97
cgccgaccacccgg

SEQ ID NO: 1197095 - RNA, 21 nt, Mycobacterium bovis subsp bovis AF2122/97
cgccgacauggcggugcgcag

SEQ ID NO: 1197096 - RNA, 22 nt, Mycobacterium bovis subsp bovis AF2122/97
cgccgacauggcggugcgcagc

SEQ ID NO: 1197097 - RNA, 16 nt, Mycobacterium bovis subsp bovis AF2122/97
cgccgacaggccggcc

SEQ ID NO: 1197098 - RNA, 12 nt, Mycobacterium bovis subsp bovis AF2122/97
cgccgacagccc

SEQ ID NO: 1197099 - RNA, 15 nt, Mycobacterium bovis subsp bovis AF2122/97
cgccgacagcgccuu

SEQ ID NO: 1197100 - RNA, 16 nt, Mycobacterium bovis subsp bovis AF2122/97
cgccgacaccaccggc

SEQ ID NO: 1197101 - RNA, 18 nt, Mycobacterium bovis subsp bovis AF2122/97
cgccgacaccaccggcgc

SEQ ID NO: 1197102 - RNA, 21 nt, Mycobacterium bovis subsp bovis AF2122/97
cgccgacaccaccggcgccgc

SEQ ID NO: 1197103 - RNA, 22 nt, Mycobacterium bovis subsp bovis AF2122/97
cgccgaaucggcaguugaacuc

SEQ ID NO: 1197104 - RNA, 16 nt, Mycobacterium bovis subsp bovis AF2122/97
cgccgaaucgcugacc

SEQ ID NO: 1197105 - RNA, 14 nt, Mycobacterium bovis subsp bovis AF2122/97
cgccgacaaaagcc

SEQ ID NO: 1197106 - RNA, 19 nt, Mycobacterium bovis subsp bovis AF2122/97
cgccgacaaccccgccagg

SEQ ID NO: 1197107 - RNA, 14 nt, Mycobacterium bovis subsp bovis AF2122/97
cgccgacaccaccg

SEQ ID NO: 1197108 - RNA, 18 nt, Mycobacterium bovis subsp bovis AF2122/97
cgccgaaaucggccagcu

SEQ ID NO: 1197109 - RNA, 21 nt, Mycobacterium bovis subsp bovis AF2122/97
cgccgaaacucaccagcaccc

SEQ ID NO: 1197110 - RNA, 21 nt, Mycobacterium bovis subsp bovis AF2122/97
cgccgaacgugcaaccacggc

SEQ ID NO: 1197111 - RNA, 16 nt, Mycobacterium bovis subsp bovis AF2122/97
cgccgaacgccaccac

SEQ ID NO: 1197112 - RNA, 16 nt, Mycobacterium bovis subsp bovis AF2122/97
cgccgaagccgcgcau

SEQ ID NO: 1197113 - RNA, 20 nt, Mycobacterium bovis subsp bovis AF2122/97
cgccgaagcucaucgccgcu

SEQ ID NO: 1197114 - RNA, 15 nt, Mycobacterium bovis subsp bovis AF2122/97
cgccgaagcgccgcu

SEQ ID NO: 1197115 - RNA, 15 nt, Mycobacterium bovis subsp bovis AF2122/97
cgccgaagccggacc

SEQ ID NO: 1197116 - RNA, 21 nt, Mycobacterium bovis subsp bovis AF2122/97
cgccgaagccuugcagcgccc

SEQ ID NO: 1197117 - RNA, 22 nt, Mycobacterium bovis subsp bovis AF2122/97
cgccgaagcgaugccgugcugg

SEQ ID NO: 1197118 - RNA, 20 nt, Mycobacterium bovis subsp bovis AF2122/97
cgcccggucucgacggcggc

SEQ ID NO: 1197119 - RNA, 20 nt, Mycobacterium bovis subsp bovis AF2122/97
cgcccggucgggcgcggggc

SEQ ID NO: 1197120 - RNA, 19 nt, Mycobacterium bovis subsp bovis AF2122/97
cgcccggugcuaaccgacg

SEQ ID NO: 1197121 - RNA, 17 nt, Mycobacterium bovis subsp bovis AF2122/97
cgcccgucguagguggc

SEQ ID NO: 1197122 - RNA, 15 nt, Mycobacterium bovis subsp bovis AF2122/97
cgcccgucuccagca

SEQ ID NO: 1197123 - RNA, 14 nt, Mycobacterium bovis subsp bovis AF2122/97
cgcccgugagaucc

SEQ ID NO: 1197124 - RNA, 22 nt, Mycobacterium bovis subsp bovis AF2122/97
cgcccgugccgcccgcgccgcc

SEQ ID NO: 1197125 - RNA, 14 nt, Mycobacterium bovis subsp bovis AF2122/97
cgcccgugccgccc

SEQ ID NO: 1197126 - RNA, 15 nt, Mycobacterium bovis subsp bovis AF2122/97
cgcccgugccgcccg

SEQ ID NO: 1197127 - RNA, 16 nt, Mycobacterium bovis subsp bovis AF2122/97
cgcccgugccgcccgc

SEQ ID NO: 1197128 - RNA, 13 nt, Mycobacterium bovis subsp bovis AF2122/97
cgcccguguugaa

SEQ ID NO: 1197129 - RNA, 23 nt, Mycobacterium bovis subsp bovis AF2122/97
cgcccguguugaagaagcccgag

SEQ ID NO: 1197130 - RNA, 21 nt, Mycobacterium bovis subsp bovis AF2122/97
cgcccucgucgcgggccaccg

SEQ ID NO: 1197131 - RNA, 23 nt, Mycobacterium bovis subsp bovis AF2122/97
cgcccugacccggagccgccagg

SEQ ID NO: 1197132 - RNA, 21 nt, Mycobacterium bovis subsp bovis AF2122/97
cgcccugaagggccgccucgc

SEQ ID NO: 1197133 - RNA, 14 nt, Mycobacterium bovis subsp bovis AF2122/97
cgcccucccugggg

SEQ ID NO: 1197134 - RNA, 22 nt, Mycobacterium bovis subsp bovis AF2122/97
cgcccucgucgaucgccgcgau

SEQ ID NO: 1197135 - RNA, 16 nt, Mycobacterium bovis subsp bovis AF2122/97
cgcccucgucgcgggc

SEQ ID NO: 1197136 - RNA, 14 nt, Mycobacterium bovis subsp bovis AF2122/97
cgcccucccgggcc

SEQ ID NO: 1197137 - RNA, 15 nt, Mycobacterium bovis subsp bovis AF2122/97
cgcccucccgggccc

SEQ ID NO: 1197138 - RNA, 21 nt, Mycobacterium bovis subsp bovis AF2122/97
cgcccuagcuggugcgcccga

SEQ ID NO: 1197139 - RNA, 15 nt, Mycobacterium bovis subsp bovis AF2122/97
cgcccucagccgcgg

SEQ ID NO: 1197140 - RNA, 16 nt, Mycobacterium bovis subsp bovis AF2122/97
cgcccucagccgcggc

SEQ ID NO: 1197141 - RNA, 18 nt, Mycobacterium bovis subsp bovis AF2122/97
cgcccucagccgcggcca

SEQ ID NO: 1197142 - RNA, 21 nt, Mycobacterium bovis subsp bovis AF2122/97
cgcccuauacgcaacaggcca

SEQ ID NO: 1197143 - RNA, 23 nt, Mycobacterium bovis subsp bovis AF2122/97
cgcccucaccgccugugccgccg

SEQ ID NO: 1197144 - RNA, 14 nt, Mycobacterium bovis subsp bovis AF2122/97
cgcccuggccgccc

SEQ ID NO: 1197145 - RNA, 16 nt, Mycobacterium bovis subsp bovis AF2122/97
cgcccuggccgcccug

SEQ ID NO: 1197146 - RNA, 17 nt, Mycobacterium bovis subsp bovis AF2122/97
cgcccuggccgccggcc

SEQ ID NO: 1197147 - RNA, 13 nt, Mycobacterium bovis subsp bovis AF2122/97
cgcccuggccgcu

SEQ ID NO: 1197148 - RNA, 11 nt, Mycobacterium bovis subsp bovis AF2122/97
cgcccugggcg

SEQ ID NO: 1197149 - RNA, 17 nt, Mycobacterium bovis subsp bovis AF2122/97
cgcccuguucggcccga

SEQ ID NO: 1197150 - RNA, 16 nt, Mycobacterium bovis subsp bovis AF2122/97
cgcccugggcgccggc

SEQ ID NO: 1197151 - RNA, 22 nt, Mycobacterium bovis subsp bovis AF2122/97
cgcccuguccggguagcggcgc

SEQ ID NO: 1197152 - RNA, 10 nt, Mycobacterium bovis subsp bovis AF2122/97
cgcccuugcc

SEQ ID NO: 1197153 - RNA, 15 nt, Mycobacterium bovis subsp bovis AF2122/97
cgcccuugccgcccg

SEQ ID NO: 1197154 - RNA, 14 nt, Mycobacterium bovis subsp bovis AF2122/97
cgcccuugccgcag

SEQ ID NO: 1197155 - RNA, 14 nt, Mycobacterium bovis subsp bovis AF2122/97
cgcccuugccgccg

SEQ ID NO: 1197156 - RNA, 20 nt, Mycobacterium bovis subsp bovis AF2122/97
cgccgccuggacgccgccgg

SEQ ID NO: 1197157 - RNA, 22 nt, Mycobacterium bovis subsp bovis AF2122/97
cgccgccuuccuggcgggcgcc

SEQ ID NO: 1197158 - RNA, 22 nt, Mycobacterium bovis subsp bovis AF2122/97
cgccgccuucuucucggcgagc

SEQ ID NO: 1197159 - RNA, 12 nt, Mycobacterium bovis subsp bovis AF2122/97
cgccgccugcuc

SEQ ID NO: 1197160 - RNA, 15 nt, Mycobacterium bovis subsp bovis AF2122/97
cgccgccugcuccuc

SEQ ID NO: 1197161 - RNA, 21 nt, Mycobacterium bovis subsp bovis AF2122/97
cgccgcgaacuccagcagccc

SEQ ID NO: 1197162 - RNA, 20 nt, Mycobacterium bovis subsp bovis AF2122/97
cgccgcgaagcgcucggcag

SEQ ID NO: 1197163 - RNA, 17 nt, Mycobacterium bovis subsp bovis AF2122/97
cgccgccguugccgcca

SEQ ID NO: 1197164 - RNA, 17 nt, Mycobacterium bovis subsp bovis AF2122/97
cgccgccguugccgccg

SEQ ID NO: 1197165 - RNA, 18 nt, Mycobacterium bovis subsp bovis AF2122/97
cgccgccguucccgccgg

SEQ ID NO: 1197166 - RNA, 19 nt, Mycobacterium bovis subsp bovis AF2122/97
cgccgccguucccgccggc

SEQ ID NO: 1197167 - RNA, 21 nt, Mycobacterium bovis subsp bovis AF2122/97
cgccgccguugccgccggcgc

SEQ ID NO: 1197168 - RNA, 14 nt, Mycobacterium bovis subsp bovis AF2122/97
cgccgccuccgccg

SEQ ID NO: 1197169 - RNA, 14 nt, Mycobacterium bovis subsp bovis AF2122/97
cgccgccugcccgg

SEQ ID NO: 1197170 - RNA, 15 nt, Mycobacterium bovis subsp bovis AF2122/97
cgccgccugcccggc

SEQ ID NO: 1197171 - RNA, 18 nt, Mycobacterium bovis subsp bovis AF2122/97
cgccgccugcccggcccg

SEQ ID NO: 1197172 - RNA, 20 nt, Mycobacterium bovis subsp bovis AF2122/97
cgccgccugcccggcccgcu

SEQ ID NO: 1197173 - RNA, 19 nt, Mycobacterium bovis subsp bovis AF2122/97
cgccgcgcagccggcccgu

SEQ ID NO: 1197174 - RNA, 19 nt, Mycobacterium bovis subsp bovis AF2122/97
cgccgcgcaucgcggccga

SEQ ID NO: 1197175 - RNA, 12 nt, Mycobacterium bovis subsp bovis AF2122/97
cgccgcgccccg

SEQ ID NO: 1197176 - RNA, 17 nt, Mycobacterium bovis subsp bovis AF2122/97
cgccgcgccccgcggca

SEQ ID NO: 1197177 - RNA, 13 nt, Mycobacterium bovis subsp bovis AF2122/97
cgccgcgcccggc

SEQ ID NO: 1197178 - RNA, 21 nt, Mycobacterium bovis subsp bovis AF2122/97
cgccgcgccgaaucgcgggcu

SEQ ID NO: 1197179 - RNA, 14 nt, Mycobacterium bovis subsp bovis AF2122/97
cgccgcgccggcac

SEQ ID NO: 1197180 - RNA, 15 nt, Mycobacterium bovis subsp bovis AF2122/97
cgccgcgccggcggc

SEQ ID NO: 1197181 - RNA, 16 nt, Mycobacterium bovis subsp bovis AF2122/97
cgccgcgcaccgcggg

SEQ ID NO: 1197182 - RNA, 22 nt, Mycobacterium bovis subsp bovis AF2122/97
cgccgcgauggcgguccaccgg

SEQ ID NO: 1197183 - RNA, 22 nt, Mycobacterium bovis subsp bovis AF2122/97
cgccgcgaugccacccaacagc

SEQ ID NO: 1197184 - RNA, 16 nt, Mycobacterium bovis subsp bovis AF2122/97
cgccgcgauggccccu

SEQ ID NO: 1197185 - RNA, 17 nt, Mycobacterium bovis subsp bovis AF2122/97
cgccgcgcagccggccc

SEQ ID NO: 1197186 - RNA, 16 nt, Mycobacterium bovis subsp bovis AF2122/97
cgccgcgagcgccggc

SEQ ID NO: 1197187 - RNA, 19 nt, Mycobacterium bovis subsp bovis AF2122/97
cgccgcgagcgccggccgc

SEQ ID NO: 1197188 - RNA, 15 nt, Mycobacterium bovis subsp bovis AF2122/97
cgccgcgaggcaccg

SEQ ID NO: 1197189 - RNA, 19 nt, Mycobacterium bovis subsp bovis AF2122/97
cgccgcggcgcccggcgga

SEQ ID NO: 1197190 - RNA, 18 nt, Mycobacterium bovis subsp bovis AF2122/97
cgccgcgggacaccaccg

SEQ ID NO: 1197191 - RNA, 23 nt, Mycobacterium bovis subsp bovis AF2122/97
cgccgcgggacaccaccgcccgc

SEQ ID NO: 1197192 - RNA, 16 nt, Mycobacterium bovis subsp bovis AF2122/97
cgccgcgggcgccggu

SEQ ID NO: 1197193 - RNA, 22 nt, Mycobacterium bovis subsp bovis AF2122/97
cgccgcguaccaauucccgcgc

SEQ ID NO: 1197194 - RNA, 19 nt, Mycobacterium bovis subsp bovis AF2122/97
cgccgcgucuaccaaccgg

SEQ ID NO: 1197195 - RNA, 20 nt, Mycobacterium bovis subsp bovis AF2122/97
cgccgcgugguuccggcgug

SEQ ID NO: 1197196 - RNA, 19 nt, Mycobacterium bovis subsp bovis AF2122/97
cgccgcgugcugcggcugg

SEQ ID NO: 1197197 - RNA, 18 nt, Mycobacterium bovis subsp bovis AF2122/97
cgccgcgcuggucggaga

SEQ ID NO: 1197198 - RNA, 14 nt, Mycobacterium bovis subsp bovis AF2122/97
cgccgcggccacca

SEQ ID NO: 1197199 - RNA, 15 nt, Mycobacterium bovis subsp bovis AF2122/97
cgccgcggccggcgc

SEQ ID NO: 1197200 - RNA, 18 nt, Mycobacterium bovis subsp bovis AF2122/97
cgccgcggccgccguccc

SEQ ID NO: 1197201 - RNA, 16 nt, Mycobacterium bovis subsp bovis AF2122/97
cgccgcggccggcgcu

SEQ ID NO: 1197202 - RNA, 12 nt, Mycobacterium bovis subsp bovis AF2122/97
cgccgcggcgcc

SEQ ID NO: 1197203 - RNA, 12 nt, Mycobacterium bovis subsp bovis AF2122/97
cgccgcgccggc

SEQ ID NO: 1197204 - RNA, 22 nt, Mycobacterium bovis subsp bovis AF2122/97
cgccgcgcgcauuuuucgccag

SEQ ID NO: 1197205 - RNA, 15 nt, Mycobacterium bovis subsp bovis AF2122/97
cgccgcgcgcggcgu

SEQ ID NO: 1197206 - RNA, 20 nt, Mycobacterium bovis subsp bovis AF2122/97
cgccgcgcggaacaccgagg

SEQ ID NO: 1197207 - RNA, 22 nt, Mycobacterium bovis subsp bovis AF2122/97
cgccgcgcuugcgaucgccgcu

SEQ ID NO: 1197208 - RNA, 18 nt, Mycobacterium bovis subsp bovis AF2122/97
cgccgcgcguucggcgcu

SEQ ID NO: 1197209 - RNA, 12 nt, Mycobacterium bovis subsp bovis AF2122/97
cgccgcgcguca

SEQ ID NO: 1197210 - RNA, 17 nt, Mycobacterium bovis subsp bovis AF2122/97
cgccgcucauccagcgc

SEQ ID NO: 1197211 - RNA, 23 nt, Mycobacterium bovis subsp bovis AF2122/97
cgccgcuaggugacgccgccagc

SEQ ID NO: 1197212 - RNA, 20 nt, Mycobacterium bovis subsp bovis AF2122/97
cgccgcuaacgcaccugcgc

SEQ ID NO: 1197213 - RNA, 20 nt, Mycobacterium bovis subsp bovis AF2122/97
cgccgcguuuauaccucgcc

SEQ ID NO: 1197214 - RNA, 17 nt, Mycobacterium bovis subsp bovis AF2122/97
cgccgcuaccgcccgcg

SEQ ID NO: 1197215 - RNA, 18 nt, Mycobacterium bovis subsp bovis AF2122/97
cgccgcuaccgcccgcgc

SEQ ID NO: 1197216 - RNA, 19 nt, Mycobacterium bovis subsp bovis AF2122/97
cgccgcuacgccggcccga

SEQ ID NO: 1197217 - RNA, 20 nt, Mycobacterium bovis subsp bovis AF2122/97
cgccgcucgguccccgcagc

SEQ ID NO: 1197218 - RNA, 23 nt, Mycobacterium bovis subsp bovis AF2122/97
cgccgcucauuagcccccgcggg

SEQ ID NO: 1197219 - RNA, 21 nt, Mycobacterium bovis subsp bovis AF2122/97
cgccggacccgccggguccgc

SEQ ID NO: 1197220 - RNA, 14 nt, Mycobacterium bovis subsp bovis AF2122/97
cgccggaccagagc

SEQ ID NO: 1197221 - RNA, 20 nt, Mycobacterium bovis subsp bovis AF2122/97
cgccggaacgagcggccgcg

SEQ ID NO: 1197222 - RNA, 17 nt, Mycobacterium bovis subsp bovis AF2122/97
cgccggaaagcccgucg

SEQ ID NO: 1197223 - RNA, 20 nt, Mycobacterium bovis subsp bovis AF2122/97
cgccgcuuucgccggcgcca

SEQ ID NO: 1197224 - RNA, 14 nt, Mycobacterium bovis subsp bovis AF2122/97
cgccgcuucacccc

SEQ ID NO: 1197225 - RNA, 15 nt, Mycobacterium bovis subsp bovis AF2122/97
cgccgcuucacccca

SEQ ID NO: 1197226 - RNA, 19 nt, Mycobacterium bovis subsp bovis AF2122/97
cgccgcugggugaccagga

SEQ ID NO: 1197227 - RNA, 20 nt, Mycobacterium bovis subsp bovis AF2122/97
cgccgcuggagaucacgccg

SEQ ID NO: 1197228 - RNA, 13 nt, Mycobacterium bovis subsp bovis AF2122/97
cgccgcuggcaau

SEQ ID NO: 1197229 - RNA, 19 nt, Mycobacterium bovis subsp bovis AF2122/97
cgccggcaauaccgccagc

SEQ ID NO: 1197230 - RNA, 21 nt, Mycobacterium bovis subsp bovis AF2122/97
cgccggcaauaccgccagcgc

SEQ ID NO: 1197231 - RNA, 22 nt, Mycobacterium bovis subsp bovis AF2122/97
cgccggcacauugaucgacggc

SEQ ID NO: 1197232 - RNA, 23 nt, Mycobacterium bovis subsp bovis AF2122/97
cgccggcaccggggcugcccgcg

SEQ ID NO: 1197233 - RNA, 17 nt, Mycobacterium bovis subsp bovis AF2122/97
cgccggcaucgcgcaac

SEQ ID NO: 1197234 - RNA, 15 nt, Mycobacterium bovis subsp bovis AF2122/97
cgccggcaucgcgcg

SEQ ID NO: 1197235 - RNA, 16 nt, Mycobacterium bovis subsp bovis AF2122/97
cgccggcaucgcgcgc

SEQ ID NO: 1197236 - RNA, 22 nt, Mycobacterium bovis subsp bovis AF2122/97
cgccggcaucgucgacgcccga

SEQ ID NO: 1197237 - RNA, 16 nt, Mycobacterium bovis subsp bovis AF2122/97
cgccggcaucgcgcaa

SEQ ID NO: 1197238 - RNA, 12 nt, Mycobacterium bovis subsp bovis AF2122/97
cgccggccagcc

SEQ ID NO: 1197239 - RNA, 15 nt, Mycobacterium bovis subsp bovis AF2122/97
cgccggccagccagc

SEQ ID NO: 1197240 - RNA, 16 nt, Mycobacterium bovis subsp bovis AF2122/97
cgccggccagccagcg

SEQ ID NO: 1197241 - RNA, 21 nt, Mycobacterium bovis subsp bovis AF2122/97
cgccggcaucuccaccgucgc

SEQ ID NO: 1197242 - RNA, 15 nt, Mycobacterium bovis subsp bovis AF2122/97
cgccggccacccgcg

SEQ ID NO: 1197243 - RNA, 14 nt, Mycobacterium bovis subsp bovis AF2122/97
cgccggccacccgc

SEQ ID NO: 1197244 - RNA, 14 nt, Mycobacterium bovis subsp bovis AF2122/97
cgccggccacgacc

SEQ ID NO: 1197245 - RNA, 16 nt, Mycobacterium bovis subsp bovis AF2122/97
cgccggccagcggcca

SEQ ID NO: 1197246 - RNA, 14 nt, Mycobacterium bovis subsp bovis AF2122/97
cgccggccaguccg

SEQ ID NO: 1197247 - RNA, 20 nt, Mycobacterium bovis subsp bovis AF2122/97
cgccggccaguccgcgcgca

SEQ ID NO: 1197248 - RNA, 15 nt, Mycobacterium bovis subsp bovis AF2122/97
cgccggagccgccca

SEQ ID NO: 1197249 - RNA, 19 nt, Mycobacterium bovis subsp bovis AF2122/97
cgccggagccgcccaagcc

SEQ ID NO: 1197250 - RNA, 14 nt, Mycobacterium bovis subsp bovis AF2122/97
cgccggagucgacc

SEQ ID NO: 1197251 - RNA, 16 nt, Mycobacterium bovis subsp bovis AF2122/97
cgccggacugcggccc

SEQ ID NO: 1197252 - RNA, 19 nt, Mycobacterium bovis subsp bovis AF2122/97
cgccggacccgucgagcag

SEQ ID NO: 1197253 - RNA, 20 nt, Mycobacterium bovis subsp bovis AF2122/97
cgccggacccgucgagcagc

SEQ ID NO: 1197254 - RNA, 19 nt, Mycobacterium bovis subsp bovis AF2122/97
cgccggaguugaagaagcc

SEQ ID NO: 1197255 - RNA, 22 nt, Mycobacterium bovis subsp bovis AF2122/97
cgccggaguugaagaagcccga

SEQ ID NO: 1197256 - RNA, 17 nt, Mycobacterium bovis subsp bovis AF2122/97
cgccggaguuucccuua

SEQ ID NO: 1197257 - RNA, 15 nt, Mycobacterium bovis subsp bovis AF2122/97
cgccggauagcgcag

SEQ ID NO: 1197258 - RNA, 17 nt, Mycobacterium bovis subsp bovis AF2122/97
cgccggauagcgcagcu

SEQ ID NO: 1197259 - RNA, 22 nt, Mycobacterium bovis subsp bovis AF2122/97
cgccggauccgauccgcacagc

SEQ ID NO: 1197260 - RNA, 21 nt, Mycobacterium bovis subsp bovis AF2122/97
cgccggaugcugucagcagcc

SEQ ID NO: 1197261 - RNA, 18 nt, Mycobacterium bovis subsp bovis AF2122/97
cgccggaugacaccgacc

SEQ ID NO: 1197262 - RNA, 14 nt, Mycobacterium bovis subsp bovis AF2122/97
cgccggccgccagc

SEQ ID NO: 1197263 - RNA, 13 nt, Mycobacterium bovis subsp bovis AF2122/97
cgccggccgccag

SEQ ID NO: 1197264 - RNA, 22 nt, Mycobacterium bovis subsp bovis AF2122/97
cgccggccgcacgccggccagc

SEQ ID NO: 1197265 - RNA, 21 nt, Mycobacterium bovis subsp bovis AF2122/97
cgccggccccaccggugccgc

SEQ ID NO: 1197266 - RNA, 13 nt, Mycobacterium bovis subsp bovis AF2122/97
cgccggccccgcc

SEQ ID NO: 1197267 - RNA, 21 nt, Mycobacterium bovis subsp bovis AF2122/97
cgccggccccgccagcgccgc

SEQ ID NO: 1197268 - RNA, 22 nt, Mycobacterium bovis subsp bovis AF2122/97
cgccggccccgccagcgccgcc

SEQ ID NO: 1197269 - RNA, 14 nt, Mycobacterium bovis subsp bovis AF2122/97
cgccggccccgccg

SEQ ID NO: 1197270 - RNA, 15 nt, Mycobacterium bovis subsp bovis AF2122/97
cgccggccccgccgg

SEQ ID NO: 1197271 - RNA, 16 nt, Mycobacterium bovis subsp bovis AF2122/97
cgccggccccgccggc

SEQ ID NO: 1197272 - RNA, 15 nt, Mycobacterium bovis subsp bovis AF2122/97
cgccggccccgccag

SEQ ID NO: 1197273 - RNA, 23 nt, Mycobacterium bovis subsp bovis AF2122/97
cgccggccccgccggcgccgccc

SEQ ID NO: 1197274 - RNA, 15 nt, Mycobacterium bovis subsp bovis AF2122/97
cgccggccgcgcaga

SEQ ID NO: 1197275 - RNA, 14 nt, Mycobacterium bovis subsp bovis AF2122/97
cgccggccggcgcg

SEQ ID NO: 1197276 - RNA, 13 nt, Mycobacterium bovis subsp bovis AF2122/97
cgccggccggcag

SEQ ID NO: 1197277 - RNA, 20 nt, Mycobacterium bovis subsp bovis AF2122/97
cgccggccgcgggcgcgcag

SEQ ID NO: 1197278 - RNA, 23 nt, Mycobacterium bovis subsp bovis AF2122/97
cgccggcgaagcgugcgccgacu

SEQ ID NO: 1197279 - RNA, 14 nt, Mycobacterium bovis subsp bovis AF2122/97
cgccggccuggccg

SEQ ID NO: 1197280 - RNA, 15 nt, Mycobacterium bovis subsp bovis AF2122/97
cgccggccuggccgc

SEQ ID NO: 1197281 - RNA, 19 nt, Mycobacterium bovis subsp bovis AF2122/97
cgccggccuggccgccaga

SEQ ID NO: 1197282 - RNA, 15 nt, Mycobacterium bovis subsp bovis AF2122/97
cgccggccgucagca

SEQ ID NO: 1197283 - RNA, 16 nt, Mycobacterium bovis subsp bovis AF2122/97
cgccggcgacugcagc

SEQ ID NO: 1197284 - RNA, 15 nt, Mycobacterium bovis subsp bovis AF2122/97
cgccggcgcccaggc

SEQ ID NO: 1197285 - RNA, 17 nt, Mycobacterium bovis subsp bovis AF2122/97
cgccggcgccacccgcg

SEQ ID NO: 1197286 - RNA, 22 nt, Mycobacterium bovis subsp bovis AF2122/97
cgccggcgccacccgcgccgcc

SEQ ID NO: 1197287 - RNA, 15 nt, Mycobacterium bovis subsp bovis AF2122/97
cgccggcgccgccau

SEQ ID NO: 1197288 - RNA, 14 nt, Mycobacterium bovis subsp bovis AF2122/97
cgccggcgccgccc

SEQ ID NO: 1197289 - RNA, 15 nt, Mycobacterium bovis subsp bovis AF2122/97
cgccggcgccgccca

SEQ ID NO: 1197290 - RNA, 13 nt, Mycobacterium bovis subsp bovis AF2122/97
cgccggcgcgccg

SEQ ID NO: 1197291 - RNA, 20 nt, Mycobacterium bovis subsp bovis AF2122/97
cgccggcgcugaucgcgaag

SEQ ID NO: 1197292 - RNA, 14 nt, Mycobacterium bovis subsp bovis AF2122/97
cgccggcggcccgc

SEQ ID NO: 1197293 - RNA, 15 nt, Mycobacterium bovis subsp bovis AF2122/97
cgccggcggcccgcu

SEQ ID NO: 1197294 - RNA, 22 nt, Mycobacterium bovis subsp bovis AF2122/97
cgccggcggcggugcgccccgc

SEQ ID NO: 1197295 - RNA, 13 nt, Mycobacterium bovis subsp bovis AF2122/97
cgccggcggcgga

SEQ ID NO: 1197296 - RNA, 13 nt, Mycobacterium bovis subsp bovis AF2122/97
cgccggcggcggc

SEQ ID NO: 1197297 - RNA, 19 nt, Mycobacterium bovis subsp bovis AF2122/97
cgccggcggcggccgcagc

SEQ ID NO: 1197298 - RNA, 13 nt, Mycobacterium bovis subsp bovis AF2122/97
cgccggcggcggu

SEQ ID NO: 1197299 - RNA, 21 nt, Mycobacterium bovis subsp bovis AF2122/97
cgccggcgguagucggccagc

SEQ ID NO: 1197300 - RNA, 23 nt, Mycobacterium bovis subsp bovis AF2122/97
cgccggcguccggagccccuguc

SEQ ID NO: 1197301 - RNA, 10 nt, Mycobacterium bovis subsp bovis AF2122/97
cgccggcucc

SEQ ID NO: 1197302 - RNA, 14 nt, Mycobacterium bovis subsp bovis AF2122/97
cgccggcucgucga

SEQ ID NO: 1197303 - RNA, 15 nt, Mycobacterium bovis subsp bovis AF2122/97
cgccggcuccggcgg

SEQ ID NO: 1197304 - RNA, 14 nt, Mycobacterium bovis subsp bovis AF2122/97
cgccggcuccgcag

SEQ ID NO: 1197305 - RNA, 16 nt, Mycobacterium bovis subsp bovis AF2122/97
cgccggcuggcggccu

SEQ ID NO: 1197306 - RNA, 16 nt, Mycobacterium bovis subsp bovis AF2122/97
cgccggcuucgcccag

SEQ ID NO: 1197307 - RNA, 15 nt, Mycobacterium bovis subsp bovis AF2122/97
cgccggcugcgccag

SEQ ID NO: 1197308 - RNA, 19 nt, Mycobacterium bovis subsp bovis AF2122/97
cgccgggauaacccagcac

SEQ ID NO: 1197309 - RNA, 12 nt, Mycobacterium bovis subsp bovis AF2122/97
cgccgggcccuc

SEQ ID NO: 1197310 - RNA, 18 nt, Mycobacterium bovis subsp bovis AF2122/97
cgccgggcuuaggccgcg

SEQ ID NO: 1197311 - RNA, 21 nt, Mycobacterium bovis subsp bovis AF2122/97
cgccgggcuuaggccgcggca

SEQ ID NO: 1197312 - RNA, 22 nt, Mycobacterium bovis subsp bovis AF2122/97
cgccgggcuuggccgcgccggu

SEQ ID NO: 1197313 - RNA, 15 nt, Mycobacterium bovis subsp bovis AF2122/97
cgccgggggcgccgc

SEQ ID NO: 1197314 - RNA, 16 nt, Mycobacterium bovis subsp bovis AF2122/97
cgccgggggcgccgcc

SEQ ID NO: 1197315 - RNA, 13 nt, Mycobacterium bovis subsp bovis AF2122/97
cgccggggggcug

SEQ ID NO: 1197316 - RNA, 18 nt, Mycobacterium bovis subsp bovis AF2122/97
cgccggggggcugcugcu

SEQ ID NO: 1197317 - RNA, 17 nt, Mycobacterium bovis subsp bovis AF2122/97
cgccgggguagacgccc

SEQ ID NO: 1197318 - RNA, 15 nt, Mycobacterium bovis subsp bovis AF2122/97
cgccgggugcgccgu

SEQ ID NO: 1197319 - RNA, 20 nt, Mycobacterium bovis subsp bovis AF2122/97
cgccggguuggcgccggcca

SEQ ID NO: 1197320 - RNA, 18 nt, Mycobacterium bovis subsp bovis AF2122/97
cgccggguccgccgggcc

SEQ ID NO: 1197321 - RNA, 20 nt, Mycobacterium bovis subsp bovis AF2122/97
cgccgguaacuguccgcccg

SEQ ID NO: 1197322 - RNA, 15 nt, Mycobacterium bovis subsp bovis AF2122/97
cgccggugccgccau

SEQ ID NO: 1197323 - RNA, 19 nt, Mycobacterium bovis subsp bovis AF2122/97
cgccggugccgaugaccga

SEQ ID NO: 1197324 - RNA, 21 nt, Mycobacterium bovis subsp bovis AF2122/97
cgccggugccgccggugccgc

SEQ ID NO: 1197325 - RNA, 22 nt, Mycobacterium bovis subsp bovis AF2122/97
cgccggugccgccugcgccgcc

SEQ ID NO: 1197326 - RNA, 14 nt, Mycobacterium bovis subsp bovis AF2122/97
cgccggugccggcc

SEQ ID NO: 1197327 - RNA, 15 nt, Mycobacterium bovis subsp bovis AF2122/97
cgccggugccggcca

SEQ ID NO: 1197328 - RNA, 21 nt, Mycobacterium bovis subsp bovis AF2122/97
cgccggugacgaugaccgcgc

SEQ ID NO: 1197329 - RNA, 22 nt, Mycobacterium bovis subsp bovis AF2122/97
cgccggugaggcgaccggacga

SEQ ID NO: 1197330 - RNA, 18 nt, Mycobacterium bovis subsp bovis AF2122/97
cgccggucaggccgccgc

SEQ ID NO: 1197331 - RNA, 15 nt, Mycobacterium bovis subsp bovis AF2122/97
cgccggucccccgcc

SEQ ID NO: 1197332 - RNA, 23 nt, Mycobacterium bovis subsp bovis AF2122/97
cgccggucagcaauacggcggcg

SEQ ID NO: 1197333 - RNA, 15 nt, Mycobacterium bovis subsp bovis AF2122/97
cgccgucacgcacgc

SEQ ID NO: 1197334 - RNA, 16 nt, Mycobacterium bovis subsp bovis AF2122/97
cgccgucacggcagua

SEQ ID NO: 1197335 - RNA, 23 nt, Mycobacterium bovis subsp bovis AF2122/97
cgccgucaccgaucgaacagugc

SEQ ID NO: 1197336 - RNA, 15 nt, Mycobacterium bovis subsp bovis AF2122/97
cgccgucacccccga

SEQ ID NO: 1197337 - RNA, 19 nt, Mycobacterium bovis subsp bovis AF2122/97
cgccguagcgcagcgccuc

SEQ ID NO: 1197338 - RNA, 15 nt, Mycobacterium bovis subsp bovis AF2122/97
cgccguagccggccg

SEQ ID NO: 1197339 - RNA, 16 nt, Mycobacterium bovis subsp bovis AF2122/97
cgccguagagcuggug

SEQ ID NO: 1197340 - RNA, 14 nt, Mycobacterium bovis subsp bovis AF2122/97
cgccguccccgccg

SEQ ID NO: 1197341 - RNA, 15 nt, Mycobacterium bovis subsp bovis AF2122/97
cgccguccccgccga

SEQ ID NO: 1197342 - RNA, 16 nt, Mycobacterium bovis subsp bovis AF2122/97
cgccgucaucgcagca

SEQ ID NO: 1197343 - RNA, 19 nt, Mycobacterium bovis subsp bovis AF2122/97
cgccgucaucgugcccgcg

SEQ ID NO: 1197344 - RNA, 20 nt, Mycobacterium bovis subsp bovis AF2122/97
cgccgucagaacaccggcca

SEQ ID NO: 1197345 - RNA, 16 nt, Mycobacterium bovis subsp bovis AF2122/97
cgccgucagcaccgcu

SEQ ID NO: 1197346 - RNA, 15 nt, Mycobacterium bovis subsp bovis AF2122/97
cgccgucagcccagg

SEQ ID NO: 1197347 - RNA, 15 nt, Mycobacterium bovis subsp bovis AF2122/97
cgccggugcggcggg

SEQ ID NO: 1197348 - RNA, 13 nt, Mycobacterium bovis subsp bovis AF2122/97
cgccggugcgcug

SEQ ID NO: 1197349 - RNA, 13 nt, Mycobacterium bovis subsp bovis AF2122/97
cgccgguggcacg

SEQ ID NO: 1197350 - RNA, 15 nt, Mycobacterium bovis subsp bovis AF2122/97
cgccgguggcacggc

SEQ ID NO: 1197351 - RNA, 19 nt, Mycobacterium bovis subsp bovis AF2122/97
cgccgguggcacggccccu

SEQ ID NO: 1197352 - RNA, 21 nt, Mycobacterium bovis subsp bovis AF2122/97
cgccgguggcagagccgccgu

SEQ ID NO: 1197353 - RNA, 13 nt, Mycobacterium bovis subsp bovis AF2122/97
cgccggugguaac

SEQ ID NO: 1197354 - RNA, 18 nt, Mycobacterium bovis subsp bovis AF2122/97
cgccggugguaccggcgg

SEQ ID NO: 1197355 - RNA, 20 nt, Mycobacterium bovis subsp bovis AF2122/97
cgccggugguaccggcggcg

SEQ ID NO: 1197356 - RNA, 16 nt, Mycobacterium bovis subsp bovis AF2122/97
cgccgguggccgcgcu

SEQ ID NO: 1197357 - RNA, 18 nt, Mycobacterium bovis subsp bovis AF2122/97
cgccgguguaacccucga

SEQ ID NO: 1197358 - RNA, 21 nt, Mycobacterium bovis subsp bovis AF2122/97
cgccgguguccuuggccgcca

SEQ ID NO: 1197359 - RNA, 21 nt, Mycobacterium bovis subsp bovis AF2122/97
cgccgguggugccggcgccgc

SEQ ID NO: 1197360 - RNA, 22 nt, Mycobacterium bovis subsp bovis AF2122/97
cgccgguggugccggcgccgcc

SEQ ID NO: 1197361 - RNA, 18 nt, Mycobacterium bovis subsp bovis AF2122/97
cgccgguuccgccggccc

SEQ ID NO: 1197362 - RNA, 19 nt, Mycobacterium bovis subsp bovis AF2122/97
cgccguaacagccggccgg

SEQ ID NO: 1197363 - RNA, 14 nt, Mycobacterium bovis subsp bovis AF2122/97
cgccuugcgggccu

SEQ ID NO: 1197364 - RNA, 15 nt, Mycobacterium bovis subsp bovis AF2122/97
cgccuuggcgcccgc

SEQ ID NO: 1197365 - RNA, 21 nt, Mycobacterium bovis subsp bovis AF2122/97
cgccuuggucgccgccuucuu

SEQ ID NO: 1197366 - RNA, 14 nt, Mycobacterium bovis subsp bovis AF2122/97
cgccuuggcacccu

SEQ ID NO: 1197367 - RNA, 17 nt, Mycobacterium bovis subsp bovis AF2122/97
cgccuuuuuucgccgcc

SEQ ID NO: 1197368 - RNA, 16 nt, Mycobacterium bovis subsp bovis AF2122/97
cgccuuugccgccggc

SEQ ID NO: 1197369 - RNA, 18 nt, Mycobacterium bovis subsp bovis AF2122/97
cgccuuccagcccgagca

SEQ ID NO: 1197370 - RNA, 21 nt, Mycobacterium bovis subsp bovis AF2122/97
cgccuucuuggcaggugccuu

SEQ ID NO: 1197371 - RNA, 18 nt, Mycobacterium bovis subsp bovis AF2122/97
cgccuucuucgcggcggu

SEQ ID NO: 1197372 - RNA, 23 nt, Mycobacterium bovis subsp bovis AF2122/97
cgccuugacgaucgagcugacga

SEQ ID NO: 1197373 - RNA, 20 nt, Mycobacterium bovis subsp bovis AF2122/97
cgccuugaagcgguggacga

SEQ ID NO: 1197374 - RNA, 13 nt, Mycobacterium bovis subsp bovis AF2122/97
cgccuugaccaca

SEQ ID NO: 1197375 - RNA, 15 nt, Mycobacterium bovis subsp bovis AF2122/97
cgcgaaacaccagac

SEQ ID NO: 1197376 - RNA, 12 nt, Mycobacterium bovis subsp bovis AF2122/97
cgcgaacacccg

SEQ ID NO: 1197377 - RNA, 22 nt, Mycobacterium bovis subsp bovis AF2122/97
cgcgaaauaacggagcggccua

SEQ ID NO: 1197378 - RNA, 18 nt, Mycobacterium bovis subsp bovis AF2122/97
cgcgaacgcgacagccac

SEQ ID NO: 1197379 - RNA, 14 nt, Mycobacterium bovis subsp bovis AF2122/97
cgcgaacgcggcca

SEQ ID NO: 1197380 - RNA, 18 nt, Mycobacterium bovis subsp bovis AF2122/97
cgcgaacgcggccaccac

SEQ ID NO: 1197381 - RNA, 21 nt, Mycobacterium bovis subsp bovis AF2122/97
cgcgaaccgucucggcgaccg

SEQ ID NO: 1197382 - RNA, 21 nt, Mycobacterium bovis subsp bovis AF2122/97
cgcgaaccugcucggcgcgcc

SEQ ID NO: 1197383 - RNA, 18 nt, Mycobacterium bovis subsp bovis AF2122/97
cgcgaagaacgacgccac

SEQ ID NO: 1197384 - RNA, 21 nt, Mycobacterium bovis subsp bovis AF2122/97
cgcgaagaacgacgccaccgc

SEQ ID NO: 1197385 - RNA, 18 nt, Mycobacterium bovis subsp bovis AF2122/97
cgcgaacuccagcagccc

SEQ ID NO: 1197386 - RNA, 15 nt, Mycobacterium bovis subsp bovis AF2122/97
cgcgaagccaccagg

SEQ ID NO: 1197387 - RNA, 14 nt, Mycobacterium bovis subsp bovis AF2122/97
cgcgaagccaccag

SEQ ID NO: 1197388 - RNA, 14 nt, Mycobacterium bovis subsp bovis AF2122/97
cgcgaagcugcggg

SEQ ID NO: 1197389 - RNA, 22 nt, Mycobacterium bovis subsp bovis AF2122/97
cgcgaagcugugcccggcgccc

SEQ ID NO: 1197390 - RNA, 23 nt, Mycobacterium bovis subsp bovis AF2122/97
cgcgaaggauuugauaggcgcgc

SEQ ID NO: 1197391 - RNA, 19 nt, Mycobacterium bovis subsp bovis AF2122/97
cgcgaagugcuugggccgc

SEQ ID NO: 1197392 - RNA, 21 nt, Mycobacterium bovis subsp bovis AF2122/97
cgcgaauaccagaccggccga

SEQ ID NO: 1197393 - RNA, 16 nt, Mycobacterium bovis subsp bovis AF2122/97
cgcgaaugucgccgcc

SEQ ID NO: 1197394 - RNA, 19 nt, Mycobacterium bovis subsp bovis AF2122/97
cgcgaauggcggacagggc

SEQ ID NO: 1197395 - RNA, 19 nt, Mycobacterium bovis subsp bovis AF2122/97
cgccuuaggcguccgagcg

SEQ ID NO: 1197396 - RNA, 22 nt, Mycobacterium bovis subsp bovis AF2122/97
cgccuucacgcuggccuccagc

SEQ ID NO: 1197397 - RNA, 21 nt, Mycobacterium bovis subsp bovis AF2122/97
cgccuuacgcaccgaugccuu

SEQ ID NO: 1197398 - RNA, 19 nt, Mycobacterium bovis subsp bovis AF2122/97
cgccugugccgccggcgcc

SEQ ID NO: 1197399 - RNA, 17 nt, Mycobacterium bovis subsp bovis AF2122/97
cgccuggcggcgccgca

SEQ ID NO: 1197400 - RNA, 17 nt, Mycobacterium bovis subsp bovis AF2122/97
cgccuggcuacgcgcgc

SEQ ID NO: 1197401 - RNA, 21 nt, Mycobacterium bovis subsp bovis AF2122/97
cgccuggcuacgcgcgcccga

SEQ ID NO: 1197402 - RNA, 19 nt, Mycobacterium bovis subsp bovis AF2122/97
cgccuggacgccgccggag

SEQ ID NO: 1197403 - RNA, 18 nt, Mycobacterium bovis subsp bovis AF2122/97
cgccugggcggccagcac

SEQ ID NO: 1197404 - RNA, 21 nt, Mycobacterium bovis subsp bovis AF2122/97
cgccugguguacacacccgcc

SEQ ID NO: 1197405 - RNA, 16 nt, Mycobacterium bovis subsp bovis AF2122/97
cgccugucccgccggc

SEQ ID NO: 1197406 - RNA, 19 nt, Mycobacterium bovis subsp bovis AF2122/97
cgccugucccgccggcccc

SEQ ID NO: 1197407 - RNA, 16 nt, Mycobacterium bovis subsp bovis AF2122/97
cgccuguacggcggcu

SEQ ID NO: 1197408 - RNA, 22 nt, Mycobacterium bovis subsp bovis AF2122/97
cgccugcugguaccgggcucca

SEQ ID NO: 1197409 - RNA, 14 nt, Mycobacterium bovis subsp bovis AF2122/97
cgccugcucggcga

SEQ ID NO: 1197410 - RNA, 16 nt, Mycobacterium bovis subsp bovis AF2122/97
cgccugcuggccgcgg

SEQ ID NO: 1197411 - RNA, 17 nt, Mycobacterium bovis subsp bovis AF2122/97
cgccugcggcagcaccc

SEQ ID NO: 1197412 - RNA, 18 nt, Mycobacterium bovis subsp bovis AF2122/97
cgccugccgacgaggggc

SEQ ID NO: 1197413 - RNA, 14 nt, Mycobacterium bovis subsp bovis AF2122/97
cgccugcgccgccc

SEQ ID NO: 1197414 - RNA, 23 nt, Mycobacterium bovis subsp bovis AF2122/97
cgccugcgacuaagggcacucca

SEQ ID NO: 1197415 - RNA, 16 nt, Mycobacterium bovis subsp bovis AF2122/97
cgccugcgccacccgc

SEQ ID NO: 1197416 - RNA, 18 nt, Mycobacterium bovis subsp bovis AF2122/97
cgccugcgccacccgcgg

SEQ ID NO: 1197417 - RNA, 18 nt, Mycobacterium bovis subsp bovis AF2122/97
cgccugcccggcccgcuc

SEQ ID NO: 1197418 - RNA, 16 nt, Mycobacterium bovis subsp bovis AF2122/97
cgccugccaccggcgc

SEQ ID NO: 1197419 - RNA, 15 nt, Mycobacterium bovis subsp bovis AF2122/97
cgccugcccgaacca

SEQ ID NO: 1197420 - RNA, 19 nt, Mycobacterium bovis subsp bovis AF2122/97
cgccugccaucacgcgcuc

SEQ ID NO: 1197421 - RNA, 17 nt, Mycobacterium bovis subsp bovis AF2122/97
cgccucgacacccagcc

SEQ ID NO: 1197422 - RNA, 20 nt, Mycobacterium bovis subsp bovis AF2122/97
cgccuccugcggguagaugu

SEQ ID NO: 1197423 - RNA, 16 nt, Mycobacterium bovis subsp bovis AF2122/97
cgccucgaccgccagc

SEQ ID NO: 1197424 - RNA, 17 nt, Mycobacterium bovis subsp bovis AF2122/97
cgccucgaggaccacca

SEQ ID NO: 1197425 - RNA, 18 nt, Mycobacterium bovis subsp bovis AF2122/97
cgccucgaccgccagccc

SEQ ID NO: 1197426 - RNA, 23 nt, Mycobacterium bovis subsp bovis AF2122/97
cgccucgagguauucgcgcagca

SEQ ID NO: 1197427 - RNA, 19 nt, Mycobacterium bovis subsp bovis AF2122/97
cgccucgccggccacccgc

SEQ ID NO: 1197428 - RNA, 19 nt, Mycobacterium bovis subsp bovis AF2122/97
cgccucgacacccagccgc

SEQ ID NO: 1197429 - RNA, 17 nt, Mycobacterium bovis subsp bovis AF2122/97
cgccucgcccagcaagg

SEQ ID NO: 1197430 - RNA, 13 nt, Mycobacterium bovis subsp bovis AF2122/97
cgccucgccgaag

SEQ ID NO: 1197431 - RNA, 14 nt, Mycobacterium bovis subsp bovis AF2122/97
cgccucgccggcca

SEQ ID NO: 1197432 - RNA, 16 nt, Mycobacterium bovis subsp bovis AF2122/97
cgccucgccggccacc

SEQ ID NO: 1197433 - RNA, 17 nt, Mycobacterium bovis subsp bovis AF2122/97
cgccucgccggccaccc

SEQ ID NO: 1197434 - RNA, 13 nt, Mycobacterium bovis subsp bovis AF2122/97
cgccuccgcggca

SEQ ID NO: 1197435 - RNA, 16 nt, Mycobacterium bovis subsp bovis AF2122/97
cgccuccugccgccgc

SEQ ID NO: 1197436 - RNA, 16 nt, Mycobacterium bovis subsp bovis AF2122/97
cgccuccguugccccc

SEQ ID NO: 1197437 - RNA, 15 nt, Mycobacterium bovis subsp bovis AF2122/97
cgccuccucgugcag

SEQ ID NO: 1197438 - RNA, 15 nt, Mycobacterium bovis subsp bovis AF2122/97
cgccuccgccgaggc

SEQ ID NO: 1197439 - RNA, 15 nt, Mycobacterium bovis subsp bovis AF2122/97
cgccuccaccgccgc

SEQ ID NO: 1197440 - RNA, 16 nt, Mycobacterium bovis subsp bovis AF2122/97
cgccuccaccgccgcg

SEQ ID NO: 1197441 - RNA, 18 nt, Mycobacterium bovis subsp bovis AF2122/97
cgccucaggggcgccuua

SEQ ID NO: 1197442 - RNA, 22 nt, Mycobacterium bovis subsp bovis AF2122/97
cgccuccagcaccacggcgcgc

SEQ ID NO: 1197443 - RNA, 17 nt, Mycobacterium bovis subsp bovis AF2122/97
cgccucggaccagaccc

SEQ ID NO: 1197444 - RNA, 18 nt, Mycobacterium bovis subsp bovis AF2122/97
cgccucggaccagaccca

SEQ ID NO: 1197445 - RNA, 17 nt, Mycobacterium bovis subsp bovis AF2122/97
cgccucgggugcauucu

SEQ ID NO: 1197446 - RNA, 16 nt, Mycobacterium bovis subsp bovis AF2122/97
cgccucgugaguugac

SEQ ID NO: 1197447 - RNA, 14 nt, Mycobacterium bovis subsp bovis AF2122/97
cgccucugcucagc

SEQ ID NO: 1197448 - RNA, 20 nt, Mycobacterium bovis subsp bovis AF2122/97
cgccugagcggccucgggac

SEQ ID NO: 1197449 - RNA, 15 nt, Mycobacterium bovis subsp bovis AF2122/97
cgccugaccgccacc

SEQ ID NO: 1197450 - RNA, 17 nt, Mycobacterium bovis subsp bovis AF2122/97
cgccugaccgccaccgu

SEQ ID NO: 1197451 - RNA, 14 nt, Mycobacterium bovis subsp bovis AF2122/97
cgccucugucuuca

SEQ ID NO: 1197452 - RNA, 16 nt, Mycobacterium bovis subsp bovis AF2122/97
cgccucugcucagccg

SEQ ID NO: 1197453 - RNA, 19 nt, Mycobacterium bovis subsp bovis AF2122/97
cgccugaugcggccggcgc

SEQ ID NO: 1197454 - RNA, 16 nt, Mycobacterium bovis subsp bovis AF2122/97
cgccugcacgcccggc

SEQ ID NO: 1197455 - RNA, 18 nt, Mycobacterium bovis subsp bovis AF2122/97
cgccgugaucagcucgcg

SEQ ID NO: 1197456 - RNA, 21 nt, Mycobacterium bovis subsp bovis AF2122/97
cgccgugaucagcucgcgcac

SEQ ID NO: 1197457 - RNA, 14 nt, Mycobacterium bovis subsp bovis AF2122/97
cgccguggcccgcu

SEQ ID NO: 1197458 - RNA, 23 nt, Mycobacterium bovis subsp bovis AF2122/97
cgccguggccugaaacggcugca

SEQ ID NO: 1197459 - RNA, 14 nt, Mycobacterium bovis subsp bovis AF2122/97
cgccgugcuugcga

SEQ ID NO: 1197460 - RNA, 17 nt, Mycobacterium bovis subsp bovis AF2122/97
cgccgugcccccggcuu

SEQ ID NO: 1197461 - RNA, 18 nt, Mycobacterium bovis subsp bovis AF2122/97
cgccgugugccacggggc

SEQ ID NO: 1197462 - RNA, 20 nt, Mycobacterium bovis subsp bovis AF2122/97
cgccgucuuggcccgguccg

SEQ ID NO: 1197463 - RNA, 23 nt, Mycobacterium bovis subsp bovis AF2122/97
cgccgugacccauucucggccgg

SEQ ID NO: 1197464 - RNA, 16 nt, Mycobacterium bovis subsp bovis AF2122/97
cgccgucggcgccggc

SEQ ID NO: 1197465 - RNA, 16 nt, Mycobacterium bovis subsp bovis AF2122/97
cgccgucggcgcgcac

SEQ ID NO: 1197466 - RNA, 21 nt, Mycobacterium bovis subsp bovis AF2122/97
cgccguccagcgccgcggccc

SEQ ID NO: 1197467 - RNA, 21 nt, Mycobacterium bovis subsp bovis AF2122/97
cgccgucguugugccggucga

SEQ ID NO: 1197468 - RNA, 17 nt, Mycobacterium bovis subsp bovis AF2122/97
cgccgucggugccgccg

SEQ ID NO: 1197469 - RNA, 21 nt, Mycobacterium bovis subsp bovis AF2122/97
cgccgucgaagcggaccagcg

SEQ ID NO: 1197470 - RNA, 22 nt, Mycobacterium bovis subsp bovis AF2122/97
cgccgucgacaacaaacccggc

SEQ ID NO: 1197471 - RNA, 17 nt, Mycobacterium bovis subsp bovis AF2122/97
cgccgucgacgcggccg

SEQ ID NO: 1197472 - RNA, 20 nt, Mycobacterium bovis subsp bovis AF2122/97
cgccgucgacgcggccggcc

SEQ ID NO: 1197473 - RNA, 18 nt, Mycobacterium bovis subsp bovis AF2122/97
cgccgucgagcacgguga

SEQ ID NO: 1197474 - RNA, 15 nt, Mycobacterium bovis subsp bovis AF2122/97
cgccgucgccaccgg

SEQ ID NO: 1197475 - RNA, 20 nt, Mycobacterium bovis subsp bovis AF2122/97
cgccguugccaccggugccg

SEQ ID NO: 1197476 - RNA, 21 nt, Mycobacterium bovis subsp bovis AF2122/97
cgccguugccgaucagcccgg

SEQ ID NO: 1197477 - RNA, 22 nt, Mycobacterium bovis subsp bovis AF2122/97
cgccguugccgaucagcccggc

SEQ ID NO: 1197478 - RNA, 23 nt, Mycobacterium bovis subsp bovis AF2122/97
cgccguugaacggcaccagcggg

SEQ ID NO: 1197479 - RNA, 15 nt, Mycobacterium bovis subsp bovis AF2122/97
cgccguugacgccgu

SEQ ID NO: 1197480 - RNA, 18 nt, Mycobacterium bovis subsp bovis AF2122/97
cgccguugaugucggcag

SEQ ID NO: 1197481 - RNA, 22 nt, Mycobacterium bovis subsp bovis AF2122/97
cgccguugaugucggcagguac

SEQ ID NO: 1197482 - RNA, 18 nt, Mycobacterium bovis subsp bovis AF2122/97
cgccguugaacggcacca

SEQ ID NO: 1197483 - RNA, 21 nt, Mycobacterium bovis subsp bovis AF2122/97
cgccguugaacggcaccagcg

SEQ ID NO: 1197484 - RNA, 16 nt, Mycobacterium bovis subsp bovis AF2122/97
cgccguucccacccac

SEQ ID NO: 1197485 - RNA, 16 nt, Mycobacterium bovis subsp bovis AF2122/97
cgccguucgcuccccc

SEQ ID NO: 1197486 - RNA, 15 nt, Mycobacterium bovis subsp bovis AF2122/97
cgccguucgggaugc

SEQ ID NO: 1197487 - RNA, 19 nt, Mycobacterium bovis subsp bovis AF2122/97
cgccguucgggaugcaagg

SEQ ID NO: 1197488 - RNA, 17 nt, Mycobacterium bovis subsp bovis AF2122/97
cgccguugucgaccucc

SEQ ID NO: 1197489 - RNA, 19 nt, Mycobacterium bovis subsp bovis AF2122/97
cgccguugggccgcgcccu

SEQ ID NO: 1197490 - RNA, 15 nt, Mycobacterium bovis subsp bovis AF2122/97
cgccguuugcgccgu

SEQ ID NO: 1197491 - RNA, 15 nt, Mycobacterium bovis subsp bovis AF2122/97
cgccguugccgccuu

SEQ ID NO: 1197492 - RNA, 15 nt, Mycobacterium bovis subsp bovis AF2122/97
cgccguugccggcca

SEQ ID NO: 1197493 - RNA, 15 nt, Mycobacterium bovis subsp bovis AF2122/97
cgccguugccggcuu

SEQ ID NO: 1197494 - RNA, 13 nt, Mycobacterium bovis subsp bovis AF2122/97
cgccguugccgcc

SEQ ID NO: 1197495 - RNA, 15 nt, Mycobacterium bovis subsp bovis AF2122/97
cgccguugccgccga

SEQ ID NO: 1197496 - RNA, 17 nt, Mycobacterium bovis subsp bovis AF2122/97
cgccguugccgccgccu

SEQ ID NO: 1197497 - RNA, 18 nt, Mycobacterium bovis subsp bovis AF2122/97
cgccguugccgccggcgc

SEQ ID NO: 1197498 - RNA, 14 nt, Mycobacterium bovis subsp bovis AF2122/97
cgccguugccgccu

SEQ ID NO: 1197499 - RNA, 23 nt, Mycobacterium bovis subsp bovis AF2122/97
cgccuaaucggccugccggcagc

SEQ ID NO: 1197500 - RNA, 20 nt, Mycobacterium bovis subsp bovis AF2122/97
cgccuaggacuucggugagc

SEQ ID NO: 1197501 - RNA, 22 nt, Mycobacterium bovis subsp bovis AF2122/97
cgccuagcgagcgcacaccggc

SEQ ID NO: 1197502 - RNA, 16 nt, Mycobacterium bovis subsp bovis AF2122/97
cgccucaccggcgcga

SEQ ID NO: 1197503 - RNA, 21 nt, Mycobacterium bovis subsp bovis AF2122/97
cgccucaaugaccaccgggcg

SEQ ID NO: 1197504 - RNA, 23 nt, Mycobacterium bovis subsp bovis AF2122/97
cgccucaaugaccaccgggcgcu

SEQ ID NO: 1197505 - RNA, 21 nt, Mycobacterium bovis subsp bovis AF2122/97
cgcgcaacguacgcacgcagc

SEQ ID NO: 1197506 - RNA, 19 nt, Mycobacterium bovis subsp bovis AF2122/97
cgcgcaacguagccagcag

SEQ ID NO: 1197507 - RNA, 18 nt, Mycobacterium bovis subsp bovis AF2122/97
cgcgcaacucgccacggu

SEQ ID NO: 1197508 - RNA, 15 nt, Mycobacterium bovis subsp bovis AF2122/97
cgcgcaaggcgccgc

SEQ ID NO: 1197509 - RNA, 17 nt, Mycobacterium bovis subsp bovis AF2122/97
cgcgcaccaacaccagc

SEQ ID NO: 1197510 - RNA, 13 nt, Mycobacterium bovis subsp bovis AF2122/97
cgcgcaccaccgc

SEQ ID NO: 1197511 - RNA, 15 nt, Mycobacterium bovis subsp bovis AF2122/97
cgcgcaccccggcau

SEQ ID NO: 1197512 - RNA, 13 nt, Mycobacterium bovis subsp bovis AF2122/97
cgcgcacccagcc

SEQ ID NO: 1197513 - RNA, 16 nt, Mycobacterium bovis subsp bovis AF2122/97
cgcgcacccagcccag

SEQ ID NO: 1197514 - RNA, 20 nt, Mycobacterium bovis subsp bovis AF2122/97
cgcgauggcgguccaccggc

SEQ ID NO: 1197515 - RNA, 17 nt, Mycobacterium bovis subsp bovis AF2122/97
cgcgaugcgcaccagcg

SEQ ID NO: 1197516 - RNA, 14 nt, Mycobacterium bovis subsp bovis AF2122/97
cgcgaugcuucccg

SEQ ID NO: 1197517 - RNA, 16 nt, Mycobacterium bovis subsp bovis AF2122/97
cgcgaugggagcccgg

SEQ ID NO: 1197518 - RNA, 15 nt, Mycobacterium bovis subsp bovis AF2122/97
cgcgauguccaggug

SEQ ID NO: 1197519 - RNA, 13 nt, Mycobacterium bovis subsp bovis AF2122/97
cgcgauucagaca

SEQ ID NO: 1197520 - RNA, 22 nt, Mycobacterium bovis subsp bovis AF2122/97
cgcgauggccccugucaugucc

SEQ ID NO: 1197521 - RNA, 21 nt, Mycobacterium bovis subsp bovis AF2122/97
cgcgauguccucgagcaccgc

SEQ ID NO: 1197522 - RNA, 18 nt, Mycobacterium bovis subsp bovis AF2122/97
cgcgcaaaugccugcugg

SEQ ID NO: 1197523 - RNA, 16 nt, Mycobacterium bovis subsp bovis AF2122/97
cgcgcaacacauccag

SEQ ID NO: 1197524 - RNA, 15 nt, Mycobacterium bovis subsp bovis AF2122/97
cgcgcaaccgcucau

SEQ ID NO: 1197525 - RNA, 16 nt, Mycobacterium bovis subsp bovis AF2122/97
cgcgcaacccggacga

SEQ ID NO: 1197526 - RNA, 14 nt, Mycobacterium bovis subsp bovis AF2122/97
cgcgcaacccugcc

SEQ ID NO: 1197527 - RNA, 23 nt, Mycobacterium bovis subsp bovis AF2122/97
cgcgauagauacccgcggcagca

SEQ ID NO: 1197528 - RNA, 16 nt, Mycobacterium bovis subsp bovis AF2122/97
cgcgaucagcgcgcac

SEQ ID NO: 1197529 - RNA, 22 nt, Mycobacterium bovis subsp bovis AF2122/97
cgcgaguaagcgaacagcggca

SEQ ID NO: 1197530 - RNA, 21 nt, Mycobacterium bovis subsp bovis AF2122/97
cgcgaggucggcggcgcaggu

SEQ ID NO: 1197531 - RNA, 19 nt, Mycobacterium bovis subsp bovis AF2122/97
cgcgagguugaccaccagc

SEQ ID NO: 1197532 - RNA, 14 nt, Mycobacterium bovis subsp bovis AF2122/97
cgcgaucgggccgg

SEQ ID NO: 1197533 - RNA, 20 nt, Mycobacterium bovis subsp bovis AF2122/97
cgcgaucgggcccagcagcg

SEQ ID NO: 1197534 - RNA, 13 nt, Mycobacterium bovis subsp bovis AF2122/97
cgcgaucgcagug

SEQ ID NO: 1197535 - RNA, 15 nt, Mycobacterium bovis subsp bovis AF2122/97
cgcgauccgcgcgca

SEQ ID NO: 1197536 - RNA, 21 nt, Mycobacterium bovis subsp bovis AF2122/97
cgcgaucaugguggggaccgc

SEQ ID NO: 1197537 - RNA, 14 nt, Mycobacterium bovis subsp bovis AF2122/97
cgcgauccacccgg

SEQ ID NO: 1197538 - RNA, 21 nt, Mycobacterium bovis subsp bovis AF2122/97
cgcgaugcccacgcacagcaa

SEQ ID NO: 1197539 - RNA, 14 nt, Mycobacterium bovis subsp bovis AF2122/97
cgcgaugcgcacca

SEQ ID NO: 1197540 - RNA, 15 nt, Mycobacterium bovis subsp bovis AF2122/97
cgcgaugcgcaccag

SEQ ID NO: 1197541 - RNA, 14 nt, Mycobacterium bovis subsp bovis AF2122/97
cgcgaucucggagc

SEQ ID NO: 1197542 - RNA, 16 nt, Mycobacterium bovis subsp bovis AF2122/97
cgcgagcaacaccagg

SEQ ID NO: 1197543 - RNA, 16 nt, Mycobacterium bovis subsp bovis AF2122/97
cgcgagaucgggccgg

SEQ ID NO: 1197544 - RNA, 15 nt, Mycobacterium bovis subsp bovis AF2122/97
cgcgagccagcugcu

SEQ ID NO: 1197545 - RNA, 15 nt, Mycobacterium bovis subsp bovis AF2122/97
cgcgagccucgcgcg

SEQ ID NO: 1197546 - RNA, 14 nt, Mycobacterium bovis subsp bovis AF2122/97
cgcgaggaugcuga

SEQ ID NO: 1197547 - RNA, 21 nt, Mycobacterium bovis subsp bovis AF2122/97
cgcgagcuuggccagcagcag

SEQ ID NO: 1197548 - RNA, 16 nt, Mycobacterium bovis subsp bovis AF2122/97
cgcgaggucggcggcg

SEQ ID NO: 1197549 - RNA, 18 nt, Mycobacterium bovis subsp bovis AF2122/97
cgcgaggucggcggcgca

SEQ ID NO: 1197550 - RNA, 21 nt, Mycobacterium bovis subsp bovis AF2122/97
cgcgagcugcgacgaugccgc

SEQ ID NO: 1197551 - RNA, 23 nt, Mycobacterium bovis subsp bovis AF2122/97
cgcgagcggaauggaggccgccg

SEQ ID NO: 1197552 - RNA, 21 nt, Mycobacterium bovis subsp bovis AF2122/97
cgcgacgcucgcugcagcagg

SEQ ID NO: 1197553 - RNA, 13 nt, Mycobacterium bovis subsp bovis AF2122/97
cgcgacgcggggc

SEQ ID NO: 1197554 - RNA, 22 nt, Mycobacterium bovis subsp bovis AF2122/97
cgcgacgucugccaggcgcagc

SEQ ID NO: 1197555 - RNA, 15 nt, Mycobacterium bovis subsp bovis AF2122/97
cgcgacguagacgac

SEQ ID NO: 1197556 - RNA, 15 nt, Mycobacterium bovis subsp bovis AF2122/97
cgcgagaacacccgu

SEQ ID NO: 1197557 - RNA, 16 nt, Mycobacterium bovis subsp bovis AF2122/97
cgcgacuagacgccgc

SEQ ID NO: 1197558 - RNA, 17 nt, Mycobacterium bovis subsp bovis AF2122/97
cgcgacuagacgccgcc

SEQ ID NO: 1197559 - RNA, 13 nt, Mycobacterium bovis subsp bovis AF2122/97
cgcgacgagccgc

SEQ ID NO: 1197560 - RNA, 14 nt, Mycobacterium bovis subsp bovis AF2122/97
cgcgacgacgaggu

SEQ ID NO: 1197561 - RNA, 16 nt, Mycobacterium bovis subsp bovis AF2122/97
cgcgaccgucaggguc

SEQ ID NO: 1197562 - RNA, 20 nt, Mycobacterium bovis subsp bovis AF2122/97
cgcgaccgucagggucaccu

SEQ ID NO: 1197563 - RNA, 22 nt, Mycobacterium bovis subsp bovis AF2122/97
cgcgaccggcguaaccggcagc

SEQ ID NO: 1197564 - RNA, 13 nt, Mycobacterium bovis subsp bovis AF2122/97
cgcgaccucggag

SEQ ID NO: 1197565 - RNA, 20 nt, Mycobacterium bovis subsp bovis AF2122/97
cgcgaccgcauugagcuggc

SEQ ID NO: 1197566 - RNA, 18 nt, Mycobacterium bovis subsp bovis AF2122/97
cgcgacccgaucgcgcca

SEQ ID NO: 1197567 - RNA, 14 nt, Mycobacterium bovis subsp bovis AF2122/97
cgcgacccgcgcaa

SEQ ID NO: 1197568 - RNA, 14 nt, Mycobacterium bovis subsp bovis AF2122/97
cgcgacccggccca

SEQ ID NO: 1197569 - RNA, 14 nt, Mycobacterium bovis subsp bovis AF2122/97
cgcgaccgaccagc

SEQ ID NO: 1197570 - RNA, 21 nt, Mycobacterium bovis subsp bovis AF2122/97
cgcgaccgcgauccccacgau

SEQ ID NO: 1197571 - RNA, 16 nt, Mycobacterium bovis subsp bovis AF2122/97
cgcgaccagccagcga

SEQ ID NO: 1197572 - RNA, 12 nt, Mycobacterium bovis subsp bovis AF2122/97
cgcgaccaccgc

SEQ ID NO: 1197573 - RNA, 19 nt, Mycobacterium bovis subsp bovis AF2122/97
cgcgaccacgcaccgcccc

SEQ ID NO: 1197574 - RNA, 15 nt, Mycobacterium bovis subsp bovis AF2122/97
cgcgacaccccggaa

SEQ ID NO: 1197575 - RNA, 13 nt, Mycobacterium bovis subsp bovis AF2122/97
cgcgacacgcggc

SEQ ID NO: 1197576 - RNA, 17 nt, Mycobacterium bovis subsp bovis AF2122/97
cgcgacacgcggcccga

SEQ ID NO: 1197577 - RNA, 22 nt, Mycobacterium bovis subsp bovis AF2122/97
cgcgcaguuuggcggcgcgcag

SEQ ID NO: 1197578 - RNA, 21 nt, Mycobacterium bovis subsp bovis AF2122/97
cgcgcagguagcgccgcacuu

SEQ ID NO: 1197579 - RNA, 19 nt, Mycobacterium bovis subsp bovis AF2122/97
cgcgcaucaucgcccaccg

SEQ ID NO: 1197580 - RNA, 20 nt, Mycobacterium bovis subsp bovis AF2122/97
cgcgcaucaucgcccaccgc

SEQ ID NO: 1197581 - RNA, 14 nt, Mycobacterium bovis subsp bovis AF2122/97
cgcgcauucgccgg

SEQ ID NO: 1197582 - RNA, 18 nt, Mycobacterium bovis subsp bovis AF2122/97
cgcgcauucgccgggcgg

SEQ ID NO: 1197583 - RNA, 16 nt, Mycobacterium bovis subsp bovis AF2122/97
cgcgccacgcacccgg

SEQ ID NO: 1197584 - RNA, 20 nt, Mycobacterium bovis subsp bovis AF2122/97
cgcgccaccggcaccgccug

SEQ ID NO: 1197585 - RNA, 23 nt, Mycobacterium bovis subsp bovis AF2122/97
cgcgccaccgagcccuccagggc

SEQ ID NO: 1197586 - RNA, 20 nt, Mycobacterium bovis subsp bovis AF2122/97
cgcgcauuuuucgccagcug

SEQ ID NO: 1197587 - RNA, 19 nt, Mycobacterium bovis subsp bovis AF2122/97
cgcgccaaacaccccggcc

SEQ ID NO: 1197588 - RNA, 14 nt, Mycobacterium bovis subsp bovis AF2122/97
cgcgccaccagcac

SEQ ID NO: 1197589 - RNA, 15 nt, Mycobacterium bovis subsp bovis AF2122/97
cgcgccaccagcacc

SEQ ID NO: 1197590 - RNA, 22 nt, Mycobacterium bovis subsp bovis AF2122/97
cgcgcagcaucuccgccggucc

SEQ ID NO: 1197591 - RNA, 17 nt, Mycobacterium bovis subsp bovis AF2122/97
cgcgcagccgccgcgcc

SEQ ID NO: 1197592 - RNA, 15 nt, Mycobacterium bovis subsp bovis AF2122/97
cgcgcagccgcucga

SEQ ID NO: 1197593 - RNA, 17 nt, Mycobacterium bovis subsp bovis AF2122/97
cgcgcagccgggcaccg

SEQ ID NO: 1197594 - RNA, 17 nt, Mycobacterium bovis subsp bovis AF2122/97
cgcgcagcgucaaaccu

SEQ ID NO: 1197595 - RNA, 15 nt, Mycobacterium bovis subsp bovis AF2122/97
cgcgcagcgccgcca

SEQ ID NO: 1197596 - RNA, 18 nt, Mycobacterium bovis subsp bovis AF2122/97
cgcgcagcauggugcggc

SEQ ID NO: 1197597 - RNA, 17 nt, Mycobacterium bovis subsp bovis AF2122/97
cgcgcaggccgccgcca

SEQ ID NO: 1197598 - RNA, 15 nt, Mycobacterium bovis subsp bovis AF2122/97
cgcgcagcuccaccg

SEQ ID NO: 1197599 - RNA, 23 nt, Mycobacterium bovis subsp bovis AF2122/97
cgcgcagaaagucgcgcgcgaac

SEQ ID NO: 1197600 - RNA, 19 nt, Mycobacterium bovis subsp bovis AF2122/97
cgcgcagaucguccaccgc

SEQ ID NO: 1197601 - RNA, 16 nt, Mycobacterium bovis subsp bovis AF2122/97
cgcgcagauggcauug

SEQ ID NO: 1197602 - RNA, 16 nt, Mycobacterium bovis subsp bovis AF2122/97
cgcgcacgccaccggg

SEQ ID NO: 1197603 - RNA, 18 nt, Mycobacterium bovis subsp bovis AF2122/97
cgcgcaccugaucgguca

SEQ ID NO: 1197604 - RNA, 19 nt, Mycobacterium bovis subsp bovis AF2122/97
cgcgccgaccucaucggca

SEQ ID NO: 1197605 - RNA, 19 nt, Mycobacterium bovis subsp bovis AF2122/97
cgcgccgaccaccgcugcg

SEQ ID NO: 1197606 - RNA, 16 nt, Mycobacterium bovis subsp bovis AF2122/97
cgcgcccuucagcacg

SEQ ID NO: 1197607 - RNA, 18 nt, Mycobacterium bovis subsp bovis AF2122/97
cgcgccgaaggccgccac

SEQ ID NO: 1197608 - RNA, 19 nt, Mycobacterium bovis subsp bovis AF2122/97
cgcgcccggaucucggcgu

SEQ ID NO: 1197609 - RNA, 17 nt, Mycobacterium bovis subsp bovis AF2122/97
cgcgccgagccagcacc

SEQ ID NO: 1197610 - RNA, 23 nt, Mycobacterium bovis subsp bovis AF2122/97
cgcgccgagccagcacccgcagc

SEQ ID NO: 1197611 - RNA, 17 nt, Mycobacterium bovis subsp bovis AF2122/97
cgcgccgaaucgcgggc

SEQ ID NO: 1197612 - RNA, 17 nt, Mycobacterium bovis subsp bovis AF2122/97
cgcgccgagcccgggcc

SEQ ID NO: 1197613 - RNA, 18 nt, Mycobacterium bovis subsp bovis AF2122/97
cgcgccgagcccgggccu

SEQ ID NO: 1197614 - RNA, 18 nt, Mycobacterium bovis subsp bovis AF2122/97
cgcgccgaguugcccggg

SEQ ID NO: 1197615 - RNA, 23 nt, Mycobacterium bovis subsp bovis AF2122/97
cgcgccgaguugcccgggucggc

SEQ ID NO: 1197616 - RNA, 17 nt, Mycobacterium bovis subsp bovis AF2122/97
cgcgccgauuccaccgc

SEQ ID NO: 1197617 - RNA, 13 nt, Mycobacterium bovis subsp bovis AF2122/97
cgcgccgccgcua

SEQ ID NO: 1197618 - RNA, 14 nt, Mycobacterium bovis subsp bovis AF2122/97
cgcgccgccggcuc

SEQ ID NO: 1197619 - RNA, 13 nt, Mycobacterium bovis subsp bovis AF2122/97
cgcgccgcgccgc

SEQ ID NO: 1197620 - RNA, 13 nt, Mycobacterium bovis subsp bovis AF2122/97
cgcgccgcggccc

SEQ ID NO: 1197621 - RNA, 12 nt, Mycobacterium bovis subsp bovis AF2122/97
cgcgccgcccgc

SEQ ID NO: 1197622 - RNA, 19 nt, Mycobacterium bovis subsp bovis AF2122/97
cgcgccccagacgcgcagg

SEQ ID NO: 1197623 - RNA, 19 nt, Mycobacterium bovis subsp bovis AF2122/97
cgcgcccagaccgacccgc

SEQ ID NO: 1197624 - RNA, 19 nt, Mycobacterium bovis subsp bovis AF2122/97
cgcgcccgggcauccuuca

SEQ ID NO: 1197625 - RNA, 12 nt, Mycobacterium bovis subsp bovis AF2122/97
cgcgcccgccgc

SEQ ID NO: 1197626 - RNA, 19 nt, Mycobacterium bovis subsp bovis AF2122/97
cgcgccaggcuugcggcac

SEQ ID NO: 1197627 - RNA, 22 nt, Mycobacterium bovis subsp bovis AF2122/97
cgcgccaggcgcgaucgcgccc

SEQ ID NO: 1197628 - RNA, 15 nt, Mycobacterium bovis subsp bovis AF2122/97
cgcgccaggccacgu

SEQ ID NO: 1197629 - RNA, 13 nt, Mycobacterium bovis subsp bovis AF2122/97
cgcgccagcuccg

SEQ ID NO: 1197630 - RNA, 20 nt, Mycobacterium bovis subsp bovis AF2122/97
cgcgcccaccagcggcggca

SEQ ID NO: 1197631 - RNA, 23 nt, Mycobacterium bovis subsp bovis AF2122/97
cgcgcccaccagcggcggcaacg

SEQ ID NO: 1197632 - RNA, 16 nt, Mycobacterium bovis subsp bovis AF2122/97
cgcgcccaccccggcc

SEQ ID NO: 1197633 - RNA, 21 nt, Mycobacterium bovis subsp bovis AF2122/97
cgcgccaucgccuccagccgg

SEQ ID NO: 1197634 - RNA, 18 nt, Mycobacterium bovis subsp bovis AF2122/97
cgguugggguggcggugc

SEQ ID NO: 1197635 - RNA, 15 nt, Mycobacterium bovis subsp bovis AF2122/97
cgguuggguagcacc

SEQ ID NO: 1197636 - RNA, 15 nt, Mycobacterium bovis subsp bovis AF2122/97
cgguugguccgccgu

SEQ ID NO: 1197637 - RNA, 14 nt, Mycobacterium bovis subsp bovis AF2122/97
cgguuguccuccga

SEQ ID NO: 1197638 - RNA, 17 nt, Mycobacterium bovis subsp bovis AF2122/97
cgguugucgcagcgcac

SEQ ID NO: 1197639 - RNA, 13 nt, Mycobacterium bovis subsp bovis AF2122/97
cgguuggcagugg

SEQ ID NO: 1197640 - RNA, 15 nt, Mycobacterium bovis subsp bovis AF2122/97
cgguuggccagccac

SEQ ID NO: 1197641 - RNA, 16 nt, Mycobacterium bovis subsp bovis AF2122/97
cgguuggccagccaca

SEQ ID NO: 1197642 - RNA, 15 nt, Mycobacterium bovis subsp bovis AF2122/97
cgguugcccccaggg

SEQ ID NO: 1197643 - RNA, 14 nt, Mycobacterium bovis subsp bovis AF2122/97
cgguugccccgacc

SEQ ID NO: 1197644 - RNA, 13 nt, Mycobacterium bovis subsp bovis AF2122/97
cgguugccccggc

SEQ ID NO: 1197645 - RNA, 17 nt, Mycobacterium bovis subsp bovis AF2122/97
cgguugccgucugcggu

SEQ ID NO: 1197646 - RNA, 20 nt, Mycobacterium bovis subsp bovis AF2122/97
cgguuuccuccggcagcagc

SEQ ID NO: 1197647 - RNA, 18 nt, Mycobacterium bovis subsp bovis AF2122/97
cgguuguggaaccacggc

SEQ ID NO: 1197648 - RNA, 13 nt, Mycobacterium bovis subsp bovis AF2122/97
cgguuguggcuga

SEQ ID NO: 1197649 - RNA, 23 nt, Mycobacterium bovis subsp bovis AF2122/97
cguaacgccaagcucggcccagc

SEQ ID NO: 1197650 - RNA, 14 nt, Mycobacterium bovis subsp bovis AF2122/97
cguaaccggcagcg

SEQ ID NO: 1197651 - RNA, 12 nt, Mycobacterium bovis subsp bovis AF2122/97
cguaaacgucgg

SEQ ID NO: 1197652 - RNA, 23 nt, Mycobacterium bovis subsp bovis AF2122/97
cguaaaccgauaucgcugcggaa

SEQ ID NO: 1197653 - RNA, 19 nt, Mycobacterium bovis subsp bovis AF2122/97
cguaaaccguggccgcgau

SEQ ID NO: 1197654 - RNA, 16 nt, Mycobacterium bovis subsp bovis AF2122/97
cgguuugcguccuggu

SEQ ID NO: 1197655 - RNA, 13 nt, Mycobacterium bovis subsp bovis AF2122/97
cgguuugcccggu

SEQ ID NO: 1197656 - RNA, 12 nt, Mycobacterium bovis subsp bovis AF2122/97
cgguuugccggu

SEQ ID NO: 1197657 - RNA, 13 nt, Mycobacterium bovis subsp bovis AF2122/97
cguaaacagcgcg

SEQ ID NO: 1197658 - RNA, 17 nt, Mycobacterium bovis subsp bovis AF2122/97
cggugggugccagccgg

SEQ ID NO: 1197659 - RNA, 19 nt, Mycobacterium bovis subsp bovis AF2122/97
cggugguaacaccggcgag

SEQ ID NO: 1197660 - RNA, 19 nt, Mycobacterium bovis subsp bovis AF2122/97
cggugguacgugcgagccc

SEQ ID NO: 1197661 - RNA, 15 nt, Mycobacterium bovis subsp bovis AF2122/97
cggugguagcggcgg

SEQ ID NO: 1197662 - RNA, 19 nt, Mycobacterium bovis subsp bovis AF2122/97
cggugguaggacgccagca

SEQ ID NO: 1197663 - RNA, 16 nt, Mycobacterium bovis subsp bovis AF2122/97
cggugguagcgacgau

SEQ ID NO: 1197664 - RNA, 21 nt, Mycobacterium bovis subsp bovis AF2122/97
cgguggggauggcgcccagau

SEQ ID NO: 1197665 - RNA, 22 nt, Mycobacterium bovis subsp bovis AF2122/97
cggugggcuuggcgccgaugcc

SEQ ID NO: 1197666 - RNA, 15 nt, Mycobacterium bovis subsp bovis AF2122/97
cgguggguagccagc

SEQ ID NO: 1197667 - RNA, 15 nt, Mycobacterium bovis subsp bovis AF2122/97
cggugggcgguccgc

SEQ ID NO: 1197668 - RNA, 22 nt, Mycobacterium bovis subsp bovis AF2122/97
cgguggcuucaacccgggcagc

SEQ ID NO: 1197669 - RNA, 21 nt, Mycobacterium bovis subsp bovis AF2122/97
cgguguccuuggccgccacuc

SEQ ID NO: 1197670 - RNA, 22 nt, Mycobacterium bovis subsp bovis AF2122/97
cggugucgacguucaucuucac

SEQ ID NO: 1197671 - RNA, 15 nt, Mycobacterium bovis subsp bovis AF2122/97
cggugucgcgaugcu

SEQ ID NO: 1197672 - RNA, 15 nt, Mycobacterium bovis subsp bovis AF2122/97
cgguguccagccacg

SEQ ID NO: 1197673 - RNA, 16 nt, Mycobacterium bovis subsp bovis AF2122/97
cggugucccgcgaggc

SEQ ID NO: 1197674 - RNA, 13 nt, Mycobacterium bovis subsp bovis AF2122/97
cggugguccuggc

SEQ ID NO: 1197675 - RNA, 16 nt, Mycobacterium bovis subsp bovis AF2122/97
cgguggucggcgcgcc

SEQ ID NO: 1197676 - RNA, 18 nt, Mycobacterium bovis subsp bovis AF2122/97
cgguggucugcgcggugc

SEQ ID NO: 1197677 - RNA, 21 nt, Mycobacterium bovis subsp bovis AF2122/97
cgguggucucgacggcgccgc

SEQ ID NO: 1197678 - RNA, 23 nt, Mycobacterium bovis subsp bovis AF2122/97
cggugucaguccgacaccacgga

SEQ ID NO: 1197679 - RNA, 14 nt, Mycobacterium bovis subsp bovis AF2122/97
cggugucggccagc

SEQ ID NO: 1197680 - RNA, 15 nt, Mycobacterium bovis subsp bovis AF2122/97
cggugucggccagca

SEQ ID NO: 1197681 - RNA, 21 nt, Mycobacterium bovis subsp bovis AF2122/97
cgguggucuuggcccggcggu

SEQ ID NO: 1197682 - RNA, 17 nt, Mycobacterium bovis subsp bovis AF2122/97
cggugucgggcugucag

SEQ ID NO: 1197683 - RNA, 21 nt, Mycobacterium bovis subsp bovis AF2122/97
cggugugcaucgacucacgga

SEQ ID NO: 1197684 - RNA, 18 nt, Mycobacterium bovis subsp bovis AF2122/97
cggugugccagugcugca

SEQ ID NO: 1197685 - RNA, 14 nt, Mycobacterium bovis subsp bovis AF2122/97
cgguuagaucaccc

SEQ ID NO: 1197686 - RNA, 17 nt, Mycobacterium bovis subsp bovis AF2122/97
cggugcagaucggcuca

SEQ ID NO: 1197687 - RNA, 14 nt, Mycobacterium bovis subsp bovis AF2122/97
cggugcaguggcua

SEQ ID NO: 1197688 - RNA, 14 nt, Mycobacterium bovis subsp bovis AF2122/97
cggugcagcccgcc

SEQ ID NO: 1197689 - RNA, 12 nt, Mycobacterium bovis subsp bovis AF2122/97
cggugcagcacg

SEQ ID NO: 1197690 - RNA, 22 nt, Mycobacterium bovis subsp bovis AF2122/97
cggugcagcacgugugcgggca

SEQ ID NO: 1197691 - RNA, 18 nt, Mycobacterium bovis subsp bovis AF2122/97
cggugcagcagggcgcgc

SEQ ID NO: 1197692 - RNA, 21 nt, Mycobacterium bovis subsp bovis AF2122/97
cggugcagcagggcgcgcauc

SEQ ID NO: 1197693 - RNA, 19 nt, Mycobacterium bovis subsp bovis AF2122/97
cggugccacguucgcgggc

SEQ ID NO: 1197694 - RNA, 12 nt, Mycobacterium bovis subsp bovis AF2122/97
cggugccaccga

SEQ ID NO: 1197695 - RNA, 12 nt, Mycobacterium bovis subsp bovis AF2122/97
cggugccaccgg

SEQ ID NO: 1197696 - RNA, 18 nt, Mycobacterium bovis subsp bovis AF2122/97
cggugccgaagcugccca

SEQ ID NO: 1197697 - RNA, 14 nt, Mycobacterium bovis subsp bovis AF2122/97
cggugccagcacca

SEQ ID NO: 1197698 - RNA, 22 nt, Mycobacterium bovis subsp bovis AF2122/97
cggugcccaacccacucgcagc

SEQ ID NO: 1197699 - RNA, 12 nt, Mycobacterium bovis subsp bovis AF2122/97
cggugcccacca

SEQ ID NO: 1197700 - RNA, 17 nt, Mycobacterium bovis subsp bovis AF2122/97
cggugcccagcagcgcg

SEQ ID NO: 1197701 - RNA, 16 nt, Mycobacterium bovis subsp bovis AF2122/97
cgguggagggcgagca

SEQ ID NO: 1197702 - RNA, 18 nt, Mycobacterium bovis subsp bovis AF2122/97
cgguggagcgcgggaugu

SEQ ID NO: 1197703 - RNA, 14 nt, Mycobacterium bovis subsp bovis AF2122/97
cggugcccgcacca

SEQ ID NO: 1197704 - RNA, 17 nt, Mycobacterium bovis subsp bovis AF2122/97
cggugccgacggugggc

SEQ ID NO: 1197705 - RNA, 15 nt, Mycobacterium bovis subsp bovis AF2122/97
cgguggagcgcgccu

SEQ ID NO: 1197706 - RNA, 18 nt, Mycobacterium bovis subsp bovis AF2122/97
cgguggccacccggccgc

SEQ ID NO: 1197707 - RNA, 20 nt, Mycobacterium bovis subsp bovis AF2122/97
cgguggcaccggcggcgacg

SEQ ID NO: 1197708 - RNA, 15 nt, Mycobacterium bovis subsp bovis AF2122/97
cgguggcacggcccc

SEQ ID NO: 1197709 - RNA, 13 nt, Mycobacterium bovis subsp bovis AF2122/97
cgguggcagcaca

SEQ ID NO: 1197710 - RNA, 20 nt, Mycobacterium bovis subsp bovis AF2122/97
cgguggccgaacaggaugau

SEQ ID NO: 1197711 - RNA, 21 nt, Mycobacterium bovis subsp bovis AF2122/97
cgguggccgcaucgacgcuca

SEQ ID NO: 1197712 - RNA, 20 nt, Mycobacterium bovis subsp bovis AF2122/97
cgguggcccgccggcaguga

SEQ ID NO: 1197713 - RNA, 20 nt, Mycobacterium bovis subsp bovis AF2122/97
cgguggccaacaccgccagc

SEQ ID NO: 1197714 - RNA, 22 nt, Mycobacterium bovis subsp bovis AF2122/97
cggucauccgggcgaccaccac

SEQ ID NO: 1197715 - RNA, 18 nt, Mycobacterium bovis subsp bovis AF2122/97
cggucaugucggccaccg

SEQ ID NO: 1197716 - RNA, 19 nt, Mycobacterium bovis subsp bovis AF2122/97
cggucaugucggccaccgg

SEQ ID NO: 1197717 - RNA, 16 nt, Mycobacterium bovis subsp bovis AF2122/97
cgguccacccaagcuc

SEQ ID NO: 1197718 - RNA, 20 nt, Mycobacterium bovis subsp bovis AF2122/97
cgguccaaaacaccgccagc

SEQ ID NO: 1197719 - RNA, 22 nt, Mycobacterium bovis subsp bovis AF2122/97
cgguccaaaacaccgccagcuc

SEQ ID NO: 1197720 - RNA, 13 nt, Mycobacterium bovis subsp bovis AF2122/97
cgguccaucccga

SEQ ID NO: 1197721 - RNA, 15 nt, Mycobacterium bovis subsp bovis AF2122/97
cgguccagggccugu

SEQ ID NO: 1197722 - RNA, 20 nt, Mycobacterium bovis subsp bovis AF2122/97
cgguccaucccgagcuccgc

SEQ ID NO: 1197723 - RNA, 16 nt, Mycobacterium bovis subsp bovis AF2122/97
cggucccacggccggc

SEQ ID NO: 1197724 - RNA, 19 nt, Mycobacterium bovis subsp bovis AF2122/97
cggucccacugccggugcu

SEQ ID NO: 1197725 - RNA, 17 nt, Mycobacterium bovis subsp bovis AF2122/97
cgguccauggacggcca

SEQ ID NO: 1197726 - RNA, 20 nt, Mycobacterium bovis subsp bovis AF2122/97
cgguccagccgguccagacc

SEQ ID NO: 1197727 - RNA, 18 nt, Mycobacterium bovis subsp bovis AF2122/97
cgguccagcggccgccgc

SEQ ID NO: 1197728 - RNA, 17 nt, Mycobacterium bovis subsp bovis AF2122/97
cgguccagacaucagug

SEQ ID NO: 1197729 - RNA, 15 nt, Mycobacterium bovis subsp bovis AF2122/97
cgguccagccaccgc

SEQ ID NO: 1197730 - RNA, 13 nt, Mycobacterium bovis subsp bovis AF2122/97
cgguccagcagcu

SEQ ID NO: 1197731 - RNA, 23 nt, Mycobacterium bovis subsp bovis AF2122/97
cgguccagcagcucggccgaggc

SEQ ID NO: 1197732 - RNA, 21 nt, Mycobacterium bovis subsp bovis AF2122/97
cgguccagccaacgggaacaa

SEQ ID NO: 1197733 - RNA, 16 nt, Mycobacterium bovis subsp bovis AF2122/97
cgguccgccgcagacc

SEQ ID NO: 1197734 - RNA, 23 nt, Mycobacterium bovis subsp bovis AF2122/97
cgguccggcgaaaagacugcgcc

SEQ ID NO: 1197735 - RNA, 18 nt, Mycobacterium bovis subsp bovis AF2122/97
cgguccugcucgcacagc

SEQ ID NO: 1197736 - RNA, 17 nt, Mycobacterium bovis subsp bovis AF2122/97
cggucccguugccgccc

SEQ ID NO: 1197737 - RNA, 16 nt, Mycobacterium bovis subsp bovis AF2122/97
cggucccgcauauccg

SEQ ID NO: 1197738 - RNA, 14 nt, Mycobacterium bovis subsp bovis AF2122/97
cggucccccgccca

SEQ ID NO: 1197739 - RNA, 19 nt, Mycobacterium bovis subsp bovis AF2122/97
cggucccccgcccacauac

SEQ ID NO: 1197740 - RNA, 20 nt, Mycobacterium bovis subsp bovis AF2122/97
cgguccccgcagcucgacca

SEQ ID NO: 1197741 - RNA, 13 nt, Mycobacterium bovis subsp bovis AF2122/97
cgguccgccgccu

SEQ ID NO: 1197742 - RNA, 17 nt, Mycobacterium bovis subsp bovis AF2122/97
cgguccgccacggcggg

SEQ ID NO: 1197743 - RNA, 18 nt, Mycobacterium bovis subsp bovis AF2122/97
cgguccgccacggcgggc

SEQ ID NO: 1197744 - RNA, 21 nt, Mycobacterium bovis subsp bovis AF2122/97
cggucccuuuguggggccggg

SEQ ID NO: 1197745 - RNA, 16 nt, Mycobacterium bovis subsp bovis AF2122/97
cggguccgccgggccc

SEQ ID NO: 1197746 - RNA, 20 nt, Mycobacterium bovis subsp bovis AF2122/97
cggguccgccgggccccggg

SEQ ID NO: 1197747 - RNA, 13 nt, Mycobacterium bovis subsp bovis AF2122/97
cgggucgccgcca

SEQ ID NO: 1197748 - RNA, 23 nt, Mycobacterium bovis subsp bovis AF2122/97
cgggucgcggcuauggcgccgcg

SEQ ID NO: 1197749 - RNA, 14 nt, Mycobacterium bovis subsp bovis AF2122/97
cgggucgcgggugc

SEQ ID NO: 1197750 - RNA, 14 nt, Mycobacterium bovis subsp bovis AF2122/97
cgggucgccgccau

SEQ ID NO: 1197751 - RNA, 12 nt, Mycobacterium bovis subsp bovis AF2122/97
cgggucggcaga

SEQ ID NO: 1197752 - RNA, 17 nt, Mycobacterium bovis subsp bovis AF2122/97
cggucaagccggcgccc

SEQ ID NO: 1197753 - RNA, 18 nt, Mycobacterium bovis subsp bovis AF2122/97
cggucaaucccggccagg

SEQ ID NO: 1197754 - RNA, 22 nt, Mycobacterium bovis subsp bovis AF2122/97
cggucaauucggugcgcuggcg

SEQ ID NO: 1197755 - RNA, 21 nt, Mycobacterium bovis subsp bovis AF2122/97
cggucaccgacaauucaacac

SEQ ID NO: 1197756 - RNA, 17 nt, Mycobacterium bovis subsp bovis AF2122/97
cggucaccgacgcagaa

SEQ ID NO: 1197757 - RNA, 14 nt, Mycobacterium bovis subsp bovis AF2122/97
cggucaccccggcu

SEQ ID NO: 1197758 - RNA, 23 nt, Mycobacterium bovis subsp bovis AF2122/97
cggucaccauggcgccgcgccga

SEQ ID NO: 1197759 - RNA, 14 nt, Mycobacterium bovis subsp bovis AF2122/97
cggucaccgcgcag

SEQ ID NO: 1197760 - RNA, 20 nt, Mycobacterium bovis subsp bovis AF2122/97
cggucaggauggggaccacu

SEQ ID NO: 1197761 - RNA, 14 nt, Mycobacterium bovis subsp bovis AF2122/97
cggucacgguggug

SEQ ID NO: 1197762 - RNA, 21 nt, Mycobacterium bovis subsp bovis AF2122/97
cggucaggcucauccgccggg

SEQ ID NO: 1197763 - RNA, 18 nt, Mycobacterium bovis subsp bovis AF2122/97
cggucaggucugacagac

SEQ ID NO: 1197764 - RNA, 18 nt, Mycobacterium bovis subsp bovis AF2122/97
cggucguuggugcagacc

SEQ ID NO: 1197765 - RNA, 16 nt, Mycobacterium bovis subsp bovis AF2122/97
cggucuacgccaccga

SEQ ID NO: 1197766 - RNA, 20 nt, Mycobacterium bovis subsp bovis AF2122/97
cggucgguacccgcacccgu

SEQ ID NO: 1197767 - RNA, 23 nt, Mycobacterium bovis subsp bovis AF2122/97
cggucggucaccauggcgccgcg

SEQ ID NO: 1197768 - RNA, 16 nt, Mycobacterium bovis subsp bovis AF2122/97
cggucggugaacccgc

SEQ ID NO: 1197769 - RNA, 14 nt, Mycobacterium bovis subsp bovis AF2122/97
cggucggugagccg

SEQ ID NO: 1197770 - RNA, 20 nt, Mycobacterium bovis subsp bovis AF2122/97
cggucgguguggacugggcc

SEQ ID NO: 1197771 - RNA, 15 nt, Mycobacterium bovis subsp bovis AF2122/97
cggucucgcaccagu

SEQ ID NO: 1197772 - RNA, 19 nt, Mycobacterium bovis subsp bovis AF2122/97
cggugaccaccccggccaa

SEQ ID NO: 1197773 - RNA, 18 nt, Mycobacterium bovis subsp bovis AF2122/97
cggugaccacuugcagca

SEQ ID NO: 1197774 - RNA, 17 nt, Mycobacterium bovis subsp bovis AF2122/97
cggucucauagugcagg

SEQ ID NO: 1197775 - RNA, 18 nt, Mycobacterium bovis subsp bovis AF2122/97
cggucuccgcccgcgggc

SEQ ID NO: 1197776 - RNA, 21 nt, Mycobacterium bovis subsp bovis AF2122/97
cggucuccgcccgcgggcccc

SEQ ID NO: 1197777 - RNA, 15 nt, Mycobacterium bovis subsp bovis AF2122/97
cggucuccgcugaug

SEQ ID NO: 1197778 - RNA, 22 nt, Mycobacterium bovis subsp bovis AF2122/97
cggugaccgugaacggcucggg

SEQ ID NO: 1197779 - RNA, 20 nt, Mycobacterium bovis subsp bovis AF2122/97
cggugaugaacgacauccgg

SEQ ID NO: 1197780 - RNA, 23 nt, Mycobacterium bovis subsp bovis AF2122/97
cggugaugaacgacauccggccg

SEQ ID NO: 1197781 - RNA, 14 nt, Mycobacterium bovis subsp bovis AF2122/97
cggugaugaagcgc

SEQ ID NO: 1197782 - RNA, 16 nt, Mycobacterium bovis subsp bovis AF2122/97
cggugauggccgacca

SEQ ID NO: 1197783 - RNA, 21 nt, Mycobacterium bovis subsp bovis AF2122/97
cggugauggccgaccagccga

SEQ ID NO: 1197784 - RNA, 14 nt, Mycobacterium bovis subsp bovis AF2122/97
cggugacgaagagc

SEQ ID NO: 1197785 - RNA, 14 nt, Mycobacterium bovis subsp bovis AF2122/97
cggugacgccagcc

SEQ ID NO: 1197786 - RNA, 17 nt, Mycobacterium bovis subsp bovis AF2122/97
cggugacgccagccugg

SEQ ID NO: 1197787 - RNA, 23 nt, Mycobacterium bovis subsp bovis AF2122/97
cggugacgccagccuggccaucg

SEQ ID NO: 1197788 - RNA, 20 nt, Mycobacterium bovis subsp bovis AF2122/97
cggugacgaagagcaccgcg

SEQ ID NO: 1197789 - RNA, 14 nt, Mycobacterium bovis subsp bovis AF2122/97
cggugacccccgag

SEQ ID NO: 1197790 - RNA, 17 nt, Mycobacterium bovis subsp bovis AF2122/97
cggugacggcggcaacg

SEQ ID NO: 1197791 - RNA, 17 nt, Mycobacterium bovis subsp bovis AF2122/97
cggugacuucacucguu

SEQ ID NO: 1197792 - RNA, 18 nt, Mycobacterium bovis subsp bovis AF2122/97
cggucggcggccgccagg

SEQ ID NO: 1197793 - RNA, 14 nt, Mycobacterium bovis subsp bovis AF2122/97
cggucgggcccggc

SEQ ID NO: 1197794 - RNA, 18 nt, Mycobacterium bovis subsp bovis AF2122/97
cggucgggggcagcgccu

SEQ ID NO: 1197795 - RNA, 18 nt, Mycobacterium bovis subsp bovis AF2122/97
cggucggccauccaccgc

SEQ ID NO: 1197796 - RNA, 20 nt, Mycobacterium bovis subsp bovis AF2122/97
cggucggccauccaccgcag

SEQ ID NO: 1197797 - RNA, 22 nt, Mycobacterium bovis subsp bovis AF2122/97
cggucggcgaccaccagcgccg

SEQ ID NO: 1197798 - RNA, 22 nt, Mycobacterium bovis subsp bovis AF2122/97
cggucgcguaccgguggaaacc

SEQ ID NO: 1197799 - RNA, 24 nt, Mycobacterium bovis subsp bovis AF2122/97
cggucgccucaccggcgcgagcag

SEQ ID NO: 1197800 - RNA, 13 nt, Mycobacterium bovis subsp bovis AF2122/97
cggucggccacca

SEQ ID NO: 1197801 - RNA, 15 nt, Mycobacterium bovis subsp bovis AF2122/97
cggucggccaccaac

SEQ ID NO: 1197802 - RNA, 13 nt, Mycobacterium bovis subsp bovis AF2122/97
cggucggccaggc

SEQ ID NO: 1197803 - RNA, 15 nt, Mycobacterium bovis subsp bovis AF2122/97
cggucgcggcugaca

SEQ ID NO: 1197804 - RNA, 15 nt, Mycobacterium bovis subsp bovis AF2122/97
cggucggacggccau

SEQ ID NO: 1197805 - RNA, 14 nt, Mycobacterium bovis subsp bovis AF2122/97
cggucgaugaccuc

SEQ ID NO: 1197806 - RNA, 23 nt, Mycobacterium bovis subsp bovis AF2122/97
cggucgaagcuggcacgcagagc

SEQ ID NO: 1197807 - RNA, 14 nt, Mycobacterium bovis subsp bovis AF2122/97
cggucgagcucgua

SEQ ID NO: 1197808 - RNA, 21 nt, Mycobacterium bovis subsp bovis AF2122/97
cggucgagcuucaucccggag

SEQ ID NO: 1197809 - RNA, 15 nt, Mycobacterium bovis subsp bovis AF2122/97
cggucgaccugagcc

SEQ ID NO: 1197810 - RNA, 16 nt, Mycobacterium bovis subsp bovis AF2122/97
cggucgaagagguggg

SEQ ID NO: 1197811 - RNA, 20 nt, Mycobacterium bovis subsp bovis AF2122/97
cggucgacggguucacccug

SEQ ID NO: 1197812 - RNA, 15 nt, Mycobacterium bovis subsp bovis AF2122/97
cggucgacuccagca

SEQ ID NO: 1197813 - RNA, 13 nt, Mycobacterium bovis subsp bovis AF2122/97
cggucgccaccgc

SEQ ID NO: 1197814 - RNA, 21 nt, Mycobacterium bovis subsp bovis AF2122/97
cggucgccaccgccggcagca

SEQ ID NO: 1197815 - RNA, 19 nt, Mycobacterium bovis subsp bovis AF2122/97
cggucgcagcagaccacaa

SEQ ID NO: 1197816 - RNA, 14 nt, Mycobacterium bovis subsp bovis AF2122/97
cggucgccgcgcgu

SEQ ID NO: 1197817 - RNA, 20 nt, Mycobacterium bovis subsp bovis AF2122/97
cggucgcccgcuaccaacgc

SEQ ID NO: 1197818 - RNA, 14 nt, Mycobacterium bovis subsp bovis AF2122/97
cggucgccaccgug

SEQ ID NO: 1197819 - RNA, 20 nt, Mycobacterium bovis subsp bovis AF2122/97
cggucgccgaauggcugggc

SEQ ID NO: 1197820 - RNA, 22 nt, Mycobacterium bovis subsp bovis AF2122/97
cggucgccgacggcgaccaccg

SEQ ID NO: 1197821 - RNA, 22 nt, Mycobacterium bovis subsp bovis AF2122/97
cguagggauagcagugcagcaa

SEQ ID NO: 1197822 - RNA, 20 nt, Mycobacterium bovis subsp bovis AF2122/97
cguagggcagcgccaggccg

SEQ ID NO: 1197823 - RNA, 13 nt, Mycobacterium bovis subsp bovis AF2122/97
cguaggcggcggc

SEQ ID NO: 1197824 - RNA, 14 nt, Mycobacterium bovis subsp bovis AF2122/97
cguaggcggcggcc

SEQ ID NO: 1197825 - RNA, 22 nt, Mycobacterium bovis subsp bovis AF2122/97
cguaggcguuguagcgguccag

SEQ ID NO: 1197826 - RNA, 16 nt, Mycobacterium bovis subsp bovis AF2122/97
cguaggcaggaucgcc

SEQ ID NO: 1197827 - RNA, 16 nt, Mycobacterium bovis subsp bovis AF2122/97
cguaggacucggcgga

SEQ ID NO: 1197828 - RNA, 18 nt, Mycobacterium bovis subsp bovis AF2122/97
cguaggacaccaccgugg

SEQ ID NO: 1197829 - RNA, 12 nt, Mycobacterium bovis subsp bovis AF2122/97
cguagcgcagcg

SEQ ID NO: 1197830 - RNA, 20 nt, Mycobacterium bovis subsp bovis AF2122/97
cguagcgcccaccguagacg

SEQ ID NO: 1197831 - RNA, 16 nt, Mycobacterium bovis subsp bovis AF2122/97
cguagcggcggcgccc

SEQ ID NO: 1197832 - RNA, 19 nt, Mycobacterium bovis subsp bovis AF2122/97
cguagcgaccgcggucgcu

SEQ ID NO: 1197833 - RNA, 23 nt, Mycobacterium bovis subsp bovis AF2122/97
cguagcggcuccgggaugaagcu

SEQ ID NO: 1197834 - RNA, 15 nt, Mycobacterium bovis subsp bovis AF2122/97
cguagcgggggagcg

SEQ ID NO: 1197835 - RNA, 21 nt, Mycobacterium bovis subsp bovis AF2122/97
cguagcuggugcguagcccac

SEQ ID NO: 1197836 - RNA, 17 nt, Mycobacterium bovis subsp bovis AF2122/97
cguagcuucccuccaga

SEQ ID NO: 1197837 - RNA, 18 nt, Mycobacterium bovis subsp bovis AF2122/97
cguagcuucccuccagau

SEQ ID NO: 1197838 - RNA, 15 nt, Mycobacterium bovis subsp bovis AF2122/97
cguagcugcgcagcg

SEQ ID NO: 1197839 - RNA, 12 nt, Mycobacterium bovis subsp bovis AF2122/97
cguagcccaggu

SEQ ID NO: 1197840 - RNA, 16 nt, Mycobacterium bovis subsp bovis AF2122/97
cguagcccacgacgaa

SEQ ID NO: 1197841 - RNA, 18 nt, Mycobacterium bovis subsp bovis AF2122/97
cguagcccacccgggugg

SEQ ID NO: 1197842 - RNA, 19 nt, Mycobacterium bovis subsp bovis AF2122/97
cguagcccacccggguggg

SEQ ID NO: 1197843 - RNA, 13 nt, Mycobacterium bovis subsp bovis AF2122/97
cguagccagcagg

SEQ ID NO: 1197844 - RNA, 15 nt, Mycobacterium bovis subsp bovis AF2122/97
cguagcccugcucag

SEQ ID NO: 1197845 - RNA, 16 nt, Mycobacterium bovis subsp bovis AF2122/97
cguagcccugcucagc

SEQ ID NO: 1197846 - RNA, 12 nt, Mycobacterium bovis subsp bovis AF2122/97
cguagccagcag

SEQ ID NO: 1197847 - RNA, 14 nt, Mycobacterium bovis subsp bovis AF2122/97
cguagccagcagcg

SEQ ID NO: 1197848 - RNA, 14 nt, Mycobacterium bovis subsp bovis AF2122/97
cguagcaccacauc

SEQ ID NO: 1197849 - RNA, 15 nt, Mycobacterium bovis subsp bovis AF2122/97
cguagcaccacaucg

SEQ ID NO: 1197850 - RNA, 23 nt, Mycobacterium bovis subsp bovis AF2122/97
cguagauggugguggcccggcug

SEQ ID NO: 1197851 - RNA, 17 nt, Mycobacterium bovis subsp bovis AF2122/97
cguagaguguccccggc

SEQ ID NO: 1197852 - RNA, 23 nt, Mycobacterium bovis subsp bovis AF2122/97
cguagacgacaucgucaucagcg

SEQ ID NO: 1197853 - RNA, 13 nt, Mycobacterium bovis subsp bovis AF2122/97
cguagaccagcag

SEQ ID NO: 1197854 - RNA, 15 nt, Mycobacterium bovis subsp bovis AF2122/97
cguagacgccgagca

SEQ ID NO: 1197855 - RNA, 18 nt, Mycobacterium bovis subsp bovis AF2122/97
cguagaaggcgauuugcu

SEQ ID NO: 1197856 - RNA, 22 nt, Mycobacterium bovis subsp bovis AF2122/97
cguagaaugcgccgucgguggg

SEQ ID NO: 1197857 - RNA, 15 nt, Mycobacterium bovis subsp bovis AF2122/97
cguagacaaggccaa

SEQ ID NO: 1197858 - RNA, 14 nt, Mycobacterium bovis subsp bovis AF2122/97
cguagaccagcagg

SEQ ID NO: 1197859 - RNA, 22 nt, Mycobacterium bovis subsp bovis AF2122/97
cguagagcuggugcgggacgcc

SEQ ID NO: 1197860 - RNA, 14 nt, Mycobacterium bovis subsp bovis AF2122/97
cguagacuugcugc

SEQ ID NO: 1197861 - RNA, 15 nt, Mycobacterium bovis subsp bovis AF2122/97
cguagagcagcagcg

SEQ ID NO: 1197862 - RNA, 17 nt, Mycobacterium bovis subsp bovis AF2122/97
cguagagcaugccgccc

SEQ ID NO: 1197863 - RNA, 17 nt, Mycobacterium bovis subsp bovis AF2122/97
cguagguggccagcgcg

SEQ ID NO: 1197864 - RNA, 16 nt, Mycobacterium bovis subsp bovis AF2122/97
cguagguggccggcuu

SEQ ID NO: 1197865 - RNA, 15 nt, Mycobacterium bovis subsp bovis AF2122/97
cguaggugcacaacc

SEQ ID NO: 1197866 - RNA, 18 nt, Mycobacterium bovis subsp bovis AF2122/97
cguagucggcggugcaga

SEQ ID NO: 1197867 - RNA, 17 nt, Mycobacterium bovis subsp bovis AF2122/97
cguagugcucgccggca

SEQ ID NO: 1197868 - RNA, 14 nt, Mycobacterium bovis subsp bovis AF2122/97
cguagucguagcag

SEQ ID NO: 1197869 - RNA, 15 nt, Mycobacterium bovis subsp bovis AF2122/97
cguaguaggcgccgc

SEQ ID NO: 1197870 - RNA, 12 nt, Mycobacterium bovis subsp bovis AF2122/97
cguauccaggcg

SEQ ID NO: 1197871 - RNA, 23 nt, Mycobacterium bovis subsp bovis AF2122/97
cguauaggucagaauugugugca

SEQ ID NO: 1197872 - RNA, 17 nt, Mycobacterium bovis subsp bovis AF2122/97
cguauaggucagaauug

SEQ ID NO: 1197873 - RNA, 17 nt, Mycobacterium bovis subsp bovis AF2122/97
cguauugauacugcccg

SEQ ID NO: 1197874 - RNA, 20 nt, Mycobacterium bovis subsp bovis AF2122/97
cguaucggguuucgaucuuc

SEQ ID NO: 1197875 - RNA, 21 nt, Mycobacterium bovis subsp bovis AF2122/97
cguaucggguuucgaucuucu

SEQ ID NO: 1197876 - RNA, 22 nt, Mycobacterium bovis subsp bovis AF2122/97
cgucaggcagcuccgccgccga

SEQ ID NO: 1197877 - RNA, 12 nt, Mycobacterium bovis subsp bovis AF2122/97
cgucagcgccgc

SEQ ID NO: 1197878 - RNA, 13 nt, Mycobacterium bovis subsp bovis AF2122/97
cgucagcggcggc

SEQ ID NO: 1197879 - RNA, 16 nt, Mycobacterium bovis subsp bovis AF2122/97
cgucagcgggcagcag

SEQ ID NO: 1197880 - RNA, 16 nt, Mycobacterium bovis subsp bovis AF2122/97
cgucagccaccgcaug

SEQ ID NO: 1197881 - RNA, 13 nt, Mycobacterium bovis subsp bovis AF2122/97
cgucagcccaggu

SEQ ID NO: 1197882 - RNA, 21 nt, Mycobacterium bovis subsp bovis AF2122/97
cgucagccccgacugcgccca

SEQ ID NO: 1197883 - RNA, 22 nt, Mycobacterium bovis subsp bovis AF2122/97
cgucagccguucggcuaagccu

SEQ ID NO: 1197884 - RNA, 14 nt, Mycobacterium bovis subsp bovis AF2122/97
cgucagcaccgcua

SEQ ID NO: 1197885 - RNA, 15 nt, Mycobacterium bovis subsp bovis AF2122/97
cgucacuucccggau

SEQ ID NO: 1197886 - RNA, 13 nt, Mycobacterium bovis subsp bovis AF2122/97
cgucaucgcgggu

SEQ ID NO: 1197887 - RNA, 14 nt, Mycobacterium bovis subsp bovis AF2122/97
cgucaucgcggugu

SEQ ID NO: 1197888 - RNA, 19 nt, Mycobacterium bovis subsp bovis AF2122/97
cgucaucgcguagugaugg

SEQ ID NO: 1197889 - RNA, 15 nt, Mycobacterium bovis subsp bovis AF2122/97
cgucaucgacgagcg

SEQ ID NO: 1197890 - RNA, 15 nt, Mycobacterium bovis subsp bovis AF2122/97
cgucauccaaccgug

SEQ ID NO: 1197891 - RNA, 12 nt, Mycobacterium bovis subsp bovis AF2122/97
cgucauccaccg

SEQ ID NO: 1197892 - RNA, 22 nt, Mycobacterium bovis subsp bovis AF2122/97
cgucaucccgauguaccccagc

SEQ ID NO: 1197893 - RNA, 23 nt, Mycobacterium bovis subsp bovis AF2122/97
cgucaugaagccguugccgccac

SEQ ID NO: 1197894 - RNA, 15 nt, Mycobacterium bovis subsp bovis AF2122/97
cgucaucggggccug

SEQ ID NO: 1197895 - RNA, 21 nt, Mycobacterium bovis subsp bovis AF2122/97
cgucaucggcuggccgcgccu

SEQ ID NO: 1197896 - RNA, 18 nt, Mycobacterium bovis subsp bovis AF2122/97
cgucaugcccaucuccaa

SEQ ID NO: 1197897 - RNA, 16 nt, Mycobacterium bovis subsp bovis AF2122/97
cgucaggugcgcgacc

SEQ ID NO: 1197898 - RNA, 17 nt, Mycobacterium bovis subsp bovis AF2122/97
cgucagguggccaaugc

SEQ ID NO: 1197899 - RNA, 19 nt, Mycobacterium bovis subsp bovis AF2122/97
cgucagguuccgcgacaac

SEQ ID NO: 1197900 - RNA, 19 nt, Mycobacterium bovis subsp bovis AF2122/97
cgucaguccucaucgagcg

SEQ ID NO: 1197901 - RNA, 15 nt, Mycobacterium bovis subsp bovis AF2122/97
cgucaguagccacgc

SEQ ID NO: 1197902 - RNA, 17 nt, Mycobacterium bovis subsp bovis AF2122/97
cgucagugccccgcagc

SEQ ID NO: 1197903 - RNA, 13 nt, Mycobacterium bovis subsp bovis AF2122/97
cgucaucaggucg

SEQ ID NO: 1197904 - RNA, 13 nt, Mycobacterium bovis subsp bovis AF2122/97
cgucaguugagaa

SEQ ID NO: 1197905 - RNA, 19 nt, Mycobacterium bovis subsp bovis AF2122/97
cgucaaccgaucggucguc

SEQ ID NO: 1197906 - RNA, 16 nt, Mycobacterium bovis subsp bovis AF2122/97
cgucaaccacggccgc

SEQ ID NO: 1197907 - RNA, 17 nt, Mycobacterium bovis subsp bovis AF2122/97
cgucaaccacggccgcc

SEQ ID NO: 1197908 - RNA, 18 nt, Mycobacterium bovis subsp bovis AF2122/97
cgucaaacgacagcccua

SEQ ID NO: 1197909 - RNA, 23 nt, Mycobacterium bovis subsp bovis AF2122/97
cgucaagagugcucagcgcgcgc

SEQ ID NO: 1197910 - RNA, 19 nt, Mycobacterium bovis subsp bovis AF2122/97
cgucaacuugggcccgcug

SEQ ID NO: 1197911 - RNA, 18 nt, Mycobacterium bovis subsp bovis AF2122/97
cgucaccaaguucagcac

SEQ ID NO: 1197912 - RNA, 18 nt, Mycobacterium bovis subsp bovis AF2122/97
cgucacaggccgccuggg

SEQ ID NO: 1197913 - RNA, 14 nt, Mycobacterium bovis subsp bovis AF2122/97
cgucaccaccgccg

SEQ ID NO: 1197914 - RNA, 17 nt, Mycobacterium bovis subsp bovis AF2122/97
cgucacaaugcccaggc

SEQ ID NO: 1197915 - RNA, 15 nt, Mycobacterium bovis subsp bovis AF2122/97
cgucacaccagcggg

SEQ ID NO: 1197916 - RNA, 16 nt, Mycobacterium bovis subsp bovis AF2122/97
cgucaauggaaccggu

SEQ ID NO: 1197917 - RNA, 15 nt, Mycobacterium bovis subsp bovis AF2122/97
cgucaaucaccaccg

SEQ ID NO: 1197918 - RNA, 20 nt, Mycobacterium bovis subsp bovis AF2122/97
cgucaaucaccaccgccagc

SEQ ID NO: 1197919 - RNA, 18 nt, Mycobacterium bovis subsp bovis AF2122/97
cgucaccgaugcgccgga

SEQ ID NO: 1197920 - RNA, 18 nt, Mycobacterium bovis subsp bovis AF2122/97
cgucacccugucgcgcac

SEQ ID NO: 1197921 - RNA, 17 nt, Mycobacterium bovis subsp bovis AF2122/97
cgucaccgaugcgccgg

SEQ ID NO: 1197922 - RNA, 13 nt, Mycobacterium bovis subsp bovis AF2122/97
cgucaccccgguc

SEQ ID NO: 1197923 - RNA, 20 nt, Mycobacterium bovis subsp bovis AF2122/97
cgucaccccggucccgccga

SEQ ID NO: 1197924 - RNA, 15 nt, Mycobacterium bovis subsp bovis AF2122/97
cgucaccaccgccgc

SEQ ID NO: 1197925 - RNA, 17 nt, Mycobacterium bovis subsp bovis AF2122/97
cgucaccguguugcacg

SEQ ID NO: 1197926 - RNA, 23 nt, Mycobacterium bovis subsp bovis AF2122/97
cgucaccggucagcgacgcacgc

SEQ ID NO: 1197927 - RNA, 22 nt, Mycobacterium bovis subsp bovis AF2122/97
cgucaccguuguucccauagcc

SEQ ID NO: 1197928 - RNA, 20 nt, Mycobacterium bovis subsp bovis AF2122/97
cgucaccgccggcaccgcca

SEQ ID NO: 1197929 - RNA, 22 nt, Mycobacterium bovis subsp bovis AF2122/97
cgucaccgccguugccgccggc

SEQ ID NO: 1197930 - RNA, 13 nt, Mycobacterium bovis subsp bovis AF2122/97
cgucaccgcgacc

SEQ ID NO: 1197931 - RNA, 20 nt, Mycobacterium bovis subsp bovis AF2122/97
cgucaccgcgaccagccagc

SEQ ID NO: 1197932 - RNA, 15 nt, Mycobacterium bovis subsp bovis AF2122/97
cgucaccgcgacccc

SEQ ID NO: 1197933 - RNA, 16 nt, Mycobacterium bovis subsp bovis AF2122/97
cgucaccggaaucccc

SEQ ID NO: 1197934 - RNA, 16 nt, Mycobacterium bovis subsp bovis AF2122/97
cgucaccggaggccgc

SEQ ID NO: 1197935 - RNA, 23 nt, Mycobacterium bovis subsp bovis AF2122/97
cgucaccggaggccgccgcgccg

SEQ ID NO: 1197936 - RNA, 20 nt, Mycobacterium bovis subsp bovis AF2122/97
cgucacggacccuuccgccg

SEQ ID NO: 1197937 - RNA, 21 nt, Mycobacterium bovis subsp bovis AF2122/97
cgucacggaccgccaccuugg

SEQ ID NO: 1197938 - RNA, 11 nt, Mycobacterium bovis subsp bovis AF2122/97
cgucacugcca

SEQ ID NO: 1197939 - RNA, 21 nt, Mycobacterium bovis subsp bovis AF2122/97
cgucacguggucggccacccc

SEQ ID NO: 1197940 - RNA, 17 nt, Mycobacterium bovis subsp bovis AF2122/97
cggccugggccagccgc

SEQ ID NO: 1197941 - RNA, 16 nt, Mycobacterium bovis subsp bovis AF2122/97
cggccuggggcagccg

SEQ ID NO: 1197942 - RNA, 15 nt, Mycobacterium bovis subsp bovis AF2122/97
cggccuucucgccgu

SEQ ID NO: 1197943 - RNA, 14 nt, Mycobacterium bovis subsp bovis AF2122/97
cggccuucuugagg

SEQ ID NO: 1197944 - RNA, 15 nt, Mycobacterium bovis subsp bovis AF2122/97
cggccuugccaccgg

SEQ ID NO: 1197945 - RNA, 23 nt, Mycobacterium bovis subsp bovis AF2122/97
cggccuugcccucaacggcggca

SEQ ID NO: 1197946 - RNA, 15 nt, Mycobacterium bovis subsp bovis AF2122/97
cggccuugccgccgg

SEQ ID NO: 1197947 - RNA, 21 nt, Mycobacterium bovis subsp bovis AF2122/97
cggccuugccgccggccccgc

SEQ ID NO: 1197948 - RNA, 23 nt, Mycobacterium bovis subsp bovis AF2122/97
cggccuugccgggccgcgcgggc

SEQ ID NO: 1197949 - RNA, 13 nt, Mycobacterium bovis subsp bovis AF2122/97
cggcgcggccgca

SEQ ID NO: 1197950 - RNA, 15 nt, Mycobacterium bovis subsp bovis AF2122/97
cggcgcggccgcagc

SEQ ID NO: 1197951 - RNA, 15 nt, Mycobacterium bovis subsp bovis AF2122/97
cggcgcggccagcuc

SEQ ID NO: 1197952 - RNA, 15 nt, Mycobacterium bovis subsp bovis AF2122/97
cggcgcggccggccg

SEQ ID NO: 1197953 - RNA, 17 nt, Mycobacterium bovis subsp bovis AF2122/97
cggcgcggccggccgcu

SEQ ID NO: 1197954 - RNA, 14 nt, Mycobacterium bovis subsp bovis AF2122/97
cggcgcuccgccag

SEQ ID NO: 1197955 - RNA, 19 nt, Mycobacterium bovis subsp bovis AF2122/97
cggcgcuagcgccgcgcuu

SEQ ID NO: 1197956 - RNA, 15 nt, Mycobacterium bovis subsp bovis AF2122/97
cggcggcccuuucca

SEQ ID NO: 1197957 - RNA, 19 nt, Mycobacterium bovis subsp bovis AF2122/97
cggcggcccguuugccggu

SEQ ID NO: 1197958 - RNA, 16 nt, Mycobacterium bovis subsp bovis AF2122/97
cggcggcccgcagccc

SEQ ID NO: 1197959 - RNA, 13 nt, Mycobacterium bovis subsp bovis AF2122/97
cggcggccggcac

SEQ ID NO: 1197960 - RNA, 15 nt, Mycobacterium bovis subsp bovis AF2122/97
cggcggccgcccaga

SEQ ID NO: 1197961 - RNA, 16 nt, Mycobacterium bovis subsp bovis AF2122/97
cggcggccgcgauggc

SEQ ID NO: 1197962 - RNA, 15 nt, Mycobacterium bovis subsp bovis AF2122/97
cggcggccaccaugu

SEQ ID NO: 1197963 - RNA, 20 nt, Mycobacterium bovis subsp bovis AF2122/97
cggcggcaugggucgugcag

SEQ ID NO: 1197964 - RNA, 20 nt, Mycobacterium bovis subsp bovis AF2122/97
cggcggccaacagcacccgg

SEQ ID NO: 1197965 - RNA, 22 nt, Mycobacterium bovis subsp bovis AF2122/97
cggcggccaacagcacccgggc

SEQ ID NO: 1197966 - RNA, 20 nt, Mycobacterium bovis subsp bovis AF2122/97
cggcggccaaggucgaccca

SEQ ID NO: 1197967 - RNA, 16 nt, Mycobacterium bovis subsp bovis AF2122/97
cggcggauucgcgcug

SEQ ID NO: 1197968 - RNA, 21 nt, Mycobacterium bovis subsp bovis AF2122/97
cggcggauucgguaucagggg

SEQ ID NO: 1197969 - RNA, 14 nt, Mycobacterium bovis subsp bovis AF2122/97
cggcggagucgcgc

SEQ ID NO: 1197970 - RNA, 13 nt, Mycobacterium bovis subsp bovis AF2122/97
cggcggagugcau

SEQ ID NO: 1197971 - RNA, 16 nt, Mycobacterium bovis subsp bovis AF2122/97
cggcggaucggcggcc

SEQ ID NO: 1197972 - RNA, 20 nt, Mycobacterium bovis subsp bovis AF2122/97
cggcggaucggcggccggca

SEQ ID NO: 1197973 - RNA, 14 nt, Mycobacterium bovis subsp bovis AF2122/97
cggcggaccgcagc

SEQ ID NO: 1197974 - RNA, 19 nt, Mycobacterium bovis subsp bovis AF2122/97
cggcggacugagagauggu

SEQ ID NO: 1197975 - RNA, 18 nt, Mycobacterium bovis subsp bovis AF2122/97
cggcggacgcccggcgca

SEQ ID NO: 1197976 - RNA, 17 nt, Mycobacterium bovis subsp bovis AF2122/97
cggcggagcgggccagc

SEQ ID NO: 1197977 - RNA, 21 nt, Mycobacterium bovis subsp bovis AF2122/97
cggcgcugcccacgccggggc

SEQ ID NO: 1197978 - RNA, 18 nt, Mycobacterium bovis subsp bovis AF2122/97
cggcgcugaucgcgaagc

SEQ ID NO: 1197979 - RNA, 21 nt, Mycobacterium bovis subsp bovis AF2122/97
cggcgcugaucgcgcgcaccg

SEQ ID NO: 1197980 - RNA, 18 nt, Mycobacterium bovis subsp bovis AF2122/97
cggcggaaggacggcagc

SEQ ID NO: 1197981 - RNA, 16 nt, Mycobacterium bovis subsp bovis AF2122/97
cggcggccgugucggg

SEQ ID NO: 1197982 - RNA, 12 nt, Mycobacterium bovis subsp bovis AF2122/97
cggcggcgcgcc

SEQ ID NO: 1197983 - RNA, 14 nt, Mycobacterium bovis subsp bovis AF2122/97
cggcggcgcaguuc

SEQ ID NO: 1197984 - RNA, 13 nt, Mycobacterium bovis subsp bovis AF2122/97
cggcggcgccgcc

SEQ ID NO: 1197985 - RNA, 20 nt, Mycobacterium bovis subsp bovis AF2122/97
cggcggccugggccagccgc

SEQ ID NO: 1197986 - RNA, 17 nt, Mycobacterium bovis subsp bovis AF2122/97
cggcggccuucggccgg

SEQ ID NO: 1197987 - RNA, 12 nt, Mycobacterium bovis subsp bovis AF2122/97
cggcggcgacgg

SEQ ID NO: 1197988 - RNA, 17 nt, Mycobacterium bovis subsp bovis AF2122/97
cggcggcgacggcggca

SEQ ID NO: 1197989 - RNA, 16 nt, Mycobacterium bovis subsp bovis AF2122/97
cggcggccuugcgggc

SEQ ID NO: 1197990 - RNA, 12 nt, Mycobacterium bovis subsp bovis AF2122/97
cggcggcggccg

SEQ ID NO: 1197991 - RNA, 14 nt, Mycobacterium bovis subsp bovis AF2122/97
cggcggcucgggug

SEQ ID NO: 1197992 - RNA, 16 nt, Mycobacterium bovis subsp bovis AF2122/97
cggcggcucccggggg

SEQ ID NO: 1197993 - RNA, 19 nt, Mycobacterium bovis subsp bovis AF2122/97
cggcggcuguugcggcggc

SEQ ID NO: 1197994 - RNA, 17 nt, Mycobacterium bovis subsp bovis AF2122/97
cggcggcugucggccgg

SEQ ID NO: 1197995 - RNA, 14 nt, Mycobacterium bovis subsp bovis AF2122/97
cggcggcuuggccg

SEQ ID NO: 1197996 - RNA, 21 nt, Mycobacterium bovis subsp bovis AF2122/97
cggcggcuuggccgccccggc

SEQ ID NO: 1197997 - RNA, 22 nt, Mycobacterium bovis subsp bovis AF2122/97
cggcggcuuggccgccccggcc

SEQ ID NO: 1197998 - RNA, 21 nt, Mycobacterium bovis subsp bovis AF2122/97
cggcggcguccaucgcgcgcc

SEQ ID NO: 1197999 - RNA, 16 nt, Mycobacterium bovis subsp bovis AF2122/97
cggcggcggugcgccc

SEQ ID NO: 1198000 - RNA, 14 nt, Mycobacterium bovis subsp bovis AF2122/97
cggcggcggcggca

SEQ ID NO: 1198001 - RNA, 15 nt, Mycobacterium bovis subsp bovis AF2122/97
cggcggcggcggccc

SEQ ID NO: 1198002 - RNA, 13 nt, Mycobacterium bovis subsp bovis AF2122/97
cggcggcggcgcu

SEQ ID NO: 1198003 - RNA, 13 nt, Mycobacterium bovis subsp bovis AF2122/97
cggcggcggccgc

SEQ ID NO: 1198004 - RNA, 10 nt, Mycobacterium bovis subsp bovis AF2122/97
cggcggcggc

SEQ ID NO: 1198005 - RNA, 16 nt, Mycobacterium bovis subsp bovis AF2122/97
cggcggcgcucgucga

SEQ ID NO: 1198006 - RNA, 12 nt, Mycobacterium bovis subsp bovis AF2122/97
cggcggcggagg

SEQ ID NO: 1198007 - RNA, 14 nt, Mycobacterium bovis subsp bovis AF2122/97
cggcgggcgagcca

SEQ ID NO: 1198008 - RNA, 15 nt, Mycobacterium bovis subsp bovis AF2122/97
cggcgggccugcccg

SEQ ID NO: 1198009 - RNA, 15 nt, Mycobacterium bovis subsp bovis AF2122/97
cggcgggcgcgggcg

SEQ ID NO: 1198010 - RNA, 19 nt, Mycobacterium bovis subsp bovis AF2122/97
cggcgggcggugggcagca

SEQ ID NO: 1198011 - RNA, 17 nt, Mycobacterium bovis subsp bovis AF2122/97
cggcgguaagggcgggc

SEQ ID NO: 1198012 - RNA, 21 nt, Mycobacterium bovis subsp bovis AF2122/97
cggcgguaguacucgcgcagg

SEQ ID NO: 1198013 - RNA, 23 nt, Mycobacterium bovis subsp bovis AF2122/97
cggcgguaccggaaucggcggcg

SEQ ID NO: 1198014 - RNA, 16 nt, Mycobacterium bovis subsp bovis AF2122/97
cggcgguaccggagca

SEQ ID NO: 1198015 - RNA, 14 nt, Mycobacterium bovis subsp bovis AF2122/97
cggcgggccgcgcg

SEQ ID NO: 1198016 - RNA, 22 nt, Mycobacterium bovis subsp bovis AF2122/97
cggcgggcacgcacaaguucuu

SEQ ID NO: 1198017 - RNA, 17 nt, Mycobacterium bovis subsp bovis AF2122/97
cggcgggaugcgcgccc

SEQ ID NO: 1198018 - RNA, 15 nt, Mycobacterium bovis subsp bovis AF2122/97
cggcgggauccucga

SEQ ID NO: 1198019 - RNA, 22 nt, Mycobacterium bovis subsp bovis AF2122/97
cggcgggaacccuugccacgaa

SEQ ID NO: 1198020 - RNA, 22 nt, Mycobacterium bovis subsp bovis AF2122/97
cggcgguauuuugccggauucu

SEQ ID NO: 1198021 - RNA, 22 nt, Mycobacterium bovis subsp bovis AF2122/97
cggcgguaugcucgcuggcgcu

SEQ ID NO: 1198022 - RNA, 22 nt, Mycobacterium bovis subsp bovis AF2122/97
cggcggucucgucaaccugcgc

SEQ ID NO: 1198023 - RNA, 17 nt, Mycobacterium bovis subsp bovis AF2122/97
cggcggucugcagugca

SEQ ID NO: 1198024 - RNA, 17 nt, Mycobacterium bovis subsp bovis AF2122/97
cggcgguccggaugcgc

SEQ ID NO: 1198025 - RNA, 15 nt, Mycobacterium bovis subsp bovis AF2122/97
cggcggucggcuggg

SEQ ID NO: 1198026 - RNA, 19 nt, Mycobacterium bovis subsp bovis AF2122/97
cggcggugaaaucgcacag

SEQ ID NO: 1198027 - RNA, 12 nt, Mycobacterium bovis subsp bovis AF2122/97
cggcggucuggg

SEQ ID NO: 1198028 - RNA, 12 nt, Mycobacterium bovis subsp bovis AF2122/97
cggcggucugua

SEQ ID NO: 1198029 - RNA, 18 nt, Mycobacterium bovis subsp bovis AF2122/97
cggcgguucugcggccgc

SEQ ID NO: 1198030 - RNA, 20 nt, Mycobacterium bovis subsp bovis AF2122/97
cggcgguuucggugguaacg

SEQ ID NO: 1198031 - RNA, 16 nt, Mycobacterium bovis subsp bovis AF2122/97
cggcguaaccggcagc

SEQ ID NO: 1198032 - RNA, 20 nt, Mycobacterium bovis subsp bovis AF2122/97
cggcuccuccccggcccgcu

SEQ ID NO: 1198033 - RNA, 16 nt, Mycobacterium bovis subsp bovis AF2122/97
cggcuccuccccggcc

SEQ ID NO: 1198034 - RNA, 13 nt, Mycobacterium bovis subsp bovis AF2122/97
cggcucaucccga

SEQ ID NO: 1198035 - RNA, 16 nt, Mycobacterium bovis subsp bovis AF2122/97
cggcucaucccgaccc

SEQ ID NO: 1198036 - RNA, 13 nt, Mycobacterium bovis subsp bovis AF2122/97
cggcucacgaccg

SEQ ID NO: 1198037 - RNA, 17 nt, Mycobacterium bovis subsp bovis AF2122/97
cggcucacgaccggcca

SEQ ID NO: 1198038 - RNA, 21 nt, Mycobacterium bovis subsp bovis AF2122/97
cggcucaccgcgcaucaucgc

SEQ ID NO: 1198039 - RNA, 15 nt, Mycobacterium bovis subsp bovis AF2122/97
cggcuagcugaugcc

SEQ ID NO: 1198040 - RNA, 18 nt, Mycobacterium bovis subsp bovis AF2122/97
cggcuacggccagugcca

SEQ ID NO: 1198041 - RNA, 21 nt, Mycobacterium bovis subsp bovis AF2122/97
cggcuacggcgacacgccagc

SEQ ID NO: 1198042 - RNA, 15 nt, Mycobacterium bovis subsp bovis AF2122/97
cggcuacggcugccc

SEQ ID NO: 1198043 - RNA, 19 nt, Mycobacterium bovis subsp bovis AF2122/97
cggcuaccgcgcucccggc

SEQ ID NO: 1198044 - RNA, 17 nt, Mycobacterium bovis subsp bovis AF2122/97
cggcuaccgccgaccgg

SEQ ID NO: 1198045 - RNA, 14 nt, Mycobacterium bovis subsp bovis AF2122/97
cggcuaccgcgcuc

SEQ ID NO: 1198046 - RNA, 16 nt, Mycobacterium bovis subsp bovis AF2122/97
cggcuaccgcgcuccc

SEQ ID NO: 1198047 - RNA, 21 nt, Mycobacterium bovis subsp bovis AF2122/97
cggcuaccgcgcucccggcgu

SEQ ID NO: 1198048 - RNA, 16 nt, Mycobacterium bovis subsp bovis AF2122/97
cggcucaccgcgcauc

SEQ ID NO: 1198049 - RNA, 18 nt, Mycobacterium bovis subsp bovis AF2122/97
cggcucaaucuccuccgc

SEQ ID NO: 1198050 - RNA, 19 nt, Mycobacterium bovis subsp bovis AF2122/97
cggcucaaucuccuccgcg

SEQ ID NO: 1198051 - RNA, 13 nt, Mycobacterium bovis subsp bovis AF2122/97
cggcucacagcac

SEQ ID NO: 1198052 - RNA, 16 nt, Mycobacterium bovis subsp bovis AF2122/97
cggcucacagcacagc

SEQ ID NO: 1198053 - RNA, 22 nt, Mycobacterium bovis subsp bovis AF2122/97
cggcucacagcacagcgcagcc

SEQ ID NO: 1198054 - RNA, 21 nt, Mycobacterium bovis subsp bovis AF2122/97
cggcucaacaccgaguuccuc

SEQ ID NO: 1198055 - RNA, 14 nt, Mycobacterium bovis subsp bovis AF2122/97
cggcuaugcuggcg

SEQ ID NO: 1198056 - RNA, 17 nt, Mycobacterium bovis subsp bovis AF2122/97
cggcuauggcgccgcgg

SEQ ID NO: 1198057 - RNA, 20 nt, Mycobacterium bovis subsp bovis AF2122/97
cggcuauaucccgccccggg

SEQ ID NO: 1198058 - RNA, 20 nt, Mycobacterium bovis subsp bovis AF2122/97
cggcguuccgggccgaucac

SEQ ID NO: 1198059 - RNA, 17 nt, Mycobacterium bovis subsp bovis AF2122/97
cggcuaccaccgcaccu

SEQ ID NO: 1198060 - RNA, 19 nt, Mycobacterium bovis subsp bovis AF2122/97
cggcguucccacuggaggu

SEQ ID NO: 1198061 - RNA, 16 nt, Mycobacterium bovis subsp bovis AF2122/97
cggcguuccggacggg

SEQ ID NO: 1198062 - RNA, 16 nt, Mycobacterium bovis subsp bovis AF2122/97
cggcguuccgggccga

SEQ ID NO: 1198063 - RNA, 17 nt, Mycobacterium bovis subsp bovis AF2122/97
cggcguuagucgaucac

SEQ ID NO: 1198064 - RNA, 19 nt, Mycobacterium bovis subsp bovis AF2122/97
cggcgugucucgucgcccc

SEQ ID NO: 1198065 - RNA, 17 nt, Mycobacterium bovis subsp bovis AF2122/97
cggcguggcgccggcca

SEQ ID NO: 1198066 - RNA, 15 nt, Mycobacterium bovis subsp bovis AF2122/97
cggcguggcgggggc

SEQ ID NO: 1198067 - RNA, 17 nt, Mycobacterium bovis subsp bovis AF2122/97
cggcguggucgcgcggc

SEQ ID NO: 1198068 - RNA, 18 nt, Mycobacterium bovis subsp bovis AF2122/97
cggcgugguauccgccgu

SEQ ID NO: 1198069 - RNA, 18 nt, Mycobacterium bovis subsp bovis AF2122/97
cggcguggcugccuucgg

SEQ ID NO: 1198070 - RNA, 22 nt, Mycobacterium bovis subsp bovis AF2122/97
cggcguggcuucacccaacccc

SEQ ID NO: 1198071 - RNA, 18 nt, Mycobacterium bovis subsp bovis AF2122/97
cggcguggcuuguucgga

SEQ ID NO: 1198072 - RNA, 19 nt, Mycobacterium bovis subsp bovis AF2122/97
cggcgugucguugccaggg

SEQ ID NO: 1198073 - RNA, 15 nt, Mycobacterium bovis subsp bovis AF2122/97
cggcgugucgggggc

SEQ ID NO: 1198074 - RNA, 20 nt, Mycobacterium bovis subsp bovis AF2122/97
cggcgugucgccgccaccag

SEQ ID NO: 1198075 - RNA, 15 nt, Mycobacterium bovis subsp bovis AF2122/97
cggcgugcugugcuc

SEQ ID NO: 1198076 - RNA, 12 nt, Mycobacterium bovis subsp bovis AF2122/97
cggcgugcagca

SEQ ID NO: 1198077 - RNA, 15 nt, Mycobacterium bovis subsp bovis AF2122/97
cggcgugcaggguca

SEQ ID NO: 1198078 - RNA, 24 nt, Mycobacterium bovis subsp bovis AF2122/97
cggcguacccguuaugcgccgccc

SEQ ID NO: 1198079 - RNA, 19 nt, Mycobacterium bovis subsp bovis AF2122/97
cggcuggugggacgcggcc

SEQ ID NO: 1198080 - RNA, 15 nt, Mycobacterium bovis subsp bovis AF2122/97
cggcuggugucgggc

SEQ ID NO: 1198081 - RNA, 21 nt, Mycobacterium bovis subsp bovis AF2122/97
cggcugggggauaccgcuggg

SEQ ID NO: 1198082 - RNA, 15 nt, Mycobacterium bovis subsp bovis AF2122/97
cggcuggucacccgu

SEQ ID NO: 1198083 - RNA, 22 nt, Mycobacterium bovis subsp bovis AF2122/97
cggcugauuggcccaccgccgu

SEQ ID NO: 1198084 - RNA, 23 nt, Mycobacterium bovis subsp bovis AF2122/97
cggcugcaaccagcggcacauca

SEQ ID NO: 1198085 - RNA, 14 nt, Mycobacterium bovis subsp bovis AF2122/97
cggcucgccggcgg

SEQ ID NO: 1198086 - RNA, 17 nt, Mycobacterium bovis subsp bovis AF2122/97
cggcucgccggcggccc

SEQ ID NO: 1198087 - RNA, 21 nt, Mycobacterium bovis subsp bovis AF2122/97
cggcucgccgacccgccgcgg

SEQ ID NO: 1198088 - RNA, 17 nt, Mycobacterium bovis subsp bovis AF2122/97
cggcugcagccgaccga

SEQ ID NO: 1198089 - RNA, 21 nt, Mycobacterium bovis subsp bovis AF2122/97
cggcugccgcaaacgcggcgu

SEQ ID NO: 1198090 - RNA, 14 nt, Mycobacterium bovis subsp bovis AF2122/97
cggcugccgcacca

SEQ ID NO: 1198091 - RNA, 16 nt, Mycobacterium bovis subsp bovis AF2122/97
cggcugccgcggcugc

SEQ ID NO: 1198092 - RNA, 18 nt, Mycobacterium bovis subsp bovis AF2122/97
cggcugccagcgccgccg

SEQ ID NO: 1198093 - RNA, 15 nt, Mycobacterium bovis subsp bovis AF2122/97
cggcugccaucccga

SEQ ID NO: 1198094 - RNA, 23 nt, Mycobacterium bovis subsp bovis AF2122/97
cggcugccaucccgaucccggcc

SEQ ID NO: 1198095 - RNA, 15 nt, Mycobacterium bovis subsp bovis AF2122/97
cggcuucggccagca

SEQ ID NO: 1198096 - RNA, 15 nt, Mycobacterium bovis subsp bovis AF2122/97
cggcuucguccaccg

SEQ ID NO: 1198097 - RNA, 15 nt, Mycobacterium bovis subsp bovis AF2122/97
cggcuucggcagacc

SEQ ID NO: 1198098 - RNA, 14 nt, Mycobacterium bovis subsp bovis AF2122/97
cggcuuccccagca

SEQ ID NO: 1198099 - RNA, 20 nt, Mycobacterium bovis subsp bovis AF2122/97
cggcuucgcccagagccgcu

SEQ ID NO: 1198100 - RNA, 19 nt, Mycobacterium bovis subsp bovis AF2122/97
cggcuuucccaccgcuucc

SEQ ID NO: 1198101 - RNA, 18 nt, Mycobacterium bovis subsp bovis AF2122/97
cggcuuuggccgccgugg

SEQ ID NO: 1198102 - RNA, 21 nt, Mycobacterium bovis subsp bovis AF2122/97
cggcuuugacgcccggcaccc

SEQ ID NO: 1198103 - RNA, 16 nt, Mycobacterium bovis subsp bovis AF2122/97
cggcuuugagccgcuc

SEQ ID NO: 1198104 - RNA, 19 nt, Mycobacterium bovis subsp bovis AF2122/97
cggcuguugcggcggcgcu

SEQ ID NO: 1198105 - RNA, 13 nt, Mycobacterium bovis subsp bovis AF2122/97
cggcuuccuccuc

SEQ ID NO: 1198106 - RNA, 14 nt, Mycobacterium bovis subsp bovis AF2122/97
cgggccguccuccc

SEQ ID NO: 1198107 - RNA, 15 nt, Mycobacterium bovis subsp bovis AF2122/97
cgggccguccuccca

SEQ ID NO: 1198108 - RNA, 14 nt, Mycobacterium bovis subsp bovis AF2122/97
cgggccgugacccu

SEQ ID NO: 1198109 - RNA, 18 nt, Mycobacterium bovis subsp bovis AF2122/97
cgggccgcguccagaccg

SEQ ID NO: 1198110 - RNA, 23 nt, Mycobacterium bovis subsp bovis AF2122/97
cgggccucaugcuaggccaccgg

SEQ ID NO: 1198111 - RNA, 23 nt, Mycobacterium bovis subsp bovis AF2122/97
cgggccggaugacgcccagggcg

SEQ ID NO: 1198112 - RNA, 21 nt, Mycobacterium bovis subsp bovis AF2122/97
cgggccggaugacgcccaggg

SEQ ID NO: 1198113 - RNA, 18 nt, Mycobacterium bovis subsp bovis AF2122/97
cgggccggugcgcaccag

SEQ ID NO: 1198114 - RNA, 15 nt, Mycobacterium bovis subsp bovis AF2122/97
cgggccgucaaucgc

SEQ ID NO: 1198115 - RNA, 12 nt, Mycobacterium bovis subsp bovis AF2122/97
cgggccgcgcgc

SEQ ID NO: 1198116 - RNA, 21 nt, Mycobacterium bovis subsp bovis AF2122/97
cgggccgcgguacccaccucc

SEQ ID NO: 1198117 - RNA, 14 nt, Mycobacterium bovis subsp bovis AF2122/97
cgggccgcgcgcag

SEQ ID NO: 1198118 - RNA, 14 nt, Mycobacterium bovis subsp bovis AF2122/97
cgggccgcggcggc

SEQ ID NO: 1198119 - RNA, 13 nt, Mycobacterium bovis subsp bovis AF2122/97
cgggccgcgcggc

SEQ ID NO: 1198120 - RNA, 16 nt, Mycobacterium bovis subsp bovis AF2122/97
cgggccgcgcgggccg

SEQ ID NO: 1198121 - RNA, 22 nt, Mycobacterium bovis subsp bovis AF2122/97
cgggccgauugcucggggagga

SEQ ID NO: 1198122 - RNA, 14 nt, Mycobacterium bovis subsp bovis AF2122/97
cgggccgagcgcac

SEQ ID NO: 1198123 - RNA, 22 nt, Mycobacterium bovis subsp bovis AF2122/97
cgggccgagaucacgccgggcg

SEQ ID NO: 1198124 - RNA, 19 nt, Mycobacterium bovis subsp bovis AF2122/97
cgggcgcaagcagcccggg

SEQ ID NO: 1198125 - RNA, 17 nt, Mycobacterium bovis subsp bovis AF2122/97
cgggcgaucgccugggc

SEQ ID NO: 1198126 - RNA, 15 nt, Mycobacterium bovis subsp bovis AF2122/97
cgggcgcaccaggga

SEQ ID NO: 1198127 - RNA, 23 nt, Mycobacterium bovis subsp bovis AF2122/97
cgggcgcaccagggagccguuca

SEQ ID NO: 1198128 - RNA, 14 nt, Mycobacterium bovis subsp bovis AF2122/97
cgggcgcaagcagc

SEQ ID NO: 1198129 - RNA, 16 nt, Mycobacterium bovis subsp bovis AF2122/97
cgggcgaugagcgcga

SEQ ID NO: 1198130 - RNA, 21 nt, Mycobacterium bovis subsp bovis AF2122/97
cgggcgaugccgaugucgggc

SEQ ID NO: 1198131 - RNA, 13 nt, Mycobacterium bovis subsp bovis AF2122/97
cgggcgaugcugg

SEQ ID NO: 1198132 - RNA, 20 nt, Mycobacterium bovis subsp bovis AF2122/97
cgggcgagcgcaucgauggc

SEQ ID NO: 1198133 - RNA, 22 nt, Mycobacterium bovis subsp bovis AF2122/97
cgggcgagcgcggccugcacca

SEQ ID NO: 1198134 - RNA, 20 nt, Mycobacterium bovis subsp bovis AF2122/97
cgggcgagcucgucgagcgc

SEQ ID NO: 1198135 - RNA, 22 nt, Mycobacterium bovis subsp bovis AF2122/97
cgggccugcgcgauccgcgcgc

SEQ ID NO: 1198136 - RNA, 13 nt, Mycobacterium bovis subsp bovis AF2122/97
cgggccugaacca

SEQ ID NO: 1198137 - RNA, 18 nt, Mycobacterium bovis subsp bovis AF2122/97
cgggccuucagcucacca

SEQ ID NO: 1198138 - RNA, 16 nt, Mycobacterium bovis subsp bovis AF2122/97
cgggccuugcgcgcgc

SEQ ID NO: 1198139 - RNA, 16 nt, Mycobacterium bovis subsp bovis AF2122/97
cgggcgaccaccaccg

SEQ ID NO: 1198140 - RNA, 23 nt, Mycobacterium bovis subsp bovis AF2122/97
cgggcgaccaccaccgccgccga

SEQ ID NO: 1198141 - RNA, 17 nt, Mycobacterium bovis subsp bovis AF2122/97
cgggcgaaacgcccggg

SEQ ID NO: 1198142 - RNA, 21 nt, Mycobacterium bovis subsp bovis AF2122/97
cgggcacaccgcaccugggcg

SEQ ID NO: 1198143 - RNA, 21 nt, Mycobacterium bovis subsp bovis AF2122/97
cgggcaccaauaccgcacccg

SEQ ID NO: 1198144 - RNA, 16 nt, Mycobacterium bovis subsp bovis AF2122/97
cgggcacaccgcaccu

SEQ ID NO: 1198145 - RNA, 21 nt, Mycobacterium bovis subsp bovis AF2122/97
cgggcacaauaggcuccagcg

SEQ ID NO: 1198146 - RNA, 15 nt, Mycobacterium bovis subsp bovis AF2122/97
cgggcaccgcgcgcu

SEQ ID NO: 1198147 - RNA, 16 nt, Mycobacterium bovis subsp bovis AF2122/97
cgggcaccuggucggc

SEQ ID NO: 1198148 - RNA, 14 nt, Mycobacterium bovis subsp bovis AF2122/97
cgggcacgcgaggc

SEQ ID NO: 1198149 - RNA, 15 nt, Mycobacterium bovis subsp bovis AF2122/97
cgggcagcugggcag

SEQ ID NO: 1198150 - RNA, 18 nt, Mycobacterium bovis subsp bovis AF2122/97
cgggcagcuguucggcca

SEQ ID NO: 1198151 - RNA, 22 nt, Mycobacterium bovis subsp bovis AF2122/97
cgggcagcuguucggccaaccc

SEQ ID NO: 1198152 - RNA, 16 nt, Mycobacterium bovis subsp bovis AF2122/97
cgggcagcuggcgacg

SEQ ID NO: 1198153 - RNA, 14 nt, Mycobacterium bovis subsp bovis AF2122/97
cgggaagcgagcag

SEQ ID NO: 1198154 - RNA, 22 nt, Mycobacterium bovis subsp bovis AF2122/97
cgggaaggaaccgggcaaauca

SEQ ID NO: 1198155 - RNA, 13 nt, Mycobacterium bovis subsp bovis AF2122/97
cgggaagccgcau

SEQ ID NO: 1198156 - RNA, 21 nt, Mycobacterium bovis subsp bovis AF2122/97
cgggaagccgcaucuggcugu

SEQ ID NO: 1198157 - RNA, 11 nt, Mycobacterium bovis subsp bovis AF2122/97
cggcuuuugcg

SEQ ID NO: 1198158 - RNA, 16 nt, Mycobacterium bovis subsp bovis AF2122/97
cggcuuuuccggcauu

SEQ ID NO: 1198159 - RNA, 20 nt, Mycobacterium bovis subsp bovis AF2122/97
cgggcauaacccgcaccggg

SEQ ID NO: 1198160 - RNA, 21 nt, Mycobacterium bovis subsp bovis AF2122/97
cgggccaggcccucgacggcg

SEQ ID NO: 1198161 - RNA, 23 nt, Mycobacterium bovis subsp bovis AF2122/97
cgggccaucgcauccccagcaca

SEQ ID NO: 1198162 - RNA, 23 nt, Mycobacterium bovis subsp bovis AF2122/97
cgggcaguuguugacagacacag

SEQ ID NO: 1198163 - RNA, 18 nt, Mycobacterium bovis subsp bovis AF2122/97
cgggcaguucacgguuga

SEQ ID NO: 1198164 - RNA, 16 nt, Mycobacterium bovis subsp bovis AF2122/97
cgggcagugcgcggcg

SEQ ID NO: 1198165 - RNA, 15 nt, Mycobacterium bovis subsp bovis AF2122/97
cgggcaguccaggca

SEQ ID NO: 1198166 - RNA, 19 nt, Mycobacterium bovis subsp bovis AF2122/97
cgggcagcuucaacaccgg

SEQ ID NO: 1198167 - RNA, 17 nt, Mycobacterium bovis subsp bovis AF2122/97
cgggcaggccgcugggc

SEQ ID NO: 1198168 - RNA, 15 nt, Mycobacterium bovis subsp bovis AF2122/97
cgggcaggccgucga

SEQ ID NO: 1198169 - RNA, 14 nt, Mycobacterium bovis subsp bovis AF2122/97
cgggcccgcgcggc

SEQ ID NO: 1198170 - RNA, 19 nt, Mycobacterium bovis subsp bovis AF2122/97
cgggcccgccggccccgcc

SEQ ID NO: 1198171 - RNA, 17 nt, Mycobacterium bovis subsp bovis AF2122/97
cgggcccgacgcguggc

SEQ ID NO: 1198172 - RNA, 18 nt, Mycobacterium bovis subsp bovis AF2122/97
cgggccgaauaccacacc

SEQ ID NO: 1198173 - RNA, 22 nt, Mycobacterium bovis subsp bovis AF2122/97
cgggcccuccacugcgagcgcc

SEQ ID NO: 1198174 - RNA, 13 nt, Mycobacterium bovis subsp bovis AF2122/97
cgggcccuccggc

SEQ ID NO: 1198175 - RNA, 17 nt, Mycobacterium bovis subsp bovis AF2122/97
cgggcccgccggccccg

SEQ ID NO: 1198176 - RNA, 15 nt, Mycobacterium bovis subsp bovis AF2122/97
cgggccaugugggga

SEQ ID NO: 1198177 - RNA, 12 nt, Mycobacterium bovis subsp bovis AF2122/97
cgggcccagccg

SEQ ID NO: 1198178 - RNA, 22 nt, Mycobacterium bovis subsp bovis AF2122/97
cgggccauggguagccgcccag

SEQ ID NO: 1198179 - RNA, 23 nt, Mycobacterium bovis subsp bovis AF2122/97
cgggccauggguagccgcccagc

SEQ ID NO: 1198180 - RNA, 19 nt, Mycobacterium bovis subsp bovis AF2122/97
cggggucuugacggcgcca

SEQ ID NO: 1198181 - RNA, 16 nt, Mycobacterium bovis subsp bovis AF2122/97
cggggugagugaccac

SEQ ID NO: 1198182 - RNA, 13 nt, Mycobacterium bovis subsp bovis AF2122/97
cggggugcacacc

SEQ ID NO: 1198183 - RNA, 21 nt, Mycobacterium bovis subsp bovis AF2122/97
cggggugcacaccgucgcgcu

SEQ ID NO: 1198184 - RNA, 15 nt, Mycobacterium bovis subsp bovis AF2122/97
cggggugcagagcca

SEQ ID NO: 1198185 - RNA, 14 nt, Mycobacterium bovis subsp bovis AF2122/97
cgggguggcacgca

SEQ ID NO: 1198186 - RNA, 16 nt, Mycobacterium bovis subsp bovis AF2122/97
cgggguaguugaggcc

SEQ ID NO: 1198187 - RNA, 15 nt, Mycobacterium bovis subsp bovis AF2122/97
cgggguaggcccagc

SEQ ID NO: 1198188 - RNA, 18 nt, Mycobacterium bovis subsp bovis AF2122/97
cgggguaucgacccucca

SEQ ID NO: 1198189 - RNA, 20 nt, Mycobacterium bovis subsp bovis AF2122/97
cgggguaucgacccuccagc

SEQ ID NO: 1198190 - RNA, 18 nt, Mycobacterium bovis subsp bovis AF2122/97
cgggguccaucggggccg

SEQ ID NO: 1198191 - RNA, 12 nt, Mycobacterium bovis subsp bovis AF2122/97
cgggggcgcgcg

SEQ ID NO: 1198192 - RNA, 14 nt, Mycobacterium bovis subsp bovis AF2122/97
cgggucacccagau

SEQ ID NO: 1198193 - RNA, 19 nt, Mycobacterium bovis subsp bovis AF2122/97
cgggucacccccggccagc

SEQ ID NO: 1198194 - RNA, 20 nt, Mycobacterium bovis subsp bovis AF2122/97
cgggucaacgccaucacccc

SEQ ID NO: 1198195 - RNA, 13 nt, Mycobacterium bovis subsp bovis AF2122/97
cggguaggugacg

SEQ ID NO: 1198196 - RNA, 14 nt, Mycobacterium bovis subsp bovis AF2122/97
cggguagcucccug

SEQ ID NO: 1198197 - RNA, 22 nt, Mycobacterium bovis subsp bovis AF2122/97
cggguagccgucgaucccgguc

SEQ ID NO: 1198198 - RNA, 13 nt, Mycobacterium bovis subsp bovis AF2122/97
cgggguggcggca

SEQ ID NO: 1198199 - RNA, 20 nt, Mycobacterium bovis subsp bovis AF2122/97
cggggugggaaguagugcau

SEQ ID NO: 1198200 - RNA, 15 nt, Mycobacterium bovis subsp bovis AF2122/97
cggggugguggaagg

SEQ ID NO: 1198201 - RNA, 12 nt, Mycobacterium bovis subsp bovis AF2122/97
cgggggugcucg

SEQ ID NO: 1198202 - RNA, 15 nt, Mycobacterium bovis subsp bovis AF2122/97
cggggggcugcugcu

SEQ ID NO: 1198203 - RNA, 17 nt, Mycobacterium bovis subsp bovis AF2122/97
cgggggugggcgugacg

SEQ ID NO: 1198204 - RNA, 22 nt, Mycobacterium bovis subsp bovis AF2122/97
cgggggcuuuuacgucugcucg

SEQ ID NO: 1198205 - RNA, 13 nt, Mycobacterium bovis subsp bovis AF2122/97
cggggcgcccggc

SEQ ID NO: 1198206 - RNA, 17 nt, Mycobacterium bovis subsp bovis AF2122/97
cggggcgauccccagca

SEQ ID NO: 1198207 - RNA, 14 nt, Mycobacterium bovis subsp bovis AF2122/97
cgggcuggucgguc

SEQ ID NO: 1198208 - RNA, 22 nt, Mycobacterium bovis subsp bovis AF2122/97
cgggcugugaacagcgcgucgg

SEQ ID NO: 1198209 - RNA, 22 nt, Mycobacterium bovis subsp bovis AF2122/97
cgggcugugauccgacaguggc

SEQ ID NO: 1198210 - RNA, 19 nt, Mycobacterium bovis subsp bovis AF2122/97
cggggcgaacggcaccgcg

SEQ ID NO: 1198211 - RNA, 21 nt, Mycobacterium bovis subsp bovis AF2122/97
cggggcgacgauccgcacgau

SEQ ID NO: 1198212 - RNA, 12 nt, Mycobacterium bovis subsp bovis AF2122/97
cggggcgacgau

SEQ ID NO: 1198213 - RNA, 17 nt, Mycobacterium bovis subsp bovis AF2122/97
cgggcuugcgcagcagc

SEQ ID NO: 1198214 - RNA, 18 nt, Mycobacterium bovis subsp bovis AF2122/97
cgggcuccccaagucgac

SEQ ID NO: 1198215 - RNA, 22 nt, Mycobacterium bovis subsp bovis AF2122/97
cgggcuccccggauuccucguc

SEQ ID NO: 1198216 - RNA, 19 nt, Mycobacterium bovis subsp bovis AF2122/97
cgggcucaacaccagccgg

SEQ ID NO: 1198217 - RNA, 17 nt, Mycobacterium bovis subsp bovis AF2122/97
cgggcucguccagcaac

SEQ ID NO: 1198218 - RNA, 15 nt, Mycobacterium bovis subsp bovis AF2122/97
cgggcucggcgaagg

SEQ ID NO: 1198219 - RNA, 20 nt, Mycobacterium bovis subsp bovis AF2122/97
cgggcuccgugguugccgaa

SEQ ID NO: 1198220 - RNA, 12 nt, Mycobacterium bovis subsp bovis AF2122/97
cgggcucggcag

SEQ ID NO: 1198221 - RNA, 20 nt, Mycobacterium bovis subsp bovis AF2122/97
cgggcguugggaucgcgcag

SEQ ID NO: 1198222 - RNA, 21 nt, Mycobacterium bovis subsp bovis AF2122/97
cgggcguugggaucgcgcagc

SEQ ID NO: 1198223 - RNA, 15 nt, Mycobacterium bovis subsp bovis AF2122/97
cgggcgugugcaguc

SEQ ID NO: 1198224 - RNA, 16 nt, Mycobacterium bovis subsp bovis AF2122/97
cgggcuaccggcagcu

SEQ ID NO: 1198225 - RNA, 15 nt, Mycobacterium bovis subsp bovis AF2122/97
cgggcuaccggcagc

SEQ ID NO: 1198226 - RNA, 23 nt, Mycobacterium bovis subsp bovis AF2122/97
cgggcguucucgauugucgccgc

SEQ ID NO: 1198227 - RNA, 20 nt, Mycobacterium bovis subsp bovis AF2122/97
cgggcguugcccuccuucuc

SEQ ID NO: 1198228 - RNA, 22 nt, Mycobacterium bovis subsp bovis AF2122/97
cgggcguuuggacgggcgugcu

SEQ ID NO: 1198229 - RNA, 15 nt, Mycobacterium bovis subsp bovis AF2122/97
cgggcggugggcagc

SEQ ID NO: 1198230 - RNA, 16 nt, Mycobacterium bovis subsp bovis AF2122/97
cgggcggugggcagca

SEQ ID NO: 1198231 - RNA, 17 nt, Mycobacterium bovis subsp bovis AF2122/97
cgggcggugggcagcag

SEQ ID NO: 1198232 - RNA, 15 nt, Mycobacterium bovis subsp bovis AF2122/97
cgggcggggacggcg

SEQ ID NO: 1198233 - RNA, 18 nt, Mycobacterium bovis subsp bovis AF2122/97
cgggcgugggcaccccgc

SEQ ID NO: 1198234 - RNA, 15 nt, Mycobacterium bovis subsp bovis AF2122/97
cgggcgugggccgcu

SEQ ID NO: 1198235 - RNA, 19 nt, Mycobacterium bovis subsp bovis AF2122/97
cgggcgugggugucggcga

SEQ ID NO: 1198236 - RNA, 15 nt, Mycobacterium bovis subsp bovis AF2122/97
cgggcgugcucgccg

SEQ ID NO: 1198237 - RNA, 21 nt, Mycobacterium bovis subsp bovis AF2122/97
cgggcgugcuacacccguaga

SEQ ID NO: 1198238 - RNA, 16 nt, Mycobacterium bovis subsp bovis AF2122/97
cgggcgucccggcggu

SEQ ID NO: 1198239 - RNA, 16 nt, Mycobacterium bovis subsp bovis AF2122/97
cgggcguccgccggcg

SEQ ID NO: 1198240 - RNA, 22 nt, Mycobacterium bovis subsp bovis AF2122/97
cgggcgccaacgggcugccccu

SEQ ID NO: 1198241 - RNA, 13 nt, Mycobacterium bovis subsp bovis AF2122/97
cgggcgccccacc

SEQ ID NO: 1198242 - RNA, 17 nt, Mycobacterium bovis subsp bovis AF2122/97
cgggcgccaacgggcug

SEQ ID NO: 1198243 - RNA, 20 nt, Mycobacterium bovis subsp bovis AF2122/97
cgggcgcccuuaagccggcg

SEQ ID NO: 1198244 - RNA, 19 nt, Mycobacterium bovis subsp bovis AF2122/97
cgggcgccgguuacccgga

SEQ ID NO: 1198245 - RNA, 19 nt, Mycobacterium bovis subsp bovis AF2122/97
cgggcgccuuccaggcggg

SEQ ID NO: 1198246 - RNA, 19 nt, Mycobacterium bovis subsp bovis AF2122/97
cgggcgccuuggucgccgc

SEQ ID NO: 1198247 - RNA, 21 nt, Mycobacterium bovis subsp bovis AF2122/97
cgggcgccuuggucgccgccu

SEQ ID NO: 1198248 - RNA, 22 nt, Mycobacterium bovis subsp bovis AF2122/97
cgggcgccuuggucgccgccuu

SEQ ID NO: 1198249 - RNA, 20 nt, Mycobacterium bovis subsp bovis AF2122/97
cgggcgccuuggucgccgcu

SEQ ID NO: 1198250 - RNA, 20 nt, Mycobacterium bovis subsp bovis AF2122/97
cgggcgcgccggccaugccu

SEQ ID NO: 1198251 - RNA, 16 nt, Mycobacterium bovis subsp bovis AF2122/97
cgggcgcggggcggcc

SEQ ID NO: 1198252 - RNA, 12 nt, Mycobacterium bovis subsp bovis AF2122/97
cgggcgcggggc

SEQ ID NO: 1198253 - RNA, 18 nt, Mycobacterium bovis subsp bovis AF2122/97
cgggcgggauccacccag

SEQ ID NO: 1198254 - RNA, 16 nt, Mycobacterium bovis subsp bovis AF2122/97
cgggcggcgucugcgc

SEQ ID NO: 1198255 - RNA, 14 nt, Mycobacterium bovis subsp bovis AF2122/97
cgggcggccaccgc

SEQ ID NO: 1198256 - RNA, 15 nt, Mycobacterium bovis subsp bovis AF2122/97
cgggcggccauggca

SEQ ID NO: 1198257 - RNA, 16 nt, Mycobacterium bovis subsp bovis AF2122/97
cgggcgcuggacggcg

SEQ ID NO: 1198258 - RNA, 18 nt, Mycobacterium bovis subsp bovis AF2122/97
cgggcgcuguagucgcgc

SEQ ID NO: 1198259 - RNA, 21 nt, Mycobacterium bovis subsp bovis AF2122/97
cgggcgcuguagucgcgccuc

SEQ ID NO: 1198260 - RNA, 15 nt, Mycobacterium bovis subsp bovis AF2122/97
cgggcggaaacaagc

SEQ ID NO: 1198261 - RNA, 20 nt, Mycobacterium bovis subsp bovis AF2122/97
cgggcggaaagcccgucggg

SEQ ID NO: 1198262 - RNA, 20 nt, Mycobacterium bovis subsp bovis AF2122/97
cgggcgcuugcaccaggggc

SEQ ID NO: 1198263 - RNA, 16 nt, Mycobacterium bovis subsp bovis AF2122/97
cgcugcccgcgcggcc

SEQ ID NO: 1198264 - RNA, 17 nt, Mycobacterium bovis subsp bovis AF2122/97
cgcugccccgccgccau

SEQ ID NO: 1198265 - RNA, 20 nt, Mycobacterium bovis subsp bovis AF2122/97
cgcugcccacggagggcagg

SEQ ID NO: 1198266 - RNA, 15 nt, Mycobacterium bovis subsp bovis AF2122/97
cgcugccaucgccuu

SEQ ID NO: 1198267 - RNA, 14 nt, Mycobacterium bovis subsp bovis AF2122/97
cgcugcccaugcgg

SEQ ID NO: 1198268 - RNA, 15 nt, Mycobacterium bovis subsp bovis AF2122/97
cgcugcccaaaagcg

SEQ ID NO: 1198269 - RNA, 17 nt, Mycobacterium bovis subsp bovis AF2122/97
cgcugcccacgggccgg

SEQ ID NO: 1198270 - RNA, 16 nt, Mycobacterium bovis subsp bovis AF2122/97
cgcugauggugcugcg

SEQ ID NO: 1198271 - RNA, 20 nt, Mycobacterium bovis subsp bovis AF2122/97
cgcugauggugcugcggcgu

SEQ ID NO: 1198272 - RNA, 17 nt, Mycobacterium bovis subsp bovis AF2122/97
cgcugccagccguuccc

SEQ ID NO: 1198273 - RNA, 17 nt, Mycobacterium bovis subsp bovis AF2122/97
cgcugaucugccgccgc

SEQ ID NO: 1198274 - RNA, 20 nt, Mycobacterium bovis subsp bovis AF2122/97
cgcugaugagccgcagaugc

SEQ ID NO: 1198275 - RNA, 16 nt, Mycobacterium bovis subsp bovis AF2122/97
cgcugaugcaucccaa

SEQ ID NO: 1198276 - RNA, 22 nt, Mycobacterium bovis subsp bovis AF2122/97
cgcugaauuccacugcgccaca

SEQ ID NO: 1198277 - RNA, 18 nt, Mycobacterium bovis subsp bovis AF2122/97
cgcugaauuggcgccgau

SEQ ID NO: 1198278 - RNA, 19 nt, Mycobacterium bovis subsp bovis AF2122/97
cgcugaaucaccccggcgg

SEQ ID NO: 1198279 - RNA, 17 nt, Mycobacterium bovis subsp bovis AF2122/97
cgcugaggaagcggcgg

SEQ ID NO: 1198280 - RNA, 12 nt, Mycobacterium bovis subsp bovis AF2122/97
cgcugagcucga

SEQ ID NO: 1198281 - RNA, 19 nt, Mycobacterium bovis subsp bovis AF2122/97
cgcugaggaacccuccgga

SEQ ID NO: 1198282 - RNA, 19 nt, Mycobacterium bovis subsp bovis AF2122/97
cgcugaggaagcggcggca

SEQ ID NO: 1198283 - RNA, 11 nt, Mycobacterium bovis subsp bovis AF2122/97
cgcucagggug

SEQ ID NO: 1198284 - RNA, 19 nt, Mycobacterium bovis subsp bovis AF2122/97
cgcucggcguccgcccagc

SEQ ID NO: 1198285 - RNA, 17 nt, Mycobacterium bovis subsp bovis AF2122/97
cgcucgggcgagaucuu

SEQ ID NO: 1198286 - RNA, 18 nt, Mycobacterium bovis subsp bovis AF2122/97
cgcucgggguggucggcu

SEQ ID NO: 1198287 - RNA, 22 nt, Mycobacterium bovis subsp bovis AF2122/97
cgcucgguccccgcagcucgac

SEQ ID NO: 1198288 - RNA, 20 nt, Mycobacterium bovis subsp bovis AF2122/97
cgcucgguuugcguccuggu

SEQ ID NO: 1198289 - RNA, 16 nt, Mycobacterium bovis subsp bovis AF2122/97
cgcucguagacuuccu

SEQ ID NO: 1198290 - RNA, 22 nt, Mycobacterium bovis subsp bovis AF2122/97
cgcucguuagcggcgggcacgc

SEQ ID NO: 1198291 - RNA, 17 nt, Mycobacterium bovis subsp bovis AF2122/97
cgcucgucguccggcca

SEQ ID NO: 1198292 - RNA, 18 nt, Mycobacterium bovis subsp bovis AF2122/97
cgcucgucgcggcccgcg

SEQ ID NO: 1198293 - RNA, 20 nt, Mycobacterium bovis subsp bovis AF2122/97
cgcugaaguggcacaagcug

SEQ ID NO: 1198294 - RNA, 16 nt, Mycobacterium bovis subsp bovis AF2122/97
cgcucguuccggcggu

SEQ ID NO: 1198295 - RNA, 19 nt, Mycobacterium bovis subsp bovis AF2122/97
cgcucguugcguugcauca

SEQ ID NO: 1198296 - RNA, 14 nt, Mycobacterium bovis subsp bovis AF2122/97
cgcugccgacuccu

SEQ ID NO: 1198297 - RNA, 16 nt, Mycobacterium bovis subsp bovis AF2122/97
cgcugccgacuccucg

SEQ ID NO: 1198298 - RNA, 18 nt, Mycobacterium bovis subsp bovis AF2122/97
cgcugccgacuccucguc

SEQ ID NO: 1198299 - RNA, 22 nt, Mycobacterium bovis subsp bovis AF2122/97
cgcugccgcccuugccgcccgc

SEQ ID NO: 1198300 - RNA, 22 nt, Mycobacterium bovis subsp bovis AF2122/97
cgcugcgaucacccccuggacu

SEQ ID NO: 1198301 - RNA, 20 nt, Mycobacterium bovis subsp bovis AF2122/97
cgcugcgccaggucagcucc

SEQ ID NO: 1198302 - RNA, 21 nt, Mycobacterium bovis subsp bovis AF2122/97
cgcugcggcaccacccggcga

SEQ ID NO: 1198303 - RNA, 18 nt, Mycobacterium bovis subsp bovis AF2122/97
cgcugcggcccacaccag

SEQ ID NO: 1198304 - RNA, 19 nt, Mycobacterium bovis subsp bovis AF2122/97
cgcugcggcccacaccagc

SEQ ID NO: 1198305 - RNA, 12 nt, Mycobacterium bovis subsp bovis AF2122/97
cgcugcggcggu

SEQ ID NO: 1198306 - RNA, 15 nt, Mycobacterium bovis subsp bovis AF2122/97
cgcugcgggucccaa

SEQ ID NO: 1198307 - RNA, 16 nt, Mycobacterium bovis subsp bovis AF2122/97
cgcugcucacgcagca

SEQ ID NO: 1198308 - RNA, 17 nt, Mycobacterium bovis subsp bovis AF2122/97
cgcugcggugccggccc

SEQ ID NO: 1198309 - RNA, 16 nt, Mycobacterium bovis subsp bovis AF2122/97
cgcugcggugggccag

SEQ ID NO: 1198310 - RNA, 22 nt, Mycobacterium bovis subsp bovis AF2122/97
cgcugcucuuuuagccacaauc

SEQ ID NO: 1198311 - RNA, 13 nt, Mycobacterium bovis subsp bovis AF2122/97
cgcugcugccauu

SEQ ID NO: 1198312 - RNA, 13 nt, Mycobacterium bovis subsp bovis AF2122/97
cgcuggcgccgcc

SEQ ID NO: 1198313 - RNA, 14 nt, Mycobacterium bovis subsp bovis AF2122/97
cgcuggcgccgccg

SEQ ID NO: 1198314 - RNA, 11 nt, Mycobacterium bovis subsp bovis AF2122/97
cgcuggccacg

SEQ ID NO: 1198315 - RNA, 13 nt, Mycobacterium bovis subsp bovis AF2122/97
cgcuggccacgau

SEQ ID NO: 1198316 - RNA, 12 nt, Mycobacterium bovis subsp bovis AF2122/97
cgcuggcccgcc

SEQ ID NO: 1198317 - RNA, 20 nt, Mycobacterium bovis subsp bovis AF2122/97
cgcuggccgucgaagacgaa

SEQ ID NO: 1198318 - RNA, 13 nt, Mycobacterium bovis subsp bovis AF2122/97
cgcuggccuccug

SEQ ID NO: 1198319 - RNA, 15 nt, Mycobacterium bovis subsp bovis AF2122/97
cgcuggccuccugga

SEQ ID NO: 1198320 - RNA, 22 nt, Mycobacterium bovis subsp bovis AF2122/97
cgcuggccucgucgcugcccau

SEQ ID NO: 1198321 - RNA, 21 nt, Mycobacterium bovis subsp bovis AF2122/97
cgcuggcacacuccugcacca

SEQ ID NO: 1198322 - RNA, 15 nt, Mycobacterium bovis subsp bovis AF2122/97
cgcuggaggcuccug

SEQ ID NO: 1198323 - RNA, 18 nt, Mycobacterium bovis subsp bovis AF2122/97
cgcuggaggcuccugguc

SEQ ID NO: 1198324 - RNA, 21 nt, Mycobacterium bovis subsp bovis AF2122/97
cgcugcuggucuugccgugca

SEQ ID NO: 1198325 - RNA, 21 nt, Mycobacterium bovis subsp bovis AF2122/97
cgcugcuugaggucccgugcg

SEQ ID NO: 1198326 - RNA, 22 nt, Mycobacterium bovis subsp bovis AF2122/97
cgcugcuugaggucccgugcgc

SEQ ID NO: 1198327 - RNA, 15 nt, Mycobacterium bovis subsp bovis AF2122/97
cggaaacccggccgc

SEQ ID NO: 1198328 - RNA, 17 nt, Mycobacterium bovis subsp bovis AF2122/97
cggaaaccaucgccagc

SEQ ID NO: 1198329 - RNA, 22 nt, Mycobacterium bovis subsp bovis AF2122/97
cgcuugcaccaggggcgcguca

SEQ ID NO: 1198330 - RNA, 16 nt, Mycobacterium bovis subsp bovis AF2122/97
cgcuugauccacccga

SEQ ID NO: 1198331 - RNA, 12 nt, Mycobacterium bovis subsp bovis AF2122/97
cgcuugcauuga

SEQ ID NO: 1198332 - RNA, 17 nt, Mycobacterium bovis subsp bovis AF2122/97
cgcuugccccgccgagc

SEQ ID NO: 1198333 - RNA, 23 nt, Mycobacterium bovis subsp bovis AF2122/97
cgcuugccccgccgagcaccggg

SEQ ID NO: 1198334 - RNA, 14 nt, Mycobacterium bovis subsp bovis AF2122/97
cgcuggcgggcggc

SEQ ID NO: 1198335 - RNA, 23 nt, Mycobacterium bovis subsp bovis AF2122/97
cgcuggcuacgccuccuucguga

SEQ ID NO: 1198336 - RNA, 20 nt, Mycobacterium bovis subsp bovis AF2122/97
cgcuggcgggcacucagcag

SEQ ID NO: 1198337 - RNA, 13 nt, Mycobacterium bovis subsp bovis AF2122/97
cgcuggcggcgca

SEQ ID NO: 1198338 - RNA, 13 nt, Mycobacterium bovis subsp bovis AF2122/97
cgcugggcgccgu

SEQ ID NO: 1198339 - RNA, 18 nt, Mycobacterium bovis subsp bovis AF2122/97
cgcugggcgccguagccg

SEQ ID NO: 1198340 - RNA, 18 nt, Mycobacterium bovis subsp bovis AF2122/97
cgcugggcccaggagauc

SEQ ID NO: 1198341 - RNA, 16 nt, Mycobacterium bovis subsp bovis AF2122/97
cgcugggacggucgcu

SEQ ID NO: 1198342 - RNA, 16 nt, Mycobacterium bovis subsp bovis AF2122/97
cgcugggacgggcgcg

SEQ ID NO: 1198343 - RNA, 14 nt, Mycobacterium bovis subsp bovis AF2122/97
cgcuggucgagcag

SEQ ID NO: 1198344 - RNA, 18 nt, Mycobacterium bovis subsp bovis AF2122/97
cgcuggucgagcagugcc

SEQ ID NO: 1198345 - RNA, 19 nt, Mycobacterium bovis subsp bovis AF2122/97
cgcuggucggagaccagcg

SEQ ID NO: 1198346 - RNA, 15 nt, Mycobacterium bovis subsp bovis AF2122/97
cgcuggucggcggcu

SEQ ID NO: 1198347 - RNA, 15 nt, Mycobacterium bovis subsp bovis AF2122/97
cgcuggguggccgcu

SEQ ID NO: 1198348 - RNA, 22 nt, Mycobacterium bovis subsp bovis AF2122/97
cgcuggugcgccacgccaccgc

SEQ ID NO: 1198349 - RNA, 19 nt, Mycobacterium bovis subsp bovis AF2122/97
cgcugguggcgccaucccc

SEQ ID NO: 1198350 - RNA, 16 nt, Mycobacterium bovis subsp bovis AF2122/97
cgcuggucggcggcuu

SEQ ID NO: 1198351 - RNA, 14 nt, Mycobacterium bovis subsp bovis AF2122/97
cgcuguggcucgac

SEQ ID NO: 1198352 - RNA, 19 nt, Mycobacterium bovis subsp bovis AF2122/97
cgcuguugcuggcgccccc

SEQ ID NO: 1198353 - RNA, 15 nt, Mycobacterium bovis subsp bovis AF2122/97
cgcuguugaagccgc

SEQ ID NO: 1198354 - RNA, 14 nt, Mycobacterium bovis subsp bovis AF2122/97
cgcuguuccucgag

SEQ ID NO: 1198355 - RNA, 12 nt, Mycobacterium bovis subsp bovis AF2122/97
cgcugugcagcg

SEQ ID NO: 1198356 - RNA, 19 nt, Mycobacterium bovis subsp bovis AF2122/97
cgcugucguaccgcucggc

SEQ ID NO: 1198357 - RNA, 14 nt, Mycobacterium bovis subsp bovis AF2122/97
cgcugucggcagua

SEQ ID NO: 1198358 - RNA, 15 nt, Mycobacterium bovis subsp bovis AF2122/97
cgcuguaggccagcc

SEQ ID NO: 1198359 - RNA, 15 nt, Mycobacterium bovis subsp bovis AF2122/97
cgcugucccagcccg

SEQ ID NO: 1198360 - RNA, 21 nt, Mycobacterium bovis subsp bovis AF2122/97
cgcuguccgcgugaaucccca

SEQ ID NO: 1198361 - RNA, 14 nt, Mycobacterium bovis subsp bovis AF2122/97
cgcgggccagcacc

SEQ ID NO: 1198362 - RNA, 18 nt, Mycobacterium bovis subsp bovis AF2122/97
cgcgggcaguggcagccc

SEQ ID NO: 1198363 - RNA, 12 nt, Mycobacterium bovis subsp bovis AF2122/97
cgcgggccacca

SEQ ID NO: 1198364 - RNA, 13 nt, Mycobacterium bovis subsp bovis AF2122/97
cgcgggccaccac

SEQ ID NO: 1198365 - RNA, 18 nt, Mycobacterium bovis subsp bovis AF2122/97
cgcgggccagcaccucga

SEQ ID NO: 1198366 - RNA, 22 nt, Mycobacterium bovis subsp bovis AF2122/97
cgcgggccaccacgcgccgcac

SEQ ID NO: 1198367 - RNA, 16 nt, Mycobacterium bovis subsp bovis AF2122/97
cgcgggccgacgcagg

SEQ ID NO: 1198368 - RNA, 14 nt, Mycobacterium bovis subsp bovis AF2122/97
cgcgggccuggccc

SEQ ID NO: 1198369 - RNA, 12 nt, Mycobacterium bovis subsp bovis AF2122/97
cgcggggccgga

SEQ ID NO: 1198370 - RNA, 12 nt, Mycobacterium bovis subsp bovis AF2122/97
cgcggggccggc

SEQ ID NO: 1198371 - RNA, 13 nt, Mycobacterium bovis subsp bovis AF2122/97
cgcggggccggcc

SEQ ID NO: 1198372 - RNA, 13 nt, Mycobacterium bovis subsp bovis AF2122/97
cgcgggggcggcc

SEQ ID NO: 1198373 - RNA, 14 nt, Mycobacterium bovis subsp bovis AF2122/97
cgcggggcucaacc

SEQ ID NO: 1198374 - RNA, 20 nt, Mycobacterium bovis subsp bovis AF2122/97
cgcgggcgaccaccgcggca

SEQ ID NO: 1198375 - RNA, 22 nt, Mycobacterium bovis subsp bovis AF2122/97
cgcgggggugggcgugacgggc

SEQ ID NO: 1198376 - RNA, 21 nt, Mycobacterium bovis subsp bovis AF2122/97
cgcggggucugucgaacuggu

SEQ ID NO: 1198377 - RNA, 16 nt, Mycobacterium bovis subsp bovis AF2122/97
cgcggggugcgcgcga

SEQ ID NO: 1198378 - RNA, 20 nt, Mycobacterium bovis subsp bovis AF2122/97
cgcggguguuccacaccagg

SEQ ID NO: 1198379 - RNA, 23 nt, Mycobacterium bovis subsp bovis AF2122/97
cgcggguuacccgcagcgugccc

SEQ ID NO: 1198380 - RNA, 23 nt, Mycobacterium bovis subsp bovis AF2122/97
cgcggguuugaucuccaccuucu

SEQ ID NO: 1198381 - RNA, 15 nt, Mycobacterium bovis subsp bovis AF2122/97
cgcgguaaagccccg

SEQ ID NO: 1198382 - RNA, 19 nt, Mycobacterium bovis subsp bovis AF2122/97
cgcgggucguccggcggca

SEQ ID NO: 1198383 - RNA, 19 nt, Mycobacterium bovis subsp bovis AF2122/97
cgcgggucgugccagcagc

SEQ ID NO: 1198384 - RNA, 13 nt, Mycobacterium bovis subsp bovis AF2122/97
cgcgggucccggc

SEQ ID NO: 1198385 - RNA, 14 nt, Mycobacterium bovis subsp bovis AF2122/97
cgcgggugccgggc

SEQ ID NO: 1198386 - RNA, 19 nt, Mycobacterium bovis subsp bovis AF2122/97
cgcgggugccgggcaugau

SEQ ID NO: 1198387 - RNA, 17 nt, Mycobacterium bovis subsp bovis AF2122/97
cgcggguguuccacacc

SEQ ID NO: 1198388 - RNA, 18 nt, Mycobacterium bovis subsp bovis AF2122/97
cgcggcgauuacggccag

SEQ ID NO: 1198389 - RNA, 13 nt, Mycobacterium bovis subsp bovis AF2122/97
cgcggcgcagcac

SEQ ID NO: 1198390 - RNA, 13 nt, Mycobacterium bovis subsp bovis AF2122/97
cgcggcgccagau

SEQ ID NO: 1198391 - RNA, 17 nt, Mycobacterium bovis subsp bovis AF2122/97
cgcggcgcaggucgcgc

SEQ ID NO: 1198392 - RNA, 16 nt, Mycobacterium bovis subsp bovis AF2122/97
cgcggcgcccggcgga

SEQ ID NO: 1198393 - RNA, 17 nt, Mycobacterium bovis subsp bovis AF2122/97
cgcggcgcccuggccgc

SEQ ID NO: 1198394 - RNA, 21 nt, Mycobacterium bovis subsp bovis AF2122/97
cgcggcgccauagccgcgacc

SEQ ID NO: 1198395 - RNA, 14 nt, Mycobacterium bovis subsp bovis AF2122/97
cgcggcgcccagga

SEQ ID NO: 1198396 - RNA, 13 nt, Mycobacterium bovis subsp bovis AF2122/97
cgcggcgccgcca

SEQ ID NO: 1198397 - RNA, 18 nt, Mycobacterium bovis subsp bovis AF2122/97
cgcggcgcgcaggaccug

SEQ ID NO: 1198398 - RNA, 13 nt, Mycobacterium bovis subsp bovis AF2122/97
cgcggcgcggccg

SEQ ID NO: 1198399 - RNA, 14 nt, Mycobacterium bovis subsp bovis AF2122/97
cgcggcgcggccgc

SEQ ID NO: 1198400 - RNA, 15 nt, Mycobacterium bovis subsp bovis AF2122/97
cgcggcgcggccgca

SEQ ID NO: 1198401 - RNA, 22 nt, Mycobacterium bovis subsp bovis AF2122/97
cgcggcgcguccgggcucgcgc

SEQ ID NO: 1198402 - RNA, 17 nt, Mycobacterium bovis subsp bovis AF2122/97
cgcggcuauggcgccgc

SEQ ID NO: 1198403 - RNA, 17 nt, Mycobacterium bovis subsp bovis AF2122/97
cgcggcucaaucuccuc

SEQ ID NO: 1198404 - RNA, 22 nt, Mycobacterium bovis subsp bovis AF2122/97
cgcggcugugcccgaucagccg

SEQ ID NO: 1198405 - RNA, 19 nt, Mycobacterium bovis subsp bovis AF2122/97
cgcggccaaucagcccgcc

SEQ ID NO: 1198406 - RNA, 23 nt, Mycobacterium bovis subsp bovis AF2122/97
cgcggccacaccuuggccgccgg

SEQ ID NO: 1198407 - RNA, 23 nt, Mycobacterium bovis subsp bovis AF2122/97
cgcggccacaucgccagcagcaa

SEQ ID NO: 1198408 - RNA, 21 nt, Mycobacterium bovis subsp bovis AF2122/97
cgcggccacaugaucgagcag

SEQ ID NO: 1198409 - RNA, 11 nt, Mycobacterium bovis subsp bovis AF2122/97
cgcggccacca

SEQ ID NO: 1198410 - RNA, 15 nt, Mycobacterium bovis subsp bovis AF2122/97
cgcggccaccaccgc

SEQ ID NO: 1198411 - RNA, 21 nt, Mycobacterium bovis subsp bovis AF2122/97
cgcggcccgcucgaucggcag

SEQ ID NO: 1198412 - RNA, 16 nt, Mycobacterium bovis subsp bovis AF2122/97
cgcggccgcagccagc

SEQ ID NO: 1198413 - RNA, 18 nt, Mycobacterium bovis subsp bovis AF2122/97
cgcggccgcagccagcaa

SEQ ID NO: 1198414 - RNA, 13 nt, Mycobacterium bovis subsp bovis AF2122/97
cgcggccgccagc

SEQ ID NO: 1198415 - RNA, 12 nt, Mycobacterium bovis subsp bovis AF2122/97
cgcggccgcccc

SEQ ID NO: 1198416 - RNA, 15 nt, Mycobacterium bovis subsp bovis AF2122/97
cgcggccgccguccc

SEQ ID NO: 1198417 - RNA, 19 nt, Mycobacterium bovis subsp bovis AF2122/97
cgcggccgccguccccgcc

SEQ ID NO: 1198418 - RNA, 21 nt, Mycobacterium bovis subsp bovis AF2122/97
cgcggccggaauacccggccc

SEQ ID NO: 1198419 - RNA, 16 nt, Mycobacterium bovis subsp bovis AF2122/97
cgcggccggcgugcca

SEQ ID NO: 1198420 - RNA, 16 nt, Mycobacterium bovis subsp bovis AF2122/97
cgcggccggcacgacc

SEQ ID NO: 1198421 - RNA, 15 nt, Mycobacterium bovis subsp bovis AF2122/97
cgcggccggccgccc

SEQ ID NO: 1198422 - RNA, 12 nt, Mycobacterium bovis subsp bovis AF2122/97
cgcggccgggcc

SEQ ID NO: 1198423 - RNA, 17 nt, Mycobacterium bovis subsp bovis AF2122/97
cgcggccguggaugucg

SEQ ID NO: 1198424 - RNA, 20 nt, Mycobacterium bovis subsp bovis AF2122/97
cgcggccguggaugucgcgg

SEQ ID NO: 1198425 - RNA, 16 nt, Mycobacterium bovis subsp bovis AF2122/97
cgcggcgagcuccgau

SEQ ID NO: 1198426 - RNA, 15 nt, Mycobacterium bovis subsp bovis AF2122/97
cgcggccgugguggu

SEQ ID NO: 1198427 - RNA, 13 nt, Mycobacterium bovis subsp bovis AF2122/97
cgcgccggcggca

SEQ ID NO: 1198428 - RNA, 12 nt, Mycobacterium bovis subsp bovis AF2122/97
cgcgccggcggu

SEQ ID NO: 1198429 - RNA, 22 nt, Mycobacterium bovis subsp bovis AF2122/97
cgcgccggcgggcgcgggcgcc

SEQ ID NO: 1198430 - RNA, 22 nt, Mycobacterium bovis subsp bovis AF2122/97
cgcggaucgaccgccagcgccg

SEQ ID NO: 1198431 - RNA, 13 nt, Mycobacterium bovis subsp bovis AF2122/97
cgcgccggccgcu

SEQ ID NO: 1198432 - RNA, 21 nt, Mycobacterium bovis subsp bovis AF2122/97
cgcgccgcggcccgcuccacg

SEQ ID NO: 1198433 - RNA, 17 nt, Mycobacterium bovis subsp bovis AF2122/97
cgcgccgcuaaccggac

SEQ ID NO: 1198434 - RNA, 18 nt, Mycobacterium bovis subsp bovis AF2122/97
cgcggauccgggcguggu

SEQ ID NO: 1198435 - RNA, 15 nt, Mycobacterium bovis subsp bovis AF2122/97
cgcggaugcauguca

SEQ ID NO: 1198436 - RNA, 18 nt, Mycobacterium bovis subsp bovis AF2122/97
cgcggcaucgacgcggcc

SEQ ID NO: 1198437 - RNA, 12 nt, Mycobacterium bovis subsp bovis AF2122/97
cgcggcagggcg

SEQ ID NO: 1198438 - RNA, 13 nt, Mycobacterium bovis subsp bovis AF2122/97
cgcggcaggccug

SEQ ID NO: 1198439 - RNA, 16 nt, Mycobacterium bovis subsp bovis AF2122/97
cgcucacugcagcgcc

SEQ ID NO: 1198440 - RNA, 19 nt, Mycobacterium bovis subsp bovis AF2122/97
cgcucagccguccgggcgg

SEQ ID NO: 1198441 - RNA, 19 nt, Mycobacterium bovis subsp bovis AF2122/97
cgcuauggcccgggccgaa

SEQ ID NO: 1198442 - RNA, 18 nt, Mycobacterium bovis subsp bovis AF2122/97
cgcuauggcggcuucgac

SEQ ID NO: 1198443 - RNA, 13 nt, Mycobacterium bovis subsp bovis AF2122/97
cgcuacgcggccg

SEQ ID NO: 1198444 - RNA, 22 nt, Mycobacterium bovis subsp bovis AF2122/97
cgcuaccgucaguagccacgcc

SEQ ID NO: 1198445 - RNA, 21 nt, Mycobacterium bovis subsp bovis AF2122/97
cgcuacgcaacgggucggguc

SEQ ID NO: 1198446 - RNA, 15 nt, Mycobacterium bovis subsp bovis AF2122/97
cgcuaccuucuuggc

SEQ ID NO: 1198447 - RNA, 16 nt, Mycobacterium bovis subsp bovis AF2122/97
cgcuaccuucuuggcu

SEQ ID NO: 1198448 - RNA, 15 nt, Mycobacterium bovis subsp bovis AF2122/97
cgcuauccggcggcc

SEQ ID NO: 1198449 - RNA, 17 nt, Mycobacterium bovis subsp bovis AF2122/97
cgcgugcgcaucccgaa

SEQ ID NO: 1198450 - RNA, 17 nt, Mycobacterium bovis subsp bovis AF2122/97
cgcgugccgcccgccuc

SEQ ID NO: 1198451 - RNA, 14 nt, Mycobacterium bovis subsp bovis AF2122/97
cgcgugccacagca

SEQ ID NO: 1198452 - RNA, 14 nt, Mycobacterium bovis subsp bovis AF2122/97
cgcgugcaggcugu

SEQ ID NO: 1198453 - RNA, 20 nt, Mycobacterium bovis subsp bovis AF2122/97
cgcgugcggcugccagugcc

SEQ ID NO: 1198454 - RNA, 16 nt, Mycobacterium bovis subsp bovis AF2122/97
cgcgugcggcugccag

SEQ ID NO: 1198455 - RNA, 17 nt, Mycobacterium bovis subsp bovis AF2122/97
cgcgucgcgcgcggcau

SEQ ID NO: 1198456 - RNA, 21 nt, Mycobacterium bovis subsp bovis AF2122/97
cgcgucgcgaaaggccacgau

SEQ ID NO: 1198457 - RNA, 17 nt, Mycobacterium bovis subsp bovis AF2122/97
cgcgugacgaccagccc

SEQ ID NO: 1198458 - RNA, 20 nt, Mycobacterium bovis subsp bovis AF2122/97
cgcgugcagcggcgccgcca

SEQ ID NO: 1198459 - RNA, 21 nt, Mycobacterium bovis subsp bovis AF2122/97
cgcuaccgcccgcgccaccgg

SEQ ID NO: 1198460 - RNA, 12 nt, Mycobacterium bovis subsp bovis AF2122/97
cgcuacccccga

SEQ ID NO: 1198461 - RNA, 15 nt, Mycobacterium bovis subsp bovis AF2122/97
cgcuacccccgaugg

SEQ ID NO: 1198462 - RNA, 22 nt, Mycobacterium bovis subsp bovis AF2122/97
cgcuaacagauuguccggccgg

SEQ ID NO: 1198463 - RNA, 17 nt, Mycobacterium bovis subsp bovis AF2122/97
cgcgugcucgagcaccu

SEQ ID NO: 1198464 - RNA, 17 nt, Mycobacterium bovis subsp bovis AF2122/97
cgcguuugcgaagccca

SEQ ID NO: 1198465 - RNA, 16 nt, Mycobacterium bovis subsp bovis AF2122/97
cgcgguuucggcguca

SEQ ID NO: 1198466 - RNA, 20 nt, Mycobacterium bovis subsp bovis AF2122/97
cgcgguuguccuccgacggg

SEQ ID NO: 1198467 - RNA, 12 nt, Mycobacterium bovis subsp bovis AF2122/97
cgcggucgcgcg

SEQ ID NO: 1198468 - RNA, 11 nt, Mycobacterium bovis subsp bovis AF2122/97
cgcgucaucaa

SEQ ID NO: 1198469 - RNA, 16 nt, Mycobacterium bovis subsp bovis AF2122/97
cgcgguuucgggccga

SEQ ID NO: 1198470 - RNA, 15 nt, Mycobacterium bovis subsp bovis AF2122/97
cgcgucaggccagcg

SEQ ID NO: 1198471 - RNA, 13 nt, Mycobacterium bovis subsp bovis AF2122/97
cgcgucccgccgc

SEQ ID NO: 1198472 - RNA, 20 nt, Mycobacterium bovis subsp bovis AF2122/97
cgcguccccagcgccaccgu

SEQ ID NO: 1198473 - RNA, 20 nt, Mycobacterium bovis subsp bovis AF2122/97
cgcguccggugcaccaggua

SEQ ID NO: 1198474 - RNA, 21 nt, Mycobacterium bovis subsp bovis AF2122/97
cgcguccgggcucgcgcucga

SEQ ID NO: 1198475 - RNA, 15 nt, Mycobacterium bovis subsp bovis AF2122/97
cgcgucgaagccggg

SEQ ID NO: 1198476 - RNA, 13 nt, Mycobacterium bovis subsp bovis AF2122/97
cgcgucgccaggc

SEQ ID NO: 1198477 - RNA, 20 nt, Mycobacterium bovis subsp bovis AF2122/97
cgcgucgagcgacccccagc

SEQ ID NO: 1198478 - RNA, 18 nt, Mycobacterium bovis subsp bovis AF2122/97
cgcgucgagcgccggccg

SEQ ID NO: 1198479 - RNA, 19 nt, Mycobacterium bovis subsp bovis AF2122/97
cgcggucggaccacccggc

SEQ ID NO: 1198480 - RNA, 14 nt, Mycobacterium bovis subsp bovis AF2122/97
cgcggucggcagcg

SEQ ID NO: 1198481 - RNA, 20 nt, Mycobacterium bovis subsp bovis AF2122/97
cgcggucggcagcgacgccg

SEQ ID NO: 1198482 - RNA, 17 nt, Mycobacterium bovis subsp bovis AF2122/97
cgcggucggccaccaac

SEQ ID NO: 1198483 - RNA, 18 nt, Mycobacterium bovis subsp bovis AF2122/97
cgcggucgauguccgcag

SEQ ID NO: 1198484 - RNA, 15 nt, Mycobacterium bovis subsp bovis AF2122/97
cgcggucggcgugca

SEQ ID NO: 1198485 - RNA, 14 nt, Mycobacterium bovis subsp bovis AF2122/97
cgcggucggcggcc

SEQ ID NO: 1198486 - RNA, 16 nt, Mycobacterium bovis subsp bovis AF2122/97
cgcggucggcggccgc

SEQ ID NO: 1198487 - RNA, 16 nt, Mycobacterium bovis subsp bovis AF2122/97
cgcggugacggcggcu

SEQ ID NO: 1198488 - RNA, 20 nt, Mycobacterium bovis subsp bovis AF2122/97
cgcggugacgagccaccacc

SEQ ID NO: 1198489 - RNA, 15 nt, Mycobacterium bovis subsp bovis AF2122/97
cgcggugacgccagc

SEQ ID NO: 1198490 - RNA, 18 nt, Mycobacterium bovis subsp bovis AF2122/97
cgcggucugcuccaggcg

SEQ ID NO: 1198491 - RNA, 22 nt, Mycobacterium bovis subsp bovis AF2122/97
cgcggucugcuccaggcgcgcc

SEQ ID NO: 1198492 - RNA, 23 nt, Mycobacterium bovis subsp bovis AF2122/97
cgcggucugcuccaggcgcgccg

SEQ ID NO: 1198493 - RNA, 16 nt, Mycobacterium bovis subsp bovis AF2122/97
cgcgguagcucgucga

SEQ ID NO: 1198494 - RNA, 19 nt, Mycobacterium bovis subsp bovis AF2122/97
cgcggucaaauccagcagc

SEQ ID NO: 1198495 - RNA, 18 nt, Mycobacterium bovis subsp bovis AF2122/97
cgcggucagcucggcagc

SEQ ID NO: 1198496 - RNA, 19 nt, Mycobacterium bovis subsp bovis AF2122/97
cgcggucagcucggcagca

SEQ ID NO: 1198497 - RNA, 20 nt, Mycobacterium bovis subsp bovis AF2122/97
cgcggucgagguccuugagg

SEQ ID NO: 1198498 - RNA, 16 nt, Mycobacterium bovis subsp bovis AF2122/97
cggcaucggugguaac

SEQ ID NO: 1198499 - RNA, 15 nt, Mycobacterium bovis subsp bovis AF2122/97
cggccagcagcagau

SEQ ID NO: 1198500 - RNA, 18 nt, Mycobacterium bovis subsp bovis AF2122/97
cggcaucggcggcaaggg

SEQ ID NO: 1198501 - RNA, 14 nt, Mycobacterium bovis subsp bovis AF2122/97
cggcaucggcgacg

SEQ ID NO: 1198502 - RNA, 16 nt, Mycobacterium bovis subsp bovis AF2122/97
cggcaucgcgagcugc

SEQ ID NO: 1198503 - RNA, 18 nt, Mycobacterium bovis subsp bovis AF2122/97
cggcaucgcgggcggcgc

SEQ ID NO: 1198504 - RNA, 21 nt, Mycobacterium bovis subsp bovis AF2122/97
cggcaucggagauacgggcca

SEQ ID NO: 1198505 - RNA, 15 nt, Mycobacterium bovis subsp bovis AF2122/97
cggcaucggccagcc

SEQ ID NO: 1198506 - RNA, 16 nt, Mycobacterium bovis subsp bovis AF2122/97
cggcaucaacgcgggc

SEQ ID NO: 1198507 - RNA, 19 nt, Mycobacterium bovis subsp bovis AF2122/97
cggcaucaacgcgggcgcu

SEQ ID NO: 1198508 - RNA, 20 nt, Mycobacterium bovis subsp bovis AF2122/97
cggcaucgagacgcacggcc

SEQ ID NO: 1198509 - RNA, 17 nt, Mycobacterium bovis subsp bovis AF2122/97
cggcaucgacugccagc

SEQ ID NO: 1198510 - RNA, 13 nt, Mycobacterium bovis subsp bovis AF2122/97
cggcaucgagcag

SEQ ID NO: 1198511 - RNA, 20 nt, Mycobacterium bovis subsp bovis AF2122/97
cggcaucgccgagguggaca

SEQ ID NO: 1198512 - RNA, 18 nt, Mycobacterium bovis subsp bovis AF2122/97
cggccagccgacgcggcg

SEQ ID NO: 1198513 - RNA, 13 nt, Mycobacterium bovis subsp bovis AF2122/97
cggccagccgcac

SEQ ID NO: 1198514 - RNA, 13 nt, Mycobacterium bovis subsp bovis AF2122/97
cggccagccgcuc

SEQ ID NO: 1198515 - RNA, 14 nt, Mycobacterium bovis subsp bovis AF2122/97
cggccagccucauc

SEQ ID NO: 1198516 - RNA, 14 nt, Mycobacterium bovis subsp bovis AF2122/97
cggccagcgcaccg

SEQ ID NO: 1198517 - RNA, 16 nt, Mycobacterium bovis subsp bovis AF2122/97
cggccagccagcgauc

SEQ ID NO: 1198518 - RNA, 21 nt, Mycobacterium bovis subsp bovis AF2122/97
cggccagcauuagccaggccc

SEQ ID NO: 1198519 - RNA, 14 nt, Mycobacterium bovis subsp bovis AF2122/97
cggccagcagugcg

SEQ ID NO: 1198520 - RNA, 12 nt, Mycobacterium bovis subsp bovis AF2122/97
cggccagcagcg

SEQ ID NO: 1198521 - RNA, 14 nt, Mycobacterium bovis subsp bovis AF2122/97
cggccagcgcccgc

SEQ ID NO: 1198522 - RNA, 19 nt, Mycobacterium bovis subsp bovis AF2122/97
cggccaggucgacaccgcg

SEQ ID NO: 1198523 - RNA, 20 nt, Mycobacterium bovis subsp bovis AF2122/97
cggccaggucgagcaccggc

SEQ ID NO: 1198524 - RNA, 16 nt, Mycobacterium bovis subsp bovis AF2122/97
cggccaguccgcgcgc

SEQ ID NO: 1198525 - RNA, 23 nt, Mycobacterium bovis subsp bovis AF2122/97
cggccagucaggaaaccggcgcg

SEQ ID NO: 1198526 - RNA, 16 nt, Mycobacterium bovis subsp bovis AF2122/97
cggccaguccaagcug

SEQ ID NO: 1198527 - RNA, 17 nt, Mycobacterium bovis subsp bovis AF2122/97
cggcccaccggucgcgc

SEQ ID NO: 1198528 - RNA, 14 nt, Mycobacterium bovis subsp bovis AF2122/97
cggcccaccggcca

SEQ ID NO: 1198529 - RNA, 12 nt, Mycobacterium bovis subsp bovis AF2122/97
cggcccagcccu

SEQ ID NO: 1198530 - RNA, 18 nt, Mycobacterium bovis subsp bovis AF2122/97
cggcccacuucccaggau

SEQ ID NO: 1198531 - RNA, 22 nt, Mycobacterium bovis subsp bovis AF2122/97
cggccaguucggcggccgccgc

SEQ ID NO: 1198532 - RNA, 16 nt, Mycobacterium bovis subsp bovis AF2122/97
cggccauugcccgggc

SEQ ID NO: 1198533 - RNA, 16 nt, Mycobacterium bovis subsp bovis AF2122/97
cggccauguagccguu

SEQ ID NO: 1198534 - RNA, 18 nt, Mycobacterium bovis subsp bovis AF2122/97
cggccauuagcagcaccc

SEQ ID NO: 1198535 - RNA, 14 nt, Mycobacterium bovis subsp bovis AF2122/97
cggcccgccucggc

SEQ ID NO: 1198536 - RNA, 20 nt, Mycobacterium bovis subsp bovis AF2122/97
cggcccgccguccggcgccc

SEQ ID NO: 1198537 - RNA, 20 nt, Mycobacterium bovis subsp bovis AF2122/97
cggcccgcagcccgccgggc

SEQ ID NO: 1198538 - RNA, 23 nt, Mycobacterium bovis subsp bovis AF2122/97
cggcccgccaaaaacgccccggc

SEQ ID NO: 1198539 - RNA, 20 nt, Mycobacterium bovis subsp bovis AF2122/97
cggcccgcauccgcaccgaa

SEQ ID NO: 1198540 - RNA, 15 nt, Mycobacterium bovis subsp bovis AF2122/97
cggcccgcagcagca

SEQ ID NO: 1198541 - RNA, 15 nt, Mycobacterium bovis subsp bovis AF2122/97
cggcccgcucagccg

SEQ ID NO: 1198542 - RNA, 13 nt, Mycobacterium bovis subsp bovis AF2122/97
cggcccgcuccac

SEQ ID NO: 1198543 - RNA, 17 nt, Mycobacterium bovis subsp bovis AF2122/97
cggcccgcucaccuugg

SEQ ID NO: 1198544 - RNA, 13 nt, Mycobacterium bovis subsp bovis AF2122/97
cggcccgcucagc

SEQ ID NO: 1198545 - RNA, 12 nt, Mycobacterium bovis subsp bovis AF2122/97
cggcccgcgggc

SEQ ID NO: 1198546 - RNA, 16 nt, Mycobacterium bovis subsp bovis AF2122/97
cggcccgaggcucggg

SEQ ID NO: 1198547 - RNA, 22 nt, Mycobacterium bovis subsp bovis AF2122/97
cggcccgaggugccggggcccc

SEQ ID NO: 1198548 - RNA, 17 nt, Mycobacterium bovis subsp bovis AF2122/97
cggccccgccagcgccg

SEQ ID NO: 1198549 - RNA, 22 nt, Mycobacterium bovis subsp bovis AF2122/97
cggccccgacauacgucggggc

SEQ ID NO: 1198550 - RNA, 18 nt, Mycobacterium bovis subsp bovis AF2122/97
cggccccgacugccgcgg

SEQ ID NO: 1198551 - RNA, 14 nt, Mycobacterium bovis subsp bovis AF2122/97
cggcccccggcagc

SEQ ID NO: 1198552 - RNA, 23 nt, Mycobacterium bovis subsp bovis AF2122/97
cggcccccgacuccggcaggccc

SEQ ID NO: 1198553 - RNA, 17 nt, Mycobacterium bovis subsp bovis AF2122/97
cggcccccgagaggcac

SEQ ID NO: 1198554 - RNA, 20 nt, Mycobacterium bovis subsp bovis AF2122/97
cggccccgccggcgccgccc

SEQ ID NO: 1198555 - RNA, 19 nt, Mycobacterium bovis subsp bovis AF2122/97
cggccccgccgccggugcg

SEQ ID NO: 1198556 - RNA, 18 nt, Mycobacterium bovis subsp bovis AF2122/97
cggccccgccggccccgc

SEQ ID NO: 1198557 - RNA, 13 nt, Mycobacterium bovis subsp bovis AF2122/97
cggccccggccgc

SEQ ID NO: 1198558 - RNA, 16 nt, Mycobacterium bovis subsp bovis AF2122/97
cggccccggccgcguc

SEQ ID NO: 1198559 - RNA, 14 nt, Mycobacterium bovis subsp bovis AF2122/97
cggccccggccgcg

SEQ ID NO: 1198560 - RNA, 16 nt, Mycobacterium bovis subsp bovis AF2122/97
cggccgacaacccggc

SEQ ID NO: 1198561 - RNA, 19 nt, Mycobacterium bovis subsp bovis AF2122/97
cggccgacacgccgaugcc

SEQ ID NO: 1198562 - RNA, 15 nt, Mycobacterium bovis subsp bovis AF2122/97
cggccgacacgccga

SEQ ID NO: 1198563 - RNA, 17 nt, Mycobacterium bovis subsp bovis AF2122/97
cggccgaaucuccgccg

SEQ ID NO: 1198564 - RNA, 15 nt, Mycobacterium bovis subsp bovis AF2122/97
cggccgaccgcgacc

SEQ ID NO: 1198565 - RNA, 13 nt, Mycobacterium bovis subsp bovis AF2122/97
cggccgagcgcac

SEQ ID NO: 1198566 - RNA, 23 nt, Mycobacterium bovis subsp bovis AF2122/97
cggccgacucggucucauagugc

SEQ ID NO: 1198567 - RNA, 23 nt, Mycobacterium bovis subsp bovis AF2122/97
cggccgagucgauugccaccgag

SEQ ID NO: 1198568 - RNA, 18 nt, Mycobacterium bovis subsp bovis AF2122/97
cggccgaggucacccggu

SEQ ID NO: 1198569 - RNA, 20 nt, Mycobacterium bovis subsp bovis AF2122/97
cggccgaggaccagaggcgc

SEQ ID NO: 1198570 - RNA, 17 nt, Mycobacterium bovis subsp bovis AF2122/97
cggccgagcgcaccgcu

SEQ ID NO: 1198571 - RNA, 17 nt, Mycobacterium bovis subsp bovis AF2122/97
cggccgaugcgacccgc

SEQ ID NO: 1198572 - RNA, 18 nt, Mycobacterium bovis subsp bovis AF2122/97
cggccgaugcgcagugca

SEQ ID NO: 1198573 - RNA, 23 nt, Mycobacterium bovis subsp bovis AF2122/97
cggccgauacagaucuggguucc

SEQ ID NO: 1198574 - RNA, 18 nt, Mycobacterium bovis subsp bovis AF2122/97
cggccgcaaggcgccgau

SEQ ID NO: 1198575 - RNA, 15 nt, Mycobacterium bovis subsp bovis AF2122/97
cggcccgggcucggc

SEQ ID NO: 1198576 - RNA, 23 nt, Mycobacterium bovis subsp bovis AF2122/97
cggcccggcccuccgggcccauc

SEQ ID NO: 1198577 - RNA, 17 nt, Mycobacterium bovis subsp bovis AF2122/97
cggcccuguucggcccu

SEQ ID NO: 1198578 - RNA, 15 nt, Mycobacterium bovis subsp bovis AF2122/97
cggccgaaacuucgc

SEQ ID NO: 1198579 - RNA, 21 nt, Mycobacterium bovis subsp bovis AF2122/97
cggcccucgaauucggccggc

SEQ ID NO: 1198580 - RNA, 14 nt, Mycobacterium bovis subsp bovis AF2122/97
cggcccuccaccgg

SEQ ID NO: 1198581 - RNA, 19 nt, Mycobacterium bovis subsp bovis AF2122/97
cggcccguguggucccggc

SEQ ID NO: 1198582 - RNA, 16 nt, Mycobacterium bovis subsp bovis AF2122/97
cggcccugccgccggc

SEQ ID NO: 1198583 - RNA, 17 nt, Mycobacterium bovis subsp bovis AF2122/97
cggccgcaagccgcgag

SEQ ID NO: 1198584 - RNA, 15 nt, Mycobacterium bovis subsp bovis AF2122/97
cggccgcagcggcca

SEQ ID NO: 1198585 - RNA, 19 nt, Mycobacterium bovis subsp bovis AF2122/97
cggccgcagcggccagccc

SEQ ID NO: 1198586 - RNA, 14 nt, Mycobacterium bovis subsp bovis AF2122/97
cggccgcagccagc

SEQ ID NO: 1198587 - RNA, 19 nt, Mycobacterium bovis subsp bovis AF2122/97
cggccgcagccagcaaguc

SEQ ID NO: 1198588 - RNA, 14 nt, Mycobacterium bovis subsp bovis AF2122/97
cggccgccccaggc

SEQ ID NO: 1198589 - RNA, 18 nt, Mycobacterium bovis subsp bovis AF2122/97
cggccgccgacagggacc

SEQ ID NO: 1198590 - RNA, 23 nt, Mycobacterium bovis subsp bovis AF2122/97
cggccgcaucggucaaugccacu

SEQ ID NO: 1198591 - RNA, 22 nt, Mycobacterium bovis subsp bovis AF2122/97
cggccgccgacuccccgccggg

SEQ ID NO: 1198592 - RNA, 11 nt, Mycobacterium bovis subsp bovis AF2122/97
cggccgcccgu

SEQ ID NO: 1198593 - RNA, 14 nt, Mycobacterium bovis subsp bovis AF2122/97
cggccgccgcggcu

SEQ ID NO: 1198594 - RNA, 15 nt, Mycobacterium bovis subsp bovis AF2122/97
cggccgccgcggcuu

SEQ ID NO: 1198595 - RNA, 13 nt, Mycobacterium bovis subsp bovis AF2122/97
cggccgccgcagc

SEQ ID NO: 1198596 - RNA, 16 nt, Mycobacterium bovis subsp bovis AF2122/97
cggccgcgaccagcgc

SEQ ID NO: 1198597 - RNA, 17 nt, Mycobacterium bovis subsp bovis AF2122/97
cggccgccuucuccggc

SEQ ID NO: 1198598 - RNA, 13 nt, Mycobacterium bovis subsp bovis AF2122/97
cggccgcgcccca

SEQ ID NO: 1198599 - RNA, 17 nt, Mycobacterium bovis subsp bovis AF2122/97
cggccgcgccggccccg

SEQ ID NO: 1198600 - RNA, 23 nt, Mycobacterium bovis subsp bovis AF2122/97
cggccgcggaugcucaggucacc

SEQ ID NO: 1198601 - RNA, 14 nt, Mycobacterium bovis subsp bovis AF2122/97
cggccgcggccucc

SEQ ID NO: 1198602 - RNA, 17 nt, Mycobacterium bovis subsp bovis AF2122/97
cggccgcgggcgcgcag

SEQ ID NO: 1198603 - RNA, 16 nt, Mycobacterium bovis subsp bovis AF2122/97
cggccgcggcggcccc

SEQ ID NO: 1198604 - RNA, 18 nt, Mycobacterium bovis subsp bovis AF2122/97
cggccgcggcggccccgc

SEQ ID NO: 1198605 - RNA, 19 nt, Mycobacterium bovis subsp bovis AF2122/97
cggccgcggucggccacca

SEQ ID NO: 1198606 - RNA, 16 nt, Mycobacterium bovis subsp bovis AF2122/97
cggccgcggccucccg

SEQ ID NO: 1198607 - RNA, 18 nt, Mycobacterium bovis subsp bovis AF2122/97
cggccgcggcgccuagca

SEQ ID NO: 1198608 - RNA, 13 nt, Mycobacterium bovis subsp bovis AF2122/97
cggccggcccggg

SEQ ID NO: 1198609 - RNA, 13 nt, Mycobacterium bovis subsp bovis AF2122/97
cggccggccaggu

SEQ ID NO: 1198610 - RNA, 14 nt, Mycobacterium bovis subsp bovis AF2122/97
cggccggccaggug

SEQ ID NO: 1198611 - RNA, 14 nt, Mycobacterium bovis subsp bovis AF2122/97
cggccggccgcggg

SEQ ID NO: 1198612 - RNA, 13 nt, Mycobacterium bovis subsp bovis AF2122/97
cggccggccgcuc

SEQ ID NO: 1198613 - RNA, 11 nt, Mycobacterium bovis subsp bovis AF2122/97
cggccggccgc

SEQ ID NO: 1198614 - RNA, 14 nt, Mycobacterium bovis subsp bovis AF2122/97
cggccggcgucagc

SEQ ID NO: 1198615 - RNA, 13 nt, Mycobacterium bovis subsp bovis AF2122/97
cggccggcgggcc

SEQ ID NO: 1198616 - RNA, 17 nt, Mycobacterium bovis subsp bovis AF2122/97
cggccggcgucagcccc

SEQ ID NO: 1198617 - RNA, 15 nt, Mycobacterium bovis subsp bovis AF2122/97
cggccggcgcggcgu

SEQ ID NO: 1198618 - RNA, 15 nt, Mycobacterium bovis subsp bovis AF2122/97
cggccgggacggcga

SEQ ID NO: 1198619 - RNA, 16 nt, Mycobacterium bovis subsp bovis AF2122/97
cggccggggccacccg

SEQ ID NO: 1198620 - RNA, 17 nt, Mycobacterium bovis subsp bovis AF2122/97
cggccggggccacccgc

SEQ ID NO: 1198621 - RNA, 13 nt, Mycobacterium bovis subsp bovis AF2122/97
cggccgggcccuc

SEQ ID NO: 1198622 - RNA, 17 nt, Mycobacterium bovis subsp bovis AF2122/97
cggccggcacgggcggg

SEQ ID NO: 1198623 - RNA, 18 nt, Mycobacterium bovis subsp bovis AF2122/97
cggccggccagcacccga

SEQ ID NO: 1198624 - RNA, 19 nt, Mycobacterium bovis subsp bovis AF2122/97
cggccggcaguccgagcuu

SEQ ID NO: 1198625 - RNA, 23 nt, Mycobacterium bovis subsp bovis AF2122/97
cggccggauguugaccggcucga

SEQ ID NO: 1198626 - RNA, 20 nt, Mycobacterium bovis subsp bovis AF2122/97
cggccggcaccccacggcca

SEQ ID NO: 1198627 - RNA, 18 nt, Mycobacterium bovis subsp bovis AF2122/97
cggccggaguccgucggg

SEQ ID NO: 1198628 - RNA, 23 nt, Mycobacterium bovis subsp bovis AF2122/97
cggccggaugagcgaacgccagu

SEQ ID NO: 1198629 - RNA, 18 nt, Mycobacterium bovis subsp bovis AF2122/97
cggccggagccgccggcc

SEQ ID NO: 1198630 - RNA, 19 nt, Mycobacterium bovis subsp bovis AF2122/97
cggccggagccgccggccc

SEQ ID NO: 1198631 - RNA, 20 nt, Mycobacterium bovis subsp bovis AF2122/97
cggccggagccgccggcccc

SEQ ID NO: 1198632 - RNA, 19 nt, Mycobacterium bovis subsp bovis AF2122/97
cggccgcuccaccucggcg

SEQ ID NO: 1198633 - RNA, 12 nt, Mycobacterium bovis subsp bovis AF2122/97
cggccgcucggg

SEQ ID NO: 1198634 - RNA, 19 nt, Mycobacterium bovis subsp bovis AF2122/97
cggccgcucaccccgcgcu

SEQ ID NO: 1198635 - RNA, 17 nt, Mycobacterium bovis subsp bovis AF2122/97
cggccgcugccuuggcg

SEQ ID NO: 1198636 - RNA, 13 nt, Mycobacterium bovis subsp bovis AF2122/97
cggccggagccgc

SEQ ID NO: 1198637 - RNA, 20 nt, Mycobacterium bovis subsp bovis AF2122/97
cggccggaauacccggccca

SEQ ID NO: 1198638 - RNA, 15 nt, Mycobacterium bovis subsp bovis AF2122/97
cggccggagccgccg

SEQ ID NO: 1198639 - RNA, 17 nt, Mycobacterium bovis subsp bovis AF2122/97
cggccggaacgcccggc

SEQ ID NO: 1198640 - RNA, 18 nt, Mycobacterium bovis subsp bovis AF2122/97
cggccugcgaacacgcga

SEQ ID NO: 1198641 - RNA, 13 nt, Mycobacterium bovis subsp bovis AF2122/97
cggccugcggcac

SEQ ID NO: 1198642 - RNA, 15 nt, Mycobacterium bovis subsp bovis AF2122/97
cggccuggccaccug

SEQ ID NO: 1198643 - RNA, 15 nt, Mycobacterium bovis subsp bovis AF2122/97
cggccugggccagcc

SEQ ID NO: 1198644 - RNA, 17 nt, Mycobacterium bovis subsp bovis AF2122/97
cggccugcugcugcagc

SEQ ID NO: 1198645 - RNA, 15 nt, Mycobacterium bovis subsp bovis AF2122/97
cggccucgccggggc

SEQ ID NO: 1198646 - RNA, 21 nt, Mycobacterium bovis subsp bovis AF2122/97
cggccuccucgucgcucccgg

SEQ ID NO: 1198647 - RNA, 18 nt, Mycobacterium bovis subsp bovis AF2122/97
cggccucggcggucgccu

SEQ ID NO: 1198648 - RNA, 23 nt, Mycobacterium bovis subsp bovis AF2122/97
cggccucgggacucccgcgcggg

SEQ ID NO: 1198649 - RNA, 21 nt, Mycobacterium bovis subsp bovis AF2122/97
cggccucgcugcucagcaacg

SEQ ID NO: 1198650 - RNA, 22 nt, Mycobacterium bovis subsp bovis AF2122/97
cggccucuagcuugacaacccu

SEQ ID NO: 1198651 - RNA, 13 nt, Mycobacterium bovis subsp bovis AF2122/97
cggccugagcggc

SEQ ID NO: 1198652 - RNA, 23 nt, Mycobacterium bovis subsp bovis AF2122/97
cggccugaccggcucgccggcgc

SEQ ID NO: 1198653 - RNA, 18 nt, Mycobacterium bovis subsp bovis AF2122/97
cggccggguuaucggcag

SEQ ID NO: 1198654 - RNA, 19 nt, Mycobacterium bovis subsp bovis AF2122/97
cggccggguuaucggcagc

SEQ ID NO: 1198655 - RNA, 21 nt, Mycobacterium bovis subsp bovis AF2122/97
cggccggguuaucggcagcag

SEQ ID NO: 1198656 - RNA, 14 nt, Mycobacterium bovis subsp bovis AF2122/97
cggccgggucgcgc

SEQ ID NO: 1198657 - RNA, 17 nt, Mycobacterium bovis subsp bovis AF2122/97
cggccggguggcccggc

SEQ ID NO: 1198658 - RNA, 19 nt, Mycobacterium bovis subsp bovis AF2122/97
cggccgguuggccagccac

SEQ ID NO: 1198659 - RNA, 16 nt, Mycobacterium bovis subsp bovis AF2122/97
cggccgucgggcagca

SEQ ID NO: 1198660 - RNA, 14 nt, Mycobacterium bovis subsp bovis AF2122/97
cggccgucggcggg

SEQ ID NO: 1198661 - RNA, 15 nt, Mycobacterium bovis subsp bovis AF2122/97
cggccgucgauugca

SEQ ID NO: 1198662 - RNA, 16 nt, Mycobacterium bovis subsp bovis AF2122/97
cggccgucccgcgagc

SEQ ID NO: 1198663 - RNA, 21 nt, Mycobacterium bovis subsp bovis AF2122/97
cggccgguuggccagccacag

SEQ ID NO: 1198664 - RNA, 18 nt, Mycobacterium bovis subsp bovis AF2122/97
cggccgucccgcgagcag

SEQ ID NO: 1198665 - RNA, 14 nt, Mycobacterium bovis subsp bovis AF2122/97
cggccgugucgggc

SEQ ID NO: 1198666 - RNA, 20 nt, Mycobacterium bovis subsp bovis AF2122/97
cggccguggcauguugcgga

SEQ ID NO: 1198667 - RNA, 14 nt, Mycobacterium bovis subsp bovis AF2122/97
cggccguugggcca

SEQ ID NO: 1198668 - RNA, 17 nt, Mycobacterium bovis subsp bovis AF2122/97
cggccguugggccaccg

SEQ ID NO: 1198669 - RNA, 19 nt, Mycobacterium bovis subsp bovis AF2122/97
cggccgugaccgagccgcg

SEQ ID NO: 1198670 - RNA, 21 nt, Mycobacterium bovis subsp bovis AF2122/97
cggccuaacucgccugcaccc

SEQ ID NO: 1198671 - RNA, 17 nt, Mycobacterium bovis subsp bovis AF2122/97
cggccucaacacccggc

SEQ ID NO: 1198672 - RNA, 17 nt, Mycobacterium bovis subsp bovis AF2122/97
cggccucccgggccgcc

SEQ ID NO: 1198673 - RNA, 12 nt, Mycobacterium bovis subsp bovis AF2122/97
cggccuccacca

SEQ ID NO: 1198674 - RNA, 16 nt, Mycobacterium bovis subsp bovis AF2122/97
cggcagcggcgccgcc

SEQ ID NO: 1198675 - RNA, 20 nt, Mycobacterium bovis subsp bovis AF2122/97
cggcagcggcgccgccugga

SEQ ID NO: 1198676 - RNA, 13 nt, Mycobacterium bovis subsp bovis AF2122/97
cggcagcggcgcg

SEQ ID NO: 1198677 - RNA, 19 nt, Mycobacterium bovis subsp bovis AF2122/97
cggcagccgggcggcagcg

SEQ ID NO: 1198678 - RNA, 17 nt, Mycobacterium bovis subsp bovis AF2122/97
cggcagacccgagcgcu

SEQ ID NO: 1198679 - RNA, 19 nt, Mycobacterium bovis subsp bovis AF2122/97
cggcagaccgaccucggcg

SEQ ID NO: 1198680 - RNA, 20 nt, Mycobacterium bovis subsp bovis AF2122/97
cggcagcgacgccggcccga

SEQ ID NO: 1198681 - RNA, 21 nt, Mycobacterium bovis subsp bovis AF2122/97
cggcagcgaaaggagcuccau

SEQ ID NO: 1198682 - RNA, 15 nt, Mycobacterium bovis subsp bovis AF2122/97
cggcaggauucccuc

SEQ ID NO: 1198683 - RNA, 17 nt, Mycobacterium bovis subsp bovis AF2122/97
cggcaggauucccucga

SEQ ID NO: 1198684 - RNA, 15 nt, Mycobacterium bovis subsp bovis AF2122/97
cggcaggcagggcag

SEQ ID NO: 1198685 - RNA, 20 nt, Mycobacterium bovis subsp bovis AF2122/97
cggcaggcccgacggcgccc

SEQ ID NO: 1198686 - RNA, 21 nt, Mycobacterium bovis subsp bovis AF2122/97
cggcaggcccgacggcgccca

SEQ ID NO: 1198687 - RNA, 16 nt, Mycobacterium bovis subsp bovis AF2122/97
cggcaggcccggaggg

SEQ ID NO: 1198688 - RNA, 20 nt, Mycobacterium bovis subsp bovis AF2122/97
cggcaggcuggcgagggcug

SEQ ID NO: 1198689 - RNA, 18 nt, Mycobacterium bovis subsp bovis AF2122/97
cggcaggcucgggcaagg

SEQ ID NO: 1198690 - RNA, 16 nt, Mycobacterium bovis subsp bovis AF2122/97
cggcaggcggccgccg

SEQ ID NO: 1198691 - RNA, 17 nt, Mycobacterium bovis subsp bovis AF2122/97
cggcaggcggccgccgg

SEQ ID NO: 1198692 - RNA, 16 nt, Mycobacterium bovis subsp bovis AF2122/97
cggcauagcgggucag

SEQ ID NO: 1198693 - RNA, 17 nt, Mycobacterium bovis subsp bovis AF2122/97
cggcaguggccagaccc

SEQ ID NO: 1198694 - RNA, 16 nt, Mycobacterium bovis subsp bovis AF2122/97
cggcaguuguggcgcu

SEQ ID NO: 1198695 - RNA, 16 nt, Mycobacterium bovis subsp bovis AF2122/97
cggcauacaacuggug

SEQ ID NO: 1198696 - RNA, 16 nt, Mycobacterium bovis subsp bovis AF2122/97
cggcagggcggugcca

SEQ ID NO: 1198697 - RNA, 20 nt, Mycobacterium bovis subsp bovis AF2122/97
cggcaggugcggucaaagga

SEQ ID NO: 1198698 - RNA, 20 nt, Mycobacterium bovis subsp bovis AF2122/97
cggcacuggugcccgacccg

SEQ ID NO: 1198699 - RNA, 13 nt, Mycobacterium bovis subsp bovis AF2122/97
cggcacugcggcc

SEQ ID NO: 1198700 - RNA, 13 nt, Mycobacterium bovis subsp bovis AF2122/97
cggcacuggcccc

SEQ ID NO: 1198701 - RNA, 16 nt, Mycobacterium bovis subsp bovis AF2122/97
cggcacuggccccggu

SEQ ID NO: 1198702 - RNA, 17 nt, Mycobacterium bovis subsp bovis AF2122/97
cggcacuggccccggug

SEQ ID NO: 1198703 - RNA, 13 nt, Mycobacterium bovis subsp bovis AF2122/97
cggcacugaccgc

SEQ ID NO: 1198704 - RNA, 14 nt, Mycobacterium bovis subsp bovis AF2122/97
cggcacugcccagc

SEQ ID NO: 1198705 - RNA, 17 nt, Mycobacterium bovis subsp bovis AF2122/97
cggcacgaucgccaacg

SEQ ID NO: 1198706 - RNA, 14 nt, Mycobacterium bovis subsp bovis AF2122/97
cggcacgccggcgg

SEQ ID NO: 1198707 - RNA, 16 nt, Mycobacterium bovis subsp bovis AF2122/97
cggcacucccuggggu

SEQ ID NO: 1198708 - RNA, 22 nt, Mycobacterium bovis subsp bovis AF2122/97
cggcaccgaugcacuccaugaa

SEQ ID NO: 1198709 - RNA, 14 nt, Mycobacterium bovis subsp bovis AF2122/97
cggcacgaaucccc

SEQ ID NO: 1198710 - RNA, 19 nt, Mycobacterium bovis subsp bovis AF2122/97
cggcacgaaucccccggac

SEQ ID NO: 1198711 - RNA, 19 nt, Mycobacterium bovis subsp bovis AF2122/97
cggcacgaaauugggcgau

SEQ ID NO: 1198712 - RNA, 13 nt, Mycobacterium bovis subsp bovis AF2122/97
cggcaccgccccg

SEQ ID NO: 1198713 - RNA, 23 nt, Mycobacterium bovis subsp bovis AF2122/97
cggcacccgaguuauagaagccg

SEQ ID NO: 1198714 - RNA, 22 nt, Mycobacterium bovis subsp bovis AF2122/97
cggcacccgcacggccuccgga

SEQ ID NO: 1198715 - RNA, 23 nt, Mycobacterium bovis subsp bovis AF2122/97
cggcacccgaaaacugacccccu

SEQ ID NO: 1198716 - RNA, 20 nt, Mycobacterium bovis subsp bovis AF2122/97
cggcacccgacucgucggcc

SEQ ID NO: 1198717 - RNA, 22 nt, Mycobacterium bovis subsp bovis AF2122/97
cggcacccgacucgucggccug

SEQ ID NO: 1198718 - RNA, 12 nt, Mycobacterium bovis subsp bovis AF2122/97
cggcacccggca

SEQ ID NO: 1198719 - RNA, 22 nt, Mycobacterium bovis subsp bovis AF2122/97
cggcacccggugagaagaagcc

SEQ ID NO: 1198720 - RNA, 18 nt, Mycobacterium bovis subsp bovis AF2122/97
cggcacccgucgggugcu

SEQ ID NO: 1198721 - RNA, 16 nt, Mycobacterium bovis subsp bovis AF2122/97
cggcacccggucggcc

SEQ ID NO: 1198722 - RNA, 18 nt, Mycobacterium bovis subsp bovis AF2122/97
cggcacccugcggcaccu

SEQ ID NO: 1198723 - RNA, 20 nt, Mycobacterium bovis subsp bovis AF2122/97
cggcaccaccgcgaccucgc

SEQ ID NO: 1198724 - RNA, 19 nt, Mycobacterium bovis subsp bovis AF2122/97
cggcaccaccacgccgacc

SEQ ID NO: 1198725 - RNA, 13 nt, Mycobacterium bovis subsp bovis AF2122/97
cggcaccaaccac

SEQ ID NO: 1198726 - RNA, 16 nt, Mycobacterium bovis subsp bovis AF2122/97
cggcacaugcgcgucc

SEQ ID NO: 1198727 - RNA, 15 nt, Mycobacterium bovis subsp bovis AF2122/97
cggcacccaguucca

SEQ ID NO: 1198728 - RNA, 22 nt, Mycobacterium bovis subsp bovis AF2122/97
cggcacccgaaaacugaccccc

SEQ ID NO: 1198729 - RNA, 16 nt, Mycobacterium bovis subsp bovis AF2122/97
cggcaccccacggcca

SEQ ID NO: 1198730 - RNA, 17 nt, Mycobacterium bovis subsp bovis AF2122/97
cggcaccagcgcgcgcc

SEQ ID NO: 1198731 - RNA, 14 nt, Mycobacterium bovis subsp bovis AF2122/97
cggcaccagcaccg

SEQ ID NO: 1198732 - RNA, 16 nt, Mycobacterium bovis subsp bovis AF2122/97
cggcaacagcucgccu

SEQ ID NO: 1198733 - RNA, 16 nt, Mycobacterium bovis subsp bovis AF2122/97
cggcaacagcaccagu

SEQ ID NO: 1198734 - RNA, 15 nt, Mycobacterium bovis subsp bovis AF2122/97
cggcaacagcaccag

SEQ ID NO: 1198735 - RNA, 15 nt, Mycobacterium bovis subsp bovis AF2122/97
cggcaaccagcgagc

SEQ ID NO: 1198736 - RNA, 14 nt, Mycobacterium bovis subsp bovis AF2122/97
cggcaaacuccagc

SEQ ID NO: 1198737 - RNA, 19 nt, Mycobacterium bovis subsp bovis AF2122/97
cggcaaaccaagcgcgcca

SEQ ID NO: 1198738 - RNA, 18 nt, Mycobacterium bovis subsp bovis AF2122/97
cggcaaaccaguuggcga

SEQ ID NO: 1198739 - RNA, 18 nt, Mycobacterium bovis subsp bovis AF2122/97
cggcaaaguuggccgccc

SEQ ID NO: 1198740 - RNA, 17 nt, Mycobacterium bovis subsp bovis AF2122/97
cggaucggucggcacca

SEQ ID NO: 1198741 - RNA, 15 nt, Mycobacterium bovis subsp bovis AF2122/97
cggaucggcgccgca

SEQ ID NO: 1198742 - RNA, 17 nt, Mycobacterium bovis subsp bovis AF2122/97
cggaucggcuaccuaac

SEQ ID NO: 1198743 - RNA, 16 nt, Mycobacterium bovis subsp bovis AF2122/97
cggaugacgcccaggg

SEQ ID NO: 1198744 - RNA, 15 nt, Mycobacterium bovis subsp bovis AF2122/97
cggaucugguccagu

SEQ ID NO: 1198745 - RNA, 24 nt, Mycobacterium bovis subsp bovis AF2122/97
cggauggaaggcggccaggugcag

SEQ ID NO: 1198746 - RNA, 23 nt, Mycobacterium bovis subsp bovis AF2122/97
cggaugcucaggucaccggccgc

SEQ ID NO: 1198747 - RNA, 20 nt, Mycobacterium bovis subsp bovis AF2122/97
cggaugcgauggccgacgcu

SEQ ID NO: 1198748 - RNA, 17 nt, Mycobacterium bovis subsp bovis AF2122/97
cggaugccggucggcgu

SEQ ID NO: 1198749 - RNA, 14 nt, Mycobacterium bovis subsp bovis AF2122/97
cggcaaacacugcg

SEQ ID NO: 1198750 - RNA, 16 nt, Mycobacterium bovis subsp bovis AF2122/97
cggcaaaccugagucc

SEQ ID NO: 1198751 - RNA, 16 nt, Mycobacterium bovis subsp bovis AF2122/97
cggauuaagucggcgg

SEQ ID NO: 1198752 - RNA, 17 nt, Mycobacterium bovis subsp bovis AF2122/97
cggaugucucggcacca

SEQ ID NO: 1198753 - RNA, 17 nt, Mycobacterium bovis subsp bovis AF2122/97
cggauguguucuccugc

SEQ ID NO: 1198754 - RNA, 15 nt, Mycobacterium bovis subsp bovis AF2122/97
cggauucgcccgggc

SEQ ID NO: 1198755 - RNA, 18 nt, Mycobacterium bovis subsp bovis AF2122/97
cggauucuucggugaaga

SEQ ID NO: 1198756 - RNA, 13 nt, Mycobacterium bovis subsp bovis AF2122/97
cggauugcagcgc

SEQ ID NO: 1198757 - RNA, 14 nt, Mycobacterium bovis subsp bovis AF2122/97
cggauugccgcgcg

SEQ ID NO: 1198758 - RNA, 14 nt, Mycobacterium bovis subsp bovis AF2122/97
cggauucgaaggca

SEQ ID NO: 1198759 - RNA, 20 nt, Mycobacterium bovis subsp bovis AF2122/97
cggaacgccgagcacgccga

SEQ ID NO: 1198760 - RNA, 20 nt, Mycobacterium bovis subsp bovis AF2122/97
cggaacgccuaacgcguagc

SEQ ID NO: 1198761 - RNA, 13 nt, Mycobacterium bovis subsp bovis AF2122/97
cggaacggccagg

SEQ ID NO: 1198762 - RNA, 18 nt, Mycobacterium bovis subsp bovis AF2122/97
cggaaccggcgugcagca

SEQ ID NO: 1198763 - RNA, 17 nt, Mycobacterium bovis subsp bovis AF2122/97
cggaaccguacgccaga

SEQ ID NO: 1198764 - RNA, 13 nt, Mycobacterium bovis subsp bovis AF2122/97
cggaaaggcuucc

SEQ ID NO: 1198765 - RNA, 15 nt, Mycobacterium bovis subsp bovis AF2122/97
cggagaugagcagcu

SEQ ID NO: 1198766 - RNA, 22 nt, Mycobacterium bovis subsp bovis AF2122/97
cggagaucgucgcguagugaug

SEQ ID NO: 1198767 - RNA, 18 nt, Mycobacterium bovis subsp bovis AF2122/97
cggagaucgagaucaccu

SEQ ID NO: 1198768 - RNA, 19 nt, Mycobacterium bovis subsp bovis AF2122/97
cggaagaagugcacugcga

SEQ ID NO: 1198769 - RNA, 23 nt, Mycobacterium bovis subsp bovis AF2122/97
cggaacuguaggucacagcugcg

SEQ ID NO: 1198770 - RNA, 22 nt, Mycobacterium bovis subsp bovis AF2122/97
cggaacguuccugcacagacag

SEQ ID NO: 1198771 - RNA, 15 nt, Mycobacterium bovis subsp bovis AF2122/97
cggaacugcgcaaca

SEQ ID NO: 1198772 - RNA, 22 nt, Mycobacterium bovis subsp bovis AF2122/97
cggagccaggacgacgccgacg

SEQ ID NO: 1198773 - RNA, 15 nt, Mycobacterium bovis subsp bovis AF2122/97
cggagccggccaccu

SEQ ID NO: 1198774 - RNA, 16 nt, Mycobacterium bovis subsp bovis AF2122/97
cggagccggccaccuc

SEQ ID NO: 1198775 - RNA, 21 nt, Mycobacterium bovis subsp bovis AF2122/97
cggagcccacacgcucacggg

SEQ ID NO: 1198776 - RNA, 19 nt, Mycobacterium bovis subsp bovis AF2122/97
cggagccgggugaggcggg

SEQ ID NO: 1198777 - RNA, 21 nt, Mycobacterium bovis subsp bovis AF2122/97
cggagcgcccuugaucagcua

SEQ ID NO: 1198778 - RNA, 14 nt, Mycobacterium bovis subsp bovis AF2122/97
cggagcgccgagcu

SEQ ID NO: 1198779 - RNA, 21 nt, Mycobacterium bovis subsp bovis AF2122/97
cggagcgcauuuguugcugcu

SEQ ID NO: 1198780 - RNA, 16 nt, Mycobacterium bovis subsp bovis AF2122/97
cggagcucaaccaccu

SEQ ID NO: 1198781 - RNA, 11 nt, Mycobacterium bovis subsp bovis AF2122/97
cggagcugggc

SEQ ID NO: 1198782 - RNA, 15 nt, Mycobacterium bovis subsp bovis AF2122/97
cggaucgaagaccag

SEQ ID NO: 1198783 - RNA, 13 nt, Mycobacterium bovis subsp bovis AF2122/97
cggaucgccaggc

SEQ ID NO: 1198784 - RNA, 19 nt, Mycobacterium bovis subsp bovis AF2122/97
cggaucgcgagcgccgcua

SEQ ID NO: 1198785 - RNA, 18 nt, Mycobacterium bovis subsp bovis AF2122/97
cggaucggcaccccacgc

SEQ ID NO: 1198786 - RNA, 15 nt, Mycobacterium bovis subsp bovis AF2122/97
cggauaaccggcaug

SEQ ID NO: 1198787 - RNA, 19 nt, Mycobacterium bovis subsp bovis AF2122/97
ccacugcggcauggcaggc

SEQ ID NO: 1198788 - RNA, 14 nt, Mycobacterium bovis subsp bovis AF2122/97
ccacugccggcagc

SEQ ID NO: 1198789 - RNA, 20 nt, Mycobacterium bovis subsp bovis AF2122/97
ccacugccggcagcgccccc

SEQ ID NO: 1198790 - RNA, 18 nt, Mycobacterium bovis subsp bovis AF2122/97
ccacugcgagcgccggcu

SEQ ID NO: 1198791 - RNA, 21 nt, Mycobacterium bovis subsp bovis AF2122/97
ccacuggacccgcccaggcgu

SEQ ID NO: 1198792 - RNA, 18 nt, Mycobacterium bovis subsp bovis AF2122/97
ccacugcgccgugaccca

SEQ ID NO: 1198793 - RNA, 20 nt, Mycobacterium bovis subsp bovis AF2122/97
ccacugcccgccgacgccag

SEQ ID NO: 1198794 - RNA, 15 nt, Mycobacterium bovis subsp bovis AF2122/97
ccacugccacuccug

SEQ ID NO: 1198795 - RNA, 15 nt, Mycobacterium bovis subsp bovis AF2122/97
ccacugccagccgug

SEQ ID NO: 1198796 - RNA, 22 nt, Mycobacterium bovis subsp bovis AF2122/97
ccacugccgcgcgcccgccuca

SEQ ID NO: 1198797 - RNA, 20 nt, Mycobacterium bovis subsp bovis AF2122/97
ccacugccgugccggugugu

SEQ ID NO: 1198798 - RNA, 21 nt, Mycobacterium bovis subsp bovis AF2122/97
ccacugccgugccgguguguc

SEQ ID NO: 1198799 - RNA, 18 nt, Mycobacterium bovis subsp bovis AF2122/97
ccacugccguugccgccg

SEQ ID NO: 1198800 - RNA, 21 nt, Mycobacterium bovis subsp bovis AF2122/97
ccacuggcgccggugccgccg

SEQ ID NO: 1198801 - RNA, 18 nt, Mycobacterium bovis subsp bovis AF2122/97
ccacuguagggccgguga

SEQ ID NO: 1198802 - RNA, 17 nt, Mycobacterium bovis subsp bovis AF2122/97
ccacuggugaucugguc

SEQ ID NO: 1198803 - RNA, 14 nt, Mycobacterium bovis subsp bovis AF2122/97
ccacuggugcagcg

SEQ ID NO: 1198804 - RNA, 21 nt, Mycobacterium bovis subsp bovis AF2122/97
ccacuggugcagcgccgacag

SEQ ID NO: 1198805 - RNA, 21 nt, Mycobacterium bovis subsp bovis AF2122/97
ccacuguuggugccgccacca

SEQ ID NO: 1198806 - RNA, 18 nt, Mycobacterium bovis subsp bovis AF2122/97
ccacuguuucugagcgcg

SEQ ID NO: 1198807 - RNA, 18 nt, Mycobacterium bovis subsp bovis AF2122/97
ccacuguugaagaagccc

SEQ ID NO: 1198808 - RNA, 17 nt, Mycobacterium bovis subsp bovis AF2122/97
ccacuuagcuggcgggg

SEQ ID NO: 1198809 - RNA, 16 nt, Mycobacterium bovis subsp bovis AF2122/97
ccagaacccggacagg

SEQ ID NO: 1198810 - RNA, 18 nt, Mycobacterium bovis subsp bovis AF2122/97
ccagaaggccgcaccgcc

SEQ ID NO: 1198811 - RNA, 20 nt, Mycobacterium bovis subsp bovis AF2122/97
ccagaaggccgcaccgccac

SEQ ID NO: 1198812 - RNA, 22 nt, Mycobacterium bovis subsp bovis AF2122/97
ccagaaggccgcaccgccaccc

SEQ ID NO: 1198813 - RNA, 18 nt, Mycobacterium bovis subsp bovis AF2122/97
ccagaaaugguucgcaca

SEQ ID NO: 1198814 - RNA, 21 nt, Mycobacterium bovis subsp bovis AF2122/97
ccagaaaugguucgcacaccu

SEQ ID NO: 1198815 - RNA, 13 nt, Mycobacterium bovis subsp bovis AF2122/97
ccacuucuucacu

SEQ ID NO: 1198816 - RNA, 11 nt, Mycobacterium bovis subsp bovis AF2122/97
ccacuucuuca

SEQ ID NO: 1198817 - RNA, 17 nt, Mycobacterium bovis subsp bovis AF2122/97
ccacuucggcgccgcgc

SEQ ID NO: 1198818 - RNA, 16 nt, Mycobacterium bovis subsp bovis AF2122/97
ccacucgcggauccgg

SEQ ID NO: 1198819 - RNA, 18 nt, Mycobacterium bovis subsp bovis AF2122/97
ccacucgcucaggaacaa

SEQ ID NO: 1198820 - RNA, 14 nt, Mycobacterium bovis subsp bovis AF2122/97
ccacucggcccggc

SEQ ID NO: 1198821 - RNA, 14 nt, Mycobacterium bovis subsp bovis AF2122/97
ccacugagccacag

SEQ ID NO: 1198822 - RNA, 17 nt, Mycobacterium bovis subsp bovis AF2122/97
ccacugaacaggccggu

SEQ ID NO: 1198823 - RNA, 16 nt, Mycobacterium bovis subsp bovis AF2122/97
ccacugaaccguagcg

SEQ ID NO: 1198824 - RNA, 22 nt, Mycobacterium bovis subsp bovis AF2122/97
ccacugaaccguagcgcccacu

SEQ ID NO: 1198825 - RNA, 21 nt, Mycobacterium bovis subsp bovis AF2122/97
ccacuagcuucgcuugccgau

SEQ ID NO: 1198826 - RNA, 21 nt, Mycobacterium bovis subsp bovis AF2122/97
ccacucaggaucccgguggca

SEQ ID NO: 1198827 - RNA, 20 nt, Mycobacterium bovis subsp bovis AF2122/97
ccacucccagccaacccguc

SEQ ID NO: 1198828 - RNA, 11 nt, Mycobacterium bovis subsp bovis AF2122/97
ccacuccagcg

SEQ ID NO: 1198829 - RNA, 16 nt, Mycobacterium bovis subsp bovis AF2122/97
ccacuccgccaacauc

SEQ ID NO: 1198830 - RNA, 13 nt, Mycobacterium bovis subsp bovis AF2122/97
ccacucccgcccc

SEQ ID NO: 1198831 - RNA, 17 nt, Mycobacterium bovis subsp bovis AF2122/97
ccacucccgccccgcuc

SEQ ID NO: 1198832 - RNA, 18 nt, Mycobacterium bovis subsp bovis AF2122/97
ccacguacuccaccgcgc

SEQ ID NO: 1198833 - RNA, 15 nt, Mycobacterium bovis subsp bovis AF2122/97
ccacgguucugccgg

SEQ ID NO: 1198834 - RNA, 22 nt, Mycobacterium bovis subsp bovis AF2122/97
ccacgguuggccaccagcuggc

SEQ ID NO: 1198835 - RNA, 20 nt, Mycobacterium bovis subsp bovis AF2122/97
ccacgguucgggcagcaccc

SEQ ID NO: 1198836 - RNA, 23 nt, Mycobacterium bovis subsp bovis AF2122/97
ccacgcguugacgaucuccgcca

SEQ ID NO: 1198837 - RNA, 22 nt, Mycobacterium bovis subsp bovis AF2122/97
ccacgcggauaucuugcgcaug

SEQ ID NO: 1198838 - RNA, 18 nt, Mycobacterium bovis subsp bovis AF2122/97
ccacgucccagagaauca

SEQ ID NO: 1198839 - RNA, 14 nt, Mycobacterium bovis subsp bovis AF2122/97
ccacguugcgcaua

SEQ ID NO: 1198840 - RNA, 20 nt, Mycobacterium bovis subsp bovis AF2122/97
ccacguacuccaccgcgccg

SEQ ID NO: 1198841 - RNA, 22 nt, Mycobacterium bovis subsp bovis AF2122/97
ccacguacuccaccgcgccguc

SEQ ID NO: 1198842 - RNA, 20 nt, Mycobacterium bovis subsp bovis AF2122/97
ccacguagcagcgccggcac

SEQ ID NO: 1198843 - RNA, 23 nt, Mycobacterium bovis subsp bovis AF2122/97
ccacguagcagcgccggcaccga

SEQ ID NO: 1198844 - RNA, 17 nt, Mycobacterium bovis subsp bovis AF2122/97
ccacgucaucuggcgcu

SEQ ID NO: 1198845 - RNA, 14 nt, Mycobacterium bovis subsp bovis AF2122/97
ccacgcacccggca

SEQ ID NO: 1198846 - RNA, 18 nt, Mycobacterium bovis subsp bovis AF2122/97
ccacgcaccgggugcagg

SEQ ID NO: 1198847 - RNA, 21 nt, Mycobacterium bovis subsp bovis AF2122/97
ccacgcaccgggugcagguga

SEQ ID NO: 1198848 - RNA, 22 nt, Mycobacterium bovis subsp bovis AF2122/97
ccacgcacucgucgggguugau

SEQ ID NO: 1198849 - RNA, 15 nt, Mycobacterium bovis subsp bovis AF2122/97
ccacgcagcacggca

SEQ ID NO: 1198850 - RNA, 16 nt, Mycobacterium bovis subsp bovis AF2122/97
ccacgcagcacggcac

SEQ ID NO: 1198851 - RNA, 16 nt, Mycobacterium bovis subsp bovis AF2122/97
ccacgccguggagauc

SEQ ID NO: 1198852 - RNA, 20 nt, Mycobacterium bovis subsp bovis AF2122/97
ccacgccguggagaucuccu

SEQ ID NO: 1198853 - RNA, 21 nt, Mycobacterium bovis subsp bovis AF2122/97
ccacgccguagcgcagcgccu

SEQ ID NO: 1198854 - RNA, 11 nt, Mycobacterium bovis subsp bovis AF2122/97
ccacgccgccg

SEQ ID NO: 1198855 - RNA, 22 nt, Mycobacterium bovis subsp bovis AF2122/97
ccacgccgaucaacaugccggu

SEQ ID NO: 1198856 - RNA, 16 nt, Mycobacterium bovis subsp bovis AF2122/97
ccacgccgccggcgcu

SEQ ID NO: 1198857 - RNA, 17 nt, Mycobacterium bovis subsp bovis AF2122/97
ccaccuguucacccacu

SEQ ID NO: 1198858 - RNA, 20 nt, Mycobacterium bovis subsp bovis AF2122/97
ccaccuguugcccuugcgca

SEQ ID NO: 1198859 - RNA, 14 nt, Mycobacterium bovis subsp bovis AF2122/97
ccacgaaugcaaga

SEQ ID NO: 1198860 - RNA, 22 nt, Mycobacterium bovis subsp bovis AF2122/97
ccacgacacuaggggcggggcu

SEQ ID NO: 1198861 - RNA, 15 nt, Mycobacterium bovis subsp bovis AF2122/97
ccacgacaggucgcc

SEQ ID NO: 1198862 - RNA, 13 nt, Mycobacterium bovis subsp bovis AF2122/97
ccacgaccgccga

SEQ ID NO: 1198863 - RNA, 15 nt, Mycobacterium bovis subsp bovis AF2122/97
ccaccgggcccgccg

SEQ ID NO: 1198864 - RNA, 21 nt, Mycobacterium bovis subsp bovis AF2122/97
ccaccgggcccgccggccccg

SEQ ID NO: 1198865 - RNA, 15 nt, Mycobacterium bovis subsp bovis AF2122/97
ccaccggcuggugcc

SEQ ID NO: 1198866 - RNA, 23 nt, Mycobacterium bovis subsp bovis AF2122/97
ccaccgggcgcugcuugaggucc

SEQ ID NO: 1198867 - RNA, 20 nt, Mycobacterium bovis subsp bovis AF2122/97
ccaccgggcgucgucgguga

SEQ ID NO: 1198868 - RNA, 21 nt, Mycobacterium bovis subsp bovis AF2122/97
ccaccgggcgugcggcggccc

SEQ ID NO: 1198869 - RNA, 13 nt, Mycobacterium bovis subsp bovis AF2122/97
ccaccgguccagc

SEQ ID NO: 1198870 - RNA, 19 nt, Mycobacterium bovis subsp bovis AF2122/97
ccaccgguaccgccggcuc

SEQ ID NO: 1198871 - RNA, 14 nt, Mycobacterium bovis subsp bovis AF2122/97
ccaccugcuccgcu

SEQ ID NO: 1198872 - RNA, 16 nt, Mycobacterium bovis subsp bovis AF2122/97
ccaccucuaccggugg

SEQ ID NO: 1198873 - RNA, 13 nt, Mycobacterium bovis subsp bovis AF2122/97
ccaccgccgccga

SEQ ID NO: 1198874 - RNA, 16 nt, Mycobacterium bovis subsp bovis AF2122/97
ccaccgccgccgccac

SEQ ID NO: 1198875 - RNA, 17 nt, Mycobacterium bovis subsp bovis AF2122/97
ccaccgccgccugcccg

SEQ ID NO: 1198876 - RNA, 12 nt, Mycobacterium bovis subsp bovis AF2122/97
ccaccgccgccu

SEQ ID NO: 1198877 - RNA, 14 nt, Mycobacterium bovis subsp bovis AF2122/97
ccaccgccgcugcc

SEQ ID NO: 1198878 - RNA, 18 nt, Mycobacterium bovis subsp bovis AF2122/97
ccaccgcauaacgccagu

SEQ ID NO: 1198879 - RNA, 17 nt, Mycobacterium bovis subsp bovis AF2122/97
ccaccgccgacccuaga

SEQ ID NO: 1198880 - RNA, 14 nt, Mycobacterium bovis subsp bovis AF2122/97
ccaccgcgcaaccc

SEQ ID NO: 1198881 - RNA, 20 nt, Mycobacterium bovis subsp bovis AF2122/97
ccaccgcggucaccgacgca

SEQ ID NO: 1198882 - RNA, 21 nt, Mycobacterium bovis subsp bovis AF2122/97
ccaccgcggucagcucggcag

SEQ ID NO: 1198883 - RNA, 16 nt, Mycobacterium bovis subsp bovis AF2122/97
ccaccgcggcugcucc

SEQ ID NO: 1198884 - RNA, 15 nt, Mycobacterium bovis subsp bovis AF2122/97
ccaccgccggcccgc

SEQ ID NO: 1198885 - RNA, 19 nt, Mycobacterium bovis subsp bovis AF2122/97
ccaccgccggugccgccau

SEQ ID NO: 1198886 - RNA, 13 nt, Mycobacterium bovis subsp bovis AF2122/97
ccaccgccggccc

SEQ ID NO: 1198887 - RNA, 13 nt, Mycobacterium bovis subsp bovis AF2122/97
ccaccggccgcgc

SEQ ID NO: 1198888 - RNA, 14 nt, Mycobacterium bovis subsp bovis AF2122/97
ccaccggccggcgc

SEQ ID NO: 1198889 - RNA, 14 nt, Mycobacterium bovis subsp bovis AF2122/97
ccaccggccguccc

SEQ ID NO: 1198890 - RNA, 22 nt, Mycobacterium bovis subsp bovis AF2122/97
ccaccggccgucccgcgagcag

SEQ ID NO: 1198891 - RNA, 21 nt, Mycobacterium bovis subsp bovis AF2122/97
ccaccggccccaccggcaccc

SEQ ID NO: 1198892 - RNA, 13 nt, Mycobacterium bovis subsp bovis AF2122/97
ccaccggcccucg

SEQ ID NO: 1198893 - RNA, 14 nt, Mycobacterium bovis subsp bovis AF2122/97
ccaccggccagugg

SEQ ID NO: 1198894 - RNA, 17 nt, Mycobacterium bovis subsp bovis AF2122/97
ccaccggcaccgccugc

SEQ ID NO: 1198895 - RNA, 15 nt, Mycobacterium bovis subsp bovis AF2122/97
ccaccggcacgguga

SEQ ID NO: 1198896 - RNA, 19 nt, Mycobacterium bovis subsp bovis AF2122/97
ccaccggcgccaccggcgc

SEQ ID NO: 1198897 - RNA, 23 nt, Mycobacterium bovis subsp bovis AF2122/97
ccaccggcuaugcuggcgcagcg

SEQ ID NO: 1198898 - RNA, 20 nt, Mycobacterium bovis subsp bovis AF2122/97
ccaccggcugauucgagcca

SEQ ID NO: 1198899 - RNA, 23 nt, Mycobacterium bovis subsp bovis AF2122/97
ccaccggcugauucgagccacau

SEQ ID NO: 1198900 - RNA, 15 nt, Mycobacterium bovis subsp bovis AF2122/97
ccaccggcggugccg

SEQ ID NO: 1198901 - RNA, 15 nt, Mycobacterium bovis subsp bovis AF2122/97
ccaccggcgccgccg

SEQ ID NO: 1198902 - RNA, 16 nt, Mycobacterium bovis subsp bovis AF2122/97
ccaccggcgccgccgg

SEQ ID NO: 1198903 - RNA, 13 nt, Mycobacterium bovis subsp bovis AF2122/97
ccaccgcuuccag

SEQ ID NO: 1198904 - RNA, 19 nt, Mycobacterium bovis subsp bovis AF2122/97
ccaccggaauacgcgccgc

SEQ ID NO: 1198905 - RNA, 18 nt, Mycobacterium bovis subsp bovis AF2122/97
ccaccgcugccggcagcg

SEQ ID NO: 1198906 - RNA, 16 nt, Mycobacterium bovis subsp bovis AF2122/97
ccaccgcugccggcgc

SEQ ID NO: 1198907 - RNA, 13 nt, Mycobacterium bovis subsp bovis AF2122/97
ccaccgcuggauc

SEQ ID NO: 1198908 - RNA, 18 nt, Mycobacterium bovis subsp bovis AF2122/97
ccaccgcguuggccacac

SEQ ID NO: 1198909 - RNA, 23 nt, Mycobacterium bovis subsp bovis AF2122/97
ccaccgcucgucguccggccacg

SEQ ID NO: 1198910 - RNA, 16 nt, Mycobacterium bovis subsp bovis AF2122/97
ccaccggcaccgcugc

SEQ ID NO: 1198911 - RNA, 15 nt, Mycobacterium bovis subsp bovis AF2122/97
ccaccggaccaccgc

SEQ ID NO: 1198912 - RNA, 17 nt, Mycobacterium bovis subsp bovis AF2122/97
ccaccggaccaccgccg

SEQ ID NO: 1198913 - RNA, 22 nt, Mycobacterium bovis subsp bovis AF2122/97
ccaccggaauccuggccgccgc

SEQ ID NO: 1198914 - RNA, 17 nt, Mycobacterium bovis subsp bovis AF2122/97
ccacccggugccgcagc

SEQ ID NO: 1198915 - RNA, 14 nt, Mycobacterium bovis subsp bovis AF2122/97
ccacccgguccugc

SEQ ID NO: 1198916 - RNA, 23 nt, Mycobacterium bovis subsp bovis AF2122/97
ccacccggcgggcggugggcagc

SEQ ID NO: 1198917 - RNA, 15 nt, Mycobacterium bovis subsp bovis AF2122/97
ccacccgcgccgccc

SEQ ID NO: 1198918 - RNA, 21 nt, Mycobacterium bovis subsp bovis AF2122/97
ccacccgcggugccugcagcu

SEQ ID NO: 1198919 - RNA, 14 nt, Mycobacterium bovis subsp bovis AF2122/97
ccacccgccgcagc

SEQ ID NO: 1198920 - RNA, 14 nt, Mycobacterium bovis subsp bovis AF2122/97
ccacccgggccucg

SEQ ID NO: 1198921 - RNA, 18 nt, Mycobacterium bovis subsp bovis AF2122/97
ccaccgaucgacugcagc

SEQ ID NO: 1198922 - RNA, 17 nt, Mycobacterium bovis subsp bovis AF2122/97
ccaccgcauugggccca

SEQ ID NO: 1198923 - RNA, 18 nt, Mycobacterium bovis subsp bovis AF2122/97
ccacccgauuggccaacc

SEQ ID NO: 1198924 - RNA, 15 nt, Mycobacterium bovis subsp bovis AF2122/97
ccacccgagcacuga

SEQ ID NO: 1198925 - RNA, 22 nt, Mycobacterium bovis subsp bovis AF2122/97
ccacccgacaacgcugggcggc

SEQ ID NO: 1198926 - RNA, 14 nt, Mycobacterium bovis subsp bovis AF2122/97
ccacccgaccgcca

SEQ ID NO: 1198927 - RNA, 16 nt, Mycobacterium bovis subsp bovis AF2122/97
ccagaugcccagcagg

SEQ ID NO: 1198928 - RNA, 23 nt, Mycobacterium bovis subsp bovis AF2122/97
ccagaugccgguaacgaacagcg

SEQ ID NO: 1198929 - RNA, 17 nt, Mycobacterium bovis subsp bovis AF2122/97
ccagauccacgccgacc

SEQ ID NO: 1198930 - RNA, 18 nt, Mycobacterium bovis subsp bovis AF2122/97
ccagaucagccgccgccu

SEQ ID NO: 1198931 - RNA, 17 nt, Mycobacterium bovis subsp bovis AF2122/97
ccagauggcucucggug

SEQ ID NO: 1198932 - RNA, 14 nt, Mycobacterium bovis subsp bovis AF2122/97
ccagaugcccagca

SEQ ID NO: 1198933 - RNA, 15 nt, Mycobacterium bovis subsp bovis AF2122/97
ccagauucgccgccc

SEQ ID NO: 1198934 - RNA, 22 nt, Mycobacterium bovis subsp bovis AF2122/97
ccagauugaggcuggucugcag

SEQ ID NO: 1198935 - RNA, 20 nt, Mycobacterium bovis subsp bovis AF2122/97
ccagauuggcgcugcccgcc

SEQ ID NO: 1198936 - RNA, 21 nt, Mycobacterium bovis subsp bovis AF2122/97
ccagauugcccaacacccacu

SEQ ID NO: 1198937 - RNA, 19 nt, Mycobacterium bovis subsp bovis AF2122/97
ccagauagagcuggugcag

SEQ ID NO: 1198938 - RNA, 23 nt, Mycobacterium bovis subsp bovis AF2122/97
ccagauacaucgggaucugggcu

SEQ ID NO: 1198939 - RNA, 17 nt, Mycobacterium bovis subsp bovis AF2122/97
ccagauaccaccgccgc

SEQ ID NO: 1198940 - RNA, 20 nt, Mycobacterium bovis subsp bovis AF2122/97
ccagagugguguucuccugc

SEQ ID NO: 1198941 - RNA, 13 nt, Mycobacterium bovis subsp bovis AF2122/97
ccagagucggaga

SEQ ID NO: 1198942 - RNA, 15 nt, Mycobacterium bovis subsp bovis AF2122/97
ccagaauccaggugg

SEQ ID NO: 1198943 - RNA, 18 nt, Mycobacterium bovis subsp bovis AF2122/97
ccagaagucgucauauuc

SEQ ID NO: 1198944 - RNA, 16 nt, Mycobacterium bovis subsp bovis AF2122/97
ccagcaggccgaagaa

SEQ ID NO: 1198945 - RNA, 21 nt, Mycobacterium bovis subsp bovis AF2122/97
ccagcaggccgggcgcaagca

SEQ ID NO: 1198946 - RNA, 14 nt, Mycobacterium bovis subsp bovis AF2122/97
ccagcagcucgccg

SEQ ID NO: 1198947 - RNA, 14 nt, Mycobacterium bovis subsp bovis AF2122/97
ccagcagcaggcca

SEQ ID NO: 1198948 - RNA, 14 nt, Mycobacterium bovis subsp bovis AF2122/97
ccagcagcucggcc

SEQ ID NO: 1198949 - RNA, 14 nt, Mycobacterium bovis subsp bovis AF2122/97
ccagcagcagcgcu

SEQ ID NO: 1198950 - RNA, 13 nt, Mycobacterium bovis subsp bovis AF2122/97
ccagcagcggcuc

SEQ ID NO: 1198951 - RNA, 15 nt, Mycobacterium bovis subsp bovis AF2122/97
ccagcagcagugcca

SEQ ID NO: 1198952 - RNA, 16 nt, Mycobacterium bovis subsp bovis AF2122/97
ccagcagcaaccgcca

SEQ ID NO: 1198953 - RNA, 15 nt, Mycobacterium bovis subsp bovis AF2122/97
ccagcagcaccaacu

SEQ ID NO: 1198954 - RNA, 14 nt, Mycobacterium bovis subsp bovis AF2122/97
ccagcagcaccgac

SEQ ID NO: 1198955 - RNA, 16 nt, Mycobacterium bovis subsp bovis AF2122/97
ccagcaccacggccag

SEQ ID NO: 1198956 - RNA, 15 nt, Mycobacterium bovis subsp bovis AF2122/97
ccagcaacagcgagc

SEQ ID NO: 1198957 - RNA, 21 nt, Mycobacterium bovis subsp bovis AF2122/97
ccagcaacagcgagcgguuga

SEQ ID NO: 1198958 - RNA, 21 nt, Mycobacterium bovis subsp bovis AF2122/97
ccagcaaaggggugugugcug

SEQ ID NO: 1198959 - RNA, 14 nt, Mycobacterium bovis subsp bovis AF2122/97
ccagcaacaccaga

SEQ ID NO: 1198960 - RNA, 17 nt, Mycobacterium bovis subsp bovis AF2122/97
ccagcaaaggggugugu

SEQ ID NO: 1198961 - RNA, 13 nt, Mycobacterium bovis subsp bovis AF2122/97
ccagcaccaccgc

SEQ ID NO: 1198962 - RNA, 15 nt, Mycobacterium bovis subsp bovis AF2122/97
ccagcaccaccggcu

SEQ ID NO: 1198963 - RNA, 12 nt, Mycobacterium bovis subsp bovis AF2122/97
ccagcaccagcg

SEQ ID NO: 1198964 - RNA, 17 nt, Mycobacterium bovis subsp bovis AF2122/97
ccagcaccucgaccgcc

SEQ ID NO: 1198965 - RNA, 14 nt, Mycobacterium bovis subsp bovis AF2122/97
ccagcacgcccucg

SEQ ID NO: 1198966 - RNA, 14 nt, Mycobacterium bovis subsp bovis AF2122/97
ccagcacgccgccg

SEQ ID NO: 1198967 - RNA, 14 nt, Mycobacterium bovis subsp bovis AF2122/97
ccagccgucggcgc

SEQ ID NO: 1198968 - RNA, 20 nt, Mycobacterium bovis subsp bovis AF2122/97
ccagccgguuggcugccggc

SEQ ID NO: 1198969 - RNA, 22 nt, Mycobacterium bovis subsp bovis AF2122/97
ccagccgucgucagguggccaa

SEQ ID NO: 1198970 - RNA, 17 nt, Mycobacterium bovis subsp bovis AF2122/97
ccagccguggcggcggg

SEQ ID NO: 1198971 - RNA, 16 nt, Mycobacterium bovis subsp bovis AF2122/97
ccagccggcagcagcg

SEQ ID NO: 1198972 - RNA, 17 nt, Mycobacterium bovis subsp bovis AF2122/97
ccagccggcagcagcgg

SEQ ID NO: 1198973 - RNA, 12 nt, Mycobacterium bovis subsp bovis AF2122/97
ccagccggccug

SEQ ID NO: 1198974 - RNA, 24 nt, Mycobacterium bovis subsp bovis AF2122/97
ccagccgggagucgucggcauggg

SEQ ID NO: 1198975 - RNA, 17 nt, Mycobacterium bovis subsp bovis AF2122/97
ccagccgggcaaggccc

SEQ ID NO: 1198976 - RNA, 13 nt, Mycobacterium bovis subsp bovis AF2122/97
ccagccggccuca

SEQ ID NO: 1198977 - RNA, 17 nt, Mycobacterium bovis subsp bovis AF2122/97
ccagccgguccagaccc

SEQ ID NO: 1198978 - RNA, 18 nt, Mycobacterium bovis subsp bovis AF2122/97
ccagccgguccagaccca

SEQ ID NO: 1198979 - RNA, 20 nt, Mycobacterium bovis subsp bovis AF2122/97
ccagccgguccagcagcucg

SEQ ID NO: 1198980 - RNA, 23 nt, Mycobacterium bovis subsp bovis AF2122/97
ccagccugcuggccgcggccucg

SEQ ID NO: 1198981 - RNA, 17 nt, Mycobacterium bovis subsp bovis AF2122/97
ccagccuggcaaccacg

SEQ ID NO: 1198982 - RNA, 17 nt, Mycobacterium bovis subsp bovis AF2122/97
ccagccuuuccggccgc

SEQ ID NO: 1198983 - RNA, 18 nt, Mycobacterium bovis subsp bovis AF2122/97
ccagccuuuccggccgcc

SEQ ID NO: 1198984 - RNA, 22 nt, Mycobacterium bovis subsp bovis AF2122/97
ccagccuuggacgugcgcgcca

SEQ ID NO: 1198985 - RNA, 18 nt, Mycobacterium bovis subsp bovis AF2122/97
ccagcgacgaccacacca

SEQ ID NO: 1198986 - RNA, 15 nt, Mycobacterium bovis subsp bovis AF2122/97
ccagcgacgccaugu

SEQ ID NO: 1198987 - RNA, 17 nt, Mycobacterium bovis subsp bovis AF2122/97
ccagcgacccggccagc

SEQ ID NO: 1198988 - RNA, 23 nt, Mycobacterium bovis subsp bovis AF2122/97
ccagcgaccaggucgccagcucg

SEQ ID NO: 1198989 - RNA, 14 nt, Mycobacterium bovis subsp bovis AF2122/97
ccagcgaccagugg

SEQ ID NO: 1198990 - RNA, 19 nt, Mycobacterium bovis subsp bovis AF2122/97
ccagcgagcauaccgccgc

SEQ ID NO: 1198991 - RNA, 20 nt, Mycobacterium bovis subsp bovis AF2122/97
ccagcgagcgcaaaucgauu

SEQ ID NO: 1198992 - RNA, 14 nt, Mycobacterium bovis subsp bovis AF2122/97
ccagcgagcgccag

SEQ ID NO: 1198993 - RNA, 14 nt, Mycobacterium bovis subsp bovis AF2122/97
ccagcgacucggcc

SEQ ID NO: 1198994 - RNA, 18 nt, Mycobacterium bovis subsp bovis AF2122/97
ccagcgaauccaggccgu

SEQ ID NO: 1198995 - RNA, 18 nt, Mycobacterium bovis subsp bovis AF2122/97
ccagcgaaucgcugguga

SEQ ID NO: 1198996 - RNA, 17 nt, Mycobacterium bovis subsp bovis AF2122/97
ccagcgaauccagccgc

SEQ ID NO: 1198997 - RNA, 20 nt, Mycobacterium bovis subsp bovis AF2122/97
ccagcgaauccagccgcgcg

SEQ ID NO: 1198998 - RNA, 16 nt, Mycobacterium bovis subsp bovis AF2122/97
ccagcgaauccaggcc

SEQ ID NO: 1198999 - RNA, 22 nt, Mycobacterium bovis subsp bovis AF2122/97
ccagcgcacggaccaucgccag

SEQ ID NO: 1199000 - RNA, 23 nt, Mycobacterium bovis subsp bovis AF2122/97
ccagcgcacuacucgaacaaccc

SEQ ID NO: 1199001 - RNA, 14 nt, Mycobacterium bovis subsp bovis AF2122/97
ccagcgcagugccu

SEQ ID NO: 1199002 - RNA, 15 nt, Mycobacterium bovis subsp bovis AF2122/97
ccagcgcagcagcgg

SEQ ID NO: 1199003 - RNA, 12 nt, Mycobacterium bovis subsp bovis AF2122/97
ccagcgcagccg

SEQ ID NO: 1199004 - RNA, 13 nt, Mycobacterium bovis subsp bovis AF2122/97
ccagcgaggagca

SEQ ID NO: 1199005 - RNA, 15 nt, Mycobacterium bovis subsp bovis AF2122/97
ccagcgaggagcagg

SEQ ID NO: 1199006 - RNA, 15 nt, Mycobacterium bovis subsp bovis AF2122/97
ccagcgaggccagcg

SEQ ID NO: 1199007 - RNA, 14 nt, Mycobacterium bovis subsp bovis AF2122/97
ccagccgcgccagc

SEQ ID NO: 1199008 - RNA, 12 nt, Mycobacterium bovis subsp bovis AF2122/97
ccagccgccccg

SEQ ID NO: 1199009 - RNA, 19 nt, Mycobacterium bovis subsp bovis AF2122/97
ccagccgcaacaccccccg

SEQ ID NO: 1199010 - RNA, 17 nt, Mycobacterium bovis subsp bovis AF2122/97
ccagccgcgcgccggcc

SEQ ID NO: 1199011 - RNA, 16 nt, Mycobacterium bovis subsp bovis AF2122/97
ccagcccguccggccc

SEQ ID NO: 1199012 - RNA, 16 nt, Mycobacterium bovis subsp bovis AF2122/97
ccagccgagcggcggc

SEQ ID NO: 1199013 - RNA, 22 nt, Mycobacterium bovis subsp bovis AF2122/97
ccagccgaccgauggcucacca

SEQ ID NO: 1199014 - RNA, 16 nt, Mycobacterium bovis subsp bovis AF2122/97
ccagccgacgccuucc

SEQ ID NO: 1199015 - RNA, 13 nt, Mycobacterium bovis subsp bovis AF2122/97
ccagccgacguac

SEQ ID NO: 1199016 - RNA, 24 nt, Mycobacterium bovis subsp bovis AF2122/97
ccagccgaagaaccggucgcagug

SEQ ID NO: 1199017 - RNA, 18 nt, Mycobacterium bovis subsp bovis AF2122/97
ccagcccuguuugacugc

SEQ ID NO: 1199018 - RNA, 14 nt, Mycobacterium bovis subsp bovis AF2122/97
ccagcccggccgcc

SEQ ID NO: 1199019 - RNA, 13 nt, Mycobacterium bovis subsp bovis AF2122/97
ccagcccggccgg

SEQ ID NO: 1199020 - RNA, 14 nt, Mycobacterium bovis subsp bovis AF2122/97
ccagccccacccgc

SEQ ID NO: 1199021 - RNA, 17 nt, Mycobacterium bovis subsp bovis AF2122/97
ccagccccacccgccgc

SEQ ID NO: 1199022 - RNA, 19 nt, Mycobacterium bovis subsp bovis AF2122/97
ccagccccacccgccgccg

SEQ ID NO: 1199023 - RNA, 22 nt, Mycobacterium bovis subsp bovis AF2122/97
ccagccccacccgccgccgccc

SEQ ID NO: 1199024 - RNA, 13 nt, Mycobacterium bovis subsp bovis AF2122/97
ccagcccagcacg

SEQ ID NO: 1199025 - RNA, 13 nt, Mycobacterium bovis subsp bovis AF2122/97
ccagcccagccgg

SEQ ID NO: 1199026 - RNA, 18 nt, Mycobacterium bovis subsp bovis AF2122/97
ccagccauggcagcgccg

SEQ ID NO: 1199027 - RNA, 12 nt, Mycobacterium bovis subsp bovis AF2122/97
ccagcagggugu

SEQ ID NO: 1199028 - RNA, 18 nt, Mycobacterium bovis subsp bovis AF2122/97
ccagcaggguuccccaua

SEQ ID NO: 1199029 - RNA, 20 nt, Mycobacterium bovis subsp bovis AF2122/97
ccagcagguccgcggccgcg

SEQ ID NO: 1199030 - RNA, 21 nt, Mycobacterium bovis subsp bovis AF2122/97
ccagcagguccgcggccgcgg

SEQ ID NO: 1199031 - RNA, 18 nt, Mycobacterium bovis subsp bovis AF2122/97
ccagcaggucgucggcgu

SEQ ID NO: 1199032 - RNA, 20 nt, Mycobacterium bovis subsp bovis AF2122/97
ccagcagguuccacggccag

SEQ ID NO: 1199033 - RNA, 19 nt, Mycobacterium bovis subsp bovis AF2122/97
ccagcaguacaccgcccgg

SEQ ID NO: 1199034 - RNA, 23 nt, Mycobacterium bovis subsp bovis AF2122/97
ccagcagugcgguaaagaucuug

SEQ ID NO: 1199035 - RNA, 13 nt, Mycobacterium bovis subsp bovis AF2122/97
ccaucagcccggc

SEQ ID NO: 1199036 - RNA, 16 nt, Mycobacterium bovis subsp bovis AF2122/97
ccaucagaaccuccuc

SEQ ID NO: 1199037 - RNA, 16 nt, Mycobacterium bovis subsp bovis AF2122/97
ccaucacggucagcuc

SEQ ID NO: 1199038 - RNA, 12 nt, Mycobacterium bovis subsp bovis AF2122/97
ccaucacaccca

SEQ ID NO: 1199039 - RNA, 14 nt, Mycobacterium bovis subsp bovis AF2122/97
ccaucacacccauc

SEQ ID NO: 1199040 - RNA, 15 nt, Mycobacterium bovis subsp bovis AF2122/97
ccaucacacccggua

SEQ ID NO: 1199041 - RNA, 15 nt, Mycobacterium bovis subsp bovis AF2122/97
ccaucacggucagcu

SEQ ID NO: 1199042 - RNA, 12 nt, Mycobacterium bovis subsp bovis AF2122/97
ccaucaaggcca

SEQ ID NO: 1199043 - RNA, 16 nt, Mycobacterium bovis subsp bovis AF2122/97
ccaucaaggccaccuc

SEQ ID NO: 1199044 - RNA, 14 nt, Mycobacterium bovis subsp bovis AF2122/97
ccauacagcacccc

SEQ ID NO: 1199045 - RNA, 15 nt, Mycobacterium bovis subsp bovis AF2122/97
ccauaucgcccacca

SEQ ID NO: 1199046 - RNA, 15 nt, Mycobacterium bovis subsp bovis AF2122/97
ccaucaacugcauca

SEQ ID NO: 1199047 - RNA, 20 nt, Mycobacterium bovis subsp bovis AF2122/97
ccaucaacugcaucaccacu

SEQ ID NO: 1199048 - RNA, 23 nt, Mycobacterium bovis subsp bovis AF2122/97
ccaucaacugcaucaccacugga

SEQ ID NO: 1199049 - RNA, 20 nt, Mycobacterium bovis subsp bovis AF2122/97
ccaucggguccgaaguacug

SEQ ID NO: 1199050 - RNA, 15 nt, Mycobacterium bovis subsp bovis AF2122/97
ccaucguccagcagg

SEQ ID NO: 1199051 - RNA, 14 nt, Mycobacterium bovis subsp bovis AF2122/97
ccaucuucgggccg

SEQ ID NO: 1199052 - RNA, 13 nt, Mycobacterium bovis subsp bovis AF2122/97
ccaucuugaccaa

SEQ ID NO: 1199053 - RNA, 23 nt, Mycobacterium bovis subsp bovis AF2122/97
ccaucgcccgaugcgccagcgua

SEQ ID NO: 1199054 - RNA, 13 nt, Mycobacterium bovis subsp bovis AF2122/97
ccaucgcccggug

SEQ ID NO: 1199055 - RNA, 18 nt, Mycobacterium bovis subsp bovis AF2122/97
ccaucggcuaggccggcc

SEQ ID NO: 1199056 - RNA, 19 nt, Mycobacterium bovis subsp bovis AF2122/97
ccaucgccaacaccaacca

SEQ ID NO: 1199057 - RNA, 17 nt, Mycobacterium bovis subsp bovis AF2122/97
ccaucgccaccgcguca

SEQ ID NO: 1199058 - RNA, 17 nt, Mycobacterium bovis subsp bovis AF2122/97
ccaucgaggcgaucacc

SEQ ID NO: 1199059 - RNA, 22 nt, Mycobacterium bovis subsp bovis AF2122/97
ccaucccugaaauaccaguccg

SEQ ID NO: 1199060 - RNA, 16 nt, Mycobacterium bovis subsp bovis AF2122/97
ccaucccguucagcga

SEQ ID NO: 1199061 - RNA, 21 nt, Mycobacterium bovis subsp bovis AF2122/97
ccaucccucgaaaaccguggu

SEQ ID NO: 1199062 - RNA, 18 nt, Mycobacterium bovis subsp bovis AF2122/97
ccaucccgaucccggcca

SEQ ID NO: 1199063 - RNA, 13 nt, Mycobacterium bovis subsp bovis AF2122/97
ccaucgacgccgc

SEQ ID NO: 1199064 - RNA, 17 nt, Mycobacterium bovis subsp bovis AF2122/97
ccaucauggcggcccgg

SEQ ID NO: 1199065 - RNA, 14 nt, Mycobacterium bovis subsp bovis AF2122/97
ccaucaugguccgg

SEQ ID NO: 1199066 - RNA, 21 nt, Mycobacterium bovis subsp bovis AF2122/97
ccaguugcguuguccaccauc

SEQ ID NO: 1199067 - RNA, 20 nt, Mycobacterium bovis subsp bovis AF2122/97
ccagugcgguggccagugcg

SEQ ID NO: 1199068 - RNA, 23 nt, Mycobacterium bovis subsp bovis AF2122/97
ccagugcgcagaacaccaccgcc

SEQ ID NO: 1199069 - RNA, 13 nt, Mycobacterium bovis subsp bovis AF2122/97
ccagugccacgcc

SEQ ID NO: 1199070 - RNA, 20 nt, Mycobacterium bovis subsp bovis AF2122/97
ccagugcgcagaacaccacc

SEQ ID NO: 1199071 - RNA, 15 nt, Mycobacterium bovis subsp bovis AF2122/97
ccagugcugcaccga

SEQ ID NO: 1199072 - RNA, 16 nt, Mycobacterium bovis subsp bovis AF2122/97
ccaguucggugagccg

SEQ ID NO: 1199073 - RNA, 16 nt, Mycobacterium bovis subsp bovis AF2122/97
ccaguucgugggucaa

SEQ ID NO: 1199074 - RNA, 19 nt, Mycobacterium bovis subsp bovis AF2122/97
ccagugcccgcacugccgc

SEQ ID NO: 1199075 - RNA, 20 nt, Mycobacterium bovis subsp bovis AF2122/97
ccagugcccgcacugccgcc

SEQ ID NO: 1199076 - RNA, 17 nt, Mycobacterium bovis subsp bovis AF2122/97
ccagugccgcccaccac

SEQ ID NO: 1199077 - RNA, 20 nt, Mycobacterium bovis subsp bovis AF2122/97
ccagugagguaucccggucu

SEQ ID NO: 1199078 - RNA, 12 nt, Mycobacterium bovis subsp bovis AF2122/97
ccagugagcccg

SEQ ID NO: 1199079 - RNA, 23 nt, Mycobacterium bovis subsp bovis AF2122/97
ccaguccgaugguaugcccgccg

SEQ ID NO: 1199080 - RNA, 18 nt, Mycobacterium bovis subsp bovis AF2122/97
ccaguccggacggcagcc

SEQ ID NO: 1199081 - RNA, 19 nt, Mycobacterium bovis subsp bovis AF2122/97
ccaguccaugugcccaggu

SEQ ID NO: 1199082 - RNA, 15 nt, Mycobacterium bovis subsp bovis AF2122/97
ccagucccucgccaa

SEQ ID NO: 1199083 - RNA, 23 nt, Mycobacterium bovis subsp bovis AF2122/97
ccagucgacgucucuggugcagg

SEQ ID NO: 1199084 - RNA, 23 nt, Mycobacterium bovis subsp bovis AF2122/97
ccaguccgcgcgcaagucgaugu

SEQ ID NO: 1199085 - RNA, 22 nt, Mycobacterium bovis subsp bovis AF2122/97
ccagucgcacgacgucaaucuc

SEQ ID NO: 1199086 - RNA, 14 nt, Mycobacterium bovis subsp bovis AF2122/97
ccaguccucgggca

SEQ ID NO: 1199087 - RNA, 16 nt, Mycobacterium bovis subsp bovis AF2122/97
ccagucgauguccugc

SEQ ID NO: 1199088 - RNA, 21 nt, Mycobacterium bovis subsp bovis AF2122/97
ccagugaccgcagucccagca

SEQ ID NO: 1199089 - RNA, 22 nt, Mycobacterium bovis subsp bovis AF2122/97
ccagugaccgcagucccagcac

SEQ ID NO: 1199090 - RNA, 16 nt, Mycobacterium bovis subsp bovis AF2122/97
ccagugaaucggaccg

SEQ ID NO: 1199091 - RNA, 21 nt, Mycobacterium bovis subsp bovis AF2122/97
ccagguccgccggugccgccg

SEQ ID NO: 1199092 - RNA, 21 nt, Mycobacterium bovis subsp bovis AF2122/97
ccaggucgauaccggcgugca

SEQ ID NO: 1199093 - RNA, 15 nt, Mycobacterium bovis subsp bovis AF2122/97
ccaggucggccgccu

SEQ ID NO: 1199094 - RNA, 12 nt, Mycobacterium bovis subsp bovis AF2122/97
ccaggucggcga

SEQ ID NO: 1199095 - RNA, 14 nt, Mycobacterium bovis subsp bovis AF2122/97
ccaggucggccacc

SEQ ID NO: 1199096 - RNA, 18 nt, Mycobacterium bovis subsp bovis AF2122/97
ccaggucggccaccgugg

SEQ ID NO: 1199097 - RNA, 14 nt, Mycobacterium bovis subsp bovis AF2122/97
ccaggucggucagg

SEQ ID NO: 1199098 - RNA, 21 nt, Mycobacterium bovis subsp bovis AF2122/97
ccaggucuccaucaaccgcgc

SEQ ID NO: 1199099 - RNA, 15 nt, Mycobacterium bovis subsp bovis AF2122/97
ccaggucuccuuggg

SEQ ID NO: 1199100 - RNA, 12 nt, Mycobacterium bovis subsp bovis AF2122/97
ccaggucugcgg

SEQ ID NO: 1199101 - RNA, 19 nt, Mycobacterium bovis subsp bovis AF2122/97
ccaguaggcuucgaccgug

SEQ ID NO: 1199102 - RNA, 21 nt, Mycobacterium bovis subsp bovis AF2122/97
ccaguaggcuucgaccguggu

SEQ ID NO: 1199103 - RNA, 16 nt, Mycobacterium bovis subsp bovis AF2122/97
ccagucacgcccacca

SEQ ID NO: 1199104 - RNA, 17 nt, Mycobacterium bovis subsp bovis AF2122/97
ccagucacgcccaccac

SEQ ID NO: 1199105 - RNA, 12 nt, Mycobacterium bovis subsp bovis AF2122/97
ccagggugacca

SEQ ID NO: 1199106 - RNA, 21 nt, Mycobacterium bovis subsp bovis AF2122/97
ccagggucccgccgccuggaa

SEQ ID NO: 1199107 - RNA, 14 nt, Mycobacterium bovis subsp bovis AF2122/97
ccagggucccgccg

SEQ ID NO: 1199108 - RNA, 19 nt, Mycobacterium bovis subsp bovis AF2122/97
ccagggggcgugccgccgc

SEQ ID NO: 1199109 - RNA, 15 nt, Mycobacterium bovis subsp bovis AF2122/97
ccaggcugguccggg

SEQ ID NO: 1199110 - RNA, 15 nt, Mycobacterium bovis subsp bovis AF2122/97
ccaggcugcgcagug

SEQ ID NO: 1199111 - RNA, 23 nt, Mycobacterium bovis subsp bovis AF2122/97
ccaggcugaaaccuugcggcaga

SEQ ID NO: 1199112 - RNA, 21 nt, Mycobacterium bovis subsp bovis AF2122/97
ccagggugcccucggccgccu

SEQ ID NO: 1199113 - RNA, 14 nt, Mycobacterium bovis subsp bovis AF2122/97
ccaggggcgcagcg

SEQ ID NO: 1199114 - RNA, 17 nt, Mycobacterium bovis subsp bovis AF2122/97
ccagggucugcucaucc

SEQ ID NO: 1199115 - RNA, 19 nt, Mycobacterium bovis subsp bovis AF2122/97
ccaggucaacgacguugau

SEQ ID NO: 1199116 - RNA, 17 nt, Mycobacterium bovis subsp bovis AF2122/97
ccagguccaccccgccg

SEQ ID NO: 1199117 - RNA, 13 nt, Mycobacterium bovis subsp bovis AF2122/97
ccagguccacauc

SEQ ID NO: 1199118 - RNA, 17 nt, Mycobacterium bovis subsp bovis AF2122/97
ccaggcuccggccggcc

SEQ ID NO: 1199119 - RNA, 15 nt, Mycobacterium bovis subsp bovis AF2122/97
ccaggcguccaucag

SEQ ID NO: 1199120 - RNA, 22 nt, Mycobacterium bovis subsp bovis AF2122/97
ccaggcuaccguuacccgggau

SEQ ID NO: 1199121 - RNA, 14 nt, Mycobacterium bovis subsp bovis AF2122/97
ccaggcgcugcagc

SEQ ID NO: 1199122 - RNA, 20 nt, Mycobacterium bovis subsp bovis AF2122/97
ccaggcgcugcagcauggcu

SEQ ID NO: 1199123 - RNA, 22 nt, Mycobacterium bovis subsp bovis AF2122/97
ccaggcgcugcagcauggcucc

SEQ ID NO: 1199124 - RNA, 17 nt, Mycobacterium bovis subsp bovis AF2122/97
ccaggcgcuuggccgga

SEQ ID NO: 1199125 - RNA, 20 nt, Mycobacterium bovis subsp bovis AF2122/97
ccaggcggcaauucgggcau

SEQ ID NO: 1199126 - RNA, 22 nt, Mycobacterium bovis subsp bovis AF2122/97
ccaggccgaucagcguggcgcc

SEQ ID NO: 1199127 - RNA, 12 nt, Mycobacterium bovis subsp bovis AF2122/97
ccaggccgcgcg

SEQ ID NO: 1199128 - RNA, 20 nt, Mycobacterium bovis subsp bovis AF2122/97
ccaggccgcgcgacaacccg

SEQ ID NO: 1199129 - RNA, 19 nt, Mycobacterium bovis subsp bovis AF2122/97
ccaggccgcuugccccgcc

SEQ ID NO: 1199130 - RNA, 21 nt, Mycobacterium bovis subsp bovis AF2122/97
ccaggccggcggcggcgcucg

SEQ ID NO: 1199131 - RNA, 21 nt, Mycobacterium bovis subsp bovis AF2122/97
ccaggauguguugccagauca

SEQ ID NO: 1199132 - RNA, 13 nt, Mycobacterium bovis subsp bovis AF2122/97
ccaggccaacggc

SEQ ID NO: 1199133 - RNA, 15 nt, Mycobacterium bovis subsp bovis AF2122/97
ccaggcccaagccgu

SEQ ID NO: 1199134 - RNA, 22 nt, Mycobacterium bovis subsp bovis AF2122/97
ccaggccagggcgguggccacc

SEQ ID NO: 1199135 - RNA, 13 nt, Mycobacterium bovis subsp bovis AF2122/97
ccaggcccagccg

SEQ ID NO: 1199136 - RNA, 17 nt, Mycobacterium bovis subsp bovis AF2122/97
ccaggcccgacacggcg

SEQ ID NO: 1199137 - RNA, 22 nt, Mycobacterium bovis subsp bovis AF2122/97
ccaggaaugucuccaguagccg

SEQ ID NO: 1199138 - RNA, 17 nt, Mycobacterium bovis subsp bovis AF2122/97
ccaggaaugucuccagu

SEQ ID NO: 1199139 - RNA, 16 nt, Mycobacterium bovis subsp bovis AF2122/97
ccaggacaacgcaccg

SEQ ID NO: 1199140 - RNA, 14 nt, Mycobacterium bovis subsp bovis AF2122/97
ccaggaugagcgcu

SEQ ID NO: 1199141 - RNA, 19 nt, Mycobacterium bovis subsp bovis AF2122/97
ccaggacgguugguccgcc

SEQ ID NO: 1199142 - RNA, 23 nt, Mycobacterium bovis subsp bovis AF2122/97
ccaggacgguugguccgccgucg

SEQ ID NO: 1199143 - RNA, 16 nt, Mycobacterium bovis subsp bovis AF2122/97
ccaggacguggucggg

SEQ ID NO: 1199144 - RNA, 12 nt, Mycobacterium bovis subsp bovis AF2122/97
ccaggaccgcgc

SEQ ID NO: 1199145 - RNA, 19 nt, Mycobacterium bovis subsp bovis AF2122/97
ccaggacggcuaccaccgc

SEQ ID NO: 1199146 - RNA, 22 nt, Mycobacterium bovis subsp bovis AF2122/97
ccagcucgcgcacccagcccag

SEQ ID NO: 1199147 - RNA, 14 nt, Mycobacterium bovis subsp bovis AF2122/97
ccagcugagcuggc

SEQ ID NO: 1199148 - RNA, 17 nt, Mycobacterium bovis subsp bovis AF2122/97
ccagcucggcgggcucg

SEQ ID NO: 1199149 - RNA, 13 nt, Mycobacterium bovis subsp bovis AF2122/97
ccagcucggcggg

SEQ ID NO: 1199150 - RNA, 23 nt, Mycobacterium bovis subsp bovis AF2122/97
ccagcucgggggcgccggcgccc

SEQ ID NO: 1199151 - RNA, 22 nt, Mycobacterium bovis subsp bovis AF2122/97
ccagcugcagcagacccggugg

SEQ ID NO: 1199152 - RNA, 16 nt, Mycobacterium bovis subsp bovis AF2122/97
ccagcugcagcagacc

SEQ ID NO: 1199153 - RNA, 20 nt, Mycobacterium bovis subsp bovis AF2122/97
ccagcugcagcagacccggu

SEQ ID NO: 1199154 - RNA, 18 nt, Mycobacterium bovis subsp bovis AF2122/97
ccagcugcgagucgucgc

SEQ ID NO: 1199155 - RNA, 22 nt, Mycobacterium bovis subsp bovis AF2122/97
ccagcugcgccgaacgcuccag

SEQ ID NO: 1199156 - RNA, 15 nt, Mycobacterium bovis subsp bovis AF2122/97
ccagcuggacuccgg

SEQ ID NO: 1199157 - RNA, 19 nt, Mycobacterium bovis subsp bovis AF2122/97
ccagcuggccgggugcgug

SEQ ID NO: 1199158 - RNA, 13 nt, Mycobacterium bovis subsp bovis AF2122/97
ccagcgcgcgccg

SEQ ID NO: 1199159 - RNA, 17 nt, Mycobacterium bovis subsp bovis AF2122/97
ccagcgcggcaacuccg

SEQ ID NO: 1199160 - RNA, 22 nt, Mycobacterium bovis subsp bovis AF2122/97
ccagcgcggccauuagcagcac

SEQ ID NO: 1199161 - RNA, 14 nt, Mycobacterium bovis subsp bovis AF2122/97
ccagcgcggccuug

SEQ ID NO: 1199162 - RNA, 23 nt, Mycobacterium bovis subsp bovis AF2122/97
ccagcgcggcgcgcggggccucg

SEQ ID NO: 1199163 - RNA, 22 nt, Mycobacterium bovis subsp bovis AF2122/97
ccagcgcgcccgcggccgccag

SEQ ID NO: 1199164 - RNA, 22 nt, Mycobacterium bovis subsp bovis AF2122/97
ccagcgcgccgaucacgguggg

SEQ ID NO: 1199165 - RNA, 18 nt, Mycobacterium bovis subsp bovis AF2122/97
ccagcgcgccacccagca

SEQ ID NO: 1199166 - RNA, 13 nt, Mycobacterium bovis subsp bovis AF2122/97
ccagcgcgagccc

SEQ ID NO: 1199167 - RNA, 14 nt, Mycobacterium bovis subsp bovis AF2122/97
ccagcgccugcgcg

SEQ ID NO: 1199168 - RNA, 20 nt, Mycobacterium bovis subsp bovis AF2122/97
ccagcgcgacguccaccagc

SEQ ID NO: 1199169 - RNA, 23 nt, Mycobacterium bovis subsp bovis AF2122/97
ccagcgcgagcccgaaccaccgc

SEQ ID NO: 1199170 - RNA, 13 nt, Mycobacterium bovis subsp bovis AF2122/97
ccagcgccgcagu

SEQ ID NO: 1199171 - RNA, 13 nt, Mycobacterium bovis subsp bovis AF2122/97
ccagcgccgccac

SEQ ID NO: 1199172 - RNA, 15 nt, Mycobacterium bovis subsp bovis AF2122/97
ccagcgccgccgcgu

SEQ ID NO: 1199173 - RNA, 19 nt, Mycobacterium bovis subsp bovis AF2122/97
ccagcgccgccgcguucac

SEQ ID NO: 1199174 - RNA, 12 nt, Mycobacterium bovis subsp bovis AF2122/97
ccagcgccgccg

SEQ ID NO: 1199175 - RNA, 16 nt, Mycobacterium bovis subsp bovis AF2122/97
ccagcgccggccaggc

SEQ ID NO: 1199176 - RNA, 15 nt, Mycobacterium bovis subsp bovis AF2122/97
ccagcgccugcgccc

SEQ ID NO: 1199177 - RNA, 17 nt, Mycobacterium bovis subsp bovis AF2122/97
ccagcgccuccagcacc

SEQ ID NO: 1199178 - RNA, 14 nt, Mycobacterium bovis subsp bovis AF2122/97
ccagcgccggaagc

SEQ ID NO: 1199179 - RNA, 14 nt, Mycobacterium bovis subsp bovis AF2122/97
ccagcgccgcggcc

SEQ ID NO: 1199180 - RNA, 12 nt, Mycobacterium bovis subsp bovis AF2122/97
ccagcgcccggc

SEQ ID NO: 1199181 - RNA, 13 nt, Mycobacterium bovis subsp bovis AF2122/97
ccagcgccccggc

SEQ ID NO: 1199182 - RNA, 15 nt, Mycobacterium bovis subsp bovis AF2122/97
ccagcgcccccagca

SEQ ID NO: 1199183 - RNA, 18 nt, Mycobacterium bovis subsp bovis AF2122/97
ccagcgcccccagcagcu

SEQ ID NO: 1199184 - RNA, 17 nt, Mycobacterium bovis subsp bovis AF2122/97
ccagcgcuucgucggcc

SEQ ID NO: 1199185 - RNA, 17 nt, Mycobacterium bovis subsp bovis AF2122/97
ccagcggaagcgguuga

SEQ ID NO: 1199186 - RNA, 21 nt, Mycobacterium bovis subsp bovis AF2122/97
ccagcggaagcgguugaccca

SEQ ID NO: 1199187 - RNA, 21 nt, Mycobacterium bovis subsp bovis AF2122/97
ccagcggcaauggccagcacc

SEQ ID NO: 1199188 - RNA, 20 nt, Mycobacterium bovis subsp bovis AF2122/97
ccagcggcacacccaucacc

SEQ ID NO: 1199189 - RNA, 19 nt, Mycobacterium bovis subsp bovis AF2122/97
ccagcgcucaccggcgucg

SEQ ID NO: 1199190 - RNA, 14 nt, Mycobacterium bovis subsp bovis AF2122/97
ccagcgcuccagca

SEQ ID NO: 1199191 - RNA, 16 nt, Mycobacterium bovis subsp bovis AF2122/97
ccagcgguaaugccag

SEQ ID NO: 1199192 - RNA, 16 nt, Mycobacterium bovis subsp bovis AF2122/97
ccagcgguagcugccc

SEQ ID NO: 1199193 - RNA, 17 nt, Mycobacterium bovis subsp bovis AF2122/97
ccagcggucagccggcc

SEQ ID NO: 1199194 - RNA, 18 nt, Mycobacterium bovis subsp bovis AF2122/97
ccagcggucagccggcca

SEQ ID NO: 1199195 - RNA, 23 nt, Mycobacterium bovis subsp bovis AF2122/97
ccagcggucggcgaccaccagcg

SEQ ID NO: 1199196 - RNA, 14 nt, Mycobacterium bovis subsp bovis AF2122/97
ccagcggucggcgg

SEQ ID NO: 1199197 - RNA, 18 nt, Mycobacterium bovis subsp bovis AF2122/97
ccagcguucccgccggcu

SEQ ID NO: 1199198 - RNA, 21 nt, Mycobacterium bovis subsp bovis AF2122/97
ccagcgucucaaggccuuuca

SEQ ID NO: 1199199 - RNA, 20 nt, Mycobacterium bovis subsp bovis AF2122/97
ccagcgucgccgccagguug

SEQ ID NO: 1199200 - RNA, 15 nt, Mycobacterium bovis subsp bovis AF2122/97
ccagcgucgccgcca

SEQ ID NO: 1199201 - RNA, 22 nt, Mycobacterium bovis subsp bovis AF2122/97
ccagcgucgcgauugccgcggu

SEQ ID NO: 1199202 - RNA, 17 nt, Mycobacterium bovis subsp bovis AF2122/97
ccagcgucgacacaccc

SEQ ID NO: 1199203 - RNA, 18 nt, Mycobacterium bovis subsp bovis AF2122/97
ccagcguccagccgcccu

SEQ ID NO: 1199204 - RNA, 21 nt, Mycobacterium bovis subsp bovis AF2122/97
ccagcguccagccgcccucgg

SEQ ID NO: 1199205 - RNA, 14 nt, Mycobacterium bovis subsp bovis AF2122/97
ccagcguccuggcg

SEQ ID NO: 1199206 - RNA, 21 nt, Mycobacterium bovis subsp bovis AF2122/97
ccagcucgagguccucagcga

SEQ ID NO: 1199207 - RNA, 13 nt, Mycobacterium bovis subsp bovis AF2122/97
ccagcuccugcau

SEQ ID NO: 1199208 - RNA, 17 nt, Mycobacterium bovis subsp bovis AF2122/97
ccagcuccugcaugccg

SEQ ID NO: 1199209 - RNA, 18 nt, Mycobacterium bovis subsp bovis AF2122/97
ccagcucgcugcgcgccc

SEQ ID NO: 1199210 - RNA, 20 nt, Mycobacterium bovis subsp bovis AF2122/97
ccagcucgcgcacccagccc

SEQ ID NO: 1199211 - RNA, 15 nt, Mycobacterium bovis subsp bovis AF2122/97
ccagcucgaacaggu

SEQ ID NO: 1199212 - RNA, 19 nt, Mycobacterium bovis subsp bovis AF2122/97
ccccgcucgaccagacgcu

SEQ ID NO: 1199213 - RNA, 21 nt, Mycobacterium bovis subsp bovis AF2122/97
ccccgcuacgcgcgcucgcuc

SEQ ID NO: 1199214 - RNA, 23 nt, Mycobacterium bovis subsp bovis AF2122/97
ccccgcgguagccgaccgaccgc

SEQ ID NO: 1199215 - RNA, 18 nt, Mycobacterium bovis subsp bovis AF2122/97
ccccgcuggucgaccggc

SEQ ID NO: 1199216 - RNA, 18 nt, Mycobacterium bovis subsp bovis AF2122/97
ccccuccuucggugaggu

SEQ ID NO: 1199217 - RNA, 12 nt, Mycobacterium bovis subsp bovis AF2122/97
ccccgccggccu

SEQ ID NO: 1199218 - RNA, 22 nt, Mycobacterium bovis subsp bovis AF2122/97
ccccgccggcgccaccgucacc

SEQ ID NO: 1199219 - RNA, 12 nt, Mycobacterium bovis subsp bovis AF2122/97
ccccgccggcca

SEQ ID NO: 1199220 - RNA, 14 nt, Mycobacterium bovis subsp bovis AF2122/97
ccccgccggccgcg

SEQ ID NO: 1199221 - RNA, 16 nt, Mycobacterium bovis subsp bovis AF2122/97
ccccgccggccgcgcc

SEQ ID NO: 1199222 - RNA, 13 nt, Mycobacterium bovis subsp bovis AF2122/97
ccccgccgucacc

SEQ ID NO: 1199223 - RNA, 16 nt, Mycobacterium bovis subsp bovis AF2122/97
ccccgccgucgccacc

SEQ ID NO: 1199224 - RNA, 13 nt, Mycobacterium bovis subsp bovis AF2122/97
ccccgcgcgccag

SEQ ID NO: 1199225 - RNA, 16 nt, Mycobacterium bovis subsp bovis AF2122/97
ccccgcgccggccgca

SEQ ID NO: 1199226 - RNA, 12 nt, Mycobacterium bovis subsp bovis AF2122/97
ccccgccuuggc

SEQ ID NO: 1199227 - RNA, 17 nt, Mycobacterium bovis subsp bovis AF2122/97
ccccgcgaaguugcggg

SEQ ID NO: 1199228 - RNA, 17 nt, Mycobacterium bovis subsp bovis AF2122/97
ccccuugguggccagcc

SEQ ID NO: 1199229 - RNA, 17 nt, Mycobacterium bovis subsp bovis AF2122/97
ccccuugaccgcugccc

SEQ ID NO: 1199230 - RNA, 22 nt, Mycobacterium bovis subsp bovis AF2122/97
ccccucuugucuagcggucgcu

SEQ ID NO: 1199231 - RNA, 20 nt, Mycobacterium bovis subsp bovis AF2122/97
ccccucguccugcgagaggu

SEQ ID NO: 1199232 - RNA, 14 nt, Mycobacterium bovis subsp bovis AF2122/97
ccccugccacagcg

SEQ ID NO: 1199233 - RNA, 19 nt, Mycobacterium bovis subsp bovis AF2122/97
ccccugaaucaccggagcg

SEQ ID NO: 1199234 - RNA, 18 nt, Mycobacterium bovis subsp bovis AF2122/97
cccgacucggccgugacc

SEQ ID NO: 1199235 - RNA, 17 nt, Mycobacterium bovis subsp bovis AF2122/97
cccgacuggucacugcc

SEQ ID NO: 1199236 - RNA, 20 nt, Mycobacterium bovis subsp bovis AF2122/97
cccgacuguagaaaacccgu

SEQ ID NO: 1199237 - RNA, 22 nt, Mycobacterium bovis subsp bovis AF2122/97
cccgacgucaggcagcuccgcc

SEQ ID NO: 1199238 - RNA, 18 nt, Mycobacterium bovis subsp bovis AF2122/97
cccgacgugaagccaagc

SEQ ID NO: 1199239 - RNA, 19 nt, Mycobacterium bovis subsp bovis AF2122/97
cccgacguugccgaagccg

SEQ ID NO: 1199240 - RNA, 13 nt, Mycobacterium bovis subsp bovis AF2122/97
cccgacggcgccc

SEQ ID NO: 1199241 - RNA, 21 nt, Mycobacterium bovis subsp bovis AF2122/97
cccgacggacuccggccggcc

SEQ ID NO: 1199242 - RNA, 17 nt, Mycobacterium bovis subsp bovis AF2122/97
cccgacgcagcuugccc

SEQ ID NO: 1199243 - RNA, 18 nt, Mycobacterium bovis subsp bovis AF2122/97
cccgacgccagcugcccg

SEQ ID NO: 1199244 - RNA, 23 nt, Mycobacterium bovis subsp bovis AF2122/97
cccgacgagucgccgcgggcagc

SEQ ID NO: 1199245 - RNA, 18 nt, Mycobacterium bovis subsp bovis AF2122/97
cccgaccagcaccagaac

SEQ ID NO: 1199246 - RNA, 14 nt, Mycobacterium bovis subsp bovis AF2122/97
cccgaccagcacca

SEQ ID NO: 1199247 - RNA, 15 nt, Mycobacterium bovis subsp bovis AF2122/97
cccgaccagcaccag

SEQ ID NO: 1199248 - RNA, 12 nt, Mycobacterium bovis subsp bovis AF2122/97
cccgaccgccga

SEQ ID NO: 1199249 - RNA, 15 nt, Mycobacterium bovis subsp bovis AF2122/97
cccgaccgccaccgc

SEQ ID NO: 1199250 - RNA, 16 nt, Mycobacterium bovis subsp bovis AF2122/97
cccgaccgccaccgcc

SEQ ID NO: 1199251 - RNA, 14 nt, Mycobacterium bovis subsp bovis AF2122/97
cccgacaucgcugc

SEQ ID NO: 1199252 - RNA, 22 nt, Mycobacterium bovis subsp bovis AF2122/97
cccgacaugguccgaccagcgg

SEQ ID NO: 1199253 - RNA, 16 nt, Mycobacterium bovis subsp bovis AF2122/97
cccgacaguggucccg

SEQ ID NO: 1199254 - RNA, 18 nt, Mycobacterium bovis subsp bovis AF2122/97
cccgaacauccgccgccc

SEQ ID NO: 1199255 - RNA, 19 nt, Mycobacterium bovis subsp bovis AF2122/97
cccgaacauugcgcccagc

SEQ ID NO: 1199256 - RNA, 18 nt, Mycobacterium bovis subsp bovis AF2122/97
cccgaaaccuguaccgcc

SEQ ID NO: 1199257 - RNA, 14 nt, Mycobacterium bovis subsp bovis AF2122/97
cccgaaccgcgcug

SEQ ID NO: 1199258 - RNA, 18 nt, Mycobacterium bovis subsp bovis AF2122/97
cccgacaauggcgccagc

SEQ ID NO: 1199259 - RNA, 15 nt, Mycobacterium bovis subsp bovis AF2122/97
cccgaauccaccagc

SEQ ID NO: 1199260 - RNA, 21 nt, Mycobacterium bovis subsp bovis AF2122/97
cccgaagccggugccggcguu

SEQ ID NO: 1199261 - RNA, 17 nt, Mycobacterium bovis subsp bovis AF2122/97
cccgaagaugaccucgg

SEQ ID NO: 1199262 - RNA, 21 nt, Mycobacterium bovis subsp bovis AF2122/97
cccgaaguagaagcccaggac

SEQ ID NO: 1199263 - RNA, 23 nt, Mycobacterium bovis subsp bovis AF2122/97
cccgcaacuacggcguccccgac

SEQ ID NO: 1199264 - RNA, 21 nt, Mycobacterium bovis subsp bovis AF2122/97
cccgcaaaaucgucagcgccg

SEQ ID NO: 1199265 - RNA, 11 nt, Mycobacterium bovis subsp bovis AF2122/97
cccgauucugg

SEQ ID NO: 1199266 - RNA, 19 nt, Mycobacterium bovis subsp bovis AF2122/97
cccgauugaccuucgacaa

SEQ ID NO: 1199267 - RNA, 21 nt, Mycobacterium bovis subsp bovis AF2122/97
cccgauuggccaaccccaugg

SEQ ID NO: 1199268 - RNA, 13 nt, Mycobacterium bovis subsp bovis AF2122/97
cccgauccagugg

SEQ ID NO: 1199269 - RNA, 21 nt, Mycobacterium bovis subsp bovis AF2122/97
cccgaugccgugccgggccag

SEQ ID NO: 1199270 - RNA, 21 nt, Mycobacterium bovis subsp bovis AF2122/97
cccgaugguggugccgaccug

SEQ ID NO: 1199271 - RNA, 22 nt, Mycobacterium bovis subsp bovis AF2122/97
cccgaugguacccgcgccgcgc

SEQ ID NO: 1199272 - RNA, 20 nt, Mycobacterium bovis subsp bovis AF2122/97
cccgcacgaguuaccggugg

SEQ ID NO: 1199273 - RNA, 13 nt, Mycobacterium bovis subsp bovis AF2122/97
cccgcaccgcguu

SEQ ID NO: 1199274 - RNA, 21 nt, Mycobacterium bovis subsp bovis AF2122/97
cccgcaccgcguucugguugu

SEQ ID NO: 1199275 - RNA, 22 nt, Mycobacterium bovis subsp bovis AF2122/97
cccgcaccggugacgcacagca

SEQ ID NO: 1199276 - RNA, 14 nt, Mycobacterium bovis subsp bovis AF2122/97
cccgcaccucaccg

SEQ ID NO: 1199277 - RNA, 13 nt, Mycobacterium bovis subsp bovis AF2122/97
cccgcaccccggc

SEQ ID NO: 1199278 - RNA, 15 nt, Mycobacterium bovis subsp bovis AF2122/97
cccgcaccccggccg

SEQ ID NO: 1199279 - RNA, 21 nt, Mycobacterium bovis subsp bovis AF2122/97
cccgcaccccggccgcgcgca

SEQ ID NO: 1199280 - RNA, 17 nt, Mycobacterium bovis subsp bovis AF2122/97
cccgcacggccuccgga

SEQ ID NO: 1199281 - RNA, 15 nt, Mycobacterium bovis subsp bovis AF2122/97
cccgcacugccgccg

SEQ ID NO: 1199282 - RNA, 15 nt, Mycobacterium bovis subsp bovis AF2122/97
cccgcacgcucgccc

SEQ ID NO: 1199283 - RNA, 21 nt, Mycobacterium bovis subsp bovis AF2122/97
cccgcacgcucggcgugucgg

SEQ ID NO: 1199284 - RNA, 13 nt, Mycobacterium bovis subsp bovis AF2122/97
cccgcaccacacc

SEQ ID NO: 1199285 - RNA, 14 nt, Mycobacterium bovis subsp bovis AF2122/97
cccgcaccaccggc

SEQ ID NO: 1199286 - RNA, 16 nt, Mycobacterium bovis subsp bovis AF2122/97
cccgcaccaccggccc

SEQ ID NO: 1199287 - RNA, 17 nt, Mycobacterium bovis subsp bovis AF2122/97
cccgcaaugcgcgcgau

SEQ ID NO: 1199288 - RNA, 23 nt, Mycobacterium bovis subsp bovis AF2122/97
cccgcaacgacugaucaagugcc

SEQ ID NO: 1199289 - RNA, 17 nt, Mycobacterium bovis subsp bovis AF2122/97
cccgaggcaacaagcac

SEQ ID NO: 1199290 - RNA, 15 nt, Mycobacterium bovis subsp bovis AF2122/97
cccgagcucgggugc

SEQ ID NO: 1199291 - RNA, 15 nt, Mycobacterium bovis subsp bovis AF2122/97
cccgagcucaccgca

SEQ ID NO: 1199292 - RNA, 18 nt, Mycobacterium bovis subsp bovis AF2122/97
cccgagcucgccgcagcg

SEQ ID NO: 1199293 - RNA, 18 nt, Mycobacterium bovis subsp bovis AF2122/97
cccgagucgaaaccgccc

SEQ ID NO: 1199294 - RNA, 22 nt, Mycobacterium bovis subsp bovis AF2122/97
cccgaguggccggugggccgcc

SEQ ID NO: 1199295 - RNA, 23 nt, Mycobacterium bovis subsp bovis AF2122/97
cccgaguggccggugggccgccc

SEQ ID NO: 1199296 - RNA, 18 nt, Mycobacterium bovis subsp bovis AF2122/97
cccgaguuaaacgcagcg

SEQ ID NO: 1199297 - RNA, 15 nt, Mycobacterium bovis subsp bovis AF2122/97
cccgagggcggcagc

SEQ ID NO: 1199298 - RNA, 22 nt, Mycobacterium bovis subsp bovis AF2122/97
cccgagcccagccgggcacccu

SEQ ID NO: 1199299 - RNA, 16 nt, Mycobacterium bovis subsp bovis AF2122/97
cccgagaguggacgug

SEQ ID NO: 1199300 - RNA, 14 nt, Mycobacterium bovis subsp bovis AF2122/97
cccgagcgcgcgcu

SEQ ID NO: 1199301 - RNA, 15 nt, Mycobacterium bovis subsp bovis AF2122/97
cccgagccgcagcuc

SEQ ID NO: 1199302 - RNA, 18 nt, Mycobacterium bovis subsp bovis AF2122/97
cccgagccgcagcucgcc

SEQ ID NO: 1199303 - RNA, 14 nt, Mycobacterium bovis subsp bovis AF2122/97
cccgagccgguaac

SEQ ID NO: 1199304 - RNA, 11 nt, Mycobacterium bovis subsp bovis AF2122/97
cccgagccugg

SEQ ID NO: 1199305 - RNA, 23 nt, Mycobacterium bovis subsp bovis AF2122/97
cccgaucgucgagccgaucgccc

SEQ ID NO: 1199306 - RNA, 20 nt, Mycobacterium bovis subsp bovis AF2122/97
cccgauccuggccacuccca

SEQ ID NO: 1199307 - RNA, 23 nt, Mycobacterium bovis subsp bovis AF2122/97
cccgaugaggacauccggcgccg

SEQ ID NO: 1199308 - RNA, 19 nt, Mycobacterium bovis subsp bovis AF2122/97
cccgaugacccacugcagg

SEQ ID NO: 1199309 - RNA, 18 nt, Mycobacterium bovis subsp bovis AF2122/97
cccgauccugcccaccau

SEQ ID NO: 1199310 - RNA, 19 nt, Mycobacterium bovis subsp bovis AF2122/97
cccgauccugcccaccauc

SEQ ID NO: 1199311 - RNA, 16 nt, Mycobacterium bovis subsp bovis AF2122/97
cccgaucagcaccgac

SEQ ID NO: 1199312 - RNA, 13 nt, Mycobacterium bovis subsp bovis AF2122/97
cccgaucaccccg

SEQ ID NO: 1199313 - RNA, 20 nt, Mycobacterium bovis subsp bovis AF2122/97
cccgauagcgaccgcggccc

SEQ ID NO: 1199314 - RNA, 16 nt, Mycobacterium bovis subsp bovis AF2122/97
cccgauacggccggcc

SEQ ID NO: 1199315 - RNA, 17 nt, Mycobacterium bovis subsp bovis AF2122/97
cccgauacgccaccggc

SEQ ID NO: 1199316 - RNA, 15 nt, Mycobacterium bovis subsp bovis AF2122/97
cccgaguugaagaag

SEQ ID NO: 1199317 - RNA, 15 nt, Mycobacterium bovis subsp bovis AF2122/97
cccgaguugaagaau

SEQ ID NO: 1199318 - RNA, 23 nt, Mycobacterium bovis subsp bovis AF2122/97
cccgaguugaaggugccggcguu

SEQ ID NO: 1199319 - RNA, 22 nt, Mycobacterium bovis subsp bovis AF2122/97
cccgaguuguggacgcccgagu

SEQ ID NO: 1199320 - RNA, 18 nt, Mycobacterium bovis subsp bovis AF2122/97
cccgaguuguugcugccc

SEQ ID NO: 1199321 - RNA, 19 nt, Mycobacterium bovis subsp bovis AF2122/97
cccgaguuguugcugcccc

SEQ ID NO: 1199322 - RNA, 18 nt, Mycobacterium bovis subsp bovis AF2122/97
cccaugaugugcagcgag

SEQ ID NO: 1199323 - RNA, 21 nt, Mycobacterium bovis subsp bovis AF2122/97
cccaugcacggccgagcaggu

SEQ ID NO: 1199324 - RNA, 13 nt, Mycobacterium bovis subsp bovis AF2122/97
cccaugucggcgc

SEQ ID NO: 1199325 - RNA, 17 nt, Mycobacterium bovis subsp bovis AF2122/97
cccaugucggcgcgccg

SEQ ID NO: 1199326 - RNA, 19 nt, Mycobacterium bovis subsp bovis AF2122/97
cccaugucggcgcgccgca

SEQ ID NO: 1199327 - RNA, 20 nt, Mycobacterium bovis subsp bovis AF2122/97
cccaugucggcgcgccgcac

SEQ ID NO: 1199328 - RNA, 19 nt, Mycobacterium bovis subsp bovis AF2122/97
cccauggugagcugugacu

SEQ ID NO: 1199329 - RNA, 16 nt, Mycobacterium bovis subsp bovis AF2122/97
cccauucaucuugcgg

SEQ ID NO: 1199330 - RNA, 16 nt, Mycobacterium bovis subsp bovis AF2122/97
cccauucccaacacag

SEQ ID NO: 1199331 - RNA, 23 nt, Mycobacterium bovis subsp bovis AF2122/97
ccccaacagggcggcaggguguu

SEQ ID NO: 1199332 - RNA, 13 nt, Mycobacterium bovis subsp bovis AF2122/97
ccccaacaucccg

SEQ ID NO: 1199333 - RNA, 23 nt, Mycobacterium bovis subsp bovis AF2122/97
ccccaagcgccugagcggccucg

SEQ ID NO: 1199334 - RNA, 22 nt, Mycobacterium bovis subsp bovis AF2122/97
ccccaaucgaccgcccgccaac

SEQ ID NO: 1199335 - RNA, 12 nt, Mycobacterium bovis subsp bovis AF2122/97
ccccacggccag

SEQ ID NO: 1199336 - RNA, 13 nt, Mycobacterium bovis subsp bovis AF2122/97
ccccacccaccac

SEQ ID NO: 1199337 - RNA, 15 nt, Mycobacterium bovis subsp bovis AF2122/97
ccccaccggcacccc

SEQ ID NO: 1199338 - RNA, 19 nt, Mycobacterium bovis subsp bovis AF2122/97
ccccaccgguaccgccacu

SEQ ID NO: 1199339 - RNA, 14 nt, Mycobacterium bovis subsp bovis AF2122/97
ccccaccggugccg

SEQ ID NO: 1199340 - RNA, 13 nt, Mycobacterium bovis subsp bovis AF2122/97
ccccgaucugcuc

SEQ ID NO: 1199341 - RNA, 17 nt, Mycobacterium bovis subsp bovis AF2122/97
ccccgcacgcgggaggu

SEQ ID NO: 1199342 - RNA, 17 nt, Mycobacterium bovis subsp bovis AF2122/97
ccccgcauugccgucgg

SEQ ID NO: 1199343 - RNA, 12 nt, Mycobacterium bovis subsp bovis AF2122/97
cccccgccggcc

SEQ ID NO: 1199344 - RNA, 14 nt, Mycobacterium bovis subsp bovis AF2122/97
cccccgccggccgc

SEQ ID NO: 1199345 - RNA, 13 nt, Mycobacterium bovis subsp bovis AF2122/97
cccccgccggcgc

SEQ ID NO: 1199346 - RNA, 12 nt, Mycobacterium bovis subsp bovis AF2122/97
cccccgcgcgaa

SEQ ID NO: 1199347 - RNA, 16 nt, Mycobacterium bovis subsp bovis AF2122/97
ccccgagcugucggcu

SEQ ID NO: 1199348 - RNA, 13 nt, Mycobacterium bovis subsp bovis AF2122/97
ccccgagauccgu

SEQ ID NO: 1199349 - RNA, 16 nt, Mycobacterium bovis subsp bovis AF2122/97
ccccgagauccguccg

SEQ ID NO: 1199350 - RNA, 22 nt, Mycobacterium bovis subsp bovis AF2122/97
ccccgagcugucggcuuccucc

SEQ ID NO: 1199351 - RNA, 23 nt, Mycobacterium bovis subsp bovis AF2122/97
ccccgauaaaaaccacccccacc

SEQ ID NO: 1199352 - RNA, 14 nt, Mycobacterium bovis subsp bovis AF2122/97
ccccccgggcccgc

SEQ ID NO: 1199353 - RNA, 20 nt, Mycobacterium bovis subsp bovis AF2122/97
cccccgauggcgucgccggc

SEQ ID NO: 1199354 - RNA, 22 nt, Mycobacterium bovis subsp bovis AF2122/97
cccccgauggcgucgccggccc

SEQ ID NO: 1199355 - RNA, 16 nt, Mycobacterium bovis subsp bovis AF2122/97
ccccccguugccgccg

SEQ ID NO: 1199356 - RNA, 21 nt, Mycobacterium bovis subsp bovis AF2122/97
cccccgacuccggcaggcccg

SEQ ID NO: 1199357 - RNA, 15 nt, Mycobacterium bovis subsp bovis AF2122/97
ccccaccgaagcggu

SEQ ID NO: 1199358 - RNA, 22 nt, Mycobacterium bovis subsp bovis AF2122/97
ccccacuggugcagcgccgaca

SEQ ID NO: 1199359 - RNA, 16 nt, Mycobacterium bovis subsp bovis AF2122/97
ccccagaccgccacac

SEQ ID NO: 1199360 - RNA, 14 nt, Mycobacterium bovis subsp bovis AF2122/97
ccccagcagggugu

SEQ ID NO: 1199361 - RNA, 19 nt, Mycobacterium bovis subsp bovis AF2122/97
ccccagcaguucgccgcgc

SEQ ID NO: 1199362 - RNA, 22 nt, Mycobacterium bovis subsp bovis AF2122/97
ccccagcaguucgccgcgcagc

SEQ ID NO: 1199363 - RNA, 19 nt, Mycobacterium bovis subsp bovis AF2122/97
ccccagcacauucugcagc

SEQ ID NO: 1199364 - RNA, 14 nt, Mycobacterium bovis subsp bovis AF2122/97
ccccagcacccggc

SEQ ID NO: 1199365 - RNA, 18 nt, Mycobacterium bovis subsp bovis AF2122/97
cccccagguagugcacac

SEQ ID NO: 1199366 - RNA, 17 nt, Mycobacterium bovis subsp bovis AF2122/97
cccccagcgccgccgcg

SEQ ID NO: 1199367 - RNA, 21 nt, Mycobacterium bovis subsp bovis AF2122/97
cccccagacaauccgccgccg

SEQ ID NO: 1199368 - RNA, 22 nt, Mycobacterium bovis subsp bovis AF2122/97
cccaggcaaguugugagggagg

SEQ ID NO: 1199369 - RNA, 19 nt, Mycobacterium bovis subsp bovis AF2122/97
cccagcgguaucccccagc

SEQ ID NO: 1199370 - RNA, 14 nt, Mycobacterium bovis subsp bovis AF2122/97
cccagcgguugacc

SEQ ID NO: 1199371 - RNA, 19 nt, Mycobacterium bovis subsp bovis AF2122/97
cccagcgguugacccucgg

SEQ ID NO: 1199372 - RNA, 23 nt, Mycobacterium bovis subsp bovis AF2122/97
cccagcgggacaaaaucagcagc

SEQ ID NO: 1199373 - RNA, 20 nt, Mycobacterium bovis subsp bovis AF2122/97
cccagcgggucgcgggugcc

SEQ ID NO: 1199374 - RNA, 15 nt, Mycobacterium bovis subsp bovis AF2122/97
cccagcgugcccgcc

SEQ ID NO: 1199375 - RNA, 16 nt, Mycobacterium bovis subsp bovis AF2122/97
cccagcgugcccgcca

SEQ ID NO: 1199376 - RNA, 21 nt, Mycobacterium bovis subsp bovis AF2122/97
cccagcgugcccgccaccggc

SEQ ID NO: 1199377 - RNA, 16 nt, Mycobacterium bovis subsp bovis AF2122/97
cccagcguucccgccg

SEQ ID NO: 1199378 - RNA, 14 nt, Mycobacterium bovis subsp bovis AF2122/97
cccagggcugccgg

SEQ ID NO: 1199379 - RNA, 15 nt, Mycobacterium bovis subsp bovis AF2122/97
cccagggggcgugcc

SEQ ID NO: 1199380 - RNA, 18 nt, Mycobacterium bovis subsp bovis AF2122/97
cccagggggcgugccgcc

SEQ ID NO: 1199381 - RNA, 17 nt, Mycobacterium bovis subsp bovis AF2122/97
cccaggccaagguggcc

SEQ ID NO: 1199382 - RNA, 15 nt, Mycobacterium bovis subsp bovis AF2122/97
cccaggcuguccgac

SEQ ID NO: 1199383 - RNA, 16 nt, Mycobacterium bovis subsp bovis AF2122/97
cccagcgcggcaacuc

SEQ ID NO: 1199384 - RNA, 15 nt, Mycobacterium bovis subsp bovis AF2122/97
cccagcggccgcgau

SEQ ID NO: 1199385 - RNA, 19 nt, Mycobacterium bovis subsp bovis AF2122/97
cccagcggagccacucggc

SEQ ID NO: 1199386 - RNA, 22 nt, Mycobacterium bovis subsp bovis AF2122/97
cccagcgcccccagcagcugcg

SEQ ID NO: 1199387 - RNA, 14 nt, Mycobacterium bovis subsp bovis AF2122/97
cccagcgcccgccg

SEQ ID NO: 1199388 - RNA, 18 nt, Mycobacterium bovis subsp bovis AF2122/97
cccagcgcccgccggcau

SEQ ID NO: 1199389 - RNA, 17 nt, Mycobacterium bovis subsp bovis AF2122/97
cccagcgcccgcgcggc

SEQ ID NO: 1199390 - RNA, 13 nt, Mycobacterium bovis subsp bovis AF2122/97
cccagcgccgccg

SEQ ID NO: 1199391 - RNA, 14 nt, Mycobacterium bovis subsp bovis AF2122/97
cccagcgcccggcc

SEQ ID NO: 1199392 - RNA, 15 nt, Mycobacterium bovis subsp bovis AF2122/97
cccagcgccgcacag

SEQ ID NO: 1199393 - RNA, 13 nt, Mycobacterium bovis subsp bovis AF2122/97
cccagcgccucca

SEQ ID NO: 1199394 - RNA, 16 nt, Mycobacterium bovis subsp bovis AF2122/97
cccagcgccuccagca

SEQ ID NO: 1199395 - RNA, 14 nt, Mycobacterium bovis subsp bovis AF2122/97
cccagcgcagcagc

SEQ ID NO: 1199396 - RNA, 15 nt, Mycobacterium bovis subsp bovis AF2122/97
cccagcgcagcagcg

SEQ ID NO: 1199397 - RNA, 14 nt, Mycobacterium bovis subsp bovis AF2122/97
cccagcgauucagc

SEQ ID NO: 1199398 - RNA, 17 nt, Mycobacterium bovis subsp bovis AF2122/97
cccagcgcagcagcggc

SEQ ID NO: 1199399 - RNA, 14 nt, Mycobacterium bovis subsp bovis AF2122/97
cccagcgagguggg

SEQ ID NO: 1199400 - RNA, 22 nt, Mycobacterium bovis subsp bovis AF2122/97
cccagcgacucggccaggauga

SEQ ID NO: 1199401 - RNA, 15 nt, Mycobacterium bovis subsp bovis AF2122/97
cccagcgacucggcc

SEQ ID NO: 1199402 - RNA, 23 nt, Mycobacterium bovis subsp bovis AF2122/97
cccagcgacgcggccagcggcaa

SEQ ID NO: 1199403 - RNA, 20 nt, Mycobacterium bovis subsp bovis AF2122/97
cccagcgacccggccagcgg

SEQ ID NO: 1199404 - RNA, 14 nt, Mycobacterium bovis subsp bovis AF2122/97
cccagcgacccggc

SEQ ID NO: 1199405 - RNA, 17 nt, Mycobacterium bovis subsp bovis AF2122/97
cccagcgaaucacccgc

SEQ ID NO: 1199406 - RNA, 16 nt, Mycobacterium bovis subsp bovis AF2122/97
cccacguugcugaugc

SEQ ID NO: 1199407 - RNA, 16 nt, Mycobacterium bovis subsp bovis AF2122/97
cccacguggggccggg

SEQ ID NO: 1199408 - RNA, 22 nt, Mycobacterium bovis subsp bovis AF2122/97
cccacggugucccgcgaggcaa

SEQ ID NO: 1199409 - RNA, 15 nt, Mycobacterium bovis subsp bovis AF2122/97
cccacgggccggccg

SEQ ID NO: 1199410 - RNA, 19 nt, Mycobacterium bovis subsp bovis AF2122/97
cccacgggccggccgagcg

SEQ ID NO: 1199411 - RNA, 19 nt, Mycobacterium bovis subsp bovis AF2122/97
cccacggcggguuccacac

SEQ ID NO: 1199412 - RNA, 15 nt, Mycobacterium bovis subsp bovis AF2122/97
cccacggcaccacca

SEQ ID NO: 1199413 - RNA, 22 nt, Mycobacterium bovis subsp bovis AF2122/97
cccacggccggccgcugccacu

SEQ ID NO: 1199414 - RNA, 15 nt, Mycobacterium bovis subsp bovis AF2122/97
cccacggcgaccacg

SEQ ID NO: 1199415 - RNA, 17 nt, Mycobacterium bovis subsp bovis AF2122/97
cccacggcgaccacgcc

SEQ ID NO: 1199416 - RNA, 18 nt, Mycobacterium bovis subsp bovis AF2122/97
cccacucaucagagcgcu

SEQ ID NO: 1199417 - RNA, 15 nt, Mycobacterium bovis subsp bovis AF2122/97
cccagcacccggcuu

SEQ ID NO: 1199418 - RNA, 13 nt, Mycobacterium bovis subsp bovis AF2122/97
cccagcacccuca

SEQ ID NO: 1199419 - RNA, 14 nt, Mycobacterium bovis subsp bovis AF2122/97
cccagcacgcuggc

SEQ ID NO: 1199420 - RNA, 12 nt, Mycobacterium bovis subsp bovis AF2122/97
cccagcagacca

SEQ ID NO: 1199421 - RNA, 14 nt, Mycobacterium bovis subsp bovis AF2122/97
cccagccggcagca

SEQ ID NO: 1199422 - RNA, 17 nt, Mycobacterium bovis subsp bovis AF2122/97
cccagccggcagcagcg

SEQ ID NO: 1199423 - RNA, 13 nt, Mycobacterium bovis subsp bovis AF2122/97
cccagccggcagc

SEQ ID NO: 1199424 - RNA, 19 nt, Mycobacterium bovis subsp bovis AF2122/97
cccagccgcgggccgcguc

SEQ ID NO: 1199425 - RNA, 13 nt, Mycobacterium bovis subsp bovis AF2122/97
cccagccgcgcca

SEQ ID NO: 1199426 - RNA, 23 nt, Mycobacterium bovis subsp bovis AF2122/97
cccagcccuuggcgcgcagguag

SEQ ID NO: 1199427 - RNA, 21 nt, Mycobacterium bovis subsp bovis AF2122/97
cccagcagcaccugcaccgca

SEQ ID NO: 1199428 - RNA, 13 nt, Mycobacterium bovis subsp bovis AF2122/97
cccagcccggcgu

SEQ ID NO: 1199429 - RNA, 13 nt, Mycobacterium bovis subsp bovis AF2122/97
cccagccccgacu

SEQ ID NO: 1199430 - RNA, 23 nt, Mycobacterium bovis subsp bovis AF2122/97
cccagcagguuccacggccaggu

SEQ ID NO: 1199431 - RNA, 20 nt, Mycobacterium bovis subsp bovis AF2122/97
cccagcaguucgccgcgcag

SEQ ID NO: 1199432 - RNA, 15 nt, Mycobacterium bovis subsp bovis AF2122/97
cccaacaccagcagc

SEQ ID NO: 1199433 - RNA, 15 nt, Mycobacterium bovis subsp bovis AF2122/97
cccaacaccgccaga

SEQ ID NO: 1199434 - RNA, 21 nt, Mycobacterium bovis subsp bovis AF2122/97
cccaacagggcggcagggugu

SEQ ID NO: 1199435 - RNA, 14 nt, Mycobacterium bovis subsp bovis AF2122/97
cccacagcgugcgg

SEQ ID NO: 1199436 - RNA, 15 nt, Mycobacterium bovis subsp bovis AF2122/97
cccacaccuuggcgg

SEQ ID NO: 1199437 - RNA, 20 nt, Mycobacterium bovis subsp bovis AF2122/97
cccacacuaggccccaccau

SEQ ID NO: 1199438 - RNA, 13 nt, Mycobacterium bovis subsp bovis AF2122/97
cccacacccagcg

SEQ ID NO: 1199439 - RNA, 12 nt, Mycobacterium bovis subsp bovis AF2122/97
cccacaccagcg

SEQ ID NO: 1199440 - RNA, 15 nt, Mycobacterium bovis subsp bovis AF2122/97
cccacaccagcgcag

SEQ ID NO: 1199441 - RNA, 19 nt, Mycobacterium bovis subsp bovis AF2122/97
cccaacccuaaaccagcca

SEQ ID NO: 1199442 - RNA, 17 nt, Mycobacterium bovis subsp bovis AF2122/97
cccaaccgaaccgcguu

SEQ ID NO: 1199443 - RNA, 16 nt, Mycobacterium bovis subsp bovis AF2122/97
cccaaccccgccggcc

SEQ ID NO: 1199444 - RNA, 13 nt, Mycobacterium bovis subsp bovis AF2122/97
cccaaccugggaa

SEQ ID NO: 1199445 - RNA, 21 nt, Mycobacterium bovis subsp bovis AF2122/97
cccacaagcgauggcaccacu

SEQ ID NO: 1199446 - RNA, 15 nt, Mycobacterium bovis subsp bovis AF2122/97
cccacaaucagcccg

SEQ ID NO: 1199447 - RNA, 14 nt, Mycobacterium bovis subsp bovis AF2122/97
cccacacacccgac

SEQ ID NO: 1199448 - RNA, 22 nt, Mycobacterium bovis subsp bovis AF2122/97
cccacgccugccgaaacgccga

SEQ ID NO: 1199449 - RNA, 22 nt, Mycobacterium bovis subsp bovis AF2122/97
cccacgcugcccacgggccggc

SEQ ID NO: 1199450 - RNA, 16 nt, Mycobacterium bovis subsp bovis AF2122/97
cccacggagggcagga

SEQ ID NO: 1199451 - RNA, 16 nt, Mycobacterium bovis subsp bovis AF2122/97
cccaccggcgccgccg

SEQ ID NO: 1199452 - RNA, 12 nt, Mycobacterium bovis subsp bovis AF2122/97
cccaccggcccg

SEQ ID NO: 1199453 - RNA, 18 nt, Mycobacterium bovis subsp bovis AF2122/97
cccaccggaccaccgccg

SEQ ID NO: 1199454 - RNA, 22 nt, Mycobacterium bovis subsp bovis AF2122/97
cccaccggaccaccgccgaagc

SEQ ID NO: 1199455 - RNA, 18 nt, Mycobacterium bovis subsp bovis AF2122/97
cccaccggugccgcccgc

SEQ ID NO: 1199456 - RNA, 16 nt, Mycobacterium bovis subsp bovis AF2122/97
cccaccggugccgccc

SEQ ID NO: 1199457 - RNA, 17 nt, Mycobacterium bovis subsp bovis AF2122/97
cccaccggugccgcccg

SEQ ID NO: 1199458 - RNA, 14 nt, Mycobacterium bovis subsp bovis AF2122/97
cccaccgucacccc

SEQ ID NO: 1199459 - RNA, 15 nt, Mycobacterium bovis subsp bovis AF2122/97
cccaccgucugcugg

SEQ ID NO: 1199460 - RNA, 21 nt, Mycobacterium bovis subsp bovis AF2122/97
cccaccgccguugggccgcgc

SEQ ID NO: 1199461 - RNA, 17 nt, Mycobacterium bovis subsp bovis AF2122/97
cccaccgcgccgagcag

SEQ ID NO: 1199462 - RNA, 21 nt, Mycobacterium bovis subsp bovis AF2122/97
cccaccgccugggcggccagc

SEQ ID NO: 1199463 - RNA, 15 nt, Mycobacterium bovis subsp bovis AF2122/97
cccaccaccgacagc

SEQ ID NO: 1199464 - RNA, 14 nt, Mycobacterium bovis subsp bovis AF2122/97
cccaccacaccaag

SEQ ID NO: 1199465 - RNA, 16 nt, Mycobacterium bovis subsp bovis AF2122/97
ccaucuugaccaaugu

SEQ ID NO: 1199466 - RNA, 15 nt, Mycobacterium bovis subsp bovis AF2122/97
ccauugugggacgcg

SEQ ID NO: 1199467 - RNA, 14 nt, Mycobacterium bovis subsp bovis AF2122/97
ccauugccgccguc

SEQ ID NO: 1199468 - RNA, 15 nt, Mycobacterium bovis subsp bovis AF2122/97
ccauuucgucagcga

SEQ ID NO: 1199469 - RNA, 14 nt, Mycobacterium bovis subsp bovis AF2122/97
cccgccuuggccac

SEQ ID NO: 1199470 - RNA, 13 nt, Mycobacterium bovis subsp bovis AF2122/97
cccgccuuggcca

SEQ ID NO: 1199471 - RNA, 21 nt, Mycobacterium bovis subsp bovis AF2122/97
cccgcgaagcgggaaggcuca

SEQ ID NO: 1199472 - RNA, 17 nt, Mycobacterium bovis subsp bovis AF2122/97
cccgcgagaucgggccg

SEQ ID NO: 1199473 - RNA, 20 nt, Mycobacterium bovis subsp bovis AF2122/97
cccgcgagaucgggccggcc

SEQ ID NO: 1199474 - RNA, 22 nt, Mycobacterium bovis subsp bovis AF2122/97
cccgcgagaucgggccggccgc

SEQ ID NO: 1199475 - RNA, 23 nt, Mycobacterium bovis subsp bovis AF2122/97
cccgcgagaucgggccggccgcc

SEQ ID NO: 1199476 - RNA, 13 nt, Mycobacterium bovis subsp bovis AF2122/97
cccgcgagcaucg

SEQ ID NO: 1199477 - RNA, 18 nt, Mycobacterium bovis subsp bovis AF2122/97
cccgcgaacgaucccgcc

SEQ ID NO: 1199478 - RNA, 12 nt, Mycobacterium bovis subsp bovis AF2122/97
cccgcgccgccc

SEQ ID NO: 1199479 - RNA, 14 nt, Mycobacterium bovis subsp bovis AF2122/97
cccgcgccgcgcau

SEQ ID NO: 1199480 - RNA, 19 nt, Mycobacterium bovis subsp bovis AF2122/97
cccgcgccgccgccaccac

SEQ ID NO: 1199481 - RNA, 23 nt, Mycobacterium bovis subsp bovis AF2122/97
cccgcgccgccggacccaccguc

SEQ ID NO: 1199482 - RNA, 20 nt, Mycobacterium bovis subsp bovis AF2122/97
cccgcgccaccggcaccgcc

SEQ ID NO: 1199483 - RNA, 13 nt, Mycobacterium bovis subsp bovis AF2122/97
cccgcgcagcacu

SEQ ID NO: 1199484 - RNA, 17 nt, Mycobacterium bovis subsp bovis AF2122/97
cccgcgauucgcggcag

SEQ ID NO: 1199485 - RNA, 16 nt, Mycobacterium bovis subsp bovis AF2122/97
cccgcgaugcgcacca

SEQ ID NO: 1199486 - RNA, 13 nt, Mycobacterium bovis subsp bovis AF2122/97
cccgcgccaccag

SEQ ID NO: 1199487 - RNA, 20 nt, Mycobacterium bovis subsp bovis AF2122/97
cccgcgaugcgcaccagcgg

SEQ ID NO: 1199488 - RNA, 15 nt, Mycobacterium bovis subsp bovis AF2122/97
cccgcgcagcacugc

SEQ ID NO: 1199489 - RNA, 21 nt, Mycobacterium bovis subsp bovis AF2122/97
cccgccgacgccgccggcccc

SEQ ID NO: 1199490 - RNA, 20 nt, Mycobacterium bovis subsp bovis AF2122/97
cccgccgagcgguugccuuc

SEQ ID NO: 1199491 - RNA, 13 nt, Mycobacterium bovis subsp bovis AF2122/97
cccgccgagcgcg

SEQ ID NO: 1199492 - RNA, 15 nt, Mycobacterium bovis subsp bovis AF2122/97
cccgccgccaccagc

SEQ ID NO: 1199493 - RNA, 13 nt, Mycobacterium bovis subsp bovis AF2122/97
cccgccgcacgca

SEQ ID NO: 1199494 - RNA, 15 nt, Mycobacterium bovis subsp bovis AF2122/97
cccgccgccccacaa

SEQ ID NO: 1199495 - RNA, 22 nt, Mycobacterium bovis subsp bovis AF2122/97
cccgccgcgaacuccagcagcc

SEQ ID NO: 1199496 - RNA, 11 nt, Mycobacterium bovis subsp bovis AF2122/97
cccgccgcgac

SEQ ID NO: 1199497 - RNA, 17 nt, Mycobacterium bovis subsp bovis AF2122/97
cccgccgcgaccacgca

SEQ ID NO: 1199498 - RNA, 21 nt, Mycobacterium bovis subsp bovis AF2122/97
cccgccgcgaccacgcaccgc

SEQ ID NO: 1199499 - RNA, 13 nt, Mycobacterium bovis subsp bovis AF2122/97
cccgccgccgccc

SEQ ID NO: 1199500 - RNA, 12 nt, Mycobacterium bovis subsp bovis AF2122/97
cccgccggcccc

SEQ ID NO: 1199501 - RNA, 13 nt, Mycobacterium bovis subsp bovis AF2122/97
cccgccgcgugcu

SEQ ID NO: 1199502 - RNA, 17 nt, Mycobacterium bovis subsp bovis AF2122/97
cccgccggacccgcccu

SEQ ID NO: 1199503 - RNA, 15 nt, Mycobacterium bovis subsp bovis AF2122/97
cccgccggacccgcc

SEQ ID NO: 1199504 - RNA, 15 nt, Mycobacterium bovis subsp bovis AF2122/97
cccgccggcuccgcc

SEQ ID NO: 1199505 - RNA, 14 nt, Mycobacterium bovis subsp bovis AF2122/97
cccgccggccccgc

SEQ ID NO: 1199506 - RNA, 15 nt, Mycobacterium bovis subsp bovis AF2122/97
cccgccggccccgcc

SEQ ID NO: 1199507 - RNA, 19 nt, Mycobacterium bovis subsp bovis AF2122/97
cccgccggccccgccggcc

SEQ ID NO: 1199508 - RNA, 21 nt, Mycobacterium bovis subsp bovis AF2122/97
cccgccggccccgccggcccc

SEQ ID NO: 1199509 - RNA, 22 nt, Mycobacterium bovis subsp bovis AF2122/97
cccgccggccccgccggccccg

SEQ ID NO: 1199510 - RNA, 18 nt, Mycobacterium bovis subsp bovis AF2122/97
cccgccggccccgccguu

SEQ ID NO: 1199511 - RNA, 18 nt, Mycobacterium bovis subsp bovis AF2122/97
cccgccgggcuccacguc

SEQ ID NO: 1199512 - RNA, 17 nt, Mycobacterium bovis subsp bovis AF2122/97
cccgccggguccgccgg

SEQ ID NO: 1199513 - RNA, 21 nt, Mycobacterium bovis subsp bovis AF2122/97
cccgccggguccgccgggccc

SEQ ID NO: 1199514 - RNA, 21 nt, Mycobacterium bovis subsp bovis AF2122/97
cccgccggcuccgccacuggc

SEQ ID NO: 1199515 - RNA, 14 nt, Mycobacterium bovis subsp bovis AF2122/97
cccgccgggcucca

SEQ ID NO: 1199516 - RNA, 16 nt, Mycobacterium bovis subsp bovis AF2122/97
cccgccguugccgccg

SEQ ID NO: 1199517 - RNA, 18 nt, Mycobacterium bovis subsp bovis AF2122/97
cccgccguugccgccguc

SEQ ID NO: 1199518 - RNA, 21 nt, Mycobacterium bovis subsp bovis AF2122/97
cccgccguugaacggcaccag

SEQ ID NO: 1199519 - RNA, 18 nt, Mycobacterium bovis subsp bovis AF2122/97
cccgccguccggcgccca

SEQ ID NO: 1199520 - RNA, 16 nt, Mycobacterium bovis subsp bovis AF2122/97
cccgccgucacccccg

SEQ ID NO: 1199521 - RNA, 15 nt, Mycobacterium bovis subsp bovis AF2122/97
cccgccugaccgcca

SEQ ID NO: 1199522 - RNA, 15 nt, Mycobacterium bovis subsp bovis AF2122/97
cccgcaucgcaccag

SEQ ID NO: 1199523 - RNA, 18 nt, Mycobacterium bovis subsp bovis AF2122/97
cccgcaggucgcaccaca

SEQ ID NO: 1199524 - RNA, 20 nt, Mycobacterium bovis subsp bovis AF2122/97
cccgcagguggcuguucacc

SEQ ID NO: 1199525 - RNA, 16 nt, Mycobacterium bovis subsp bovis AF2122/97
cccgcaggcuuccccg

SEQ ID NO: 1199526 - RNA, 20 nt, Mycobacterium bovis subsp bovis AF2122/97
cccgcagcgccuaccagcac

SEQ ID NO: 1199527 - RNA, 15 nt, Mycobacterium bovis subsp bovis AF2122/97
cccgcaggacgcugc

SEQ ID NO: 1199528 - RNA, 19 nt, Mycobacterium bovis subsp bovis AF2122/97
cccgcagcuaucuccaugc

SEQ ID NO: 1199529 - RNA, 19 nt, Mycobacterium bovis subsp bovis AF2122/97
cccgcagcucgaccaggaa

SEQ ID NO: 1199530 - RNA, 13 nt, Mycobacterium bovis subsp bovis AF2122/97
cccgcagaccgcc

SEQ ID NO: 1199531 - RNA, 22 nt, Mycobacterium bovis subsp bovis AF2122/97
cccgcaugcccuggaccagcgg

SEQ ID NO: 1199532 - RNA, 17 nt, Mycobacterium bovis subsp bovis AF2122/97
cccgcauugccaacgcc

SEQ ID NO: 1199533 - RNA, 14 nt, Mycobacterium bovis subsp bovis AF2122/97
cccgccaaccccaa

SEQ ID NO: 1199534 - RNA, 24 nt, Mycobacterium bovis subsp bovis AF2122/97
cccgccacgucgccggcuaccgcc

SEQ ID NO: 1199535 - RNA, 16 nt, Mycobacterium bovis subsp bovis AF2122/97
cccgccacgucgccgg

SEQ ID NO: 1199536 - RNA, 22 nt, Mycobacterium bovis subsp bovis AF2122/97
cccgccacgguucgggcagcac

SEQ ID NO: 1199537 - RNA, 18 nt, Mycobacterium bovis subsp bovis AF2122/97
cccgccaccucgccggcc

SEQ ID NO: 1199538 - RNA, 14 nt, Mycobacterium bovis subsp bovis AF2122/97
cccgccaccgaaca

SEQ ID NO: 1199539 - RNA, 14 nt, Mycobacterium bovis subsp bovis AF2122/97
cccgccgaccgaca

SEQ ID NO: 1199540 - RNA, 19 nt, Mycobacterium bovis subsp bovis AF2122/97
cccgccgaccgacaccacc

SEQ ID NO: 1199541 - RNA, 16 nt, Mycobacterium bovis subsp bovis AF2122/97
cccgcccuugccgccg

SEQ ID NO: 1199542 - RNA, 17 nt, Mycobacterium bovis subsp bovis AF2122/97
cccgcccuugccgccag

SEQ ID NO: 1199543 - RNA, 21 nt, Mycobacterium bovis subsp bovis AF2122/97
cccgcccguagacccacaguc

SEQ ID NO: 1199544 - RNA, 14 nt, Mycobacterium bovis subsp bovis AF2122/97
cccgcccggcaguu

SEQ ID NO: 1199545 - RNA, 14 nt, Mycobacterium bovis subsp bovis AF2122/97
cccgcccgcgcggu

SEQ ID NO: 1199546 - RNA, 18 nt, Mycobacterium bovis subsp bovis AF2122/97
cccgcccacggcaccacc

SEQ ID NO: 1199547 - RNA, 12 nt, Mycobacterium bovis subsp bovis AF2122/97
cccgccccgacc

SEQ ID NO: 1199548 - RNA, 14 nt, Mycobacterium bovis subsp bovis AF2122/97
cccgccaucugccu

SEQ ID NO: 1199549 - RNA, 15 nt, Mycobacterium bovis subsp bovis AF2122/97
cccgccaucugccug

SEQ ID NO: 1199550 - RNA, 18 nt, Mycobacterium bovis subsp bovis AF2122/97
cccgccauugccgccguc

SEQ ID NO: 1199551 - RNA, 21 nt, Mycobacterium bovis subsp bovis AF2122/97
cccgcccaagguggcggccag

SEQ ID NO: 1199552 - RNA, 13 nt, Mycobacterium bovis subsp bovis AF2122/97
cccgcccacggca

SEQ ID NO: 1199553 - RNA, 13 nt, Mycobacterium bovis subsp bovis AF2122/97
cccgcccaaugcg

SEQ ID NO: 1199554 - RNA, 15 nt, Mycobacterium bovis subsp bovis AF2122/97
cccgccaugcggcgc

SEQ ID NO: 1199555 - RNA, 15 nt, Mycobacterium bovis subsp bovis AF2122/97
cccgccagcggcagc

SEQ ID NO: 1199556 - RNA, 13 nt, Mycobacterium bovis subsp bovis AF2122/97
cccgccaggaucu

SEQ ID NO: 1199557 - RNA, 13 nt, Mycobacterium bovis subsp bovis AF2122/97
cccgccagcgccg

SEQ ID NO: 1199558 - RNA, 15 nt, Mycobacterium bovis subsp bovis AF2122/97
cccgccagcgccgcc

SEQ ID NO: 1199559 - RNA, 16 nt, Mycobacterium bovis subsp bovis AF2122/97
cccgccagcgccgccg

SEQ ID NO: 1199560 - RNA, 17 nt, Mycobacterium bovis subsp bovis AF2122/97
cccgccagcgccgccgg

SEQ ID NO: 1199561 - RNA, 13 nt, Mycobacterium bovis subsp bovis AF2122/97
cccgcgcgcacca

SEQ ID NO: 1199562 - RNA, 21 nt, Mycobacterium bovis subsp bovis AF2122/97
cccgcgccuccguugccccca

SEQ ID NO: 1199563 - RNA, 17 nt, Mycobacterium bovis subsp bovis AF2122/97
cccgcgccuuggcaccc

SEQ ID NO: 1199564 - RNA, 17 nt, Mycobacterium bovis subsp bovis AF2122/97
cccgcgcgagagccucc

SEQ ID NO: 1199565 - RNA, 11 nt, Mycobacterium bovis subsp bovis AF2122/97
cccgcgcgucg

SEQ ID NO: 1199566 - RNA, 13 nt, Mycobacterium bovis subsp bovis AF2122/97
cccgcggccagca

SEQ ID NO: 1199567 - RNA, 16 nt, Mycobacterium bovis subsp bovis AF2122/97
cccgcggaccgcaacg

SEQ ID NO: 1199568 - RNA, 23 nt, Mycobacterium bovis subsp bovis AF2122/97
cccgcggcaacgcggucugcucc

SEQ ID NO: 1199569 - RNA, 22 nt, Mycobacterium bovis subsp bovis AF2122/97
cccgcggcgaaccgucucgccc

SEQ ID NO: 1199570 - RNA, 14 nt, Mycobacterium bovis subsp bovis AF2122/97
cccgcggcgccgcc

SEQ ID NO: 1199571 - RNA, 15 nt, Mycobacterium bovis subsp bovis AF2122/97
cccgcggcgccgcca

SEQ ID NO: 1199572 - RNA, 21 nt, Mycobacterium bovis subsp bovis AF2122/97
cccgcggcgccguugccaccg

SEQ ID NO: 1199573 - RNA, 19 nt, Mycobacterium bovis subsp bovis AF2122/97
cccgcgggucguccggcgg

SEQ ID NO: 1199574 - RNA, 13 nt, Mycobacterium bovis subsp bovis AF2122/97
cccgcggggaauc

SEQ ID NO: 1199575 - RNA, 21 nt, Mycobacterium bovis subsp bovis AF2122/97
cccgcggugacgagcacaugc

SEQ ID NO: 1199576 - RNA, 18 nt, Mycobacterium bovis subsp bovis AF2122/97
cccgcggugacgccagcc

SEQ ID NO: 1199577 - RNA, 18 nt, Mycobacterium bovis subsp bovis AF2122/97
cccgcuaacuggcccgga

SEQ ID NO: 1199578 - RNA, 23 nt, Mycobacterium bovis subsp bovis AF2122/97
cccgcuaacuggcccggacaugc

SEQ ID NO: 1199579 - RNA, 14 nt, Mycobacterium bovis subsp bovis AF2122/97
cccgcguucgagag

SEQ ID NO: 1199580 - RNA, 15 nt, Mycobacterium bovis subsp bovis AF2122/97
cccgcucggccgccg

SEQ ID NO: 1199581 - RNA, 23 nt, Mycobacterium bovis subsp bovis AF2122/97
cccgcucgcccgccgccaccagc

SEQ ID NO: 1199582 - RNA, 19 nt, Mycobacterium bovis subsp bovis AF2122/97
cccgcucguaggaccucag

SEQ ID NO: 1199583 - RNA, 16 nt, Mycobacterium bovis subsp bovis AF2122/97
cccgcucggccgccgg

SEQ ID NO: 1199584 - RNA, 17 nt, Mycobacterium bovis subsp bovis AF2122/97
cccgcuccgcgccgccc

SEQ ID NO: 1199585 - RNA, 13 nt, Mycobacterium bovis subsp bovis AF2122/97
cccgcuccacccc

SEQ ID NO: 1199586 - RNA, 16 nt, Mycobacterium bovis subsp bovis AF2122/97
cccgcucccugcaccc

SEQ ID NO: 1199587 - RNA, 20 nt, Mycobacterium bovis subsp bovis AF2122/97
cccgcuccgccgucgccgcc

SEQ ID NO: 1199588 - RNA, 21 nt, Mycobacterium bovis subsp bovis AF2122/97
cccgcuccgccgucgccgccg

SEQ ID NO: 1199589 - RNA, 23 nt, Mycobacterium bovis subsp bovis AF2122/97
cccgcguugaaggcgccgguguu

SEQ ID NO: 1199590 - RNA, 17 nt, Mycobacterium bovis subsp bovis AF2122/97
cccgcucacgcucaccc

SEQ ID NO: 1199591 - RNA, 14 nt, Mycobacterium bovis subsp bovis AF2122/97
cccgcuggcccgcc

SEQ ID NO: 1199592 - RNA, 15 nt, Mycobacterium bovis subsp bovis AF2122/97
cccgcuggcccgcca

SEQ ID NO: 1199593 - RNA, 18 nt, Mycobacterium bovis subsp bovis AF2122/97
cccgcuggcgagcagacg

SEQ ID NO: 1199594 - RNA, 16 nt, Mycobacterium bovis subsp bovis AF2122/97
cccgcuggccuccugg

SEQ ID NO: 1199595 - RNA, 21 nt, Mycobacterium bovis subsp bovis AF2122/97
cccgcugggcuuggggccgga

SEQ ID NO: 1199596 - RNA, 13 nt, Mycobacterium bovis subsp bovis AF2122/97
cccgcuguaccuc

SEQ ID NO: 1199597 - RNA, 16 nt, Mycobacterium bovis subsp bovis AF2122/97
cccgcugccacccauc

SEQ ID NO: 1199598 - RNA, 14 nt, Mycobacterium bovis subsp bovis AF2122/97
cccgcugaccauca

SEQ ID NO: 1199599 - RNA, 18 nt, Mycobacterium bovis subsp bovis AF2122/97
cccggauguccgccgacg

SEQ ID NO: 1199600 - RNA, 19 nt, Mycobacterium bovis subsp bovis AF2122/97
cccggcaaacuccagcuug

SEQ ID NO: 1199601 - RNA, 12 nt, Mycobacterium bovis subsp bovis AF2122/97
cccggcaaccgg

SEQ ID NO: 1199602 - RNA, 17 nt, Mycobacterium bovis subsp bovis AF2122/97
cccggcaaccuggacug

SEQ ID NO: 1199603 - RNA, 16 nt, Mycobacterium bovis subsp bovis AF2122/97
cccggcauacucuuug

SEQ ID NO: 1199604 - RNA, 21 nt, Mycobacterium bovis subsp bovis AF2122/97
cccggcauagccacgcaagca

SEQ ID NO: 1199605 - RNA, 12 nt, Mycobacterium bovis subsp bovis AF2122/97
cccggcaccgcg

SEQ ID NO: 1199606 - RNA, 22 nt, Mycobacterium bovis subsp bovis AF2122/97
cccggcacccaguuccacccgg

SEQ ID NO: 1199607 - RNA, 17 nt, Mycobacterium bovis subsp bovis AF2122/97
cccggcauugcccgagc

SEQ ID NO: 1199608 - RNA, 15 nt, Mycobacterium bovis subsp bovis AF2122/97
cccggccaaccacca

SEQ ID NO: 1199609 - RNA, 16 nt, Mycobacterium bovis subsp bovis AF2122/97
cccggccaaccaccaa

SEQ ID NO: 1199610 - RNA, 12 nt, Mycobacterium bovis subsp bovis AF2122/97
cccggcauacaa

SEQ ID NO: 1199611 - RNA, 12 nt, Mycobacterium bovis subsp bovis AF2122/97
cccggccagcug

SEQ ID NO: 1199612 - RNA, 14 nt, Mycobacterium bovis subsp bovis AF2122/97
cccggccaggccga

SEQ ID NO: 1199613 - RNA, 18 nt, Mycobacterium bovis subsp bovis AF2122/97
cccggccaggucgacacc

SEQ ID NO: 1199614 - RNA, 22 nt, Mycobacterium bovis subsp bovis AF2122/97
cccggcccauugucgaucaccu

SEQ ID NO: 1199615 - RNA, 15 nt, Mycobacterium bovis subsp bovis AF2122/97
cccggaaccggcgug

SEQ ID NO: 1199616 - RNA, 14 nt, Mycobacterium bovis subsp bovis AF2122/97
cccggaaccagccg

SEQ ID NO: 1199617 - RNA, 16 nt, Mycobacterium bovis subsp bovis AF2122/97
cccggaacccgagccg

SEQ ID NO: 1199618 - RNA, 13 nt, Mycobacterium bovis subsp bovis AF2122/97
cccggaagcgccg

SEQ ID NO: 1199619 - RNA, 17 nt, Mycobacterium bovis subsp bovis AF2122/97
cccggaagcgccggccc

SEQ ID NO: 1199620 - RNA, 19 nt, Mycobacterium bovis subsp bovis AF2122/97
cccggaaucgucgcggccg

SEQ ID NO: 1199621 - RNA, 16 nt, Mycobacterium bovis subsp bovis AF2122/97
cccgcuuugcacugug

SEQ ID NO: 1199622 - RNA, 19 nt, Mycobacterium bovis subsp bovis AF2122/97
cccgcuuuuucccggcggc

SEQ ID NO: 1199623 - RNA, 21 nt, Mycobacterium bovis subsp bovis AF2122/97
cccggacaugcgggcagcacu

SEQ ID NO: 1199624 - RNA, 14 nt, Mycobacterium bovis subsp bovis AF2122/97
cccggaccacuguu

SEQ ID NO: 1199625 - RNA, 18 nt, Mycobacterium bovis subsp bovis AF2122/97
cccggaccgucguggcgg

SEQ ID NO: 1199626 - RNA, 18 nt, Mycobacterium bovis subsp bovis AF2122/97
cccggacguaggcacccc

SEQ ID NO: 1199627 - RNA, 19 nt, Mycobacterium bovis subsp bovis AF2122/97
cccggacucuccccuggcc

SEQ ID NO: 1199628 - RNA, 18 nt, Mycobacterium bovis subsp bovis AF2122/97
cccggagcggucagcgga

SEQ ID NO: 1199629 - RNA, 16 nt, Mycobacterium bovis subsp bovis AF2122/97
cccggcgagcacccgc

SEQ ID NO: 1199630 - RNA, 14 nt, Mycobacterium bovis subsp bovis AF2122/97
cccggccugcuggu

SEQ ID NO: 1199631 - RNA, 15 nt, Mycobacterium bovis subsp bovis AF2122/97
cccggccuugccacc

SEQ ID NO: 1199632 - RNA, 16 nt, Mycobacterium bovis subsp bovis AF2122/97
cccggccuugccaccg

SEQ ID NO: 1199633 - RNA, 15 nt, Mycobacterium bovis subsp bovis AF2122/97
cccggccuugccgcc

SEQ ID NO: 1199634 - RNA, 21 nt, Mycobacterium bovis subsp bovis AF2122/97
cccggccuugccgccggcccc

SEQ ID NO: 1199635 - RNA, 18 nt, Mycobacterium bovis subsp bovis AF2122/97
cccggcgcaagcgccgcg

SEQ ID NO: 1199636 - RNA, 23 nt, Mycobacterium bovis subsp bovis AF2122/97
cccggccgcgcacccguccgccg

SEQ ID NO: 1199637 - RNA, 22 nt, Mycobacterium bovis subsp bovis AF2122/97
cccggccgcgucacggaccugg

SEQ ID NO: 1199638 - RNA, 19 nt, Mycobacterium bovis subsp bovis AF2122/97
cccggccgggucgagugcg

SEQ ID NO: 1199639 - RNA, 21 nt, Mycobacterium bovis subsp bovis AF2122/97
cccggccguugggccaccggc

SEQ ID NO: 1199640 - RNA, 16 nt, Mycobacterium bovis subsp bovis AF2122/97
cccggccguugggcca

SEQ ID NO: 1199641 - RNA, 14 nt, Mycobacterium bovis subsp bovis AF2122/97
cccggccgcacccg

SEQ ID NO: 1199642 - RNA, 23 nt, Mycobacterium bovis subsp bovis AF2122/97
cccggcccguagcguccgcgccc

SEQ ID NO: 1199643 - RNA, 13 nt, Mycobacterium bovis subsp bovis AF2122/97
cccggccgcgccc

SEQ ID NO: 1199644 - RNA, 15 nt, Mycobacterium bovis subsp bovis AF2122/97
cccggccgcgcccca

SEQ ID NO: 1199645 - RNA, 14 nt, Mycobacterium bovis subsp bovis AF2122/97
cccggccgcgcgca

SEQ ID NO: 1199646 - RNA, 14 nt, Mycobacterium bovis subsp bovis AF2122/97
cccggccgcgcggg

SEQ ID NO: 1199647 - RNA, 18 nt, Mycobacterium bovis subsp bovis AF2122/97
cccggccgaacgccucgc

SEQ ID NO: 1199648 - RNA, 15 nt, Mycobacterium bovis subsp bovis AF2122/97
cccggcccgcucagc

SEQ ID NO: 1199649 - RNA, 17 nt, Mycobacterium bovis subsp bovis AF2122/97
cccggcccgcucagccg

SEQ ID NO: 1199650 - RNA, 14 nt, Mycobacterium bovis subsp bovis AF2122/97
cccggcccgccacc

SEQ ID NO: 1199651 - RNA, 22 nt, Mycobacterium bovis subsp bovis AF2122/97
cccggcgcuggugcgccacgcc

SEQ ID NO: 1199652 - RNA, 12 nt, Mycobacterium bovis subsp bovis AF2122/97
cccggcggcagc

SEQ ID NO: 1199653 - RNA, 17 nt, Mycobacterium bovis subsp bovis AF2122/97
cccggcggccaucccgc

SEQ ID NO: 1199654 - RNA, 22 nt, Mycobacterium bovis subsp bovis AF2122/97
cccggcgcggccgcaagccgcg

SEQ ID NO: 1199655 - RNA, 16 nt, Mycobacterium bovis subsp bovis AF2122/97
cccggcgcuagcgccg

SEQ ID NO: 1199656 - RNA, 18 nt, Mycobacterium bovis subsp bovis AF2122/97
cccggcgcuagcgccgcg

SEQ ID NO: 1199657 - RNA, 15 nt, Mycobacterium bovis subsp bovis AF2122/97
cccggcgcggccgca

SEQ ID NO: 1199658 - RNA, 12 nt, Mycobacterium bovis subsp bovis AF2122/97
cccggcgcgccg

SEQ ID NO: 1199659 - RNA, 16 nt, Mycobacterium bovis subsp bovis AF2122/97
cccggcguugccgccg

SEQ ID NO: 1199660 - RNA, 22 nt, Mycobacterium bovis subsp bovis AF2122/97
cccggcguuguugaccagcacg

SEQ ID NO: 1199661 - RNA, 18 nt, Mycobacterium bovis subsp bovis AF2122/97
cccggcucucuucgcgcg

SEQ ID NO: 1199662 - RNA, 19 nt, Mycobacterium bovis subsp bovis AF2122/97
cccggcuccuccccggccc

SEQ ID NO: 1199663 - RNA, 15 nt, Mycobacterium bovis subsp bovis AF2122/97
cccggcucggccacc

SEQ ID NO: 1199664 - RNA, 21 nt, Mycobacterium bovis subsp bovis AF2122/97
cccggcugccagcgccgccgc

SEQ ID NO: 1199665 - RNA, 20 nt, Mycobacterium bovis subsp bovis AF2122/97
cccggcgggcggugggcagc

SEQ ID NO: 1199666 - RNA, 19 nt, Mycobacterium bovis subsp bovis AF2122/97
cccggcgguuggugcagcg

SEQ ID NO: 1199667 - RNA, 17 nt, Mycobacterium bovis subsp bovis AF2122/97
cccggcgggcggugggc

SEQ ID NO: 1199668 - RNA, 21 nt, Mycobacterium bovis subsp bovis AF2122/97
cccggcguauugcaccgccag

SEQ ID NO: 1199669 - RNA, 22 nt, Mycobacterium bovis subsp bovis AF2122/97
cccggcguggcuucacccaacc

SEQ ID NO: 1199670 - RNA, 13 nt, Mycobacterium bovis subsp bovis AF2122/97
cccgggccgccgc

SEQ ID NO: 1199671 - RNA, 22 nt, Mycobacterium bovis subsp bovis AF2122/97
cccgggccggucggugagccgu

SEQ ID NO: 1199672 - RNA, 15 nt, Mycobacterium bovis subsp bovis AF2122/97
cccgggccugaacca

SEQ ID NO: 1199673 - RNA, 18 nt, Mycobacterium bovis subsp bovis AF2122/97
cccgggccugggacggcg

SEQ ID NO: 1199674 - RNA, 20 nt, Mycobacterium bovis subsp bovis AF2122/97
cccgggcgagcgcggccugc

SEQ ID NO: 1199675 - RNA, 21 nt, Mycobacterium bovis subsp bovis AF2122/97
cccgggccaucgcauccccag

SEQ ID NO: 1199676 - RNA, 13 nt, Mycobacterium bovis subsp bovis AF2122/97
cccgggcccgccg

SEQ ID NO: 1199677 - RNA, 16 nt, Mycobacterium bovis subsp bovis AF2122/97
cccgggcccgucgucg

SEQ ID NO: 1199678 - RNA, 16 nt, Mycobacterium bovis subsp bovis AF2122/97
cccgggccaccaguug

SEQ ID NO: 1199679 - RNA, 17 nt, Mycobacterium bovis subsp bovis AF2122/97
cccgggaaggaaccggg

SEQ ID NO: 1199680 - RNA, 23 nt, Mycobacterium bovis subsp bovis AF2122/97
cccgggauaguuuucggccgcca

SEQ ID NO: 1199681 - RNA, 15 nt, Mycobacterium bovis subsp bovis AF2122/97
cccgggaucggggca

SEQ ID NO: 1199682 - RNA, 16 nt, Mycobacterium bovis subsp bovis AF2122/97
cccgggaugaccaccg

SEQ ID NO: 1199683 - RNA, 14 nt, Mycobacterium bovis subsp bovis AF2122/97
cccgggaugcuccc

SEQ ID NO: 1199684 - RNA, 11 nt, Mycobacterium bovis subsp bovis AF2122/97
cccgggcaccg

SEQ ID NO: 1199685 - RNA, 15 nt, Mycobacterium bovis subsp bovis AF2122/97
cccgggcagcaccag

SEQ ID NO: 1199686 - RNA, 16 nt, Mycobacterium bovis subsp bovis AF2122/97
cccggcuucgccgcgc

SEQ ID NO: 1199687 - RNA, 17 nt, Mycobacterium bovis subsp bovis AF2122/97
cccggcuuucccaccgc

SEQ ID NO: 1199688 - RNA, 17 nt, Mycobacterium bovis subsp bovis AF2122/97
cccggcuuuugcgccca

SEQ ID NO: 1199689 - RNA, 20 nt, Mycobacterium bovis subsp bovis AF2122/97
cccgggcggaacgccggcac

SEQ ID NO: 1199690 - RNA, 17 nt, Mycobacterium bovis subsp bovis AF2122/97
cccgggcgugggcaccc

SEQ ID NO: 1199691 - RNA, 23 nt, Mycobacterium bovis subsp bovis AF2122/97
cccgggcguugggaucgcgcagc

SEQ ID NO: 1199692 - RNA, 18 nt, Mycobacterium bovis subsp bovis AF2122/97
cccgggcgggagucgucg

SEQ ID NO: 1199693 - RNA, 20 nt, Mycobacterium bovis subsp bovis AF2122/97
cccgggcgggauccacccag

SEQ ID NO: 1199694 - RNA, 16 nt, Mycobacterium bovis subsp bovis AF2122/97
cccgggcugccgccca

SEQ ID NO: 1199695 - RNA, 16 nt, Mycobacterium bovis subsp bovis AF2122/97
cccggggcgcucgcgc

SEQ ID NO: 1199696 - RNA, 15 nt, Mycobacterium bovis subsp bovis AF2122/97
cccggggccgcaacc

SEQ ID NO: 1199697 - RNA, 18 nt, Mycobacterium bovis subsp bovis AF2122/97
cccgggguccaucggggc

SEQ ID NO: 1199698 - RNA, 18 nt, Mycobacterium bovis subsp bovis AF2122/97
cccggggguccaccuugg

SEQ ID NO: 1199699 - RNA, 18 nt, Mycobacterium bovis subsp bovis AF2122/97
cccgggugaaacgauggc

SEQ ID NO: 1199700 - RNA, 12 nt, Mycobacterium bovis subsp bovis AF2122/97
cccgggucccau

SEQ ID NO: 1199701 - RNA, 21 nt, Mycobacterium bovis subsp bovis AF2122/97
cccggguccaagaaccacgac

SEQ ID NO: 1199702 - RNA, 13 nt, Mycobacterium bovis subsp bovis AF2122/97
cccggggugccga

SEQ ID NO: 1199703 - RNA, 17 nt, Mycobacterium bovis subsp bovis AF2122/97
cccgggugggccaguga

SEQ ID NO: 1199704 - RNA, 19 nt, Mycobacterium bovis subsp bovis AF2122/97
cccgggucggcacgacccg

SEQ ID NO: 1199705 - RNA, 24 nt, Mycobacterium bovis subsp bovis AF2122/97
cccgguggacagaaucgaccgccg

SEQ ID NO: 1199706 - RNA, 17 nt, Mycobacterium bovis subsp bovis AF2122/97
cccggugccgcccgcgc

SEQ ID NO: 1199707 - RNA, 22 nt, Mycobacterium bovis subsp bovis AF2122/97
cccggugccgcccgcgccuccg

SEQ ID NO: 1199708 - RNA, 12 nt, Mycobacterium bovis subsp bovis AF2122/97
cccggugcgucg

SEQ ID NO: 1199709 - RNA, 14 nt, Mycobacterium bovis subsp bovis AF2122/97
cccggugcucaagc

SEQ ID NO: 1199710 - RNA, 16 nt, Mycobacterium bovis subsp bovis AF2122/97
cccggugccgcagcag

SEQ ID NO: 1199711 - RNA, 23 nt, Mycobacterium bovis subsp bovis AF2122/97
cccggugccguuggagccgccac

SEQ ID NO: 1199712 - RNA, 22 nt, Mycobacterium bovis subsp bovis AF2122/97
cccggugaugaccggacgcuga

SEQ ID NO: 1199713 - RNA, 16 nt, Mycobacterium bovis subsp bovis AF2122/97
cccggugacgccgucg

SEQ ID NO: 1199714 - RNA, 18 nt, Mycobacterium bovis subsp bovis AF2122/97
cccggucgguguggacug

SEQ ID NO: 1199715 - RNA, 12 nt, Mycobacterium bovis subsp bovis AF2122/97
cccggugacaag

SEQ ID NO: 1199716 - RNA, 20 nt, Mycobacterium bovis subsp bovis AF2122/97
cccggucuauuugccugccg

SEQ ID NO: 1199717 - RNA, 12 nt, Mycobacterium bovis subsp bovis AF2122/97
cccggucggcga

SEQ ID NO: 1199718 - RNA, 22 nt, Mycobacterium bovis subsp bovis AF2122/97
cccgguccugcucgcacagcac

SEQ ID NO: 1199719 - RNA, 22 nt, Mycobacterium bovis subsp bovis AF2122/97
cccgguccggcccggggacgcc

SEQ ID NO: 1199720 - RNA, 15 nt, Mycobacterium bovis subsp bovis AF2122/97
cccgguccauucguc

SEQ ID NO: 1199721 - RNA, 17 nt, Mycobacterium bovis subsp bovis AF2122/97
cccgguccacgccagga

SEQ ID NO: 1199722 - RNA, 16 nt, Mycobacterium bovis subsp bovis AF2122/97
cccgguagcggcggca

SEQ ID NO: 1199723 - RNA, 21 nt, Mycobacterium bovis subsp bovis AF2122/97
cccgguagcguucggcgagca

SEQ ID NO: 1199724 - RNA, 16 nt, Mycobacterium bovis subsp bovis AF2122/97
cccgucgggugcugau

SEQ ID NO: 1199725 - RNA, 23 nt, Mycobacterium bovis subsp bovis AF2122/97
cccgucgcggccggcggccgccc

SEQ ID NO: 1199726 - RNA, 21 nt, Mycobacterium bovis subsp bovis AF2122/97
cccgugauccgccgacagccc

SEQ ID NO: 1199727 - RNA, 18 nt, Mycobacterium bovis subsp bovis AF2122/97
cccgugacauucugcagc

SEQ ID NO: 1199728 - RNA, 13 nt, Mycobacterium bovis subsp bovis AF2122/97
cccgucggcgccg

SEQ ID NO: 1199729 - RNA, 14 nt, Mycobacterium bovis subsp bovis AF2122/97
cccgucggcgugcg

SEQ ID NO: 1199730 - RNA, 12 nt, Mycobacterium bovis subsp bovis AF2122/97
cccgucuuccag

SEQ ID NO: 1199731 - RNA, 15 nt, Mycobacterium bovis subsp bovis AF2122/97
cccgugcgcgcgcag

SEQ ID NO: 1199732 - RNA, 18 nt, Mycobacterium bovis subsp bovis AF2122/97
cccgugccgcccgcgccg

SEQ ID NO: 1199733 - RNA, 22 nt, Mycobacterium bovis subsp bovis AF2122/97
cccguugccgccugucccgccg

SEQ ID NO: 1199734 - RNA, 15 nt, Mycobacterium bovis subsp bovis AF2122/97
cccguuggccaagaa

SEQ ID NO: 1199735 - RNA, 14 nt, Mycobacterium bovis subsp bovis AF2122/97
cccguucgccgucg

SEQ ID NO: 1199736 - RNA, 18 nt, Mycobacterium bovis subsp bovis AF2122/97
cccguugagcagcaccca

SEQ ID NO: 1199737 - RNA, 13 nt, Mycobacterium bovis subsp bovis AF2122/97
cccguugcaggug

SEQ ID NO: 1199738 - RNA, 17 nt, Mycobacterium bovis subsp bovis AF2122/97
cccguuaugcgccgccc

SEQ ID NO: 1199739 - RNA, 21 nt, Mycobacterium bovis subsp bovis AF2122/97
cccggugucgaugcgcagccc

SEQ ID NO: 1199740 - RNA, 22 nt, Mycobacterium bovis subsp bovis AF2122/97
cccgguguucaucacgccgccg

SEQ ID NO: 1199741 - RNA, 23 nt, Mycobacterium bovis subsp bovis AF2122/97
cccgguguucaucacgccgccgg

SEQ ID NO: 1199742 - RNA, 19 nt, Mycobacterium bovis subsp bovis AF2122/97
cccgguguuccggucgccc

SEQ ID NO: 1199743 - RNA, 12 nt, Mycobacterium bovis subsp bovis AF2122/97
cccgguguugag

SEQ ID NO: 1199744 - RNA, 15 nt, Mycobacterium bovis subsp bovis AF2122/97
cccgguucagcgcug

SEQ ID NO: 1199745 - RNA, 17 nt, Mycobacterium bovis subsp bovis AF2122/97
cccguaagcggaugucc

SEQ ID NO: 1199746 - RNA, 14 nt, Mycobacterium bovis subsp bovis AF2122/97
cccguaccagcccg

SEQ ID NO: 1199747 - RNA, 22 nt, Mycobacterium bovis subsp bovis AF2122/97
cccguacccacgacgggccgag

SEQ ID NO: 1199748 - RNA, 18 nt, Mycobacterium bovis subsp bovis AF2122/97
cccguagaccuucgagua

SEQ ID NO: 1199749 - RNA, 19 nt, Mycobacterium bovis subsp bovis AF2122/97
cccgguugugcgcgcgccc

SEQ ID NO: 1199750 - RNA, 17 nt, Mycobacterium bovis subsp bovis AF2122/97
cccgucgagcagcaugu

SEQ ID NO: 1199751 - RNA, 12 nt, Mycobacterium bovis subsp bovis AF2122/97
cccgucgccgcc

SEQ ID NO: 1199752 - RNA, 13 nt, Mycobacterium bovis subsp bovis AF2122/97
cccgucgccgccc

SEQ ID NO: 1199753 - RNA, 12 nt, Mycobacterium bovis subsp bovis AF2122/97
cccgucccccgc

SEQ ID NO: 1199754 - RNA, 13 nt, Mycobacterium bovis subsp bovis AF2122/97
cccgucaccgccg

SEQ ID NO: 1199755 - RNA, 20 nt, Mycobacterium bovis subsp bovis AF2122/97
cccguauugccaaagcccga

SEQ ID NO: 1199756 - RNA, 12 nt, Mycobacterium bovis subsp bovis AF2122/97
cccguccaggcc

SEQ ID NO: 1199757 - RNA, 20 nt, Mycobacterium bovis subsp bovis AF2122/97
cccgucaugcccaccgccug

SEQ ID NO: 1199758 - RNA, 18 nt, Mycobacterium bovis subsp bovis AF2122/97
cccucaguguacaccgcg

SEQ ID NO: 1199759 - RNA, 21 nt, Mycobacterium bovis subsp bovis AF2122/97
cccucaguguacaccgcgccc

SEQ ID NO: 1199760 - RNA, 23 nt, Mycobacterium bovis subsp bovis AF2122/97
cccucaguguacaccgcgcccgc

SEQ ID NO: 1199761 - RNA, 23 nt, Mycobacterium bovis subsp bovis AF2122/97
cccucaccgccugugccgccggc

SEQ ID NO: 1199762 - RNA, 22 nt, Mycobacterium bovis subsp bovis AF2122/97
cccucaccgcgagggcgcgugu

SEQ ID NO: 1199763 - RNA, 21 nt, Mycobacterium bovis subsp bovis AF2122/97
cccucacguggacugaccucg

SEQ ID NO: 1199764 - RNA, 20 nt, Mycobacterium bovis subsp bovis AF2122/97
cccuccagggcccugcuggc

SEQ ID NO: 1199765 - RNA, 14 nt, Mycobacterium bovis subsp bovis AF2122/97
cccuccagcacgcc

SEQ ID NO: 1199766 - RNA, 18 nt, Mycobacterium bovis subsp bovis AF2122/97
cccuccagauaccaccgc

SEQ ID NO: 1199767 - RNA, 13 nt, Mycobacterium bovis subsp bovis AF2122/97
cccucccaccagc

SEQ ID NO: 1199768 - RNA, 16 nt, Mycobacterium bovis subsp bovis AF2122/97
cccucccaccagcggc

SEQ ID NO: 1199769 - RNA, 15 nt, Mycobacterium bovis subsp bovis AF2122/97
cccucccgggcccgc

SEQ ID NO: 1199770 - RNA, 21 nt, Mycobacterium bovis subsp bovis AF2122/97
cccuccagauaccaccgccgc

SEQ ID NO: 1199771 - RNA, 18 nt, Mycobacterium bovis subsp bovis AF2122/97
cccuccggacccacccgc

SEQ ID NO: 1199772 - RNA, 14 nt, Mycobacterium bovis subsp bovis AF2122/97
cccuccggcgcagc

SEQ ID NO: 1199773 - RNA, 15 nt, Mycobacterium bovis subsp bovis AF2122/97
cccuccggcgcagcg

SEQ ID NO: 1199774 - RNA, 16 nt, Mycobacterium bovis subsp bovis AF2122/97
cccuccgggcgcacca

SEQ ID NO: 1199775 - RNA, 17 nt, Mycobacterium bovis subsp bovis AF2122/97
cccuacgcagcgcggcu

SEQ ID NO: 1199776 - RNA, 23 nt, Mycobacterium bovis subsp bovis AF2122/97
cccucaaggucuuuagccgccgc

SEQ ID NO: 1199777 - RNA, 18 nt, Mycobacterium bovis subsp bovis AF2122/97
cccucaacgucccagccc

SEQ ID NO: 1199778 - RNA, 16 nt, Mycobacterium bovis subsp bovis AF2122/97
ccgccagcagggccag

SEQ ID NO: 1199779 - RNA, 18 nt, Mycobacterium bovis subsp bovis AF2122/97
ccgccagcauugaagaag

SEQ ID NO: 1199780 - RNA, 15 nt, Mycobacterium bovis subsp bovis AF2122/97
ccgccagcccagccc

SEQ ID NO: 1199781 - RNA, 11 nt, Mycobacterium bovis subsp bovis AF2122/97
ccgccagcccc

SEQ ID NO: 1199782 - RNA, 13 nt, Mycobacterium bovis subsp bovis AF2122/97
ccgccagccccac

SEQ ID NO: 1199783 - RNA, 14 nt, Mycobacterium bovis subsp bovis AF2122/97
ccgccagccccacc

SEQ ID NO: 1199784 - RNA, 16 nt, Mycobacterium bovis subsp bovis AF2122/97
ccgccagccgcgagcc

SEQ ID NO: 1199785 - RNA, 14 nt, Mycobacterium bovis subsp bovis AF2122/97
ccgccagccggcgc

SEQ ID NO: 1199786 - RNA, 19 nt, Mycobacterium bovis subsp bovis AF2122/97
ccgccagccgcgagccggu

SEQ ID NO: 1199787 - RNA, 15 nt, Mycobacterium bovis subsp bovis AF2122/97
ccgccagccuggucu

SEQ ID NO: 1199788 - RNA, 20 nt, Mycobacterium bovis subsp bovis AF2122/97
ccgccagccuggucuuguug

SEQ ID NO: 1199789 - RNA, 16 nt, Mycobacterium bovis subsp bovis AF2122/97
ccgccagcgccgccgg

SEQ ID NO: 1199790 - RNA, 13 nt, Mycobacterium bovis subsp bovis AF2122/97
ccgccagcgccgc

SEQ ID NO: 1199791 - RNA, 22 nt, Mycobacterium bovis subsp bovis AF2122/97
ccgccagggcccuagccggcgc

SEQ ID NO: 1199792 - RNA, 20 nt, Mycobacterium bovis subsp bovis AF2122/97
ccgccaggaacucggcccac

SEQ ID NO: 1199793 - RNA, 14 nt, Mycobacterium bovis subsp bovis AF2122/97
ccgccaggccgacc

SEQ ID NO: 1199794 - RNA, 16 nt, Mycobacterium bovis subsp bovis AF2122/97
ccgccagcugcgcagc

SEQ ID NO: 1199795 - RNA, 16 nt, Mycobacterium bovis subsp bovis AF2122/97
ccgccagcugggcagc

SEQ ID NO: 1199796 - RNA, 20 nt, Mycobacterium bovis subsp bovis AF2122/97
ccgccagauugccugacaac

SEQ ID NO: 1199797 - RNA, 17 nt, Mycobacterium bovis subsp bovis AF2122/97
ccgccagcaccaccggc

SEQ ID NO: 1199798 - RNA, 22 nt, Mycobacterium bovis subsp bovis AF2122/97
ccgccagcaccaccggcucccg

SEQ ID NO: 1199799 - RNA, 17 nt, Mycobacterium bovis subsp bovis AF2122/97
ccgccagcaccucggcc

SEQ ID NO: 1199800 - RNA, 17 nt, Mycobacterium bovis subsp bovis AF2122/97
ccgccagaccgcggcgg

SEQ ID NO: 1199801 - RNA, 20 nt, Mycobacterium bovis subsp bovis AF2122/97
ccgccacgggcggccaccgc

SEQ ID NO: 1199802 - RNA, 19 nt, Mycobacterium bovis subsp bovis AF2122/97
ccgccacgguacauccaga

SEQ ID NO: 1199803 - RNA, 19 nt, Mycobacterium bovis subsp bovis AF2122/97
ccgccacgguucgggcagc

SEQ ID NO: 1199804 - RNA, 21 nt, Mycobacterium bovis subsp bovis AF2122/97
ccgccacuggcgccggugccg

SEQ ID NO: 1199805 - RNA, 14 nt, Mycobacterium bovis subsp bovis AF2122/97
ccgccacugcuggg

SEQ ID NO: 1199806 - RNA, 21 nt, Mycobacterium bovis subsp bovis AF2122/97
ccgccaccggcguccaguccg

SEQ ID NO: 1199807 - RNA, 16 nt, Mycobacterium bovis subsp bovis AF2122/97
ccgccaccgcgacacc

SEQ ID NO: 1199808 - RNA, 20 nt, Mycobacterium bovis subsp bovis AF2122/97
ccgccacccgccaacgccaa

SEQ ID NO: 1199809 - RNA, 11 nt, Mycobacterium bovis subsp bovis AF2122/97
ccgccacccuu

SEQ ID NO: 1199810 - RNA, 14 nt, Mycobacterium bovis subsp bovis AF2122/97
ccgccaccgccagc

SEQ ID NO: 1199811 - RNA, 16 nt, Mycobacterium bovis subsp bovis AF2122/97
ccgccaccgccagcgu

SEQ ID NO: 1199812 - RNA, 19 nt, Mycobacterium bovis subsp bovis AF2122/97
ccgccaccgaacgcaccga

SEQ ID NO: 1199813 - RNA, 15 nt, Mycobacterium bovis subsp bovis AF2122/97
ccgccaccgccaccg

SEQ ID NO: 1199814 - RNA, 19 nt, Mycobacterium bovis subsp bovis AF2122/97
ccgccacggaucgcggcgg

SEQ ID NO: 1199815 - RNA, 18 nt, Mycobacterium bovis subsp bovis AF2122/97
ccgccacgcucaacccgu

SEQ ID NO: 1199816 - RNA, 14 nt, Mycobacterium bovis subsp bovis AF2122/97
ccgccacgccgaag

SEQ ID NO: 1199817 - RNA, 15 nt, Mycobacterium bovis subsp bovis AF2122/97
ccgccaccucgccgg

SEQ ID NO: 1199818 - RNA, 17 nt, Mycobacterium bovis subsp bovis AF2122/97
ccgccaccuuggcguug

SEQ ID NO: 1199819 - RNA, 17 nt, Mycobacterium bovis subsp bovis AF2122/97
ccgccagucccccgcuc

SEQ ID NO: 1199820 - RNA, 15 nt, Mycobacterium bovis subsp bovis AF2122/97
ccgccaucagccgcu

SEQ ID NO: 1199821 - RNA, 20 nt, Mycobacterium bovis subsp bovis AF2122/97
ccgccaucaucgcuuggccu

SEQ ID NO: 1199822 - RNA, 21 nt, Mycobacterium bovis subsp bovis AF2122/97
ccgccaucaacaaggggcagc

SEQ ID NO: 1199823 - RNA, 20 nt, Mycobacterium bovis subsp bovis AF2122/97
ccgccauccgauggcccggc

SEQ ID NO: 1199824 - RNA, 13 nt, Mycobacterium bovis subsp bovis AF2122/97
ccgcccagcgagg

SEQ ID NO: 1199825 - RNA, 15 nt, Mycobacterium bovis subsp bovis AF2122/97
ccgcccagccgcagc

SEQ ID NO: 1199826 - RNA, 15 nt, Mycobacterium bovis subsp bovis AF2122/97
ccgcccgccagcgau

SEQ ID NO: 1199827 - RNA, 13 nt, Mycobacterium bovis subsp bovis AF2122/97
ccgcccgcccacc

SEQ ID NO: 1199828 - RNA, 18 nt, Mycobacterium bovis subsp bovis AF2122/97
ccgccauuggcaggcaug

SEQ ID NO: 1199829 - RNA, 16 nt, Mycobacterium bovis subsp bovis AF2122/97
ccgcccagaccgccga

SEQ ID NO: 1199830 - RNA, 15 nt, Mycobacterium bovis subsp bovis AF2122/97
ccgccaucgccgaug

SEQ ID NO: 1199831 - RNA, 19 nt, Mycobacterium bovis subsp bovis AF2122/97
ccgccaucauggcggcccg

SEQ ID NO: 1199832 - RNA, 22 nt, Mycobacterium bovis subsp bovis AF2122/97
ccgcccaccacacagccgcgcu

SEQ ID NO: 1199833 - RNA, 17 nt, Mycobacterium bovis subsp bovis AF2122/97
ccgcccaagccgccggc

SEQ ID NO: 1199834 - RNA, 18 nt, Mycobacterium bovis subsp bovis AF2122/97
ccgcccaauccaccgaag

SEQ ID NO: 1199835 - RNA, 17 nt, Mycobacterium bovis subsp bovis AF2122/97
ccgcccuugccgccggc

SEQ ID NO: 1199836 - RNA, 19 nt, Mycobacterium bovis subsp bovis AF2122/97
ccgcccuugccgccggccc

SEQ ID NO: 1199837 - RNA, 19 nt, Mycobacterium bovis subsp bovis AF2122/97
ccgcccuugccgccagccc

SEQ ID NO: 1199838 - RNA, 17 nt, Mycobacterium bovis subsp bovis AF2122/97
ccgcccuugccgccagc

SEQ ID NO: 1199839 - RNA, 15 nt, Mycobacterium bovis subsp bovis AF2122/97
ccgcccugguccagg

SEQ ID NO: 1199840 - RNA, 17 nt, Mycobacterium bovis subsp bovis AF2122/97
ccgcccugguccaggcc

SEQ ID NO: 1199841 - RNA, 24 nt, Mycobacterium bovis subsp bovis AF2122/97
ccgcccugguccaggcccuggcca

SEQ ID NO: 1199842 - RNA, 15 nt, Mycobacterium bovis subsp bovis AF2122/97
ccgcccgcgccaccg

SEQ ID NO: 1199843 - RNA, 21 nt, Mycobacterium bovis subsp bovis AF2122/97
ccgcccgcgcccccggugccg

SEQ ID NO: 1199844 - RNA, 14 nt, Mycobacterium bovis subsp bovis AF2122/97
ccgcccgcgccucc

SEQ ID NO: 1199845 - RNA, 22 nt, Mycobacterium bovis subsp bovis AF2122/97
ccgcccgcuccgccgucgccgc

SEQ ID NO: 1199846 - RNA, 14 nt, Mycobacterium bovis subsp bovis AF2122/97
ccgcccggcccggc

SEQ ID NO: 1199847 - RNA, 21 nt, Mycobacterium bovis subsp bovis AF2122/97
ccgcccggcaguucgcggcca

SEQ ID NO: 1199848 - RNA, 23 nt, Mycobacterium bovis subsp bovis AF2122/97
ccgcccggacgcaacacccgggc

SEQ ID NO: 1199849 - RNA, 16 nt, Mycobacterium bovis subsp bovis AF2122/97
ccgccgaacagugucg

SEQ ID NO: 1199850 - RNA, 18 nt, Mycobacterium bovis subsp bovis AF2122/97
ccgccgagcggugccggc

SEQ ID NO: 1199851 - RNA, 14 nt, Mycobacterium bovis subsp bovis AF2122/97
ccgccgagcuggcg

SEQ ID NO: 1199852 - RNA, 18 nt, Mycobacterium bovis subsp bovis AF2122/97
ccgccgaaacucaccagc

SEQ ID NO: 1199853 - RNA, 20 nt, Mycobacterium bovis subsp bovis AF2122/97
ccgccgaaacucaccagcac

SEQ ID NO: 1199854 - RNA, 21 nt, Mycobacterium bovis subsp bovis AF2122/97
ccgccgaaacucaccagcacc

SEQ ID NO: 1199855 - RNA, 18 nt, Mycobacterium bovis subsp bovis AF2122/97
ccgccgaugaugcggcgc

SEQ ID NO: 1199856 - RNA, 15 nt, Mycobacterium bovis subsp bovis AF2122/97
ccgccgaucgacacc

SEQ ID NO: 1199857 - RNA, 16 nt, Mycobacterium bovis subsp bovis AF2122/97
ccgccgaugccaccgc

SEQ ID NO: 1199858 - RNA, 17 nt, Mycobacterium bovis subsp bovis AF2122/97
ccgccgaugccaccgcu

SEQ ID NO: 1199859 - RNA, 23 nt, Mycobacterium bovis subsp bovis AF2122/97
ccgccgaggacacauugaccagg

SEQ ID NO: 1199860 - RNA, 15 nt, Mycobacterium bovis subsp bovis AF2122/97
ccgccgaucaccagg

SEQ ID NO: 1199861 - RNA, 20 nt, Mycobacterium bovis subsp bovis AF2122/97
ccgccgauaccgccggcccc

SEQ ID NO: 1199862 - RNA, 21 nt, Mycobacterium bovis subsp bovis AF2122/97
ccgccgauaccgccggcccca

SEQ ID NO: 1199863 - RNA, 13 nt, Mycobacterium bovis subsp bovis AF2122/97
ccgcaccgugccg

SEQ ID NO: 1199864 - RNA, 19 nt, Mycobacterium bovis subsp bovis AF2122/97
ccgcaccggugacgcacag

SEQ ID NO: 1199865 - RNA, 15 nt, Mycobacterium bovis subsp bovis AF2122/97
ccgcaccgucccagu

SEQ ID NO: 1199866 - RNA, 16 nt, Mycobacterium bovis subsp bovis AF2122/97
ccgcaccugggcggcg

SEQ ID NO: 1199867 - RNA, 17 nt, Mycobacterium bovis subsp bovis AF2122/97
ccgcaccugggcggcgc

SEQ ID NO: 1199868 - RNA, 21 nt, Mycobacterium bovis subsp bovis AF2122/97
ccgcaccugggcggcgcgaag

SEQ ID NO: 1199869 - RNA, 19 nt, Mycobacterium bovis subsp bovis AF2122/97
ccgcaccgaaaccaugccg

SEQ ID NO: 1199870 - RNA, 16 nt, Mycobacterium bovis subsp bovis AF2122/97
ccgcacccggccgcgc

SEQ ID NO: 1199871 - RNA, 19 nt, Mycobacterium bovis subsp bovis AF2122/97
ccgcaccaagcagcgacca

SEQ ID NO: 1199872 - RNA, 17 nt, Mycobacterium bovis subsp bovis AF2122/97
ccgcacccgcucgucgg

SEQ ID NO: 1199873 - RNA, 22 nt, Mycobacterium bovis subsp bovis AF2122/97
ccgcacaccugcgcggcgugcg

SEQ ID NO: 1199874 - RNA, 14 nt, Mycobacterium bovis subsp bovis AF2122/97
ccgcaaucugcuug

SEQ ID NO: 1199875 - RNA, 21 nt, Mycobacterium bovis subsp bovis AF2122/97
ccgcaaugacgucgucggcca

SEQ ID NO: 1199876 - RNA, 21 nt, Mycobacterium bovis subsp bovis AF2122/97
ccgcaaugaccuggccgcccg

SEQ ID NO: 1199877 - RNA, 18 nt, Mycobacterium bovis subsp bovis AF2122/97
ccgcaaugacgucgucgg

SEQ ID NO: 1199878 - RNA, 19 nt, Mycobacterium bovis subsp bovis AF2122/97
ccgcaauucccaucggccu

SEQ ID NO: 1199879 - RNA, 20 nt, Mycobacterium bovis subsp bovis AF2122/97
ccgcaauucccaucggccug

SEQ ID NO: 1199880 - RNA, 21 nt, Mycobacterium bovis subsp bovis AF2122/97
ccgauggcgcaccggcgucgg

SEQ ID NO: 1199881 - RNA, 21 nt, Mycobacterium bovis subsp bovis AF2122/97
ccgauggcgguggugccgcgg

SEQ ID NO: 1199882 - RNA, 17 nt, Mycobacterium bovis subsp bovis AF2122/97
ccgauggaugggcugcg

SEQ ID NO: 1199883 - RNA, 22 nt, Mycobacterium bovis subsp bovis AF2122/97
ccgauggaugggcugcgcgucg

SEQ ID NO: 1199884 - RNA, 18 nt, Mycobacterium bovis subsp bovis AF2122/97
ccgauggcuuggugccca

SEQ ID NO: 1199885 - RNA, 22 nt, Mycobacterium bovis subsp bovis AF2122/97
ccgcagcgcgaaggucagcgac

SEQ ID NO: 1199886 - RNA, 23 nt, Mycobacterium bovis subsp bovis AF2122/97
ccgcagcgcgaaggucagcgacu

SEQ ID NO: 1199887 - RNA, 19 nt, Mycobacterium bovis subsp bovis AF2122/97
ccgcagcggaacugggccc

SEQ ID NO: 1199888 - RNA, 19 nt, Mycobacterium bovis subsp bovis AF2122/97
ccgcagcgaaaacccgguc

SEQ ID NO: 1199889 - RNA, 20 nt, Mycobacterium bovis subsp bovis AF2122/97
ccgcagcgaagaccagcggc

SEQ ID NO: 1199890 - RNA, 14 nt, Mycobacterium bovis subsp bovis AF2122/97
ccgcagcgccaccc

SEQ ID NO: 1199891 - RNA, 16 nt, Mycobacterium bovis subsp bovis AF2122/97
ccgcagacgccgucug

SEQ ID NO: 1199892 - RNA, 19 nt, Mycobacterium bovis subsp bovis AF2122/97
ccgcagacgugguagccgg

SEQ ID NO: 1199893 - RNA, 18 nt, Mycobacterium bovis subsp bovis AF2122/97
ccgcacgccggccagcga

SEQ ID NO: 1199894 - RNA, 14 nt, Mycobacterium bovis subsp bovis AF2122/97
ccgcagaccgccac

SEQ ID NO: 1199895 - RNA, 17 nt, Mycobacterium bovis subsp bovis AF2122/97
ccgcagaucaccgccag

SEQ ID NO: 1199896 - RNA, 18 nt, Mycobacterium bovis subsp bovis AF2122/97
ccgcagaucaccgccagc

SEQ ID NO: 1199897 - RNA, 13 nt, Mycobacterium bovis subsp bovis AF2122/97
ccgcagaugggcc

SEQ ID NO: 1199898 - RNA, 21 nt, Mycobacterium bovis subsp bovis AF2122/97
ccgcagaucaccgccagcugg

SEQ ID NO: 1199899 - RNA, 15 nt, Mycobacterium bovis subsp bovis AF2122/97
ccgcagauccccgcc

SEQ ID NO: 1199900 - RNA, 12 nt, Mycobacterium bovis subsp bovis AF2122/97
ccgcacgaccag

SEQ ID NO: 1199901 - RNA, 17 nt, Mycobacterium bovis subsp bovis AF2122/97
ccgcacgccgaccggcc

SEQ ID NO: 1199902 - RNA, 19 nt, Mycobacterium bovis subsp bovis AF2122/97
ccgcacgccgaccggcccg

SEQ ID NO: 1199903 - RNA, 13 nt, Mycobacterium bovis subsp bovis AF2122/97
ccgcacggccucc

SEQ ID NO: 1199904 - RNA, 15 nt, Mycobacterium bovis subsp bovis AF2122/97
ccgcacgggcccagg

SEQ ID NO: 1199905 - RNA, 20 nt, Mycobacterium bovis subsp bovis AF2122/97
ccgcacgggcccaggacagc

SEQ ID NO: 1199906 - RNA, 20 nt, Mycobacterium bovis subsp bovis AF2122/97
ccgcagaaugucguaggcgc

SEQ ID NO: 1199907 - RNA, 16 nt, Mycobacterium bovis subsp bovis AF2122/97
ccgcacggaugucgcc

SEQ ID NO: 1199908 - RNA, 17 nt, Mycobacterium bovis subsp bovis AF2122/97
ccgcacgcucggcgugu

SEQ ID NO: 1199909 - RNA, 16 nt, Mycobacterium bovis subsp bovis AF2122/97
ccgcacgcuggcgggc

SEQ ID NO: 1199910 - RNA, 12 nt, Mycobacterium bovis subsp bovis AF2122/97
ccgccaccaccg

SEQ ID NO: 1199911 - RNA, 12 nt, Mycobacterium bovis subsp bovis AF2122/97
ccgccacaccgc

SEQ ID NO: 1199912 - RNA, 18 nt, Mycobacterium bovis subsp bovis AF2122/97
ccgccacacggggccgcc

SEQ ID NO: 1199913 - RNA, 21 nt, Mycobacterium bovis subsp bovis AF2122/97
ccgccacacggggccgccagc

SEQ ID NO: 1199914 - RNA, 20 nt, Mycobacterium bovis subsp bovis AF2122/97
ccgccaccaccgcugccggc

SEQ ID NO: 1199915 - RNA, 22 nt, Mycobacterium bovis subsp bovis AF2122/97
ccgccaccaccgcugccggcgc

SEQ ID NO: 1199916 - RNA, 15 nt, Mycobacterium bovis subsp bovis AF2122/97
ccgccaccacgguca

SEQ ID NO: 1199917 - RNA, 11 nt, Mycobacterium bovis subsp bovis AF2122/97
ccgccacccgc

SEQ ID NO: 1199918 - RNA, 12 nt, Mycobacterium bovis subsp bovis AF2122/97
ccgccaccagcu

SEQ ID NO: 1199919 - RNA, 12 nt, Mycobacterium bovis subsp bovis AF2122/97
ccgccaccaggg

SEQ ID NO: 1199920 - RNA, 23 nt, Mycobacterium bovis subsp bovis AF2122/97
ccgccaccagggcggccuccccg

SEQ ID NO: 1199921 - RNA, 11 nt, Mycobacterium bovis subsp bovis AF2122/97
ccgccaccauc

SEQ ID NO: 1199922 - RNA, 21 nt, Mycobacterium bovis subsp bovis AF2122/97
ccgccaccaucgccucggcgc

SEQ ID NO: 1199923 - RNA, 15 nt, Mycobacterium bovis subsp bovis AF2122/97
ccgcauugccgucgg

SEQ ID NO: 1199924 - RNA, 23 nt, Mycobacterium bovis subsp bovis AF2122/97
ccgcauugccaacgcccacguua

SEQ ID NO: 1199925 - RNA, 16 nt, Mycobacterium bovis subsp bovis AF2122/97
ccgccaacuccucagc

SEQ ID NO: 1199926 - RNA, 17 nt, Mycobacterium bovis subsp bovis AF2122/97
ccgccaacuccucagcc

SEQ ID NO: 1199927 - RNA, 20 nt, Mycobacterium bovis subsp bovis AF2122/97
ccgcauaggccccgccagcg

SEQ ID NO: 1199928 - RNA, 23 nt, Mycobacterium bovis subsp bovis AF2122/97
ccgcauaggccccgccagcgccg

SEQ ID NO: 1199929 - RNA, 14 nt, Mycobacterium bovis subsp bovis AF2122/97
ccgcagcggcggca

SEQ ID NO: 1199930 - RNA, 22 nt, Mycobacterium bovis subsp bovis AF2122/97
ccgcagcggcggcaacccugcc

SEQ ID NO: 1199931 - RNA, 22 nt, Mycobacterium bovis subsp bovis AF2122/97
ccgcagcggccagcccagccgg

SEQ ID NO: 1199932 - RNA, 18 nt, Mycobacterium bovis subsp bovis AF2122/97
ccgcauccgcgacggcgc

SEQ ID NO: 1199933 - RNA, 15 nt, Mycobacterium bovis subsp bovis AF2122/97
ccgcauccggucucg

SEQ ID NO: 1199934 - RNA, 18 nt, Mycobacterium bovis subsp bovis AF2122/97
ccgcauccagccgugcgg

SEQ ID NO: 1199935 - RNA, 16 nt, Mycobacterium bovis subsp bovis AF2122/97
ccgcaucacccgggau

SEQ ID NO: 1199936 - RNA, 22 nt, Mycobacterium bovis subsp bovis AF2122/97
ccgcauggugggugccggcguc

SEQ ID NO: 1199937 - RNA, 19 nt, Mycobacterium bovis subsp bovis AF2122/97
ccgcaucggugucuuccuc

SEQ ID NO: 1199938 - RNA, 20 nt, Mycobacterium bovis subsp bovis AF2122/97
ccgcaucgggcuugcgcagc

SEQ ID NO: 1199939 - RNA, 15 nt, Mycobacterium bovis subsp bovis AF2122/97
ccgcaucgcaccagg

SEQ ID NO: 1199940 - RNA, 14 nt, Mycobacterium bovis subsp bovis AF2122/97
ccgcaucgccgaac

SEQ ID NO: 1199941 - RNA, 18 nt, Mycobacterium bovis subsp bovis AF2122/97
cccuuggacugucccacc

SEQ ID NO: 1199942 - RNA, 14 nt, Mycobacterium bovis subsp bovis AF2122/97
cccucggcgaccug

SEQ ID NO: 1199943 - RNA, 13 nt, Mycobacterium bovis subsp bovis AF2122/97
cccuuggccagca

SEQ ID NO: 1199944 - RNA, 14 nt, Mycobacterium bovis subsp bovis AF2122/97
cccucggccgcccg

SEQ ID NO: 1199945 - RNA, 19 nt, Mycobacterium bovis subsp bovis AF2122/97
cccuugcucguccaggucg

SEQ ID NO: 1199946 - RNA, 18 nt, Mycobacterium bovis subsp bovis AF2122/97
cccucggcacggucgccc

SEQ ID NO: 1199947 - RNA, 22 nt, Mycobacterium bovis subsp bovis AF2122/97
cccucgcuguuggccgguccca

SEQ ID NO: 1199948 - RNA, 14 nt, Mycobacterium bovis subsp bovis AF2122/97
cccucgcaaccggc

SEQ ID NO: 1199949 - RNA, 18 nt, Mycobacterium bovis subsp bovis AF2122/97
cccucgaucacggcggcc

SEQ ID NO: 1199950 - RNA, 20 nt, Mycobacterium bovis subsp bovis AF2122/97
cccucgaugccgcguagcug

SEQ ID NO: 1199951 - RNA, 24 nt, Mycobacterium bovis subsp bovis AF2122/97
cccucgcgaaauaacggagcggcc

SEQ ID NO: 1199952 - RNA, 15 nt, Mycobacterium bovis subsp bovis AF2122/97
cccuugggcaccacc

SEQ ID NO: 1199953 - RNA, 18 nt, Mycobacterium bovis subsp bovis AF2122/97
cccuugggcaccacccga

SEQ ID NO: 1199954 - RNA, 23 nt, Mycobacterium bovis subsp bovis AF2122/97
cccuugugaacggugucaacggc

SEQ ID NO: 1199955 - RNA, 13 nt, Mycobacterium bovis subsp bovis AF2122/97
cccuugguggcca

SEQ ID NO: 1199956 - RNA, 23 nt, Mycobacterium bovis subsp bovis AF2122/97
cccuuucgcgccgcgaggcaccg

SEQ ID NO: 1199957 - RNA, 18 nt, Mycobacterium bovis subsp bovis AF2122/97
cccuuugcuguccccgcc

SEQ ID NO: 1199958 - RNA, 16 nt, Mycobacterium bovis subsp bovis AF2122/97
cccuuucccaccuuca

SEQ ID NO: 1199959 - RNA, 23 nt, Mycobacterium bovis subsp bovis AF2122/97
ccgaacgcacgucgaggcggcag

SEQ ID NO: 1199960 - RNA, 21 nt, Mycobacterium bovis subsp bovis AF2122/97
ccgaacgcacgucgaggcggc

SEQ ID NO: 1199961 - RNA, 23 nt, Mycobacterium bovis subsp bovis AF2122/97
ccgaacgugcaaccacggcggca

SEQ ID NO: 1199962 - RNA, 22 nt, Mycobacterium bovis subsp bovis AF2122/97
ccgaacgcgagguuccaguugg

SEQ ID NO: 1199963 - RNA, 19 nt, Mycobacterium bovis subsp bovis AF2122/97
ccgaacuaccgacgcaccu

SEQ ID NO: 1199964 - RNA, 17 nt, Mycobacterium bovis subsp bovis AF2122/97
ccgaacucaacgacacc

SEQ ID NO: 1199965 - RNA, 11 nt, Mycobacterium bovis subsp bovis AF2122/97
ccgaagcccga

SEQ ID NO: 1199966 - RNA, 21 nt, Mycobacterium bovis subsp bovis AF2122/97
ccgaaccgcguuaugccaggc

SEQ ID NO: 1199967 - RNA, 23 nt, Mycobacterium bovis subsp bovis AF2122/97
ccgaaccgcguuaugccaggcgc

SEQ ID NO: 1199968 - RNA, 15 nt, Mycobacterium bovis subsp bovis AF2122/97
ccgaacaccacaccg

SEQ ID NO: 1199969 - RNA, 18 nt, Mycobacterium bovis subsp bovis AF2122/97
ccgaacaccacaccgagc

SEQ ID NO: 1199970 - RNA, 19 nt, Mycobacterium bovis subsp bovis AF2122/97
ccgaaccgucagcggcaac

SEQ ID NO: 1199971 - RNA, 22 nt, Mycobacterium bovis subsp bovis AF2122/97
ccgaaccguucgcucagggugu

SEQ ID NO: 1199972 - RNA, 18 nt, Mycobacterium bovis subsp bovis AF2122/97
ccgaaccuggucuugacu

SEQ ID NO: 1199973 - RNA, 17 nt, Mycobacterium bovis subsp bovis AF2122/97
ccgaaccggcaccagcg

SEQ ID NO: 1199974 - RNA, 18 nt, Mycobacterium bovis subsp bovis AF2122/97
ccgaaccggcgcauuccc

SEQ ID NO: 1199975 - RNA, 13 nt, Mycobacterium bovis subsp bovis AF2122/97
ccgaaagccucuc

SEQ ID NO: 1199976 - RNA, 22 nt, Mycobacterium bovis subsp bovis AF2122/97
ccgaaacuucgcccgggccgcg

SEQ ID NO: 1199977 - RNA, 14 nt, Mycobacterium bovis subsp bovis AF2122/97
ccgaaauacccagc

SEQ ID NO: 1199978 - RNA, 21 nt, Mycobacterium bovis subsp bovis AF2122/97
ccgaaaucaguugcgcuccaa

SEQ ID NO: 1199979 - RNA, 23 nt, Mycobacterium bovis subsp bovis AF2122/97
ccgaaaucaguugcgcuccaaca

SEQ ID NO: 1199980 - RNA, 20 nt, Mycobacterium bovis subsp bovis AF2122/97
ccgaaaucaccucaccaguc

SEQ ID NO: 1199981 - RNA, 19 nt, Mycobacterium bovis subsp bovis AF2122/97
cccuuuucccugccuucuu

SEQ ID NO: 1199982 - RNA, 16 nt, Mycobacterium bovis subsp bovis AF2122/97
cccuuuguggggccgg

SEQ ID NO: 1199983 - RNA, 14 nt, Mycobacterium bovis subsp bovis AF2122/97
ccgaccacuccacg

SEQ ID NO: 1199984 - RNA, 13 nt, Mycobacterium bovis subsp bovis AF2122/97
ccgaccacaccgg

SEQ ID NO: 1199985 - RNA, 23 nt, Mycobacterium bovis subsp bovis AF2122/97
ccgacauggcggugcgcagcuug

SEQ ID NO: 1199986 - RNA, 19 nt, Mycobacterium bovis subsp bovis AF2122/97
ccgacaugguccgaccagc

SEQ ID NO: 1199987 - RNA, 22 nt, Mycobacterium bovis subsp bovis AF2122/97
ccgacaugguccgaccagcggc

SEQ ID NO: 1199988 - RNA, 15 nt, Mycobacterium bovis subsp bovis AF2122/97
ccgaccagcacaccg

SEQ ID NO: 1199989 - RNA, 20 nt, Mycobacterium bovis subsp bovis AF2122/97
ccgacaguccgcgccggcgg

SEQ ID NO: 1199990 - RNA, 21 nt, Mycobacterium bovis subsp bovis AF2122/97
ccgacaguccgcgccggcggg

SEQ ID NO: 1199991 - RNA, 18 nt, Mycobacterium bovis subsp bovis AF2122/97
ccgacaguuuaccgugcc

SEQ ID NO: 1199992 - RNA, 18 nt, Mycobacterium bovis subsp bovis AF2122/97
ccgacaucgugauccccg

SEQ ID NO: 1199993 - RNA, 16 nt, Mycobacterium bovis subsp bovis AF2122/97
ccgacaucggcggccc

SEQ ID NO: 1199994 - RNA, 21 nt, Mycobacterium bovis subsp bovis AF2122/97
ccgacauggcggugcgcagcu

SEQ ID NO: 1199995 - RNA, 22 nt, Mycobacterium bovis subsp bovis AF2122/97
ccgacaguuuaccgugccgccc

SEQ ID NO: 1199996 - RNA, 23 nt, Mycobacterium bovis subsp bovis AF2122/97
ccgacagauggucacccacguug

SEQ ID NO: 1199997 - RNA, 17 nt, Mycobacterium bovis subsp bovis AF2122/97
ccgacagauggucgguc

SEQ ID NO: 1199998 - RNA, 12 nt, Mycobacterium bovis subsp bovis AF2122/97
ccgacagcccca

SEQ ID NO: 1199999 - RNA, 14 nt, Mycobacterium bovis subsp bovis AF2122/97
ccgacaccgugccg

SEQ ID NO: 1200000 - RNA, 14 nt, Mycobacterium bovis subsp bovis AF2122/97
ccgacacccucggg

SEQ ID NO: 1200001 - RNA, 16 nt, Mycobacterium bovis subsp bovis AF2122/97
ccgacaaugucggcga

SEQ ID NO: 1200002 - RNA, 17 nt, Mycobacterium bovis subsp bovis AF2122/97
ccgacaaugucggcgau

SEQ ID NO: 1200003 - RNA, 19 nt, Mycobacterium bovis subsp bovis AF2122/97
ccgacaacuguccugccag

SEQ ID NO: 1200004 - RNA, 17 nt, Mycobacterium bovis subsp bovis AF2122/97
ccgacaaccccgccagg

SEQ ID NO: 1200005 - RNA, 21 nt, Mycobacterium bovis subsp bovis AF2122/97
ccgacaacgacgucgccgacc

SEQ ID NO: 1200006 - RNA, 18 nt, Mycobacterium bovis subsp bovis AF2122/97
ccgaagcucaucaccggc

SEQ ID NO: 1200007 - RNA, 13 nt, Mycobacterium bovis subsp bovis AF2122/97
ccgaaggccgcca

SEQ ID NO: 1200008 - RNA, 13 nt, Mycobacterium bovis subsp bovis AF2122/97
ccgaagccgcgca

SEQ ID NO: 1200009 - RNA, 17 nt, Mycobacterium bovis subsp bovis AF2122/97
ccgaagcggaucuggcc

SEQ ID NO: 1200010 - RNA, 16 nt, Mycobacterium bovis subsp bovis AF2122/97
ccgaagcggccaccgc

SEQ ID NO: 1200011 - RNA, 21 nt, Mycobacterium bovis subsp bovis AF2122/97
ccgaagcggccaccgccgccg

SEQ ID NO: 1200012 - RNA, 19 nt, Mycobacterium bovis subsp bovis AF2122/97
ccgaauuguuguaacccgu

SEQ ID NO: 1200013 - RNA, 22 nt, Mycobacterium bovis subsp bovis AF2122/97
ccgacugccguucagcggcggg

SEQ ID NO: 1200014 - RNA, 18 nt, Mycobacterium bovis subsp bovis AF2122/97
ccgacugccgcgggcagc

SEQ ID NO: 1200015 - RNA, 18 nt, Mycobacterium bovis subsp bovis AF2122/97
ccgacugggcgcgacccc

SEQ ID NO: 1200016 - RNA, 15 nt, Mycobacterium bovis subsp bovis AF2122/97
ccgacugcacuugaa

SEQ ID NO: 1200017 - RNA, 18 nt, Mycobacterium bovis subsp bovis AF2122/97
ccgacuccugugcggagc

SEQ ID NO: 1200018 - RNA, 19 nt, Mycobacterium bovis subsp bovis AF2122/97
ccgacggggauggagccgg

SEQ ID NO: 1200019 - RNA, 21 nt, Mycobacterium bovis subsp bovis AF2122/97
ccgacgggauagacgaccccg

SEQ ID NO: 1200020 - RNA, 23 nt, Mycobacterium bovis subsp bovis AF2122/97
ccgacgggcgaaauuccgggccu

SEQ ID NO: 1200021 - RNA, 12 nt, Mycobacterium bovis subsp bovis AF2122/97
ccgagcgcgccg

SEQ ID NO: 1200022 - RNA, 16 nt, Mycobacterium bovis subsp bovis AF2122/97
ccgagcccgucagcuc

SEQ ID NO: 1200023 - RNA, 19 nt, Mycobacterium bovis subsp bovis AF2122/97
ccgagcgcuugaccccgcc

SEQ ID NO: 1200024 - RNA, 15 nt, Mycobacterium bovis subsp bovis AF2122/97
ccgagcggaccaccg

SEQ ID NO: 1200025 - RNA, 16 nt, Mycobacterium bovis subsp bovis AF2122/97
ccgagccagcacccgc

SEQ ID NO: 1200026 - RNA, 16 nt, Mycobacterium bovis subsp bovis AF2122/97
ccgagccaucaccgca

SEQ ID NO: 1200027 - RNA, 14 nt, Mycobacterium bovis subsp bovis AF2122/97
ccgagcccagccgg

SEQ ID NO: 1200028 - RNA, 15 nt, Mycobacterium bovis subsp bovis AF2122/97
ccgagcccagcgccu

SEQ ID NO: 1200029 - RNA, 16 nt, Mycobacterium bovis subsp bovis AF2122/97
ccgagcacuccggagc

SEQ ID NO: 1200030 - RNA, 14 nt, Mycobacterium bovis subsp bovis AF2122/97
ccgagcacucggcc

SEQ ID NO: 1200031 - RNA, 20 nt, Mycobacterium bovis subsp bovis AF2122/97
ccgagcagggccggcaccgc

SEQ ID NO: 1200032 - RNA, 17 nt, Mycobacterium bovis subsp bovis AF2122/97
ccgacccgccgcgcccg

SEQ ID NO: 1200033 - RNA, 15 nt, Mycobacterium bovis subsp bovis AF2122/97
ccgacccgcgcgccg

SEQ ID NO: 1200034 - RNA, 17 nt, Mycobacterium bovis subsp bovis AF2122/97
ccgacccguaccagccc

SEQ ID NO: 1200035 - RNA, 22 nt, Mycobacterium bovis subsp bovis AF2122/97
ccgacccuagauaugcacccgc

SEQ ID NO: 1200036 - RNA, 12 nt, Mycobacterium bovis subsp bovis AF2122/97
ccgaccccgcgc

SEQ ID NO: 1200037 - RNA, 14 nt, Mycobacterium bovis subsp bovis AF2122/97
ccgacccgcccgaa

SEQ ID NO: 1200038 - RNA, 17 nt, Mycobacterium bovis subsp bovis AF2122/97
ccgacccaucaccagcg

SEQ ID NO: 1200039 - RNA, 19 nt, Mycobacterium bovis subsp bovis AF2122/97
ccgacccaucaccagcggc

SEQ ID NO: 1200040 - RNA, 18 nt, Mycobacterium bovis subsp bovis AF2122/97
ccgaccggguugauggcg

SEQ ID NO: 1200041 - RNA, 18 nt, Mycobacterium bovis subsp bovis AF2122/97
ccgaccgcacgaccagcu

SEQ ID NO: 1200042 - RNA, 19 nt, Mycobacterium bovis subsp bovis AF2122/97
ccgaccgcgggucgugcca

SEQ ID NO: 1200043 - RNA, 13 nt, Mycobacterium bovis subsp bovis AF2122/97
ccgaccgaaccgu

SEQ ID NO: 1200044 - RNA, 16 nt, Mycobacterium bovis subsp bovis AF2122/97
ccgaccgaaagccgca

SEQ ID NO: 1200045 - RNA, 20 nt, Mycobacterium bovis subsp bovis AF2122/97
ccgaccgauaacacccgggc

SEQ ID NO: 1200046 - RNA, 22 nt, Mycobacterium bovis subsp bovis AF2122/97
ccgaccgauaacacccgggcca

SEQ ID NO: 1200047 - RNA, 20 nt, Mycobacterium bovis subsp bovis AF2122/97
ccgacggcaaaccaguuggc

SEQ ID NO: 1200048 - RNA, 19 nt, Mycobacterium bovis subsp bovis AF2122/97
ccgacggccagcaggauga

SEQ ID NO: 1200049 - RNA, 15 nt, Mycobacterium bovis subsp bovis AF2122/97
ccgacggcagugcug

SEQ ID NO: 1200050 - RNA, 16 nt, Mycobacterium bovis subsp bovis AF2122/97
ccgacggcgaccaccg

SEQ ID NO: 1200051 - RNA, 18 nt, Mycobacterium bovis subsp bovis AF2122/97
ccgacggcgccccgcgcu

SEQ ID NO: 1200052 - RNA, 15 nt, Mycobacterium bovis subsp bovis AF2122/97
ccgacgggccgucgc

SEQ ID NO: 1200053 - RNA, 18 nt, Mycobacterium bovis subsp bovis AF2122/97
ccgaccuaccgucgacca

SEQ ID NO: 1200054 - RNA, 20 nt, Mycobacterium bovis subsp bovis AF2122/97
ccgacgcggucggcggccgc

SEQ ID NO: 1200055 - RNA, 15 nt, Mycobacterium bovis subsp bovis AF2122/97
ccgacgcgucggcga

SEQ ID NO: 1200056 - RNA, 13 nt, Mycobacterium bovis subsp bovis AF2122/97
ccgacgcuccagg

SEQ ID NO: 1200057 - RNA, 15 nt, Mycobacterium bovis subsp bovis AF2122/97
ccgaccucgacgccc

SEQ ID NO: 1200058 - RNA, 15 nt, Mycobacterium bovis subsp bovis AF2122/97
ccgaccucgccgcgc

SEQ ID NO: 1200059 - RNA, 19 nt, Mycobacterium bovis subsp bovis AF2122/97
ccgaccucguucgucacca

SEQ ID NO: 1200060 - RNA, 18 nt, Mycobacterium bovis subsp bovis AF2122/97
ccgaccgucgucgugcag

SEQ ID NO: 1200061 - RNA, 14 nt, Mycobacterium bovis subsp bovis AF2122/97
ccgaccggcccgca

SEQ ID NO: 1200062 - RNA, 20 nt, Mycobacterium bovis subsp bovis AF2122/97
ccgaggaucucgcgguccag

SEQ ID NO: 1200063 - RNA, 21 nt, Mycobacterium bovis subsp bovis AF2122/97
ccgagcucaccgcacaccugc

SEQ ID NO: 1200064 - RNA, 20 nt, Mycobacterium bovis subsp bovis AF2122/97
ccgaggacgccggcgccgcc

SEQ ID NO: 1200065 - RNA, 21 nt, Mycobacterium bovis subsp bovis AF2122/97
ccgaggacgccggcgccgcca

SEQ ID NO: 1200066 - RNA, 23 nt, Mycobacterium bovis subsp bovis AF2122/97
ccgaggaugugguuggugcuggc

SEQ ID NO: 1200067 - RNA, 15 nt, Mycobacterium bovis subsp bovis AF2122/97
ccgagcguccggugg

SEQ ID NO: 1200068 - RNA, 22 nt, Mycobacterium bovis subsp bovis AF2122/97
ccgagcuacgaccguugggaug

SEQ ID NO: 1200069 - RNA, 22 nt, Mycobacterium bovis subsp bovis AF2122/97
ccgagcucaccaaggucggcga

SEQ ID NO: 1200070 - RNA, 16 nt, Mycobacterium bovis subsp bovis AF2122/97
ccgagcggucgaucug

SEQ ID NO: 1200071 - RNA, 20 nt, Mycobacterium bovis subsp bovis AF2122/97
ccgagcgguugccuucuugg

SEQ ID NO: 1200072 - RNA, 22 nt, Mycobacterium bovis subsp bovis AF2122/97
ccgagcgggaacgagccacgcc

SEQ ID NO: 1200073 - RNA, 23 nt, Mycobacterium bovis subsp bovis AF2122/97
ccgagcgggaacgagccacgcca

SEQ ID NO: 1200074 - RNA, 22 nt, Mycobacterium bovis subsp bovis AF2122/97
ccgagcggguugucuuucacau

SEQ ID NO: 1200075 - RNA, 12 nt, Mycobacterium bovis subsp bovis AF2122/97
ccgagcgcgcgc

SEQ ID NO: 1200076 - RNA, 14 nt, Mycobacterium bovis subsp bovis AF2122/97
ccgagcggcccuuc

SEQ ID NO: 1200077 - RNA, 20 nt, Mycobacterium bovis subsp bovis AF2122/97
ccgagcggcccuucaccagc

SEQ ID NO: 1200078 - RNA, 12 nt, Mycobacterium bovis subsp bovis AF2122/97
ccgaggucggcc

SEQ ID NO: 1200079 - RNA, 19 nt, Mycobacterium bovis subsp bovis AF2122/97
ccgaggucgguucggccgg

SEQ ID NO: 1200080 - RNA, 16 nt, Mycobacterium bovis subsp bovis AF2122/97
ccgaggccgcugccag

SEQ ID NO: 1200081 - RNA, 15 nt, Mycobacterium bovis subsp bovis AF2122/97
ccgaggcgagacgcu

SEQ ID NO: 1200082 - RNA, 22 nt, Mycobacterium bovis subsp bovis AF2122/97
ccgaggcgagacgcuccagugg

SEQ ID NO: 1200083 - RNA, 19 nt, Mycobacterium bovis subsp bovis AF2122/97
ccgaggccaugcucgccaa

SEQ ID NO: 1200084 - RNA, 16 nt, Mycobacterium bovis subsp bovis AF2122/97
ccgaggccgaccucgu

SEQ ID NO: 1200085 - RNA, 22 nt, Mycobacterium bovis subsp bovis AF2122/97
ccgaggccuaccaggcgcggcc

SEQ ID NO: 1200086 - RNA, 14 nt, Mycobacterium bovis subsp bovis AF2122/97
ccgaggugccgcgc

SEQ ID NO: 1200087 - RNA, 15 nt, Mycobacterium bovis subsp bovis AF2122/97
ccgaggugccgcgca

SEQ ID NO: 1200088 - RNA, 19 nt, Mycobacterium bovis subsp bovis AF2122/97
ccgaggugccgcgcagcug

SEQ ID NO: 1200089 - RNA, 19 nt, Mycobacterium bovis subsp bovis AF2122/97
ccgaggucuccggugcgca

SEQ ID NO: 1200090 - RNA, 23 nt, Mycobacterium bovis subsp bovis AF2122/97
ccgagguucaaagcagcgcacca

SEQ ID NO: 1200091 - RNA, 23 nt, Mycobacterium bovis subsp bovis AF2122/97
ccgaguagaagauggcaccgccc

SEQ ID NO: 1200092 - RNA, 20 nt, Mycobacterium bovis subsp bovis AF2122/97
ccgaucgccgaggcuagcag

SEQ ID NO: 1200093 - RNA, 14 nt, Mycobacterium bovis subsp bovis AF2122/97
ccgaugcugcgggc

SEQ ID NO: 1200094 - RNA, 16 nt, Mycobacterium bovis subsp bovis AF2122/97
ccgauccgcacagcaa

SEQ ID NO: 1200095 - RNA, 22 nt, Mycobacterium bovis subsp bovis AF2122/97
ccgauccgguggcuggccgcca

SEQ ID NO: 1200096 - RNA, 18 nt, Mycobacterium bovis subsp bovis AF2122/97
ccgauccggaucccacca

SEQ ID NO: 1200097 - RNA, 18 nt, Mycobacterium bovis subsp bovis AF2122/97
ccgauccugcccaccauc

SEQ ID NO: 1200098 - RNA, 23 nt, Mycobacterium bovis subsp bovis AF2122/97
ccgauccuggccacucccagcca

SEQ ID NO: 1200099 - RNA, 15 nt, Mycobacterium bovis subsp bovis AF2122/97
ccgaucgacacccgc

SEQ ID NO: 1200100 - RNA, 14 nt, Mycobacterium bovis subsp bovis AF2122/97
ccgaucgacugcag

SEQ ID NO: 1200101 - RNA, 22 nt, Mycobacterium bovis subsp bovis AF2122/97
ccgaucgaucagcaacucggcc

SEQ ID NO: 1200102 - RNA, 16 nt, Mycobacterium bovis subsp bovis AF2122/97
ccgauccagcaggccg

SEQ ID NO: 1200103 - RNA, 13 nt, Mycobacterium bovis subsp bovis AF2122/97
ccgauccagcagg

SEQ ID NO: 1200104 - RNA, 22 nt, Mycobacterium bovis subsp bovis AF2122/97
ccgauaucggugaccguggcgg

SEQ ID NO: 1200105 - RNA, 13 nt, Mycobacterium bovis subsp bovis AF2122/97
ccgauccccaggc

SEQ ID NO: 1200106 - RNA, 14 nt, Mycobacterium bovis subsp bovis AF2122/97
ccgauccccaggcc

SEQ ID NO: 1200107 - RNA, 17 nt, Mycobacterium bovis subsp bovis AF2122/97
ccgauagcgcggcacca

SEQ ID NO: 1200108 - RNA, 19 nt, Mycobacterium bovis subsp bovis AF2122/97
ccgauagcgcggcaccagc

SEQ ID NO: 1200109 - RNA, 16 nt, Mycobacterium bovis subsp bovis AF2122/97
ccgagucgacggccag

SEQ ID NO: 1200110 - RNA, 22 nt, Mycobacterium bovis subsp bovis AF2122/97
ccgauacuaaacaggccgccac

SEQ ID NO: 1200111 - RNA, 15 nt, Mycobacterium bovis subsp bovis AF2122/97
ccgauacccagcggg

SEQ ID NO: 1200112 - RNA, 20 nt, Mycobacterium bovis subsp bovis AF2122/97
ccgcggcgaucuuggaucgg

SEQ ID NO: 1200113 - RNA, 21 nt, Mycobacterium bovis subsp bovis AF2122/97
ccgcggcgaaccagcgcgucu

SEQ ID NO: 1200114 - RNA, 20 nt, Mycobacterium bovis subsp bovis AF2122/97
ccgcggucggaccacccggc

SEQ ID NO: 1200115 - RNA, 19 nt, Mycobacterium bovis subsp bovis AF2122/97
ccgcggugacucggccucc

SEQ ID NO: 1200116 - RNA, 23 nt, Mycobacterium bovis subsp bovis AF2122/97
ccgcggucucagugcucgcccag

SEQ ID NO: 1200117 - RNA, 22 nt, Mycobacterium bovis subsp bovis AF2122/97
ccgcggucugcgccuucgccag

SEQ ID NO: 1200118 - RNA, 12 nt, Mycobacterium bovis subsp bovis AF2122/97
ccgcggucggcc

SEQ ID NO: 1200119 - RNA, 20 nt, Mycobacterium bovis subsp bovis AF2122/97
ccgcggucggccaccaacuc

SEQ ID NO: 1200120 - RNA, 13 nt, Mycobacterium bovis subsp bovis AF2122/97
ccgcggucggcga

SEQ ID NO: 1200121 - RNA, 13 nt, Mycobacterium bovis subsp bovis AF2122/97
ccgcggucggcgu

SEQ ID NO: 1200122 - RNA, 13 nt, Mycobacterium bovis subsp bovis AF2122/97
ccgcggccccgcc

SEQ ID NO: 1200123 - RNA, 23 nt, Mycobacterium bovis subsp bovis AF2122/97
ccgcggcccgcucgaucggcagc

SEQ ID NO: 1200124 - RNA, 23 nt, Mycobacterium bovis subsp bovis AF2122/97
ccgcggccucguagucccacugc

SEQ ID NO: 1200125 - RNA, 23 nt, Mycobacterium bovis subsp bovis AF2122/97
ccgcggccuuggcggccgcgacc

SEQ ID NO: 1200126 - RNA, 15 nt, Mycobacterium bovis subsp bovis AF2122/97
ccgcggccgggccgc

SEQ ID NO: 1200127 - RNA, 21 nt, Mycobacterium bovis subsp bovis AF2122/97
ccgcggccagcaccggggaca

SEQ ID NO: 1200128 - RNA, 15 nt, Mycobacterium bovis subsp bovis AF2122/97
ccgcggccagcagca

SEQ ID NO: 1200129 - RNA, 16 nt, Mycobacterium bovis subsp bovis AF2122/97
ccgcggcaugauuuuu

SEQ ID NO: 1200130 - RNA, 12 nt, Mycobacterium bovis subsp bovis AF2122/97
ccgcggcacgcu

SEQ ID NO: 1200131 - RNA, 16 nt, Mycobacterium bovis subsp bovis AF2122/97
ccgcggcaccgccccg

SEQ ID NO: 1200132 - RNA, 23 nt, Mycobacterium bovis subsp bovis AF2122/97
ccgcggaucaccaucgccgccgc

SEQ ID NO: 1200133 - RNA, 15 nt, Mycobacterium bovis subsp bovis AF2122/97
ccgcggcaccgcccc

SEQ ID NO: 1200134 - RNA, 21 nt, Mycobacterium bovis subsp bovis AF2122/97
ccgcggaucauccuucgccgg

SEQ ID NO: 1200135 - RNA, 23 nt, Mycobacterium bovis subsp bovis AF2122/97
ccgcggauaggccgcgcggcggc

SEQ ID NO: 1200136 - RNA, 20 nt, Mycobacterium bovis subsp bovis AF2122/97
ccgcggaucaccaucgccgc

SEQ ID NO: 1200137 - RNA, 21 nt, Mycobacterium bovis subsp bovis AF2122/97
ccgcggaucaccaucgccgcc

SEQ ID NO: 1200138 - RNA, 16 nt, Mycobacterium bovis subsp bovis AF2122/97
ccgcggcaacaccacc

SEQ ID NO: 1200139 - RNA, 15 nt, Mycobacterium bovis subsp bovis AF2122/97
ccgcgucgggccgca

SEQ ID NO: 1200140 - RNA, 12 nt, Mycobacterium bovis subsp bovis AF2122/97
ccgcgucggcgg

SEQ ID NO: 1200141 - RNA, 19 nt, Mycobacterium bovis subsp bovis AF2122/97
ccgcuaccaacgcaacacg

SEQ ID NO: 1200142 - RNA, 20 nt, Mycobacterium bovis subsp bovis AF2122/97
ccgcgugcucgagcaccucg

SEQ ID NO: 1200143 - RNA, 13 nt, Mycobacterium bovis subsp bovis AF2122/97
ccgcguggcuggc

SEQ ID NO: 1200144 - RNA, 14 nt, Mycobacterium bovis subsp bovis AF2122/97
ccgcgugcgucagc

SEQ ID NO: 1200145 - RNA, 17 nt, Mycobacterium bovis subsp bovis AF2122/97
ccgcucauuagcccccg

SEQ ID NO: 1200146 - RNA, 22 nt, Mycobacterium bovis subsp bovis AF2122/97
ccgcuacucgugaagugcuuug

SEQ ID NO: 1200147 - RNA, 22 nt, Mycobacterium bovis subsp bovis AF2122/97
ccgcucagggugcgccgcagca

SEQ ID NO: 1200148 - RNA, 18 nt, Mycobacterium bovis subsp bovis AF2122/97
ccgcuaccgcccgcgcca

SEQ ID NO: 1200149 - RNA, 13 nt, Mycobacterium bovis subsp bovis AF2122/97
ccgcuacgcgcgc

SEQ ID NO: 1200150 - RNA, 21 nt, Mycobacterium bovis subsp bovis AF2122/97
ccgcuacgcgcgcucgcucac

SEQ ID NO: 1200151 - RNA, 13 nt, Mycobacterium bovis subsp bovis AF2122/97
ccgcuaccccagc

SEQ ID NO: 1200152 - RNA, 12 nt, Mycobacterium bovis subsp bovis AF2122/97
ccgcuacccccg

SEQ ID NO: 1200153 - RNA, 17 nt, Mycobacterium bovis subsp bovis AF2122/97
ccgcuagucgucggcgc

SEQ ID NO: 1200154 - RNA, 16 nt, Mycobacterium bovis subsp bovis AF2122/97
ccgcuaggucagguga

SEQ ID NO: 1200155 - RNA, 20 nt, Mycobacterium bovis subsp bovis AF2122/97
ccgcuaggugacgccgccag

SEQ ID NO: 1200156 - RNA, 20 nt, Mycobacterium bovis subsp bovis AF2122/97
ccgcuagcgcuugcgacccc

SEQ ID NO: 1200157 - RNA, 15 nt, Mycobacterium bovis subsp bovis AF2122/97
ccgcuaggacggcgc

SEQ ID NO: 1200158 - RNA, 14 nt, Mycobacterium bovis subsp bovis AF2122/97
ccgcuccgccgucg

SEQ ID NO: 1200159 - RNA, 21 nt, Mycobacterium bovis subsp bovis AF2122/97
ccgcucccucuacacccggac

SEQ ID NO: 1200160 - RNA, 13 nt, Mycobacterium bovis subsp bovis AF2122/97
ccgcuccgccguc

SEQ ID NO: 1200161 - RNA, 18 nt, Mycobacterium bovis subsp bovis AF2122/97
ccgcucgcaggccggcgg

SEQ ID NO: 1200162 - RNA, 16 nt, Mycobacterium bovis subsp bovis AF2122/97
ccgcucgacggcccgc

SEQ ID NO: 1200163 - RNA, 22 nt, Mycobacterium bovis subsp bovis AF2122/97
ccgcucgacggcccgccguccg

SEQ ID NO: 1200164 - RNA, 19 nt, Mycobacterium bovis subsp bovis AF2122/97
ccgcucgagcagcgcgccg

SEQ ID NO: 1200165 - RNA, 17 nt, Mycobacterium bovis subsp bovis AF2122/97
ccgcucgaucggcagcc

SEQ ID NO: 1200166 - RNA, 14 nt, Mycobacterium bovis subsp bovis AF2122/97
ccgcucgcacagcc

SEQ ID NO: 1200167 - RNA, 20 nt, Mycobacterium bovis subsp bovis AF2122/97
ccgcugaccccggcagcgcc

SEQ ID NO: 1200168 - RNA, 14 nt, Mycobacterium bovis subsp bovis AF2122/97
ccgcugacuccugc

SEQ ID NO: 1200169 - RNA, 17 nt, Mycobacterium bovis subsp bovis AF2122/97
ccgcugacuccugcggc

SEQ ID NO: 1200170 - RNA, 16 nt, Mycobacterium bovis subsp bovis AF2122/97
ccgcugagccagcucc

SEQ ID NO: 1200171 - RNA, 18 nt, Mycobacterium bovis subsp bovis AF2122/97
ccgcugagccagcuccac

SEQ ID NO: 1200172 - RNA, 14 nt, Mycobacterium bovis subsp bovis AF2122/97
ccgcugagcccugc

SEQ ID NO: 1200173 - RNA, 14 nt, Mycobacterium bovis subsp bovis AF2122/97
ccgcucggccgcag

SEQ ID NO: 1200174 - RNA, 14 nt, Mycobacterium bovis subsp bovis AF2122/97
ccgcucggccgccg

SEQ ID NO: 1200175 - RNA, 15 nt, Mycobacterium bovis subsp bovis AF2122/97
ccgcucggccgccgg

SEQ ID NO: 1200176 - RNA, 16 nt, Mycobacterium bovis subsp bovis AF2122/97
ccgcugagcccugcgc

SEQ ID NO: 1200177 - RNA, 17 nt, Mycobacterium bovis subsp bovis AF2122/97
ccgcugauagcggucgg

SEQ ID NO: 1200178 - RNA, 18 nt, Mycobacterium bovis subsp bovis AF2122/97
ccgcugaucaaggcgcuc

SEQ ID NO: 1200179 - RNA, 19 nt, Mycobacterium bovis subsp bovis AF2122/97
ccgcugaucagauccucga

SEQ ID NO: 1200180 - RNA, 18 nt, Mycobacterium bovis subsp bovis AF2122/97
ccgcugaucugccgccgc

SEQ ID NO: 1200181 - RNA, 16 nt, Mycobacterium bovis subsp bovis AF2122/97
ccgcugaugagccgca

SEQ ID NO: 1200182 - RNA, 16 nt, Mycobacterium bovis subsp bovis AF2122/97
ccgcuggggcgcccga

SEQ ID NO: 1200183 - RNA, 14 nt, Mycobacterium bovis subsp bovis AF2122/97
ccgcugggugacca

SEQ ID NO: 1200184 - RNA, 21 nt, Mycobacterium bovis subsp bovis AF2122/97
ccgcugguggugauugggauu

SEQ ID NO: 1200185 - RNA, 23 nt, Mycobacterium bovis subsp bovis AF2122/97
ccgcuggugugucccggggugaa

SEQ ID NO: 1200186 - RNA, 17 nt, Mycobacterium bovis subsp bovis AF2122/97
ccgcuguaccuccagga

SEQ ID NO: 1200187 - RNA, 21 nt, Mycobacterium bovis subsp bovis AF2122/97
ccgcugcgccaggucagcucc

SEQ ID NO: 1200188 - RNA, 20 nt, Mycobacterium bovis subsp bovis AF2122/97
ccgcugccuuggcgcggcac

SEQ ID NO: 1200189 - RNA, 23 nt, Mycobacterium bovis subsp bovis AF2122/97
ccgcugcuagugcgggccgugac

SEQ ID NO: 1200190 - RNA, 19 nt, Mycobacterium bovis subsp bovis AF2122/97
ccgcugcggugccggcccu

SEQ ID NO: 1200191 - RNA, 18 nt, Mycobacterium bovis subsp bovis AF2122/97
ccgcugcguaguguucug

SEQ ID NO: 1200192 - RNA, 13 nt, Mycobacterium bovis subsp bovis AF2122/97
ccgcgccaguggc

SEQ ID NO: 1200193 - RNA, 11 nt, Mycobacterium bovis subsp bovis AF2122/97
ccgcgcgcaga

SEQ ID NO: 1200194 - RNA, 19 nt, Mycobacterium bovis subsp bovis AF2122/97
ccgcgcgccggcgacccgg

SEQ ID NO: 1200195 - RNA, 21 nt, Mycobacterium bovis subsp bovis AF2122/97
ccgcgcgcaucgcgccuuuga

SEQ ID NO: 1200196 - RNA, 19 nt, Mycobacterium bovis subsp bovis AF2122/97
ccgcgcggcgagagccucg

SEQ ID NO: 1200197 - RNA, 12 nt, Mycobacterium bovis subsp bovis AF2122/97
ccgcgcggcagg

SEQ ID NO: 1200198 - RNA, 17 nt, Mycobacterium bovis subsp bovis AF2122/97
ccgcgcggagaccccgc

SEQ ID NO: 1200199 - RNA, 21 nt, Mycobacterium bovis subsp bovis AF2122/97
ccgcgcggagaccccgcgcgc

SEQ ID NO: 1200200 - RNA, 16 nt, Mycobacterium bovis subsp bovis AF2122/97
ccgcgcgggccgccgc

SEQ ID NO: 1200201 - RNA, 14 nt, Mycobacterium bovis subsp bovis AF2122/97
ccgcgcggcgugcu

SEQ ID NO: 1200202 - RNA, 23 nt, Mycobacterium bovis subsp bovis AF2122/97
ccgcgcggcggugucacgaccca

SEQ ID NO: 1200203 - RNA, 14 nt, Mycobacterium bovis subsp bovis AF2122/97
ccgcgcggcggcgc

SEQ ID NO: 1200204 - RNA, 20 nt, Mycobacterium bovis subsp bovis AF2122/97
ccgcgcucaccggggccguc

SEQ ID NO: 1200205 - RNA, 23 nt, Mycobacterium bovis subsp bovis AF2122/97
ccgcgcucaucugcgcgcggaag

SEQ ID NO: 1200206 - RNA, 15 nt, Mycobacterium bovis subsp bovis AF2122/97
ccgcgcucagcuccg

SEQ ID NO: 1200207 - RNA, 23 nt, Mycobacterium bovis subsp bovis AF2122/97
ccgcgcucgcacccgcucggcgc

SEQ ID NO: 1200208 - RNA, 17 nt, Mycobacterium bovis subsp bovis AF2122/97
ccgcgcucccggcgucu

SEQ ID NO: 1200209 - RNA, 13 nt, Mycobacterium bovis subsp bovis AF2122/97
ccgcgcucccggc

SEQ ID NO: 1200210 - RNA, 18 nt, Mycobacterium bovis subsp bovis AF2122/97
ccgcgcgguacugcgcag

SEQ ID NO: 1200211 - RNA, 15 nt, Mycobacterium bovis subsp bovis AF2122/97
ccgcgcuagcucggc

SEQ ID NO: 1200212 - RNA, 21 nt, Mycobacterium bovis subsp bovis AF2122/97
ccgcggaggcggccagccuac

SEQ ID NO: 1200213 - RNA, 23 nt, Mycobacterium bovis subsp bovis AF2122/97
ccgcggaggcggccagccuaccg

SEQ ID NO: 1200214 - RNA, 18 nt, Mycobacterium bovis subsp bovis AF2122/97
ccgcggaggcggccagcc

SEQ ID NO: 1200215 - RNA, 22 nt, Mycobacterium bovis subsp bovis AF2122/97
ccgcggacgugccggucccccc

SEQ ID NO: 1200216 - RNA, 17 nt, Mycobacterium bovis subsp bovis AF2122/97
ccgcggacuuggcgguc

SEQ ID NO: 1200217 - RNA, 16 nt, Mycobacterium bovis subsp bovis AF2122/97
ccgcggacccgcagcu

SEQ ID NO: 1200218 - RNA, 19 nt, Mycobacterium bovis subsp bovis AF2122/97
ccgcggacguggucggagc

SEQ ID NO: 1200219 - RNA, 19 nt, Mycobacterium bovis subsp bovis AF2122/97
ccgcggacucgggcaggcc

SEQ ID NO: 1200220 - RNA, 14 nt, Mycobacterium bovis subsp bovis AF2122/97
ccgcgcugagcacg

SEQ ID NO: 1200221 - RNA, 23 nt, Mycobacterium bovis subsp bovis AF2122/97
ccgcgcuggucagccgugccgug

SEQ ID NO: 1200222 - RNA, 22 nt, Mycobacterium bovis subsp bovis AF2122/97
ccgcgcuggucggagaccagcg

SEQ ID NO: 1200223 - RNA, 18 nt, Mycobacterium bovis subsp bovis AF2122/97
ccgcgcuucacagccacc

SEQ ID NO: 1200224 - RNA, 16 nt, Mycobacterium bovis subsp bovis AF2122/97
ccgcgaauucccagga

SEQ ID NO: 1200225 - RNA, 20 nt, Mycobacterium bovis subsp bovis AF2122/97
ccgcgaacgcgacagccacc

SEQ ID NO: 1200226 - RNA, 21 nt, Mycobacterium bovis subsp bovis AF2122/97
ccgcgaacgggucgggacgcu

SEQ ID NO: 1200227 - RNA, 21 nt, Mycobacterium bovis subsp bovis AF2122/97
ccgcgaacgauuucggcccac

SEQ ID NO: 1200228 - RNA, 18 nt, Mycobacterium bovis subsp bovis AF2122/97
ccgcgaaacccaugaccu

SEQ ID NO: 1200229 - RNA, 19 nt, Mycobacterium bovis subsp bovis AF2122/97
ccgcgaagcgcucggcagc

SEQ ID NO: 1200230 - RNA, 23 nt, Mycobacterium bovis subsp bovis AF2122/97
ccgcgaagcugcgggucucgcug

SEQ ID NO: 1200231 - RNA, 20 nt, Mycobacterium bovis subsp bovis AF2122/97
ccgcgaaggggugcccggcg

SEQ ID NO: 1200232 - RNA, 19 nt, Mycobacterium bovis subsp bovis AF2122/97
ccgcgaaguugcgggugau

SEQ ID NO: 1200233 - RNA, 13 nt, Mycobacterium bovis subsp bovis AF2122/97
ccgcgauccccac

SEQ ID NO: 1200234 - RNA, 14 nt, Mycobacterium bovis subsp bovis AF2122/97
ccgcgaucccggcc

SEQ ID NO: 1200235 - RNA, 16 nt, Mycobacterium bovis subsp bovis AF2122/97
ccgcgaucgacggugu

SEQ ID NO: 1200236 - RNA, 19 nt, Mycobacterium bovis subsp bovis AF2122/97
ccgcgaucgcgacacggcc

SEQ ID NO: 1200237 - RNA, 16 nt, Mycobacterium bovis subsp bovis AF2122/97
ccgcgaugagcggcgc

SEQ ID NO: 1200238 - RNA, 20 nt, Mycobacterium bovis subsp bovis AF2122/97
ccgcgauggccgcgugcagc

SEQ ID NO: 1200239 - RNA, 20 nt, Mycobacterium bovis subsp bovis AF2122/97
ccgcgaugcgcaccagcggc

SEQ ID NO: 1200240 - RNA, 15 nt, Mycobacterium bovis subsp bovis AF2122/97
ccgcgaugccaccca

SEQ ID NO: 1200241 - RNA, 14 nt, Mycobacterium bovis subsp bovis AF2122/97
ccgcgaugugccca

SEQ ID NO: 1200242 - RNA, 21 nt, Mycobacterium bovis subsp bovis AF2122/97
ccgcgauggugcgccgggcgu

SEQ ID NO: 1200243 - RNA, 13 nt, Mycobacterium bovis subsp bovis AF2122/97
ccgcgacgacacg

SEQ ID NO: 1200244 - RNA, 16 nt, Mycobacterium bovis subsp bovis AF2122/97
ccgcgaaccucacagc

SEQ ID NO: 1200245 - RNA, 19 nt, Mycobacterium bovis subsp bovis AF2122/97
ccgcgaccgcgaccgcauu

SEQ ID NO: 1200246 - RNA, 20 nt, Mycobacterium bovis subsp bovis AF2122/97
ccgcgaccgcgcacggcugg

SEQ ID NO: 1200247 - RNA, 15 nt, Mycobacterium bovis subsp bovis AF2122/97
ccgccgccgacgaag

SEQ ID NO: 1200248 - RNA, 16 nt, Mycobacterium bovis subsp bovis AF2122/97
ccgccgccccggcgcu

SEQ ID NO: 1200249 - RNA, 17 nt, Mycobacterium bovis subsp bovis AF2122/97
ccgccgccugcccggcc

SEQ ID NO: 1200250 - RNA, 12 nt, Mycobacterium bovis subsp bovis AF2122/97
ccgccgcccccg

SEQ ID NO: 1200251 - RNA, 17 nt, Mycobacterium bovis subsp bovis AF2122/97
ccgccgaugccgccggc

SEQ ID NO: 1200252 - RNA, 22 nt, Mycobacterium bovis subsp bovis AF2122/97
ccgccgcccugguccaggcccu

SEQ ID NO: 1200253 - RNA, 12 nt, Mycobacterium bovis subsp bovis AF2122/97
ccgccgcccgca

SEQ ID NO: 1200254 - RNA, 23 nt, Mycobacterium bovis subsp bovis AF2122/97
ccgccgccccacaacaugcugga

SEQ ID NO: 1200255 - RNA, 14 nt, Mycobacterium bovis subsp bovis AF2122/97
ccgccugcgccgcc

SEQ ID NO: 1200256 - RNA, 15 nt, Mycobacterium bovis subsp bovis AF2122/97
ccgccugcuccugcg

SEQ ID NO: 1200257 - RNA, 15 nt, Mycobacterium bovis subsp bovis AF2122/97
ccgccuggacgccgc

SEQ ID NO: 1200258 - RNA, 22 nt, Mycobacterium bovis subsp bovis AF2122/97
ccgccuggguugaccgccaccc

SEQ ID NO: 1200259 - RNA, 23 nt, Mycobacterium bovis subsp bovis AF2122/97
ccgccuggguugaccgccacccc

SEQ ID NO: 1200260 - RNA, 21 nt, Mycobacterium bovis subsp bovis AF2122/97
ccgccugguguacacacccgc

SEQ ID NO: 1200261 - RNA, 18 nt, Mycobacterium bovis subsp bovis AF2122/97
ccgccugucccgccggcc

SEQ ID NO: 1200262 - RNA, 21 nt, Mycobacterium bovis subsp bovis AF2122/97
ccgccugucccgccggccccg

SEQ ID NO: 1200263 - RNA, 17 nt, Mycobacterium bovis subsp bovis AF2122/97
ccgccugugccgccggc

SEQ ID NO: 1200264 - RNA, 17 nt, Mycobacterium bovis subsp bovis AF2122/97
ccgccuuugcccgccgc

SEQ ID NO: 1200265 - RNA, 11 nt, Mycobacterium bovis subsp bovis AF2122/97
ccggccuucuc

SEQ ID NO: 1200266 - RNA, 15 nt, Mycobacterium bovis subsp bovis AF2122/97
ccggcgaaccccagc

SEQ ID NO: 1200267 - RNA, 19 nt, Mycobacterium bovis subsp bovis AF2122/97
ccggcgaagccggccggga

SEQ ID NO: 1200268 - RNA, 21 nt, Mycobacterium bovis subsp bovis AF2122/97
ccggcgaaaagacugcgccgc

SEQ ID NO: 1200269 - RNA, 17 nt, Mycobacterium bovis subsp bovis AF2122/97
ccggccuuuacccgggc

SEQ ID NO: 1200270 - RNA, 18 nt, Mycobacterium bovis subsp bovis AF2122/97
ccggccuuauucacccgg

SEQ ID NO: 1200271 - RNA, 22 nt, Mycobacterium bovis subsp bovis AF2122/97
ccggccuucaaggaagccgcgg

SEQ ID NO: 1200272 - RNA, 19 nt, Mycobacterium bovis subsp bovis AF2122/97
ccggccuugccgccggcgc

SEQ ID NO: 1200273 - RNA, 23 nt, Mycobacterium bovis subsp bovis AF2122/97
ccggccugcgcgaccgaccagcc

SEQ ID NO: 1200274 - RNA, 15 nt, Mycobacterium bovis subsp bovis AF2122/97
ccggcgagcacccgc

SEQ ID NO: 1200275 - RNA, 22 nt, Mycobacterium bovis subsp bovis AF2122/97
ccggcgagcacccgcuggucga

SEQ ID NO: 1200276 - RNA, 22 nt, Mycobacterium bovis subsp bovis AF2122/97
ccggcgagcccgcaucgcacca

SEQ ID NO: 1200277 - RNA, 19 nt, Mycobacterium bovis subsp bovis AF2122/97
ccggcgagggccacggcug

SEQ ID NO: 1200278 - RNA, 19 nt, Mycobacterium bovis subsp bovis AF2122/97
ccggcgagugcugucgucu

SEQ ID NO: 1200279 - RNA, 23 nt, Mycobacterium bovis subsp bovis AF2122/97
ccggcgacgacccgggucggcac

SEQ ID NO: 1200280 - RNA, 21 nt, Mycobacterium bovis subsp bovis AF2122/97
ccggcgacgaucucgccgcca

SEQ ID NO: 1200281 - RNA, 20 nt, Mycobacterium bovis subsp bovis AF2122/97
ccggcgaccggcgagcccgc

SEQ ID NO: 1200282 - RNA, 18 nt, Mycobacterium bovis subsp bovis AF2122/97
ccggcgaccgggccccca

SEQ ID NO: 1200283 - RNA, 20 nt, Mycobacterium bovis subsp bovis AF2122/97
ccggcgaauacgaccgucgc

SEQ ID NO: 1200284 - RNA, 21 nt, Mycobacterium bovis subsp bovis AF2122/97
ccggccgccaacuccagcacc

SEQ ID NO: 1200285 - RNA, 21 nt, Mycobacterium bovis subsp bovis AF2122/97
ccggccgcacgccggccagcg

SEQ ID NO: 1200286 - RNA, 23 nt, Mycobacterium bovis subsp bovis AF2122/97
ccggccgcacgccgaccagcacc

SEQ ID NO: 1200287 - RNA, 23 nt, Mycobacterium bovis subsp bovis AF2122/97
ccggccgcgcacccguccgccgc

SEQ ID NO: 1200288 - RNA, 16 nt, Mycobacterium bovis subsp bovis AF2122/97
ccggccgagcgcacug

SEQ ID NO: 1200289 - RNA, 14 nt, Mycobacterium bovis subsp bovis AF2122/97
ccggccgccagcgc

SEQ ID NO: 1200290 - RNA, 18 nt, Mycobacterium bovis subsp bovis AF2122/97
ccggccgcggcggccccg

SEQ ID NO: 1200291 - RNA, 14 nt, Mycobacterium bovis subsp bovis AF2122/97
ccggccgcgggcgu

SEQ ID NO: 1200292 - RNA, 16 nt, Mycobacterium bovis subsp bovis AF2122/97
ccggccgcgccggccc

SEQ ID NO: 1200293 - RNA, 17 nt, Mycobacterium bovis subsp bovis AF2122/97
ccggccgcucaccccgc

SEQ ID NO: 1200294 - RNA, 18 nt, Mycobacterium bovis subsp bovis AF2122/97
ccggccggaacgcccggc

SEQ ID NO: 1200295 - RNA, 19 nt, Mycobacterium bovis subsp bovis AF2122/97
ccggccggaacgcccggcu

SEQ ID NO: 1200296 - RNA, 14 nt, Mycobacterium bovis subsp bovis AF2122/97
ccggccggcauccg

SEQ ID NO: 1200297 - RNA, 17 nt, Mycobacterium bovis subsp bovis AF2122/97
ccggccgguuggccagc

SEQ ID NO: 1200298 - RNA, 21 nt, Mycobacterium bovis subsp bovis AF2122/97
ccggccgguuggccagccaca

SEQ ID NO: 1200299 - RNA, 14 nt, Mycobacterium bovis subsp bovis AF2122/97
ccggccggugccag

SEQ ID NO: 1200300 - RNA, 19 nt, Mycobacterium bovis subsp bovis AF2122/97
ccggccgguaguagcugac

SEQ ID NO: 1200301 - RNA, 13 nt, Mycobacterium bovis subsp bovis AF2122/97
ccggccgucggcc

SEQ ID NO: 1200302 - RNA, 14 nt, Mycobacterium bovis subsp bovis AF2122/97
ccggccgucgacgc

SEQ ID NO: 1200303 - RNA, 15 nt, Mycobacterium bovis subsp bovis AF2122/97
ccggccgucgggcag

SEQ ID NO: 1200304 - RNA, 17 nt, Mycobacterium bovis subsp bovis AF2122/97
ccggccguugggccacc

SEQ ID NO: 1200305 - RNA, 18 nt, Mycobacterium bovis subsp bovis AF2122/97
ccggccucaacacccggc

SEQ ID NO: 1200306 - RNA, 15 nt, Mycobacterium bovis subsp bovis AF2122/97
ccggccuaccgagcu

SEQ ID NO: 1200307 - RNA, 14 nt, Mycobacterium bovis subsp bovis AF2122/97
ccggccucgccgaa

SEQ ID NO: 1200308 - RNA, 15 nt, Mycobacterium bovis subsp bovis AF2122/97
ccggccucgccgaag

SEQ ID NO: 1200309 - RNA, 24 nt, Mycobacterium bovis subsp bovis AF2122/97
ccggcgccgccgaugccgaugccc

SEQ ID NO: 1200310 - RNA, 18 nt, Mycobacterium bovis subsp bovis AF2122/97
ccggcgccucaucggaca

SEQ ID NO: 1200311 - RNA, 17 nt, Mycobacterium bovis subsp bovis AF2122/97
ccggcgccggugccgcc

SEQ ID NO: 1200312 - RNA, 12 nt, Mycobacterium bovis subsp bovis AF2122/97
ccggcgccgucg

SEQ ID NO: 1200313 - RNA, 14 nt, Mycobacterium bovis subsp bovis AF2122/97
ccggcgcgaucccc

SEQ ID NO: 1200314 - RNA, 15 nt, Mycobacterium bovis subsp bovis AF2122/97
ccggcgcgcaccccg

SEQ ID NO: 1200315 - RNA, 13 nt, Mycobacterium bovis subsp bovis AF2122/97
ccggcgcgcccca

SEQ ID NO: 1200316 - RNA, 17 nt, Mycobacterium bovis subsp bovis AF2122/97
ccggcgcgccccaccgc

SEQ ID NO: 1200317 - RNA, 19 nt, Mycobacterium bovis subsp bovis AF2122/97
ccggcgcgccccaccgcgc

SEQ ID NO: 1200318 - RNA, 21 nt, Mycobacterium bovis subsp bovis AF2122/97
ccggcgcgccccaccgcgccg

SEQ ID NO: 1200319 - RNA, 17 nt, Mycobacterium bovis subsp bovis AF2122/97
ccggcgcggagugccca

SEQ ID NO: 1200320 - RNA, 22 nt, Mycobacterium bovis subsp bovis AF2122/97
ccggcgcggagugcccagggcc

SEQ ID NO: 1200321 - RNA, 19 nt, Mycobacterium bovis subsp bovis AF2122/97
ccggcgcuagcgccgcgcu

SEQ ID NO: 1200322 - RNA, 14 nt, Mycobacterium bovis subsp bovis AF2122/97
ccggcgcucgcggc

SEQ ID NO: 1200323 - RNA, 19 nt, Mycobacterium bovis subsp bovis AF2122/97
ccggcgcuccacugaccag

SEQ ID NO: 1200324 - RNA, 22 nt, Mycobacterium bovis subsp bovis AF2122/97
ccggcgcuccacugaccagguc

SEQ ID NO: 1200325 - RNA, 20 nt, Mycobacterium bovis subsp bovis AF2122/97
ccggcgcugcccgggcugcc

SEQ ID NO: 1200326 - RNA, 14 nt, Mycobacterium bovis subsp bovis AF2122/97
ccggcgcgcagccg

SEQ ID NO: 1200327 - RNA, 13 nt, Mycobacterium bovis subsp bovis AF2122/97
ccggcgcggccgc

SEQ ID NO: 1200328 - RNA, 17 nt, Mycobacterium bovis subsp bovis AF2122/97
ccggcgcggccggccgc

SEQ ID NO: 1200329 - RNA, 17 nt, Mycobacterium bovis subsp bovis AF2122/97
ccggcgccagcgccgcc

SEQ ID NO: 1200330 - RNA, 18 nt, Mycobacterium bovis subsp bovis AF2122/97
ccggcgccagcgccgcca

SEQ ID NO: 1200331 - RNA, 19 nt, Mycobacterium bovis subsp bovis AF2122/97
ccggcgccagcgccgccac

SEQ ID NO: 1200332 - RNA, 21 nt, Mycobacterium bovis subsp bovis AF2122/97
ccggcgccagcgccgccaccg

SEQ ID NO: 1200333 - RNA, 20 nt, Mycobacterium bovis subsp bovis AF2122/97
ccggcgccaccggcgccgcc

SEQ ID NO: 1200334 - RNA, 22 nt, Mycobacterium bovis subsp bovis AF2122/97
ccggcgccaccggcgccgcccg

SEQ ID NO: 1200335 - RNA, 13 nt, Mycobacterium bovis subsp bovis AF2122/97
ccggcgccacccc

SEQ ID NO: 1200336 - RNA, 13 nt, Mycobacterium bovis subsp bovis AF2122/97
ccggcgcccaggc

SEQ ID NO: 1200337 - RNA, 13 nt, Mycobacterium bovis subsp bovis AF2122/97
ccggcgccaucgg

SEQ ID NO: 1200338 - RNA, 20 nt, Mycobacterium bovis subsp bovis AF2122/97
ccggcgccauucgccccacc

SEQ ID NO: 1200339 - RNA, 15 nt, Mycobacterium bovis subsp bovis AF2122/97
ccggcgcccaggccg

SEQ ID NO: 1200340 - RNA, 17 nt, Mycobacterium bovis subsp bovis AF2122/97
ccggcgccgcaccaagc

SEQ ID NO: 1200341 - RNA, 16 nt, Mycobacterium bovis subsp bovis AF2122/97
ccggcgccgccacugc

SEQ ID NO: 1200342 - RNA, 14 nt, Mycobacterium bovis subsp bovis AF2122/97
ccggcgccgccagc

SEQ ID NO: 1200343 - RNA, 17 nt, Mycobacterium bovis subsp bovis AF2122/97
ccggcgccgccagcacc

SEQ ID NO: 1200344 - RNA, 12 nt, Mycobacterium bovis subsp bovis AF2122/97
ccggcgccgccc

SEQ ID NO: 1200345 - RNA, 15 nt, Mycobacterium bovis subsp bovis AF2122/97
ccggcgccgccgucg

SEQ ID NO: 1200346 - RNA, 17 nt, Mycobacterium bovis subsp bovis AF2122/97
ccggcgccgcccuugcc

SEQ ID NO: 1200347 - RNA, 21 nt, Mycobacterium bovis subsp bovis AF2122/97
ccggcgcaguagccgaccagg

SEQ ID NO: 1200348 - RNA, 22 nt, Mycobacterium bovis subsp bovis AF2122/97
ccggcgcaguagccgaccagga

SEQ ID NO: 1200349 - RNA, 19 nt, Mycobacterium bovis subsp bovis AF2122/97
ccggcgcauaccggcgucg

SEQ ID NO: 1200350 - RNA, 22 nt, Mycobacterium bovis subsp bovis AF2122/97
ccggcgcagguucucggugccg

SEQ ID NO: 1200351 - RNA, 14 nt, Mycobacterium bovis subsp bovis AF2122/97
ccggcgccacccgc

SEQ ID NO: 1200352 - RNA, 16 nt, Mycobacterium bovis subsp bovis AF2122/97
ccggcgccaccgccgc

SEQ ID NO: 1200353 - RNA, 19 nt, Mycobacterium bovis subsp bovis AF2122/97
ccggcgccaccggcgccgc

SEQ ID NO: 1200354 - RNA, 17 nt, Mycobacterium bovis subsp bovis AF2122/97
ccggcgcaccugggcug

SEQ ID NO: 1200355 - RNA, 19 nt, Mycobacterium bovis subsp bovis AF2122/97
ccggcgcaagcgccgcgcu

SEQ ID NO: 1200356 - RNA, 20 nt, Mycobacterium bovis subsp bovis AF2122/97
ccggcgauuaccggcacgcc

SEQ ID NO: 1200357 - RNA, 22 nt, Mycobacterium bovis subsp bovis AF2122/97
ccggauuucgucgggcaccgcc

SEQ ID NO: 1200358 - RNA, 20 nt, Mycobacterium bovis subsp bovis AF2122/97
ccggcaaacgauauccgaac

SEQ ID NO: 1200359 - RNA, 19 nt, Mycobacterium bovis subsp bovis AF2122/97
ccggcaacaucagcaggac

SEQ ID NO: 1200360 - RNA, 14 nt, Mycobacterium bovis subsp bovis AF2122/97
ccggcaaacuccag

SEQ ID NO: 1200361 - RNA, 16 nt, Mycobacterium bovis subsp bovis AF2122/97
ccggcaaugccacggu

SEQ ID NO: 1200362 - RNA, 15 nt, Mycobacterium bovis subsp bovis AF2122/97
ccggcaccaaccacc

SEQ ID NO: 1200363 - RNA, 13 nt, Mycobacterium bovis subsp bovis AF2122/97
ccggcaccacgau

SEQ ID NO: 1200364 - RNA, 15 nt, Mycobacterium bovis subsp bovis AF2122/97
ccggcaaugccgcgg

SEQ ID NO: 1200365 - RNA, 14 nt, Mycobacterium bovis subsp bovis AF2122/97
ccggcacacccucc

SEQ ID NO: 1200366 - RNA, 15 nt, Mycobacterium bovis subsp bovis AF2122/97
ccggcauacagccgg

SEQ ID NO: 1200367 - RNA, 13 nt, Mycobacterium bovis subsp bovis AF2122/97
ccggcaccagcgg

SEQ ID NO: 1200368 - RNA, 14 nt, Mycobacterium bovis subsp bovis AF2122/97
ccggcaccagcggc

SEQ ID NO: 1200369 - RNA, 19 nt, Mycobacterium bovis subsp bovis AF2122/97
ccggcaccagcggcaccgc

SEQ ID NO: 1200370 - RNA, 17 nt, Mycobacterium bovis subsp bovis AF2122/97
ccggcagguccaucugg

SEQ ID NO: 1200371 - RNA, 13 nt, Mycobacterium bovis subsp bovis AF2122/97
ccggcacccacca

SEQ ID NO: 1200372 - RNA, 15 nt, Mycobacterium bovis subsp bovis AF2122/97
ccggcaccccuuuga

SEQ ID NO: 1200373 - RNA, 17 nt, Mycobacterium bovis subsp bovis AF2122/97
ccggcauaccgaacagc

SEQ ID NO: 1200374 - RNA, 23 nt, Mycobacterium bovis subsp bovis AF2122/97
ccggcauacucuuugugcccaau

SEQ ID NO: 1200375 - RNA, 21 nt, Mycobacterium bovis subsp bovis AF2122/97
ccggcaucgucgacgcccgau

SEQ ID NO: 1200376 - RNA, 15 nt, Mycobacterium bovis subsp bovis AF2122/97
ccggccacgaccucg

SEQ ID NO: 1200377 - RNA, 20 nt, Mycobacterium bovis subsp bovis AF2122/97
ccggcccguagcugcgcagc

SEQ ID NO: 1200378 - RNA, 14 nt, Mycobacterium bovis subsp bovis AF2122/97
ccggccgagccguu

SEQ ID NO: 1200379 - RNA, 16 nt, Mycobacterium bovis subsp bovis AF2122/97
ccggcccugcucggcc

SEQ ID NO: 1200380 - RNA, 23 nt, Mycobacterium bovis subsp bovis AF2122/97
ccggcccugagcugccgagcggu

SEQ ID NO: 1200381 - RNA, 19 nt, Mycobacterium bovis subsp bovis AF2122/97
ccggcccugccgccggccc

SEQ ID NO: 1200382 - RNA, 16 nt, Mycobacterium bovis subsp bovis AF2122/97
ccggccccgccggcgc

SEQ ID NO: 1200383 - RNA, 18 nt, Mycobacterium bovis subsp bovis AF2122/97
ccggcccccgacuccggc

SEQ ID NO: 1200384 - RNA, 21 nt, Mycobacterium bovis subsp bovis AF2122/97
ccggcccaaggaacggcgucg

SEQ ID NO: 1200385 - RNA, 14 nt, Mycobacterium bovis subsp bovis AF2122/97
ccggccccaccggc

SEQ ID NO: 1200386 - RNA, 14 nt, Mycobacterium bovis subsp bovis AF2122/97
ccggccccaccggu

SEQ ID NO: 1200387 - RNA, 13 nt, Mycobacterium bovis subsp bovis AF2122/97
ccggcccgccacc

SEQ ID NO: 1200388 - RNA, 14 nt, Mycobacterium bovis subsp bovis AF2122/97
ccggccccgcccgc

SEQ ID NO: 1200389 - RNA, 17 nt, Mycobacterium bovis subsp bovis AF2122/97
ccggccccgcggccagc

SEQ ID NO: 1200390 - RNA, 22 nt, Mycobacterium bovis subsp bovis AF2122/97
ccggccagacccuggccguccc

SEQ ID NO: 1200391 - RNA, 17 nt, Mycobacterium bovis subsp bovis AF2122/97
ccggccacuacggccug

SEQ ID NO: 1200392 - RNA, 18 nt, Mycobacterium bovis subsp bovis AF2122/97
ccggccacgguccggccc

SEQ ID NO: 1200393 - RNA, 22 nt, Mycobacterium bovis subsp bovis AF2122/97
ccggccacgucgaugugcgccc

SEQ ID NO: 1200394 - RNA, 16 nt, Mycobacterium bovis subsp bovis AF2122/97
ccggccacuccaguac

SEQ ID NO: 1200395 - RNA, 20 nt, Mycobacterium bovis subsp bovis AF2122/97
ccggccagccgacgcggcgg

SEQ ID NO: 1200396 - RNA, 11 nt, Mycobacterium bovis subsp bovis AF2122/97
ccggccagccu

SEQ ID NO: 1200397 - RNA, 13 nt, Mycobacterium bovis subsp bovis AF2122/97
ccggccagccuca

SEQ ID NO: 1200398 - RNA, 13 nt, Mycobacterium bovis subsp bovis AF2122/97
ccggcccaccagc

SEQ ID NO: 1200399 - RNA, 18 nt, Mycobacterium bovis subsp bovis AF2122/97
ccggcccaccagcgcagc

SEQ ID NO: 1200400 - RNA, 15 nt, Mycobacterium bovis subsp bovis AF2122/97
ccggaucccaccacc

SEQ ID NO: 1200401 - RNA, 16 nt, Mycobacterium bovis subsp bovis AF2122/97
ccggaucccagugcca

SEQ ID NO: 1200402 - RNA, 17 nt, Mycobacterium bovis subsp bovis AF2122/97
ccggaucaucgccgcgg

SEQ ID NO: 1200403 - RNA, 15 nt, Mycobacterium bovis subsp bovis AF2122/97
ccggaguucucgcug

SEQ ID NO: 1200404 - RNA, 15 nt, Mycobacterium bovis subsp bovis AF2122/97
ccggaguugaagaag

SEQ ID NO: 1200405 - RNA, 15 nt, Mycobacterium bovis subsp bovis AF2122/97
ccggauaggucgggc

SEQ ID NO: 1200406 - RNA, 15 nt, Mycobacterium bovis subsp bovis AF2122/97
ccggaggugcgccgc

SEQ ID NO: 1200407 - RNA, 16 nt, Mycobacterium bovis subsp bovis AF2122/97
ccggaucugacggcgc

SEQ ID NO: 1200408 - RNA, 19 nt, Mycobacterium bovis subsp bovis AF2122/97
ccggaucgucgaacagcac

SEQ ID NO: 1200409 - RNA, 23 nt, Mycobacterium bovis subsp bovis AF2122/97
ccggaucgucgaacagcaccgcc

SEQ ID NO: 1200410 - RNA, 14 nt, Mycobacterium bovis subsp bovis AF2122/97
ccggaucgccacgg

SEQ ID NO: 1200411 - RNA, 21 nt, Mycobacterium bovis subsp bovis AF2122/97
ccggaucccugugccagcagc

SEQ ID NO: 1200412 - RNA, 17 nt, Mycobacterium bovis subsp bovis AF2122/97
ccggaucggcuaccuaa

SEQ ID NO: 1200413 - RNA, 17 nt, Mycobacterium bovis subsp bovis AF2122/97
ccggaucgcucccgucu

SEQ ID NO: 1200414 - RNA, 17 nt, Mycobacterium bovis subsp bovis AF2122/97
ccggaugcugucagcag

SEQ ID NO: 1200415 - RNA, 19 nt, Mycobacterium bovis subsp bovis AF2122/97
ccggaugcugucagcagcc

SEQ ID NO: 1200416 - RNA, 17 nt, Mycobacterium bovis subsp bovis AF2122/97
ccggauguauuccaggc

SEQ ID NO: 1200417 - RNA, 19 nt, Mycobacterium bovis subsp bovis AF2122/97
ccggauguauuccaggcgu

SEQ ID NO: 1200418 - RNA, 22 nt, Mycobacterium bovis subsp bovis AF2122/97
ccggaugucgacgagcaccgcg

SEQ ID NO: 1200419 - RNA, 18 nt, Mycobacterium bovis subsp bovis AF2122/97
ccggauucgcccgggcgu

SEQ ID NO: 1200420 - RNA, 15 nt, Mycobacterium bovis subsp bovis AF2122/97
ccggauugagcacgc

SEQ ID NO: 1200421 - RNA, 19 nt, Mycobacterium bovis subsp bovis AF2122/97
ccggagcuuguugcagcgg

SEQ ID NO: 1200422 - RNA, 15 nt, Mycobacterium bovis subsp bovis AF2122/97
ccggagcggucagcg

SEQ ID NO: 1200423 - RNA, 16 nt, Mycobacterium bovis subsp bovis AF2122/97
ccggagcggucagcgg

SEQ ID NO: 1200424 - RNA, 21 nt, Mycobacterium bovis subsp bovis AF2122/97
ccggaggcaauccgaucugga

SEQ ID NO: 1200425 - RNA, 13 nt, Mycobacterium bovis subsp bovis AF2122/97
ccggagucggcgu

SEQ ID NO: 1200426 - RNA, 14 nt, Mycobacterium bovis subsp bovis AF2122/97
ccggacgaccggaa

SEQ ID NO: 1200427 - RNA, 22 nt, Mycobacterium bovis subsp bovis AF2122/97
ccggacgcacgauccgcacccg

SEQ ID NO: 1200428 - RNA, 21 nt, Mycobacterium bovis subsp bovis AF2122/97
ccggagauguaguccucggug

SEQ ID NO: 1200429 - RNA, 19 nt, Mycobacterium bovis subsp bovis AF2122/97
ccggacgcugauugcgacc

SEQ ID NO: 1200430 - RNA, 22 nt, Mycobacterium bovis subsp bovis AF2122/97
ccggaccacuguuggugccgcc

SEQ ID NO: 1200431 - RNA, 13 nt, Mycobacterium bovis subsp bovis AF2122/97
ccggaccaucagc

SEQ ID NO: 1200432 - RNA, 20 nt, Mycobacterium bovis subsp bovis AF2122/97
ccggaccaucgacaacgccu

SEQ ID NO: 1200433 - RNA, 21 nt, Mycobacterium bovis subsp bovis AF2122/97
ccggacccaccaauccacaga

SEQ ID NO: 1200434 - RNA, 21 nt, Mycobacterium bovis subsp bovis AF2122/97
ccggaccgaagaccuccucgg

SEQ ID NO: 1200435 - RNA, 15 nt, Mycobacterium bovis subsp bovis AF2122/97
ccgcuugccccgccu

SEQ ID NO: 1200436 - RNA, 20 nt, Mycobacterium bovis subsp bovis AF2122/97
ccgcuugccggacaacugga

SEQ ID NO: 1200437 - RNA, 13 nt, Mycobacterium bovis subsp bovis AF2122/97
ccgcuugcggggc

SEQ ID NO: 1200438 - RNA, 16 nt, Mycobacterium bovis subsp bovis AF2122/97
ccguuggcucgagccg

SEQ ID NO: 1200439 - RNA, 22 nt, Mycobacterium bovis subsp bovis AF2122/97
ccguuggcggcgguggccagcg

SEQ ID NO: 1200440 - RNA, 20 nt, Mycobacterium bovis subsp bovis AF2122/97
ccguuggugccgccugugcc

SEQ ID NO: 1200441 - RNA, 17 nt, Mycobacterium bovis subsp bovis AF2122/97
ccguugucgaccuccuc

SEQ ID NO: 1200442 - RNA, 18 nt, Mycobacterium bovis subsp bovis AF2122/97
ccguuguggaccaucuuc

SEQ ID NO: 1200443 - RNA, 20 nt, Mycobacterium bovis subsp bovis AF2122/97
ccguugacgccguugccacc

SEQ ID NO: 1200444 - RNA, 18 nt, Mycobacterium bovis subsp bovis AF2122/97
ccguugagcauaugacgu

SEQ ID NO: 1200445 - RNA, 19 nt, Mycobacterium bovis subsp bovis AF2122/97
ccguugaguguguuugagu

SEQ ID NO: 1200446 - RNA, 21 nt, Mycobacterium bovis subsp bovis AF2122/97
ccguuggcgacguuggcggga

SEQ ID NO: 1200447 - RNA, 20 nt, Mycobacterium bovis subsp bovis AF2122/97
ccguucuucgcgauguccuc

SEQ ID NO: 1200448 - RNA, 20 nt, Mycobacterium bovis subsp bovis AF2122/97
ccguucugucccggcgcgcc

SEQ ID NO: 1200449 - RNA, 19 nt, Mycobacterium bovis subsp bovis AF2122/97
ccguuguucuugucggagc

SEQ ID NO: 1200450 - RNA, 18 nt, Mycobacterium bovis subsp bovis AF2122/97
ccuaaaccagccaccacc

SEQ ID NO: 1200451 - RNA, 15 nt, Mycobacterium bovis subsp bovis AF2122/97
ccuaaggcucaccag

SEQ ID NO: 1200452 - RNA, 19 nt, Mycobacterium bovis subsp bovis AF2122/97
ccguggccugaaacggcug

SEQ ID NO: 1200453 - RNA, 11 nt, Mycobacterium bovis subsp bovis AF2122/97
ccguggcccaa

SEQ ID NO: 1200454 - RNA, 13 nt, Mycobacterium bovis subsp bovis AF2122/97
ccguggcgcccgc

SEQ ID NO: 1200455 - RNA, 19 nt, Mycobacterium bovis subsp bovis AF2122/97
ccguggcgccggucgccgg

SEQ ID NO: 1200456 - RNA, 14 nt, Mycobacterium bovis subsp bovis AF2122/97
ccgugggccugccc

SEQ ID NO: 1200457 - RNA, 17 nt, Mycobacterium bovis subsp bovis AF2122/97
ccguggguagcgaagaa

SEQ ID NO: 1200458 - RNA, 15 nt, Mycobacterium bovis subsp bovis AF2122/97
ccguucugcccaggc

SEQ ID NO: 1200459 - RNA, 16 nt, Mycobacterium bovis subsp bovis AF2122/97
ccguucugcccaggca

SEQ ID NO: 1200460 - RNA, 16 nt, Mycobacterium bovis subsp bovis AF2122/97
ccguucuggaaccccg

SEQ ID NO: 1200461 - RNA, 16 nt, Mycobacterium bovis subsp bovis AF2122/97
ccguucggcuaagccu

SEQ ID NO: 1200462 - RNA, 14 nt, Mycobacterium bovis subsp bovis AF2122/97
ccguucggggcgcg

SEQ ID NO: 1200463 - RNA, 18 nt, Mycobacterium bovis subsp bovis AF2122/97
ccguucggcgcccgcucg

SEQ ID NO: 1200464 - RNA, 19 nt, Mycobacterium bovis subsp bovis AF2122/97
ccguucgugagcggccagg

SEQ ID NO: 1200465 - RNA, 16 nt, Mycobacterium bovis subsp bovis AF2122/97
ccguucgcucccccgc

SEQ ID NO: 1200466 - RNA, 13 nt, Mycobacterium bovis subsp bovis AF2122/97
ccguuaccgccaa

SEQ ID NO: 1200467 - RNA, 15 nt, Mycobacterium bovis subsp bovis AF2122/97
ccguuaccgccgcug

SEQ ID NO: 1200468 - RNA, 16 nt, Mycobacterium bovis subsp bovis AF2122/97
ccguuaccgccgucgc

SEQ ID NO: 1200469 - RNA, 22 nt, Mycobacterium bovis subsp bovis AF2122/97
ccguuagcuuagcugccgucgg

SEQ ID NO: 1200470 - RNA, 19 nt, Mycobacterium bovis subsp bovis AF2122/97
ccguccgguggaccgccga

SEQ ID NO: 1200471 - RNA, 22 nt, Mycobacterium bovis subsp bovis AF2122/97
ccguccgggcggccucccgggc

SEQ ID NO: 1200472 - RNA, 14 nt, Mycobacterium bovis subsp bovis AF2122/97
ccguccggggccgc

SEQ ID NO: 1200473 - RNA, 14 nt, Mycobacterium bovis subsp bovis AF2122/97
ccguccgucggcgc

SEQ ID NO: 1200474 - RNA, 22 nt, Mycobacterium bovis subsp bovis AF2122/97
ccgucgauuucgacgaccaccu

SEQ ID NO: 1200475 - RNA, 19 nt, Mycobacterium bovis subsp bovis AF2122/97
ccgucgauguggcgcuccg

SEQ ID NO: 1200476 - RNA, 16 nt, Mycobacterium bovis subsp bovis AF2122/97
ccguccucggucagcu

SEQ ID NO: 1200477 - RNA, 22 nt, Mycobacterium bovis subsp bovis AF2122/97
ccguccucggucagcucgucgg

SEQ ID NO: 1200478 - RNA, 12 nt, Mycobacterium bovis subsp bovis AF2122/97
ccgucgccgcca

SEQ ID NO: 1200479 - RNA, 18 nt, Mycobacterium bovis subsp bovis AF2122/97
ccgucgccgaacagugcg

SEQ ID NO: 1200480 - RNA, 16 nt, Mycobacterium bovis subsp bovis AF2122/97
ccgucgccgcccuggc

SEQ ID NO: 1200481 - RNA, 17 nt, Mycobacterium bovis subsp bovis AF2122/97
ccgucgccgcccuggcc

SEQ ID NO: 1200482 - RNA, 18 nt, Mycobacterium bovis subsp bovis AF2122/97
ccgucgccgcccuggccg

SEQ ID NO: 1200483 - RNA, 12 nt, Mycobacterium bovis subsp bovis AF2122/97
ccgucgccgccg

SEQ ID NO: 1200484 - RNA, 18 nt, Mycobacterium bovis subsp bovis AF2122/97
ccgucgccgcccgugccg

SEQ ID NO: 1200485 - RNA, 23 nt, Mycobacterium bovis subsp bovis AF2122/97
ccgucgccgccggcuccggcggu

SEQ ID NO: 1200486 - RNA, 17 nt, Mycobacterium bovis subsp bovis AF2122/97
ccgucgccaaucugcgc

SEQ ID NO: 1200487 - RNA, 22 nt, Mycobacterium bovis subsp bovis AF2122/97
ccgucgcccuuagggucgccgc

SEQ ID NO: 1200488 - RNA, 19 nt, Mycobacterium bovis subsp bovis AF2122/97
ccgugcaccagcgaccagg

SEQ ID NO: 1200489 - RNA, 23 nt, Mycobacterium bovis subsp bovis AF2122/97
ccgugcagggcauugcggcccgc

SEQ ID NO: 1200490 - RNA, 20 nt, Mycobacterium bovis subsp bovis AF2122/97
ccgucgccggauagcgcagc

SEQ ID NO: 1200491 - RNA, 15 nt, Mycobacterium bovis subsp bovis AF2122/97
ccgucgccugccgac

SEQ ID NO: 1200492 - RNA, 19 nt, Mycobacterium bovis subsp bovis AF2122/97
ccgucgccugccgacgagg

SEQ ID NO: 1200493 - RNA, 15 nt, Mycobacterium bovis subsp bovis AF2122/97
ccgucgcgacgucgg

SEQ ID NO: 1200494 - RNA, 17 nt, Mycobacterium bovis subsp bovis AF2122/97
ccucacccacccgcggu

SEQ ID NO: 1200495 - RNA, 13 nt, Mycobacterium bovis subsp bovis AF2122/97
ccucacccagcug

SEQ ID NO: 1200496 - RNA, 19 nt, Mycobacterium bovis subsp bovis AF2122/97
ccucaccgacgucgccaag

SEQ ID NO: 1200497 - RNA, 14 nt, Mycobacterium bovis subsp bovis AF2122/97
ccucaccaggucuu

SEQ ID NO: 1200498 - RNA, 22 nt, Mycobacterium bovis subsp bovis AF2122/97
ccucaccaggucuucgaccacg

SEQ ID NO: 1200499 - RNA, 13 nt, Mycobacterium bovis subsp bovis AF2122/97
ccucaccagucag

SEQ ID NO: 1200500 - RNA, 20 nt, Mycobacterium bovis subsp bovis AF2122/97
ccucaaggucggccaggcug

SEQ ID NO: 1200501 - RNA, 20 nt, Mycobacterium bovis subsp bovis AF2122/97
ccucaaggagcccguccagg

SEQ ID NO: 1200502 - RNA, 14 nt, Mycobacterium bovis subsp bovis AF2122/97
ccucacgggcgccg

SEQ ID NO: 1200503 - RNA, 15 nt, Mycobacterium bovis subsp bovis AF2122/97
ccucacugcggcgcc

SEQ ID NO: 1200504 - RNA, 15 nt, Mycobacterium bovis subsp bovis AF2122/97
ccucaacgucccagc

SEQ ID NO: 1200505 - RNA, 11 nt, Mycobacterium bovis subsp bovis AF2122/97
ccucaaagccu

SEQ ID NO: 1200506 - RNA, 13 nt, Mycobacterium bovis subsp bovis AF2122/97
ccucaaagccucg

SEQ ID NO: 1200507 - RNA, 13 nt, Mycobacterium bovis subsp bovis AF2122/97
ccucaacaccagg

SEQ ID NO: 1200508 - RNA, 15 nt, Mycobacterium bovis subsp bovis AF2122/97
ccucaacaccaggcc

SEQ ID NO: 1200509 - RNA, 16 nt, Mycobacterium bovis subsp bovis AF2122/97
ccucaacaccaggccg

SEQ ID NO: 1200510 - RNA, 22 nt, Mycobacterium bovis subsp bovis AF2122/97
ccuaugcugcccggcaaccugg

SEQ ID NO: 1200511 - RNA, 17 nt, Mycobacterium bovis subsp bovis AF2122/97
ccuagggcggcggcgcg

SEQ ID NO: 1200512 - RNA, 22 nt, Mycobacterium bovis subsp bovis AF2122/97
ccuagguagucggccuccucgu

SEQ ID NO: 1200513 - RNA, 20 nt, Mycobacterium bovis subsp bovis AF2122/97
ccuaguccggcacugcggcc

SEQ ID NO: 1200514 - RNA, 21 nt, Mycobacterium bovis subsp bovis AF2122/97
ccuaguccggcacugcggcca

SEQ ID NO: 1200515 - RNA, 17 nt, Mycobacterium bovis subsp bovis AF2122/97
ccuaugauucagccggc

SEQ ID NO: 1200516 - RNA, 18 nt, Mycobacterium bovis subsp bovis AF2122/97
ccuaugauucagccggcu

SEQ ID NO: 1200517 - RNA, 19 nt, Mycobacterium bovis subsp bovis AF2122/97
ccuaucagugagccgccau

SEQ ID NO: 1200518 - RNA, 20 nt, Mycobacterium bovis subsp bovis AF2122/97
ccuauccaaagaccccuacc

SEQ ID NO: 1200519 - RNA, 16 nt, Mycobacterium bovis subsp bovis AF2122/97
ccuaucccgaaucuca

SEQ ID NO: 1200520 - RNA, 13 nt, Mycobacterium bovis subsp bovis AF2122/97
ccuauccgggccc

SEQ ID NO: 1200521 - RNA, 16 nt, Mycobacterium bovis subsp bovis AF2122/97
ccuaucgacaacaugc

SEQ ID NO: 1200522 - RNA, 17 nt, Mycobacterium bovis subsp bovis AF2122/97
ccuaucagugagccgcc

SEQ ID NO: 1200523 - RNA, 18 nt, Mycobacterium bovis subsp bovis AF2122/97
ccuacaccggcgcucaau

SEQ ID NO: 1200524 - RNA, 19 nt, Mycobacterium bovis subsp bovis AF2122/97
ccuacugcggucgcccagg

SEQ ID NO: 1200525 - RNA, 17 nt, Mycobacterium bovis subsp bovis AF2122/97
ccuagcgagcggcacca

SEQ ID NO: 1200526 - RNA, 21 nt, Mycobacterium bovis subsp bovis AF2122/97
ccuagcagggugccggcgccg

SEQ ID NO: 1200527 - RNA, 23 nt, Mycobacterium bovis subsp bovis AF2122/97
ccuagcagggugccggcgccgcc

SEQ ID NO: 1200528 - RNA, 11 nt, Mycobacterium bovis subsp bovis AF2122/97
ccuagcgcggc

SEQ ID NO: 1200529 - RNA, 13 nt, Mycobacterium bovis subsp bovis AF2122/97
ccuagccgcagcc

SEQ ID NO: 1200530 - RNA, 14 nt, Mycobacterium bovis subsp bovis AF2122/97
ccuagccgcggcac

SEQ ID NO: 1200531 - RNA, 16 nt, Mycobacterium bovis subsp bovis AF2122/97
ccuagccggcgcgccc

SEQ ID NO: 1200532 - RNA, 18 nt, Mycobacterium bovis subsp bovis AF2122/97
ccuagccggcgcgcccca

SEQ ID NO: 1200533 - RNA, 22 nt, Mycobacterium bovis subsp bovis AF2122/97
ccuagauccaaacacccuugcc

SEQ ID NO: 1200534 - RNA, 18 nt, Mycobacterium bovis subsp bovis AF2122/97
ccgggccuugcgcgcgca

SEQ ID NO: 1200535 - RNA, 14 nt, Mycobacterium bovis subsp bovis AF2122/97
ccgggccgccgcga

SEQ ID NO: 1200536 - RNA, 16 nt, Mycobacterium bovis subsp bovis AF2122/97
ccgggccguacggcgc

SEQ ID NO: 1200537 - RNA, 16 nt, Mycobacterium bovis subsp bovis AF2122/97
ccgggcgagucccggc

SEQ ID NO: 1200538 - RNA, 17 nt, Mycobacterium bovis subsp bovis AF2122/97
ccgggcgcaagcagccc

SEQ ID NO: 1200539 - RNA, 23 nt, Mycobacterium bovis subsp bovis AF2122/97
ccgggcgauucgcaaucagcugg

SEQ ID NO: 1200540 - RNA, 22 nt, Mycobacterium bovis subsp bovis AF2122/97
ccgggcgaucaaagccagcacc

SEQ ID NO: 1200541 - RNA, 24 nt, Mycobacterium bovis subsp bovis AF2122/97
ccgggggacgauuccgcccacaug

SEQ ID NO: 1200542 - RNA, 12 nt, Mycobacterium bovis subsp bovis AF2122/97
ccgggggaacgg

SEQ ID NO: 1200543 - RNA, 14 nt, Mycobacterium bovis subsp bovis AF2122/97
ccggggcugcccgc

SEQ ID NO: 1200544 - RNA, 15 nt, Mycobacterium bovis subsp bovis AF2122/97
ccggggucggcccgc

SEQ ID NO: 1200545 - RNA, 18 nt, Mycobacterium bovis subsp bovis AF2122/97
ccgggguauucccgcaga

SEQ ID NO: 1200546 - RNA, 19 nt, Mycobacterium bovis subsp bovis AF2122/97
ccggggugcugacauaggu

SEQ ID NO: 1200547 - RNA, 13 nt, Mycobacterium bovis subsp bovis AF2122/97
ccggggggcugcu

SEQ ID NO: 1200548 - RNA, 15 nt, Mycobacterium bovis subsp bovis AF2122/97
ccgggguaucgaccc

SEQ ID NO: 1200549 - RNA, 18 nt, Mycobacterium bovis subsp bovis AF2122/97
ccgggcaccggccggugg

SEQ ID NO: 1200550 - RNA, 23 nt, Mycobacterium bovis subsp bovis AF2122/97
ccgggcaccacuuggguggcgcc

SEQ ID NO: 1200551 - RNA, 14 nt, Mycobacterium bovis subsp bovis AF2122/97
ccgggcagccgcgc

SEQ ID NO: 1200552 - RNA, 20 nt, Mycobacterium bovis subsp bovis AF2122/97
ccgggcagcaucaacaccgg

SEQ ID NO: 1200553 - RNA, 17 nt, Mycobacterium bovis subsp bovis AF2122/97
ccgggcagccgcgccgc

SEQ ID NO: 1200554 - RNA, 12 nt, Mycobacterium bovis subsp bovis AF2122/97
ccgggccgcgcg

SEQ ID NO: 1200555 - RNA, 15 nt, Mycobacterium bovis subsp bovis AF2122/97
ccgggccgcggcggc

SEQ ID NO: 1200556 - RNA, 21 nt, Mycobacterium bovis subsp bovis AF2122/97
ccgggccgccagggcccuagc

SEQ ID NO: 1200557 - RNA, 21 nt, Mycobacterium bovis subsp bovis AF2122/97
ccgggaucggcuccgccgcgg

SEQ ID NO: 1200558 - RNA, 20 nt, Mycobacterium bovis subsp bovis AF2122/97
ccgggaucucgaaggccgcc

SEQ ID NO: 1200559 - RNA, 18 nt, Mycobacterium bovis subsp bovis AF2122/97
ccgggaucugggucugug

SEQ ID NO: 1200560 - RNA, 23 nt, Mycobacterium bovis subsp bovis AF2122/97
ccgggaugggagccacugcggca

SEQ ID NO: 1200561 - RNA, 17 nt, Mycobacterium bovis subsp bovis AF2122/97
ccggcggacgacgucgg

SEQ ID NO: 1200562 - RNA, 19 nt, Mycobacterium bovis subsp bovis AF2122/97
ccggcggagcgggccagca

SEQ ID NO: 1200563 - RNA, 17 nt, Mycobacterium bovis subsp bovis AF2122/97
ccggcggacaccucggg

SEQ ID NO: 1200564 - RNA, 19 nt, Mycobacterium bovis subsp bovis AF2122/97
ccgggcaaaucaagcacag

SEQ ID NO: 1200565 - RNA, 21 nt, Mycobacterium bovis subsp bovis AF2122/97
ccgggcaaaucaagcacagcc

SEQ ID NO: 1200566 - RNA, 20 nt, Mycobacterium bovis subsp bovis AF2122/97
ccgggcaacgcgaaccggcc

SEQ ID NO: 1200567 - RNA, 15 nt, Mycobacterium bovis subsp bovis AF2122/97
ccgggcaaggcccgg

SEQ ID NO: 1200568 - RNA, 24 nt, Mycobacterium bovis subsp bovis AF2122/97
ccgggcaacgcgaaccggccaucg

SEQ ID NO: 1200569 - RNA, 14 nt, Mycobacterium bovis subsp bovis AF2122/97
ccgggcaaggccac

SEQ ID NO: 1200570 - RNA, 17 nt, Mycobacterium bovis subsp bovis AF2122/97
ccgggauugccgccacc

SEQ ID NO: 1200571 - RNA, 16 nt, Mycobacterium bovis subsp bovis AF2122/97
ccgggcaaaucaagca

SEQ ID NO: 1200572 - RNA, 17 nt, Mycobacterium bovis subsp bovis AF2122/97
ccgggcaaaucaagcac

SEQ ID NO: 1200573 - RNA, 16 nt, Mycobacterium bovis subsp bovis AF2122/97
ccgggauugccgucgg

SEQ ID NO: 1200574 - RNA, 18 nt, Mycobacterium bovis subsp bovis AF2122/97
ccgggucgaugucggggc

SEQ ID NO: 1200575 - RNA, 14 nt, Mycobacterium bovis subsp bovis AF2122/97
ccgggucgaacagg

SEQ ID NO: 1200576 - RNA, 17 nt, Mycobacterium bovis subsp bovis AF2122/97
ccggguccgccgggccc

SEQ ID NO: 1200577 - RNA, 13 nt, Mycobacterium bovis subsp bovis AF2122/97
ccgggucggccgg

SEQ ID NO: 1200578 - RNA, 12 nt, Mycobacterium bovis subsp bovis AF2122/97
ccgggucggcga

SEQ ID NO: 1200579 - RNA, 20 nt, Mycobacterium bovis subsp bovis AF2122/97
ccgggucgcgggauggggcc

SEQ ID NO: 1200580 - RNA, 21 nt, Mycobacterium bovis subsp bovis AF2122/97
ccgggucgggcaccgcgcgcu

SEQ ID NO: 1200581 - RNA, 15 nt, Mycobacterium bovis subsp bovis AF2122/97
ccgggugccacaacc

SEQ ID NO: 1200582 - RNA, 23 nt, Mycobacterium bovis subsp bovis AF2122/97
ccgggugcaacggcguuggcgcc

SEQ ID NO: 1200583 - RNA, 15 nt, Mycobacterium bovis subsp bovis AF2122/97
ccgggugcagaucgc

SEQ ID NO: 1200584 - RNA, 21 nt, Mycobacterium bovis subsp bovis AF2122/97
ccgggugaggcgggucgccgc

SEQ ID NO: 1200585 - RNA, 22 nt, Mycobacterium bovis subsp bovis AF2122/97
ccgggugcugugaacgaaggga

SEQ ID NO: 1200586 - RNA, 14 nt, Mycobacterium bovis subsp bovis AF2122/97
ccggguggcacacc

SEQ ID NO: 1200587 - RNA, 21 nt, Mycobacterium bovis subsp bovis AF2122/97
ccggguggccacgcccaggca

SEQ ID NO: 1200588 - RNA, 19 nt, Mycobacterium bovis subsp bovis AF2122/97
ccgggugcgacgcgaccgc

SEQ ID NO: 1200589 - RNA, 18 nt, Mycobacterium bovis subsp bovis AF2122/97
ccggguggcgucaccgcc

SEQ ID NO: 1200590 - RNA, 20 nt, Mycobacterium bovis subsp bovis AF2122/97
ccgguacaacccccaggcgc

SEQ ID NO: 1200591 - RNA, 20 nt, Mycobacterium bovis subsp bovis AF2122/97
ccgguacccguagcaccaca

SEQ ID NO: 1200592 - RNA, 18 nt, Mycobacterium bovis subsp bovis AF2122/97
ccgguagaucagcgccug

SEQ ID NO: 1200593 - RNA, 15 nt, Mycobacterium bovis subsp bovis AF2122/97
ccgguagcggcggca

SEQ ID NO: 1200594 - RNA, 16 nt, Mycobacterium bovis subsp bovis AF2122/97
ccggucagcgcggcgc

SEQ ID NO: 1200595 - RNA, 16 nt, Mycobacterium bovis subsp bovis AF2122/97
ccggucaggccgccgc

SEQ ID NO: 1200596 - RNA, 18 nt, Mycobacterium bovis subsp bovis AF2122/97
ccggucaggccgccgcgg

SEQ ID NO: 1200597 - RNA, 21 nt, Mycobacterium bovis subsp bovis AF2122/97
ccggucagguacaucccggug

SEQ ID NO: 1200598 - RNA, 18 nt, Mycobacterium bovis subsp bovis AF2122/97
ccggucauaccaagcgcg

SEQ ID NO: 1200599 - RNA, 18 nt, Mycobacterium bovis subsp bovis AF2122/97
ccgguccagcggccgccg

SEQ ID NO: 1200600 - RNA, 19 nt, Mycobacterium bovis subsp bovis AF2122/97
ccgguccagcggccgccgc

SEQ ID NO: 1200601 - RNA, 16 nt, Mycobacterium bovis subsp bovis AF2122/97
ccgguccagcccagcg

SEQ ID NO: 1200602 - RNA, 17 nt, Mycobacterium bovis subsp bovis AF2122/97
ccggucggccauccacc

SEQ ID NO: 1200603 - RNA, 16 nt, Mycobacterium bovis subsp bovis AF2122/97
ccggucggccaggccg

SEQ ID NO: 1200604 - RNA, 21 nt, Mycobacterium bovis subsp bovis AF2122/97
ccggucgggggcguccuccug

SEQ ID NO: 1200605 - RNA, 11 nt, Mycobacterium bovis subsp bovis AF2122/97
ccggucggcgg

SEQ ID NO: 1200606 - RNA, 15 nt, Mycobacterium bovis subsp bovis AF2122/97
ccggucggcgguagc

SEQ ID NO: 1200607 - RNA, 16 nt, Mycobacterium bovis subsp bovis AF2122/97
ccgguccgccagcgcg

SEQ ID NO: 1200608 - RNA, 14 nt, Mycobacterium bovis subsp bovis AF2122/97
ccggucccccgccc

SEQ ID NO: 1200609 - RNA, 20 nt, Mycobacterium bovis subsp bovis AF2122/97
ccggucccgcgugccacucg

SEQ ID NO: 1200610 - RNA, 13 nt, Mycobacterium bovis subsp bovis AF2122/97
ccggucggcacca

SEQ ID NO: 1200611 - RNA, 13 nt, Mycobacterium bovis subsp bovis AF2122/97
ccggucggcagcu

SEQ ID NO: 1200612 - RNA, 14 nt, Mycobacterium bovis subsp bovis AF2122/97
ccggucggcagcuu

SEQ ID NO: 1200613 - RNA, 16 nt, Mycobacterium bovis subsp bovis AF2122/97
ccggucggugagccgu

SEQ ID NO: 1200614 - RNA, 19 nt, Mycobacterium bovis subsp bovis AF2122/97
ccggucggugagccgugcc

SEQ ID NO: 1200615 - RNA, 18 nt, Mycobacterium bovis subsp bovis AF2122/97
ccggucguuugcgccagg

SEQ ID NO: 1200616 - RNA, 16 nt, Mycobacterium bovis subsp bovis AF2122/97
ccggucggcccgcgcu

SEQ ID NO: 1200617 - RNA, 23 nt, Mycobacterium bovis subsp bovis AF2122/97
ccggucuauuugccugccgcgca

SEQ ID NO: 1200618 - RNA, 12 nt, Mycobacterium bovis subsp bovis AF2122/97
ccggugccgccu

SEQ ID NO: 1200619 - RNA, 15 nt, Mycobacterium bovis subsp bovis AF2122/97
ccggugggccgccca

SEQ ID NO: 1200620 - RNA, 22 nt, Mycobacterium bovis subsp bovis AF2122/97
ccgguggggacccgcuccaagc

SEQ ID NO: 1200621 - RNA, 19 nt, Mycobacterium bovis subsp bovis AF2122/97
ccgguggggucggucuggc

SEQ ID NO: 1200622 - RNA, 19 nt, Mycobacterium bovis subsp bovis AF2122/97
ccgguggcgccggggccgc

SEQ ID NO: 1200623 - RNA, 15 nt, Mycobacterium bovis subsp bovis AF2122/97
ccgguggcgugggca

SEQ ID NO: 1200624 - RNA, 20 nt, Mycobacterium bovis subsp bovis AF2122/97
ccgguggcuggccgccaccg

SEQ ID NO: 1200625 - RNA, 21 nt, Mycobacterium bovis subsp bovis AF2122/97
ccgguggcuggccgccaccgc

SEQ ID NO: 1200626 - RNA, 16 nt, Mycobacterium bovis subsp bovis AF2122/97
ccgguguaggccucgg

SEQ ID NO: 1200627 - RNA, 16 nt, Mycobacterium bovis subsp bovis AF2122/97
ccggugucggccagca

SEQ ID NO: 1200628 - RNA, 17 nt, Mycobacterium bovis subsp bovis AF2122/97
ccggugucucccuugcc

SEQ ID NO: 1200629 - RNA, 22 nt, Mycobacterium bovis subsp bovis AF2122/97
ccggugucucccuugccgccau

SEQ ID NO: 1200630 - RNA, 15 nt, Mycobacterium bovis subsp bovis AF2122/97
ccgguguccagccac

SEQ ID NO: 1200631 - RNA, 18 nt, Mycobacterium bovis subsp bovis AF2122/97
ccggugguggcgaccccg

SEQ ID NO: 1200632 - RNA, 16 nt, Mycobacterium bovis subsp bovis AF2122/97
ccgguggugccggcgc

SEQ ID NO: 1200633 - RNA, 21 nt, Mycobacterium bovis subsp bovis AF2122/97
ccggugguaccggcggcgccg

SEQ ID NO: 1200634 - RNA, 15 nt, Mycobacterium bovis subsp bovis AF2122/97
ccgguggucaggaac

SEQ ID NO: 1200635 - RNA, 14 nt, Mycobacterium bovis subsp bovis AF2122/97
ccgguggucugcgc

SEQ ID NO: 1200636 - RNA, 19 nt, Mycobacterium bovis subsp bovis AF2122/97
ccggugcugucgacgucgg

SEQ ID NO: 1200637 - RNA, 17 nt, Mycobacterium bovis subsp bovis AF2122/97
ccgguggcagagccgcc

SEQ ID NO: 1200638 - RNA, 19 nt, Mycobacterium bovis subsp bovis AF2122/97
ccggugcugguccagccgg

SEQ ID NO: 1200639 - RNA, 22 nt, Mycobacterium bovis subsp bovis AF2122/97
ccggugcggccaaugacgucgg

SEQ ID NO: 1200640 - RNA, 14 nt, Mycobacterium bovis subsp bovis AF2122/97
ccggugcggcgggc

SEQ ID NO: 1200641 - RNA, 19 nt, Mycobacterium bovis subsp bovis AF2122/97
ccggugcucaagcgcgucg

SEQ ID NO: 1200642 - RNA, 22 nt, Mycobacterium bovis subsp bovis AF2122/97
ccggugcuaaccgacgcugaag

SEQ ID NO: 1200643 - RNA, 20 nt, Mycobacterium bovis subsp bovis AF2122/97
ccggugccguuggagccgcc

SEQ ID NO: 1200644 - RNA, 16 nt, Mycobacterium bovis subsp bovis AF2122/97
ccggucuacgccaccg

SEQ ID NO: 1200645 - RNA, 22 nt, Mycobacterium bovis subsp bovis AF2122/97
ccggugccgcgguaggugcaug

SEQ ID NO: 1200646 - RNA, 21 nt, Mycobacterium bovis subsp bovis AF2122/97
ccggugccggcguugccgccg

SEQ ID NO: 1200647 - RNA, 20 nt, Mycobacterium bovis subsp bovis AF2122/97
ccggugccgggaugccgccg

SEQ ID NO: 1200648 - RNA, 16 nt, Mycobacterium bovis subsp bovis AF2122/97
ccggugccgggcacca

SEQ ID NO: 1200649 - RNA, 16 nt, Mycobacterium bovis subsp bovis AF2122/97
ccggugcgaucccacc

SEQ ID NO: 1200650 - RNA, 16 nt, Mycobacterium bovis subsp bovis AF2122/97
ccggugcgcagguacg

SEQ ID NO: 1200651 - RNA, 20 nt, Mycobacterium bovis subsp bovis AF2122/97
ccgguugcggucaucggcgc

SEQ ID NO: 1200652 - RNA, 15 nt, Mycobacterium bovis subsp bovis AF2122/97
ccgguuggccagcca

SEQ ID NO: 1200653 - RNA, 19 nt, Mycobacterium bovis subsp bovis AF2122/97
ccgguuucuucggccagcu

SEQ ID NO: 1200654 - RNA, 15 nt, Mycobacterium bovis subsp bovis AF2122/97
ccguaagcaccagcc

SEQ ID NO: 1200655 - RNA, 16 nt, Mycobacterium bovis subsp bovis AF2122/97
ccguaagcaccagcca

SEQ ID NO: 1200656 - RNA, 17 nt, Mycobacterium bovis subsp bovis AF2122/97
ccguaagcaccagccag

SEQ ID NO: 1200657 - RNA, 18 nt, Mycobacterium bovis subsp bovis AF2122/97
ccgguucagggguggcgc

SEQ ID NO: 1200658 - RNA, 21 nt, Mycobacterium bovis subsp bovis AF2122/97
ccggugucuucugccaucaac

SEQ ID NO: 1200659 - RNA, 19 nt, Mycobacterium bovis subsp bovis AF2122/97
ccgguguuuccgaaacccg

SEQ ID NO: 1200660 - RNA, 22 nt, Mycobacterium bovis subsp bovis AF2122/97
ccgguguuuccgaaacccgccg

SEQ ID NO: 1200661 - RNA, 16 nt, Mycobacterium bovis subsp bovis AF2122/97
ccgguguugccgccgg

SEQ ID NO: 1200662 - RNA, 11 nt, Mycobacterium bovis subsp bovis AF2122/97
ccgguguugau

SEQ ID NO: 1200663 - RNA, 22 nt, Mycobacterium bovis subsp bovis AF2122/97
ccgguuccgcaaugaccuggcc

SEQ ID NO: 1200664 - RNA, 18 nt, Mycobacterium bovis subsp bovis AF2122/97
ccgguucgccgccguugg

SEQ ID NO: 1200665 - RNA, 21 nt, Mycobacterium bovis subsp bovis AF2122/97
ccgguucggggggcaggucga

SEQ ID NO: 1200666 - RNA, 20 nt, Mycobacterium bovis subsp bovis AF2122/97
ccgguucugcgcccacccgc

SEQ ID NO: 1200667 - RNA, 15 nt, Mycobacterium bovis subsp bovis AF2122/97
ccguaccagcccguc

SEQ ID NO: 1200668 - RNA, 14 nt, Mycobacterium bovis subsp bovis AF2122/97
ccguauccaggcgu

SEQ ID NO: 1200669 - RNA, 17 nt, Mycobacterium bovis subsp bovis AF2122/97
ccguauugaccagcggg

SEQ ID NO: 1200670 - RNA, 19 nt, Mycobacterium bovis subsp bovis AF2122/97
ccgucaccgccggcaccgc

SEQ ID NO: 1200671 - RNA, 22 nt, Mycobacterium bovis subsp bovis AF2122/97
ccgucaccggaauccccccugu

SEQ ID NO: 1200672 - RNA, 13 nt, Mycobacterium bovis subsp bovis AF2122/97
ccgucacgcccgc

SEQ ID NO: 1200673 - RNA, 16 nt, Mycobacterium bovis subsp bovis AF2122/97
ccgucaccgcgacccc

SEQ ID NO: 1200674 - RNA, 17 nt, Mycobacterium bovis subsp bovis AF2122/97
ccgucaccgcccuugcc

SEQ ID NO: 1200675 - RNA, 13 nt, Mycobacterium bovis subsp bovis AF2122/97
ccgucaccgccga

SEQ ID NO: 1200676 - RNA, 17 nt, Mycobacterium bovis subsp bovis AF2122/97
ccguauugccaaagccc

SEQ ID NO: 1200677 - RNA, 19 nt, Mycobacterium bovis subsp bovis AF2122/97
ccgucaaccugcugcagaa

SEQ ID NO: 1200678 - RNA, 19 nt, Mycobacterium bovis subsp bovis AF2122/97
ccgucacaaugcccaggcu

SEQ ID NO: 1200679 - RNA, 22 nt, Mycobacterium bovis subsp bovis AF2122/97
ccguccagcaacagcgagcggu

SEQ ID NO: 1200680 - RNA, 16 nt, Mycobacterium bovis subsp bovis AF2122/97
ccguccagcgccgcgg

SEQ ID NO: 1200681 - RNA, 18 nt, Mycobacterium bovis subsp bovis AF2122/97
ccguccaggcgcugcagc

SEQ ID NO: 1200682 - RNA, 19 nt, Mycobacterium bovis subsp bovis AF2122/97
ccguccaggcgcugcagca

SEQ ID NO: 1200683 - RNA, 20 nt, Mycobacterium bovis subsp bovis AF2122/97
ccguccaggcgcugcagcau

SEQ ID NO: 1200684 - RNA, 15 nt, Mycobacterium bovis subsp bovis AF2122/97
ccgucccacugaccg

SEQ ID NO: 1200685 - RNA, 20 nt, Mycobacterium bovis subsp bovis AF2122/97
ccgucccagcugaccagcgu

SEQ ID NO: 1200686 - RNA, 14 nt, Mycobacterium bovis subsp bovis AF2122/97
ccgucccggcucga

SEQ ID NO: 1200687 - RNA, 19 nt, Mycobacterium bovis subsp bovis AF2122/97
ccgucaucgugcccgcguc

SEQ ID NO: 1200688 - RNA, 13 nt, Mycobacterium bovis subsp bovis AF2122/97
ccgucauggcccg

SEQ ID NO: 1200689 - RNA, 16 nt, Mycobacterium bovis subsp bovis AF2122/97
ccgucauggcccgauc

SEQ ID NO: 1200690 - RNA, 18 nt, Mycobacterium bovis subsp bovis AF2122/97
ccgucaugggcggcuucg

SEQ ID NO: 1200691 - RNA, 18 nt, Mycobacterium bovis subsp bovis AF2122/97
ccguccaagccggcugca

SEQ ID NO: 1200692 - RNA, 23 nt, Mycobacterium bovis subsp bovis AF2122/97
ccugacgcucggucgccaccgcc

SEQ ID NO: 1200693 - RNA, 20 nt, Mycobacterium bovis subsp bovis AF2122/97
ccugaccucauguccgccgu

SEQ ID NO: 1200694 - RNA, 18 nt, Mycobacterium bovis subsp bovis AF2122/97
ccugaccggcucgccggc

SEQ ID NO: 1200695 - RNA, 18 nt, Mycobacterium bovis subsp bovis AF2122/97
ccugaccggucacccgug

SEQ ID NO: 1200696 - RNA, 23 nt, Mycobacterium bovis subsp bovis AF2122/97
ccugacgccccgccacaauggac

SEQ ID NO: 1200697 - RNA, 18 nt, Mycobacterium bovis subsp bovis AF2122/97
ccugaccgaagucugcag

SEQ ID NO: 1200698 - RNA, 12 nt, Mycobacterium bovis subsp bovis AF2122/97
ccugacacccau

SEQ ID NO: 1200699 - RNA, 15 nt, Mycobacterium bovis subsp bovis AF2122/97
ccucuucggagguga

SEQ ID NO: 1200700 - RNA, 11 nt, Mycobacterium bovis subsp bovis AF2122/97
ccugagcagau

SEQ ID NO: 1200701 - RNA, 19 nt, Mycobacterium bovis subsp bovis AF2122/97
ccugagcaucuccucgccu

SEQ ID NO: 1200702 - RNA, 17 nt, Mycobacterium bovis subsp bovis AF2122/97
ccugagcaccaagaccg

SEQ ID NO: 1200703 - RNA, 19 nt, Mycobacterium bovis subsp bovis AF2122/97
ccugacuuuugucacugcg

SEQ ID NO: 1200704 - RNA, 19 nt, Mycobacterium bovis subsp bovis AF2122/97
ccugauaugacuugcgcgc

SEQ ID NO: 1200705 - RNA, 21 nt, Mycobacterium bovis subsp bovis AF2122/97
ccugauggcgcugcaccguag

SEQ ID NO: 1200706 - RNA, 16 nt, Mycobacterium bovis subsp bovis AF2122/97
ccugaucgagcgccag

SEQ ID NO: 1200707 - RNA, 18 nt, Mycobacterium bovis subsp bovis AF2122/97
ccugauccgccugccgac

SEQ ID NO: 1200708 - RNA, 17 nt, Mycobacterium bovis subsp bovis AF2122/97
ccugcagcccgggcagc

SEQ ID NO: 1200709 - RNA, 15 nt, Mycobacterium bovis subsp bovis AF2122/97
ccugcaggccgccgg

SEQ ID NO: 1200710 - RNA, 20 nt, Mycobacterium bovis subsp bovis AF2122/97
ccugcaggccgccggccagc

SEQ ID NO: 1200711 - RNA, 12 nt, Mycobacterium bovis subsp bovis AF2122/97
ccugcagcuggc

SEQ ID NO: 1200712 - RNA, 14 nt, Mycobacterium bovis subsp bovis AF2122/97
ccugcagcucgggc

SEQ ID NO: 1200713 - RNA, 20 nt, Mycobacterium bovis subsp bovis AF2122/97
ccugcaggaucaaaaccucg

SEQ ID NO: 1200714 - RNA, 14 nt, Mycobacterium bovis subsp bovis AF2122/97
ccugccaccggcgc

SEQ ID NO: 1200715 - RNA, 14 nt, Mycobacterium bovis subsp bovis AF2122/97
ccugccacccggcc

SEQ ID NO: 1200716 - RNA, 17 nt, Mycobacterium bovis subsp bovis AF2122/97
ccugccacagcgacagc

SEQ ID NO: 1200717 - RNA, 12 nt, Mycobacterium bovis subsp bovis AF2122/97
ccugccacccgg

SEQ ID NO: 1200718 - RNA, 18 nt, Mycobacterium bovis subsp bovis AF2122/97
ccugccaaugcugcaggu

SEQ ID NO: 1200719 - RNA, 18 nt, Mycobacterium bovis subsp bovis AF2122/97
ccucggcgaucaauugcc

SEQ ID NO: 1200720 - RNA, 21 nt, Mycobacterium bovis subsp bovis AF2122/97
ccucggcgaccugcucgcugg

SEQ ID NO: 1200721 - RNA, 15 nt, Mycobacterium bovis subsp bovis AF2122/97
ccucggcgaccuggc

SEQ ID NO: 1200722 - RNA, 12 nt, Mycobacterium bovis subsp bovis AF2122/97
ccucggccgcag

SEQ ID NO: 1200723 - RNA, 12 nt, Mycobacterium bovis subsp bovis AF2122/97
ccucggccgcca

SEQ ID NO: 1200724 - RNA, 17 nt, Mycobacterium bovis subsp bovis AF2122/97
ccucggccgccagcccc

SEQ ID NO: 1200725 - RNA, 18 nt, Mycobacterium bovis subsp bovis AF2122/97
ccucggccgccagcccca

SEQ ID NO: 1200726 - RNA, 13 nt, Mycobacterium bovis subsp bovis AF2122/97
ccucggccgcccg

SEQ ID NO: 1200727 - RNA, 13 nt, Mycobacterium bovis subsp bovis AF2122/97
ccucggccgccug

SEQ ID NO: 1200728 - RNA, 17 nt, Mycobacterium bovis subsp bovis AF2122/97
ccucggcaugcagcccc

SEQ ID NO: 1200729 - RNA, 14 nt, Mycobacterium bovis subsp bovis AF2122/97
ccucggccacccgc

SEQ ID NO: 1200730 - RNA, 20 nt, Mycobacterium bovis subsp bovis AF2122/97
ccucggcaaaccaagcgcgc

SEQ ID NO: 1200731 - RNA, 23 nt, Mycobacterium bovis subsp bovis AF2122/97
ccucggcaagucgacgccgcagc

SEQ ID NO: 1200732 - RNA, 22 nt, Mycobacterium bovis subsp bovis AF2122/97
ccucguagaacgcuagcgccaa

SEQ ID NO: 1200733 - RNA, 20 nt, Mycobacterium bovis subsp bovis AF2122/97
ccucguaugccguggccgcc

SEQ ID NO: 1200734 - RNA, 16 nt, Mycobacterium bovis subsp bovis AF2122/97
ccucggcgccgcccag

SEQ ID NO: 1200735 - RNA, 16 nt, Mycobacterium bovis subsp bovis AF2122/97
ccucggcgaugucgcg

SEQ ID NO: 1200736 - RNA, 13 nt, Mycobacterium bovis subsp bovis AF2122/97
ccucggcgccgcc

SEQ ID NO: 1200737 - RNA, 16 nt, Mycobacterium bovis subsp bovis AF2122/97
ccucgucccacagguu

SEQ ID NO: 1200738 - RNA, 23 nt, Mycobacterium bovis subsp bovis AF2122/97
ccucgucaaucaccaccgccagc

SEQ ID NO: 1200739 - RNA, 19 nt, Mycobacterium bovis subsp bovis AF2122/97
ccucgucgagguccucguc

SEQ ID NO: 1200740 - RNA, 16 nt, Mycobacterium bovis subsp bovis AF2122/97
ccucgucgauguucgc

SEQ ID NO: 1200741 - RNA, 22 nt, Mycobacterium bovis subsp bovis AF2122/97
ccucgucgccgcgguagacgcc

SEQ ID NO: 1200742 - RNA, 15 nt, Mycobacterium bovis subsp bovis AF2122/97
ccucgucgccgcggu

SEQ ID NO: 1200743 - RNA, 20 nt, Mycobacterium bovis subsp bovis AF2122/97
ccucgucgcucccgguuggg

SEQ ID NO: 1200744 - RNA, 17 nt, Mycobacterium bovis subsp bovis AF2122/97
ccucugcgaucaguucg

SEQ ID NO: 1200745 - RNA, 12 nt, Mycobacterium bovis subsp bovis AF2122/97
ccucugcucagc

SEQ ID NO: 1200746 - RNA, 14 nt, Mycobacterium bovis subsp bovis AF2122/97
ccucugucuucagc

SEQ ID NO: 1200747 - RNA, 18 nt, Mycobacterium bovis subsp bovis AF2122/97
ccucugucuucagcugcg

SEQ ID NO: 1200748 - RNA, 21 nt, Mycobacterium bovis subsp bovis AF2122/97
ccucuagcuugacaacccugu

SEQ ID NO: 1200749 - RNA, 20 nt, Mycobacterium bovis subsp bovis AF2122/97
ccucgccaucgaccuugagc

SEQ ID NO: 1200750 - RNA, 13 nt, Mycobacterium bovis subsp bovis AF2122/97
ccucgcccagcaa

SEQ ID NO: 1200751 - RNA, 14 nt, Mycobacterium bovis subsp bovis AF2122/97
ccucgccgcacgcc

SEQ ID NO: 1200752 - RNA, 21 nt, Mycobacterium bovis subsp bovis AF2122/97
ccucgcccagcaaggcccgaa

SEQ ID NO: 1200753 - RNA, 20 nt, Mycobacterium bovis subsp bovis AF2122/97
ccucgcacaauggcggcgcc

SEQ ID NO: 1200754 - RNA, 22 nt, Mycobacterium bovis subsp bovis AF2122/97
ccucgcacaauggcggcgccgu

SEQ ID NO: 1200755 - RNA, 15 nt, Mycobacterium bovis subsp bovis AF2122/97
ccucgcaggugguga

SEQ ID NO: 1200756 - RNA, 19 nt, Mycobacterium bovis subsp bovis AF2122/97
ccucgcagguggugacacg

SEQ ID NO: 1200757 - RNA, 23 nt, Mycobacterium bovis subsp bovis AF2122/97
ccucgaugcggguggcgccggug

SEQ ID NO: 1200758 - RNA, 18 nt, Mycobacterium bovis subsp bovis AF2122/97
ccucgcugcgguggaacc

SEQ ID NO: 1200759 - RNA, 20 nt, Mycobacterium bovis subsp bovis AF2122/97
ccucggagaucgagaucacc

SEQ ID NO: 1200760 - RNA, 15 nt, Mycobacterium bovis subsp bovis AF2122/97
ccucggacugcagcg

SEQ ID NO: 1200761 - RNA, 16 nt, Mycobacterium bovis subsp bovis AF2122/97
ccucggacugcagcgc

SEQ ID NO: 1200762 - RNA, 19 nt, Mycobacterium bovis subsp bovis AF2122/97
ccucggacugcagcgcggc

SEQ ID NO: 1200763 - RNA, 17 nt, Mycobacterium bovis subsp bovis AF2122/97
ccucgccggccaccagc

SEQ ID NO: 1200764 - RNA, 15 nt, Mycobacterium bovis subsp bovis AF2122/97
ccucgccugcacgcc

SEQ ID NO: 1200765 - RNA, 18 nt, Mycobacterium bovis subsp bovis AF2122/97
ccucgccggacgggugca

SEQ ID NO: 1200766 - RNA, 15 nt, Mycobacterium bovis subsp bovis AF2122/97
ccucgccgcgcguga

SEQ ID NO: 1200767 - RNA, 22 nt, Mycobacterium bovis subsp bovis AF2122/97
ccucagcugcucgucuuggcgg

SEQ ID NO: 1200768 - RNA, 20 nt, Mycobacterium bovis subsp bovis AF2122/97
ccucgaucgacucgaaccgu

SEQ ID NO: 1200769 - RNA, 16 nt, Mycobacterium bovis subsp bovis AF2122/97
ccucgaucacggcggc

SEQ ID NO: 1200770 - RNA, 21 nt, Mycobacterium bovis subsp bovis AF2122/97
ccucgagguauucgcgcagca

SEQ ID NO: 1200771 - RNA, 22 nt, Mycobacterium bovis subsp bovis AF2122/97
ccucgaguucgggcugcggcag

SEQ ID NO: 1200772 - RNA, 18 nt, Mycobacterium bovis subsp bovis AF2122/97
ccucgagcugcuggcgcg

SEQ ID NO: 1200773 - RNA, 13 nt, Mycobacterium bovis subsp bovis AF2122/97
ccucgagcuugcc

SEQ ID NO: 1200774 - RNA, 13 nt, Mycobacterium bovis subsp bovis AF2122/97
ccucgagcggcag

SEQ ID NO: 1200775 - RNA, 18 nt, Mycobacterium bovis subsp bovis AF2122/97
ccucauagagcggcacca

SEQ ID NO: 1200776 - RNA, 15 nt, Mycobacterium bovis subsp bovis AF2122/97
ccuggcuggucagga

SEQ ID NO: 1200777 - RNA, 17 nt, Mycobacterium bovis subsp bovis AF2122/97
ccuggcuacgcgcgccc

SEQ ID NO: 1200778 - RNA, 19 nt, Mycobacterium bovis subsp bovis AF2122/97
ccugguccaggcccuggcc

SEQ ID NO: 1200779 - RNA, 15 nt, Mycobacterium bovis subsp bovis AF2122/97
ccugggcaaacuggg

SEQ ID NO: 1200780 - RNA, 19 nt, Mycobacterium bovis subsp bovis AF2122/97
ccuggucggugacugugcg

SEQ ID NO: 1200781 - RNA, 13 nt, Mycobacterium bovis subsp bovis AF2122/97
ccuggucgccgug

SEQ ID NO: 1200782 - RNA, 15 nt, Mycobacterium bovis subsp bovis AF2122/97
ccuggucggccaggu

SEQ ID NO: 1200783 - RNA, 14 nt, Mycobacterium bovis subsp bovis AF2122/97
ccuggugucgaucg

SEQ ID NO: 1200784 - RNA, 13 nt, Mycobacterium bovis subsp bovis AF2122/97
ccugguggcggga

SEQ ID NO: 1200785 - RNA, 18 nt, Mycobacterium bovis subsp bovis AF2122/97
ccugguggcagacauggc

SEQ ID NO: 1200786 - RNA, 21 nt, Mycobacterium bovis subsp bovis AF2122/97
ccugguguucgggcagcuggc

SEQ ID NO: 1200787 - RNA, 13 nt, Mycobacterium bovis subsp bovis AF2122/97
ccuggugugcggg

SEQ ID NO: 1200788 - RNA, 23 nt, Mycobacterium bovis subsp bovis AF2122/97
ccuggcccgccacgaugucgucg

SEQ ID NO: 1200789 - RNA, 16 nt, Mycobacterium bovis subsp bovis AF2122/97
ccuggcccuuguuggc

SEQ ID NO: 1200790 - RNA, 12 nt, Mycobacterium bovis subsp bovis AF2122/97
ccuggccccggc

SEQ ID NO: 1200791 - RNA, 12 nt, Mycobacterium bovis subsp bovis AF2122/97
ccuggccaucga

SEQ ID NO: 1200792 - RNA, 20 nt, Mycobacterium bovis subsp bovis AF2122/97
ccuggcccgauaaaugccgc

SEQ ID NO: 1200793 - RNA, 20 nt, Mycobacterium bovis subsp bovis AF2122/97
ccuggaaugccgccacaaag

SEQ ID NO: 1200794 - RNA, 23 nt, Mycobacterium bovis subsp bovis AF2122/97
ccuggaaguacacggcggcccgc

SEQ ID NO: 1200795 - RNA, 18 nt, Mycobacterium bovis subsp bovis AF2122/97
ccuggacauaccggcccg

SEQ ID NO: 1200796 - RNA, 18 nt, Mycobacterium bovis subsp bovis AF2122/97
ccuggacaaccucgucga

SEQ ID NO: 1200797 - RNA, 12 nt, Mycobacterium bovis subsp bovis AF2122/97
ccuggaccucgu

SEQ ID NO: 1200798 - RNA, 16 nt, Mycobacterium bovis subsp bovis AF2122/97
ccuggccacucccagc

SEQ ID NO: 1200799 - RNA, 22 nt, Mycobacterium bovis subsp bovis AF2122/97
ccuggccagcagagcggcacgc

SEQ ID NO: 1200800 - RNA, 11 nt, Mycobacterium bovis subsp bovis AF2122/97
ccuggcgagcc

SEQ ID NO: 1200801 - RNA, 15 nt, Mycobacterium bovis subsp bovis AF2122/97
ccuggccgggaccgc

SEQ ID NO: 1200802 - RNA, 15 nt, Mycobacterium bovis subsp bovis AF2122/97
ccuggccgccgcagu

SEQ ID NO: 1200803 - RNA, 18 nt, Mycobacterium bovis subsp bovis AF2122/97
ccuggccgucccaccagc

SEQ ID NO: 1200804 - RNA, 16 nt, Mycobacterium bovis subsp bovis AF2122/97
ccuggccugcccagca

SEQ ID NO: 1200805 - RNA, 14 nt, Mycobacterium bovis subsp bovis AF2122/97
ccugccaguccgca

SEQ ID NO: 1200806 - RNA, 22 nt, Mycobacterium bovis subsp bovis AF2122/97
ccugccauaggcccacggcagc

SEQ ID NO: 1200807 - RNA, 16 nt, Mycobacterium bovis subsp bovis AF2122/97
ccugccaguccgcagc

SEQ ID NO: 1200808 - RNA, 14 nt, Mycobacterium bovis subsp bovis AF2122/97
ccugcccaccuucg

SEQ ID NO: 1200809 - RNA, 13 nt, Mycobacterium bovis subsp bovis AF2122/97
ccugcccagcacc

SEQ ID NO: 1200810 - RNA, 23 nt, Mycobacterium bovis subsp bovis AF2122/97
ccugcucagcuaaaaaccgcugc

SEQ ID NO: 1200811 - RNA, 13 nt, Mycobacterium bovis subsp bovis AF2122/97
ccugcucauccac

SEQ ID NO: 1200812 - RNA, 17 nt, Mycobacterium bovis subsp bovis AF2122/97
ccugcuccgcugucacc

SEQ ID NO: 1200813 - RNA, 19 nt, Mycobacterium bovis subsp bovis AF2122/97
ccugcuggcccugcuccuc

SEQ ID NO: 1200814 - RNA, 14 nt, Mycobacterium bovis subsp bovis AF2122/97
ccugcucgcacagc

SEQ ID NO: 1200815 - RNA, 16 nt, Mycobacterium bovis subsp bovis AF2122/97
ccugcuggucaccauc

SEQ ID NO: 1200816 - RNA, 22 nt, Mycobacterium bovis subsp bovis AF2122/97
ccugcuuguagcgcaucgccaa

SEQ ID NO: 1200817 - RNA, 14 nt, Mycobacterium bovis subsp bovis AF2122/97
ccugcuugcaggcg

SEQ ID NO: 1200818 - RNA, 12 nt, Mycobacterium bovis subsp bovis AF2122/97
ccugcuuuccag

SEQ ID NO: 1200819 - RNA, 19 nt, Mycobacterium bovis subsp bovis AF2122/97
ccuggaagacggugcgggc

SEQ ID NO: 1200820 - RNA, 20 nt, Mycobacterium bovis subsp bovis AF2122/97
ccuggaagacggugcgggcu

SEQ ID NO: 1200821 - RNA, 19 nt, Mycobacterium bovis subsp bovis AF2122/97
ccuggaacugcaugguggc

SEQ ID NO: 1200822 - RNA, 16 nt, Mycobacterium bovis subsp bovis AF2122/97
ccuggaaagggccgcc

SEQ ID NO: 1200823 - RNA, 16 nt, Mycobacterium bovis subsp bovis AF2122/97
ccuguucgccgucgcu

SEQ ID NO: 1200824 - RNA, 23 nt, Mycobacterium bovis subsp bovis AF2122/97
ccuguugacccaucaugguccgg

SEQ ID NO: 1200825 - RNA, 16 nt, Mycobacterium bovis subsp bovis AF2122/97
ccuguucacccacucc

SEQ ID NO: 1200826 - RNA, 20 nt, Mycobacterium bovis subsp bovis AF2122/97
ccugugccagcagcagcgcc

SEQ ID NO: 1200827 - RNA, 21 nt, Mycobacterium bovis subsp bovis AF2122/97
ccuguuggcaugccgcccgcu

SEQ ID NO: 1200828 - RNA, 23 nt, Mycobacterium bovis subsp bovis AF2122/97
ccuguuuaccuuccucgcccuug

SEQ ID NO: 1200829 - RNA, 20 nt, Mycobacterium bovis subsp bovis AF2122/97
ccuguugcagaaaacccucg

SEQ ID NO: 1200830 - RNA, 19 nt, Mycobacterium bovis subsp bovis AF2122/97
ccuucacgcuggccuccag

SEQ ID NO: 1200831 - RNA, 23 nt, Mycobacterium bovis subsp bovis AF2122/97
ccuucagggcgucgaacucaucu

SEQ ID NO: 1200832 - RNA, 15 nt, Mycobacterium bovis subsp bovis AF2122/97
ccuucagccagucca

SEQ ID NO: 1200833 - RNA, 19 nt, Mycobacterium bovis subsp bovis AF2122/97
ccuucagcgaagccggguc

SEQ ID NO: 1200834 - RNA, 15 nt, Mycobacterium bovis subsp bovis AF2122/97
ccuucaccagcugcg

SEQ ID NO: 1200835 - RNA, 14 nt, Mycobacterium bovis subsp bovis AF2122/97
ccuucaaagcggcc

SEQ ID NO: 1200836 - RNA, 23 nt, Mycobacterium bovis subsp bovis AF2122/97
ccuuaucgcucucggucaguucc

SEQ ID NO: 1200837 - RNA, 18 nt, Mycobacterium bovis subsp bovis AF2122/97
ccuuagcccggccgcgcc

SEQ ID NO: 1200838 - RNA, 15 nt, Mycobacterium bovis subsp bovis AF2122/97
caggcagggcagccc

SEQ ID NO: 1200839 - RNA, 22 nt, Mycobacterium bovis subsp bovis AF2122/97
caggcaguccaccgcgcggcgc

SEQ ID NO: 1200840 - RNA, 13 nt, Mycobacterium bovis subsp bovis AF2122/97
caggcacuccagc

SEQ ID NO: 1200841 - RNA, 13 nt, Mycobacterium bovis subsp bovis AF2122/97
caggcagcuccgc

SEQ ID NO: 1200842 - RNA, 14 nt, Mycobacterium bovis subsp bovis AF2122/97
caggcagcuccgcc

SEQ ID NO: 1200843 - RNA, 14 nt, Mycobacterium bovis subsp bovis AF2122/97
caggccgaccauaa

SEQ ID NO: 1200844 - RNA, 18 nt, Mycobacterium bovis subsp bovis AF2122/97
caggccgagcccggugcu

SEQ ID NO: 1200845 - RNA, 18 nt, Mycobacterium bovis subsp bovis AF2122/97
caggccgaugcgggucuc

SEQ ID NO: 1200846 - RNA, 17 nt, Mycobacterium bovis subsp bovis AF2122/97
caggccgcacagcacca

SEQ ID NO: 1200847 - RNA, 22 nt, Mycobacterium bovis subsp bovis AF2122/97
caggccgccaccgucaccgccg

SEQ ID NO: 1200848 - RNA, 19 nt, Mycobacterium bovis subsp bovis AF2122/97
caggccgggcaccaauacc

SEQ ID NO: 1200849 - RNA, 18 nt, Mycobacterium bovis subsp bovis AF2122/97
caggccggcggcggcgcu

SEQ ID NO: 1200850 - RNA, 24 nt, Mycobacterium bovis subsp bovis AF2122/97
caggccgggcgcaagcagcccggg

SEQ ID NO: 1200851 - RNA, 14 nt, Mycobacterium bovis subsp bovis AF2122/97
caggccggugugcg

SEQ ID NO: 1200852 - RNA, 23 nt, Mycobacterium bovis subsp bovis AF2122/97
caggccgguuugcacgcaccaca

SEQ ID NO: 1200853 - RNA, 16 nt, Mycobacterium bovis subsp bovis AF2122/97
caggccgggcgcaagc

SEQ ID NO: 1200854 - RNA, 21 nt, Mycobacterium bovis subsp bovis AF2122/97
caggccguagcccacgacgaa

SEQ ID NO: 1200855 - RNA, 17 nt, Mycobacterium bovis subsp bovis AF2122/97
caggccggcacccacca

SEQ ID NO: 1200856 - RNA, 17 nt, Mycobacterium bovis subsp bovis AF2122/97
caggccggcagcuugca

SEQ ID NO: 1200857 - RNA, 15 nt, Mycobacterium bovis subsp bovis AF2122/97
caggccgcgcauggu

SEQ ID NO: 1200858 - RNA, 23 nt, Mycobacterium bovis subsp bovis AF2122/97
caggccgcgcggacccagcaccc

SEQ ID NO: 1200859 - RNA, 17 nt, Mycobacterium bovis subsp bovis AF2122/97
caggccgcgcaugguca

SEQ ID NO: 1200860 - RNA, 23 nt, Mycobacterium bovis subsp bovis AF2122/97
caggccgcgcgacaacccggcgu

SEQ ID NO: 1200861 - RNA, 18 nt, Mycobacterium bovis subsp bovis AF2122/97
caggccgcuugccccgcc

SEQ ID NO: 1200862 - RNA, 19 nt, Mycobacterium bovis subsp bovis AF2122/97
caggccgcuugccccgccu

SEQ ID NO: 1200863 - RNA, 17 nt, Mycobacterium bovis subsp bovis AF2122/97
caggccgcccagcuguc

SEQ ID NO: 1200864 - RNA, 15 nt, Mycobacterium bovis subsp bovis AF2122/97
caggccgccuggggg

SEQ ID NO: 1200865 - RNA, 16 nt, Mycobacterium bovis subsp bovis AF2122/97
caggcgccgugggcuu

SEQ ID NO: 1200866 - RNA, 13 nt, Mycobacterium bovis subsp bovis AF2122/97
caggcgcgcacca

SEQ ID NO: 1200867 - RNA, 17 nt, Mycobacterium bovis subsp bovis AF2122/97
caggcgcgcaccaccgc

SEQ ID NO: 1200868 - RNA, 16 nt, Mycobacterium bovis subsp bovis AF2122/97
caggcgcucaucaccc

SEQ ID NO: 1200869 - RNA, 16 nt, Mycobacterium bovis subsp bovis AF2122/97
caggcgcggcccaggu

SEQ ID NO: 1200870 - RNA, 20 nt, Mycobacterium bovis subsp bovis AF2122/97
caggcgcucaucacccagcg

SEQ ID NO: 1200871 - RNA, 19 nt, Mycobacterium bovis subsp bovis AF2122/97
caggcgcucagcgcggcca

SEQ ID NO: 1200872 - RNA, 15 nt, Mycobacterium bovis subsp bovis AF2122/97
caggcgcgccgcacc

SEQ ID NO: 1200873 - RNA, 17 nt, Mycobacterium bovis subsp bovis AF2122/97
caggcgcgccgcacccg

SEQ ID NO: 1200874 - RNA, 22 nt, Mycobacterium bovis subsp bovis AF2122/97
caggccguugcuauucgccagc

SEQ ID NO: 1200875 - RNA, 17 nt, Mycobacterium bovis subsp bovis AF2122/97
caggccguggcggacgg

SEQ ID NO: 1200876 - RNA, 14 nt, Mycobacterium bovis subsp bovis AF2122/97
caggcgcauagggc

SEQ ID NO: 1200877 - RNA, 20 nt, Mycobacterium bovis subsp bovis AF2122/97
caggcgcauagggccaccgc

SEQ ID NO: 1200878 - RNA, 12 nt, Mycobacterium bovis subsp bovis AF2122/97
caggcgccgcua

SEQ ID NO: 1200879 - RNA, 15 nt, Mycobacterium bovis subsp bovis AF2122/97
caggcgcccacaaau

SEQ ID NO: 1200880 - RNA, 12 nt, Mycobacterium bovis subsp bovis AF2122/97
caggcgugcaca

SEQ ID NO: 1200881 - RNA, 21 nt, Mycobacterium bovis subsp bovis AF2122/97
caggcgugcacaggucagcgc

SEQ ID NO: 1200882 - RNA, 14 nt, Mycobacterium bovis subsp bovis AF2122/97
caggcggccgagcu

SEQ ID NO: 1200883 - RNA, 13 nt, Mycobacterium bovis subsp bovis AF2122/97
caggcggccgcca

SEQ ID NO: 1200884 - RNA, 21 nt, Mycobacterium bovis subsp bovis AF2122/97
caggcggccgccgggaaauau

SEQ ID NO: 1200885 - RNA, 13 nt, Mycobacterium bovis subsp bovis AF2122/97
caggcggcuggcc

SEQ ID NO: 1200886 - RNA, 22 nt, Mycobacterium bovis subsp bovis AF2122/97
caggcggcggccuggcacccgg

SEQ ID NO: 1200887 - RNA, 20 nt, Mycobacterium bovis subsp bovis AF2122/97
caggcggcucaaccucuggc

SEQ ID NO: 1200888 - RNA, 15 nt, Mycobacterium bovis subsp bovis AF2122/97
caggcguugaacgca

SEQ ID NO: 1200889 - RNA, 21 nt, Mycobacterium bovis subsp bovis AF2122/97
caggcguuuggcgugccgucg

SEQ ID NO: 1200890 - RNA, 22 nt, Mycobacterium bovis subsp bovis AF2122/97
caggcucacacucggccgggcu

SEQ ID NO: 1200891 - RNA, 17 nt, Mycobacterium bovis subsp bovis AF2122/97
caggcuaaucagccagg

SEQ ID NO: 1200892 - RNA, 22 nt, Mycobacterium bovis subsp bovis AF2122/97
caggcuaaucagccaggccagu

SEQ ID NO: 1200893 - RNA, 20 nt, Mycobacterium bovis subsp bovis AF2122/97
cagggucccgccgccuggaa

SEQ ID NO: 1200894 - RNA, 17 nt, Mycobacterium bovis subsp bovis AF2122/97
cagggucgaguucgcag

SEQ ID NO: 1200895 - RNA, 13 nt, Mycobacterium bovis subsp bovis AF2122/97
cagggucagcugg

SEQ ID NO: 1200896 - RNA, 23 nt, Mycobacterium bovis subsp bovis AF2122/97
caggggugugccguggucgaaga

SEQ ID NO: 1200897 - RNA, 18 nt, Mycobacterium bovis subsp bovis AF2122/97
cagggguggcgcgggccg

SEQ ID NO: 1200898 - RNA, 21 nt, Mycobacterium bovis subsp bovis AF2122/97
caggguauccacgccgggcaa

SEQ ID NO: 1200899 - RNA, 17 nt, Mycobacterium bovis subsp bovis AF2122/97
cagggugcgccgcagca

SEQ ID NO: 1200900 - RNA, 13 nt, Mycobacterium bovis subsp bovis AF2122/97
caggguggccagc

SEQ ID NO: 1200901 - RNA, 12 nt, Mycobacterium bovis subsp bovis AF2122/97
cagggugggcuu

SEQ ID NO: 1200902 - RNA, 10 nt, Mycobacterium bovis subsp bovis AF2122/97
cagggugggc

SEQ ID NO: 1200903 - RNA, 20 nt, Mycobacterium bovis subsp bovis AF2122/97
cagggugccggcgccgcccu

SEQ ID NO: 1200904 - RNA, 16 nt, Mycobacterium bovis subsp bovis AF2122/97
cagggucugcgccgcc

SEQ ID NO: 1200905 - RNA, 13 nt, Mycobacterium bovis subsp bovis AF2122/97
cagggucugcuca

SEQ ID NO: 1200906 - RNA, 14 nt, Mycobacterium bovis subsp bovis AF2122/97
cagggucugcucau

SEQ ID NO: 1200907 - RNA, 15 nt, Mycobacterium bovis subsp bovis AF2122/97
cagggcggccucccc

SEQ ID NO: 1200908 - RNA, 23 nt, Mycobacterium bovis subsp bovis AF2122/97
cagggcggccuccccgaccugca

SEQ ID NO: 1200909 - RNA, 19 nt, Mycobacterium bovis subsp bovis AF2122/97
cagggcggcaacggcggca

SEQ ID NO: 1200910 - RNA, 22 nt, Mycobacterium bovis subsp bovis AF2122/97
cagggcggcguuaccaccguca

SEQ ID NO: 1200911 - RNA, 20 nt, Mycobacterium bovis subsp bovis AF2122/97
cagggcgguggccacccggc

SEQ ID NO: 1200912 - RNA, 15 nt, Mycobacterium bovis subsp bovis AF2122/97
cagggcucggcggcc

SEQ ID NO: 1200913 - RNA, 18 nt, Mycobacterium bovis subsp bovis AF2122/97
cagggcgucgaacucauc

SEQ ID NO: 1200914 - RNA, 22 nt, Mycobacterium bovis subsp bovis AF2122/97
cagggcgucgaccgcggcccgg

SEQ ID NO: 1200915 - RNA, 14 nt, Mycobacterium bovis subsp bovis AF2122/97
caggggcuggugcu

SEQ ID NO: 1200916 - RNA, 12 nt, Mycobacterium bovis subsp bovis AF2122/97
cagggccaccgc

SEQ ID NO: 1200917 - RNA, 12 nt, Mycobacterium bovis subsp bovis AF2122/97
cagggcagcggc

SEQ ID NO: 1200918 - RNA, 17 nt, Mycobacterium bovis subsp bovis AF2122/97
cagggcaucagcagagc

SEQ ID NO: 1200919 - RNA, 21 nt, Mycobacterium bovis subsp bovis AF2122/97
cagggcaucggucucgcacca

SEQ ID NO: 1200920 - RNA, 15 nt, Mycobacterium bovis subsp bovis AF2122/97
cagggagcggcugca

SEQ ID NO: 1200921 - RNA, 20 nt, Mycobacterium bovis subsp bovis AF2122/97
cagggcacguucggcgcaca

SEQ ID NO: 1200922 - RNA, 16 nt, Mycobacterium bovis subsp bovis AF2122/97
cagggcaacggccgcu

SEQ ID NO: 1200923 - RNA, 19 nt, Mycobacterium bovis subsp bovis AF2122/97
caggcucauccgccgggcc

SEQ ID NO: 1200924 - RNA, 23 nt, Mycobacterium bovis subsp bovis AF2122/97
caggcucauccgccgggccaggc

SEQ ID NO: 1200925 - RNA, 23 nt, Mycobacterium bovis subsp bovis AF2122/97
caggcucgagguguagcccuccg

SEQ ID NO: 1200926 - RNA, 17 nt, Mycobacterium bovis subsp bovis AF2122/97
cagggacgaacugcuga

SEQ ID NO: 1200927 - RNA, 12 nt, Mycobacterium bovis subsp bovis AF2122/97
cagggacccgag

SEQ ID NO: 1200928 - RNA, 13 nt, Mycobacterium bovis subsp bovis AF2122/97
cagggacccgaga

SEQ ID NO: 1200929 - RNA, 14 nt, Mycobacterium bovis subsp bovis AF2122/97
cagggccgcgcgca

SEQ ID NO: 1200930 - RNA, 16 nt, Mycobacterium bovis subsp bovis AF2122/97
cagggccgccgaagcu

SEQ ID NO: 1200931 - RNA, 20 nt, Mycobacterium bovis subsp bovis AF2122/97
cagggccgccgcgaacgggu

SEQ ID NO: 1200932 - RNA, 15 nt, Mycobacterium bovis subsp bovis AF2122/97
cagggcccuagccgg

SEQ ID NO: 1200933 - RNA, 12 nt, Mycobacterium bovis subsp bovis AF2122/97
cagggcccugcu

SEQ ID NO: 1200934 - RNA, 17 nt, Mycobacterium bovis subsp bovis AF2122/97
cagggcccuagccggcg

SEQ ID NO: 1200935 - RNA, 21 nt, Mycobacterium bovis subsp bovis AF2122/97
cagggcccuagccggcgcgcc

SEQ ID NO: 1200936 - RNA, 15 nt, Mycobacterium bovis subsp bovis AF2122/97
cagggcccugcuggc

SEQ ID NO: 1200937 - RNA, 18 nt, Mycobacterium bovis subsp bovis AF2122/97
cagggcccugcuggccca

SEQ ID NO: 1200938 - RNA, 16 nt, Mycobacterium bovis subsp bovis AF2122/97
cagggccgacgcgaac

SEQ ID NO: 1200939 - RNA, 12 nt, Mycobacterium bovis subsp bovis AF2122/97
cagggccgagca

SEQ ID NO: 1200940 - RNA, 17 nt, Mycobacterium bovis subsp bovis AF2122/97
cagggccagcggcagcc

SEQ ID NO: 1200941 - RNA, 17 nt, Mycobacterium bovis subsp bovis AF2122/97
cagggccagaucgccgg

SEQ ID NO: 1200942 - RNA, 18 nt, Mycobacterium bovis subsp bovis AF2122/97
cagggcgcaaaccacccg

SEQ ID NO: 1200943 - RNA, 14 nt, Mycobacterium bovis subsp bovis AF2122/97
cagggccuggaaga

SEQ ID NO: 1200944 - RNA, 15 nt, Mycobacterium bovis subsp bovis AF2122/97
cagggccuccacccg

SEQ ID NO: 1200945 - RNA, 22 nt, Mycobacterium bovis subsp bovis AF2122/97
cagggccgcucgccucgauggc

SEQ ID NO: 1200946 - RNA, 15 nt, Mycobacterium bovis subsp bovis AF2122/97
cagggccuggccaca

SEQ ID NO: 1200947 - RNA, 22 nt, Mycobacterium bovis subsp bovis AF2122/97
cagggccuugaucggcacaugc

SEQ ID NO: 1200948 - RNA, 14 nt, Mycobacterium bovis subsp bovis AF2122/97
cagcggcgccacgu

SEQ ID NO: 1200949 - RNA, 17 nt, Mycobacterium bovis subsp bovis AF2122/97
cagcggcgaucaggcgg

SEQ ID NO: 1200950 - RNA, 23 nt, Mycobacterium bovis subsp bovis AF2122/97
cagcggcgaucggaggcccgcca

SEQ ID NO: 1200951 - RNA, 16 nt, Mycobacterium bovis subsp bovis AF2122/97
cagcggccgggcggcc

SEQ ID NO: 1200952 - RNA, 17 nt, Mycobacterium bovis subsp bovis AF2122/97
cagcggccuccgggcca

SEQ ID NO: 1200953 - RNA, 13 nt, Mycobacterium bovis subsp bovis AF2122/97
cagcggccgcucc

SEQ ID NO: 1200954 - RNA, 17 nt, Mycobacterium bovis subsp bovis AF2122/97
cagcggccgcuccaccu

SEQ ID NO: 1200955 - RNA, 18 nt, Mycobacterium bovis subsp bovis AF2122/97
cagcggcgccgccaaggg

SEQ ID NO: 1200956 - RNA, 15 nt, Mycobacterium bovis subsp bovis AF2122/97
cagcggcgcgcugca

SEQ ID NO: 1200957 - RNA, 21 nt, Mycobacterium bovis subsp bovis AF2122/97
cagcggcggaaggacggcagc

SEQ ID NO: 1200958 - RNA, 18 nt, Mycobacterium bovis subsp bovis AF2122/97
cagcggcggccacggcca

SEQ ID NO: 1200959 - RNA, 23 nt, Mycobacterium bovis subsp bovis AF2122/97
cagcggcggcaacccugcccggc

SEQ ID NO: 1200960 - RNA, 20 nt, Mycobacterium bovis subsp bovis AF2122/97
cagcggcgguaugcucgcug

SEQ ID NO: 1200961 - RNA, 21 nt, Mycobacterium bovis subsp bovis AF2122/97
cagcggcgguaugcucgcugg

SEQ ID NO: 1200962 - RNA, 17 nt, Mycobacterium bovis subsp bovis AF2122/97
cagcuagaccgaucacc

SEQ ID NO: 1200963 - RNA, 12 nt, Mycobacterium bovis subsp bovis AF2122/97
cagcggcugggc

SEQ ID NO: 1200964 - RNA, 13 nt, Mycobacterium bovis subsp bovis AF2122/97
cagcuagcccggc

SEQ ID NO: 1200965 - RNA, 16 nt, Mycobacterium bovis subsp bovis AF2122/97
cagcuaugucaccugg

SEQ ID NO: 1200966 - RNA, 14 nt, Mycobacterium bovis subsp bovis AF2122/97
cagcuccauccccu

SEQ ID NO: 1200967 - RNA, 22 nt, Mycobacterium bovis subsp bovis AF2122/97
cagcuccagcaaaacccgcucc

SEQ ID NO: 1200968 - RNA, 12 nt, Mycobacterium bovis subsp bovis AF2122/97
cagcucgccggc

SEQ ID NO: 1200969 - RNA, 13 nt, Mycobacterium bovis subsp bovis AF2122/97
cagcuccuccgac

SEQ ID NO: 1200970 - RNA, 18 nt, Mycobacterium bovis subsp bovis AF2122/97
cagcucgcgcacccagcc

SEQ ID NO: 1200971 - RNA, 14 nt, Mycobacterium bovis subsp bovis AF2122/97
cagcuccucagcca

SEQ ID NO: 1200972 - RNA, 18 nt, Mycobacterium bovis subsp bovis AF2122/97
cagcuccucagccaccgc

SEQ ID NO: 1200973 - RNA, 19 nt, Mycobacterium bovis subsp bovis AF2122/97
cagcuccucagccaccgcg

SEQ ID NO: 1200974 - RNA, 14 nt, Mycobacterium bovis subsp bovis AF2122/97
cagcuccggcgcuc

SEQ ID NO: 1200975 - RNA, 19 nt, Mycobacterium bovis subsp bovis AF2122/97
cagcucccgggcggcggcc

SEQ ID NO: 1200976 - RNA, 16 nt, Mycobacterium bovis subsp bovis AF2122/97
cagcuccccgaccgaa

SEQ ID NO: 1200977 - RNA, 15 nt, Mycobacterium bovis subsp bovis AF2122/97
cagcucgcgcucgcu

SEQ ID NO: 1200978 - RNA, 16 nt, Mycobacterium bovis subsp bovis AF2122/97
cagcucggccgaggcg

SEQ ID NO: 1200979 - RNA, 20 nt, Mycobacterium bovis subsp bovis AF2122/97
cagcucggccgaggcggucu

SEQ ID NO: 1200980 - RNA, 21 nt, Mycobacterium bovis subsp bovis AF2122/97
cagcucgggggcgccggcgcc

SEQ ID NO: 1200981 - RNA, 14 nt, Mycobacterium bovis subsp bovis AF2122/97
cagcucggugacaa

SEQ ID NO: 1200982 - RNA, 15 nt, Mycobacterium bovis subsp bovis AF2122/97
cagcucgggcaugaa

SEQ ID NO: 1200983 - RNA, 20 nt, Mycobacterium bovis subsp bovis AF2122/97
cagcucggcggcagcggcgg

SEQ ID NO: 1200984 - RNA, 16 nt, Mycobacterium bovis subsp bovis AF2122/97
cagcucggcacccgcc

SEQ ID NO: 1200985 - RNA, 16 nt, Mycobacterium bovis subsp bovis AF2122/97
cagcucggccagugcc

SEQ ID NO: 1200986 - RNA, 20 nt, Mycobacterium bovis subsp bovis AF2122/97
cagcucgucggcgauggcca

SEQ ID NO: 1200987 - RNA, 16 nt, Mycobacterium bovis subsp bovis AF2122/97
cagcucgucgcugaac

SEQ ID NO: 1200988 - RNA, 11 nt, Mycobacterium bovis subsp bovis AF2122/97
cagcugcucgu

SEQ ID NO: 1200989 - RNA, 14 nt, Mycobacterium bovis subsp bovis AF2122/97
cagcugcugccgau

SEQ ID NO: 1200990 - RNA, 19 nt, Mycobacterium bovis subsp bovis AF2122/97
cagcugcugccgauacagc

SEQ ID NO: 1200991 - RNA, 12 nt, Mycobacterium bovis subsp bovis AF2122/97
cagcuggccacu

SEQ ID NO: 1200992 - RNA, 21 nt, Mycobacterium bovis subsp bovis AF2122/97
cagcuggcgaaugcgggccuc

SEQ ID NO: 1200993 - RNA, 21 nt, Mycobacterium bovis subsp bovis AF2122/97
cagcuggcgauacagcgacag

SEQ ID NO: 1200994 - RNA, 17 nt, Mycobacterium bovis subsp bovis AF2122/97
cagcuggcgcagccugc

SEQ ID NO: 1200995 - RNA, 15 nt, Mycobacterium bovis subsp bovis AF2122/97
cagcuggcgcagccu

SEQ ID NO: 1200996 - RNA, 16 nt, Mycobacterium bovis subsp bovis AF2122/97
cagcuggacuccgguc

SEQ ID NO: 1200997 - RNA, 18 nt, Mycobacterium bovis subsp bovis AF2122/97
cagcuguugucgcggaag

SEQ ID NO: 1200998 - RNA, 15 nt, Mycobacterium bovis subsp bovis AF2122/97
cagcugucgggcagc

SEQ ID NO: 1200999 - RNA, 22 nt, Mycobacterium bovis subsp bovis AF2122/97
cagcuuagccgcagcuuggccu

SEQ ID NO: 1201000 - RNA, 14 nt, Mycobacterium bovis subsp bovis AF2122/97
caggaccagcaccg

SEQ ID NO: 1201001 - RNA, 17 nt, Mycobacterium bovis subsp bovis AF2122/97
caggaccagcaccgccg

SEQ ID NO: 1201002 - RNA, 21 nt, Mycobacterium bovis subsp bovis AF2122/97
caggacgcccacaugcucagg

SEQ ID NO: 1201003 - RNA, 11 nt, Mycobacterium bovis subsp bovis AF2122/97
caggaauugcc

SEQ ID NO: 1201004 - RNA, 15 nt, Mycobacterium bovis subsp bovis AF2122/97
caggaagucgagcag

SEQ ID NO: 1201005 - RNA, 21 nt, Mycobacterium bovis subsp bovis AF2122/97
caggaagauuucugggccgcu

SEQ ID NO: 1201006 - RNA, 12 nt, Mycobacterium bovis subsp bovis AF2122/97
caggaagcccac

SEQ ID NO: 1201007 - RNA, 16 nt, Mycobacterium bovis subsp bovis AF2122/97
caggaagcccacgauc

SEQ ID NO: 1201008 - RNA, 22 nt, Mycobacterium bovis subsp bovis AF2122/97
cagcuugcccgagcccagccgg

SEQ ID NO: 1201009 - RNA, 13 nt, Mycobacterium bovis subsp bovis AF2122/97
cagcuugacccac

SEQ ID NO: 1201010 - RNA, 20 nt, Mycobacterium bovis subsp bovis AF2122/97
cagcuugaugucuuuggcgu

SEQ ID NO: 1201011 - RNA, 14 nt, Mycobacterium bovis subsp bovis AF2122/97
caggacgcgggcua

SEQ ID NO: 1201012 - RNA, 16 nt, Mycobacterium bovis subsp bovis AF2122/97
caggacguggucggga

SEQ ID NO: 1201013 - RNA, 16 nt, Mycobacterium bovis subsp bovis AF2122/97
caggacuccggccgca

SEQ ID NO: 1201014 - RNA, 23 nt, Mycobacterium bovis subsp bovis AF2122/97
caggacuggcaccgccagccacc

SEQ ID NO: 1201015 - RNA, 18 nt, Mycobacterium bovis subsp bovis AF2122/97
caggacuggcaccgccag

SEQ ID NO: 1201016 - RNA, 22 nt, Mycobacterium bovis subsp bovis AF2122/97
caggagcaccucgaagugcagg

SEQ ID NO: 1201017 - RNA, 21 nt, Mycobacterium bovis subsp bovis AF2122/97
caggagaauuaguuucguccc

SEQ ID NO: 1201018 - RNA, 19 nt, Mycobacterium bovis subsp bovis AF2122/97
caggagacgguacgccagu

SEQ ID NO: 1201019 - RNA, 18 nt, Mycobacterium bovis subsp bovis AF2122/97
caggagguugggaacagc

SEQ ID NO: 1201020 - RNA, 15 nt, Mycobacterium bovis subsp bovis AF2122/97
caggaguggccacgu

SEQ ID NO: 1201021 - RNA, 18 nt, Mycobacterium bovis subsp bovis AF2122/97
caggaguuugaccaccug

SEQ ID NO: 1201022 - RNA, 15 nt, Mycobacterium bovis subsp bovis AF2122/97
caggagcgugucggc

SEQ ID NO: 1201023 - RNA, 16 nt, Mycobacterium bovis subsp bovis AF2122/97
caggagcgugucggcc

SEQ ID NO: 1201024 - RNA, 18 nt, Mycobacterium bovis subsp bovis AF2122/97
caggagcgcggcccgccu

SEQ ID NO: 1201025 - RNA, 20 nt, Mycobacterium bovis subsp bovis AF2122/97
caggagcgccgucaucgcag

SEQ ID NO: 1201026 - RNA, 20 nt, Mycobacterium bovis subsp bovis AF2122/97
caggaucuguuugggcaucu

SEQ ID NO: 1201027 - RNA, 17 nt, Mycobacterium bovis subsp bovis AF2122/97
caggaucucuucucggc

SEQ ID NO: 1201028 - RNA, 22 nt, Mycobacterium bovis subsp bovis AF2122/97
caggauggugcggccgcggcga

SEQ ID NO: 1201029 - RNA, 20 nt, Mycobacterium bovis subsp bovis AF2122/97
caggaucgcuacgucgaccg

SEQ ID NO: 1201030 - RNA, 14 nt, Mycobacterium bovis subsp bovis AF2122/97
caggaucgccugag

SEQ ID NO: 1201031 - RNA, 21 nt, Mycobacterium bovis subsp bovis AF2122/97
caggaucgccugagcgccgcg

SEQ ID NO: 1201032 - RNA, 22 nt, Mycobacterium bovis subsp bovis AF2122/97
caggaucgccugagcgccgcgg

SEQ ID NO: 1201033 - RNA, 14 nt, Mycobacterium bovis subsp bovis AF2122/97
caggaucgcggcgc

SEQ ID NO: 1201034 - RNA, 17 nt, Mycobacterium bovis subsp bovis AF2122/97
caggaucgcggcgccgu

SEQ ID NO: 1201035 - RNA, 14 nt, Mycobacterium bovis subsp bovis AF2122/97
caggauucccaguc

SEQ ID NO: 1201036 - RNA, 19 nt, Mycobacterium bovis subsp bovis AF2122/97
caggauucugcugaccaug

SEQ ID NO: 1201037 - RNA, 16 nt, Mycobacterium bovis subsp bovis AF2122/97
caggauguucaauccc

SEQ ID NO: 1201038 - RNA, 20 nt, Mycobacterium bovis subsp bovis AF2122/97
cagucguacucccaggccgc

SEQ ID NO: 1201039 - RNA, 14 nt, Mycobacterium bovis subsp bovis AF2122/97
cagucggcgccgcc

SEQ ID NO: 1201040 - RNA, 17 nt, Mycobacterium bovis subsp bovis AF2122/97
cagucgccggccggccc

SEQ ID NO: 1201041 - RNA, 12 nt, Mycobacterium bovis subsp bovis AF2122/97
cagucgcgcgcu

SEQ ID NO: 1201042 - RNA, 18 nt, Mycobacterium bovis subsp bovis AF2122/97
cagucgcgcgcucgcggc

SEQ ID NO: 1201043 - RNA, 22 nt, Mycobacterium bovis subsp bovis AF2122/97
cagucgcgguaccaucaccgcg

SEQ ID NO: 1201044 - RNA, 23 nt, Mycobacterium bovis subsp bovis AF2122/97
cagucgcuggguggcgggccgga

SEQ ID NO: 1201045 - RNA, 14 nt, Mycobacterium bovis subsp bovis AF2122/97
cagucgagcaccug

SEQ ID NO: 1201046 - RNA, 15 nt, Mycobacterium bovis subsp bovis AF2122/97
cagucgaugagugac

SEQ ID NO: 1201047 - RNA, 21 nt, Mycobacterium bovis subsp bovis AF2122/97
cagucgaugagugacgguccg

SEQ ID NO: 1201048 - RNA, 19 nt, Mycobacterium bovis subsp bovis AF2122/97
cagucgaugucaaggaaca

SEQ ID NO: 1201049 - RNA, 21 nt, Mycobacterium bovis subsp bovis AF2122/97
cagucgaugucaaggaacagu

SEQ ID NO: 1201050 - RNA, 22 nt, Mycobacterium bovis subsp bovis AF2122/97
cagucgaccggacacuccugca

SEQ ID NO: 1201051 - RNA, 21 nt, Mycobacterium bovis subsp bovis AF2122/97
cagucaggccuagcgcggcga

SEQ ID NO: 1201052 - RNA, 18 nt, Mycobacterium bovis subsp bovis AF2122/97
cagugcaggcggccgcca

SEQ ID NO: 1201053 - RNA, 15 nt, Mycobacterium bovis subsp bovis AF2122/97
cagugcaucggucag

SEQ ID NO: 1201054 - RNA, 16 nt, Mycobacterium bovis subsp bovis AF2122/97
cagugcagacaggcgg

SEQ ID NO: 1201055 - RNA, 20 nt, Mycobacterium bovis subsp bovis AF2122/97
cagugcaucgaucaccgcuu

SEQ ID NO: 1201056 - RNA, 20 nt, Mycobacterium bovis subsp bovis AF2122/97
cagugccagaacccggacag

SEQ ID NO: 1201057 - RNA, 22 nt, Mycobacterium bovis subsp bovis AF2122/97
cagugccagaacccggacaggg

SEQ ID NO: 1201058 - RNA, 19 nt, Mycobacterium bovis subsp bovis AF2122/97
cagugccaccugggcgggc

SEQ ID NO: 1201059 - RNA, 19 nt, Mycobacterium bovis subsp bovis AF2122/97
cagugccaggugggugaac

SEQ ID NO: 1201060 - RNA, 12 nt, Mycobacterium bovis subsp bovis AF2122/97
cagugcugccuu

SEQ ID NO: 1201061 - RNA, 13 nt, Mycobacterium bovis subsp bovis AF2122/97
caguggcgacgag

SEQ ID NO: 1201062 - RNA, 17 nt, Mycobacterium bovis subsp bovis AF2122/97
caguggcagccagcggc

SEQ ID NO: 1201063 - RNA, 17 nt, Mycobacterium bovis subsp bovis AF2122/97
caguggaugcauacacg

SEQ ID NO: 1201064 - RNA, 14 nt, Mycobacterium bovis subsp bovis AF2122/97
cagugacgccacga

SEQ ID NO: 1201065 - RNA, 17 nt, Mycobacterium bovis subsp bovis AF2122/97
cagugcacccgggccgc

SEQ ID NO: 1201066 - RNA, 16 nt, Mycobacterium bovis subsp bovis AF2122/97
cagugcaccgcgucgu

SEQ ID NO: 1201067 - RNA, 22 nt, Mycobacterium bovis subsp bovis AF2122/97
cagugaccugggcgccccaggg

SEQ ID NO: 1201068 - RNA, 18 nt, Mycobacterium bovis subsp bovis AF2122/97
cagugaccgcuggugugu

SEQ ID NO: 1201069 - RNA, 14 nt, Mycobacterium bovis subsp bovis AF2122/97
cagugaacauuggg

SEQ ID NO: 1201070 - RNA, 17 nt, Mycobacterium bovis subsp bovis AF2122/97
cagugaagacaccaggc

SEQ ID NO: 1201071 - RNA, 22 nt, Mycobacterium bovis subsp bovis AF2122/97
cagugaagacaccaggcccggu

SEQ ID NO: 1201072 - RNA, 23 nt, Mycobacterium bovis subsp bovis AF2122/97
caguacgucgaucaacaggucua

SEQ ID NO: 1201073 - RNA, 23 nt, Mycobacterium bovis subsp bovis AF2122/97
caguacuaacaacaccaccagca

SEQ ID NO: 1201074 - RNA, 15 nt, Mycobacterium bovis subsp bovis AF2122/97
caguagccacgccca

SEQ ID NO: 1201075 - RNA, 19 nt, Mycobacterium bovis subsp bovis AF2122/97
cagucaacucccgaacacu

SEQ ID NO: 1201076 - RNA, 18 nt, Mycobacterium bovis subsp bovis AF2122/97
cagucaacagggccagga

SEQ ID NO: 1201077 - RNA, 14 nt, Mycobacterium bovis subsp bovis AF2122/97
cagguugccgucgg

SEQ ID NO: 1201078 - RNA, 22 nt, Mycobacterium bovis subsp bovis AF2122/97
cagguugcccgguggaaugcca

SEQ ID NO: 1201079 - RNA, 23 nt, Mycobacterium bovis subsp bovis AF2122/97
cagguguugcacgagcaucauug

SEQ ID NO: 1201080 - RNA, 17 nt, Mycobacterium bovis subsp bovis AF2122/97
caggugucgcugcugaa

SEQ ID NO: 1201081 - RNA, 17 nt, Mycobacterium bovis subsp bovis AF2122/97
cagguuggucaccaccu

SEQ ID NO: 1201082 - RNA, 19 nt, Mycobacterium bovis subsp bovis AF2122/97
cagguuggugcucagcggc

SEQ ID NO: 1201083 - RNA, 19 nt, Mycobacterium bovis subsp bovis AF2122/97
cagguugcguugcaggaaa

SEQ ID NO: 1201084 - RNA, 20 nt, Mycobacterium bovis subsp bovis AF2122/97
cagguugcguugcaggaaag

SEQ ID NO: 1201085 - RNA, 20 nt, Mycobacterium bovis subsp bovis AF2122/97
cagguuggcggcugcacgcu

SEQ ID NO: 1201086 - RNA, 15 nt, Mycobacterium bovis subsp bovis AF2122/97
cagguuggccccggc

SEQ ID NO: 1201087 - RNA, 18 nt, Mycobacterium bovis subsp bovis AF2122/97
cagguuggagcccgagcu

SEQ ID NO: 1201088 - RNA, 13 nt, Mycobacterium bovis subsp bovis AF2122/97
cagguuggcaagc

SEQ ID NO: 1201089 - RNA, 15 nt, Mycobacterium bovis subsp bovis AF2122/97
cagguuggccaccgc

SEQ ID NO: 1201090 - RNA, 14 nt, Mycobacterium bovis subsp bovis AF2122/97
caggugcucgucga

SEQ ID NO: 1201091 - RNA, 16 nt, Mycobacterium bovis subsp bovis AF2122/97
cagguggccgucgccg

SEQ ID NO: 1201092 - RNA, 12 nt, Mycobacterium bovis subsp bovis AF2122/97
caggugggcagc

SEQ ID NO: 1201093 - RNA, 15 nt, Mycobacterium bovis subsp bovis AF2122/97
caggugggcagcagg

SEQ ID NO: 1201094 - RNA, 18 nt, Mycobacterium bovis subsp bovis AF2122/97
caggugggccgagagcag

SEQ ID NO: 1201095 - RNA, 22 nt, Mycobacterium bovis subsp bovis AF2122/97
cagguggcuguucaccucuugg

SEQ ID NO: 1201096 - RNA, 18 nt, Mycobacterium bovis subsp bovis AF2122/97
cagggugugcgaacaagu

SEQ ID NO: 1201097 - RNA, 21 nt, Mycobacterium bovis subsp bovis AF2122/97
caggguguucacguucagccc

SEQ ID NO: 1201098 - RNA, 20 nt, Mycobacterium bovis subsp bovis AF2122/97
caggguguuuauggcccugg

SEQ ID NO: 1201099 - RNA, 23 nt, Mycobacterium bovis subsp bovis AF2122/97
caggguguuuauggcccugggcc

SEQ ID NO: 1201100 - RNA, 20 nt, Mycobacterium bovis subsp bovis AF2122/97
caggguugccccgaagcggg

SEQ ID NO: 1201101 - RNA, 20 nt, Mycobacterium bovis subsp bovis AF2122/97
cagggugucgaagagcaggc

SEQ ID NO: 1201102 - RNA, 15 nt, Mycobacterium bovis subsp bovis AF2122/97
caguugguagagcac

SEQ ID NO: 1201103 - RNA, 14 nt, Mycobacterium bovis subsp bovis AF2122/97
caguuggcagcgcu

SEQ ID NO: 1201104 - RNA, 15 nt, Mycobacterium bovis subsp bovis AF2122/97
caguuggcaccagcc

SEQ ID NO: 1201105 - RNA, 15 nt, Mycobacterium bovis subsp bovis AF2122/97
caguugcgcuccaac

SEQ ID NO: 1201106 - RNA, 17 nt, Mycobacterium bovis subsp bovis AF2122/97
caguuggaacugaugaa

SEQ ID NO: 1201107 - RNA, 21 nt, Mycobacterium bovis subsp bovis AF2122/97
caguugcccgacgccggucac

SEQ ID NO: 1201108 - RNA, 18 nt, Mycobacterium bovis subsp bovis AF2122/97
caguugccgguugccacc

SEQ ID NO: 1201109 - RNA, 17 nt, Mycobacterium bovis subsp bovis AF2122/97
caguugcacaccgaucg

SEQ ID NO: 1201110 - RNA, 18 nt, Mycobacterium bovis subsp bovis AF2122/97
cagugucgauagcccgcc

SEQ ID NO: 1201111 - RNA, 14 nt, Mycobacterium bovis subsp bovis AF2122/97
cagugucucacaaa

SEQ ID NO: 1201112 - RNA, 16 nt, Mycobacterium bovis subsp bovis AF2122/97
cagugugggggucagg

SEQ ID NO: 1201113 - RNA, 14 nt, Mycobacterium bovis subsp bovis AF2122/97
caguuaaagguggu

SEQ ID NO: 1201114 - RNA, 21 nt, Mycobacterium bovis subsp bovis AF2122/97
caguguugcgcugcggccagc

SEQ ID NO: 1201115 - RNA, 20 nt, Mycobacterium bovis subsp bovis AF2122/97
caguugaucaggccgaugcg

SEQ ID NO: 1201116 - RNA, 20 nt, Mycobacterium bovis subsp bovis AF2122/97
caguucuugauuagccauua

SEQ ID NO: 1201117 - RNA, 12 nt, Mycobacterium bovis subsp bovis AF2122/97
cauacacgguag

SEQ ID NO: 1201118 - RNA, 15 nt, Mycobacterium bovis subsp bovis AF2122/97
cauaacugcggccca

SEQ ID NO: 1201119 - RNA, 16 nt, Mycobacterium bovis subsp bovis AF2122/97
cauaaccggcgcgccc

SEQ ID NO: 1201120 - RNA, 15 nt, Mycobacterium bovis subsp bovis AF2122/97
cauacagcgcccgga

SEQ ID NO: 1201121 - RNA, 21 nt, Mycobacterium bovis subsp bovis AF2122/97
cauacagcgggcgcuguaguc

SEQ ID NO: 1201122 - RNA, 21 nt, Mycobacterium bovis subsp bovis AF2122/97
cauacaggcccgccagcaggg

SEQ ID NO: 1201123 - RNA, 20 nt, Mycobacterium bovis subsp bovis AF2122/97
cauacaucgccuugcccagc

SEQ ID NO: 1201124 - RNA, 16 nt, Mycobacterium bovis subsp bovis AF2122/97
cauaccccgaacauug

SEQ ID NO: 1201125 - RNA, 18 nt, Mycobacterium bovis subsp bovis AF2122/97
cauacgcccacuccagca

SEQ ID NO: 1201126 - RNA, 15 nt, Mycobacterium bovis subsp bovis AF2122/97
cauacgaaacaugcg

SEQ ID NO: 1201127 - RNA, 18 nt, Mycobacterium bovis subsp bovis AF2122/97
cauacgcggcuuugacgc

SEQ ID NO: 1201128 - RNA, 20 nt, Mycobacterium bovis subsp bovis AF2122/97
cauaccuaacgagccgucca

SEQ ID NO: 1201129 - RNA, 13 nt, Mycobacterium bovis subsp bovis AF2122/97
cauaccgccgcug

SEQ ID NO: 1201130 - RNA, 16 nt, Mycobacterium bovis subsp bovis AF2122/97
cauaccgccgcugcca

SEQ ID NO: 1201131 - RNA, 18 nt, Mycobacterium bovis subsp bovis AF2122/97
cauaccggcuggccaggu

SEQ ID NO: 1201132 - RNA, 22 nt, Mycobacterium bovis subsp bovis AF2122/97
cauaucgugaugugcccauuca

SEQ ID NO: 1201133 - RNA, 12 nt, Mycobacterium bovis subsp bovis AF2122/97
caucaacugcau

SEQ ID NO: 1201134 - RNA, 14 nt, Mycobacterium bovis subsp bovis AF2122/97
caucaaggccaccu

SEQ ID NO: 1201135 - RNA, 21 nt, Mycobacterium bovis subsp bovis AF2122/97
caucaccgaccaacgcggugu

SEQ ID NO: 1201136 - RNA, 13 nt, Mycobacterium bovis subsp bovis AF2122/97
caucaccccggcc

SEQ ID NO: 1201137 - RNA, 22 nt, Mycobacterium bovis subsp bovis AF2122/97
caucaaaaacgaacccaggcac

SEQ ID NO: 1201138 - RNA, 21 nt, Mycobacterium bovis subsp bovis AF2122/97
caucaaaaacgaacccaggca

SEQ ID NO: 1201139 - RNA, 14 nt, Mycobacterium bovis subsp bovis AF2122/97
caucaucucggugg

SEQ ID NO: 1201140 - RNA, 22 nt, Mycobacterium bovis subsp bovis AF2122/97
caucaucuggucgaccaucggu

SEQ ID NO: 1201141 - RNA, 17 nt, Mycobacterium bovis subsp bovis AF2122/97
cauccaaaaucgccuga

SEQ ID NO: 1201142 - RNA, 14 nt, Mycobacterium bovis subsp bovis AF2122/97
cauccacgucgccc

SEQ ID NO: 1201143 - RNA, 11 nt, Mycobacterium bovis subsp bovis AF2122/97
caucacgcccu

SEQ ID NO: 1201144 - RNA, 18 nt, Mycobacterium bovis subsp bovis AF2122/97
caucacgcacugauguca

SEQ ID NO: 1201145 - RNA, 24 nt, Mycobacterium bovis subsp bovis AF2122/97
caucaccgcgccagccuccaccag

SEQ ID NO: 1201146 - RNA, 16 nt, Mycobacterium bovis subsp bovis AF2122/97
caucaccgccagcccc

SEQ ID NO: 1201147 - RNA, 20 nt, Mycobacterium bovis subsp bovis AF2122/97
caucaccgccagccccgcgc

SEQ ID NO: 1201148 - RNA, 16 nt, Mycobacterium bovis subsp bovis AF2122/97
caucacggaccaggcc

SEQ ID NO: 1201149 - RNA, 12 nt, Mycobacterium bovis subsp bovis AF2122/97
caucacggucag

SEQ ID NO: 1201150 - RNA, 16 nt, Mycobacterium bovis subsp bovis AF2122/97
caucacggcggggauc

SEQ ID NO: 1201151 - RNA, 23 nt, Mycobacterium bovis subsp bovis AF2122/97
caucacggcggggaucgcuggcc

SEQ ID NO: 1201152 - RNA, 20 nt, Mycobacterium bovis subsp bovis AF2122/97
caucagcccuucagcgaagc

SEQ ID NO: 1201153 - RNA, 15 nt, Mycobacterium bovis subsp bovis AF2122/97
caucagccgcaccag

SEQ ID NO: 1201154 - RNA, 15 nt, Mycobacterium bovis subsp bovis AF2122/97
caucagccgcugcgu

SEQ ID NO: 1201155 - RNA, 18 nt, Mycobacterium bovis subsp bovis AF2122/97
caucagcgacaagugcac

SEQ ID NO: 1201156 - RNA, 16 nt, Mycobacterium bovis subsp bovis AF2122/97
caucagguuguacagg

SEQ ID NO: 1201157 - RNA, 16 nt, Mycobacterium bovis subsp bovis AF2122/97
caucaggugcgccugg

SEQ ID NO: 1201158 - RNA, 17 nt, Mycobacterium bovis subsp bovis AF2122/97
caucaguuugacgccga

SEQ ID NO: 1201159 - RNA, 13 nt, Mycobacterium bovis subsp bovis AF2122/97
caucgcggcggcg

SEQ ID NO: 1201160 - RNA, 19 nt, Mycobacterium bovis subsp bovis AF2122/97
caucgcgggugaucuccac

SEQ ID NO: 1201161 - RNA, 20 nt, Mycobacterium bovis subsp bovis AF2122/97
caucgcgggugaucuccacc

SEQ ID NO: 1201162 - RNA, 21 nt, Mycobacterium bovis subsp bovis AF2122/97
caucgcgggugaucuccaccg

SEQ ID NO: 1201163 - RNA, 16 nt, Mycobacterium bovis subsp bovis AF2122/97
caucgcgggcggcgcu

SEQ ID NO: 1201164 - RNA, 19 nt, Mycobacterium bovis subsp bovis AF2122/97
caucgcggccgcugggccc

SEQ ID NO: 1201165 - RNA, 22 nt, Mycobacterium bovis subsp bovis AF2122/97
caucgcggcaucgacgcggcca

SEQ ID NO: 1201166 - RNA, 17 nt, Mycobacterium bovis subsp bovis AF2122/97
caucgcgcggaccagag

SEQ ID NO: 1201167 - RNA, 20 nt, Mycobacterium bovis subsp bovis AF2122/97
caucgcgcugcggcccacac

SEQ ID NO: 1201168 - RNA, 15 nt, Mycobacterium bovis subsp bovis AF2122/97
caucgcgaugcaacu

SEQ ID NO: 1201169 - RNA, 14 nt, Mycobacterium bovis subsp bovis AF2122/97
caucgcgcgcggcu

SEQ ID NO: 1201170 - RNA, 22 nt, Mycobacterium bovis subsp bovis AF2122/97
caucgcgcaaccgggcggacag

SEQ ID NO: 1201171 - RNA, 19 nt, Mycobacterium bovis subsp bovis AF2122/97
caucgcgauuccggcggcc

SEQ ID NO: 1201172 - RNA, 17 nt, Mycobacterium bovis subsp bovis AF2122/97
caucgcgacggcaagca

SEQ ID NO: 1201173 - RNA, 20 nt, Mycobacterium bovis subsp bovis AF2122/97
caucgacuugccgccgcaca

SEQ ID NO: 1201174 - RNA, 19 nt, Mycobacterium bovis subsp bovis AF2122/97
caucgacccgaucacgcug

SEQ ID NO: 1201175 - RNA, 17 nt, Mycobacterium bovis subsp bovis AF2122/97
caucgaccgcggccggg

SEQ ID NO: 1201176 - RNA, 22 nt, Mycobacterium bovis subsp bovis AF2122/97
caucgagcccggacgagugcac

SEQ ID NO: 1201177 - RNA, 19 nt, Mycobacterium bovis subsp bovis AF2122/97
caucgaggcgaucaccgcg

SEQ ID NO: 1201178 - RNA, 21 nt, Mycobacterium bovis subsp bovis AF2122/97
caucgaggucguuucccuggc

SEQ ID NO: 1201179 - RNA, 15 nt, Mycobacterium bovis subsp bovis AF2122/97
caucgaguccaccac

SEQ ID NO: 1201180 - RNA, 17 nt, Mycobacterium bovis subsp bovis AF2122/97
caucgaguccaccaccu

SEQ ID NO: 1201181 - RNA, 23 nt, Mycobacterium bovis subsp bovis AF2122/97
caucgccaucguuucacccgggc

SEQ ID NO: 1201182 - RNA, 21 nt, Mycobacterium bovis subsp bovis AF2122/97
caucgccauaccggccgccau

SEQ ID NO: 1201183 - RNA, 17 nt, Mycobacterium bovis subsp bovis AF2122/97
caucgaguucggcccgc

SEQ ID NO: 1201184 - RNA, 14 nt, Mycobacterium bovis subsp bovis AF2122/97
caucgaucaccgcu

SEQ ID NO: 1201185 - RNA, 20 nt, Mycobacterium bovis subsp bovis AF2122/97
caucgccagcaucagcccgg

SEQ ID NO: 1201186 - RNA, 21 nt, Mycobacterium bovis subsp bovis AF2122/97
caucgccagccugugcugcca

SEQ ID NO: 1201187 - RNA, 14 nt, Mycobacterium bovis subsp bovis AF2122/97
caucgccagcgccg

SEQ ID NO: 1201188 - RNA, 13 nt, Mycobacterium bovis subsp bovis AF2122/97
caucgccaggccc

SEQ ID NO: 1201189 - RNA, 23 nt, Mycobacterium bovis subsp bovis AF2122/97
cauccggucagauagugcaugua

SEQ ID NO: 1201190 - RNA, 17 nt, Mycobacterium bovis subsp bovis AF2122/97
cauccgggcgaccacca

SEQ ID NO: 1201191 - RNA, 15 nt, Mycobacterium bovis subsp bovis AF2122/97
cauccgggccgagcg

SEQ ID NO: 1201192 - RNA, 18 nt, Mycobacterium bovis subsp bovis AF2122/97
cauccggauauggaaagc

SEQ ID NO: 1201193 - RNA, 19 nt, Mycobacterium bovis subsp bovis AF2122/97
cauccgccgggccaggccg

SEQ ID NO: 1201194 - RNA, 15 nt, Mycobacterium bovis subsp bovis AF2122/97
cauccgccccgcccg

SEQ ID NO: 1201195 - RNA, 14 nt, Mycobacterium bovis subsp bovis AF2122/97
cauccgccgccccc

SEQ ID NO: 1201196 - RNA, 18 nt, Mycobacterium bovis subsp bovis AF2122/97
cauccucgagcugcuggc

SEQ ID NO: 1201197 - RNA, 12 nt, Mycobacterium bovis subsp bovis AF2122/97
cauccuucacca

SEQ ID NO: 1201198 - RNA, 16 nt, Mycobacterium bovis subsp bovis AF2122/97
cauccuucaccagcug

SEQ ID NO: 1201199 - RNA, 16 nt, Mycobacterium bovis subsp bovis AF2122/97
cauccuugacgcggcc

SEQ ID NO: 1201200 - RNA, 17 nt, Mycobacterium bovis subsp bovis AF2122/97
cauccuugccaaucgcc

SEQ ID NO: 1201201 - RNA, 20 nt, Mycobacterium bovis subsp bovis AF2122/97
caucggucagcaugggguag

SEQ ID NO: 1201202 - RNA, 22 nt, Mycobacterium bovis subsp bovis AF2122/97
caucggucagcgggcacgccgc

SEQ ID NO: 1201203 - RNA, 14 nt, Mycobacterium bovis subsp bovis AF2122/97
caucggugucuucc

SEQ ID NO: 1201204 - RNA, 16 nt, Mycobacterium bovis subsp bovis AF2122/97
caucggucucgcacca

SEQ ID NO: 1201205 - RNA, 20 nt, Mycobacterium bovis subsp bovis AF2122/97
caucggugcgcacggcggcc

SEQ ID NO: 1201206 - RNA, 19 nt, Mycobacterium bovis subsp bovis AF2122/97
caucgggcgagcucgucga

SEQ ID NO: 1201207 - RNA, 19 nt, Mycobacterium bovis subsp bovis AF2122/97
caucggcugcgacaggacg

SEQ ID NO: 1201208 - RNA, 23 nt, Mycobacterium bovis subsp bovis AF2122/97
caucggcuggccgcgccucgguc

SEQ ID NO: 1201209 - RNA, 17 nt, Mycobacterium bovis subsp bovis AF2122/97
caucggugcagcccgcc

SEQ ID NO: 1201210 - RNA, 20 nt, Mycobacterium bovis subsp bovis AF2122/97
caucggugagcccguugacc

SEQ ID NO: 1201211 - RNA, 14 nt, Mycobacterium bovis subsp bovis AF2122/97
caucuccgacucga

SEQ ID NO: 1201212 - RNA, 21 nt, Mycobacterium bovis subsp bovis AF2122/97
caucucccgaccgccgagcgg

SEQ ID NO: 1201213 - RNA, 22 nt, Mycobacterium bovis subsp bovis AF2122/97
caucucuugcaaccuggacugc

SEQ ID NO: 1201214 - RNA, 15 nt, Mycobacterium bovis subsp bovis AF2122/97
caucugacagcuggg

SEQ ID NO: 1201215 - RNA, 21 nt, Mycobacterium bovis subsp bovis AF2122/97
caucuguuccgugccagcugc

SEQ ID NO: 1201216 - RNA, 22 nt, Mycobacterium bovis subsp bovis AF2122/97
caucuguuccgugccagcugcc

SEQ ID NO: 1201217 - RNA, 20 nt, Mycobacterium bovis subsp bovis AF2122/97
caucugguauggguccucga

SEQ ID NO: 1201218 - RNA, 15 nt, Mycobacterium bovis subsp bovis AF2122/97
caucuggccggcggu

SEQ ID NO: 1201219 - RNA, 13 nt, Mycobacterium bovis subsp bovis AF2122/97
caucuggcgccgu

SEQ ID NO: 1201220 - RNA, 15 nt, Mycobacterium bovis subsp bovis AF2122/97
caucuggcgcugcug

SEQ ID NO: 1201221 - RNA, 17 nt, Mycobacterium bovis subsp bovis AF2122/97
caucuggcgcugcuggc

SEQ ID NO: 1201222 - RNA, 18 nt, Mycobacterium bovis subsp bovis AF2122/97
caucuggcgcugcuggca

SEQ ID NO: 1201223 - RNA, 23 nt, Mycobacterium bovis subsp bovis AF2122/97
caucuggcugagcagacugcccu

SEQ ID NO: 1201224 - RNA, 18 nt, Mycobacterium bovis subsp bovis AF2122/97
caucuugucgaucugccc

SEQ ID NO: 1201225 - RNA, 12 nt, Mycobacterium bovis subsp bovis AF2122/97
caucuugaccaa

SEQ ID NO: 1201226 - RNA, 14 nt, Mycobacterium bovis subsp bovis AF2122/97
caucuugccaccgc

SEQ ID NO: 1201227 - RNA, 16 nt, Mycobacterium bovis subsp bovis AF2122/97
caucuucggacgccag

SEQ ID NO: 1201228 - RNA, 19 nt, Mycobacterium bovis subsp bovis AF2122/97
caugggagcgggauucugg

SEQ ID NO: 1201229 - RNA, 16 nt, Mycobacterium bovis subsp bovis AF2122/97
caugggcaaugguggu

SEQ ID NO: 1201230 - RNA, 19 nt, Mycobacterium bovis subsp bovis AF2122/97
caugggcccugcacagcag

SEQ ID NO: 1201231 - RNA, 16 nt, Mycobacterium bovis subsp bovis AF2122/97
caugcguaugcccacg

SEQ ID NO: 1201232 - RNA, 20 nt, Mycobacterium bovis subsp bovis AF2122/97
caugcgguuagcagccgcug

SEQ ID NO: 1201233 - RNA, 23 nt, Mycobacterium bovis subsp bovis AF2122/97
caugcggaauuugcuugggcccc

SEQ ID NO: 1201234 - RNA, 15 nt, Mycobacterium bovis subsp bovis AF2122/97
caugcccgggaugac

SEQ ID NO: 1201235 - RNA, 23 nt, Mycobacterium bovis subsp bovis AF2122/97
caugcccgcggugaccaccccgg

SEQ ID NO: 1201236 - RNA, 17 nt, Mycobacterium bovis subsp bovis AF2122/97
caugcccaucuccaaca

SEQ ID NO: 1201237 - RNA, 22 nt, Mycobacterium bovis subsp bovis AF2122/97
caugcccaugauggccgcggcu

SEQ ID NO: 1201238 - RNA, 13 nt, Mycobacterium bovis subsp bovis AF2122/97
caugccuccagaa

SEQ ID NO: 1201239 - RNA, 23 nt, Mycobacterium bovis subsp bovis AF2122/97
caugcccgugggugcgucugggc

SEQ ID NO: 1201240 - RNA, 19 nt, Mycobacterium bovis subsp bovis AF2122/97
caugcccgucagcggacag

SEQ ID NO: 1201241 - RNA, 16 nt, Mycobacterium bovis subsp bovis AF2122/97
caugcccguccugcag

SEQ ID NO: 1201242 - RNA, 13 nt, Mycobacterium bovis subsp bovis AF2122/97
caugcgcucagaa

SEQ ID NO: 1201243 - RNA, 22 nt, Mycobacterium bovis subsp bovis AF2122/97
caugcgccgagauccacgccag

SEQ ID NO: 1201244 - RNA, 19 nt, Mycobacterium bovis subsp bovis AF2122/97
caugcgauucugcguccug

SEQ ID NO: 1201245 - RNA, 17 nt, Mycobacterium bovis subsp bovis AF2122/97
caugcgccaacccggcc

SEQ ID NO: 1201246 - RNA, 17 nt, Mycobacterium bovis subsp bovis AF2122/97
caugcgagucgucccag

SEQ ID NO: 1201247 - RNA, 17 nt, Mycobacterium bovis subsp bovis AF2122/97
caugccuucggccaacc

SEQ ID NO: 1201248 - RNA, 18 nt, Mycobacterium bovis subsp bovis AF2122/97
caugcaccucgagcgugg

SEQ ID NO: 1201249 - RNA, 14 nt, Mycobacterium bovis subsp bovis AF2122/97
caugcaccgaugcc

SEQ ID NO: 1201250 - RNA, 23 nt, Mycobacterium bovis subsp bovis AF2122/97
caugcaccgaugccgaagccccc

SEQ ID NO: 1201251 - RNA, 20 nt, Mycobacterium bovis subsp bovis AF2122/97
caugcaagucaaacgccguc

SEQ ID NO: 1201252 - RNA, 21 nt, Mycobacterium bovis subsp bovis AF2122/97
cauggucggucaagucugucu

SEQ ID NO: 1201253 - RNA, 22 nt, Mycobacterium bovis subsp bovis AF2122/97
cauggugcggcggcguccgggu

SEQ ID NO: 1201254 - RNA, 23 nt, Mycobacterium bovis subsp bovis AF2122/97
cauggugcggcggcguccgggug

SEQ ID NO: 1201255 - RNA, 16 nt, Mycobacterium bovis subsp bovis AF2122/97
caugugcccaggucuc

SEQ ID NO: 1201256 - RNA, 21 nt, Mycobacterium bovis subsp bovis AF2122/97
cauguucggccaccagaacca

SEQ ID NO: 1201257 - RNA, 14 nt, Mycobacterium bovis subsp bovis AF2122/97
cauguuccccgucg

SEQ ID NO: 1201258 - RNA, 17 nt, Mycobacterium bovis subsp bovis AF2122/97
cauguugaaaaggcgcu

SEQ ID NO: 1201259 - RNA, 12 nt, Mycobacterium bovis subsp bovis AF2122/97
cauguugaccuc

SEQ ID NO: 1201260 - RNA, 20 nt, Mycobacterium bovis subsp bovis AF2122/97
cauuaaugcggccccgcgca

SEQ ID NO: 1201261 - RNA, 13 nt, Mycobacterium bovis subsp bovis AF2122/97
cauuagcagcacc

SEQ ID NO: 1201262 - RNA, 22 nt, Mycobacterium bovis subsp bovis AF2122/97
cauucgugggaaccaccagcac

SEQ ID NO: 1201263 - RNA, 14 nt, Mycobacterium bovis subsp bovis AF2122/97
cauucgugcccggg

SEQ ID NO: 1201264 - RNA, 17 nt, Mycobacterium bovis subsp bovis AF2122/97
cauugacgaggcgagcg

SEQ ID NO: 1201265 - RNA, 11 nt, Mycobacterium bovis subsp bovis AF2122/97
cauucugcggc

SEQ ID NO: 1201266 - RNA, 14 nt, Mycobacterium bovis subsp bovis AF2122/97
cauugugcucgccg

SEQ ID NO: 1201267 - RNA, 21 nt, Mycobacterium bovis subsp bovis AF2122/97
cauugccgccgucgccgccgc

SEQ ID NO: 1201268 - RNA, 15 nt, Mycobacterium bovis subsp bovis AF2122/97
cauugcagaaccgcc

SEQ ID NO: 1201269 - RNA, 20 nt, Mycobacterium bovis subsp bovis AF2122/97
cauugaucgacggccagccc

SEQ ID NO: 1201270 - RNA, 21 nt, Mycobacterium bovis subsp bovis AF2122/97
cauugccguucucgucgagga

SEQ ID NO: 1201271 - RNA, 22 nt, Mycobacterium bovis subsp bovis AF2122/97
cauugccggccaccagccuggc

SEQ ID NO: 1201272 - RNA, 15 nt, Mycobacterium bovis subsp bovis AF2122/97
cauugcgcaggaugu

SEQ ID NO: 1201273 - RNA, 14 nt, Mycobacterium bovis subsp bovis AF2122/97
cagcggaccgcugc

SEQ ID NO: 1201274 - RNA, 18 nt, Mycobacterium bovis subsp bovis AF2122/97
cagcgcuucgucggccgg

SEQ ID NO: 1201275 - RNA, 12 nt, Mycobacterium bovis subsp bovis AF2122/97
cagcgcugccac

SEQ ID NO: 1201276 - RNA, 15 nt, Mycobacterium bovis subsp bovis AF2122/97
cagcgcugagccgcu

SEQ ID NO: 1201277 - RNA, 13 nt, Mycobacterium bovis subsp bovis AF2122/97
cagcgcuagccgg

SEQ ID NO: 1201278 - RNA, 16 nt, Mycobacterium bovis subsp bovis AF2122/97
cagcggcaccgcggcc

SEQ ID NO: 1201279 - RNA, 17 nt, Mycobacterium bovis subsp bovis AF2122/97
cagcggcacacccauca

SEQ ID NO: 1201280 - RNA, 23 nt, Mycobacterium bovis subsp bovis AF2122/97
cagcggcaaggucaacgggaggu

SEQ ID NO: 1201281 - RNA, 21 nt, Mycobacterium bovis subsp bovis AF2122/97
cagcggcaauggccagcacca

SEQ ID NO: 1201282 - RNA, 14 nt, Mycobacterium bovis subsp bovis AF2122/97
cagcggagcgcccu

SEQ ID NO: 1201283 - RNA, 13 nt, Mycobacterium bovis subsp bovis AF2122/97
cagcggcaggaag

SEQ ID NO: 1201284 - RNA, 15 nt, Mycobacterium bovis subsp bovis AF2122/97
cagcggccagcccag

SEQ ID NO: 1201285 - RNA, 14 nt, Mycobacterium bovis subsp bovis AF2122/97
cagcggccagcagu

SEQ ID NO: 1201286 - RNA, 16 nt, Mycobacterium bovis subsp bovis AF2122/97
cagcggccagcagugc

SEQ ID NO: 1201287 - RNA, 13 nt, Mycobacterium bovis subsp bovis AF2122/97
cagcggccaaccc

SEQ ID NO: 1201288 - RNA, 12 nt, Mycobacterium bovis subsp bovis AF2122/97
cagcggccaccg

SEQ ID NO: 1201289 - RNA, 13 nt, Mycobacterium bovis subsp bovis AF2122/97
cagcggccaccga

SEQ ID NO: 1201290 - RNA, 13 nt, Mycobacterium bovis subsp bovis AF2122/97
cagcggcauugcc

SEQ ID NO: 1201291 - RNA, 19 nt, Mycobacterium bovis subsp bovis AF2122/97
cagcgcggcgcgcaggacc

SEQ ID NO: 1201292 - RNA, 14 nt, Mycobacterium bovis subsp bovis AF2122/97
cagcgcggcgcccu

SEQ ID NO: 1201293 - RNA, 22 nt, Mycobacterium bovis subsp bovis AF2122/97
cagcgcggcgcccuggccgccc

SEQ ID NO: 1201294 - RNA, 15 nt, Mycobacterium bovis subsp bovis AF2122/97
cagcgcggccacccg

SEQ ID NO: 1201295 - RNA, 22 nt, Mycobacterium bovis subsp bovis AF2122/97
cagcgcgggacacgucgcgcca

SEQ ID NO: 1201296 - RNA, 15 nt, Mycobacterium bovis subsp bovis AF2122/97
cagcgcggcuggggc

SEQ ID NO: 1201297 - RNA, 17 nt, Mycobacterium bovis subsp bovis AF2122/97
cagcgcgucggagccgg

SEQ ID NO: 1201298 - RNA, 16 nt, Mycobacterium bovis subsp bovis AF2122/97
cagcgcgucgccgaaa

SEQ ID NO: 1201299 - RNA, 18 nt, Mycobacterium bovis subsp bovis AF2122/97
cagcgcgcugggaagcuc

SEQ ID NO: 1201300 - RNA, 14 nt, Mycobacterium bovis subsp bovis AF2122/97
cagcgcgcgccgcu

SEQ ID NO: 1201301 - RNA, 15 nt, Mycobacterium bovis subsp bovis AF2122/97
cagcgcgcgccgcug

SEQ ID NO: 1201302 - RNA, 15 nt, Mycobacterium bovis subsp bovis AF2122/97
cagcgcgccacccag

SEQ ID NO: 1201303 - RNA, 17 nt, Mycobacterium bovis subsp bovis AF2122/97
cagcgcgaugucgccgg

SEQ ID NO: 1201304 - RNA, 19 nt, Mycobacterium bovis subsp bovis AF2122/97
cagcgcgcaaagacaccga

SEQ ID NO: 1201305 - RNA, 18 nt, Mycobacterium bovis subsp bovis AF2122/97
cagcgcgacguccaccag

SEQ ID NO: 1201306 - RNA, 22 nt, Mycobacterium bovis subsp bovis AF2122/97
cagcgcgacguccaccagccgg

SEQ ID NO: 1201307 - RNA, 22 nt, Mycobacterium bovis subsp bovis AF2122/97
cagcgcgagaucagccggcagc

SEQ ID NO: 1201308 - RNA, 17 nt, Mycobacterium bovis subsp bovis AF2122/97
cagcgcgagaucagccg

SEQ ID NO: 1201309 - RNA, 20 nt, Mycobacterium bovis subsp bovis AF2122/97
cagcgccuugaccagcagcu

SEQ ID NO: 1201310 - RNA, 21 nt, Mycobacterium bovis subsp bovis AF2122/97
cagcgccuugaccagcagcug

SEQ ID NO: 1201311 - RNA, 16 nt, Mycobacterium bovis subsp bovis AF2122/97
cagcgcgaacgccugc

SEQ ID NO: 1201312 - RNA, 20 nt, Mycobacterium bovis subsp bovis AF2122/97
cagcgccuuguggcacaccc

SEQ ID NO: 1201313 - RNA, 15 nt, Mycobacterium bovis subsp bovis AF2122/97
cagcgccugcgccca

SEQ ID NO: 1201314 - RNA, 13 nt, Mycobacterium bovis subsp bovis AF2122/97
cagcgccuggccg

SEQ ID NO: 1201315 - RNA, 12 nt, Mycobacterium bovis subsp bovis AF2122/97
cagcgcccccag

SEQ ID NO: 1201316 - RNA, 16 nt, Mycobacterium bovis subsp bovis AF2122/97
cagcgccccaugcaac

SEQ ID NO: 1201317 - RNA, 22 nt, Mycobacterium bovis subsp bovis AF2122/97
cagcgcccccggacugcggaac

SEQ ID NO: 1201318 - RNA, 20 nt, Mycobacterium bovis subsp bovis AF2122/97
cagcgccacuggaagccaag

SEQ ID NO: 1201319 - RNA, 14 nt, Mycobacterium bovis subsp bovis AF2122/97
cagcgccagcagcu

SEQ ID NO: 1201320 - RNA, 13 nt, Mycobacterium bovis subsp bovis AF2122/97
cagcgccaggccg

SEQ ID NO: 1201321 - RNA, 14 nt, Mycobacterium bovis subsp bovis AF2122/97
cagcgccgcguggc

SEQ ID NO: 1201322 - RNA, 14 nt, Mycobacterium bovis subsp bovis AF2122/97
cagcgccgcgcgcg

SEQ ID NO: 1201323 - RNA, 17 nt, Mycobacterium bovis subsp bovis AF2122/97
cagcgccgcgcgggugc

SEQ ID NO: 1201324 - RNA, 12 nt, Mycobacterium bovis subsp bovis AF2122/97
cagcgccuccuc

SEQ ID NO: 1201325 - RNA, 18 nt, Mycobacterium bovis subsp bovis AF2122/97
cagcgcccggucacgcug

SEQ ID NO: 1201326 - RNA, 14 nt, Mycobacterium bovis subsp bovis AF2122/97
cagcgccgacccgu

SEQ ID NO: 1201327 - RNA, 20 nt, Mycobacterium bovis subsp bovis AF2122/97
cagcgccgagagcaccgcuc

SEQ ID NO: 1201328 - RNA, 13 nt, Mycobacterium bovis subsp bovis AF2122/97
cagcgccgccacc

SEQ ID NO: 1201329 - RNA, 14 nt, Mycobacterium bovis subsp bovis AF2122/97
cagcgccgccaccc

SEQ ID NO: 1201330 - RNA, 16 nt, Mycobacterium bovis subsp bovis AF2122/97
cagcgccgccaccccg

SEQ ID NO: 1201331 - RNA, 14 nt, Mycobacterium bovis subsp bovis AF2122/97
cagcgcccggccac

SEQ ID NO: 1201332 - RNA, 15 nt, Mycobacterium bovis subsp bovis AF2122/97
cagcgcccggcccgc

SEQ ID NO: 1201333 - RNA, 19 nt, Mycobacterium bovis subsp bovis AF2122/97
cagcgccgccggcgccggc

SEQ ID NO: 1201334 - RNA, 19 nt, Mycobacterium bovis subsp bovis AF2122/97
cagcgcauuuuccacaucc

SEQ ID NO: 1201335 - RNA, 21 nt, Mycobacterium bovis subsp bovis AF2122/97
cagcgcaucuuugaacgccau

SEQ ID NO: 1201336 - RNA, 16 nt, Mycobacterium bovis subsp bovis AF2122/97
cagcgccacccgaucg

SEQ ID NO: 1201337 - RNA, 19 nt, Mycobacterium bovis subsp bovis AF2122/97
cagcgccaacgcccccauc

SEQ ID NO: 1201338 - RNA, 22 nt, Mycobacterium bovis subsp bovis AF2122/97
cagcgccaacucgagaguggcc

SEQ ID NO: 1201339 - RNA, 13 nt, Mycobacterium bovis subsp bovis AF2122/97
cagcgccaauguc

SEQ ID NO: 1201340 - RNA, 14 nt, Mycobacterium bovis subsp bovis AF2122/97
cagcgcaucgccgc

SEQ ID NO: 1201341 - RNA, 14 nt, Mycobacterium bovis subsp bovis AF2122/97
cagcgcaucggcca

SEQ ID NO: 1201342 - RNA, 16 nt, Mycobacterium bovis subsp bovis AF2122/97
cagcgcaucgccgcug

SEQ ID NO: 1201343 - RNA, 17 nt, Mycobacterium bovis subsp bovis AF2122/97
cagcgcaucggccagca

SEQ ID NO: 1201344 - RNA, 20 nt, Mycobacterium bovis subsp bovis AF2122/97
cagcgcaggauucugcugac

SEQ ID NO: 1201345 - RNA, 22 nt, Mycobacterium bovis subsp bovis AF2122/97
cagcgcagucugauuccacauc

SEQ ID NO: 1201346 - RNA, 21 nt, Mycobacterium bovis subsp bovis AF2122/97
cagcgcagccgaucgucucgg

SEQ ID NO: 1201347 - RNA, 16 nt, Mycobacterium bovis subsp bovis AF2122/97
cagcgcagccugcagc

SEQ ID NO: 1201348 - RNA, 11 nt, Mycobacterium bovis subsp bovis AF2122/97
cagcgcagcag

SEQ ID NO: 1201349 - RNA, 13 nt, Mycobacterium bovis subsp bovis AF2122/97
cagcgcagcagcg

SEQ ID NO: 1201350 - RNA, 20 nt, Mycobacterium bovis subsp bovis AF2122/97
cagcgcacggaccaucgcca

SEQ ID NO: 1201351 - RNA, 16 nt, Mycobacterium bovis subsp bovis AF2122/97
cagcgcacuggccgcu

SEQ ID NO: 1201352 - RNA, 24 nt, Mycobacterium bovis subsp bovis AF2122/97
cagcgagucgggguacaggcugcu

SEQ ID NO: 1201353 - RNA, 17 nt, Mycobacterium bovis subsp bovis AF2122/97
cagcgaguugagcaugu

SEQ ID NO: 1201354 - RNA, 17 nt, Mycobacterium bovis subsp bovis AF2122/97
cagcgauaucggcggcu

SEQ ID NO: 1201355 - RNA, 17 nt, Mycobacterium bovis subsp bovis AF2122/97
cagcgauauccacaauc

SEQ ID NO: 1201356 - RNA, 21 nt, Mycobacterium bovis subsp bovis AF2122/97
cagcgauggguguugcuggcc

SEQ ID NO: 1201357 - RNA, 20 nt, Mycobacterium bovis subsp bovis AF2122/97
cagcgaucccggcaacaacg

SEQ ID NO: 1201358 - RNA, 20 nt, Mycobacterium bovis subsp bovis AF2122/97
cagcgaucuugguggccuca

SEQ ID NO: 1201359 - RNA, 22 nt, Mycobacterium bovis subsp bovis AF2122/97
cagcgcaacggccagcgcugcu

SEQ ID NO: 1201360 - RNA, 21 nt, Mycobacterium bovis subsp bovis AF2122/97
cagcgcaacaucgaaaaccga

SEQ ID NO: 1201361 - RNA, 14 nt, Mycobacterium bovis subsp bovis AF2122/97
cagcgcacggacca

SEQ ID NO: 1201362 - RNA, 16 nt, Mycobacterium bovis subsp bovis AF2122/97
cagcgcacugcccggg

SEQ ID NO: 1201363 - RNA, 15 nt, Mycobacterium bovis subsp bovis AF2122/97
cagcgcacuacucga

SEQ ID NO: 1201364 - RNA, 23 nt, Mycobacterium bovis subsp bovis AF2122/97
cagccguccgggcggccucccgg

SEQ ID NO: 1201365 - RNA, 22 nt, Mycobacterium bovis subsp bovis AF2122/97
cagccgucaccgcgaccccugg

SEQ ID NO: 1201366 - RNA, 20 nt, Mycobacterium bovis subsp bovis AF2122/97
cagccgguggucugcgcggu

SEQ ID NO: 1201367 - RNA, 16 nt, Mycobacterium bovis subsp bovis AF2122/97
cagccggugccgccgu

SEQ ID NO: 1201368 - RNA, 16 nt, Mycobacterium bovis subsp bovis AF2122/97
cagccggugacguggu

SEQ ID NO: 1201369 - RNA, 18 nt, Mycobacterium bovis subsp bovis AF2122/97
cagccgguccagacccag

SEQ ID NO: 1201370 - RNA, 17 nt, Mycobacterium bovis subsp bovis AF2122/97
cagccgguccagcagcu

SEQ ID NO: 1201371 - RNA, 14 nt, Mycobacterium bovis subsp bovis AF2122/97
cagccgucggcgcu

SEQ ID NO: 1201372 - RNA, 22 nt, Mycobacterium bovis subsp bovis AF2122/97
cagccgucggcgcugcgcgcga

SEQ ID NO: 1201373 - RNA, 14 nt, Mycobacterium bovis subsp bovis AF2122/97
cagccgugcccagg

SEQ ID NO: 1201374 - RNA, 15 nt, Mycobacterium bovis subsp bovis AF2122/97
cagccgugccguggu

SEQ ID NO: 1201375 - RNA, 17 nt, Mycobacterium bovis subsp bovis AF2122/97
cagccguggcgcgacgu

SEQ ID NO: 1201376 - RNA, 12 nt, Mycobacterium bovis subsp bovis AF2122/97
cagccuccacca

SEQ ID NO: 1201377 - RNA, 18 nt, Mycobacterium bovis subsp bovis AF2122/97
cagccucauuuauggaca

SEQ ID NO: 1201378 - RNA, 17 nt, Mycobacterium bovis subsp bovis AF2122/97
cagccucgcgggcaggg

SEQ ID NO: 1201379 - RNA, 23 nt, Mycobacterium bovis subsp bovis AF2122/97
cagccugcagcgaaacaccggcc

SEQ ID NO: 1201380 - RNA, 16 nt, Mycobacterium bovis subsp bovis AF2122/97
cagccugcgccacaau

SEQ ID NO: 1201381 - RNA, 17 nt, Mycobacterium bovis subsp bovis AF2122/97
cagccugcuggccgcgg

SEQ ID NO: 1201382 - RNA, 13 nt, Mycobacterium bovis subsp bovis AF2122/97
cagccuggccucg

SEQ ID NO: 1201383 - RNA, 14 nt, Mycobacterium bovis subsp bovis AF2122/97
cagccuggccucgc

SEQ ID NO: 1201384 - RNA, 21 nt, Mycobacterium bovis subsp bovis AF2122/97
cagccuugaucucgucccacu

SEQ ID NO: 1201385 - RNA, 18 nt, Mycobacterium bovis subsp bovis AF2122/97
cagccuuuccggccgccu

SEQ ID NO: 1201386 - RNA, 16 nt, Mycobacterium bovis subsp bovis AF2122/97
cagccuuuccggccgc

SEQ ID NO: 1201387 - RNA, 14 nt, Mycobacterium bovis subsp bovis AF2122/97
cagcgacgcuagga

SEQ ID NO: 1201388 - RNA, 15 nt, Mycobacterium bovis subsp bovis AF2122/97
cagcgacgccggccc

SEQ ID NO: 1201389 - RNA, 16 nt, Mycobacterium bovis subsp bovis AF2122/97
cagcgacgccggcccg

SEQ ID NO: 1201390 - RNA, 20 nt, Mycobacterium bovis subsp bovis AF2122/97
cagcgaccucacugcggcgc

SEQ ID NO: 1201391 - RNA, 18 nt, Mycobacterium bovis subsp bovis AF2122/97
cagcgacgagaucagccu

SEQ ID NO: 1201392 - RNA, 18 nt, Mycobacterium bovis subsp bovis AF2122/97
cagcgacuccaccccacc

SEQ ID NO: 1201393 - RNA, 19 nt, Mycobacterium bovis subsp bovis AF2122/97
cagcgacgggaaagccacc

SEQ ID NO: 1201394 - RNA, 20 nt, Mycobacterium bovis subsp bovis AF2122/97
cagcgacgggaaagccaccu

SEQ ID NO: 1201395 - RNA, 23 nt, Mycobacterium bovis subsp bovis AF2122/97
cagcgacuuggcaucgcgagcca

SEQ ID NO: 1201396 - RNA, 14 nt, Mycobacterium bovis subsp bovis AF2122/97
cagcgaggccagcg

SEQ ID NO: 1201397 - RNA, 15 nt, Mycobacterium bovis subsp bovis AF2122/97
cagcgaggagcaggg

SEQ ID NO: 1201398 - RNA, 15 nt, Mycobacterium bovis subsp bovis AF2122/97
cagcgagcgccaggu

SEQ ID NO: 1201399 - RNA, 23 nt, Mycobacterium bovis subsp bovis AF2122/97
cagcgagcccagcugcgccgaac

SEQ ID NO: 1201400 - RNA, 15 nt, Mycobacterium bovis subsp bovis AF2122/97
cagcgagcacacucc

SEQ ID NO: 1201401 - RNA, 16 nt, Mycobacterium bovis subsp bovis AF2122/97
cagcgaacggccagga

SEQ ID NO: 1201402 - RNA, 13 nt, Mycobacterium bovis subsp bovis AF2122/97
cagcgaacggcca

SEQ ID NO: 1201403 - RNA, 18 nt, Mycobacterium bovis subsp bovis AF2122/97
cagcgaaccgacccggcc

SEQ ID NO: 1201404 - RNA, 24 nt, Mycobacterium bovis subsp bovis AF2122/97
cagcgaaccggcugggcgccacca

SEQ ID NO: 1201405 - RNA, 14 nt, Mycobacterium bovis subsp bovis AF2122/97
cagcgaaccgccgg

SEQ ID NO: 1201406 - RNA, 17 nt, Mycobacterium bovis subsp bovis AF2122/97
cagcgaaccgccggcac

SEQ ID NO: 1201407 - RNA, 19 nt, Mycobacterium bovis subsp bovis AF2122/97
cagcgaaacaccggccagc

SEQ ID NO: 1201408 - RNA, 19 nt, Mycobacterium bovis subsp bovis AF2122/97
cagcgaaaugccggugccg

SEQ ID NO: 1201409 - RNA, 15 nt, Mycobacterium bovis subsp bovis AF2122/97
cagcgaccaccguca

SEQ ID NO: 1201410 - RNA, 16 nt, Mycobacterium bovis subsp bovis AF2122/97
cagcgaccaguggugg

SEQ ID NO: 1201411 - RNA, 22 nt, Mycobacterium bovis subsp bovis AF2122/97
cagcgacagcgugccgaacagg

SEQ ID NO: 1201412 - RNA, 15 nt, Mycobacterium bovis subsp bovis AF2122/97
cagcgacaacaccac

SEQ ID NO: 1201413 - RNA, 18 nt, Mycobacterium bovis subsp bovis AF2122/97
cagccgcauaggccccgc

SEQ ID NO: 1201414 - RNA, 18 nt, Mycobacterium bovis subsp bovis AF2122/97
cagccgcaacaccccccg

SEQ ID NO: 1201415 - RNA, 18 nt, Mycobacterium bovis subsp bovis AF2122/97
cagccgaugucgcgcgcu

SEQ ID NO: 1201416 - RNA, 14 nt, Mycobacterium bovis subsp bovis AF2122/97
cagccgcagccagg

SEQ ID NO: 1201417 - RNA, 19 nt, Mycobacterium bovis subsp bovis AF2122/97
cagccgcgaccgcagcugg

SEQ ID NO: 1201418 - RNA, 15 nt, Mycobacterium bovis subsp bovis AF2122/97
cagccgcggccacau

SEQ ID NO: 1201419 - RNA, 13 nt, Mycobacterium bovis subsp bovis AF2122/97
cagccgcgcugcg

SEQ ID NO: 1201420 - RNA, 22 nt, Mycobacterium bovis subsp bovis AF2122/97
cagccgcccugaauccucucga

SEQ ID NO: 1201421 - RNA, 17 nt, Mycobacterium bovis subsp bovis AF2122/97
cagccgcccgcccaccu

SEQ ID NO: 1201422 - RNA, 13 nt, Mycobacterium bovis subsp bovis AF2122/97
cagccgccgacuu

SEQ ID NO: 1201423 - RNA, 13 nt, Mycobacterium bovis subsp bovis AF2122/97
cagccgcccgccc

SEQ ID NO: 1201424 - RNA, 18 nt, Mycobacterium bovis subsp bovis AF2122/97
cagccggcgcacucccgg

SEQ ID NO: 1201425 - RNA, 15 nt, Mycobacterium bovis subsp bovis AF2122/97
cagccggccgcgacc

SEQ ID NO: 1201426 - RNA, 16 nt, Mycobacterium bovis subsp bovis AF2122/97
cagccggccugucccg

SEQ ID NO: 1201427 - RNA, 17 nt, Mycobacterium bovis subsp bovis AF2122/97
cagccggccugucccgc

SEQ ID NO: 1201428 - RNA, 18 nt, Mycobacterium bovis subsp bovis AF2122/97
cagccggcccugcggcca

SEQ ID NO: 1201429 - RNA, 13 nt, Mycobacterium bovis subsp bovis AF2122/97
cagccgggcacca

SEQ ID NO: 1201430 - RNA, 18 nt, Mycobacterium bovis subsp bovis AF2122/97
cagccgggcaccacccuu

SEQ ID NO: 1201431 - RNA, 23 nt, Mycobacterium bovis subsp bovis AF2122/97
cagccggcgaaugcgguccucga

SEQ ID NO: 1201432 - RNA, 16 nt, Mycobacterium bovis subsp bovis AF2122/97
cagccgguccagaccc

SEQ ID NO: 1201433 - RNA, 15 nt, Mycobacterium bovis subsp bovis AF2122/97
cagccggguggacac

SEQ ID NO: 1201434 - RNA, 15 nt, Mycobacterium bovis subsp bovis AF2122/97
cagccgggcgucgcu

SEQ ID NO: 1201435 - RNA, 20 nt, Mycobacterium bovis subsp bovis AF2122/97
cagccgggcgucgcuggugg

SEQ ID NO: 1201436 - RNA, 14 nt, Mycobacterium bovis subsp bovis AF2122/97
cagccggaccgugu

SEQ ID NO: 1201437 - RNA, 20 nt, Mycobacterium bovis subsp bovis AF2122/97
cagccggccauacgcgcgcg

SEQ ID NO: 1201438 - RNA, 23 nt, Mycobacterium bovis subsp bovis AF2122/97
cagccggccaauggccugcagcg

SEQ ID NO: 1201439 - RNA, 15 nt, Mycobacterium bovis subsp bovis AF2122/97
cagccgcucacccgg

SEQ ID NO: 1201440 - RNA, 13 nt, Mycobacterium bovis subsp bovis AF2122/97
cagccgcuccacg

SEQ ID NO: 1201441 - RNA, 13 nt, Mycobacterium bovis subsp bovis AF2122/97
cagcccgccgcug

SEQ ID NO: 1201442 - RNA, 19 nt, Mycobacterium bovis subsp bovis AF2122/97
cagcccgccggacccgccc

SEQ ID NO: 1201443 - RNA, 13 nt, Mycobacterium bovis subsp bovis AF2122/97
cagcccgcgcagc

SEQ ID NO: 1201444 - RNA, 15 nt, Mycobacterium bovis subsp bovis AF2122/97
cagcccgagcucggg

SEQ ID NO: 1201445 - RNA, 20 nt, Mycobacterium bovis subsp bovis AF2122/97
cagcccgaugaucccgccac

SEQ ID NO: 1201446 - RNA, 17 nt, Mycobacterium bovis subsp bovis AF2122/97
cagcccgacguugcgua

SEQ ID NO: 1201447 - RNA, 20 nt, Mycobacterium bovis subsp bovis AF2122/97
cagcccggcgacgacccggg

SEQ ID NO: 1201448 - RNA, 15 nt, Mycobacterium bovis subsp bovis AF2122/97
cagcccggcggccgc

SEQ ID NO: 1201449 - RNA, 16 nt, Mycobacterium bovis subsp bovis AF2122/97
cagcccggcggccgcu

SEQ ID NO: 1201450 - RNA, 13 nt, Mycobacterium bovis subsp bovis AF2122/97
cagcccgggcagc

SEQ ID NO: 1201451 - RNA, 17 nt, Mycobacterium bovis subsp bovis AF2122/97
cagcccggcgugcagaa

SEQ ID NO: 1201452 - RNA, 18 nt, Mycobacterium bovis subsp bovis AF2122/97
cagcccgggcagcaccag

SEQ ID NO: 1201453 - RNA, 16 nt, Mycobacterium bovis subsp bovis AF2122/97
cagcccgggcagcccc

SEQ ID NO: 1201454 - RNA, 17 nt, Mycobacterium bovis subsp bovis AF2122/97
cagcccgggcagccccu

SEQ ID NO: 1201455 - RNA, 18 nt, Mycobacterium bovis subsp bovis AF2122/97
cagcccggccggucgaga

SEQ ID NO: 1201456 - RNA, 14 nt, Mycobacterium bovis subsp bovis AF2122/97
cagcccggccgccg

SEQ ID NO: 1201457 - RNA, 16 nt, Mycobacterium bovis subsp bovis AF2122/97
cagcccggccgccgag

SEQ ID NO: 1201458 - RNA, 18 nt, Mycobacterium bovis subsp bovis AF2122/97
cagcccggccgccgagga

SEQ ID NO: 1201459 - RNA, 13 nt, Mycobacterium bovis subsp bovis AF2122/97
cagcccggccuug

SEQ ID NO: 1201460 - RNA, 16 nt, Mycobacterium bovis subsp bovis AF2122/97
cagcccggccuugccg

SEQ ID NO: 1201461 - RNA, 21 nt, Mycobacterium bovis subsp bovis AF2122/97
cagcccggccuugccgccggc

SEQ ID NO: 1201462 - RNA, 14 nt, Mycobacterium bovis subsp bovis AF2122/97
cagcccugcgcagc

SEQ ID NO: 1201463 - RNA, 12 nt, Mycobacterium bovis subsp bovis AF2122/97
cagcccucuggu

SEQ ID NO: 1201464 - RNA, 13 nt, Mycobacterium bovis subsp bovis AF2122/97
cagcccuucagcg

SEQ ID NO: 1201465 - RNA, 16 nt, Mycobacterium bovis subsp bovis AF2122/97
cagcccuucagcgucc

SEQ ID NO: 1201466 - RNA, 18 nt, Mycobacterium bovis subsp bovis AF2122/97
cagcccuuggcgcgcagg

SEQ ID NO: 1201467 - RNA, 19 nt, Mycobacterium bovis subsp bovis AF2122/97
cagcccuucagcguccugg

SEQ ID NO: 1201468 - RNA, 23 nt, Mycobacterium bovis subsp bovis AF2122/97
cagcccguccaggcgcugcagca

SEQ ID NO: 1201469 - RNA, 19 nt, Mycobacterium bovis subsp bovis AF2122/97
cagcccgucggcgccgaac

SEQ ID NO: 1201470 - RNA, 17 nt, Mycobacterium bovis subsp bovis AF2122/97
cagcccguagcacaccg

SEQ ID NO: 1201471 - RNA, 19 nt, Mycobacterium bovis subsp bovis AF2122/97
cagcccgugacuggugaac

SEQ ID NO: 1201472 - RNA, 16 nt, Mycobacterium bovis subsp bovis AF2122/97
cagcccguucgugccg

SEQ ID NO: 1201473 - RNA, 19 nt, Mycobacterium bovis subsp bovis AF2122/97
cagccgagcggcggcacug

SEQ ID NO: 1201474 - RNA, 17 nt, Mycobacterium bovis subsp bovis AF2122/97
cagccgauacaggccac

SEQ ID NO: 1201475 - RNA, 16 nt, Mycobacterium bovis subsp bovis AF2122/97
cagccgaugcugcggg

SEQ ID NO: 1201476 - RNA, 20 nt, Mycobacterium bovis subsp bovis AF2122/97
cagccgaccgaaucagcacg

SEQ ID NO: 1201477 - RNA, 22 nt, Mycobacterium bovis subsp bovis AF2122/97
cagccgacgcacgugaugcccu

SEQ ID NO: 1201478 - RNA, 15 nt, Mycobacterium bovis subsp bovis AF2122/97
cagcacgccagcccc

SEQ ID NO: 1201479 - RNA, 18 nt, Mycobacterium bovis subsp bovis AF2122/97
cagcacgauccagcugua

SEQ ID NO: 1201480 - RNA, 15 nt, Mycobacterium bovis subsp bovis AF2122/97
cagcaccgugacagc

SEQ ID NO: 1201481 - RNA, 15 nt, Mycobacterium bovis subsp bovis AF2122/97
cagcaccggggacag

SEQ ID NO: 1201482 - RNA, 20 nt, Mycobacterium bovis subsp bovis AF2122/97
cagcaccggggacagcccgg

SEQ ID NO: 1201483 - RNA, 23 nt, Mycobacterium bovis subsp bovis AF2122/97
cagcaccuccguaacgccaagcu

SEQ ID NO: 1201484 - RNA, 13 nt, Mycobacterium bovis subsp bovis AF2122/97
cagcaccuccgua

SEQ ID NO: 1201485 - RNA, 21 nt, Mycobacterium bovis subsp bovis AF2122/97
cagcaccuccaccgcgccggc

SEQ ID NO: 1201486 - RNA, 22 nt, Mycobacterium bovis subsp bovis AF2122/97
cagcaccucagaaaguccccgc

SEQ ID NO: 1201487 - RNA, 19 nt, Mycobacterium bovis subsp bovis AF2122/97
cagcaccagggcgcggauc

SEQ ID NO: 1201488 - RNA, 17 nt, Mycobacterium bovis subsp bovis AF2122/97
cagcacccaacccggcg

SEQ ID NO: 1201489 - RNA, 22 nt, Mycobacterium bovis subsp bovis AF2122/97
cagcacccaauacacccaacuc

SEQ ID NO: 1201490 - RNA, 18 nt, Mycobacterium bovis subsp bovis AF2122/97
cagcacccaaugccaccg

SEQ ID NO: 1201491 - RNA, 20 nt, Mycobacterium bovis subsp bovis AF2122/97
cagcacccaaugccaccgcg

SEQ ID NO: 1201492 - RNA, 13 nt, Mycobacterium bovis subsp bovis AF2122/97
cagcacccacauc

SEQ ID NO: 1201493 - RNA, 14 nt, Mycobacterium bovis subsp bovis AF2122/97
cagcacccacauca

SEQ ID NO: 1201494 - RNA, 22 nt, Mycobacterium bovis subsp bovis AF2122/97
cagcacccacgccgguggcacg

SEQ ID NO: 1201495 - RNA, 16 nt, Mycobacterium bovis subsp bovis AF2122/97
cagcacccacaucagc

SEQ ID NO: 1201496 - RNA, 18 nt, Mycobacterium bovis subsp bovis AF2122/97
cagcacccgggccuggga

SEQ ID NO: 1201497 - RNA, 14 nt, Mycobacterium bovis subsp bovis AF2122/97
cagcacccgcagcc

SEQ ID NO: 1201498 - RNA, 19 nt, Mycobacterium bovis subsp bovis AF2122/97
cagcacccgcuccagcucg

SEQ ID NO: 1201499 - RNA, 14 nt, Mycobacterium bovis subsp bovis AF2122/97
cagcacccgcgcca

SEQ ID NO: 1201500 - RNA, 16 nt, Mycobacterium bovis subsp bovis AF2122/97
cagcaccccauggcca

SEQ ID NO: 1201501 - RNA, 17 nt, Mycobacterium bovis subsp bovis AF2122/97
cagcacccgagcgaugc

SEQ ID NO: 1201502 - RNA, 22 nt, Mycobacterium bovis subsp bovis AF2122/97
cagcacccgagcgaugcgaccg

SEQ ID NO: 1201503 - RNA, 16 nt, Mycobacterium bovis subsp bovis AF2122/97
cagcaccgaacccgcc

SEQ ID NO: 1201504 - RNA, 15 nt, Mycobacterium bovis subsp bovis AF2122/97
cagcacccugcgggc

SEQ ID NO: 1201505 - RNA, 13 nt, Mycobacterium bovis subsp bovis AF2122/97
cagcaccgacagc

SEQ ID NO: 1201506 - RNA, 16 nt, Mycobacterium bovis subsp bovis AF2122/97
cagcaccgcagcgacc

SEQ ID NO: 1201507 - RNA, 15 nt, Mycobacterium bovis subsp bovis AF2122/97
cagcaccgcgacgac

SEQ ID NO: 1201508 - RNA, 13 nt, Mycobacterium bovis subsp bovis AF2122/97
cagcaccgcgacc

SEQ ID NO: 1201509 - RNA, 18 nt, Mycobacterium bovis subsp bovis AF2122/97
cagcaccggaucgaccaa

SEQ ID NO: 1201510 - RNA, 14 nt, Mycobacterium bovis subsp bovis AF2122/97
cagcaccgcuucuu

SEQ ID NO: 1201511 - RNA, 12 nt, Mycobacterium bovis subsp bovis AF2122/97
cagcaccgccgg

SEQ ID NO: 1201512 - RNA, 16 nt, Mycobacterium bovis subsp bovis AF2122/97
cagcaccgccggugcg

SEQ ID NO: 1201513 - RNA, 20 nt, Mycobacterium bovis subsp bovis AF2122/97
cagcacgccgccggccgcca

SEQ ID NO: 1201514 - RNA, 18 nt, Mycobacterium bovis subsp bovis AF2122/97
cagcacgcccgcgcugac

SEQ ID NO: 1201515 - RNA, 19 nt, Mycobacterium bovis subsp bovis AF2122/97
cagcacgcugaccacaacc

SEQ ID NO: 1201516 - RNA, 21 nt, Mycobacterium bovis subsp bovis AF2122/97
cagcacgcugaccacaaccgu

SEQ ID NO: 1201517 - RNA, 21 nt, Mycobacterium bovis subsp bovis AF2122/97
cagcacgcucgugacgaucag

SEQ ID NO: 1201518 - RNA, 14 nt, Mycobacterium bovis subsp bovis AF2122/97
cagcacgcgcgcga

SEQ ID NO: 1201519 - RNA, 14 nt, Mycobacterium bovis subsp bovis AF2122/97
cagcacggcggcca

SEQ ID NO: 1201520 - RNA, 13 nt, Mycobacterium bovis subsp bovis AF2122/97
cagcacggcuucg

SEQ ID NO: 1201521 - RNA, 18 nt, Mycobacterium bovis subsp bovis AF2122/97
cagcacgggugagcacca

SEQ ID NO: 1201522 - RNA, 16 nt, Mycobacterium bovis subsp bovis AF2122/97
cagcacggcggccacg

SEQ ID NO: 1201523 - RNA, 20 nt, Mycobacterium bovis subsp bovis AF2122/97
cagcacgggugagcaccacg

SEQ ID NO: 1201524 - RNA, 12 nt, Mycobacterium bovis subsp bovis AF2122/97
cagcacggucaa

SEQ ID NO: 1201525 - RNA, 15 nt, Mycobacterium bovis subsp bovis AF2122/97
cagcacguaacccag

SEQ ID NO: 1201526 - RNA, 16 nt, Mycobacterium bovis subsp bovis AF2122/97
cagcacguaacccagu

SEQ ID NO: 1201527 - RNA, 17 nt, Mycobacterium bovis subsp bovis AF2122/97
cagcacguccgcggagc

SEQ ID NO: 1201528 - RNA, 18 nt, Mycobacterium bovis subsp bovis AF2122/97
cagcacgugccccaugcg

SEQ ID NO: 1201529 - RNA, 14 nt, Mycobacterium bovis subsp bovis AF2122/97
cagcacgugggcca

SEQ ID NO: 1201530 - RNA, 17 nt, Mycobacterium bovis subsp bovis AF2122/97
cagcacgugggccaacg

SEQ ID NO: 1201531 - RNA, 19 nt, Mycobacterium bovis subsp bovis AF2122/97
cagcacuccaccgcuggcc

SEQ ID NO: 1201532 - RNA, 13 nt, Mycobacterium bovis subsp bovis AF2122/97
cagcacuccggcg

SEQ ID NO: 1201533 - RNA, 19 nt, Mycobacterium bovis subsp bovis AF2122/97
cagcacuuccaagccgacc

SEQ ID NO: 1201534 - RNA, 19 nt, Mycobacterium bovis subsp bovis AF2122/97
cagcagaaacaucgacagc

SEQ ID NO: 1201535 - RNA, 18 nt, Mycobacterium bovis subsp bovis AF2122/97
cagcacuuggacccggcc

SEQ ID NO: 1201536 - RNA, 22 nt, Mycobacterium bovis subsp bovis AF2122/97
cagcacuuggacccggccggcc

SEQ ID NO: 1201537 - RNA, 13 nt, Mycobacterium bovis subsp bovis AF2122/97
cagcagauugucg

SEQ ID NO: 1201538 - RNA, 17 nt, Mycobacterium bovis subsp bovis AF2122/97
cagcagauugaugucag

SEQ ID NO: 1201539 - RNA, 14 nt, Mycobacterium bovis subsp bovis AF2122/97
cagcagccaggagc

SEQ ID NO: 1201540 - RNA, 14 nt, Mycobacterium bovis subsp bovis AF2122/97
cagcagcagguugu

SEQ ID NO: 1201541 - RNA, 14 nt, Mycobacterium bovis subsp bovis AF2122/97
cagcagcaucggca

SEQ ID NO: 1201542 - RNA, 13 nt, Mycobacterium bovis subsp bovis AF2122/97
cagcagcaacgcg

SEQ ID NO: 1201543 - RNA, 21 nt, Mycobacterium bovis subsp bovis AF2122/97
cagcagcacuccggcgacgau

SEQ ID NO: 1201544 - RNA, 16 nt, Mycobacterium bovis subsp bovis AF2122/97
cagcagcagauccugg

SEQ ID NO: 1201545 - RNA, 20 nt, Mycobacterium bovis subsp bovis AF2122/97
cagcagcgacuccagcgccc

SEQ ID NO: 1201546 - RNA, 15 nt, Mycobacterium bovis subsp bovis AF2122/97
cagcagcgacgguca

SEQ ID NO: 1201547 - RNA, 15 nt, Mycobacterium bovis subsp bovis AF2122/97
cagcagcgcacugcc

SEQ ID NO: 1201548 - RNA, 20 nt, Mycobacterium bovis subsp bovis AF2122/97
cagcagcccgacaguggucc

SEQ ID NO: 1201549 - RNA, 21 nt, Mycobacterium bovis subsp bovis AF2122/97
cagcagcccgggcagccccuc

SEQ ID NO: 1201550 - RNA, 17 nt, Mycobacterium bovis subsp bovis AF2122/97
cagcagccgccgaugau

SEQ ID NO: 1201551 - RNA, 12 nt, Mycobacterium bovis subsp bovis AF2122/97
cagcagccgcga

SEQ ID NO: 1201552 - RNA, 18 nt, Mycobacterium bovis subsp bovis AF2122/97
cagcagccgcgacgcggc

SEQ ID NO: 1201553 - RNA, 14 nt, Mycobacterium bovis subsp bovis AF2122/97
cagcagcgccgcgu

SEQ ID NO: 1201554 - RNA, 15 nt, Mycobacterium bovis subsp bovis AF2122/97
cagcagcgcgcgggu

SEQ ID NO: 1201555 - RNA, 16 nt, Mycobacterium bovis subsp bovis AF2122/97
cagcagcgggcgcgcu

SEQ ID NO: 1201556 - RNA, 15 nt, Mycobacterium bovis subsp bovis AF2122/97
cagcagcggcgagcc

SEQ ID NO: 1201557 - RNA, 13 nt, Mycobacterium bovis subsp bovis AF2122/97
cagcaggacaccu

SEQ ID NO: 1201558 - RNA, 21 nt, Mycobacterium bovis subsp bovis AF2122/97
cagcaggaaguaccccuugga

SEQ ID NO: 1201559 - RNA, 18 nt, Mycobacterium bovis subsp bovis AF2122/97
cagcaggaaguagccgag

SEQ ID NO: 1201560 - RNA, 23 nt, Mycobacterium bovis subsp bovis AF2122/97
cagcaggaucggcagcagaguuc

SEQ ID NO: 1201561 - RNA, 20 nt, Mycobacterium bovis subsp bovis AF2122/97
cagcaggaucggcagcagag

SEQ ID NO: 1201562 - RNA, 23 nt, Mycobacterium bovis subsp bovis AF2122/97
cagcagcgucggugccaccacgc

SEQ ID NO: 1201563 - RNA, 20 nt, Mycobacterium bovis subsp bovis AF2122/97
cagcagcuccacuggcgucu

SEQ ID NO: 1201564 - RNA, 20 nt, Mycobacterium bovis subsp bovis AF2122/97
cagcagcucgccggcacgca

SEQ ID NO: 1201565 - RNA, 17 nt, Mycobacterium bovis subsp bovis AF2122/97
cagcaggccacugcguu

SEQ ID NO: 1201566 - RNA, 19 nt, Mycobacterium bovis subsp bovis AF2122/97
cagcaggcccacccgggcg

SEQ ID NO: 1201567 - RNA, 16 nt, Mycobacterium bovis subsp bovis AF2122/97
cagcaggccgggacag

SEQ ID NO: 1201568 - RNA, 21 nt, Mycobacterium bovis subsp bovis AF2122/97
cagcaggccgggcgcaagcag

SEQ ID NO: 1201569 - RNA, 12 nt, Mycobacterium bovis subsp bovis AF2122/97
cagcaggcggcu

SEQ ID NO: 1201570 - RNA, 14 nt, Mycobacterium bovis subsp bovis AF2122/97
cagcaggcggcuga

SEQ ID NO: 1201571 - RNA, 22 nt, Mycobacterium bovis subsp bovis AF2122/97
cagcaggcggcugaacggcagc

SEQ ID NO: 1201572 - RNA, 20 nt, Mycobacterium bovis subsp bovis AF2122/97
cagcagggcgcgcaucugcu

SEQ ID NO: 1201573 - RNA, 23 nt, Mycobacterium bovis subsp bovis AF2122/97
cagcagggcgcgcaucugcucgg

SEQ ID NO: 1201574 - RNA, 23 nt, Mycobacterium bovis subsp bovis AF2122/97
cagcaggggacgggcggccagga

SEQ ID NO: 1201575 - RNA, 14 nt, Mycobacterium bovis subsp bovis AF2122/97
cagcagggccacca

SEQ ID NO: 1201576 - RNA, 22 nt, Mycobacterium bovis subsp bovis AF2122/97
cagcagggccaccaccacggcc

SEQ ID NO: 1201577 - RNA, 17 nt, Mycobacterium bovis subsp bovis AF2122/97
cagcagguuggcgagcu

SEQ ID NO: 1201578 - RNA, 15 nt, Mycobacterium bovis subsp bovis AF2122/97
cagcagguuguaguc

SEQ ID NO: 1201579 - RNA, 22 nt, Mycobacterium bovis subsp bovis AF2122/97
cagcaguggcgcauuggccuga

SEQ ID NO: 1201580 - RNA, 14 nt, Mycobacterium bovis subsp bovis AF2122/97
cagcaguuucaccu

SEQ ID NO: 1201581 - RNA, 23 nt, Mycobacterium bovis subsp bovis AF2122/97
cagcaguuucaccuugcgcacca

SEQ ID NO: 1201582 - RNA, 23 nt, Mycobacterium bovis subsp bovis AF2122/97
cagccacggguagcugccgcggc

SEQ ID NO: 1201583 - RNA, 16 nt, Mycobacterium bovis subsp bovis AF2122/97
cagccaccgucaugcc

SEQ ID NO: 1201584 - RNA, 17 nt, Mycobacterium bovis subsp bovis AF2122/97
cagccaccgucaugccg

SEQ ID NO: 1201585 - RNA, 15 nt, Mycobacterium bovis subsp bovis AF2122/97
cagccacgcaaauac

SEQ ID NO: 1201586 - RNA, 16 nt, Mycobacterium bovis subsp bovis AF2122/97
cagccacgcugucccg

SEQ ID NO: 1201587 - RNA, 13 nt, Mycobacterium bovis subsp bovis AF2122/97
cagccagaucucc

SEQ ID NO: 1201588 - RNA, 17 nt, Mycobacterium bovis subsp bovis AF2122/97
cagccagaucuccccga

SEQ ID NO: 1201589 - RNA, 12 nt, Mycobacterium bovis subsp bovis AF2122/97
cagccagcaaca

SEQ ID NO: 1201590 - RNA, 14 nt, Mycobacterium bovis subsp bovis AF2122/97
cagccagaugccgg

SEQ ID NO: 1201591 - RNA, 16 nt, Mycobacterium bovis subsp bovis AF2122/97
cagccagaugccggua

SEQ ID NO: 1201592 - RNA, 11 nt, Mycobacterium bovis subsp bovis AF2122/97
cagccagacca

SEQ ID NO: 1201593 - RNA, 14 nt, Mycobacterium bovis subsp bovis AF2122/97
cagccagcccagcc

SEQ ID NO: 1201594 - RNA, 13 nt, Mycobacterium bovis subsp bovis AF2122/97
cagccagccaccg

SEQ ID NO: 1201595 - RNA, 14 nt, Mycobacterium bovis subsp bovis AF2122/97
cagccagccaccga

SEQ ID NO: 1201596 - RNA, 16 nt, Mycobacterium bovis subsp bovis AF2122/97
cagccagcccagccgc

SEQ ID NO: 1201597 - RNA, 12 nt, Mycobacterium bovis subsp bovis AF2122/97
cagccagcaagu

SEQ ID NO: 1201598 - RNA, 18 nt, Mycobacterium bovis subsp bovis AF2122/97
cagccagauucauuggcc

SEQ ID NO: 1201599 - RNA, 12 nt, Mycobacterium bovis subsp bovis AF2122/97
cagccagccacc

SEQ ID NO: 1201600 - RNA, 12 nt, Mycobacterium bovis subsp bovis AF2122/97
cagccaggagcc

SEQ ID NO: 1201601 - RNA, 22 nt, Mycobacterium bovis subsp bovis AF2122/97
cagccagcuggacuccggucag

SEQ ID NO: 1201602 - RNA, 18 nt, Mycobacterium bovis subsp bovis AF2122/97
cagccagcuggacuccgg

SEQ ID NO: 1201603 - RNA, 20 nt, Mycobacterium bovis subsp bovis AF2122/97
cagccaggccuuggugcggc

SEQ ID NO: 1201604 - RNA, 12 nt, Mycobacterium bovis subsp bovis AF2122/97
cagccaggaagc

SEQ ID NO: 1201605 - RNA, 18 nt, Mycobacterium bovis subsp bovis AF2122/97
cagccaggccgcaaugcg

SEQ ID NO: 1201606 - RNA, 17 nt, Mycobacterium bovis subsp bovis AF2122/97
cagccaggccagugcca

SEQ ID NO: 1201607 - RNA, 12 nt, Mycobacterium bovis subsp bovis AF2122/97
cagccagccugc

SEQ ID NO: 1201608 - RNA, 14 nt, Mycobacterium bovis subsp bovis AF2122/97
cagccagccgcccu

SEQ ID NO: 1201609 - RNA, 19 nt, Mycobacterium bovis subsp bovis AF2122/97
cagccaguccagcgcgcca

SEQ ID NO: 1201610 - RNA, 20 nt, Mycobacterium bovis subsp bovis AF2122/97
cagccaguguugcaguggcg

SEQ ID NO: 1201611 - RNA, 19 nt, Mycobacterium bovis subsp bovis AF2122/97
cagccaguguugcaguggc

SEQ ID NO: 1201612 - RNA, 18 nt, Mycobacterium bovis subsp bovis AF2122/97
cagccagggucccgccgc

SEQ ID NO: 1201613 - RNA, 22 nt, Mycobacterium bovis subsp bovis AF2122/97
cagccaggugauuaccugguuc

SEQ ID NO: 1201614 - RNA, 23 nt, Mycobacterium bovis subsp bovis AF2122/97
cagccaguaaaaaggcaggacug

SEQ ID NO: 1201615 - RNA, 20 nt, Mycobacterium bovis subsp bovis AF2122/97
cagccaggcgugcacagguc

SEQ ID NO: 1201616 - RNA, 12 nt, Mycobacterium bovis subsp bovis AF2122/97
cagccaggcugc

SEQ ID NO: 1201617 - RNA, 21 nt, Mycobacterium bovis subsp bovis AF2122/97
cagccagggucccgccgccug

SEQ ID NO: 1201618 - RNA, 21 nt, Mycobacterium bovis subsp bovis AF2122/97
cagccccgcgcccaccccggc

SEQ ID NO: 1201619 - RNA, 17 nt, Mycobacterium bovis subsp bovis AF2122/97
cagccccgcggccagca

SEQ ID NO: 1201620 - RNA, 14 nt, Mycobacterium bovis subsp bovis AF2122/97
cagccccgacugcg

SEQ ID NO: 1201621 - RNA, 16 nt, Mycobacterium bovis subsp bovis AF2122/97
cagccccuccgcgccg

SEQ ID NO: 1201622 - RNA, 16 nt, Mycobacterium bovis subsp bovis AF2122/97
cagccccugccgaucc

SEQ ID NO: 1201623 - RNA, 13 nt, Mycobacterium bovis subsp bovis AF2122/97
cagccccuccgcg

SEQ ID NO: 1201624 - RNA, 12 nt, Mycobacterium bovis subsp bovis AF2122/97
cagccccacccg

SEQ ID NO: 1201625 - RNA, 18 nt, Mycobacterium bovis subsp bovis AF2122/97
cagccccacccgccgccg

SEQ ID NO: 1201626 - RNA, 12 nt, Mycobacterium bovis subsp bovis AF2122/97
cagcccaugggg

SEQ ID NO: 1201627 - RNA, 17 nt, Mycobacterium bovis subsp bovis AF2122/97
cagcccaugcgccacgc

SEQ ID NO: 1201628 - RNA, 15 nt, Mycobacterium bovis subsp bovis AF2122/97
cagcccaaaucccag

SEQ ID NO: 1201629 - RNA, 19 nt, Mycobacterium bovis subsp bovis AF2122/97
cagcccaacucggccagcu

SEQ ID NO: 1201630 - RNA, 23 nt, Mycobacterium bovis subsp bovis AF2122/97
cagcccacaggcggcgcugcagc

SEQ ID NO: 1201631 - RNA, 13 nt, Mycobacterium bovis subsp bovis AF2122/97
cagcccaggccuu

SEQ ID NO: 1201632 - RNA, 16 nt, Mycobacterium bovis subsp bovis AF2122/97
cagcccagccgccagc

SEQ ID NO: 1201633 - RNA, 21 nt, Mycobacterium bovis subsp bovis AF2122/97
cagcccagccguucgucgcgg

SEQ ID NO: 1201634 - RNA, 10 nt, Mycobacterium bovis subsp bovis AF2122/97
cagcccacuc

SEQ ID NO: 1201635 - RNA, 14 nt, Mycobacterium bovis subsp bovis AF2122/97
cagcccagcacgcu

SEQ ID NO: 1201636 - RNA, 19 nt, Mycobacterium bovis subsp bovis AF2122/97
cagcccagcacgcuggcgu

SEQ ID NO: 1201637 - RNA, 22 nt, Mycobacterium bovis subsp bovis AF2122/97
cagcccagcagguuccacggcc

SEQ ID NO: 1201638 - RNA, 20 nt, Mycobacterium bovis subsp bovis AF2122/97
cagcccacgaaugcaagacc

SEQ ID NO: 1201639 - RNA, 21 nt, Mycobacterium bovis subsp bovis AF2122/97
cagcccaccggcgccgccggc

SEQ ID NO: 1201640 - RNA, 16 nt, Mycobacterium bovis subsp bovis AF2122/97
cagcccaccggugccg

SEQ ID NO: 1201641 - RNA, 16 nt, Mycobacterium bovis subsp bovis AF2122/97
cagccauggugggccu

SEQ ID NO: 1201642 - RNA, 18 nt, Mycobacterium bovis subsp bovis AF2122/97
cagccauggugggccuuc

SEQ ID NO: 1201643 - RNA, 20 nt, Mycobacterium bovis subsp bovis AF2122/97
cagccauggugggccuuccu

SEQ ID NO: 1201644 - RNA, 22 nt, Mycobacterium bovis subsp bovis AF2122/97
cagccauacuccgagggaacgg

SEQ ID NO: 1201645 - RNA, 15 nt, Mycobacterium bovis subsp bovis AF2122/97
cagccauagugcggc

SEQ ID NO: 1201646 - RNA, 15 nt, Mycobacterium bovis subsp bovis AF2122/97
cagcauccccgcagc

SEQ ID NO: 1201647 - RNA, 19 nt, Mycobacterium bovis subsp bovis AF2122/97
cagcauccccgcagcgucc

SEQ ID NO: 1201648 - RNA, 13 nt, Mycobacterium bovis subsp bovis AF2122/97
cagcaucagcgcc

SEQ ID NO: 1201649 - RNA, 20 nt, Mycobacterium bovis subsp bovis AF2122/97
cagcaucagcgccagcgagc

SEQ ID NO: 1201650 - RNA, 23 nt, Mycobacterium bovis subsp bovis AF2122/97
cagcauaucgauucgggcgucgg

SEQ ID NO: 1201651 - RNA, 18 nt, Mycobacterium bovis subsp bovis AF2122/97
cagcaugacaccggccac

SEQ ID NO: 1201652 - RNA, 22 nt, Mycobacterium bovis subsp bovis AF2122/97
cagcaugacaccggccaccagc

SEQ ID NO: 1201653 - RNA, 22 nt, Mycobacterium bovis subsp bovis AF2122/97
cagcaucugcgggucggcaucg

SEQ ID NO: 1201654 - RNA, 15 nt, Mycobacterium bovis subsp bovis AF2122/97
cagcaugacaccggc

SEQ ID NO: 1201655 - RNA, 16 nt, Mycobacterium bovis subsp bovis AF2122/97
cagcaugcccgccauc

SEQ ID NO: 1201656 - RNA, 13 nt, Mycobacterium bovis subsp bovis AF2122/97
cagcaugcggcca

SEQ ID NO: 1201657 - RNA, 20 nt, Mycobacterium bovis subsp bovis AF2122/97
cagcaucggugcgggcgcca

SEQ ID NO: 1201658 - RNA, 15 nt, Mycobacterium bovis subsp bovis AF2122/97
cagcaucggcacccc

SEQ ID NO: 1201659 - RNA, 18 nt, Mycobacterium bovis subsp bovis AF2122/97
cagcaucggcaccccggc

SEQ ID NO: 1201660 - RNA, 21 nt, Mycobacterium bovis subsp bovis AF2122/97
cagcaucuccgucggccaggc

SEQ ID NO: 1201661 - RNA, 21 nt, Mycobacterium bovis subsp bovis AF2122/97
cagcauccggccgucaucugg

SEQ ID NO: 1201662 - RNA, 13 nt, Mycobacterium bovis subsp bovis AF2122/97
cagcaugguggac

SEQ ID NO: 1201663 - RNA, 17 nt, Mycobacterium bovis subsp bovis AF2122/97
cagcauggcccuggcga

SEQ ID NO: 1201664 - RNA, 22 nt, Mycobacterium bovis subsp bovis AF2122/97
cagcauggcccuggcgaccagc

SEQ ID NO: 1201665 - RNA, 22 nt, Mycobacterium bovis subsp bovis AF2122/97
cagcaugguccacagccggcgg

SEQ ID NO: 1201666 - RNA, 13 nt, Mycobacterium bovis subsp bovis AF2122/97
cagcauucaccaa

SEQ ID NO: 1201667 - RNA, 17 nt, Mycobacterium bovis subsp bovis AF2122/97
cagcauucaccaaaccg

SEQ ID NO: 1201668 - RNA, 16 nt, Mycobacterium bovis subsp bovis AF2122/97
cagcauugaagaagcc

SEQ ID NO: 1201669 - RNA, 15 nt, Mycobacterium bovis subsp bovis AF2122/97
cagccaacgcguccc

SEQ ID NO: 1201670 - RNA, 14 nt, Mycobacterium bovis subsp bovis AF2122/97
cagccaaccggcgc

SEQ ID NO: 1201671 - RNA, 22 nt, Mycobacterium bovis subsp bovis AF2122/97
cagccaaccggcgcaguagccg

SEQ ID NO: 1201672 - RNA, 16 nt, Mycobacterium bovis subsp bovis AF2122/97
cagccaaccguccggg

SEQ ID NO: 1201673 - RNA, 17 nt, Mycobacterium bovis subsp bovis AF2122/97
cagccaacgggaacaac

SEQ ID NO: 1201674 - RNA, 23 nt, Mycobacterium bovis subsp bovis AF2122/97
cagccacauacaggcccgccagc

SEQ ID NO: 1201675 - RNA, 21 nt, Mycobacterium bovis subsp bovis AF2122/97
cagccaccacaucgcgggcgu

SEQ ID NO: 1201676 - RNA, 14 nt, Mycobacterium bovis subsp bovis AF2122/97
cagccaccaucugg

SEQ ID NO: 1201677 - RNA, 15 nt, Mycobacterium bovis subsp bovis AF2122/97
cagccaccgcaugug

SEQ ID NO: 1201678 - RNA, 18 nt, Mycobacterium bovis subsp bovis AF2122/97
cagccaccgcauguggga

SEQ ID NO: 1201679 - RNA, 18 nt, Mycobacterium bovis subsp bovis AF2122/97
cagccaccaucuggaugg

SEQ ID NO: 1201680 - RNA, 19 nt, Mycobacterium bovis subsp bovis AF2122/97
cagccacagccgaccucga

SEQ ID NO: 1201681 - RNA, 18 nt, Mycobacterium bovis subsp bovis AF2122/97
cagccacagcccggcggc

SEQ ID NO: 1201682 - RNA, 18 nt, Mycobacterium bovis subsp bovis AF2122/97
cacugccgcgcgcccgcc

SEQ ID NO: 1201683 - RNA, 12 nt, Mycobacterium bovis subsp bovis AF2122/97
cacugcgagcgc

SEQ ID NO: 1201684 - RNA, 16 nt, Mycobacterium bovis subsp bovis AF2122/97
cacugcgagcgccggc

SEQ ID NO: 1201685 - RNA, 13 nt, Mycobacterium bovis subsp bovis AF2122/97
cacugcggcagcg

SEQ ID NO: 1201686 - RNA, 17 nt, Mycobacterium bovis subsp bovis AF2122/97
cacugcggcagguucgg

SEQ ID NO: 1201687 - RNA, 15 nt, Mycobacterium bovis subsp bovis AF2122/97
cacugcgccgugacc

SEQ ID NO: 1201688 - RNA, 22 nt, Mycobacterium bovis subsp bovis AF2122/97
cacugcgcgugcucgacgcgca

SEQ ID NO: 1201689 - RNA, 15 nt, Mycobacterium bovis subsp bovis AF2122/97
cacugcgcccgccac

SEQ ID NO: 1201690 - RNA, 16 nt, Mycobacterium bovis subsp bovis AF2122/97
cacugcccagcagacc

SEQ ID NO: 1201691 - RNA, 17 nt, Mycobacterium bovis subsp bovis AF2122/97
cacugccccgcaucgcc

SEQ ID NO: 1201692 - RNA, 15 nt, Mycobacterium bovis subsp bovis AF2122/97
cacugcccggggucc

SEQ ID NO: 1201693 - RNA, 15 nt, Mycobacterium bovis subsp bovis AF2122/97
cacugcccggggugc

SEQ ID NO: 1201694 - RNA, 13 nt, Mycobacterium bovis subsp bovis AF2122/97
cacugccgagcac

SEQ ID NO: 1201695 - RNA, 12 nt, Mycobacterium bovis subsp bovis AF2122/97
caauguccaggc

SEQ ID NO: 1201696 - RNA, 15 nt, Mycobacterium bovis subsp bovis AF2122/97
cacuguugaagaagc

SEQ ID NO: 1201697 - RNA, 17 nt, Mycobacterium bovis subsp bovis AF2122/97
cacuuaccgagccguca

SEQ ID NO: 1201698 - RNA, 18 nt, Mycobacterium bovis subsp bovis AF2122/97
cacugugccgcugcaucc

SEQ ID NO: 1201699 - RNA, 23 nt, Mycobacterium bovis subsp bovis AF2122/97
cacuggugcagcgccgacagccg

SEQ ID NO: 1201700 - RNA, 16 nt, Mycobacterium bovis subsp bovis AF2122/97
cacuggucgcggcgcu

SEQ ID NO: 1201701 - RNA, 14 nt, Mycobacterium bovis subsp bovis AF2122/97
cacuggucaacggg

SEQ ID NO: 1201702 - RNA, 22 nt, Mycobacterium bovis subsp bovis AF2122/97
cacuggggccccgggaagugaa

SEQ ID NO: 1201703 - RNA, 22 nt, Mycobacterium bovis subsp bovis AF2122/97
cacugggugcgucgacccagcu

SEQ ID NO: 1201704 - RNA, 23 nt, Mycobacterium bovis subsp bovis AF2122/97
cacuggggugcugcgcgcggcgg

SEQ ID NO: 1201705 - RNA, 23 nt, Mycobacterium bovis subsp bovis AF2122/97
cacuggcggaccgguaggcaccg

SEQ ID NO: 1201706 - RNA, 17 nt, Mycobacterium bovis subsp bovis AF2122/97
cacugcucgucgcgcau

SEQ ID NO: 1201707 - RNA, 20 nt, Mycobacterium bovis subsp bovis AF2122/97
cacugcggcauggcaggcga

SEQ ID NO: 1201708 - RNA, 17 nt, Mycobacterium bovis subsp bovis AF2122/97
cacuggaauggaucucg

SEQ ID NO: 1201709 - RNA, 12 nt, Mycobacterium bovis subsp bovis AF2122/97
cacuucggcgcc

SEQ ID NO: 1201710 - RNA, 17 nt, Mycobacterium bovis subsp bovis AF2122/97
cacuucggcgccgcgcc

SEQ ID NO: 1201711 - RNA, 22 nt, Mycobacterium bovis subsp bovis AF2122/97
cacuuccgggcagcugggcagg

SEQ ID NO: 1201712 - RNA, 21 nt, Mycobacterium bovis subsp bovis AF2122/97
cacuugaaguucuucuccguc

SEQ ID NO: 1201713 - RNA, 16 nt, Mycobacterium bovis subsp bovis AF2122/97
cacuucccccgggucc

SEQ ID NO: 1201714 - RNA, 16 nt, Mycobacterium bovis subsp bovis AF2122/97
cacuuccagcccggca

SEQ ID NO: 1201715 - RNA, 17 nt, Mycobacterium bovis subsp bovis AF2122/97
cacuucacgccgccccu

SEQ ID NO: 1201716 - RNA, 21 nt, Mycobacterium bovis subsp bovis AF2122/97
cacuugcucggugagccucuu

SEQ ID NO: 1201717 - RNA, 17 nt, Mycobacterium bovis subsp bovis AF2122/97
cacuuggucacccaauu

SEQ ID NO: 1201718 - RNA, 19 nt, Mycobacterium bovis subsp bovis AF2122/97
cacuugaugccgcacccga

SEQ ID NO: 1201719 - RNA, 12 nt, Mycobacterium bovis subsp bovis AF2122/97
cacuugaugcuc

SEQ ID NO: 1201720 - RNA, 13 nt, Mycobacterium bovis subsp bovis AF2122/97
cacuugccgggca

SEQ ID NO: 1201721 - RNA, 16 nt, Mycobacterium bovis subsp bovis AF2122/97
cacuuucgacccgcgg

SEQ ID NO: 1201722 - RNA, 18 nt, Mycobacterium bovis subsp bovis AF2122/97
cacuuuccgaggagggcc

SEQ ID NO: 1201723 - RNA, 13 nt, Mycobacterium bovis subsp bovis AF2122/97
cacuuuccggccg

SEQ ID NO: 1201724 - RNA, 19 nt, Mycobacterium bovis subsp bovis AF2122/97
cacuuuuccgccggccagg

SEQ ID NO: 1201725 - RNA, 17 nt, Mycobacterium bovis subsp bovis AF2122/97
cagaacaccaccgccag

SEQ ID NO: 1201726 - RNA, 12 nt, Mycobacterium bovis subsp bovis AF2122/97
cagaacaccacc

SEQ ID NO: 1201727 - RNA, 20 nt, Mycobacterium bovis subsp bovis AF2122/97
cagaaaugguucgcacaccu

SEQ ID NO: 1201728 - RNA, 15 nt, Mycobacterium bovis subsp bovis AF2122/97
cagaaacaacgucgc

SEQ ID NO: 1201729 - RNA, 14 nt, Mycobacterium bovis subsp bovis AF2122/97
cagaacgacaccgc

SEQ ID NO: 1201730 - RNA, 23 nt, Mycobacterium bovis subsp bovis AF2122/97
cagaacggcguugcggaaucagc

SEQ ID NO: 1201731 - RNA, 22 nt, Mycobacterium bovis subsp bovis AF2122/97
cagaacgucggugugcgcgcca

SEQ ID NO: 1201732 - RNA, 14 nt, Mycobacterium bovis subsp bovis AF2122/97
cagaacucaccgac

SEQ ID NO: 1201733 - RNA, 20 nt, Mycobacterium bovis subsp bovis AF2122/97
cagaacucaccgacggauga

SEQ ID NO: 1201734 - RNA, 18 nt, Mycobacterium bovis subsp bovis AF2122/97
cagaaccuggagccgugc

SEQ ID NO: 1201735 - RNA, 22 nt, Mycobacterium bovis subsp bovis AF2122/97
cagaacggaauucagcgacgcu

SEQ ID NO: 1201736 - RNA, 21 nt, Mycobacterium bovis subsp bovis AF2122/97
cagaaccacuuuccgaggagg

SEQ ID NO: 1201737 - RNA, 15 nt, Mycobacterium bovis subsp bovis AF2122/97
cagaaggccagcgaa

SEQ ID NO: 1201738 - RNA, 17 nt, Mycobacterium bovis subsp bovis AF2122/97
cagaccgaacagcaccg

SEQ ID NO: 1201739 - RNA, 21 nt, Mycobacterium bovis subsp bovis AF2122/97
cagaccgccaccggcugauuc

SEQ ID NO: 1201740 - RNA, 14 nt, Mycobacterium bovis subsp bovis AF2122/97
cagaccgcaccauu

SEQ ID NO: 1201741 - RNA, 22 nt, Mycobacterium bovis subsp bovis AF2122/97
cagacccgaauccaccagcugg

SEQ ID NO: 1201742 - RNA, 22 nt, Mycobacterium bovis subsp bovis AF2122/97
cagacccuggccgucccaccag

SEQ ID NO: 1201743 - RNA, 16 nt, Mycobacterium bovis subsp bovis AF2122/97
cagacccgugccguca

SEQ ID NO: 1201744 - RNA, 15 nt, Mycobacterium bovis subsp bovis AF2122/97
cagaccggaaacagc

SEQ ID NO: 1201745 - RNA, 16 nt, Mycobacterium bovis subsp bovis AF2122/97
cagaccuagcaccgcg

SEQ ID NO: 1201746 - RNA, 16 nt, Mycobacterium bovis subsp bovis AF2122/97
cagaccguccagcaac

SEQ ID NO: 1201747 - RNA, 23 nt, Mycobacterium bovis subsp bovis AF2122/97
cagaccgugacguagggcagcgc

SEQ ID NO: 1201748 - RNA, 18 nt, Mycobacterium bovis subsp bovis AF2122/97
cagaccagggcagcggcc

SEQ ID NO: 1201749 - RNA, 13 nt, Mycobacterium bovis subsp bovis AF2122/97
cagacccaccacc

SEQ ID NO: 1201750 - RNA, 15 nt, Mycobacterium bovis subsp bovis AF2122/97
cagacccaccaccgc

SEQ ID NO: 1201751 - RNA, 22 nt, Mycobacterium bovis subsp bovis AF2122/97
cagaccaaugaccgccagcagc

SEQ ID NO: 1201752 - RNA, 23 nt, Mycobacterium bovis subsp bovis AF2122/97
cagaccaaugaccgccagcagca

SEQ ID NO: 1201753 - RNA, 14 nt, Mycobacterium bovis subsp bovis AF2122/97
cagaccaccgccug

SEQ ID NO: 1201754 - RNA, 13 nt, Mycobacterium bovis subsp bovis AF2122/97
cagacacagaauc

SEQ ID NO: 1201755 - RNA, 14 nt, Mycobacterium bovis subsp bovis AF2122/97
cagacacagcaccg

SEQ ID NO: 1201756 - RNA, 13 nt, Mycobacterium bovis subsp bovis AF2122/97
cagacacgcugca

SEQ ID NO: 1201757 - RNA, 14 nt, Mycobacterium bovis subsp bovis AF2122/97
cagacagcugcaca

SEQ ID NO: 1201758 - RNA, 19 nt, Mycobacterium bovis subsp bovis AF2122/97
cagacacuggucgcggcgc

SEQ ID NO: 1201759 - RNA, 21 nt, Mycobacterium bovis subsp bovis AF2122/97
cagacauggcaagucaacacc

SEQ ID NO: 1201760 - RNA, 23 nt, Mycobacterium bovis subsp bovis AF2122/97
cagacaggcggcggccuggcacc

SEQ ID NO: 1201761 - RNA, 13 nt, Mycobacterium bovis subsp bovis AF2122/97
cagaccaacauga

SEQ ID NO: 1201762 - RNA, 19 nt, Mycobacterium bovis subsp bovis AF2122/97
cagaccaacaugaacguca

SEQ ID NO: 1201763 - RNA, 12 nt, Mycobacterium bovis subsp bovis AF2122/97
cagaccaagccc

SEQ ID NO: 1201764 - RNA, 23 nt, Mycobacterium bovis subsp bovis AF2122/97
cagaccaagcccgucgucgugca

SEQ ID NO: 1201765 - RNA, 15 nt, Mycobacterium bovis subsp bovis AF2122/97
cagacaugucaggcc

SEQ ID NO: 1201766 - RNA, 16 nt, Mycobacterium bovis subsp bovis AF2122/97
cagacaacgccgucga

SEQ ID NO: 1201767 - RNA, 12 nt, Mycobacterium bovis subsp bovis AF2122/97
cagacaacaaca

SEQ ID NO: 1201768 - RNA, 17 nt, Mycobacterium bovis subsp bovis AF2122/97
cagaauugugugcagca

SEQ ID NO: 1201769 - RNA, 18 nt, Mycobacterium bovis subsp bovis AF2122/97
cagaaugccuggcccguc

SEQ ID NO: 1201770 - RNA, 14 nt, Mycobacterium bovis subsp bovis AF2122/97
cagaaucugccucu

SEQ ID NO: 1201771 - RNA, 18 nt, Mycobacterium bovis subsp bovis AF2122/97
cagaaucgcacgcgaaau

SEQ ID NO: 1201772 - RNA, 21 nt, Mycobacterium bovis subsp bovis AF2122/97
cagaaucucgccgggcugcaa

SEQ ID NO: 1201773 - RNA, 22 nt, Mycobacterium bovis subsp bovis AF2122/97
cagaaucaggcucgccgaugcu

SEQ ID NO: 1201774 - RNA, 20 nt, Mycobacterium bovis subsp bovis AF2122/97
cagaaucccaacuccuccaa

SEQ ID NO: 1201775 - RNA, 17 nt, Mycobacterium bovis subsp bovis AF2122/97
cagaaucgaccgccgcu

SEQ ID NO: 1201776 - RNA, 20 nt, Mycobacterium bovis subsp bovis AF2122/97
cagaauccugcgcugcacca

SEQ ID NO: 1201777 - RNA, 20 nt, Mycobacterium bovis subsp bovis AF2122/97
cagacgcucuugaauaggaa

SEQ ID NO: 1201778 - RNA, 19 nt, Mycobacterium bovis subsp bovis AF2122/97
cagacgcucgaccugccuu

SEQ ID NO: 1201779 - RNA, 20 nt, Mycobacterium bovis subsp bovis AF2122/97
cagacgccacugccagccgu

SEQ ID NO: 1201780 - RNA, 15 nt, Mycobacterium bovis subsp bovis AF2122/97
cagacgccccuuccc

SEQ ID NO: 1201781 - RNA, 17 nt, Mycobacterium bovis subsp bovis AF2122/97
cagacgcagaagccccc

SEQ ID NO: 1201782 - RNA, 18 nt, Mycobacterium bovis subsp bovis AF2122/97
cagacgcagaaucgccca

SEQ ID NO: 1201783 - RNA, 24 nt, Mycobacterium bovis subsp bovis AF2122/97
cagacguuccaucacggaccaggc

SEQ ID NO: 1201784 - RNA, 17 nt, Mycobacterium bovis subsp bovis AF2122/97
cagacgucaugcggaua

SEQ ID NO: 1201785 - RNA, 22 nt, Mycobacterium bovis subsp bovis AF2122/97
cagacggugaagccgagcgccc

SEQ ID NO: 1201786 - RNA, 17 nt, Mycobacterium bovis subsp bovis AF2122/97
cagacggugcagcuccc

SEQ ID NO: 1201787 - RNA, 20 nt, Mycobacterium bovis subsp bovis AF2122/97
cagacggggucgcccggggc

SEQ ID NO: 1201788 - RNA, 15 nt, Mycobacterium bovis subsp bovis AF2122/97
cagacggcugccacg

SEQ ID NO: 1201789 - RNA, 14 nt, Mycobacterium bovis subsp bovis AF2122/97
cagacggcucagcg

SEQ ID NO: 1201790 - RNA, 18 nt, Mycobacterium bovis subsp bovis AF2122/97
cagacuccguugccaccu

SEQ ID NO: 1201791 - RNA, 20 nt, Mycobacterium bovis subsp bovis AF2122/97
cagagaaaccgcgaacaacc

SEQ ID NO: 1201792 - RNA, 18 nt, Mycobacterium bovis subsp bovis AF2122/97
cagagaacuccgccacca

SEQ ID NO: 1201793 - RNA, 16 nt, Mycobacterium bovis subsp bovis AF2122/97
cagagacgaucaucuc

SEQ ID NO: 1201794 - RNA, 18 nt, Mycobacterium bovis subsp bovis AF2122/97
cagagacguacugggcga

SEQ ID NO: 1201795 - RNA, 17 nt, Mycobacterium bovis subsp bovis AF2122/97
cagagaucagcacccaa

SEQ ID NO: 1201796 - RNA, 14 nt, Mycobacterium bovis subsp bovis AF2122/97
cagagacagcgcca

SEQ ID NO: 1201797 - RNA, 17 nt, Mycobacterium bovis subsp bovis AF2122/97
cagagccgcugcggcac

SEQ ID NO: 1201798 - RNA, 15 nt, Mycobacterium bovis subsp bovis AF2122/97
cagagccgggcuggc

SEQ ID NO: 1201799 - RNA, 19 nt, Mycobacterium bovis subsp bovis AF2122/97
cagagcaccgcgaacagca

SEQ ID NO: 1201800 - RNA, 16 nt, Mycobacterium bovis subsp bovis AF2122/97
cagagcacgcgcggcg

SEQ ID NO: 1201801 - RNA, 21 nt, Mycobacterium bovis subsp bovis AF2122/97
cagagcgcugguuggccugcc

SEQ ID NO: 1201802 - RNA, 22 nt, Mycobacterium bovis subsp bovis AF2122/97
cagagcgaacccccgccgcgca

SEQ ID NO: 1201803 - RNA, 21 nt, Mycobacterium bovis subsp bovis AF2122/97
cagaggcgcaagaaugccgcc

SEQ ID NO: 1201804 - RNA, 14 nt, Mycobacterium bovis subsp bovis AF2122/97
cagagugaggcgcu

SEQ ID NO: 1201805 - RNA, 12 nt, Mycobacterium bovis subsp bovis AF2122/97
cagagugaaucc

SEQ ID NO: 1201806 - RNA, 17 nt, Mycobacterium bovis subsp bovis AF2122/97
cagaggucacgcagcac

SEQ ID NO: 1201807 - RNA, 19 nt, Mycobacterium bovis subsp bovis AF2122/97
cagaggucggucagccacc

SEQ ID NO: 1201808 - RNA, 12 nt, Mycobacterium bovis subsp bovis AF2122/97
cagagucaacag

SEQ ID NO: 1201809 - RNA, 15 nt, Mycobacterium bovis subsp bovis AF2122/97
cagauaccaccgccg

SEQ ID NO: 1201810 - RNA, 23 nt, Mycobacterium bovis subsp bovis AF2122/97
cagauaccaccgccgcugccggu

SEQ ID NO: 1201811 - RNA, 14 nt, Mycobacterium bovis subsp bovis AF2122/97
cagauacgagcugu

SEQ ID NO: 1201812 - RNA, 16 nt, Mycobacterium bovis subsp bovis AF2122/97
cagauaaggaucagaa

SEQ ID NO: 1201813 - RNA, 21 nt, Mycobacterium bovis subsp bovis AF2122/97
cagauagguuccaccgggcgu

SEQ ID NO: 1201814 - RNA, 19 nt, Mycobacterium bovis subsp bovis AF2122/97
cagauaggacccagccagc

SEQ ID NO: 1201815 - RNA, 17 nt, Mycobacterium bovis subsp bovis AF2122/97
cagauagugcauguauu

SEQ ID NO: 1201816 - RNA, 21 nt, Mycobacterium bovis subsp bovis AF2122/97
cagauaugacggcagaccaug

SEQ ID NO: 1201817 - RNA, 17 nt, Mycobacterium bovis subsp bovis AF2122/97
cagaucaacaucaucac

SEQ ID NO: 1201818 - RNA, 14 nt, Mycobacterium bovis subsp bovis AF2122/97
cagaucaccgccag

SEQ ID NO: 1201819 - RNA, 16 nt, Mycobacterium bovis subsp bovis AF2122/97
cagaucaccgccagcu

SEQ ID NO: 1201820 - RNA, 20 nt, Mycobacterium bovis subsp bovis AF2122/97
cagaucaacgcgaaccgucu

SEQ ID NO: 1201821 - RNA, 18 nt, Mycobacterium bovis subsp bovis AF2122/97
cagaucacgggugugccu

SEQ ID NO: 1201822 - RNA, 17 nt, Mycobacterium bovis subsp bovis AF2122/97
cagaucagccgccgccu

SEQ ID NO: 1201823 - RNA, 14 nt, Mycobacterium bovis subsp bovis AF2122/97
cagauccccgccac

SEQ ID NO: 1201824 - RNA, 15 nt, Mycobacterium bovis subsp bovis AF2122/97
cagaucccgccgcgg

SEQ ID NO: 1201825 - RNA, 16 nt, Mycobacterium bovis subsp bovis AF2122/97
cagaugcagcggucca

SEQ ID NO: 1201826 - RNA, 17 nt, Mycobacterium bovis subsp bovis AF2122/97
cagaugagucaaaaucc

SEQ ID NO: 1201827 - RNA, 21 nt, Mycobacterium bovis subsp bovis AF2122/97
cagaugaugccguucggaccc

SEQ ID NO: 1201828 - RNA, 13 nt, Mycobacterium bovis subsp bovis AF2122/97
cagaugagucaaa

SEQ ID NO: 1201829 - RNA, 17 nt, Mycobacterium bovis subsp bovis AF2122/97
cagaugaaagugccagu

SEQ ID NO: 1201830 - RNA, 17 nt, Mycobacterium bovis subsp bovis AF2122/97
cagaugcggcccgggcu

SEQ ID NO: 1201831 - RNA, 17 nt, Mycobacterium bovis subsp bovis AF2122/97
cagaugcauccagcugc

SEQ ID NO: 1201832 - RNA, 19 nt, Mycobacterium bovis subsp bovis AF2122/97
cagaucguagugcgcgcca

SEQ ID NO: 1201833 - RNA, 14 nt, Mycobacterium bovis subsp bovis AF2122/97
cagaucguccaccg

SEQ ID NO: 1201834 - RNA, 15 nt, Mycobacterium bovis subsp bovis AF2122/97
cagaucguccaccgc

SEQ ID NO: 1201835 - RNA, 20 nt, Mycobacterium bovis subsp bovis AF2122/97
cagaucuccaagcucgacaa

SEQ ID NO: 1201836 - RNA, 21 nt, Mycobacterium bovis subsp bovis AF2122/97
cagaucuccagguuccagguc

SEQ ID NO: 1201837 - RNA, 13 nt, Mycobacterium bovis subsp bovis AF2122/97
cagaucuugcagu

SEQ ID NO: 1201838 - RNA, 17 nt, Mycobacterium bovis subsp bovis AF2122/97
cagaucgcacaccaaca

SEQ ID NO: 1201839 - RNA, 17 nt, Mycobacterium bovis subsp bovis AF2122/97
cagaucgagggggacgc

SEQ ID NO: 1201840 - RNA, 18 nt, Mycobacterium bovis subsp bovis AF2122/97
cagaucgccgggcuuggc

SEQ ID NO: 1201841 - RNA, 18 nt, Mycobacterium bovis subsp bovis AF2122/97
cagaucgcgguccgagcg

SEQ ID NO: 1201842 - RNA, 17 nt, Mycobacterium bovis subsp bovis AF2122/97
cagaucggcgacgccgu

SEQ ID NO: 1201843 - RNA, 22 nt, Mycobacterium bovis subsp bovis AF2122/97
cagauugccgagcccagguggu

SEQ ID NO: 1201844 - RNA, 16 nt, Mycobacterium bovis subsp bovis AF2122/97
cagauucgcgcuggcc

SEQ ID NO: 1201845 - RNA, 12 nt, Mycobacterium bovis subsp bovis AF2122/97
cagauggggcuc

SEQ ID NO: 1201846 - RNA, 19 nt, Mycobacterium bovis subsp bovis AF2122/97
cagauguaccucaucgcag

SEQ ID NO: 1201847 - RNA, 12 nt, Mycobacterium bovis subsp bovis AF2122/97
cagauggugaac

SEQ ID NO: 1201848 - RNA, 21 nt, Mycobacterium bovis subsp bovis AF2122/97
cagaugguuggaucgccaccg

SEQ ID NO: 1201849 - RNA, 18 nt, Mycobacterium bovis subsp bovis AF2122/97
cagcaaaaaccagcgucc

SEQ ID NO: 1201850 - RNA, 15 nt, Mycobacterium bovis subsp bovis AF2122/97
cagauuugcuccagc

SEQ ID NO: 1201851 - RNA, 16 nt, Mycobacterium bovis subsp bovis AF2122/97
cagauugucgcugaau

SEQ ID NO: 1201852 - RNA, 18 nt, Mycobacterium bovis subsp bovis AF2122/97
cagauugcucggugguga

SEQ ID NO: 1201853 - RNA, 17 nt, Mycobacterium bovis subsp bovis AF2122/97
cagauugucgacgguca

SEQ ID NO: 1201854 - RNA, 12 nt, Mycobacterium bovis subsp bovis AF2122/97
cagcaccaccac

SEQ ID NO: 1201855 - RNA, 16 nt, Mycobacterium bovis subsp bovis AF2122/97
cagcacauccugcagc

SEQ ID NO: 1201856 - RNA, 16 nt, Mycobacterium bovis subsp bovis AF2122/97
cagcacagcgcagccu

SEQ ID NO: 1201857 - RNA, 17 nt, Mycobacterium bovis subsp bovis AF2122/97
cagcacagcgcagccug

SEQ ID NO: 1201858 - RNA, 19 nt, Mycobacterium bovis subsp bovis AF2122/97
cagcacagcgcagccugca

SEQ ID NO: 1201859 - RNA, 13 nt, Mycobacterium bovis subsp bovis AF2122/97
cagcacaggcugg

SEQ ID NO: 1201860 - RNA, 14 nt, Mycobacterium bovis subsp bovis AF2122/97
cagcacaggcuggc

SEQ ID NO: 1201861 - RNA, 16 nt, Mycobacterium bovis subsp bovis AF2122/97
cagcacaggcuggcga

SEQ ID NO: 1201862 - RNA, 20 nt, Mycobacterium bovis subsp bovis AF2122/97
cagcacaggcuggcgauggc

SEQ ID NO: 1201863 - RNA, 14 nt, Mycobacterium bovis subsp bovis AF2122/97
cagcaccagcgccu

SEQ ID NO: 1201864 - RNA, 13 nt, Mycobacterium bovis subsp bovis AF2122/97
cagcaccagcacg

SEQ ID NO: 1201865 - RNA, 14 nt, Mycobacterium bovis subsp bovis AF2122/97
cagcaccaccgcgg

SEQ ID NO: 1201866 - RNA, 19 nt, Mycobacterium bovis subsp bovis AF2122/97
cagcaccacggccagcggg

SEQ ID NO: 1201867 - RNA, 18 nt, Mycobacterium bovis subsp bovis AF2122/97
cagcaccacggcgcgcgc

SEQ ID NO: 1201868 - RNA, 14 nt, Mycobacterium bovis subsp bovis AF2122/97
cagcacaaacccag

SEQ ID NO: 1201869 - RNA, 15 nt, Mycobacterium bovis subsp bovis AF2122/97
cagcacaaacccagu

SEQ ID NO: 1201870 - RNA, 16 nt, Mycobacterium bovis subsp bovis AF2122/97
cagcacacccagaugc

SEQ ID NO: 1201871 - RNA, 17 nt, Mycobacterium bovis subsp bovis AF2122/97
cagcaaucagccgccuu

SEQ ID NO: 1201872 - RNA, 19 nt, Mycobacterium bovis subsp bovis AF2122/97
cagcaaucagccgccuucu

SEQ ID NO: 1201873 - RNA, 22 nt, Mycobacterium bovis subsp bovis AF2122/97
cagcaauccaaggcucagcagc

SEQ ID NO: 1201874 - RNA, 16 nt, Mycobacterium bovis subsp bovis AF2122/97
cagcaacgacauccag

SEQ ID NO: 1201875 - RNA, 15 nt, Mycobacterium bovis subsp bovis AF2122/97
cagcaacgcggugcc

SEQ ID NO: 1201876 - RNA, 18 nt, Mycobacterium bovis subsp bovis AF2122/97
cagcaaaggggugugugc

SEQ ID NO: 1201877 - RNA, 22 nt, Mycobacterium bovis subsp bovis AF2122/97
cagcaaaggggugugugcugcc

SEQ ID NO: 1201878 - RNA, 13 nt, Mycobacterium bovis subsp bovis AF2122/97
cagcaacggcagc

SEQ ID NO: 1201879 - RNA, 18 nt, Mycobacterium bovis subsp bovis AF2122/97
cagcaacggcagcgaggc

SEQ ID NO: 1201880 - RNA, 18 nt, Mycobacterium bovis subsp bovis AF2122/97
cagcaacugggcggccug

SEQ ID NO: 1201881 - RNA, 20 nt, Mycobacterium bovis subsp bovis AF2122/97
cagcaacugccgcacccggu

SEQ ID NO: 1201882 - RNA, 21 nt, Mycobacterium bovis subsp bovis AF2122/97
cagcaacuuugagcagaaggc

SEQ ID NO: 1201883 - RNA, 21 nt, Mycobacterium bovis subsp bovis AF2122/97
cagcaagugugagcagaccca

SEQ ID NO: 1201884 - RNA, 16 nt, Mycobacterium bovis subsp bovis AF2122/97
cagcaagaucggcagc

SEQ ID NO: 1201885 - RNA, 11 nt, Mycobacterium bovis subsp bovis AF2122/97
cagcaagccgc

SEQ ID NO: 1201886 - RNA, 23 nt, Mycobacterium bovis subsp bovis AF2122/97
cagcaagccagcaucggcagcag

SEQ ID NO: 1201887 - RNA, 22 nt, Mycobacterium bovis subsp bovis AF2122/97
caaagaauucguucagcgccag

SEQ ID NO: 1201888 - RNA, 22 nt, Mycobacterium bovis subsp bovis AF2122/97
caaagccgucagcucaccaccc

SEQ ID NO: 1201889 - RNA, 20 nt, Mycobacterium bovis subsp bovis AF2122/97
caaagccgggauugccgcca

SEQ ID NO: 1201890 - RNA, 12 nt, Mycobacterium bovis subsp bovis AF2122/97
caaagccgugcc

SEQ ID NO: 1201891 - RNA, 13 nt, Mycobacterium bovis subsp bovis AF2122/97
caaagcagcgcac

SEQ ID NO: 1201892 - RNA, 19 nt, Mycobacterium bovis subsp bovis AF2122/97
caaagcccgacgcgaagcu

SEQ ID NO: 1201893 - RNA, 21 nt, Mycobacterium bovis subsp bovis AF2122/97
caaaguacgcccuggaaugcc

SEQ ID NO: 1201894 - RNA, 16 nt, Mycobacterium bovis subsp bovis AF2122/97
caaaguagacgugcca

SEQ ID NO: 1201895 - RNA, 23 nt, Mycobacterium bovis subsp bovis AF2122/97
caaaguucgacgagaagacaccg

SEQ ID NO: 1201896 - RNA, 11 nt, Mycobacterium bovis subsp bovis AF2122/97
caaauaggacu

SEQ ID NO: 1201897 - RNA, 22 nt, Mycobacterium bovis subsp bovis AF2122/97
caaaucagaugcgaaggcaucg

SEQ ID NO: 1201898 - RNA, 14 nt, Mycobacterium bovis subsp bovis AF2122/97
caaaucaagcacag

SEQ ID NO: 1201899 - RNA, 15 nt, Mycobacterium bovis subsp bovis AF2122/97
caaaucaagcacagc

SEQ ID NO: 1201900 - RNA, 17 nt, Mycobacterium bovis subsp bovis AF2122/97
caaaucaagcacagccc

SEQ ID NO: 1201901 - RNA, 13 nt, Mycobacterium bovis subsp bovis AF2122/97
caaaucaagcaca

SEQ ID NO: 1201902 - RNA, 15 nt, Mycobacterium bovis subsp bovis AF2122/97
caaauucugguguca

SEQ ID NO: 1201903 - RNA, 17 nt, Mycobacterium bovis subsp bovis AF2122/97
caacaggccaacuuggc

SEQ ID NO: 1201904 - RNA, 14 nt, Mycobacterium bovis subsp bovis AF2122/97
caacacgccggccc

SEQ ID NO: 1201905 - RNA, 13 nt, Mycobacterium bovis subsp bovis AF2122/97
caacacgggcagc

SEQ ID NO: 1201906 - RNA, 11 nt, Mycobacterium bovis subsp bovis AF2122/97
caacaccagca

SEQ ID NO: 1201907 - RNA, 15 nt, Mycobacterium bovis subsp bovis AF2122/97
caacaccagccgguc

SEQ ID NO: 1201908 - RNA, 11 nt, Mycobacterium bovis subsp bovis AF2122/97
caacaccauca

SEQ ID NO: 1201909 - RNA, 16 nt, Mycobacterium bovis subsp bovis AF2122/97
caacacagccgucgca

SEQ ID NO: 1201910 - RNA, 14 nt, Mycobacterium bovis subsp bovis AF2122/97
caaccgggacaacc

SEQ ID NO: 1201911 - RNA, 20 nt, Mycobacterium bovis subsp bovis AF2122/97
caaccggucaaacgcgcgcg

SEQ ID NO: 1201912 - RNA, 13 nt, Mycobacterium bovis subsp bovis AF2122/97
caaccgguccagg

SEQ ID NO: 1201913 - RNA, 15 nt, Mycobacterium bovis subsp bovis AF2122/97
caaccggucagccug

SEQ ID NO: 1201914 - RNA, 14 nt, Mycobacterium bovis subsp bovis AF2122/97
caaccggugcgcau

SEQ ID NO: 1201915 - RNA, 15 nt, Mycobacterium bovis subsp bovis AF2122/97
caaccggacgcccuc

SEQ ID NO: 1201916 - RNA, 15 nt, Mycobacterium bovis subsp bovis AF2122/97
caaccgcugcugcug

SEQ ID NO: 1201917 - RNA, 23 nt, Mycobacterium bovis subsp bovis AF2122/97
caaccgcuuugaauugcgcgccc

SEQ ID NO: 1201918 - RNA, 14 nt, Mycobacterium bovis subsp bovis AF2122/97
caaccgcugcugcu

SEQ ID NO: 1201919 - RNA, 22 nt, Mycobacterium bovis subsp bovis AF2122/97
caaccgcgugcgucagcgccuu

SEQ ID NO: 1201920 - RNA, 16 nt, Mycobacterium bovis subsp bovis AF2122/97
caaccgggaucugcuc

SEQ ID NO: 1201921 - RNA, 21 nt, Mycobacterium bovis subsp bovis AF2122/97
caaccggcgcaguagccgacc

SEQ ID NO: 1201922 - RNA, 12 nt, Mycobacterium bovis subsp bovis AF2122/97
caaccgccgcca

SEQ ID NO: 1201923 - RNA, 13 nt, Mycobacterium bovis subsp bovis AF2122/97
caaccgcaccgca

SEQ ID NO: 1201924 - RNA, 21 nt, Mycobacterium bovis subsp bovis AF2122/97
caaccgccaucgucgaagacc

SEQ ID NO: 1201925 - RNA, 20 nt, Mycobacterium bovis subsp bovis AF2122/97
caaccgcaggccgaagacgu

SEQ ID NO: 1201926 - RNA, 19 nt, Mycobacterium bovis subsp bovis AF2122/97
caaccgaugacgcguucaa

SEQ ID NO: 1201927 - RNA, 20 nt, Mycobacterium bovis subsp bovis AF2122/97
caaccgaauccaucgagacc

SEQ ID NO: 1201928 - RNA, 20 nt, Mycobacterium bovis subsp bovis AF2122/97
caaccgaauugaacugagga

SEQ ID NO: 1201929 - RNA, 18 nt, Mycobacterium bovis subsp bovis AF2122/97
caacccugcggugcagga

SEQ ID NO: 1201930 - RNA, 12 nt, Mycobacterium bovis subsp bovis AF2122/97
caaccccgcggu

SEQ ID NO: 1201931 - RNA, 18 nt, Mycobacterium bovis subsp bovis AF2122/97
caacccccgccggcgccc

SEQ ID NO: 1201932 - RNA, 13 nt, Mycobacterium bovis subsp bovis AF2122/97
caaccccgagcgg

SEQ ID NO: 1201933 - RNA, 17 nt, Mycobacterium bovis subsp bovis AF2122/97
caacccucgccggucag

SEQ ID NO: 1201934 - RNA, 22 nt, Mycobacterium bovis subsp bovis AF2122/97
caacccggugucgugggcaccu

SEQ ID NO: 1201935 - RNA, 14 nt, Mycobacterium bovis subsp bovis AF2122/97
caacccgcuuggca

SEQ ID NO: 1201936 - RNA, 14 nt, Mycobacterium bovis subsp bovis AF2122/97
caacccgcaccccg

SEQ ID NO: 1201937 - RNA, 21 nt, Mycobacterium bovis subsp bovis AF2122/97
caacccgggccgccagggccc

SEQ ID NO: 1201938 - RNA, 22 nt, Mycobacterium bovis subsp bovis AF2122/97
caaccaucgguggccaucgcga

SEQ ID NO: 1201939 - RNA, 17 nt, Mycobacterium bovis subsp bovis AF2122/97
caacccaacaaaaggcc

SEQ ID NO: 1201940 - RNA, 16 nt, Mycobacterium bovis subsp bovis AF2122/97
caaccccaacaucccg

SEQ ID NO: 1201941 - RNA, 23 nt, Mycobacterium bovis subsp bovis AF2122/97
caacccacucgcagcagcaucug

SEQ ID NO: 1201942 - RNA, 23 nt, Mycobacterium bovis subsp bovis AF2122/97
caaccaugcgguuagcagccgcu

SEQ ID NO: 1201943 - RNA, 22 nt, Mycobacterium bovis subsp bovis AF2122/97
caacaggccgucgaugaucugc

SEQ ID NO: 1201944 - RNA, 14 nt, Mycobacterium bovis subsp bovis AF2122/97
caacagggccagga

SEQ ID NO: 1201945 - RNA, 15 nt, Mycobacterium bovis subsp bovis AF2122/97
caacaugcuggagaa

SEQ ID NO: 1201946 - RNA, 18 nt, Mycobacterium bovis subsp bovis AF2122/97
caacaugucaccugcauc

SEQ ID NO: 1201947 - RNA, 18 nt, Mycobacterium bovis subsp bovis AF2122/97
caacauguugucgucgcc

SEQ ID NO: 1201948 - RNA, 21 nt, Mycobacterium bovis subsp bovis AF2122/97
caaccaaagcgacgagcagca

SEQ ID NO: 1201949 - RNA, 11 nt, Mycobacterium bovis subsp bovis AF2122/97
caaccagcaga

SEQ ID NO: 1201950 - RNA, 21 nt, Mycobacterium bovis subsp bovis AF2122/97
caaccagcgagcccagcugcg

SEQ ID NO: 1201951 - RNA, 16 nt, Mycobacterium bovis subsp bovis AF2122/97
caaccagcuagaccag

SEQ ID NO: 1201952 - RNA, 16 nt, Mycobacterium bovis subsp bovis AF2122/97
caaccagcgagcccag

SEQ ID NO: 1201953 - RNA, 18 nt, Mycobacterium bovis subsp bovis AF2122/97
caaccagcgagcccagcu

SEQ ID NO: 1201954 - RNA, 12 nt, Mycobacterium bovis subsp bovis AF2122/97
caaccagcagca

SEQ ID NO: 1201955 - RNA, 13 nt, Mycobacterium bovis subsp bovis AF2122/97
caaccagcccggc

SEQ ID NO: 1201956 - RNA, 15 nt, Mycobacterium bovis subsp bovis AF2122/97
caaccaccggccgcg

SEQ ID NO: 1201957 - RNA, 22 nt, Mycobacterium bovis subsp bovis AF2122/97
caaccacccacccgcaccaccg

SEQ ID NO: 1201958 - RNA, 19 nt, Mycobacterium bovis subsp bovis AF2122/97
caaccaccucgccaacauc

SEQ ID NO: 1201959 - RNA, 21 nt, Mycobacterium bovis subsp bovis AF2122/97
caacugggccgagcgcgccgu

SEQ ID NO: 1201960 - RNA, 17 nt, Mycobacterium bovis subsp bovis AF2122/97
caacugccgagcagacg

SEQ ID NO: 1201961 - RNA, 15 nt, Mycobacterium bovis subsp bovis AF2122/97
caacugcggcagguc

SEQ ID NO: 1201962 - RNA, 14 nt, Mycobacterium bovis subsp bovis AF2122/97
caacugcaucacca

SEQ ID NO: 1201963 - RNA, 13 nt, Mycobacterium bovis subsp bovis AF2122/97
caacugcucgacg

SEQ ID NO: 1201964 - RNA, 19 nt, Mycobacterium bovis subsp bovis AF2122/97
caacucuucagcaagccaa

SEQ ID NO: 1201965 - RNA, 16 nt, Mycobacterium bovis subsp bovis AF2122/97
caacuacgccagccgc

SEQ ID NO: 1201966 - RNA, 18 nt, Mycobacterium bovis subsp bovis AF2122/97
caacuagccgcugccugg

SEQ ID NO: 1201967 - RNA, 22 nt, Mycobacterium bovis subsp bovis AF2122/97
caacggacgaagcaccucccga

SEQ ID NO: 1201968 - RNA, 17 nt, Mycobacterium bovis subsp bovis AF2122/97
caacgcugcggcagguc

SEQ ID NO: 1201969 - RNA, 20 nt, Mycobacterium bovis subsp bovis AF2122/97
caacgcggucugcuccaggc

SEQ ID NO: 1201970 - RNA, 13 nt, Mycobacterium bovis subsp bovis AF2122/97
caacggcggcgca

SEQ ID NO: 1201971 - RNA, 19 nt, Mycobacterium bovis subsp bovis AF2122/97
caacggcacuagcccgacc

SEQ ID NO: 1201972 - RNA, 14 nt, Mycobacterium bovis subsp bovis AF2122/97
caacgucgcugaaa

SEQ ID NO: 1201973 - RNA, 19 nt, Mycobacterium bovis subsp bovis AF2122/97
caacgucgcugaaaucggu

SEQ ID NO: 1201974 - RNA, 23 nt, Mycobacterium bovis subsp bovis AF2122/97
caacgccacgccgaugauggaca

SEQ ID NO: 1201975 - RNA, 14 nt, Mycobacterium bovis subsp bovis AF2122/97
caacgccaaaaugg

SEQ ID NO: 1201976 - RNA, 15 nt, Mycobacterium bovis subsp bovis AF2122/97
caacgccaaaauggu

SEQ ID NO: 1201977 - RNA, 18 nt, Mycobacterium bovis subsp bovis AF2122/97
caacgcgggugccgggca

SEQ ID NO: 1201978 - RNA, 18 nt, Mycobacterium bovis subsp bovis AF2122/97
caacgcgguaaagccccg

SEQ ID NO: 1201979 - RNA, 14 nt, Mycobacterium bovis subsp bovis AF2122/97
caacgcggucugcu

SEQ ID NO: 1201980 - RNA, 20 nt, Mycobacterium bovis subsp bovis AF2122/97
caacgccgauggcuuggugc

SEQ ID NO: 1201981 - RNA, 15 nt, Mycobacterium bovis subsp bovis AF2122/97
caacgcccaccacgc

SEQ ID NO: 1201982 - RNA, 19 nt, Mycobacterium bovis subsp bovis AF2122/97
caaccgugccgcaucaccc

SEQ ID NO: 1201983 - RNA, 17 nt, Mycobacterium bovis subsp bovis AF2122/97
caaccugaaccggccgc

SEQ ID NO: 1201984 - RNA, 17 nt, Mycobacterium bovis subsp bovis AF2122/97
caaccugaauccagacc

SEQ ID NO: 1201985 - RNA, 19 nt, Mycobacterium bovis subsp bovis AF2122/97
caaccucgucgucaucgag

SEQ ID NO: 1201986 - RNA, 14 nt, Mycobacterium bovis subsp bovis AF2122/97
caaucugcgggccg

SEQ ID NO: 1201987 - RNA, 20 nt, Mycobacterium bovis subsp bovis AF2122/97
caaucguccacccgagcucu

SEQ ID NO: 1201988 - RNA, 20 nt, Mycobacterium bovis subsp bovis AF2122/97
caauccugcgggacuggcug

SEQ ID NO: 1201989 - RNA, 15 nt, Mycobacterium bovis subsp bovis AF2122/97
caauccugguguucg

SEQ ID NO: 1201990 - RNA, 18 nt, Mycobacterium bovis subsp bovis AF2122/97
caaucgaggaaggugugc

SEQ ID NO: 1201991 - RNA, 19 nt, Mycobacterium bovis subsp bovis AF2122/97
caaucgaguagcugaccga

SEQ ID NO: 1201992 - RNA, 20 nt, Mycobacterium bovis subsp bovis AF2122/97
caaucgagaacgcccgcugc

SEQ ID NO: 1201993 - RNA, 21 nt, Mycobacterium bovis subsp bovis AF2122/97
caaucgcaaugaccugcagcg

SEQ ID NO: 1201994 - RNA, 23 nt, Mycobacterium bovis subsp bovis AF2122/97
caauccgcccuugccgccuuggc

SEQ ID NO: 1201995 - RNA, 18 nt, Mycobacterium bovis subsp bovis AF2122/97
caaucccgccaucugccu

SEQ ID NO: 1201996 - RNA, 19 nt, Mycobacterium bovis subsp bovis AF2122/97
caaucccgccaucugccug

SEQ ID NO: 1201997 - RNA, 17 nt, Mycobacterium bovis subsp bovis AF2122/97
caaucaugucagcgcug

SEQ ID NO: 1201998 - RNA, 15 nt, Mycobacterium bovis subsp bovis AF2122/97
caaucauguucaucu

SEQ ID NO: 1201999 - RNA, 13 nt, Mycobacterium bovis subsp bovis AF2122/97
caauccacagauu

SEQ ID NO: 1202000 - RNA, 17 nt, Mycobacterium bovis subsp bovis AF2122/97
caauccacagauugauu

SEQ ID NO: 1202001 - RNA, 21 nt, Mycobacterium bovis subsp bovis AF2122/97
caauccaccgaagccccuccc

SEQ ID NO: 1202002 - RNA, 20 nt, Mycobacterium bovis subsp bovis AF2122/97
caauccaggccaccccgacc

SEQ ID NO: 1202003 - RNA, 20 nt, Mycobacterium bovis subsp bovis AF2122/97
caaugcacaccgggcaccag

SEQ ID NO: 1202004 - RNA, 17 nt, Mycobacterium bovis subsp bovis AF2122/97
caaugaccgccagcagc

SEQ ID NO: 1202005 - RNA, 16 nt, Mycobacterium bovis subsp bovis AF2122/97
caaugaccugcagcgc

SEQ ID NO: 1202006 - RNA, 20 nt, Mycobacterium bovis subsp bovis AF2122/97
caaugcgagguucagccuga

SEQ ID NO: 1202007 - RNA, 20 nt, Mycobacterium bovis subsp bovis AF2122/97
caaugcguugacgucgagca

SEQ ID NO: 1202008 - RNA, 23 nt, Mycobacterium bovis subsp bovis AF2122/97
caaugcguugacgucgagcagcg

SEQ ID NO: 1202009 - RNA, 17 nt, Mycobacterium bovis subsp bovis AF2122/97
caaugcgcgacggucaa

SEQ ID NO: 1202010 - RNA, 19 nt, Mycobacterium bovis subsp bovis AF2122/97
caauggcucugaggucacc

SEQ ID NO: 1202011 - RNA, 18 nt, Mycobacterium bovis subsp bovis AF2122/97
caauggugguugcguucc

SEQ ID NO: 1202012 - RNA, 16 nt, Mycobacterium bovis subsp bovis AF2122/97
caauggcgccagccga

SEQ ID NO: 1202013 - RNA, 17 nt, Mycobacterium bovis subsp bovis AF2122/97
caauggcgccagccgac

SEQ ID NO: 1202014 - RNA, 17 nt, Mycobacterium bovis subsp bovis AF2122/97
caauggcgcgaccgaug

SEQ ID NO: 1202015 - RNA, 17 nt, Mycobacterium bovis subsp bovis AF2122/97
caauggccugcagcgcg

SEQ ID NO: 1202016 - RNA, 14 nt, Mycobacterium bovis subsp bovis AF2122/97
caauggccagcacc

SEQ ID NO: 1202017 - RNA, 15 nt, Mycobacterium bovis subsp bovis AF2122/97
caauacguagucgcc

SEQ ID NO: 1202018 - RNA, 19 nt, Mycobacterium bovis subsp bovis AF2122/97
caauacgugcgaaucgaga

SEQ ID NO: 1202019 - RNA, 13 nt, Mycobacterium bovis subsp bovis AF2122/97
caauaguguguuu

SEQ ID NO: 1202020 - RNA, 20 nt, Mycobacterium bovis subsp bovis AF2122/97
caauagcgacagcagcgcca

SEQ ID NO: 1202021 - RNA, 23 nt, Mycobacterium bovis subsp bovis AF2122/97
caauagcugcgcgaagccaccag

SEQ ID NO: 1202022 - RNA, 15 nt, Mycobacterium bovis subsp bovis AF2122/97
caauaggcuccagcg

SEQ ID NO: 1202023 - RNA, 17 nt, Mycobacterium bovis subsp bovis AF2122/97
caagucaacccugccac

SEQ ID NO: 1202024 - RNA, 22 nt, Mycobacterium bovis subsp bovis AF2122/97
caagucauccaggucgccuucc

SEQ ID NO: 1202025 - RNA, 15 nt, Mycobacterium bovis subsp bovis AF2122/97
caaguagucgaaggu

SEQ ID NO: 1202026 - RNA, 19 nt, Mycobacterium bovis subsp bovis AF2122/97
caagguggccaccaaacgc

SEQ ID NO: 1202027 - RNA, 19 nt, Mycobacterium bovis subsp bovis AF2122/97
caauaagggagaccgcggc

SEQ ID NO: 1202028 - RNA, 14 nt, Mycobacterium bovis subsp bovis AF2122/97
caagccggggaacu

SEQ ID NO: 1202029 - RNA, 19 nt, Mycobacterium bovis subsp bovis AF2122/97
caagccgggugggagcagc

SEQ ID NO: 1202030 - RNA, 16 nt, Mycobacterium bovis subsp bovis AF2122/97
caagccgccggcgcca

SEQ ID NO: 1202031 - RNA, 17 nt, Mycobacterium bovis subsp bovis AF2122/97
caagccgccggugcgca

SEQ ID NO: 1202032 - RNA, 12 nt, Mycobacterium bovis subsp bovis AF2122/97
caagccaagcgu

SEQ ID NO: 1202033 - RNA, 11 nt, Mycobacterium bovis subsp bovis AF2122/97
caagccaagcg

SEQ ID NO: 1202034 - RNA, 18 nt, Mycobacterium bovis subsp bovis AF2122/97
caagccaaccagcccggc

SEQ ID NO: 1202035 - RNA, 19 nt, Mycobacterium bovis subsp bovis AF2122/97
caagccagcaucggcagca

SEQ ID NO: 1202036 - RNA, 13 nt, Mycobacterium bovis subsp bovis AF2122/97
caagccagcacug

SEQ ID NO: 1202037 - RNA, 17 nt, Mycobacterium bovis subsp bovis AF2122/97
caagccagcacugccau

SEQ ID NO: 1202038 - RNA, 14 nt, Mycobacterium bovis subsp bovis AF2122/97
caagccagcguugg

SEQ ID NO: 1202039 - RNA, 16 nt, Mycobacterium bovis subsp bovis AF2122/97
caagcagcccggguga

SEQ ID NO: 1202040 - RNA, 21 nt, Mycobacterium bovis subsp bovis AF2122/97
caagcacagcccggcgacgac

SEQ ID NO: 1202041 - RNA, 18 nt, Mycobacterium bovis subsp bovis AF2122/97
caagcacagcgaacagac

SEQ ID NO: 1202042 - RNA, 17 nt, Mycobacterium bovis subsp bovis AF2122/97
caacuucaacuggauca

SEQ ID NO: 1202043 - RNA, 12 nt, Mycobacterium bovis subsp bovis AF2122/97
caacuucaccac

SEQ ID NO: 1202044 - RNA, 15 nt, Mycobacterium bovis subsp bovis AF2122/97
caagcacaccgccag

SEQ ID NO: 1202045 - RNA, 17 nt, Mycobacterium bovis subsp bovis AF2122/97
caagcacaccgccagcg

SEQ ID NO: 1202046 - RNA, 18 nt, Mycobacterium bovis subsp bovis AF2122/97
caagcacaccgccagcgg

SEQ ID NO: 1202047 - RNA, 20 nt, Mycobacterium bovis subsp bovis AF2122/97
caacuuccgcagcgccaccc

SEQ ID NO: 1202048 - RNA, 23 nt, Mycobacterium bovis subsp bovis AF2122/97
caagcggguuguggcacccggcu

SEQ ID NO: 1202049 - RNA, 13 nt, Mycobacterium bovis subsp bovis AF2122/97
caagcgugacccg

SEQ ID NO: 1202050 - RNA, 21 nt, Mycobacterium bovis subsp bovis AF2122/97
caagccucuauacgccugcuc

SEQ ID NO: 1202051 - RNA, 17 nt, Mycobacterium bovis subsp bovis AF2122/97
caaggacucggacgcgc

SEQ ID NO: 1202052 - RNA, 19 nt, Mycobacterium bovis subsp bovis AF2122/97
caaggaacaguaccaaagc

SEQ ID NO: 1202053 - RNA, 19 nt, Mycobacterium bovis subsp bovis AF2122/97
caaggcgcuaaaacgccag

SEQ ID NO: 1202054 - RNA, 23 nt, Mycobacterium bovis subsp bovis AF2122/97
caaggcgcuaaaacgccagucga

SEQ ID NO: 1202055 - RNA, 22 nt, Mycobacterium bovis subsp bovis AF2122/97
caaggcgauugucggggccgca

SEQ ID NO: 1202056 - RNA, 16 nt, Mycobacterium bovis subsp bovis AF2122/97
caagguggcaugcgac

SEQ ID NO: 1202057 - RNA, 20 nt, Mycobacterium bovis subsp bovis AF2122/97
caaggugucaacgcgcggcu

SEQ ID NO: 1202058 - RNA, 17 nt, Mycobacterium bovis subsp bovis AF2122/97
caagguguccagcaccu

SEQ ID NO: 1202059 - RNA, 18 nt, Mycobacterium bovis subsp bovis AF2122/97
caaggucuuuagccgccg

SEQ ID NO: 1202060 - RNA, 21 nt, Mycobacterium bovis subsp bovis AF2122/97
caagggugcuugucgccgcgu

SEQ ID NO: 1202061 - RNA, 22 nt, Mycobacterium bovis subsp bovis AF2122/97
caaggucaucacuaaccuggcg

SEQ ID NO: 1202062 - RNA, 19 nt, Mycobacterium bovis subsp bovis AF2122/97
caagguauggccggagcgc

SEQ ID NO: 1202063 - RNA, 14 nt, Mycobacterium bovis subsp bovis AF2122/97
caaaacccgcucca

SEQ ID NO: 1202064 - RNA, 18 nt, Mycobacterium bovis subsp bovis AF2122/97
caaaacccgcuccacccc

SEQ ID NO: 1202065 - RNA, 16 nt, Mycobacterium bovis subsp bovis AF2122/97
caaaacccgagccugg

SEQ ID NO: 1202066 - RNA, 21 nt, Mycobacterium bovis subsp bovis AF2122/97
caaaaacccggugaccagcaa

SEQ ID NO: 1202067 - RNA, 19 nt, Mycobacterium bovis subsp bovis AF2122/97
caaaaagcucggcccuguu

SEQ ID NO: 1202068 - RNA, 22 nt, Mycobacterium bovis subsp bovis AF2122/97
auuuuuguuguuauuuuuggcc

SEQ ID NO: 1202069 - RNA, 16 nt, Mycobacterium bovis subsp bovis AF2122/97
auuucguugagaacau

SEQ ID NO: 1202070 - RNA, 13 nt, Mycobacterium bovis subsp bovis AF2122/97
auuucucccagcc

SEQ ID NO: 1202071 - RNA, 15 nt, Mycobacterium bovis subsp bovis AF2122/97
auuucucccagccca

SEQ ID NO: 1202072 - RNA, 20 nt, Mycobacterium bovis subsp bovis AF2122/97
auuuggccgauguuguugac

SEQ ID NO: 1202073 - RNA, 19 nt, Mycobacterium bovis subsp bovis AF2122/97
auuuucacugugccgcugc

SEQ ID NO: 1202074 - RNA, 17 nt, Mycobacterium bovis subsp bovis AF2122/97
auucagcgccccaugca

SEQ ID NO: 1202075 - RNA, 20 nt, Mycobacterium bovis subsp bovis AF2122/97
auucuagguucgaguccugg

SEQ ID NO: 1202076 - RNA, 11 nt, Mycobacterium bovis subsp bovis AF2122/97
auucuggaugc

SEQ ID NO: 1202077 - RNA, 22 nt, Mycobacterium bovis subsp bovis AF2122/97
auucugugucugcucgcgccgc

SEQ ID NO: 1202078 - RNA, 19 nt, Mycobacterium bovis subsp bovis AF2122/97
auucuccgcccucaguuca

SEQ ID NO: 1202079 - RNA, 20 nt, Mycobacterium bovis subsp bovis AF2122/97
auugacgccguugccgccgu

SEQ ID NO: 1202080 - RNA, 15 nt, Mycobacterium bovis subsp bovis AF2122/97
auugagcacgcgcaa

SEQ ID NO: 1202081 - RNA, 18 nt, Mycobacterium bovis subsp bovis AF2122/97
auugaagccccccgagcu

SEQ ID NO: 1202082 - RNA, 14 nt, Mycobacterium bovis subsp bovis AF2122/97
auugccuccgcuag

SEQ ID NO: 1202083 - RNA, 16 nt, Mycobacterium bovis subsp bovis AF2122/97
auugccgccaccuugg

SEQ ID NO: 1202084 - RNA, 11 nt, Mycobacterium bovis subsp bovis AF2122/97
auugccgccgg

SEQ ID NO: 1202085 - RNA, 11 nt, Mycobacterium bovis subsp bovis AF2122/97
auugccgccgu

SEQ ID NO: 1202086 - RNA, 15 nt, Mycobacterium bovis subsp bovis AF2122/97
auugcccgcgcucgc

SEQ ID NO: 1202087 - RNA, 16 nt, Mycobacterium bovis subsp bovis AF2122/97
auugcagaauccgguc

SEQ ID NO: 1202088 - RNA, 15 nt, Mycobacterium bovis subsp bovis AF2122/97
auugcuuggccgcgc

SEQ ID NO: 1202089 - RNA, 17 nt, Mycobacterium bovis subsp bovis AF2122/97
auugcguucgccgcccg

SEQ ID NO: 1202090 - RNA, 22 nt, Mycobacterium bovis subsp bovis AF2122/97
auuucagccuuguugccgccgg

SEQ ID NO: 1202091 - RNA, 19 nt, Mycobacterium bovis subsp bovis AF2122/97
auuagcccacccauggccu

SEQ ID NO: 1202092 - RNA, 21 nt, Mycobacterium bovis subsp bovis AF2122/97
auuaguuucguccccagaccg

SEQ ID NO: 1202093 - RNA, 21 nt, Mycobacterium bovis subsp bovis AF2122/97
auuacgcaccgaggccgccga

SEQ ID NO: 1202094 - RNA, 11 nt, Mycobacterium bovis subsp bovis AF2122/97
auguuggugau

SEQ ID NO: 1202095 - RNA, 18 nt, Mycobacterium bovis subsp bovis AF2122/97
auguugcgacggccggca

SEQ ID NO: 1202096 - RNA, 21 nt, Mycobacterium bovis subsp bovis AF2122/97
auguuggcagggccagcggca

SEQ ID NO: 1202097 - RNA, 16 nt, Mycobacterium bovis subsp bovis AF2122/97
auguuguucagcaggc

SEQ ID NO: 1202098 - RNA, 19 nt, Mycobacterium bovis subsp bovis AF2122/97
auguugccggaguugaagu

SEQ ID NO: 1202099 - RNA, 17 nt, Mycobacterium bovis subsp bovis AF2122/97
auguugcgacggccggc

SEQ ID NO: 1202100 - RNA, 16 nt, Mycobacterium bovis subsp bovis AF2122/97
auguucacgccgccgg

SEQ ID NO: 1202101 - RNA, 16 nt, Mycobacterium bovis subsp bovis AF2122/97
auguuuugcugcaugc

SEQ ID NO: 1202102 - RNA, 22 nt, Mycobacterium bovis subsp bovis AF2122/97
auguuugaaacguaugacgccc

SEQ ID NO: 1202103 - RNA, 23 nt, Mycobacterium bovis subsp bovis AF2122/97
auuaagggucaucgccagcggca

SEQ ID NO: 1202104 - RNA, 16 nt, Mycobacterium bovis subsp bovis AF2122/97
auuaaggugaccacgg

SEQ ID NO: 1202105 - RNA, 14 nt, Mycobacterium bovis subsp bovis AF2122/97
auuaacugcuucca

SEQ ID NO: 1202106 - RNA, 15 nt, Mycobacterium bovis subsp bovis AF2122/97
auggugugcagcagc

SEQ ID NO: 1202107 - RNA, 20 nt, Mycobacterium bovis subsp bovis AF2122/97
augguguaacggcggcugaa

SEQ ID NO: 1202108 - RNA, 15 nt, Mycobacterium bovis subsp bovis AF2122/97
augguggugggugau

SEQ ID NO: 1202109 - RNA, 16 nt, Mycobacterium bovis subsp bovis AF2122/97
auggugguggcccggc

SEQ ID NO: 1202110 - RNA, 12 nt, Mycobacterium bovis subsp bovis AF2122/97
auggucuccacc

SEQ ID NO: 1202111 - RNA, 22 nt, Mycobacterium bovis subsp bovis AF2122/97
augguaccgccacuggcgcuga

SEQ ID NO: 1202112 - RNA, 14 nt, Mycobacterium bovis subsp bovis AF2122/97
augggacacaaucc

SEQ ID NO: 1202113 - RNA, 21 nt, Mycobacterium bovis subsp bovis AF2122/97
auggcugagcccgccgcgacc

SEQ ID NO: 1202114 - RNA, 18 nt, Mycobacterium bovis subsp bovis AF2122/97
augggcgcguagcucagc

SEQ ID NO: 1202115 - RNA, 23 nt, Mycobacterium bovis subsp bovis AF2122/97
augggcgccaucccgccgcccgc

SEQ ID NO: 1202116 - RNA, 22 nt, Mycobacterium bovis subsp bovis AF2122/97
augggcgucggucaccuggcga

SEQ ID NO: 1202117 - RNA, 20 nt, Mycobacterium bovis subsp bovis AF2122/97
augggcgguuccacgcugcc

SEQ ID NO: 1202118 - RNA, 15 nt, Mycobacterium bovis subsp bovis AF2122/97
auggccagcaucagc

SEQ ID NO: 1202119 - RNA, 11 nt, Mycobacterium bovis subsp bovis AF2122/97
auggccagcac

SEQ ID NO: 1202120 - RNA, 23 nt, Mycobacterium bovis subsp bovis AF2122/97
auggccagguuguagacggcacc

SEQ ID NO: 1202121 - RNA, 16 nt, Mycobacterium bovis subsp bovis AF2122/97
auggccagcacggugu

SEQ ID NO: 1202122 - RNA, 20 nt, Mycobacterium bovis subsp bovis AF2122/97
auggcgcgcaacguagccag

SEQ ID NO: 1202123 - RNA, 22 nt, Mycobacterium bovis subsp bovis AF2122/97
auggcgcgcaacguagccagca

SEQ ID NO: 1202124 - RNA, 16 nt, Mycobacterium bovis subsp bovis AF2122/97
auggcgcugauggugc

SEQ ID NO: 1202125 - RNA, 23 nt, Mycobacterium bovis subsp bovis AF2122/97
auggcgcugauggugcugcggcg

SEQ ID NO: 1202126 - RNA, 19 nt, Mycobacterium bovis subsp bovis AF2122/97
auggcggccgggucgguga

SEQ ID NO: 1202127 - RNA, 17 nt, Mycobacterium bovis subsp bovis AF2122/97
augcgcaccagcggcug

SEQ ID NO: 1202128 - RNA, 15 nt, Mycobacterium bovis subsp bovis AF2122/97
augcgaugcgcgccg

SEQ ID NO: 1202129 - RNA, 20 nt, Mycobacterium bovis subsp bovis AF2122/97
augcgcacucuagccgggug

SEQ ID NO: 1202130 - RNA, 16 nt, Mycobacterium bovis subsp bovis AF2122/97
auggcacugccggcac

SEQ ID NO: 1202131 - RNA, 15 nt, Mycobacterium bovis subsp bovis AF2122/97
auguagggcugcucc

SEQ ID NO: 1202132 - RNA, 14 nt, Mycobacterium bovis subsp bovis AF2122/97
auguaguccagcuc

SEQ ID NO: 1202133 - RNA, 18 nt, Mycobacterium bovis subsp bovis AF2122/97
auguccauagccggcauu

SEQ ID NO: 1202134 - RNA, 18 nt, Mycobacterium bovis subsp bovis AF2122/97
auguccuauuugcagccu

SEQ ID NO: 1202135 - RNA, 15 nt, Mycobacterium bovis subsp bovis AF2122/97
auguccucgauccgg

SEQ ID NO: 1202136 - RNA, 20 nt, Mycobacterium bovis subsp bovis AF2122/97
auguccugggccgccgcccu

SEQ ID NO: 1202137 - RNA, 19 nt, Mycobacterium bovis subsp bovis AF2122/97
auguccuuggagaugucgg

SEQ ID NO: 1202138 - RNA, 15 nt, Mycobacterium bovis subsp bovis AF2122/97
augucuuguggugga

SEQ ID NO: 1202139 - RNA, 22 nt, Mycobacterium bovis subsp bovis AF2122/97
auguggggucagugcgggcggc

SEQ ID NO: 1202140 - RNA, 14 nt, Mycobacterium bovis subsp bovis AF2122/97
auguggccgugggu

SEQ ID NO: 1202141 - RNA, 22 nt, Mycobacterium bovis subsp bovis AF2122/97
aucugcuagcuuggcggccagc

SEQ ID NO: 1202142 - RNA, 16 nt, Mycobacterium bovis subsp bovis AF2122/97
aucuucuucagguagc

SEQ ID NO: 1202143 - RNA, 15 nt, Mycobacterium bovis subsp bovis AF2122/97
aucuggucaagaccc

SEQ ID NO: 1202144 - RNA, 19 nt, Mycobacterium bovis subsp bovis AF2122/97
aucuggucaagguugacgu

SEQ ID NO: 1202145 - RNA, 21 nt, Mycobacterium bovis subsp bovis AF2122/97
aucuggucacgguucgcccgu

SEQ ID NO: 1202146 - RNA, 15 nt, Mycobacterium bovis subsp bovis AF2122/97
aucuucugccuuggc

SEQ ID NO: 1202147 - RNA, 22 nt, Mycobacterium bovis subsp bovis AF2122/97
augaagcuggugaucagcucag

SEQ ID NO: 1202148 - RNA, 22 nt, Mycobacterium bovis subsp bovis AF2122/97
augaccuguagaucagcagcgg

SEQ ID NO: 1202149 - RNA, 18 nt, Mycobacterium bovis subsp bovis AF2122/97
augacgaccgaucggcgc

SEQ ID NO: 1202150 - RNA, 22 nt, Mycobacterium bovis subsp bovis AF2122/97
augacgauggccgccgcgagga

SEQ ID NO: 1202151 - RNA, 13 nt, Mycobacterium bovis subsp bovis AF2122/97
augagaucgggac

SEQ ID NO: 1202152 - RNA, 23 nt, Mycobacterium bovis subsp bovis AF2122/97
augagaucauccacugcgagggc

SEQ ID NO: 1202153 - RNA, 17 nt, Mycobacterium bovis subsp bovis AF2122/97
augagggcuugugguga

SEQ ID NO: 1202154 - RNA, 21 nt, Mycobacterium bovis subsp bovis AF2122/97
augaccagcacaccgcccgca

SEQ ID NO: 1202155 - RNA, 19 nt, Mycobacterium bovis subsp bovis AF2122/97
augaugaccggcaauuccg

SEQ ID NO: 1202156 - RNA, 21 nt, Mycobacterium bovis subsp bovis AF2122/97
augauggccgucagccaggug

SEQ ID NO: 1202157 - RNA, 13 nt, Mycobacterium bovis subsp bovis AF2122/97
augaugucggccg

SEQ ID NO: 1202158 - RNA, 20 nt, Mycobacterium bovis subsp bovis AF2122/97
augauguugagcuggaccuc

SEQ ID NO: 1202159 - RNA, 20 nt, Mycobacterium bovis subsp bovis AF2122/97
augcaacgcggcgaagugca

SEQ ID NO: 1202160 - RNA, 20 nt, Mycobacterium bovis subsp bovis AF2122/97
augccacccagaugcagcgg

SEQ ID NO: 1202161 - RNA, 20 nt, Mycobacterium bovis subsp bovis AF2122/97
augccagcuguugcggggug

SEQ ID NO: 1202162 - RNA, 22 nt, Mycobacterium bovis subsp bovis AF2122/97
augccaggacuggcaccgccag

SEQ ID NO: 1202163 - RNA, 20 nt, Mycobacterium bovis subsp bovis AF2122/97
augccacuaggaagguggcc

SEQ ID NO: 1202164 - RNA, 14 nt, Mycobacterium bovis subsp bovis AF2122/97
augccacacacugc

SEQ ID NO: 1202165 - RNA, 20 nt, Mycobacterium bovis subsp bovis AF2122/97
augcagcgggucgccgggcc

SEQ ID NO: 1202166 - RNA, 23 nt, Mycobacterium bovis subsp bovis AF2122/97
augcagcgguccagacaucagug

SEQ ID NO: 1202167 - RNA, 22 nt, Mycobacterium bovis subsp bovis AF2122/97
augcagggcccgcaacaucggg

SEQ ID NO: 1202168 - RNA, 20 nt, Mycobacterium bovis subsp bovis AF2122/97
augcagccccacuucgggcg

SEQ ID NO: 1202169 - RNA, 16 nt, Mycobacterium bovis subsp bovis AF2122/97
augcacaaccgcugcu

SEQ ID NO: 1202170 - RNA, 13 nt, Mycobacterium bovis subsp bovis AF2122/97
augccgguguuga

SEQ ID NO: 1202171 - RNA, 21 nt, Mycobacterium bovis subsp bovis AF2122/97
augccggugccgggcaccacc

SEQ ID NO: 1202172 - RNA, 18 nt, Mycobacterium bovis subsp bovis AF2122/97
augccggucauccgggcg

SEQ ID NO: 1202173 - RNA, 18 nt, Mycobacterium bovis subsp bovis AF2122/97
augccggcgaaggccagc

SEQ ID NO: 1202174 - RNA, 22 nt, Mycobacterium bovis subsp bovis AF2122/97
augccggcgaaggccagcagaa

SEQ ID NO: 1202175 - RNA, 21 nt, Mycobacterium bovis subsp bovis AF2122/97
augccggacgccaugcccgca

SEQ ID NO: 1202176 - RNA, 13 nt, Mycobacterium bovis subsp bovis AF2122/97
augccgcggugga

SEQ ID NO: 1202177 - RNA, 14 nt, Mycobacterium bovis subsp bovis AF2122/97
augccuaccgggcc

SEQ ID NO: 1202178 - RNA, 18 nt, Mycobacterium bovis subsp bovis AF2122/97
augccguucaugccaugg

SEQ ID NO: 1202179 - RNA, 17 nt, Mycobacterium bovis subsp bovis AF2122/97
augccguugaucgcaaa

SEQ ID NO: 1202180 - RNA, 18 nt, Mycobacterium bovis subsp bovis AF2122/97
augccugcccaccuucga

SEQ ID NO: 1202181 - RNA, 20 nt, Mycobacterium bovis subsp bovis AF2122/97
augccuucggccaaccaugc

SEQ ID NO: 1202182 - RNA, 23 nt, Mycobacterium bovis subsp bovis AF2122/97
augccuggaaucgcggagccagg

SEQ ID NO: 1202183 - RNA, 16 nt, Mycobacterium bovis subsp bovis AF2122/97
augccugcgcgaugcg

SEQ ID NO: 1202184 - RNA, 12 nt, Mycobacterium bovis subsp bovis AF2122/97
augcccuugaga

SEQ ID NO: 1202185 - RNA, 18 nt, Mycobacterium bovis subsp bovis AF2122/97
augcccuugcggaagaag

SEQ ID NO: 1202186 - RNA, 18 nt, Mycobacterium bovis subsp bovis AF2122/97
augcccuggggguggcag

SEQ ID NO: 1202187 - RNA, 21 nt, Mycobacterium bovis subsp bovis AF2122/97
augcccugcccgaagguggga

SEQ ID NO: 1202188 - RNA, 15 nt, Mycobacterium bovis subsp bovis AF2122/97
augcccugcgcucgg

SEQ ID NO: 1202189 - RNA, 19 nt, Mycobacterium bovis subsp bovis AF2122/97
augccgcccgcgccgccgg

SEQ ID NO: 1202190 - RNA, 19 nt, Mycobacterium bovis subsp bovis AF2122/97
augccgcccccauaacugc

SEQ ID NO: 1202191 - RNA, 13 nt, Mycobacterium bovis subsp bovis AF2122/97
augccgaucggcc

SEQ ID NO: 1202192 - RNA, 22 nt, Mycobacterium bovis subsp bovis AF2122/97
augccgacgacaacagccagcu

SEQ ID NO: 1202193 - RNA, 21 nt, Mycobacterium bovis subsp bovis AF2122/97
augccauaugggggaaagcuu

SEQ ID NO: 1202194 - RNA, 20 nt, Mycobacterium bovis subsp bovis AF2122/97
augccauguugaaaaggcgc

SEQ ID NO: 1202195 - RNA, 23 nt, Mycobacterium bovis subsp bovis AF2122/97
aucucgacggccucgucgauguu

SEQ ID NO: 1202196 - RNA, 20 nt, Mycobacterium bovis subsp bovis AF2122/97
aucucgaccucgucggccga

SEQ ID NO: 1202197 - RNA, 22 nt, Mycobacterium bovis subsp bovis AF2122/97
aucucgacaucggccagcuuga

SEQ ID NO: 1202198 - RNA, 15 nt, Mycobacterium bovis subsp bovis AF2122/97
aucucgcaaggggga

SEQ ID NO: 1202199 - RNA, 14 nt, Mycobacterium bovis subsp bovis AF2122/97
aucucgaucaucau

SEQ ID NO: 1202200 - RNA, 14 nt, Mycobacterium bovis subsp bovis AF2122/97
aucucgcccaccuc

SEQ ID NO: 1202201 - RNA, 18 nt, Mycobacterium bovis subsp bovis AF2122/97
aucuccucgccugcccga

SEQ ID NO: 1202202 - RNA, 17 nt, Mycobacterium bovis subsp bovis AF2122/97
aucuccgucggccaggc

SEQ ID NO: 1202203 - RNA, 18 nt, Mycobacterium bovis subsp bovis AF2122/97
aucuccuccaccagugcc

SEQ ID NO: 1202204 - RNA, 21 nt, Mycobacterium bovis subsp bovis AF2122/97
aucuccggcggaucugggcuu

SEQ ID NO: 1202205 - RNA, 20 nt, Mycobacterium bovis subsp bovis AF2122/97
aucuccggcuggcccaccuc

SEQ ID NO: 1202206 - RNA, 18 nt, Mycobacterium bovis subsp bovis AF2122/97
aucuccccgaccgcgccc

SEQ ID NO: 1202207 - RNA, 17 nt, Mycobacterium bovis subsp bovis AF2122/97
aucuccccguccugcca

SEQ ID NO: 1202208 - RNA, 23 nt, Mycobacterium bovis subsp bovis AF2122/97
aucucccgaaucgugcggcgacc

SEQ ID NO: 1202209 - RNA, 23 nt, Mycobacterium bovis subsp bovis AF2122/97
aucuccaccuucugguccagcac

SEQ ID NO: 1202210 - RNA, 15 nt, Mycobacterium bovis subsp bovis AF2122/97
aucuccagcgguucg

SEQ ID NO: 1202211 - RNA, 12 nt, Mycobacterium bovis subsp bovis AF2122/97
aucuccaccuuc

SEQ ID NO: 1202212 - RNA, 18 nt, Mycobacterium bovis subsp bovis AF2122/97
aucuagaggcggcccccg

SEQ ID NO: 1202213 - RNA, 14 nt, Mycobacterium bovis subsp bovis AF2122/97
aucuauggaugacc

SEQ ID NO: 1202214 - RNA, 20 nt, Mycobacterium bovis subsp bovis AF2122/97
aucucggccagggucacaaa

SEQ ID NO: 1202215 - RNA, 16 nt, Mycobacterium bovis subsp bovis AF2122/97
aucucggcgcagccgg

SEQ ID NO: 1202216 - RNA, 13 nt, Mycobacterium bovis subsp bovis AF2122/97
aucucggcggcca

SEQ ID NO: 1202217 - RNA, 19 nt, Mycobacterium bovis subsp bovis AF2122/97
aucucggcguugccgccgu

SEQ ID NO: 1202218 - RNA, 24 nt, Mycobacterium bovis subsp bovis AF2122/97
aucucggcagagacguacugggcg

SEQ ID NO: 1202219 - RNA, 18 nt, Mycobacterium bovis subsp bovis AF2122/97
aucucgccggcgaagacc

SEQ ID NO: 1202220 - RNA, 22 nt, Mycobacterium bovis subsp bovis AF2122/97
aucucgcgggcccgcgcggcgg

SEQ ID NO: 1202221 - RNA, 15 nt, Mycobacterium bovis subsp bovis AF2122/97
aucucgguggacggc

SEQ ID NO: 1202222 - RNA, 22 nt, Mycobacterium bovis subsp bovis AF2122/97
aucucgguggacggcaggcggc

SEQ ID NO: 1202223 - RNA, 16 nt, Mycobacterium bovis subsp bovis AF2122/97
aucucguagccgccgu

SEQ ID NO: 1202224 - RNA, 23 nt, Mycobacterium bovis subsp bovis AF2122/97
aucucguagccgccgucgccggu

SEQ ID NO: 1202225 - RNA, 15 nt, Mycobacterium bovis subsp bovis AF2122/97
aucucggucagaugc

SEQ ID NO: 1202226 - RNA, 21 nt, Mycobacterium bovis subsp bovis AF2122/97
aucucguggaucugccucucg

SEQ ID NO: 1202227 - RNA, 12 nt, Mycobacterium bovis subsp bovis AF2122/97
aucucuccugga

SEQ ID NO: 1202228 - RNA, 15 nt, Mycobacterium bovis subsp bovis AF2122/97
aucucuugcaaccug

SEQ ID NO: 1202229 - RNA, 14 nt, Mycobacterium bovis subsp bovis AF2122/97
aucugcccuguucg

SEQ ID NO: 1202230 - RNA, 13 nt, Mycobacterium bovis subsp bovis AF2122/97
aucugcggcgccc

SEQ ID NO: 1202231 - RNA, 22 nt, Mycobacterium bovis subsp bovis AF2122/97
aucugcggaggcgaccccggcc

SEQ ID NO: 1202232 - RNA, 19 nt, Mycobacterium bovis subsp bovis AF2122/97
aucugcgcgaggggccggc

SEQ ID NO: 1202233 - RNA, 18 nt, Mycobacterium bovis subsp bovis AF2122/97
aucggcccgugccacagc

SEQ ID NO: 1202234 - RNA, 19 nt, Mycobacterium bovis subsp bovis AF2122/97
aucggcccagcccuucagc

SEQ ID NO: 1202235 - RNA, 18 nt, Mycobacterium bovis subsp bovis AF2122/97
aucggcuucuucuucuug

SEQ ID NO: 1202236 - RNA, 16 nt, Mycobacterium bovis subsp bovis AF2122/97
aucggcgacaggagac

SEQ ID NO: 1202237 - RNA, 18 nt, Mycobacterium bovis subsp bovis AF2122/97
aucgggaaguacggcagg

SEQ ID NO: 1202238 - RNA, 19 nt, Mycobacterium bovis subsp bovis AF2122/97
aucgggaaguacggcaggc

SEQ ID NO: 1202239 - RNA, 20 nt, Mycobacterium bovis subsp bovis AF2122/97
aucgggcuugcgcagcagcg

SEQ ID NO: 1202240 - RNA, 13 nt, Mycobacterium bovis subsp bovis AF2122/97
aucggggcaccgu

SEQ ID NO: 1202241 - RNA, 13 nt, Mycobacterium bovis subsp bovis AF2122/97
aucggccaccugu

SEQ ID NO: 1202242 - RNA, 18 nt, Mycobacterium bovis subsp bovis AF2122/97
aucggccaccuguuggca

SEQ ID NO: 1202243 - RNA, 10 nt, Mycobacterium bovis subsp bovis AF2122/97
aucggccacc

SEQ ID NO: 1202244 - RNA, 14 nt, Mycobacterium bovis subsp bovis AF2122/97
aucggauggccccc

SEQ ID NO: 1202245 - RNA, 15 nt, Mycobacterium bovis subsp bovis AF2122/97
aucggauggcggcca

SEQ ID NO: 1202246 - RNA, 18 nt, Mycobacterium bovis subsp bovis AF2122/97
aucggauacccagccggc

SEQ ID NO: 1202247 - RNA, 20 nt, Mycobacterium bovis subsp bovis AF2122/97
aucggauacccagccggccu

SEQ ID NO: 1202248 - RNA, 17 nt, Mycobacterium bovis subsp bovis AF2122/97
aucgcguagcuggccag

SEQ ID NO: 1202249 - RNA, 20 nt, Mycobacterium bovis subsp bovis AF2122/97
aucgcgucggcgaugaacag

SEQ ID NO: 1202250 - RNA, 14 nt, Mycobacterium bovis subsp bovis AF2122/97
aucgcggugugccg

SEQ ID NO: 1202251 - RNA, 23 nt, Mycobacterium bovis subsp bovis AF2122/97
aucgcggucaaauccagcagcca

SEQ ID NO: 1202252 - RNA, 14 nt, Mycobacterium bovis subsp bovis AF2122/97
aucgcgggugaucu

SEQ ID NO: 1202253 - RNA, 17 nt, Mycobacterium bovis subsp bovis AF2122/97
aucgcgggcggcgcugg

SEQ ID NO: 1202254 - RNA, 17 nt, Mycobacterium bovis subsp bovis AF2122/97
aucgcguucugcaccag

SEQ ID NO: 1202255 - RNA, 14 nt, Mycobacterium bovis subsp bovis AF2122/97
aucgucgagcaccu

SEQ ID NO: 1202256 - RNA, 18 nt, Mycobacterium bovis subsp bovis AF2122/97
aucgugcggaaccugcuc

SEQ ID NO: 1202257 - RNA, 18 nt, Mycobacterium bovis subsp bovis AF2122/97
aucguguacuggucugga

SEQ ID NO: 1202258 - RNA, 20 nt, Mycobacterium bovis subsp bovis AF2122/97
aucguugccggugccgccgc

SEQ ID NO: 1202259 - RNA, 20 nt, Mycobacterium bovis subsp bovis AF2122/97
aucguucaugaucggcagaa

SEQ ID NO: 1202260 - RNA, 20 nt, Mycobacterium bovis subsp bovis AF2122/97
aucguuaucgacaccaccau

SEQ ID NO: 1202261 - RNA, 21 nt, Mycobacterium bovis subsp bovis AF2122/97
aucagcugcgcaucgccacca

SEQ ID NO: 1202262 - RNA, 14 nt, Mycobacterium bovis subsp bovis AF2122/97
aucagcuuuugcac

SEQ ID NO: 1202263 - RNA, 13 nt, Mycobacterium bovis subsp bovis AF2122/97
aucgagcaccgca

SEQ ID NO: 1202264 - RNA, 16 nt, Mycobacterium bovis subsp bovis AF2122/97
aucgagaguugaaucc

SEQ ID NO: 1202265 - RNA, 21 nt, Mycobacterium bovis subsp bovis AF2122/97
aucgaggaacucggacccacc

SEQ ID NO: 1202266 - RNA, 16 nt, Mycobacterium bovis subsp bovis AF2122/97
aucgagcaggccgccc

SEQ ID NO: 1202267 - RNA, 20 nt, Mycobacterium bovis subsp bovis AF2122/97
aucgagcagggugaccagga

SEQ ID NO: 1202268 - RNA, 12 nt, Mycobacterium bovis subsp bovis AF2122/97
aucgagguugac

SEQ ID NO: 1202269 - RNA, 22 nt, Mycobacterium bovis subsp bovis AF2122/97
aucgaggugauguuggccgcca

SEQ ID NO: 1202270 - RNA, 19 nt, Mycobacterium bovis subsp bovis AF2122/97
aucgaguagcugaccgagc

SEQ ID NO: 1202271 - RNA, 22 nt, Mycobacterium bovis subsp bovis AF2122/97
aucgcaagcgcggcgaagccgg

SEQ ID NO: 1202272 - RNA, 22 nt, Mycobacterium bovis subsp bovis AF2122/97
aucgcaccgugugggccccgcc

SEQ ID NO: 1202273 - RNA, 14 nt, Mycobacterium bovis subsp bovis AF2122/97
aucgcaccuccggc

SEQ ID NO: 1202274 - RNA, 22 nt, Mycobacterium bovis subsp bovis AF2122/97
aucgaucagcaacucggccacg

SEQ ID NO: 1202275 - RNA, 14 nt, Mycobacterium bovis subsp bovis AF2122/97
aucgcggcgagcac

SEQ ID NO: 1202276 - RNA, 12 nt, Mycobacterium bovis subsp bovis AF2122/97
aucgcggccaca

SEQ ID NO: 1202277 - RNA, 17 nt, Mycobacterium bovis subsp bovis AF2122/97
aucgcgcggcugugccc

SEQ ID NO: 1202278 - RNA, 16 nt, Mycobacterium bovis subsp bovis AF2122/97
aucgcgccgucggcga

SEQ ID NO: 1202279 - RNA, 19 nt, Mycobacterium bovis subsp bovis AF2122/97
aucgcgauccacccggcau

SEQ ID NO: 1202280 - RNA, 18 nt, Mycobacterium bovis subsp bovis AF2122/97
aucgcgcagcgccgccac

SEQ ID NO: 1202281 - RNA, 15 nt, Mycobacterium bovis subsp bovis AF2122/97
aucgccguccagcaa

SEQ ID NO: 1202282 - RNA, 20 nt, Mycobacterium bovis subsp bovis AF2122/97
aucgccggcuucgcccagag

SEQ ID NO: 1202283 - RNA, 18 nt, Mycobacterium bovis subsp bovis AF2122/97
aucgccgucagcaccgcu

SEQ ID NO: 1202284 - RNA, 20 nt, Mycobacterium bovis subsp bovis AF2122/97
aucgccuaccggccuuucca

SEQ ID NO: 1202285 - RNA, 17 nt, Mycobacterium bovis subsp bovis AF2122/97
aucgccuccagccggcg

SEQ ID NO: 1202286 - RNA, 23 nt, Mycobacterium bovis subsp bovis AF2122/97
aucgccuccagccggcgaaugcg

SEQ ID NO: 1202287 - RNA, 20 nt, Mycobacterium bovis subsp bovis AF2122/97
aucgccgggaacaucccagc

SEQ ID NO: 1202288 - RNA, 23 nt, Mycobacterium bovis subsp bovis AF2122/97
aucgcccgggcgggauccaccca

SEQ ID NO: 1202289 - RNA, 11 nt, Mycobacterium bovis subsp bovis AF2122/97
aucgcccgguu

SEQ ID NO: 1202290 - RNA, 20 nt, Mycobacterium bovis subsp bovis AF2122/97
aucgcccgguucagcgcugg

SEQ ID NO: 1202291 - RNA, 18 nt, Mycobacterium bovis subsp bovis AF2122/97
aucgcccagugugcgccg

SEQ ID NO: 1202292 - RNA, 17 nt, Mycobacterium bovis subsp bovis AF2122/97
aucgcccauuucggcac

SEQ ID NO: 1202293 - RNA, 17 nt, Mycobacterium bovis subsp bovis AF2122/97
aucgcagucauguccau

SEQ ID NO: 1202294 - RNA, 17 nt, Mycobacterium bovis subsp bovis AF2122/97
aucgcagauggcgaggu

SEQ ID NO: 1202295 - RNA, 17 nt, Mycobacterium bovis subsp bovis AF2122/97
aucgcacggaugaugcc

SEQ ID NO: 1202296 - RNA, 16 nt, Mycobacterium bovis subsp bovis AF2122/97
aucgcauccccagcac

SEQ ID NO: 1202297 - RNA, 19 nt, Mycobacterium bovis subsp bovis AF2122/97
auaaccguugaccucuucg

SEQ ID NO: 1202298 - RNA, 15 nt, Mycobacterium bovis subsp bovis AF2122/97
auaaccggccauguc

SEQ ID NO: 1202299 - RNA, 13 nt, Mycobacterium bovis subsp bovis AF2122/97
auaacccuggccg

SEQ ID NO: 1202300 - RNA, 13 nt, Mycobacterium bovis subsp bovis AF2122/97
auaacccagcacc

SEQ ID NO: 1202301 - RNA, 21 nt, Mycobacterium bovis subsp bovis AF2122/97
agugacgccucgacacccagc

SEQ ID NO: 1202302 - RNA, 21 nt, Mycobacterium bovis subsp bovis AF2122/97
agucuugaccgcaccggccgc

SEQ ID NO: 1202303 - RNA, 14 nt, Mycobacterium bovis subsp bovis AF2122/97
agucuggcgguauc

SEQ ID NO: 1202304 - RNA, 15 nt, Mycobacterium bovis subsp bovis AF2122/97
agucgcgggccaagc

SEQ ID NO: 1202305 - RNA, 22 nt, Mycobacterium bovis subsp bovis AF2122/97
agucgccgucgugccaccguug

SEQ ID NO: 1202306 - RNA, 14 nt, Mycobacterium bovis subsp bovis AF2122/97
agucgccgcgggca

SEQ ID NO: 1202307 - RNA, 23 nt, Mycobacterium bovis subsp bovis AF2122/97
agucgccgaggacgccggcgccg

SEQ ID NO: 1202308 - RNA, 19 nt, Mycobacterium bovis subsp bovis AF2122/97
agucgacgaacgccucacc

SEQ ID NO: 1202309 - RNA, 18 nt, Mycobacterium bovis subsp bovis AF2122/97
agucgacgacguggcugc

SEQ ID NO: 1202310 - RNA, 13 nt, Mycobacterium bovis subsp bovis AF2122/97
agucgccagaccg

SEQ ID NO: 1202311 - RNA, 16 nt, Mycobacterium bovis subsp bovis AF2122/97
agucgacgccgcagcg

SEQ ID NO: 1202312 - RNA, 13 nt, Mycobacterium bovis subsp bovis AF2122/97
aguccggcccccg

SEQ ID NO: 1202313 - RNA, 11 nt, Mycobacterium bovis subsp bovis AF2122/97
aguaccgcgcg

SEQ ID NO: 1202314 - RNA, 22 nt, Mycobacterium bovis subsp bovis AF2122/97
aguccgcgccgacggccagcag

SEQ ID NO: 1202315 - RNA, 20 nt, Mycobacterium bovis subsp bovis AF2122/97
aguccgguagcugugguggu

SEQ ID NO: 1202316 - RNA, 23 nt, Mycobacterium bovis subsp bovis AF2122/97
agugacucaccgugaaccgcccg

SEQ ID NO: 1202317 - RNA, 22 nt, Mycobacterium bovis subsp bovis AF2122/97
agugacgguccguucgaugcca

SEQ ID NO: 1202318 - RNA, 19 nt, Mycobacterium bovis subsp bovis AF2122/97
agugacugguauuucccuu

SEQ ID NO: 1202319 - RNA, 20 nt, Mycobacterium bovis subsp bovis AF2122/97
agugagcaugcgacgucagg

SEQ ID NO: 1202320 - RNA, 16 nt, Mycobacterium bovis subsp bovis AF2122/97
agugagcgaucgggug

SEQ ID NO: 1202321 - RNA, 18 nt, Mycobacterium bovis subsp bovis AF2122/97
agugcagguuggccugcu

SEQ ID NO: 1202322 - RNA, 16 nt, Mycobacterium bovis subsp bovis AF2122/97
agugcaggcggccgcc

SEQ ID NO: 1202323 - RNA, 15 nt, Mycobacterium bovis subsp bovis AF2122/97
agugcagcucgauac

SEQ ID NO: 1202324 - RNA, 23 nt, Mycobacterium bovis subsp bovis AF2122/97
agugcaggugcccggccaaaaug

SEQ ID NO: 1202325 - RNA, 21 nt, Mycobacterium bovis subsp bovis AF2122/97
agugcucgcaaucguuggcca

SEQ ID NO: 1202326 - RNA, 11 nt, Mycobacterium bovis subsp bovis AF2122/97
aguggaagccg

SEQ ID NO: 1202327 - RNA, 15 nt, Mycobacterium bovis subsp bovis AF2122/97
aguggagggcccggc

SEQ ID NO: 1202328 - RNA, 19 nt, Mycobacterium bovis subsp bovis AF2122/97
aguggagccccgacugcug

SEQ ID NO: 1202329 - RNA, 22 nt, Mycobacterium bovis subsp bovis AF2122/97
agugcgacugcgaaugcugggc

SEQ ID NO: 1202330 - RNA, 23 nt, Mycobacterium bovis subsp bovis AF2122/97
agugcgacugcgaaugcugggcc

SEQ ID NO: 1202331 - RNA, 19 nt, Mycobacterium bovis subsp bovis AF2122/97
agugucuccggcaacagca

SEQ ID NO: 1202332 - RNA, 20 nt, Mycobacterium bovis subsp bovis AF2122/97
agugucuccggcaacagcac

SEQ ID NO: 1202333 - RNA, 22 nt, Mycobacterium bovis subsp bovis AF2122/97
agugucuccggcaacagcacca

SEQ ID NO: 1202334 - RNA, 16 nt, Mycobacterium bovis subsp bovis AF2122/97
agugugacggcggcca

SEQ ID NO: 1202335 - RNA, 14 nt, Mycobacterium bovis subsp bovis AF2122/97
agugugaacugucc

SEQ ID NO: 1202336 - RNA, 13 nt, Mycobacterium bovis subsp bovis AF2122/97
agugucugcucgc

SEQ ID NO: 1202337 - RNA, 18 nt, Mycobacterium bovis subsp bovis AF2122/97
aguggcagccagcggcga

SEQ ID NO: 1202338 - RNA, 13 nt, Mycobacterium bovis subsp bovis AF2122/97
agugggacuggcg

SEQ ID NO: 1202339 - RNA, 17 nt, Mycobacterium bovis subsp bovis AF2122/97
agugggacuggcgugaa

SEQ ID NO: 1202340 - RNA, 20 nt, Mycobacterium bovis subsp bovis AF2122/97
agugggaugaccuuggccgu

SEQ ID NO: 1202341 - RNA, 14 nt, Mycobacterium bovis subsp bovis AF2122/97
agugggugccggca

SEQ ID NO: 1202342 - RNA, 20 nt, Mycobacterium bovis subsp bovis AF2122/97
agugggcgguaccucgucga

SEQ ID NO: 1202343 - RNA, 21 nt, Mycobacterium bovis subsp bovis AF2122/97
agugguacggcucggcgcuga

SEQ ID NO: 1202344 - RNA, 20 nt, Mycobacterium bovis subsp bovis AF2122/97
aguggugaccgacgcggaca

SEQ ID NO: 1202345 - RNA, 19 nt, Mycobacterium bovis subsp bovis AF2122/97
aguggugauccagccgucg

SEQ ID NO: 1202346 - RNA, 16 nt, Mycobacterium bovis subsp bovis AF2122/97
agugguuagucggccu

SEQ ID NO: 1202347 - RNA, 11 nt, Mycobacterium bovis subsp bovis AF2122/97
aguuccucuac

SEQ ID NO: 1202348 - RNA, 15 nt, Mycobacterium bovis subsp bovis AF2122/97
aguuccaauccggaa

SEQ ID NO: 1202349 - RNA, 22 nt, Mycobacterium bovis subsp bovis AF2122/97
aguucgucaccguuggccgcgc

SEQ ID NO: 1202350 - RNA, 16 nt, Mycobacterium bovis subsp bovis AF2122/97
aguucguagucggcau

SEQ ID NO: 1202351 - RNA, 22 nt, Mycobacterium bovis subsp bovis AF2122/97
aguucgguugcccccagggccg

SEQ ID NO: 1202352 - RNA, 20 nt, Mycobacterium bovis subsp bovis AF2122/97
aguucugcacagugcggccc

SEQ ID NO: 1202353 - RNA, 18 nt, Mycobacterium bovis subsp bovis AF2122/97
aguucggcccgcaaacag

SEQ ID NO: 1202354 - RNA, 14 nt, Mycobacterium bovis subsp bovis AF2122/97
aguucgagcugcca

SEQ ID NO: 1202355 - RNA, 22 nt, Mycobacterium bovis subsp bovis AF2122/97
aguucggcgucuugcaucagcg

SEQ ID NO: 1202356 - RNA, 16 nt, Mycobacterium bovis subsp bovis AF2122/97
aguucggcgagcacau

SEQ ID NO: 1202357 - RNA, 16 nt, Mycobacterium bovis subsp bovis AF2122/97
aguucgggcugcggca

SEQ ID NO: 1202358 - RNA, 22 nt, Mycobacterium bovis subsp bovis AF2122/97
aguucgacggcgucaaaggccu

SEQ ID NO: 1202359 - RNA, 17 nt, Mycobacterium bovis subsp bovis AF2122/97
aguuccugcacggucaa

SEQ ID NO: 1202360 - RNA, 18 nt, Mycobacterium bovis subsp bovis AF2122/97
aguuccugacgccauuca

SEQ ID NO: 1202361 - RNA, 21 nt, Mycobacterium bovis subsp bovis AF2122/97
aguuagccaccuuggacacca

SEQ ID NO: 1202362 - RNA, 18 nt, Mycobacterium bovis subsp bovis AF2122/97
aguuaggccgccagccgg

SEQ ID NO: 1202363 - RNA, 19 nt, Mycobacterium bovis subsp bovis AF2122/97
aguguugcaguggcgacga

SEQ ID NO: 1202364 - RNA, 15 nt, Mycobacterium bovis subsp bovis AF2122/97
aguguguuugguggu

SEQ ID NO: 1202365 - RNA, 16 nt, Mycobacterium bovis subsp bovis AF2122/97
agugugagcagaccca

SEQ ID NO: 1202366 - RNA, 20 nt, Mycobacterium bovis subsp bovis AF2122/97
agugugagcagacccagucc

SEQ ID NO: 1202367 - RNA, 18 nt, Mycobacterium bovis subsp bovis AF2122/97
aguguggccgaaagccag

SEQ ID NO: 1202368 - RNA, 21 nt, Mycobacterium bovis subsp bovis AF2122/97
aguuguuggccagaccgcgcg

SEQ ID NO: 1202369 - RNA, 20 nt, Mycobacterium bovis subsp bovis AF2122/97
aguuguugcaggagccggca

SEQ ID NO: 1202370 - RNA, 15 nt, Mycobacterium bovis subsp bovis AF2122/97
aguuguuggccagac

SEQ ID NO: 1202371 - RNA, 13 nt, Mycobacterium bovis subsp bovis AF2122/97
aguuggaacugcc

SEQ ID NO: 1202372 - RNA, 21 nt, Mycobacterium bovis subsp bovis AF2122/97
aguugaacaauccgguguuga

SEQ ID NO: 1202373 - RNA, 11 nt, Mycobacterium bovis subsp bovis AF2122/97
aguugaagaag

SEQ ID NO: 1202374 - RNA, 13 nt, Mycobacterium bovis subsp bovis AF2122/97
aguugaagaagcc

SEQ ID NO: 1202375 - RNA, 11 nt, Mycobacterium bovis subsp bovis AF2122/97
aguugaagaau

SEQ ID NO: 1202376 - RNA, 16 nt, Mycobacterium bovis subsp bovis AF2122/97
aguugcacaccggcac

SEQ ID NO: 1202377 - RNA, 14 nt, Mycobacterium bovis subsp bovis AF2122/97
aguugcucggccga

SEQ ID NO: 1202378 - RNA, 18 nt, Mycobacterium bovis subsp bovis AF2122/97
aguugcucggccgaugcg

SEQ ID NO: 1202379 - RNA, 22 nt, Mycobacterium bovis subsp bovis AF2122/97
aguugcucguugugcagguggc

SEQ ID NO: 1202380 - RNA, 16 nt, Mycobacterium bovis subsp bovis AF2122/97
aguuucccuuaccaga

SEQ ID NO: 1202381 - RNA, 19 nt, Mycobacterium bovis subsp bovis AF2122/97
aguuucugcucgaccguca

SEQ ID NO: 1202382 - RNA, 20 nt, Mycobacterium bovis subsp bovis AF2122/97
auaccgcuggggcuguaguc

SEQ ID NO: 1202383 - RNA, 14 nt, Mycobacterium bovis subsp bovis AF2122/97
auaccucgccaucc

SEQ ID NO: 1202384 - RNA, 19 nt, Mycobacterium bovis subsp bovis AF2122/97
auaccggccgccaucaucg

SEQ ID NO: 1202385 - RNA, 15 nt, Mycobacterium bovis subsp bovis AF2122/97
auaccggcuggccag

SEQ ID NO: 1202386 - RNA, 21 nt, Mycobacterium bovis subsp bovis AF2122/97
auaccgguggcagccugcugc

SEQ ID NO: 1202387 - RNA, 22 nt, Mycobacterium bovis subsp bovis AF2122/97
auacgauguucagguugcugau

SEQ ID NO: 1202388 - RNA, 13 nt, Mycobacterium bovis subsp bovis AF2122/97
auacgggcaguga

SEQ ID NO: 1202389 - RNA, 14 nt, Mycobacterium bovis subsp bovis AF2122/97
auacggccggccgu

SEQ ID NO: 1202390 - RNA, 19 nt, Mycobacterium bovis subsp bovis AF2122/97
auacucucgcgacaucacc

SEQ ID NO: 1202391 - RNA, 15 nt, Mycobacterium bovis subsp bovis AF2122/97
auagauucccggcuc

SEQ ID NO: 1202392 - RNA, 20 nt, Mycobacterium bovis subsp bovis AF2122/97
auagcugcgcgaagccacca

SEQ ID NO: 1202393 - RNA, 14 nt, Mycobacterium bovis subsp bovis AF2122/97
auaggaagguugaa

SEQ ID NO: 1202394 - RNA, 14 nt, Mycobacterium bovis subsp bovis AF2122/97
auaucuugcgcaug

SEQ ID NO: 1202395 - RNA, 19 nt, Mycobacterium bovis subsp bovis AF2122/97
auaucuuuagcgcgugcug

SEQ ID NO: 1202396 - RNA, 18 nt, Mycobacterium bovis subsp bovis AF2122/97
auaucauuacucaacagu

SEQ ID NO: 1202397 - RNA, 13 nt, Mycobacterium bovis subsp bovis AF2122/97
auaggacugcgcc

SEQ ID NO: 1202398 - RNA, 21 nt, Mycobacterium bovis subsp bovis AF2122/97
auagguguguggcgccgggga

SEQ ID NO: 1202399 - RNA, 17 nt, Mycobacterium bovis subsp bovis AF2122/97
aucaaacccccggggcg

SEQ ID NO: 1202400 - RNA, 15 nt, Mycobacterium bovis subsp bovis AF2122/97
aucaagcacagcccg

SEQ ID NO: 1202401 - RNA, 17 nt, Mycobacterium bovis subsp bovis AF2122/97
aucaacgcguugcacag

SEQ ID NO: 1202402 - RNA, 19 nt, Mycobacterium bovis subsp bovis AF2122/97
aucaacgcguugcacagca

SEQ ID NO: 1202403 - RNA, 16 nt, Mycobacterium bovis subsp bovis AF2122/97
aucaacgacaccagau

SEQ ID NO: 1202404 - RNA, 22 nt, Mycobacterium bovis subsp bovis AF2122/97
aucaaggagauccagggccuuc

SEQ ID NO: 1202405 - RNA, 13 nt, Mycobacterium bovis subsp bovis AF2122/97
aucaaggccaccu

SEQ ID NO: 1202406 - RNA, 14 nt, Mycobacterium bovis subsp bovis AF2122/97
aucaaggccaccuc

SEQ ID NO: 1202407 - RNA, 17 nt, Mycobacterium bovis subsp bovis AF2122/97
aucaaucuucccaccuu

SEQ ID NO: 1202408 - RNA, 20 nt, Mycobacterium bovis subsp bovis AF2122/97
aucaaugcugcguccuggau

SEQ ID NO: 1202409 - RNA, 15 nt, Mycobacterium bovis subsp bovis AF2122/97
aucaauugcccggca

SEQ ID NO: 1202410 - RNA, 19 nt, Mycobacterium bovis subsp bovis AF2122/97
aucaccacuggacccgccc

SEQ ID NO: 1202411 - RNA, 23 nt, Mycobacterium bovis subsp bovis AF2122/97
aucacaucggccucugaccagcc

SEQ ID NO: 1202412 - RNA, 13 nt, Mycobacterium bovis subsp bovis AF2122/97
aucacaucaaagu

SEQ ID NO: 1202413 - RNA, 22 nt, Mycobacterium bovis subsp bovis AF2122/97
aucaccucgaugccgcccguga

SEQ ID NO: 1202414 - RNA, 18 nt, Mycobacterium bovis subsp bovis AF2122/97
aucaccggcauacagccg

SEQ ID NO: 1202415 - RNA, 18 nt, Mycobacterium bovis subsp bovis AF2122/97
aucaccggugcgcuggag

SEQ ID NO: 1202416 - RNA, 23 nt, Mycobacterium bovis subsp bovis AF2122/97
aucaccgccagcugggcagccag

SEQ ID NO: 1202417 - RNA, 20 nt, Mycobacterium bovis subsp bovis AF2122/97
aucaccgccgcggccgccgu

SEQ ID NO: 1202418 - RNA, 13 nt, Mycobacterium bovis subsp bovis AF2122/97
aucaccgcggcgg

SEQ ID NO: 1202419 - RNA, 17 nt, Mycobacterium bovis subsp bovis AF2122/97
aucaccggaacccccag

SEQ ID NO: 1202420 - RNA, 21 nt, Mycobacterium bovis subsp bovis AF2122/97
aucaccgaacggcgaggugcc

SEQ ID NO: 1202421 - RNA, 15 nt, Mycobacterium bovis subsp bovis AF2122/97
aucaccgacaccgug

SEQ ID NO: 1202422 - RNA, 20 nt, Mycobacterium bovis subsp bovis AF2122/97
aucaccgagucgacggccag

SEQ ID NO: 1202423 - RNA, 12 nt, Mycobacterium bovis subsp bovis AF2122/97
aucaccccgcca

SEQ ID NO: 1202424 - RNA, 14 nt, Mycobacterium bovis subsp bovis AF2122/97
aucacccccuggac

SEQ ID NO: 1202425 - RNA, 18 nt, Mycobacterium bovis subsp bovis AF2122/97
aucaccaugaucagcgcc

SEQ ID NO: 1202426 - RNA, 18 nt, Mycobacterium bovis subsp bovis AF2122/97
aucaccauccagcccauc

SEQ ID NO: 1202427 - RNA, 21 nt, Mycobacterium bovis subsp bovis AF2122/97
aucacccacucgccgagcugg

SEQ ID NO: 1202428 - RNA, 20 nt, Mycobacterium bovis subsp bovis AF2122/97
aucaccaggguguauggcca

SEQ ID NO: 1202429 - RNA, 15 nt, Mycobacterium bovis subsp bovis AF2122/97
aucaccauaggcaag

SEQ ID NO: 1202430 - RNA, 15 nt, Mycobacterium bovis subsp bovis AF2122/97
aucacgcgaaugacg

SEQ ID NO: 1202431 - RNA, 13 nt, Mycobacterium bovis subsp bovis AF2122/97
aucacggucagcc

SEQ ID NO: 1202432 - RNA, 20 nt, Mycobacterium bovis subsp bovis AF2122/97
aucacggcgggaugcagcug

SEQ ID NO: 1202433 - RNA, 15 nt, Mycobacterium bovis subsp bovis AF2122/97
aucacggcggggauc

SEQ ID NO: 1202434 - RNA, 18 nt, Mycobacterium bovis subsp bovis AF2122/97
aucacgggcuaccggcag

SEQ ID NO: 1202435 - RNA, 21 nt, Mycobacterium bovis subsp bovis AF2122/97
aucacgggcuaccggcagcug

SEQ ID NO: 1202436 - RNA, 16 nt, Mycobacterium bovis subsp bovis AF2122/97
aucacguggugcggcc

SEQ ID NO: 1202437 - RNA, 16 nt, Mycobacterium bovis subsp bovis AF2122/97
aucacguggaccacgg

SEQ ID NO: 1202438 - RNA, 22 nt, Mycobacterium bovis subsp bovis AF2122/97
aucacucacccgggcagccugc

SEQ ID NO: 1202439 - RNA, 18 nt, Mycobacterium bovis subsp bovis AF2122/97
aucacucccccacacacc

SEQ ID NO: 1202440 - RNA, 22 nt, Mycobacterium bovis subsp bovis AF2122/97
aucacugaggcugcggguggga

SEQ ID NO: 1202441 - RNA, 22 nt, Mycobacterium bovis subsp bovis AF2122/97
aucagcaccgugacagcggcau

SEQ ID NO: 1202442 - RNA, 17 nt, Mycobacterium bovis subsp bovis AF2122/97
aucagcaccgacagccc

SEQ ID NO: 1202443 - RNA, 15 nt, Mycobacterium bovis subsp bovis AF2122/97
aucagcaugcggcca

SEQ ID NO: 1202444 - RNA, 19 nt, Mycobacterium bovis subsp bovis AF2122/97
aucagcaugguccacagcc

SEQ ID NO: 1202445 - RNA, 16 nt, Mycobacterium bovis subsp bovis AF2122/97
aucagcccgcgcagca

SEQ ID NO: 1202446 - RNA, 22 nt, Mycobacterium bovis subsp bovis AF2122/97
aucagcccgacaccguccagca

SEQ ID NO: 1202447 - RNA, 12 nt, Mycobacterium bovis subsp bovis AF2122/97
aucagccgccgc

SEQ ID NO: 1202448 - RNA, 12 nt, Mycobacterium bovis subsp bovis AF2122/97
aucagccgugcg

SEQ ID NO: 1202449 - RNA, 20 nt, Mycobacterium bovis subsp bovis AF2122/97
aucagcgacuugcuggcgua

SEQ ID NO: 1202450 - RNA, 19 nt, Mycobacterium bovis subsp bovis AF2122/97
aucagacggcgaguaggcg

SEQ ID NO: 1202451 - RNA, 20 nt, Mycobacterium bovis subsp bovis AF2122/97
aucagagcguucuucagcca

SEQ ID NO: 1202452 - RNA, 21 nt, Mycobacterium bovis subsp bovis AF2122/97
aucagagcguucuucagccag

SEQ ID NO: 1202453 - RNA, 21 nt, Mycobacterium bovis subsp bovis AF2122/97
aggugggauugaagcuggcca

SEQ ID NO: 1202454 - RNA, 13 nt, Mycobacterium bovis subsp bovis AF2122/97
aggugggcagcag

SEQ ID NO: 1202455 - RNA, 16 nt, Mycobacterium bovis subsp bovis AF2122/97
agguggcgcggggccg

SEQ ID NO: 1202456 - RNA, 23 nt, Mycobacterium bovis subsp bovis AF2122/97
agguggccgcgcaggggcggcgu

SEQ ID NO: 1202457 - RNA, 15 nt, Mycobacterium bovis subsp bovis AF2122/97
aggugggauugaagc

SEQ ID NO: 1202458 - RNA, 12 nt, Mycobacterium bovis subsp bovis AF2122/97
agguggccaggc

SEQ ID NO: 1202459 - RNA, 11 nt, Mycobacterium bovis subsp bovis AF2122/97
aggugccgggg

SEQ ID NO: 1202460 - RNA, 19 nt, Mycobacterium bovis subsp bovis AF2122/97
aggugccgaagaugaccgc

SEQ ID NO: 1202461 - RNA, 18 nt, Mycobacterium bovis subsp bovis AF2122/97
aggugccgcgcagcugcc

SEQ ID NO: 1202462 - RNA, 13 nt, Mycobacterium bovis subsp bovis AF2122/97
aggugccuucuuc

SEQ ID NO: 1202463 - RNA, 17 nt, Mycobacterium bovis subsp bovis AF2122/97
aggugcgggccggugga

SEQ ID NO: 1202464 - RNA, 13 nt, Mycobacterium bovis subsp bovis AF2122/97
aggugcgcacagg

SEQ ID NO: 1202465 - RNA, 16 nt, Mycobacterium bovis subsp bovis AF2122/97
aggugcgcgaccagga

SEQ ID NO: 1202466 - RNA, 13 nt, Mycobacterium bovis subsp bovis AF2122/97
aggugcugcaccu

SEQ ID NO: 1202467 - RNA, 23 nt, Mycobacterium bovis subsp bovis AF2122/97
aggugcuggugaucugcugggca

SEQ ID NO: 1202468 - RNA, 18 nt, Mycobacterium bovis subsp bovis AF2122/97
agguggaagugcaccugg

SEQ ID NO: 1202469 - RNA, 20 nt, Mycobacterium bovis subsp bovis AF2122/97
agguggaagugcaccuggau

SEQ ID NO: 1202470 - RNA, 17 nt, Mycobacterium bovis subsp bovis AF2122/97
aggugacaaaucggcca

SEQ ID NO: 1202471 - RNA, 20 nt, Mycobacterium bovis subsp bovis AF2122/97
aggugacgacgagggcggga

SEQ ID NO: 1202472 - RNA, 17 nt, Mycobacterium bovis subsp bovis AF2122/97
aggugacgccgccagca

SEQ ID NO: 1202473 - RNA, 15 nt, Mycobacterium bovis subsp bovis AF2122/97
aggugaucagcagga

SEQ ID NO: 1202474 - RNA, 16 nt, Mycobacterium bovis subsp bovis AF2122/97
aggugaugaacaccgg

SEQ ID NO: 1202475 - RNA, 19 nt, Mycobacterium bovis subsp bovis AF2122/97
aggugagcagcaagaccgc

SEQ ID NO: 1202476 - RNA, 15 nt, Mycobacterium bovis subsp bovis AF2122/97
aggugccaaccgcgg

SEQ ID NO: 1202477 - RNA, 13 nt, Mycobacterium bovis subsp bovis AF2122/97
aggugccaccugu

SEQ ID NO: 1202478 - RNA, 17 nt, Mycobacterium bovis subsp bovis AF2122/97
aggugaucggaagaaac

SEQ ID NO: 1202479 - RNA, 15 nt, Mycobacterium bovis subsp bovis AF2122/97
aggugaugccgccgu

SEQ ID NO: 1202480 - RNA, 16 nt, Mycobacterium bovis subsp bovis AF2122/97
aggugcacugccgggu

SEQ ID NO: 1202481 - RNA, 17 nt, Mycobacterium bovis subsp bovis AF2122/97
agguccucgagguccuc

SEQ ID NO: 1202482 - RNA, 17 nt, Mycobacterium bovis subsp bovis AF2122/97
agguccgugccgaugcc

SEQ ID NO: 1202483 - RNA, 21 nt, Mycobacterium bovis subsp bovis AF2122/97
agguccuggguguagcaaguc

SEQ ID NO: 1202484 - RNA, 22 nt, Mycobacterium bovis subsp bovis AF2122/97
agguccgccccguugugucacc

SEQ ID NO: 1202485 - RNA, 22 nt, Mycobacterium bovis subsp bovis AF2122/97
aggucgacaccgcggugccccg

SEQ ID NO: 1202486 - RNA, 18 nt, Mycobacterium bovis subsp bovis AF2122/97
aggucgccagcucggcac

SEQ ID NO: 1202487 - RNA, 16 nt, Mycobacterium bovis subsp bovis AF2122/97
aggucgaucugcgcca

SEQ ID NO: 1202488 - RNA, 20 nt, Mycobacterium bovis subsp bovis AF2122/97
aggucgccgcaacaugggug

SEQ ID NO: 1202489 - RNA, 12 nt, Mycobacterium bovis subsp bovis AF2122/97
aggucgaugccg

SEQ ID NO: 1202490 - RNA, 23 nt, Mycobacterium bovis subsp bovis AF2122/97
aggucgauaccggcgugcaguac

SEQ ID NO: 1202491 - RNA, 15 nt, Mycobacterium bovis subsp bovis AF2122/97
aggucgagcgccgcg

SEQ ID NO: 1202492 - RNA, 15 nt, Mycobacterium bovis subsp bovis AF2122/97
aggucccggcuggga

SEQ ID NO: 1202493 - RNA, 19 nt, Mycobacterium bovis subsp bovis AF2122/97
agguccgaucgugugaggc

SEQ ID NO: 1202494 - RNA, 20 nt, Mycobacterium bovis subsp bovis AF2122/97
agguccgccggugccgccgu

SEQ ID NO: 1202495 - RNA, 19 nt, Mycobacterium bovis subsp bovis AF2122/97
agguccgcggccgcgguga

SEQ ID NO: 1202496 - RNA, 13 nt, Mycobacterium bovis subsp bovis AF2122/97
agguccaccaccc

SEQ ID NO: 1202497 - RNA, 18 nt, Mycobacterium bovis subsp bovis AF2122/97
aggucauauugcggugca

SEQ ID NO: 1202498 - RNA, 16 nt, Mycobacterium bovis subsp bovis AF2122/97
aggucagcgggcuugc

SEQ ID NO: 1202499 - RNA, 18 nt, Mycobacterium bovis subsp bovis AF2122/97
aggucgcggucuuugagc

SEQ ID NO: 1202500 - RNA, 22 nt, Mycobacterium bovis subsp bovis AF2122/97
aggucgccggccacgaccucuu

SEQ ID NO: 1202501 - RNA, 23 nt, Mycobacterium bovis subsp bovis AF2122/97
aggucggccagcagcagugccac

SEQ ID NO: 1202502 - RNA, 16 nt, Mycobacterium bovis subsp bovis AF2122/97
aggucgguaccccagc

SEQ ID NO: 1202503 - RNA, 20 nt, Mycobacterium bovis subsp bovis AF2122/97
aggucgguaccccagcgcug

SEQ ID NO: 1202504 - RNA, 17 nt, Mycobacterium bovis subsp bovis AF2122/97
aggucggucaggucgag

SEQ ID NO: 1202505 - RNA, 19 nt, Mycobacterium bovis subsp bovis AF2122/97
aggucggggaacgcggcga

SEQ ID NO: 1202506 - RNA, 21 nt, Mycobacterium bovis subsp bovis AF2122/97
aggucggugugcaucgccggc

SEQ ID NO: 1202507 - RNA, 23 nt, Mycobacterium bovis subsp bovis AF2122/97
aggucguggacuuuauggcuagu

SEQ ID NO: 1202508 - RNA, 18 nt, Mycobacterium bovis subsp bovis AF2122/97
aggucuggccugccccag

SEQ ID NO: 1202509 - RNA, 20 nt, Mycobacterium bovis subsp bovis AF2122/97
aggucuccaucaaccgcgcu

SEQ ID NO: 1202510 - RNA, 19 nt, Mycobacterium bovis subsp bovis AF2122/97
aggucuucaggccgcgcau

SEQ ID NO: 1202511 - RNA, 14 nt, Mycobacterium bovis subsp bovis AF2122/97
aggugaacugguug

SEQ ID NO: 1202512 - RNA, 21 nt, Mycobacterium bovis subsp bovis AF2122/97
agguacucaguguuccgccac

SEQ ID NO: 1202513 - RNA, 22 nt, Mycobacterium bovis subsp bovis AF2122/97
agguagucggcgcgucguugcc

SEQ ID NO: 1202514 - RNA, 22 nt, Mycobacterium bovis subsp bovis AF2122/97
agguagucgucgacuugcaggc

SEQ ID NO: 1202515 - RNA, 14 nt, Mycobacterium bovis subsp bovis AF2122/97
agguacgccaggug

SEQ ID NO: 1202516 - RNA, 13 nt, Mycobacterium bovis subsp bovis AF2122/97
agguaugcccgga

SEQ ID NO: 1202517 - RNA, 22 nt, Mycobacterium bovis subsp bovis AF2122/97
agguaguucgacugaaucaugg

SEQ ID NO: 1202518 - RNA, 15 nt, Mycobacterium bovis subsp bovis AF2122/97
aggucaccggccgcc

SEQ ID NO: 1202519 - RNA, 20 nt, Mycobacterium bovis subsp bovis AF2122/97
aggucaccggucaccgcgca

SEQ ID NO: 1202520 - RNA, 19 nt, Mycobacterium bovis subsp bovis AF2122/97
aggucagccgcgcggguca

SEQ ID NO: 1202521 - RNA, 16 nt, Mycobacterium bovis subsp bovis AF2122/97
agguauuugccgugcu

SEQ ID NO: 1202522 - RNA, 21 nt, Mycobacterium bovis subsp bovis AF2122/97
aggucaacgggaggugguuca

SEQ ID NO: 1202523 - RNA, 16 nt, Mycobacterium bovis subsp bovis AF2122/97
agggucguacgucgga

SEQ ID NO: 1202524 - RNA, 18 nt, Mycobacterium bovis subsp bovis AF2122/97
agggugacccccaauccu

SEQ ID NO: 1202525 - RNA, 16 nt, Mycobacterium bovis subsp bovis AF2122/97
agggucacaaacccag

SEQ ID NO: 1202526 - RNA, 18 nt, Mycobacterium bovis subsp bovis AF2122/97
agggucacaaacccagca

SEQ ID NO: 1202527 - RNA, 16 nt, Mycobacterium bovis subsp bovis AF2122/97
agggucgacguaggac

SEQ ID NO: 1202528 - RNA, 19 nt, Mycobacterium bovis subsp bovis AF2122/97
aggguauccacgccgggca

SEQ ID NO: 1202529 - RNA, 19 nt, Mycobacterium bovis subsp bovis AF2122/97
agggugccggucacgucga

SEQ ID NO: 1202530 - RNA, 14 nt, Mycobacterium bovis subsp bovis AF2122/97
aggguggccagcag

SEQ ID NO: 1202531 - RNA, 17 nt, Mycobacterium bovis subsp bovis AF2122/97
agggugcucgucaccaa

SEQ ID NO: 1202532 - RNA, 19 nt, Mycobacterium bovis subsp bovis AF2122/97
agggugcccgcguugccaa

SEQ ID NO: 1202533 - RNA, 17 nt, Mycobacterium bovis subsp bovis AF2122/97
agggugcccucggccgc

SEQ ID NO: 1202534 - RNA, 14 nt, Mycobacterium bovis subsp bovis AF2122/97
aggguggggccggc

SEQ ID NO: 1202535 - RNA, 21 nt, Mycobacterium bovis subsp bovis AF2122/97
aggguggggcgguggccggcg

SEQ ID NO: 1202536 - RNA, 23 nt, Mycobacterium bovis subsp bovis AF2122/97
agggugucgaagagcaggcccau

SEQ ID NO: 1202537 - RNA, 14 nt, Mycobacterium bovis subsp bovis AF2122/97
aggguugccgccga

SEQ ID NO: 1202538 - RNA, 21 nt, Mycobacterium bovis subsp bovis AF2122/97
aggguuuccaagucggagcgg

SEQ ID NO: 1202539 - RNA, 13 nt, Mycobacterium bovis subsp bovis AF2122/97
agguaagcagcca

SEQ ID NO: 1202540 - RNA, 16 nt, Mycobacterium bovis subsp bovis AF2122/97
agguaagcagccagca

SEQ ID NO: 1202541 - RNA, 15 nt, Mycobacterium bovis subsp bovis AF2122/97
agguuugcgccgcgc

SEQ ID NO: 1202542 - RNA, 23 nt, Mycobacterium bovis subsp bovis AF2122/97
agguuugcgccgcgcagcgagga

SEQ ID NO: 1202543 - RNA, 18 nt, Mycobacterium bovis subsp bovis AF2122/97
agguuucccgggucccau

SEQ ID NO: 1202544 - RNA, 19 nt, Mycobacterium bovis subsp bovis AF2122/97
aggugugcgacgacggcgc

SEQ ID NO: 1202545 - RNA, 17 nt, Mycobacterium bovis subsp bovis AF2122/97
aggugucgacgcgggcg

SEQ ID NO: 1202546 - RNA, 19 nt, Mycobacterium bovis subsp bovis AF2122/97
agguguagcccuccgagca

SEQ ID NO: 1202547 - RNA, 18 nt, Mycobacterium bovis subsp bovis AF2122/97
aggugugcgucuccagcu

SEQ ID NO: 1202548 - RNA, 14 nt, Mycobacterium bovis subsp bovis AF2122/97
agguguggugacag

SEQ ID NO: 1202549 - RNA, 13 nt, Mycobacterium bovis subsp bovis AF2122/97
agguucaaagcag

SEQ ID NO: 1202550 - RNA, 14 nt, Mycobacterium bovis subsp bovis AF2122/97
agguugcgccauaa

SEQ ID NO: 1202551 - RNA, 17 nt, Mycobacterium bovis subsp bovis AF2122/97
agguugccuuggcggcc

SEQ ID NO: 1202552 - RNA, 14 nt, Mycobacterium bovis subsp bovis AF2122/97
agguugggaacagc

SEQ ID NO: 1202553 - RNA, 19 nt, Mycobacterium bovis subsp bovis AF2122/97
agguugggaacagccuauu

SEQ ID NO: 1202554 - RNA, 16 nt, Mycobacterium bovis subsp bovis AF2122/97
agguugacccccgggu

SEQ ID NO: 1202555 - RNA, 21 nt, Mycobacterium bovis subsp bovis AF2122/97
agguugcaaccuugggcgccg

SEQ ID NO: 1202556 - RNA, 16 nt, Mycobacterium bovis subsp bovis AF2122/97
agguugaacgccgcca

SEQ ID NO: 1202557 - RNA, 19 nt, Mycobacterium bovis subsp bovis AF2122/97
agguugacgucaggcugaa

SEQ ID NO: 1202558 - RNA, 17 nt, Mycobacterium bovis subsp bovis AF2122/97
agguucgaucgcgguga

SEQ ID NO: 1202559 - RNA, 15 nt, Mycobacterium bovis subsp bovis AF2122/97
agguucagccugagc

SEQ ID NO: 1202560 - RNA, 19 nt, Mycobacterium bovis subsp bovis AF2122/97
aguacacgaucuugcggaa

SEQ ID NO: 1202561 - RNA, 21 nt, Mycobacterium bovis subsp bovis AF2122/97
aguaccacuguuacggccaca

SEQ ID NO: 1202562 - RNA, 12 nt, Mycobacterium bovis subsp bovis AF2122/97
aguaccagccca

SEQ ID NO: 1202563 - RNA, 18 nt, Mycobacterium bovis subsp bovis AF2122/97
aguaccccucgcacaaug

SEQ ID NO: 1202564 - RNA, 12 nt, Mycobacterium bovis subsp bovis AF2122/97
aguaaugcccau

SEQ ID NO: 1202565 - RNA, 15 nt, Mycobacterium bovis subsp bovis AF2122/97
aguaaccguccgcgg

SEQ ID NO: 1202566 - RNA, 20 nt, Mycobacterium bovis subsp bovis AF2122/97
aggcguuggaucccagcccg

SEQ ID NO: 1202567 - RNA, 17 nt, Mycobacterium bovis subsp bovis AF2122/97
aggcguugaacugugcg

SEQ ID NO: 1202568 - RNA, 19 nt, Mycobacterium bovis subsp bovis AF2122/97
aggcgugcuugaccgccug

SEQ ID NO: 1202569 - RNA, 15 nt, Mycobacterium bovis subsp bovis AF2122/97
aggcguccaucagag

SEQ ID NO: 1202570 - RNA, 14 nt, Mycobacterium bovis subsp bovis AF2122/97
aggcgucccagccg

SEQ ID NO: 1202571 - RNA, 15 nt, Mycobacterium bovis subsp bovis AF2122/97
aggcucaaucgauga

SEQ ID NO: 1202572 - RNA, 15 nt, Mycobacterium bovis subsp bovis AF2122/97
aggcuaaucagccag

SEQ ID NO: 1202573 - RNA, 18 nt, Mycobacterium bovis subsp bovis AF2122/97
aggcucauccgccgggcc

SEQ ID NO: 1202574 - RNA, 16 nt, Mycobacterium bovis subsp bovis AF2122/97
aggcucccccaccagg

SEQ ID NO: 1202575 - RNA, 13 nt, Mycobacterium bovis subsp bovis AF2122/97
aggcuccggccgg

SEQ ID NO: 1202576 - RNA, 19 nt, Mycobacterium bovis subsp bovis AF2122/97
aggcuccggccggccagca

SEQ ID NO: 1202577 - RNA, 19 nt, Mycobacterium bovis subsp bovis AF2122/97
aggcucgcguggccgccgg

SEQ ID NO: 1202578 - RNA, 15 nt, Mycobacterium bovis subsp bovis AF2122/97
aggcucgggcaaggc

SEQ ID NO: 1202579 - RNA, 21 nt, Mycobacterium bovis subsp bovis AF2122/97
aggcucgagguguagcccucc

SEQ ID NO: 1202580 - RNA, 21 nt, Mycobacterium bovis subsp bovis AF2122/97
aggcugcagugccgcacccag

SEQ ID NO: 1202581 - RNA, 17 nt, Mycobacterium bovis subsp bovis AF2122/97
aggcugaccguggcgcc

SEQ ID NO: 1202582 - RNA, 15 nt, Mycobacterium bovis subsp bovis AF2122/97
aggcggccagcgcgc

SEQ ID NO: 1202583 - RNA, 12 nt, Mycobacterium bovis subsp bovis AF2122/97
aggcggccaggu

SEQ ID NO: 1202584 - RNA, 15 nt, Mycobacterium bovis subsp bovis AF2122/97
aggcggccgccggga

SEQ ID NO: 1202585 - RNA, 21 nt, Mycobacterium bovis subsp bovis AF2122/97
aggcggcgcgggucggcgacc

SEQ ID NO: 1202586 - RNA, 18 nt, Mycobacterium bovis subsp bovis AF2122/97
aggcggcgccgcacccac

SEQ ID NO: 1202587 - RNA, 15 nt, Mycobacterium bovis subsp bovis AF2122/97
aggcggcggccuggc

SEQ ID NO: 1202588 - RNA, 16 nt, Mycobacterium bovis subsp bovis AF2122/97
aggcgggggagcccag

SEQ ID NO: 1202589 - RNA, 21 nt, Mycobacterium bovis subsp bovis AF2122/97
aggcggucgaucauggcggca

SEQ ID NO: 1202590 - RNA, 14 nt, Mycobacterium bovis subsp bovis AF2122/97
aggcgguguccaga

SEQ ID NO: 1202591 - RNA, 15 nt, Mycobacterium bovis subsp bovis AF2122/97
aggcgcgcaccaccg

SEQ ID NO: 1202592 - RNA, 15 nt, Mycobacterium bovis subsp bovis AF2122/97
aggcgcuaggaacgc

SEQ ID NO: 1202593 - RNA, 22 nt, Mycobacterium bovis subsp bovis AF2122/97
aggcgcuccuucagggcgucga

SEQ ID NO: 1202594 - RNA, 16 nt, Mycobacterium bovis subsp bovis AF2122/97
aggcgcuucgccacac

SEQ ID NO: 1202595 - RNA, 15 nt, Mycobacterium bovis subsp bovis AF2122/97
aggcgcuucgccaca

SEQ ID NO: 1202596 - RNA, 22 nt, Mycobacterium bovis subsp bovis AF2122/97
aggcgcugaacgcgagcaacac

SEQ ID NO: 1202597 - RNA, 16 nt, Mycobacterium bovis subsp bovis AF2122/97
aggcgcuggcggguca

SEQ ID NO: 1202598 - RNA, 23 nt, Mycobacterium bovis subsp bovis AF2122/97
aggcgcugaagaucaacaggcgu

SEQ ID NO: 1202599 - RNA, 14 nt, Mycobacterium bovis subsp bovis AF2122/97
aggcgcugcagcau

SEQ ID NO: 1202600 - RNA, 16 nt, Mycobacterium bovis subsp bovis AF2122/97
aggccgccguggugau

SEQ ID NO: 1202601 - RNA, 19 nt, Mycobacterium bovis subsp bovis AF2122/97
aggccgccguggugaucaa

SEQ ID NO: 1202602 - RNA, 22 nt, Mycobacterium bovis subsp bovis AF2122/97
aggccgccgccgucggcgagca

SEQ ID NO: 1202603 - RNA, 17 nt, Mycobacterium bovis subsp bovis AF2122/97
aggccgccgagguguuu

SEQ ID NO: 1202604 - RNA, 18 nt, Mycobacterium bovis subsp bovis AF2122/97
aggccgcaugccacggca

SEQ ID NO: 1202605 - RNA, 16 nt, Mycobacterium bovis subsp bovis AF2122/97
aggccgaugacgaugc

SEQ ID NO: 1202606 - RNA, 19 nt, Mycobacterium bovis subsp bovis AF2122/97
aggccgcgcggacccagca

SEQ ID NO: 1202607 - RNA, 15 nt, Mycobacterium bovis subsp bovis AF2122/97
aggccgcugccaggg

SEQ ID NO: 1202608 - RNA, 14 nt, Mycobacterium bovis subsp bovis AF2122/97
aggccgcugggccg

SEQ ID NO: 1202609 - RNA, 17 nt, Mycobacterium bovis subsp bovis AF2122/97
aggccgcuugccccgcc

SEQ ID NO: 1202610 - RNA, 15 nt, Mycobacterium bovis subsp bovis AF2122/97
aggccggcccgcaac

SEQ ID NO: 1202611 - RNA, 13 nt, Mycobacterium bovis subsp bovis AF2122/97
aggccggcggcgg

SEQ ID NO: 1202612 - RNA, 21 nt, Mycobacterium bovis subsp bovis AF2122/97
aggccggcaagaccgaacagc

SEQ ID NO: 1202613 - RNA, 14 nt, Mycobacterium bovis subsp bovis AF2122/97
aggccggcaaggca

SEQ ID NO: 1202614 - RNA, 13 nt, Mycobacterium bovis subsp bovis AF2122/97
aggccggccacca

SEQ ID NO: 1202615 - RNA, 15 nt, Mycobacterium bovis subsp bovis AF2122/97
aggccucggccagcg

SEQ ID NO: 1202616 - RNA, 14 nt, Mycobacterium bovis subsp bovis AF2122/97
aggccuccaaaauc

SEQ ID NO: 1202617 - RNA, 19 nt, Mycobacterium bovis subsp bovis AF2122/97
aggccugacugaauuuggu

SEQ ID NO: 1202618 - RNA, 14 nt, Mycobacterium bovis subsp bovis AF2122/97
aggccuaccaggcg

SEQ ID NO: 1202619 - RNA, 20 nt, Mycobacterium bovis subsp bovis AF2122/97
aggccgggcgcaagcagccc

SEQ ID NO: 1202620 - RNA, 16 nt, Mycobacterium bovis subsp bovis AF2122/97
aggccggguggccacg

SEQ ID NO: 1202621 - RNA, 23 nt, Mycobacterium bovis subsp bovis AF2122/97
aggccggccaccgagucgaucac

SEQ ID NO: 1202622 - RNA, 17 nt, Mycobacterium bovis subsp bovis AF2122/97
aggccggcuaccgcgcu

SEQ ID NO: 1202623 - RNA, 18 nt, Mycobacterium bovis subsp bovis AF2122/97
aggccgggcgcaagcagc

SEQ ID NO: 1202624 - RNA, 13 nt, Mycobacterium bovis subsp bovis AF2122/97
aggccggcucgcu

SEQ ID NO: 1202625 - RNA, 17 nt, Mycobacterium bovis subsp bovis AF2122/97
aggccggcggcgguggu

SEQ ID NO: 1202626 - RNA, 21 nt, Mycobacterium bovis subsp bovis AF2122/97
aggccggcgucgaucaacaac

SEQ ID NO: 1202627 - RNA, 22 nt, Mycobacterium bovis subsp bovis AF2122/97
aggccgucguugccggcgacca

SEQ ID NO: 1202628 - RNA, 16 nt, Mycobacterium bovis subsp bovis AF2122/97
aggccgucggcgucga

SEQ ID NO: 1202629 - RNA, 13 nt, Mycobacterium bovis subsp bovis AF2122/97
aggccgucaggcg

SEQ ID NO: 1202630 - RNA, 19 nt, Mycobacterium bovis subsp bovis AF2122/97
aggccguggcggacggcgu

SEQ ID NO: 1202631 - RNA, 22 nt, Mycobacterium bovis subsp bovis AF2122/97
aggccguggcggacggcgucga

SEQ ID NO: 1202632 - RNA, 14 nt, Mycobacterium bovis subsp bovis AF2122/97
aggccgguucccuu

SEQ ID NO: 1202633 - RNA, 14 nt, Mycobacterium bovis subsp bovis AF2122/97
aggcgccgcagggc

SEQ ID NO: 1202634 - RNA, 22 nt, Mycobacterium bovis subsp bovis AF2122/97
aggcgcagauuccucuucaggc

SEQ ID NO: 1202635 - RNA, 14 nt, Mycobacterium bovis subsp bovis AF2122/97
aggcgcagcugggu

SEQ ID NO: 1202636 - RNA, 16 nt, Mycobacterium bovis subsp bovis AF2122/97
aggcgauccagacggu

SEQ ID NO: 1202637 - RNA, 18 nt, Mycobacterium bovis subsp bovis AF2122/97
aggcgaugcgccaggcug

SEQ ID NO: 1202638 - RNA, 20 nt, Mycobacterium bovis subsp bovis AF2122/97
aggcgaugcgccaggcugaa

SEQ ID NO: 1202639 - RNA, 16 nt, Mycobacterium bovis subsp bovis AF2122/97
aggcgauugcgccgca

SEQ ID NO: 1202640 - RNA, 17 nt, Mycobacterium bovis subsp bovis AF2122/97
aggcgauugcgccgcac

SEQ ID NO: 1202641 - RNA, 15 nt, Mycobacterium bovis subsp bovis AF2122/97
aggcgaacagggcug

SEQ ID NO: 1202642 - RNA, 16 nt, Mycobacterium bovis subsp bovis AF2122/97
aggcgacggcucuacc

SEQ ID NO: 1202643 - RNA, 15 nt, Mycobacterium bovis subsp bovis AF2122/97
aggcgagccgccacc

SEQ ID NO: 1202644 - RNA, 13 nt, Mycobacterium bovis subsp bovis AF2122/97
aggcgaccgggga

SEQ ID NO: 1202645 - RNA, 14 nt, Mycobacterium bovis subsp bovis AF2122/97
aggcgaagcgguga

SEQ ID NO: 1202646 - RNA, 20 nt, Mycobacterium bovis subsp bovis AF2122/97
agggccagcgccucggcauc

SEQ ID NO: 1202647 - RNA, 14 nt, Mycobacterium bovis subsp bovis AF2122/97
agggccagcggcag

SEQ ID NO: 1202648 - RNA, 14 nt, Mycobacterium bovis subsp bovis AF2122/97
agggccacggcugc

SEQ ID NO: 1202649 - RNA, 19 nt, Mycobacterium bovis subsp bovis AF2122/97
agggcauugcggcccgcga

SEQ ID NO: 1202650 - RNA, 18 nt, Mycobacterium bovis subsp bovis AF2122/97
agggccgccgaagcucau

SEQ ID NO: 1202651 - RNA, 13 nt, Mycobacterium bovis subsp bovis AF2122/97
agggcccuggcgg

SEQ ID NO: 1202652 - RNA, 16 nt, Mycobacterium bovis subsp bovis AF2122/97
agggcccuggcggccc

SEQ ID NO: 1202653 - RNA, 21 nt, Mycobacterium bovis subsp bovis AF2122/97
agggccauaaaugcgcguucg

SEQ ID NO: 1202654 - RNA, 20 nt, Mycobacterium bovis subsp bovis AF2122/97
agggccccaccgagcgguga

SEQ ID NO: 1202655 - RNA, 13 nt, Mycobacterium bovis subsp bovis AF2122/97
agggcacaucggg

SEQ ID NO: 1202656 - RNA, 19 nt, Mycobacterium bovis subsp bovis AF2122/97
agggcagccgcccacccgg

SEQ ID NO: 1202657 - RNA, 19 nt, Mycobacterium bovis subsp bovis AF2122/97
agggcaucgggccuagccg

SEQ ID NO: 1202658 - RNA, 16 nt, Mycobacterium bovis subsp bovis AF2122/97
agggcagcagcccggg

SEQ ID NO: 1202659 - RNA, 20 nt, Mycobacterium bovis subsp bovis AF2122/97
agggcagcgccaggccguug

SEQ ID NO: 1202660 - RNA, 13 nt, Mycobacterium bovis subsp bovis AF2122/97
agggcgccgaucg

SEQ ID NO: 1202661 - RNA, 20 nt, Mycobacterium bovis subsp bovis AF2122/97
agggcgccgggggcgccgcc

SEQ ID NO: 1202662 - RNA, 16 nt, Mycobacterium bovis subsp bovis AF2122/97
agggcgcccgccccgc

SEQ ID NO: 1202663 - RNA, 21 nt, Mycobacterium bovis subsp bovis AF2122/97
agggcgauuuccaucgcgacc

SEQ ID NO: 1202664 - RNA, 15 nt, Mycobacterium bovis subsp bovis AF2122/97
agggccuuggcggga

SEQ ID NO: 1202665 - RNA, 16 nt, Mycobacterium bovis subsp bovis AF2122/97
agggccuccacccgcc

SEQ ID NO: 1202666 - RNA, 11 nt, Mycobacterium bovis subsp bovis AF2122/97
agggccguucc

SEQ ID NO: 1202667 - RNA, 17 nt, Mycobacterium bovis subsp bovis AF2122/97
agggccggugacucaga

SEQ ID NO: 1202668 - RNA, 15 nt, Mycobacterium bovis subsp bovis AF2122/97
agggccgccgcuggu

SEQ ID NO: 1202669 - RNA, 11 nt, Mycobacterium bovis subsp bovis AF2122/97
agggccgccgc

SEQ ID NO: 1202670 - RNA, 18 nt, Mycobacterium bovis subsp bovis AF2122/97
agggccgccgcugccgcc

SEQ ID NO: 1202671 - RNA, 19 nt, Mycobacterium bovis subsp bovis AF2122/97
agggccgccgcugccgccu

SEQ ID NO: 1202672 - RNA, 19 nt, Mycobacterium bovis subsp bovis AF2122/97
aggggcuuuugcgucugcu

SEQ ID NO: 1202673 - RNA, 23 nt, Mycobacterium bovis subsp bovis AF2122/97
aggguagacggggcgagcaugcc

SEQ ID NO: 1202674 - RNA, 16 nt, Mycobacterium bovis subsp bovis AF2122/97
agggguggcgcgggcc

SEQ ID NO: 1202675 - RNA, 20 nt, Mycobacterium bovis subsp bovis AF2122/97
agggguggcgcgggccggcg

SEQ ID NO: 1202676 - RNA, 15 nt, Mycobacterium bovis subsp bovis AF2122/97
agggcgguggccacc

SEQ ID NO: 1202677 - RNA, 21 nt, Mycobacterium bovis subsp bovis AF2122/97
agggcugacgggaugguuccg

SEQ ID NO: 1202678 - RNA, 17 nt, Mycobacterium bovis subsp bovis AF2122/97
aggggcagcgcggccac

SEQ ID NO: 1202679 - RNA, 14 nt, Mycobacterium bovis subsp bovis AF2122/97
aggggcaacagggg

SEQ ID NO: 1202680 - RNA, 15 nt, Mycobacterium bovis subsp bovis AF2122/97
aggggaucugagugg

SEQ ID NO: 1202681 - RNA, 18 nt, Mycobacterium bovis subsp bovis AF2122/97
aggggaucugaguggacg

SEQ ID NO: 1202682 - RNA, 13 nt, Mycobacterium bovis subsp bovis AF2122/97
aggggagcugacc

SEQ ID NO: 1202683 - RNA, 20 nt, Mycobacterium bovis subsp bovis AF2122/97
aggggacccagcggcggucu

SEQ ID NO: 1202684 - RNA, 14 nt, Mycobacterium bovis subsp bovis AF2122/97
agggcuugcaccug

SEQ ID NO: 1202685 - RNA, 17 nt, Mycobacterium bovis subsp bovis AF2122/97
agggcuugucgccggca

SEQ ID NO: 1202686 - RNA, 17 nt, Mycobacterium bovis subsp bovis AF2122/97
aggcuggucugcaggcg

SEQ ID NO: 1202687 - RNA, 16 nt, Mycobacterium bovis subsp bovis AF2122/97
aggcuggcgagggcug

SEQ ID NO: 1202688 - RNA, 19 nt, Mycobacterium bovis subsp bovis AF2122/97
aggcuguccagcagcgaaa

SEQ ID NO: 1202689 - RNA, 16 nt, Mycobacterium bovis subsp bovis AF2122/97
aggcugucgagucggu

SEQ ID NO: 1202690 - RNA, 16 nt, Mycobacterium bovis subsp bovis AF2122/97
aggcuguaacacccgg

SEQ ID NO: 1202691 - RNA, 17 nt, Mycobacterium bovis subsp bovis AF2122/97
aggcuguggccagcauc

SEQ ID NO: 1202692 - RNA, 21 nt, Mycobacterium bovis subsp bovis AF2122/97
aggcuguggccagcaucauca

SEQ ID NO: 1202693 - RNA, 11 nt, Mycobacterium bovis subsp bovis AF2122/97
aggcuggaggu

SEQ ID NO: 1202694 - RNA, 14 nt, Mycobacterium bovis subsp bovis AF2122/97
aggcuggaggugaa

SEQ ID NO: 1202695 - RNA, 23 nt, Mycobacterium bovis subsp bovis AF2122/97
aggcugccgaaguugaagaagcc

SEQ ID NO: 1202696 - RNA, 22 nt, Mycobacterium bovis subsp bovis AF2122/97
aggcugcagugccgcacccaga

SEQ ID NO: 1202697 - RNA, 18 nt, Mycobacterium bovis subsp bovis AF2122/97
aggcuuuccggggaauga

SEQ ID NO: 1202698 - RNA, 15 nt, Mycobacterium bovis subsp bovis AF2122/97
aggcuuacaugcccu

SEQ ID NO: 1202699 - RNA, 14 nt, Mycobacterium bovis subsp bovis AF2122/97
aggcugugccggcc

SEQ ID NO: 1202700 - RNA, 17 nt, Mycobacterium bovis subsp bovis AF2122/97
aggcuuccggcgcgacc

SEQ ID NO: 1202701 - RNA, 17 nt, Mycobacterium bovis subsp bovis AF2122/97
aggcuuccagccacagc

SEQ ID NO: 1202702 - RNA, 21 nt, Mycobacterium bovis subsp bovis AF2122/97
aggcuuccagccacagcccgg

SEQ ID NO: 1202703 - RNA, 23 nt, Mycobacterium bovis subsp bovis AF2122/97
aggcuuccagccacagcccggcg

SEQ ID NO: 1202704 - RNA, 14 nt, Mycobacterium bovis subsp bovis AF2122/97
agggaggggccguc

SEQ ID NO: 1202705 - RNA, 19 nt, Mycobacterium bovis subsp bovis AF2122/97
agggagcgccgcagggucc

SEQ ID NO: 1202706 - RNA, 14 nt, Mycobacterium bovis subsp bovis AF2122/97
agggagugccgcac

SEQ ID NO: 1202707 - RNA, 20 nt, Mycobacterium bovis subsp bovis AF2122/97
agggaucacgccaccauccc

SEQ ID NO: 1202708 - RNA, 15 nt, Mycobacterium bovis subsp bovis AF2122/97
agggaugaucaccgg

SEQ ID NO: 1202709 - RNA, 20 nt, Mycobacterium bovis subsp bovis AF2122/97
agggaucuagaggcggcccc

SEQ ID NO: 1202710 - RNA, 23 nt, Mycobacterium bovis subsp bovis AF2122/97
agggauccacgcaaacggggaug

SEQ ID NO: 1202711 - RNA, 13 nt, Mycobacterium bovis subsp bovis AF2122/97
agggacccggcgc

SEQ ID NO: 1202712 - RNA, 23 nt, Mycobacterium bovis subsp bovis AF2122/97
agggaccgguuauacguauguca

SEQ ID NO: 1202713 - RNA, 22 nt, Mycobacterium bovis subsp bovis AF2122/97
agggaauccgaacucgcgggcg

SEQ ID NO: 1202714 - RNA, 19 nt, Mycobacterium bovis subsp bovis AF2122/97
agcuaaugcacgcccaggc

SEQ ID NO: 1202715 - RNA, 21 nt, Mycobacterium bovis subsp bovis AF2122/97
agcuaugucaccugggccagc

SEQ ID NO: 1202716 - RNA, 19 nt, Mycobacterium bovis subsp bovis AF2122/97
agcuaucccaggggcaccg

SEQ ID NO: 1202717 - RNA, 15 nt, Mycobacterium bovis subsp bovis AF2122/97
agcucaauuccaugc

SEQ ID NO: 1202718 - RNA, 14 nt, Mycobacterium bovis subsp bovis AF2122/97
agcucaccacccgc

SEQ ID NO: 1202719 - RNA, 13 nt, Mycobacterium bovis subsp bovis AF2122/97
agcucaccgcaca

SEQ ID NO: 1202720 - RNA, 11 nt, Mycobacterium bovis subsp bovis AF2122/97
agcucacccug

SEQ ID NO: 1202721 - RNA, 15 nt, Mycobacterium bovis subsp bovis AF2122/97
agcgucguugcucgg

SEQ ID NO: 1202722 - RNA, 21 nt, Mycobacterium bovis subsp bovis AF2122/97
agcgucucaaggccuuucaac

SEQ ID NO: 1202723 - RNA, 18 nt, Mycobacterium bovis subsp bovis AF2122/97
agcgucgcggccacgguc

SEQ ID NO: 1202724 - RNA, 19 nt, Mycobacterium bovis subsp bovis AF2122/97
agcgucggcgcaucaccac

SEQ ID NO: 1202725 - RNA, 17 nt, Mycobacterium bovis subsp bovis AF2122/97
agcguggggccgccacc

SEQ ID NO: 1202726 - RNA, 21 nt, Mycobacterium bovis subsp bovis AF2122/97
agcguggguucgaaucccauc

SEQ ID NO: 1202727 - RNA, 15 nt, Mycobacterium bovis subsp bovis AF2122/97
agcgugggcauuccc

SEQ ID NO: 1202728 - RNA, 23 nt, Mycobacterium bovis subsp bovis AF2122/97
agcguggcgcccgugccgcccgc

SEQ ID NO: 1202729 - RNA, 16 nt, Mycobacterium bovis subsp bovis AF2122/97
agcgugcggggcgccu

SEQ ID NO: 1202730 - RNA, 13 nt, Mycobacterium bovis subsp bovis AF2122/97
agcgugcggggcg

SEQ ID NO: 1202731 - RNA, 15 nt, Mycobacterium bovis subsp bovis AF2122/97
agcgugcggggcgcc

SEQ ID NO: 1202732 - RNA, 23 nt, Mycobacterium bovis subsp bovis AF2122/97
agcgugccgcagcggcggcaacc

SEQ ID NO: 1202733 - RNA, 23 nt, Mycobacterium bovis subsp bovis AF2122/97
agcgguggcgucgucggcgggcu

SEQ ID NO: 1202734 - RNA, 14 nt, Mycobacterium bovis subsp bovis AF2122/97
agcgguggcguggu

SEQ ID NO: 1202735 - RNA, 18 nt, Mycobacterium bovis subsp bovis AF2122/97
agcggugcagcccgccgg

SEQ ID NO: 1202736 - RNA, 13 nt, Mycobacterium bovis subsp bovis AF2122/97
agcggugacccac

SEQ ID NO: 1202737 - RNA, 14 nt, Mycobacterium bovis subsp bovis AF2122/97
agcgguccagccac

SEQ ID NO: 1202738 - RNA, 16 nt, Mycobacterium bovis subsp bovis AF2122/97
agcgguggcaagccua

SEQ ID NO: 1202739 - RNA, 15 nt, Mycobacterium bovis subsp bovis AF2122/97
agcggugugggauga

SEQ ID NO: 1202740 - RNA, 17 nt, Mycobacterium bovis subsp bovis AF2122/97
agcgggccagcacccgc

SEQ ID NO: 1202741 - RNA, 21 nt, Mycobacterium bovis subsp bovis AF2122/97
agcgggcagcaggcgaugcgc

SEQ ID NO: 1202742 - RNA, 20 nt, Mycobacterium bovis subsp bovis AF2122/97
agcggcgcccgccaccggag

SEQ ID NO: 1202743 - RNA, 15 nt, Mycobacterium bovis subsp bovis AF2122/97
agcggcgccgccugg

SEQ ID NO: 1202744 - RNA, 12 nt, Mycobacterium bovis subsp bovis AF2122/97
agcggcgccgcc

SEQ ID NO: 1202745 - RNA, 21 nt, Mycobacterium bovis subsp bovis AF2122/97
agcggcgccgcccuaaggggc

SEQ ID NO: 1202746 - RNA, 14 nt, Mycobacterium bovis subsp bovis AF2122/97
agcggcgcgggggu

SEQ ID NO: 1202747 - RNA, 15 nt, Mycobacterium bovis subsp bovis AF2122/97
agcggcgggcgauga

SEQ ID NO: 1202748 - RNA, 13 nt, Mycobacterium bovis subsp bovis AF2122/97
agcggcggccacg

SEQ ID NO: 1202749 - RNA, 18 nt, Mycobacterium bovis subsp bovis AF2122/97
agcggcggccacggccau

SEQ ID NO: 1202750 - RNA, 17 nt, Mycobacterium bovis subsp bovis AF2122/97
agcggcguucgaugcca

SEQ ID NO: 1202751 - RNA, 18 nt, Mycobacterium bovis subsp bovis AF2122/97
agcgggaaggcucaccac

SEQ ID NO: 1202752 - RNA, 17 nt, Mycobacterium bovis subsp bovis AF2122/97
agcggcuugcccaggcg

SEQ ID NO: 1202753 - RNA, 22 nt, Mycobacterium bovis subsp bovis AF2122/97
agcggcucgccuaucgacucag

SEQ ID NO: 1202754 - RNA, 13 nt, Mycobacterium bovis subsp bovis AF2122/97
agcggcuccggga

SEQ ID NO: 1202755 - RNA, 18 nt, Mycobacterium bovis subsp bovis AF2122/97
agcggcuccgaaggccgc

SEQ ID NO: 1202756 - RNA, 19 nt, Mycobacterium bovis subsp bovis AF2122/97
agcggcuccgaaggccgcc

SEQ ID NO: 1202757 - RNA, 22 nt, Mycobacterium bovis subsp bovis AF2122/97
agcggcuccacuuggggcgcca

SEQ ID NO: 1202758 - RNA, 12 nt, Mycobacterium bovis subsp bovis AF2122/97
agcggccgcagg

SEQ ID NO: 1202759 - RNA, 19 nt, Mycobacterium bovis subsp bovis AF2122/97
agcggccgggcggccaggc

SEQ ID NO: 1202760 - RNA, 23 nt, Mycobacterium bovis subsp bovis AF2122/97
agcggcccuucaccagccacccc

SEQ ID NO: 1202761 - RNA, 17 nt, Mycobacterium bovis subsp bovis AF2122/97
agcggccgaccgcgacc

SEQ ID NO: 1202762 - RNA, 16 nt, Mycobacterium bovis subsp bovis AF2122/97
agcggccagcccagcc

SEQ ID NO: 1202763 - RNA, 23 nt, Mycobacterium bovis subsp bovis AF2122/97
agcggccaucgggauggacacca

SEQ ID NO: 1202764 - RNA, 20 nt, Mycobacterium bovis subsp bovis AF2122/97
agcggccauaucgcccacca

SEQ ID NO: 1202765 - RNA, 13 nt, Mycobacterium bovis subsp bovis AF2122/97
agcggccagcagu

SEQ ID NO: 1202766 - RNA, 23 nt, Mycobacterium bovis subsp bovis AF2122/97
agcggcgccacguggucgagcag

SEQ ID NO: 1202767 - RNA, 20 nt, Mycobacterium bovis subsp bovis AF2122/97
agcggcgcagcgugagugca

SEQ ID NO: 1202768 - RNA, 23 nt, Mycobacterium bovis subsp bovis AF2122/97
agcggccuaacgaguaggcggcu

SEQ ID NO: 1202769 - RNA, 14 nt, Mycobacterium bovis subsp bovis AF2122/97
agcggccucgggac

SEQ ID NO: 1202770 - RNA, 20 nt, Mycobacterium bovis subsp bovis AF2122/97
agcggcgaucggaggcccgc

SEQ ID NO: 1202771 - RNA, 14 nt, Mycobacterium bovis subsp bovis AF2122/97
agcggagcgcccuu

SEQ ID NO: 1202772 - RNA, 21 nt, Mycobacterium bovis subsp bovis AF2122/97
agcggagccacucggcccggc

SEQ ID NO: 1202773 - RNA, 17 nt, Mycobacterium bovis subsp bovis AF2122/97
agcggcauugccagccg

SEQ ID NO: 1202774 - RNA, 19 nt, Mycobacterium bovis subsp bovis AF2122/97
agcggaccgcugccugccg

SEQ ID NO: 1202775 - RNA, 12 nt, Mycobacterium bovis subsp bovis AF2122/97
agcggaccgcug

SEQ ID NO: 1202776 - RNA, 20 nt, Mycobacterium bovis subsp bovis AF2122/97
agcggagacgaucgccaggc

SEQ ID NO: 1202777 - RNA, 19 nt, Mycobacterium bovis subsp bovis AF2122/97
agcgcgaucgauuccgcuc

SEQ ID NO: 1202778 - RNA, 18 nt, Mycobacterium bovis subsp bovis AF2122/97
agcgcgaucgggccggcg

SEQ ID NO: 1202779 - RNA, 16 nt, Mycobacterium bovis subsp bovis AF2122/97
agcgcgaugcagugcg

SEQ ID NO: 1202780 - RNA, 16 nt, Mycobacterium bovis subsp bovis AF2122/97
agauuggcgcugcccg

SEQ ID NO: 1202781 - RNA, 21 nt, Mycobacterium bovis subsp bovis AF2122/97
agcgcgagcccgaaccaccgc

SEQ ID NO: 1202782 - RNA, 17 nt, Mycobacterium bovis subsp bovis AF2122/97
agcgcgcccaaccuggg

SEQ ID NO: 1202783 - RNA, 18 nt, Mycobacterium bovis subsp bovis AF2122/97
agcgcgcccaaccuggga

SEQ ID NO: 1202784 - RNA, 22 nt, Mycobacterium bovis subsp bovis AF2122/97
agcgcgccagcuugucgggcac

SEQ ID NO: 1202785 - RNA, 19 nt, Mycobacterium bovis subsp bovis AF2122/97
agcgcgcacacggcuaccc

SEQ ID NO: 1202786 - RNA, 18 nt, Mycobacterium bovis subsp bovis AF2122/97
agcgcgcauagggcuggu

SEQ ID NO: 1202787 - RNA, 17 nt, Mycobacterium bovis subsp bovis AF2122/97
agcgcgccacccagcac

SEQ ID NO: 1202788 - RNA, 12 nt, Mycobacterium bovis subsp bovis AF2122/97
agcgcgccacga

SEQ ID NO: 1202789 - RNA, 22 nt, Mycobacterium bovis subsp bovis AF2122/97
agcgcgcccugcgcgugcuugg

SEQ ID NO: 1202790 - RNA, 19 nt, Mycobacterium bovis subsp bovis AF2122/97
agcgcgccguugccgccca

SEQ ID NO: 1202791 - RNA, 20 nt, Mycobacterium bovis subsp bovis AF2122/97
agcgcgccucgcccagcaag

SEQ ID NO: 1202792 - RNA, 21 nt, Mycobacterium bovis subsp bovis AF2122/97
agcgcgcgcggugcggccacu

SEQ ID NO: 1202793 - RNA, 19 nt, Mycobacterium bovis subsp bovis AF2122/97
agcgcgcgccgcuggguga

SEQ ID NO: 1202794 - RNA, 13 nt, Mycobacterium bovis subsp bovis AF2122/97
agcgcggccaccc

SEQ ID NO: 1202795 - RNA, 14 nt, Mycobacterium bovis subsp bovis AF2122/97
agcgcggccacccg

SEQ ID NO: 1202796 - RNA, 12 nt, Mycobacterium bovis subsp bovis AF2122/97
agcgcggccacc

SEQ ID NO: 1202797 - RNA, 15 nt, Mycobacterium bovis subsp bovis AF2122/97
agcgcggccagcagc

SEQ ID NO: 1202798 - RNA, 13 nt, Mycobacterium bovis subsp bovis AF2122/97
agcgcggccggaa

SEQ ID NO: 1202799 - RNA, 16 nt, Mycobacterium bovis subsp bovis AF2122/97
agcgcggccagcagca

SEQ ID NO: 1202800 - RNA, 17 nt, Mycobacterium bovis subsp bovis AF2122/97
agcgcggcaccagcacc

SEQ ID NO: 1202801 - RNA, 19 nt, Mycobacterium bovis subsp bovis AF2122/97
agcgcggccaauugcgccg

SEQ ID NO: 1202802 - RNA, 21 nt, Mycobacterium bovis subsp bovis AF2122/97
agcgcggcaaaguuggccgcc

SEQ ID NO: 1202803 - RNA, 19 nt, Mycobacterium bovis subsp bovis AF2122/97
agcgcgcuggccagcccgg

SEQ ID NO: 1202804 - RNA, 21 nt, Mycobacterium bovis subsp bovis AF2122/97
agcgcgcuggccagcccgguc

SEQ ID NO: 1202805 - RNA, 19 nt, Mycobacterium bovis subsp bovis AF2122/97
agcgcggcguguacgucga

SEQ ID NO: 1202806 - RNA, 14 nt, Mycobacterium bovis subsp bovis AF2122/97
agcgcggcgagggc

SEQ ID NO: 1202807 - RNA, 13 nt, Mycobacterium bovis subsp bovis AF2122/97
agcgcugcugccg

SEQ ID NO: 1202808 - RNA, 15 nt, Mycobacterium bovis subsp bovis AF2122/97
agcgcugggcccagg

SEQ ID NO: 1202809 - RNA, 19 nt, Mycobacterium bovis subsp bovis AF2122/97
agcgcuggcaggccgggca

SEQ ID NO: 1202810 - RNA, 16 nt, Mycobacterium bovis subsp bovis AF2122/97
agcgcuggcuacgccu

SEQ ID NO: 1202811 - RNA, 12 nt, Mycobacterium bovis subsp bovis AF2122/97
agcucagcugcg

SEQ ID NO: 1202812 - RNA, 19 nt, Mycobacterium bovis subsp bovis AF2122/97
agcucagugaugcgccccg

SEQ ID NO: 1202813 - RNA, 22 nt, Mycobacterium bovis subsp bovis AF2122/97
agcucaccucaugaucucacca

SEQ ID NO: 1202814 - RNA, 17 nt, Mycobacterium bovis subsp bovis AF2122/97
agcucacgcugaagccg

SEQ ID NO: 1202815 - RNA, 22 nt, Mycobacterium bovis subsp bovis AF2122/97
agcucacgugcugccgauagcg

SEQ ID NO: 1202816 - RNA, 17 nt, Mycobacterium bovis subsp bovis AF2122/97
agcucacuucacgccgc

SEQ ID NO: 1202817 - RNA, 22 nt, Mycobacterium bovis subsp bovis AF2122/97
agcucguugcuggcggccagca

SEQ ID NO: 1202818 - RNA, 16 nt, Mycobacterium bovis subsp bovis AF2122/97
agcugccgcggccggc

SEQ ID NO: 1202819 - RNA, 23 nt, Mycobacterium bovis subsp bovis AF2122/97
agcugccgaucaauggcaacgaa

SEQ ID NO: 1202820 - RNA, 16 nt, Mycobacterium bovis subsp bovis AF2122/97
agcugcccgacguugu

SEQ ID NO: 1202821 - RNA, 22 nt, Mycobacterium bovis subsp bovis AF2122/97
agcugcccgccagcgccgccgc

SEQ ID NO: 1202822 - RNA, 20 nt, Mycobacterium bovis subsp bovis AF2122/97
agcugaaaauaggccgggca

SEQ ID NO: 1202823 - RNA, 14 nt, Mycobacterium bovis subsp bovis AF2122/97
agcuggacggccuc

SEQ ID NO: 1202824 - RNA, 16 nt, Mycobacterium bovis subsp bovis AF2122/97
agcuggcgugcagcag

SEQ ID NO: 1202825 - RNA, 15 nt, Mycobacterium bovis subsp bovis AF2122/97
agcuggcuacgggcc

SEQ ID NO: 1202826 - RNA, 16 nt, Mycobacterium bovis subsp bovis AF2122/97
agcugcgcaucgccac

SEQ ID NO: 1202827 - RNA, 18 nt, Mycobacterium bovis subsp bovis AF2122/97
agcugcuggcgcgccugu

SEQ ID NO: 1202828 - RNA, 19 nt, Mycobacterium bovis subsp bovis AF2122/97
agcugcgcagcgcaaacau

SEQ ID NO: 1202829 - RNA, 16 nt, Mycobacterium bovis subsp bovis AF2122/97
agcugcuuggcggucu

SEQ ID NO: 1202830 - RNA, 18 nt, Mycobacterium bovis subsp bovis AF2122/97
agcuguagaccuggccgu

SEQ ID NO: 1202831 - RNA, 22 nt, Mycobacterium bovis subsp bovis AF2122/97
agcuguaggcgaccagauagaa

SEQ ID NO: 1202832 - RNA, 18 nt, Mycobacterium bovis subsp bovis AF2122/97
agcuguccucgcgggcuu

SEQ ID NO: 1202833 - RNA, 20 nt, Mycobacterium bovis subsp bovis AF2122/97
agcugucauccccggccagc

SEQ ID NO: 1202834 - RNA, 22 nt, Mycobacterium bovis subsp bovis AF2122/97
agcugucauccccggccagccu

SEQ ID NO: 1202835 - RNA, 14 nt, Mycobacterium bovis subsp bovis AF2122/97
agcuguugcggggu

SEQ ID NO: 1202836 - RNA, 21 nt, Mycobacterium bovis subsp bovis AF2122/97
agcuguuggcguggaucuugg

SEQ ID NO: 1202837 - RNA, 23 nt, Mycobacterium bovis subsp bovis AF2122/97
agcuguugguuuuguaguccgca

SEQ ID NO: 1202838 - RNA, 23 nt, Mycobacterium bovis subsp bovis AF2122/97
agcuuccgcgacgcucgcugcag

SEQ ID NO: 1202839 - RNA, 13 nt, Mycobacterium bovis subsp bovis AF2122/97
agcuucaaugucg

SEQ ID NO: 1202840 - RNA, 21 nt, Mycobacterium bovis subsp bovis AF2122/97
agcuuaggugugguucccggc

SEQ ID NO: 1202841 - RNA, 15 nt, Mycobacterium bovis subsp bovis AF2122/97
agcuuggcggccagc

SEQ ID NO: 1202842 - RNA, 20 nt, Mycobacterium bovis subsp bovis AF2122/97
agcuuggagaucgccgccgg

SEQ ID NO: 1202843 - RNA, 13 nt, Mycobacterium bovis subsp bovis AF2122/97
agcuuguccagau

SEQ ID NO: 1202844 - RNA, 23 nt, Mycobacterium bovis subsp bovis AF2122/97
agcuuggccgguucagggguggc

SEQ ID NO: 1202845 - RNA, 19 nt, Mycobacterium bovis subsp bovis AF2122/97
agcuugcggccgaauuccu

SEQ ID NO: 1202846 - RNA, 22 nt, Mycobacterium bovis subsp bovis AF2122/97
agcuuucgcgucacccggggcu

SEQ ID NO: 1202847 - RNA, 14 nt, Mycobacterium bovis subsp bovis AF2122/97
agcuuguugcagcg

SEQ ID NO: 1202848 - RNA, 15 nt, Mycobacterium bovis subsp bovis AF2122/97
agcuuucccguugcu

SEQ ID NO: 1202849 - RNA, 13 nt, Mycobacterium bovis subsp bovis AF2122/97
agcuuuaucggcc

SEQ ID NO: 1202850 - RNA, 16 nt, Mycobacterium bovis subsp bovis AF2122/97
agcuuuaucugcaugc

SEQ ID NO: 1202851 - RNA, 18 nt, Mycobacterium bovis subsp bovis AF2122/97
aggaugccgaaccgcgcg

SEQ ID NO: 1202852 - RNA, 13 nt, Mycobacterium bovis subsp bovis AF2122/97
aggaugaugaccg

SEQ ID NO: 1202853 - RNA, 15 nt, Mycobacterium bovis subsp bovis AF2122/97
aggaucucgcggucc

SEQ ID NO: 1202854 - RNA, 19 nt, Mycobacterium bovis subsp bovis AF2122/97
aggaucucggcgugcuggu

SEQ ID NO: 1202855 - RNA, 17 nt, Mycobacterium bovis subsp bovis AF2122/97
aggaucggauggcggcc

SEQ ID NO: 1202856 - RNA, 21 nt, Mycobacterium bovis subsp bovis AF2122/97
aggaucgguuucugcggcccc

SEQ ID NO: 1202857 - RNA, 18 nt, Mycobacterium bovis subsp bovis AF2122/97
aggaucgcgccuauccaa

SEQ ID NO: 1202858 - RNA, 13 nt, Mycobacterium bovis subsp bovis AF2122/97
aggaucgcggcgc

SEQ ID NO: 1202859 - RNA, 23 nt, Mycobacterium bovis subsp bovis AF2122/97
aggauucgcgcgaauguccggca

SEQ ID NO: 1202860 - RNA, 14 nt, Mycobacterium bovis subsp bovis AF2122/97
aggauugccgagcg

SEQ ID NO: 1202861 - RNA, 23 nt, Mycobacterium bovis subsp bovis AF2122/97
aggauucccucgacagugcugcc

SEQ ID NO: 1202862 - RNA, 18 nt, Mycobacterium bovis subsp bovis AF2122/97
aggauuugauaggcgcgc

SEQ ID NO: 1202863 - RNA, 22 nt, Mycobacterium bovis subsp bovis AF2122/97
aggcaccgaucggugccggccu

SEQ ID NO: 1202864 - RNA, 13 nt, Mycobacterium bovis subsp bovis AF2122/97
aggcacguucagc

SEQ ID NO: 1202865 - RNA, 20 nt, Mycobacterium bovis subsp bovis AF2122/97
aggcacaacaucgccgcagu

SEQ ID NO: 1202866 - RNA, 16 nt, Mycobacterium bovis subsp bovis AF2122/97
aggcacccuguacgaa

SEQ ID NO: 1202867 - RNA, 23 nt, Mycobacterium bovis subsp bovis AF2122/97
aggcaacccagaaguagguuuuc

SEQ ID NO: 1202868 - RNA, 13 nt, Mycobacterium bovis subsp bovis AF2122/97
aggcaagccagca

SEQ ID NO: 1202869 - RNA, 15 nt, Mycobacterium bovis subsp bovis AF2122/97
aggcaagccagcacu

SEQ ID NO: 1202870 - RNA, 15 nt, Mycobacterium bovis subsp bovis AF2122/97
aggcaagcaaccggu

SEQ ID NO: 1202871 - RNA, 19 nt, Mycobacterium bovis subsp bovis AF2122/97
aggcaaggucaacccgcac

SEQ ID NO: 1202872 - RNA, 12 nt, Mycobacterium bovis subsp bovis AF2122/97
aggccgagcaga

SEQ ID NO: 1202873 - RNA, 22 nt, Mycobacterium bovis subsp bovis AF2122/97
aggccgaacagccgagccagca

SEQ ID NO: 1202874 - RNA, 18 nt, Mycobacterium bovis subsp bovis AF2122/97
aggcccucgggacugcgc

SEQ ID NO: 1202875 - RNA, 19 nt, Mycobacterium bovis subsp bovis AF2122/97
aggcccucgacggcgucga

SEQ ID NO: 1202876 - RNA, 15 nt, Mycobacterium bovis subsp bovis AF2122/97
aggcccgggcggcca

SEQ ID NO: 1202877 - RNA, 18 nt, Mycobacterium bovis subsp bovis AF2122/97
aggcccgguucgaggauc

SEQ ID NO: 1202878 - RNA, 16 nt, Mycobacterium bovis subsp bovis AF2122/97
aggcccugcggccacg

SEQ ID NO: 1202879 - RNA, 14 nt, Mycobacterium bovis subsp bovis AF2122/97
aggcccuggccagc

SEQ ID NO: 1202880 - RNA, 22 nt, Mycobacterium bovis subsp bovis AF2122/97
aggccccggugccgaccgguug

SEQ ID NO: 1202881 - RNA, 19 nt, Mycobacterium bovis subsp bovis AF2122/97
aggccccccgcgccugccu

SEQ ID NO: 1202882 - RNA, 18 nt, Mycobacterium bovis subsp bovis AF2122/97
aggccaguuuggcgcuuu

SEQ ID NO: 1202883 - RNA, 21 nt, Mycobacterium bovis subsp bovis AF2122/97
aggccaugcucgccaaaccca

SEQ ID NO: 1202884 - RNA, 21 nt, Mycobacterium bovis subsp bovis AF2122/97
aggccagcgcucaccggcguc

SEQ ID NO: 1202885 - RNA, 18 nt, Mycobacterium bovis subsp bovis AF2122/97
aggccagagucgcccgca

SEQ ID NO: 1202886 - RNA, 20 nt, Mycobacterium bovis subsp bovis AF2122/97
aggccacccgcgaagccgcc

SEQ ID NO: 1202887 - RNA, 17 nt, Mycobacterium bovis subsp bovis AF2122/97
aggccaccgcagacgcc

SEQ ID NO: 1202888 - RNA, 17 nt, Mycobacterium bovis subsp bovis AF2122/97
aggcagcguagugcugc

SEQ ID NO: 1202889 - RNA, 20 nt, Mycobacterium bovis subsp bovis AF2122/97
aggcagcguagugcugcgcg

SEQ ID NO: 1202890 - RNA, 11 nt, Mycobacterium bovis subsp bovis AF2122/97
aggcagugagg

SEQ ID NO: 1202891 - RNA, 18 nt, Mycobacterium bovis subsp bovis AF2122/97
aggccaagguggccacca

SEQ ID NO: 1202892 - RNA, 16 nt, Mycobacterium bovis subsp bovis AF2122/97
aggccaacccugcggc

SEQ ID NO: 1202893 - RNA, 13 nt, Mycobacterium bovis subsp bovis AF2122/97
aggccaacggcgc

SEQ ID NO: 1202894 - RNA, 19 nt, Mycobacterium bovis subsp bovis AF2122/97
aggccaccacugcgcccgc

SEQ ID NO: 1202895 - RNA, 22 nt, Mycobacterium bovis subsp bovis AF2122/97
aggccaagccgcggcuaggcca

SEQ ID NO: 1202896 - RNA, 22 nt, Mycobacterium bovis subsp bovis AF2122/97
aggcauuggugaguagauugcu

SEQ ID NO: 1202897 - RNA, 16 nt, Mycobacterium bovis subsp bovis AF2122/97
aggacguggcgcugga

SEQ ID NO: 1202898 - RNA, 16 nt, Mycobacterium bovis subsp bovis AF2122/97
aggacggcguagacgu

SEQ ID NO: 1202899 - RNA, 12 nt, Mycobacterium bovis subsp bovis AF2122/97
aggacgguucau

SEQ ID NO: 1202900 - RNA, 21 nt, Mycobacterium bovis subsp bovis AF2122/97
aggacgcgggcuaucgguuca

SEQ ID NO: 1202901 - RNA, 20 nt, Mycobacterium bovis subsp bovis AF2122/97
aggacgcccacaugcucagg

SEQ ID NO: 1202902 - RNA, 13 nt, Mycobacterium bovis subsp bovis AF2122/97
aggacgcaccgcc

SEQ ID NO: 1202903 - RNA, 16 nt, Mycobacterium bovis subsp bovis AF2122/97
aggacgcaccgccagu

SEQ ID NO: 1202904 - RNA, 15 nt, Mycobacterium bovis subsp bovis AF2122/97
aggacggcagccacc

SEQ ID NO: 1202905 - RNA, 22 nt, Mycobacterium bovis subsp bovis AF2122/97
aggaccuucugucccugcaguc

SEQ ID NO: 1202906 - RNA, 15 nt, Mycobacterium bovis subsp bovis AF2122/97
aggacgaguccuagc

SEQ ID NO: 1202907 - RNA, 23 nt, Mycobacterium bovis subsp bovis AF2122/97
aggaccugcgucaucgcggguga

SEQ ID NO: 1202908 - RNA, 17 nt, Mycobacterium bovis subsp bovis AF2122/97
aggaccugugcggccga

SEQ ID NO: 1202909 - RNA, 15 nt, Mycobacterium bovis subsp bovis AF2122/97
aggacaccagcugga

SEQ ID NO: 1202910 - RNA, 15 nt, Mycobacterium bovis subsp bovis AF2122/97
aggacacauugacca

SEQ ID NO: 1202911 - RNA, 23 nt, Mycobacterium bovis subsp bovis AF2122/97
aggacacguggugggcgcagagu

SEQ ID NO: 1202912 - RNA, 20 nt, Mycobacterium bovis subsp bovis AF2122/97
aggacagcugguugugcugg

SEQ ID NO: 1202913 - RNA, 15 nt, Mycobacterium bovis subsp bovis AF2122/97
aggacaucacgaagg

SEQ ID NO: 1202914 - RNA, 17 nt, Mycobacterium bovis subsp bovis AF2122/97
aggaccgcucugcggcc

SEQ ID NO: 1202915 - RNA, 23 nt, Mycobacterium bovis subsp bovis AF2122/97
aggaccggugggucugcucagcg

SEQ ID NO: 1202916 - RNA, 18 nt, Mycobacterium bovis subsp bovis AF2122/97
aggaccgcgcccagaccg

SEQ ID NO: 1202917 - RNA, 13 nt, Mycobacterium bovis subsp bovis AF2122/97
aggaccgcgccga

SEQ ID NO: 1202918 - RNA, 16 nt, Mycobacterium bovis subsp bovis AF2122/97
aggaccgcucugcggc

SEQ ID NO: 1202919 - RNA, 14 nt, Mycobacterium bovis subsp bovis AF2122/97
aggaccagaggcgc

SEQ ID NO: 1202920 - RNA, 17 nt, Mycobacterium bovis subsp bovis AF2122/97
aggacuggaaagcagca

SEQ ID NO: 1202921 - RNA, 20 nt, Mycobacterium bovis subsp bovis AF2122/97
aggacguuugagaccccaac

SEQ ID NO: 1202922 - RNA, 19 nt, Mycobacterium bovis subsp bovis AF2122/97
aggacguuucagccgggug

SEQ ID NO: 1202923 - RNA, 18 nt, Mycobacterium bovis subsp bovis AF2122/97
aggacuucggugagcagg

SEQ ID NO: 1202924 - RNA, 19 nt, Mycobacterium bovis subsp bovis AF2122/97
aggaucccgguggcagcac

SEQ ID NO: 1202925 - RNA, 19 nt, Mycobacterium bovis subsp bovis AF2122/97
aggauccggcugcggauca

SEQ ID NO: 1202926 - RNA, 16 nt, Mycobacterium bovis subsp bovis AF2122/97
aggaucagcgcacugg

SEQ ID NO: 1202927 - RNA, 18 nt, Mycobacterium bovis subsp bovis AF2122/97
aggaucagcgcacuggcc

SEQ ID NO: 1202928 - RNA, 15 nt, Mycobacterium bovis subsp bovis AF2122/97
aggauaucgccgaga

SEQ ID NO: 1202929 - RNA, 23 nt, Mycobacterium bovis subsp bovis AF2122/97
aggagcgugucggccggccaggu

SEQ ID NO: 1202930 - RNA, 16 nt, Mycobacterium bovis subsp bovis AF2122/97
aggaguuugaccaccu

SEQ ID NO: 1202931 - RNA, 19 nt, Mycobacterium bovis subsp bovis AF2122/97
aggaaagucaccguccacg

SEQ ID NO: 1202932 - RNA, 16 nt, Mycobacterium bovis subsp bovis AF2122/97
aggaacaggcaaagua

SEQ ID NO: 1202933 - RNA, 21 nt, Mycobacterium bovis subsp bovis AF2122/97
aggaaccacccaccggccacc

SEQ ID NO: 1202934 - RNA, 22 nt, Mycobacterium bovis subsp bovis AF2122/97
aggaaccacccaccggccacca

SEQ ID NO: 1202935 - RNA, 11 nt, Mycobacterium bovis subsp bovis AF2122/97
aggaaccgggc

SEQ ID NO: 1202936 - RNA, 18 nt, Mycobacterium bovis subsp bovis AF2122/97
aggaaccgggcaaaucaa

SEQ ID NO: 1202937 - RNA, 19 nt, Mycobacterium bovis subsp bovis AF2122/97
aggaaccgggcaaaucaag

SEQ ID NO: 1202938 - RNA, 22 nt, Mycobacterium bovis subsp bovis AF2122/97
aggaaccgggcaaaucaagcac

SEQ ID NO: 1202939 - RNA, 23 nt, Mycobacterium bovis subsp bovis AF2122/97
aggaaccgggcaaaucaagcaca

SEQ ID NO: 1202940 - RNA, 15 nt, Mycobacterium bovis subsp bovis AF2122/97
aggaaccgucgaaga

SEQ ID NO: 1202941 - RNA, 22 nt, Mycobacterium bovis subsp bovis AF2122/97
aggaaccgucgaagaugaccug

SEQ ID NO: 1202942 - RNA, 20 nt, Mycobacterium bovis subsp bovis AF2122/97
aggaacuacccgccagcaaa

SEQ ID NO: 1202943 - RNA, 21 nt, Mycobacterium bovis subsp bovis AF2122/97
aggaacugaaacgcuuggccc

SEQ ID NO: 1202944 - RNA, 15 nt, Mycobacterium bovis subsp bovis AF2122/97
aggaacucggaccca

SEQ ID NO: 1202945 - RNA, 17 nt, Mycobacterium bovis subsp bovis AF2122/97
aggaacucggcccacac

SEQ ID NO: 1202946 - RNA, 12 nt, Mycobacterium bovis subsp bovis AF2122/97
aggaagccgaga

SEQ ID NO: 1202947 - RNA, 14 nt, Mycobacterium bovis subsp bovis AF2122/97
aggaagcggccggu

SEQ ID NO: 1202948 - RNA, 17 nt, Mycobacterium bovis subsp bovis AF2122/97
aggaagcggccggugga

SEQ ID NO: 1202949 - RNA, 23 nt, Mycobacterium bovis subsp bovis AF2122/97
aggaagggcuaucguggcggcgu

SEQ ID NO: 1202950 - RNA, 22 nt, Mycobacterium bovis subsp bovis AF2122/97
aggaaggugugcgucuccagcu

SEQ ID NO: 1202951 - RNA, 19 nt, Mycobacterium bovis subsp bovis AF2122/97
aggaaucccucggccgcag

SEQ ID NO: 1202952 - RNA, 22 nt, Mycobacterium bovis subsp bovis AF2122/97
aggaaucccucggccgcaggcu

SEQ ID NO: 1202953 - RNA, 21 nt, Mycobacterium bovis subsp bovis AF2122/97
aggaauucgccauagcgggcg

SEQ ID NO: 1202954 - RNA, 16 nt, Mycobacterium bovis subsp bovis AF2122/97
aggacaagccgcugau

SEQ ID NO: 1202955 - RNA, 21 nt, Mycobacterium bovis subsp bovis AF2122/97
acggccagcaggaugaugacc

SEQ ID NO: 1202956 - RNA, 22 nt, Mycobacterium bovis subsp bovis AF2122/97
acggccaguugguagccgcccu

SEQ ID NO: 1202957 - RNA, 19 nt, Mycobacterium bovis subsp bovis AF2122/97
acggccaugaucacaccgc

SEQ ID NO: 1202958 - RNA, 22 nt, Mycobacterium bovis subsp bovis AF2122/97
acggccaucgccagccugugcu

SEQ ID NO: 1202959 - RNA, 13 nt, Mycobacterium bovis subsp bovis AF2122/97
acggccaucgugc

SEQ ID NO: 1202960 - RNA, 21 nt, Mycobacterium bovis subsp bovis AF2122/97
acggcccgagccgcgugggcc

SEQ ID NO: 1202961 - RNA, 16 nt, Mycobacterium bovis subsp bovis AF2122/97
acggcccgccguccgg

SEQ ID NO: 1202962 - RNA, 14 nt, Mycobacterium bovis subsp bovis AF2122/97
acggccgggacggc

SEQ ID NO: 1202963 - RNA, 23 nt, Mycobacterium bovis subsp bovis AF2122/97
acggcccgccguccggcgcccac

SEQ ID NO: 1202964 - RNA, 20 nt, Mycobacterium bovis subsp bovis AF2122/97
acggcgaaaaucccgcuccc

SEQ ID NO: 1202965 - RNA, 20 nt, Mycobacterium bovis subsp bovis AF2122/97
acggcgaaaucgacagcagc

SEQ ID NO: 1202966 - RNA, 18 nt, Mycobacterium bovis subsp bovis AF2122/97
acggcgaaccggcccacc

SEQ ID NO: 1202967 - RNA, 20 nt, Mycobacterium bovis subsp bovis AF2122/97
acggcgaccaccgcggcugc

SEQ ID NO: 1202968 - RNA, 19 nt, Mycobacterium bovis subsp bovis AF2122/97
acggcgaccacgccgccgg

SEQ ID NO: 1202969 - RNA, 18 nt, Mycobacterium bovis subsp bovis AF2122/97
acggcgacacgccagccg

SEQ ID NO: 1202970 - RNA, 14 nt, Mycobacterium bovis subsp bovis AF2122/97
acggcgacaucggc

SEQ ID NO: 1202971 - RNA, 16 nt, Mycobacterium bovis subsp bovis AF2122/97
acggcgacggcgccca

SEQ ID NO: 1202972 - RNA, 20 nt, Mycobacterium bovis subsp bovis AF2122/97
acggcgagaaaaugacccac

SEQ ID NO: 1202973 - RNA, 16 nt, Mycobacterium bovis subsp bovis AF2122/97
acggcgacucgaggac

SEQ ID NO: 1202974 - RNA, 22 nt, Mycobacterium bovis subsp bovis AF2122/97
acggcgagaaaaugacccacac

SEQ ID NO: 1202975 - RNA, 14 nt, Mycobacterium bovis subsp bovis AF2122/97
acggcgcugacgaa

SEQ ID NO: 1202976 - RNA, 17 nt, Mycobacterium bovis subsp bovis AF2122/97
acggcgaccgccaucac

SEQ ID NO: 1202977 - RNA, 12 nt, Mycobacterium bovis subsp bovis AF2122/97
acggccagcagg

SEQ ID NO: 1202978 - RNA, 17 nt, Mycobacterium bovis subsp bovis AF2122/97
acggcauucgaccucaa

SEQ ID NO: 1202979 - RNA, 22 nt, Mycobacterium bovis subsp bovis AF2122/97
acggcaagccaaccagcccggc

SEQ ID NO: 1202980 - RNA, 15 nt, Mycobacterium bovis subsp bovis AF2122/97
acggcaagccauuca

SEQ ID NO: 1202981 - RNA, 16 nt, Mycobacterium bovis subsp bovis AF2122/97
acggcaagccauucac

SEQ ID NO: 1202982 - RNA, 19 nt, Mycobacterium bovis subsp bovis AF2122/97
acggcaauacccgccgcga

SEQ ID NO: 1202983 - RNA, 21 nt, Mycobacterium bovis subsp bovis AF2122/97
acggaucgcccugacacccau

SEQ ID NO: 1202984 - RNA, 16 nt, Mycobacterium bovis subsp bovis AF2122/97
acggauaucagcaaca

SEQ ID NO: 1202985 - RNA, 17 nt, Mycobacterium bovis subsp bovis AF2122/97
acggauucgaaggcacc

SEQ ID NO: 1202986 - RNA, 18 nt, Mycobacterium bovis subsp bovis AF2122/97
acggauucgaaggcaccu

SEQ ID NO: 1202987 - RNA, 20 nt, Mycobacterium bovis subsp bovis AF2122/97
acggauucccgcccagcagc

SEQ ID NO: 1202988 - RNA, 15 nt, Mycobacterium bovis subsp bovis AF2122/97
acggaaccgauaccu

SEQ ID NO: 1202989 - RNA, 17 nt, Mycobacterium bovis subsp bovis AF2122/97
acgcugcucuggacggu

SEQ ID NO: 1202990 - RNA, 17 nt, Mycobacterium bovis subsp bovis AF2122/97
acgcugcuggcaugcag

SEQ ID NO: 1202991 - RNA, 18 nt, Mycobacterium bovis subsp bovis AF2122/97
acgcacaauacggucagc

SEQ ID NO: 1202992 - RNA, 13 nt, Mycobacterium bovis subsp bovis AF2122/97
acggcggcgaggc

SEQ ID NO: 1202993 - RNA, 17 nt, Mycobacterium bovis subsp bovis AF2122/97
acggcggccccggcauu

SEQ ID NO: 1202994 - RNA, 16 nt, Mycobacterium bovis subsp bovis AF2122/97
acggcggagucgcgca

SEQ ID NO: 1202995 - RNA, 22 nt, Mycobacterium bovis subsp bovis AF2122/97
acggcggaucggcggccggcac

SEQ ID NO: 1202996 - RNA, 18 nt, Mycobacterium bovis subsp bovis AF2122/97
acggcggcaacggcggca

SEQ ID NO: 1202997 - RNA, 15 nt, Mycobacterium bovis subsp bovis AF2122/97
acggcggcacgggcg

SEQ ID NO: 1202998 - RNA, 22 nt, Mycobacterium bovis subsp bovis AF2122/97
acgggccgcgguacccaccucc

SEQ ID NO: 1202999 - RNA, 16 nt, Mycobacterium bovis subsp bovis AF2122/97
acgggccggaccauca

SEQ ID NO: 1203000 - RNA, 21 nt, Mycobacterium bovis subsp bovis AF2122/97
acgggccggaccaucagcguc

SEQ ID NO: 1203001 - RNA, 20 nt, Mycobacterium bovis subsp bovis AF2122/97
acgggccgcgguacccaccu

SEQ ID NO: 1203002 - RNA, 15 nt, Mycobacterium bovis subsp bovis AF2122/97
acggcgguaagggcg

SEQ ID NO: 1203003 - RNA, 22 nt, Mycobacterium bovis subsp bovis AF2122/97
acgggcugccccuccgggcgca

SEQ ID NO: 1203004 - RNA, 17 nt, Mycobacterium bovis subsp bovis AF2122/97
acgggcucggcaggccc

SEQ ID NO: 1203005 - RNA, 21 nt, Mycobacterium bovis subsp bovis AF2122/97
acgggcucgcugcaccagcug

SEQ ID NO: 1203006 - RNA, 16 nt, Mycobacterium bovis subsp bovis AF2122/97
acgggcuaccggcagc

SEQ ID NO: 1203007 - RNA, 15 nt, Mycobacterium bovis subsp bovis AF2122/97
acgggcggggacggc

SEQ ID NO: 1203008 - RNA, 15 nt, Mycobacterium bovis subsp bovis AF2122/97
acgggguggcacgca

SEQ ID NO: 1203009 - RNA, 16 nt, Mycobacterium bovis subsp bovis AF2122/97
acgggggcuguccacc

SEQ ID NO: 1203010 - RNA, 20 nt, Mycobacterium bovis subsp bovis AF2122/97
acggggucgcccggggcgca

SEQ ID NO: 1203011 - RNA, 23 nt, Mycobacterium bovis subsp bovis AF2122/97
acggggaggucaaaaucagggug

SEQ ID NO: 1203012 - RNA, 16 nt, Mycobacterium bovis subsp bovis AF2122/97
acggggccgccagcug

SEQ ID NO: 1203013 - RNA, 14 nt, Mycobacterium bovis subsp bovis AF2122/97
acggggcgagcaug

SEQ ID NO: 1203014 - RNA, 19 nt, Mycobacterium bovis subsp bovis AF2122/97
acggggcggucggccggcu

SEQ ID NO: 1203015 - RNA, 23 nt, Mycobacterium bovis subsp bovis AF2122/97
acgggucgggcaaccugccgggc

SEQ ID NO: 1203016 - RNA, 11 nt, Mycobacterium bovis subsp bovis AF2122/97
acgggucagca

SEQ ID NO: 1203017 - RNA, 13 nt, Mycobacterium bovis subsp bovis AF2122/97
acgggucgccgga

SEQ ID NO: 1203018 - RNA, 15 nt, Mycobacterium bovis subsp bovis AF2122/97
acggguccgggccaa

SEQ ID NO: 1203019 - RNA, 14 nt, Mycobacterium bovis subsp bovis AF2122/97
acgggugucgggcg

SEQ ID NO: 1203020 - RNA, 16 nt, Mycobacterium bovis subsp bovis AF2122/97
acgguacagcuccaca

SEQ ID NO: 1203021 - RNA, 23 nt, Mycobacterium bovis subsp bovis AF2122/97
acgguacgccgccgcgacgcacu

SEQ ID NO: 1203022 - RNA, 12 nt, Mycobacterium bovis subsp bovis AF2122/97
acguaacccagu

SEQ ID NO: 1203023 - RNA, 20 nt, Mycobacterium bovis subsp bovis AF2122/97
acggugucgcgaugcuuccc

SEQ ID NO: 1203024 - RNA, 20 nt, Mycobacterium bovis subsp bovis AF2122/97
acgguguauugggguggcag

SEQ ID NO: 1203025 - RNA, 18 nt, Mycobacterium bovis subsp bovis AF2122/97
acgguggugucagccacc

SEQ ID NO: 1203026 - RNA, 23 nt, Mycobacterium bovis subsp bovis AF2122/97
acggugucuugccaccacgcaug

SEQ ID NO: 1203027 - RNA, 11 nt, Mycobacterium bovis subsp bovis AF2122/97
acgguguuggu

SEQ ID NO: 1203028 - RNA, 14 nt, Mycobacterium bovis subsp bovis AF2122/97
acgguguuggugac

SEQ ID NO: 1203029 - RNA, 13 nt, Mycobacterium bovis subsp bovis AF2122/97
acgguugccggcg

SEQ ID NO: 1203030 - RNA, 23 nt, Mycobacterium bovis subsp bovis AF2122/97
acggucuggcccgcgacaucggg

SEQ ID NO: 1203031 - RNA, 17 nt, Mycobacterium bovis subsp bovis AF2122/97
acggucgcucggcauga

SEQ ID NO: 1203032 - RNA, 18 nt, Mycobacterium bovis subsp bovis AF2122/97
acggucgaccaggacggu

SEQ ID NO: 1203033 - RNA, 17 nt, Mycobacterium bovis subsp bovis AF2122/97
acgguccgccacggcgg

SEQ ID NO: 1203034 - RNA, 12 nt, Mycobacterium bovis subsp bovis AF2122/97
acggucaacgac

SEQ ID NO: 1203035 - RNA, 23 nt, Mycobacterium bovis subsp bovis AF2122/97
acgguggccgagccgcggucacc

SEQ ID NO: 1203036 - RNA, 15 nt, Mycobacterium bovis subsp bovis AF2122/97
acggugcugccguug

SEQ ID NO: 1203037 - RNA, 20 nt, Mycobacterium bovis subsp bovis AF2122/97
acgguggcgccgucggccga

SEQ ID NO: 1203038 - RNA, 19 nt, Mycobacterium bovis subsp bovis AF2122/97
acggugcucuucgaugacu

SEQ ID NO: 1203039 - RNA, 15 nt, Mycobacterium bovis subsp bovis AF2122/97
acgguguaacugcgu

SEQ ID NO: 1203040 - RNA, 19 nt, Mycobacterium bovis subsp bovis AF2122/97
acggugggugggcgccgca

SEQ ID NO: 1203041 - RNA, 16 nt, Mycobacterium bovis subsp bovis AF2122/97
acggugaucagcagca

SEQ ID NO: 1203042 - RNA, 21 nt, Mycobacterium bovis subsp bovis AF2122/97
acggugcacagcagugaacgu

SEQ ID NO: 1203043 - RNA, 18 nt, Mycobacterium bovis subsp bovis AF2122/97
acggugaucgccggcuuc

SEQ ID NO: 1203044 - RNA, 14 nt, Mycobacterium bovis subsp bovis AF2122/97
acggugauggggga

SEQ ID NO: 1203045 - RNA, 13 nt, Mycobacterium bovis subsp bovis AF2122/97
acgucgaucaaca

SEQ ID NO: 1203046 - RNA, 15 nt, Mycobacterium bovis subsp bovis AF2122/97
acgucgagcaggcug

SEQ ID NO: 1203047 - RNA, 14 nt, Mycobacterium bovis subsp bovis AF2122/97
acgucgagcagccg

SEQ ID NO: 1203048 - RNA, 18 nt, Mycobacterium bovis subsp bovis AF2122/97
acgucgagauccucgucg

SEQ ID NO: 1203049 - RNA, 18 nt, Mycobacterium bovis subsp bovis AF2122/97
acguccaguggcagccag

SEQ ID NO: 1203050 - RNA, 21 nt, Mycobacterium bovis subsp bovis AF2122/97
acgucccgguaauccacucca

SEQ ID NO: 1203051 - RNA, 17 nt, Mycobacterium bovis subsp bovis AF2122/97
acguccgcaaccucgcc

SEQ ID NO: 1203052 - RNA, 15 nt, Mycobacterium bovis subsp bovis AF2122/97
acguccgcgccgagc

SEQ ID NO: 1203053 - RNA, 17 nt, Mycobacterium bovis subsp bovis AF2122/97
acguccagggccacgau

SEQ ID NO: 1203054 - RNA, 24 nt, Mycobacterium bovis subsp bovis AF2122/97
acguccaguccaugugcccagguc

SEQ ID NO: 1203055 - RNA, 20 nt, Mycobacterium bovis subsp bovis AF2122/97
acgugccaaugauucggcac

SEQ ID NO: 1203056 - RNA, 15 nt, Mycobacterium bovis subsp bovis AF2122/97
acgugcaucugugag

SEQ ID NO: 1203057 - RNA, 14 nt, Mycobacterium bovis subsp bovis AF2122/97
acgugccuuccucg

SEQ ID NO: 1203058 - RNA, 23 nt, Mycobacterium bovis subsp bovis AF2122/97
acgugcgaaucgagacggccacg

SEQ ID NO: 1203059 - RNA, 23 nt, Mycobacterium bovis subsp bovis AF2122/97
acgugcgagcccaccuggggccg

SEQ ID NO: 1203060 - RNA, 20 nt, Mycobacterium bovis subsp bovis AF2122/97
acgugcucguagacuugcug

SEQ ID NO: 1203061 - RNA, 21 nt, Mycobacterium bovis subsp bovis AF2122/97
acgugcucguagacuugcugc

SEQ ID NO: 1203062 - RNA, 21 nt, Mycobacterium bovis subsp bovis AF2122/97
acgucgguaaacguugggaaa

SEQ ID NO: 1203063 - RNA, 23 nt, Mycobacterium bovis subsp bovis AF2122/97
acgucggugugcgcgccaggcuc

SEQ ID NO: 1203064 - RNA, 15 nt, Mycobacterium bovis subsp bovis AF2122/97
acgucgcuccgaugu

SEQ ID NO: 1203065 - RNA, 21 nt, Mycobacterium bovis subsp bovis AF2122/97
acgucgcgcaucgccuccucg

SEQ ID NO: 1203066 - RNA, 16 nt, Mycobacterium bovis subsp bovis AF2122/97
acgucgcgcaucgccu

SEQ ID NO: 1203067 - RNA, 17 nt, Mycobacterium bovis subsp bovis AF2122/97
acgucgcgcaucgccuc

SEQ ID NO: 1203068 - RNA, 21 nt, Mycobacterium bovis subsp bovis AF2122/97
acgucucuggugcaggugagu

SEQ ID NO: 1203069 - RNA, 22 nt, Mycobacterium bovis subsp bovis AF2122/97
acguuggccgagcagggccggc

SEQ ID NO: 1203070 - RNA, 15 nt, Mycobacterium bovis subsp bovis AF2122/97
acguuggcagcccuc

SEQ ID NO: 1203071 - RNA, 22 nt, Mycobacterium bovis subsp bovis AF2122/97
acguugcuggcuggguggcccc

SEQ ID NO: 1203072 - RNA, 18 nt, Mycobacterium bovis subsp bovis AF2122/97
acguuggcgugcaccgca

SEQ ID NO: 1203073 - RNA, 22 nt, Mycobacterium bovis subsp bovis AF2122/97
acguuggggauggucccgcucu

SEQ ID NO: 1203074 - RNA, 17 nt, Mycobacterium bovis subsp bovis AF2122/97
acuacggccuggccacc

SEQ ID NO: 1203075 - RNA, 16 nt, Mycobacterium bovis subsp bovis AF2122/97
acuccucagccgccug

SEQ ID NO: 1203076 - RNA, 16 nt, Mycobacterium bovis subsp bovis AF2122/97
acuccucucucuuggu

SEQ ID NO: 1203077 - RNA, 13 nt, Mycobacterium bovis subsp bovis AF2122/97
acuccugcagccc

SEQ ID NO: 1203078 - RNA, 22 nt, Mycobacterium bovis subsp bovis AF2122/97
acuccugcagcccgggcagcac

SEQ ID NO: 1203079 - RNA, 13 nt, Mycobacterium bovis subsp bovis AF2122/97
acuccugcacaca

SEQ ID NO: 1203080 - RNA, 19 nt, Mycobacterium bovis subsp bovis AF2122/97
acucgaccaccgccggccc

SEQ ID NO: 1203081 - RNA, 13 nt, Mycobacterium bovis subsp bovis AF2122/97
acucgaagcggug

SEQ ID NO: 1203082 - RNA, 18 nt, Mycobacterium bovis subsp bovis AF2122/97
acucgaaccguuucggga

SEQ ID NO: 1203083 - RNA, 23 nt, Mycobacterium bovis subsp bovis AF2122/97
acucgacguaagugugcccugcu

SEQ ID NO: 1203084 - RNA, 18 nt, Mycobacterium bovis subsp bovis AF2122/97
acucgagagcgaucaacg

SEQ ID NO: 1203085 - RNA, 21 nt, Mycobacterium bovis subsp bovis AF2122/97
acucgagcgcucacauucaac

SEQ ID NO: 1203086 - RNA, 20 nt, Mycobacterium bovis subsp bovis AF2122/97
acuccgggcucggcgucgcc

SEQ ID NO: 1203087 - RNA, 18 nt, Mycobacterium bovis subsp bovis AF2122/97
acuccggucaacacccgc

SEQ ID NO: 1203088 - RNA, 14 nt, Mycobacterium bovis subsp bovis AF2122/97
acuccgcggcgcgc

SEQ ID NO: 1203089 - RNA, 17 nt, Mycobacterium bovis subsp bovis AF2122/97
acuccgcgcgcugggcc

SEQ ID NO: 1203090 - RNA, 15 nt, Mycobacterium bovis subsp bovis AF2122/97
acuccgcggaaccca

SEQ ID NO: 1203091 - RNA, 19 nt, Mycobacterium bovis subsp bovis AF2122/97
acuccgcggaacccagcac

SEQ ID NO: 1203092 - RNA, 20 nt, Mycobacterium bovis subsp bovis AF2122/97
acuccgcggaacccagcacu

SEQ ID NO: 1203093 - RNA, 12 nt, Mycobacterium bovis subsp bovis AF2122/97
acuccgcggcga

SEQ ID NO: 1203094 - RNA, 12 nt, Mycobacterium bovis subsp bovis AF2122/97
acuccgcggcgc

SEQ ID NO: 1203095 - RNA, 17 nt, Mycobacterium bovis subsp bovis AF2122/97
acuccgcgagcccggcc

SEQ ID NO: 1203096 - RNA, 16 nt, Mycobacterium bovis subsp bovis AF2122/97
acucaacaccagcaag

SEQ ID NO: 1203097 - RNA, 18 nt, Mycobacterium bovis subsp bovis AF2122/97
acucggcgaccugccgga

SEQ ID NO: 1203098 - RNA, 21 nt, Mycobacterium bovis subsp bovis AF2122/97
acucggcccggcaggacuugg

SEQ ID NO: 1203099 - RNA, 16 nt, Mycobacterium bovis subsp bovis AF2122/97
acucggccgggcucua

SEQ ID NO: 1203100 - RNA, 18 nt, Mycobacterium bovis subsp bovis AF2122/97
acucggcgauauggccuu

SEQ ID NO: 1203101 - RNA, 18 nt, Mycobacterium bovis subsp bovis AF2122/97
acucgaggaccugcucgg

SEQ ID NO: 1203102 - RNA, 21 nt, Mycobacterium bovis subsp bovis AF2122/97
acucggauagccccguguugu

SEQ ID NO: 1203103 - RNA, 12 nt, Mycobacterium bovis subsp bovis AF2122/97
acucggcccaca

SEQ ID NO: 1203104 - RNA, 17 nt, Mycobacterium bovis subsp bovis AF2122/97
acucggcccacacgguc

SEQ ID NO: 1203105 - RNA, 21 nt, Mycobacterium bovis subsp bovis AF2122/97
acucggccacggcgucggcca

SEQ ID NO: 1203106 - RNA, 14 nt, Mycobacterium bovis subsp bovis AF2122/97
acucggacccaccc

SEQ ID NO: 1203107 - RNA, 20 nt, Mycobacterium bovis subsp bovis AF2122/97
acugaucgaccgccuccucg

SEQ ID NO: 1203108 - RNA, 17 nt, Mycobacterium bovis subsp bovis AF2122/97
acugaggcucaggugcu

SEQ ID NO: 1203109 - RNA, 20 nt, Mycobacterium bovis subsp bovis AF2122/97
acugaggaaagucaccgucc

SEQ ID NO: 1203110 - RNA, 17 nt, Mycobacterium bovis subsp bovis AF2122/97
acugagaucgcuucccg

SEQ ID NO: 1203111 - RNA, 15 nt, Mycobacterium bovis subsp bovis AF2122/97
acugagccacaggga

SEQ ID NO: 1203112 - RNA, 12 nt, Mycobacterium bovis subsp bovis AF2122/97
acugccgagcac

SEQ ID NO: 1203113 - RNA, 19 nt, Mycobacterium bovis subsp bovis AF2122/97
acugccggacagccacgca

SEQ ID NO: 1203114 - RNA, 22 nt, Mycobacterium bovis subsp bovis AF2122/97
acugccggacagccacgcacaa

SEQ ID NO: 1203115 - RNA, 21 nt, Mycobacterium bovis subsp bovis AF2122/97
acugccgcggcaccgccccgc

SEQ ID NO: 1203116 - RNA, 24 nt, Mycobacterium bovis subsp bovis AF2122/97
acugcgaaggaccagagcucgaag

SEQ ID NO: 1203117 - RNA, 15 nt, Mycobacterium bovis subsp bovis AF2122/97
acugcgaaugcuggg

SEQ ID NO: 1203118 - RNA, 17 nt, Mycobacterium bovis subsp bovis AF2122/97
acugcgaaugcugggcc

SEQ ID NO: 1203119 - RNA, 13 nt, Mycobacterium bovis subsp bovis AF2122/97
acugcgccgccgg

SEQ ID NO: 1203120 - RNA, 13 nt, Mycobacterium bovis subsp bovis AF2122/97
acugcgccguucg

SEQ ID NO: 1203121 - RNA, 14 nt, Mycobacterium bovis subsp bovis AF2122/97
acugcgccguucgc

SEQ ID NO: 1203122 - RNA, 20 nt, Mycobacterium bovis subsp bovis AF2122/97
acugcgccguucgcuccccc

SEQ ID NO: 1203123 - RNA, 17 nt, Mycobacterium bovis subsp bovis AF2122/97
acugcgcaccugggucg

SEQ ID NO: 1203124 - RNA, 20 nt, Mycobacterium bovis subsp bovis AF2122/97
acugcgagggcacgcgcaca

SEQ ID NO: 1203125 - RNA, 18 nt, Mycobacterium bovis subsp bovis AF2122/97
acugcgaccgucccggcc

SEQ ID NO: 1203126 - RNA, 18 nt, Mycobacterium bovis subsp bovis AF2122/97
acugcccgcguuugcgaa

SEQ ID NO: 1203127 - RNA, 22 nt, Mycobacterium bovis subsp bovis AF2122/97
acugcccgauggcuaccuugga

SEQ ID NO: 1203128 - RNA, 12 nt, Mycobacterium bovis subsp bovis AF2122/97
acugccacuccu

SEQ ID NO: 1203129 - RNA, 13 nt, Mycobacterium bovis subsp bovis AF2122/97
acugcagcccugc

SEQ ID NO: 1203130 - RNA, 24 nt, Mycobacterium bovis subsp bovis AF2122/97
acugcagugccguguccagcaugc

SEQ ID NO: 1203131 - RNA, 13 nt, Mycobacterium bovis subsp bovis AF2122/97
acuggugggccau

SEQ ID NO: 1203132 - RNA, 21 nt, Mycobacterium bovis subsp bovis AF2122/97
acuggucgccaacgccagcac

SEQ ID NO: 1203133 - RNA, 16 nt, Mycobacterium bovis subsp bovis AF2122/97
acugggcgcuggaggc

SEQ ID NO: 1203134 - RNA, 13 nt, Mycobacterium bovis subsp bovis AF2122/97
acugggggccggc

SEQ ID NO: 1203135 - RNA, 16 nt, Mycobacterium bovis subsp bovis AF2122/97
acuggggaggccaacc

SEQ ID NO: 1203136 - RNA, 16 nt, Mycobacterium bovis subsp bovis AF2122/97
acuggcuuugacggga

SEQ ID NO: 1203137 - RNA, 20 nt, Mycobacterium bovis subsp bovis AF2122/97
acuggccccgccagcggcag

SEQ ID NO: 1203138 - RNA, 18 nt, Mycobacterium bovis subsp bovis AF2122/97
acuggccccgguggugcu

SEQ ID NO: 1203139 - RNA, 18 nt, Mycobacterium bovis subsp bovis AF2122/97
acuggcgguccgaugcgc

SEQ ID NO: 1203140 - RNA, 20 nt, Mycobacterium bovis subsp bovis AF2122/97
acuggcgguccgaugcgcgc

SEQ ID NO: 1203141 - RNA, 20 nt, Mycobacterium bovis subsp bovis AF2122/97
acuggcgccggugccgccgg

SEQ ID NO: 1203142 - RNA, 21 nt, Mycobacterium bovis subsp bovis AF2122/97
acuggcccggacaugcgggca

SEQ ID NO: 1203143 - RNA, 19 nt, Mycobacterium bovis subsp bovis AF2122/97
acuggccguuucggcgccg

SEQ ID NO: 1203144 - RNA, 21 nt, Mycobacterium bovis subsp bovis AF2122/97
acugcugcggcagcgcggcca

SEQ ID NO: 1203145 - RNA, 20 nt, Mycobacterium bovis subsp bovis AF2122/97
acugcuccuugggucgguca

SEQ ID NO: 1203146 - RNA, 18 nt, Mycobacterium bovis subsp bovis AF2122/97
acugcugaaucacaccau

SEQ ID NO: 1203147 - RNA, 14 nt, Mycobacterium bovis subsp bovis AF2122/97
acugcggcauggca

SEQ ID NO: 1203148 - RNA, 19 nt, Mycobacterium bovis subsp bovis AF2122/97
acugcggcccgacccggcc

SEQ ID NO: 1203149 - RNA, 18 nt, Mycobacterium bovis subsp bovis AF2122/97
acugcguaguugauggcc

SEQ ID NO: 1203150 - RNA, 17 nt, Mycobacterium bovis subsp bovis AF2122/97
acuggacaagcuccucg

SEQ ID NO: 1203151 - RNA, 20 nt, Mycobacterium bovis subsp bovis AF2122/97
acuggaauggaucucggcgu

SEQ ID NO: 1203152 - RNA, 11 nt, Mycobacterium bovis subsp bovis AF2122/97
acuggaaagca

SEQ ID NO: 1203153 - RNA, 17 nt, Mycobacterium bovis subsp bovis AF2122/97
acuggaaagcagcagcg

SEQ ID NO: 1203154 - RNA, 16 nt, Mycobacterium bovis subsp bovis AF2122/97
acugcuuccggaacaa

SEQ ID NO: 1203155 - RNA, 18 nt, Mycobacterium bovis subsp bovis AF2122/97
acugcugcuugagcucgc

SEQ ID NO: 1203156 - RNA, 20 nt, Mycobacterium bovis subsp bovis AF2122/97
acuguuaggcgauugcgccg

SEQ ID NO: 1203157 - RNA, 13 nt, Mycobacterium bovis subsp bovis AF2122/97
acuguucccacag

SEQ ID NO: 1203158 - RNA, 17 nt, Mycobacterium bovis subsp bovis AF2122/97
acugucuugggggccaa

SEQ ID NO: 1203159 - RNA, 23 nt, Mycobacterium bovis subsp bovis AF2122/97
acugucggguaaccccaccugga

SEQ ID NO: 1203160 - RNA, 13 nt, Mycobacterium bovis subsp bovis AF2122/97
acugguuggugac

SEQ ID NO: 1203161 - RNA, 19 nt, Mycobacterium bovis subsp bovis AF2122/97
acuuagcgggugccagccc

SEQ ID NO: 1203162 - RNA, 16 nt, Mycobacterium bovis subsp bovis AF2122/97
acuucagcauggugga

SEQ ID NO: 1203163 - RNA, 14 nt, Mycobacterium bovis subsp bovis AF2122/97
acuucccacccggc

SEQ ID NO: 1203164 - RNA, 15 nt, Mycobacterium bovis subsp bovis AF2122/97
acuucccacccggcc

SEQ ID NO: 1203165 - RNA, 19 nt, Mycobacterium bovis subsp bovis AF2122/97
acuuccgggcagcugggca

SEQ ID NO: 1203166 - RNA, 19 nt, Mycobacterium bovis subsp bovis AF2122/97
acuuccgcagcgccacccg

SEQ ID NO: 1203167 - RNA, 13 nt, Mycobacterium bovis subsp bovis AF2122/97
acuucaccggcuc

SEQ ID NO: 1203168 - RNA, 11 nt, Mycobacterium bovis subsp bovis AF2122/97
acuucaccacc

SEQ ID NO: 1203169 - RNA, 13 nt, Mycobacterium bovis subsp bovis AF2122/97
agagauugcugug

SEQ ID NO: 1203170 - RNA, 23 nt, Mycobacterium bovis subsp bovis AF2122/97
agaguaucgaauccgucccaggu

SEQ ID NO: 1203171 - RNA, 18 nt, Mycobacterium bovis subsp bovis AF2122/97
agaguccuuaaacgucgu

SEQ ID NO: 1203172 - RNA, 15 nt, Mycobacterium bovis subsp bovis AF2122/97
agagguagagcagau

SEQ ID NO: 1203173 - RNA, 13 nt, Mycobacterium bovis subsp bovis AF2122/97
agagccugcucgc

SEQ ID NO: 1203174 - RNA, 20 nt, Mycobacterium bovis subsp bovis AF2122/97
agagcugguccuccaaggcg

SEQ ID NO: 1203175 - RNA, 20 nt, Mycobacterium bovis subsp bovis AF2122/97
agagggcggggcagaagucg

SEQ ID NO: 1203176 - RNA, 14 nt, Mycobacterium bovis subsp bovis AF2122/97
agauaccaccgccg

SEQ ID NO: 1203177 - RNA, 11 nt, Mycobacterium bovis subsp bovis AF2122/97
agagugaaucc

SEQ ID NO: 1203178 - RNA, 14 nt, Mycobacterium bovis subsp bovis AF2122/97
agauacggccacca

SEQ ID NO: 1203179 - RNA, 18 nt, Mycobacterium bovis subsp bovis AF2122/97
agauacgcguguggcaga

SEQ ID NO: 1203180 - RNA, 21 nt, Mycobacterium bovis subsp bovis AF2122/97
agauagacguuguugaaggcu

SEQ ID NO: 1203181 - RNA, 12 nt, Mycobacterium bovis subsp bovis AF2122/97
agauaugcagga

SEQ ID NO: 1203182 - RNA, 19 nt, Mycobacterium bovis subsp bovis AF2122/97
agaucagcgccugguccuc

SEQ ID NO: 1203183 - RNA, 22 nt, Mycobacterium bovis subsp bovis AF2122/97
agaucagcaugguccacagccg

SEQ ID NO: 1203184 - RNA, 23 nt, Mycobacterium bovis subsp bovis AF2122/97
agaucagcaccgugacagcggca

SEQ ID NO: 1203185 - RNA, 17 nt, Mycobacterium bovis subsp bovis AF2122/97
agaucagcacccaagaa

SEQ ID NO: 1203186 - RNA, 21 nt, Mycobacterium bovis subsp bovis AF2122/97
agaucagcgucccggucgcca

SEQ ID NO: 1203187 - RNA, 15 nt, Mycobacterium bovis subsp bovis AF2122/97
agaucaccgccacca

SEQ ID NO: 1203188 - RNA, 13 nt, Mycobacterium bovis subsp bovis AF2122/97
agaucaccgccag

SEQ ID NO: 1203189 - RNA, 19 nt, Mycobacterium bovis subsp bovis AF2122/97
agaucaacgcgucgcccgc

SEQ ID NO: 1203190 - RNA, 23 nt, Mycobacterium bovis subsp bovis AF2122/97
agaugacgguggugacgucgagg

SEQ ID NO: 1203191 - RNA, 21 nt, Mycobacterium bovis subsp bovis AF2122/97
agaugccgcgaucgugcaggu

SEQ ID NO: 1203192 - RNA, 12 nt, Mycobacterium bovis subsp bovis AF2122/97
agaugccgggcu

SEQ ID NO: 1203193 - RNA, 21 nt, Mycobacterium bovis subsp bovis AF2122/97
agaugcacgucgagcaggcug

SEQ ID NO: 1203194 - RNA, 18 nt, Mycobacterium bovis subsp bovis AF2122/97
agaugccugcuagcagca

SEQ ID NO: 1203195 - RNA, 19 nt, Mycobacterium bovis subsp bovis AF2122/97
agaugccugcuagcagcag

SEQ ID NO: 1203196 - RNA, 16 nt, Mycobacterium bovis subsp bovis AF2122/97
agaugcccagcaggaa

SEQ ID NO: 1203197 - RNA, 17 nt, Mycobacterium bovis subsp bovis AF2122/97
agaucuugugccaggcg

SEQ ID NO: 1203198 - RNA, 13 nt, Mycobacterium bovis subsp bovis AF2122/97
agaucuugcagug

SEQ ID NO: 1203199 - RNA, 20 nt, Mycobacterium bovis subsp bovis AF2122/97
agaucuugcagugcgccagc

SEQ ID NO: 1203200 - RNA, 14 nt, Mycobacterium bovis subsp bovis AF2122/97
agaucuggguuccc

SEQ ID NO: 1203201 - RNA, 19 nt, Mycobacterium bovis subsp bovis AF2122/97
agaucucgcgggcccgcgc

SEQ ID NO: 1203202 - RNA, 22 nt, Mycobacterium bovis subsp bovis AF2122/97
agaucgcacaccaacaccgcgg

SEQ ID NO: 1203203 - RNA, 15 nt, Mycobacterium bovis subsp bovis AF2122/97
agaucgccugggggu

SEQ ID NO: 1203204 - RNA, 19 nt, Mycobacterium bovis subsp bovis AF2122/97
agaucgccucgacgcggca

SEQ ID NO: 1203205 - RNA, 18 nt, Mycobacterium bovis subsp bovis AF2122/97
agaucgcuaggaccgcgg

SEQ ID NO: 1203206 - RNA, 13 nt, Mycobacterium bovis subsp bovis AF2122/97
agaucgcgcccug

SEQ ID NO: 1203207 - RNA, 17 nt, Mycobacterium bovis subsp bovis AF2122/97
agaucgcgcccugcgga

SEQ ID NO: 1203208 - RNA, 16 nt, Mycobacterium bovis subsp bovis AF2122/97
agaucgagggggacgc

SEQ ID NO: 1203209 - RNA, 14 nt, Mycobacterium bovis subsp bovis AF2122/97
agaucggugccagc

SEQ ID NO: 1203210 - RNA, 14 nt, Mycobacterium bovis subsp bovis AF2122/97
agaucgucgccaug

SEQ ID NO: 1203211 - RNA, 14 nt, Mycobacterium bovis subsp bovis AF2122/97
agaucggcgccccu

SEQ ID NO: 1203212 - RNA, 21 nt, Mycobacterium bovis subsp bovis AF2122/97
agaucguugccucgucgccgc

SEQ ID NO: 1203213 - RNA, 23 nt, Mycobacterium bovis subsp bovis AF2122/97
agauccauuggaugccauaggac

SEQ ID NO: 1203214 - RNA, 12 nt, Mycobacterium bovis subsp bovis AF2122/97
agauccaggugu

SEQ ID NO: 1203215 - RNA, 15 nt, Mycobacterium bovis subsp bovis AF2122/97
agaucccggucccaa

SEQ ID NO: 1203216 - RNA, 20 nt, Mycobacterium bovis subsp bovis AF2122/97
agauccgccacgcucaaccc

SEQ ID NO: 1203217 - RNA, 13 nt, Mycobacterium bovis subsp bovis AF2122/97
agauccgccgggu

SEQ ID NO: 1203218 - RNA, 22 nt, Mycobacterium bovis subsp bovis AF2122/97
agauccggccaacggcacccug

SEQ ID NO: 1203219 - RNA, 20 nt, Mycobacterium bovis subsp bovis AF2122/97
agauccucgucgagguccuc

SEQ ID NO: 1203220 - RNA, 23 nt, Mycobacterium bovis subsp bovis AF2122/97
agauccguccgcugguggucagc

SEQ ID NO: 1203221 - RNA, 13 nt, Mycobacterium bovis subsp bovis AF2122/97
agauugcugacga

SEQ ID NO: 1203222 - RNA, 15 nt, Mycobacterium bovis subsp bovis AF2122/97
agauucggugccagc

SEQ ID NO: 1203223 - RNA, 18 nt, Mycobacterium bovis subsp bovis AF2122/97
agauggcgcgcugggcug

SEQ ID NO: 1203224 - RNA, 13 nt, Mycobacterium bovis subsp bovis AF2122/97
agauggcgaucau

SEQ ID NO: 1203225 - RNA, 19 nt, Mycobacterium bovis subsp bovis AF2122/97
agauggcauugcgcccacc

SEQ ID NO: 1203226 - RNA, 15 nt, Mycobacterium bovis subsp bovis AF2122/97
agauggucgggcggc

SEQ ID NO: 1203227 - RNA, 20 nt, Mycobacterium bovis subsp bovis AF2122/97
agauggguacccgaucacuc

SEQ ID NO: 1203228 - RNA, 18 nt, Mycobacterium bovis subsp bovis AF2122/97
agaugguggucaccacca

SEQ ID NO: 1203229 - RNA, 19 nt, Mycobacterium bovis subsp bovis AF2122/97
agauggugguggcccggcu

SEQ ID NO: 1203230 - RNA, 23 nt, Mycobacterium bovis subsp bovis AF2122/97
agaagucaaggugucaacgcgcg

SEQ ID NO: 1203231 - RNA, 15 nt, Mycobacterium bovis subsp bovis AF2122/97
agaagaacucggcgu

SEQ ID NO: 1203232 - RNA, 23 nt, Mycobacterium bovis subsp bovis AF2122/97
agaagcaugauuggcucggggug

SEQ ID NO: 1203233 - RNA, 21 nt, Mycobacterium bovis subsp bovis AF2122/97
agaagcagggauucuggaugc

SEQ ID NO: 1203234 - RNA, 22 nt, Mycobacterium bovis subsp bovis AF2122/97
agaauggccgccuugaggcccu

SEQ ID NO: 1203235 - RNA, 20 nt, Mycobacterium bovis subsp bovis AF2122/97
agaauggacugaacaccaaa

SEQ ID NO: 1203236 - RNA, 20 nt, Mycobacterium bovis subsp bovis AF2122/97
agaaugcugacggugcagga

SEQ ID NO: 1203237 - RNA, 13 nt, Mycobacterium bovis subsp bovis AF2122/97
agaaucugccucu

SEQ ID NO: 1203238 - RNA, 16 nt, Mycobacterium bovis subsp bovis AF2122/97
agaaucucgccgggcu

SEQ ID NO: 1203239 - RNA, 22 nt, Mycobacterium bovis subsp bovis AF2122/97
agaaucccgggcucugcugcca

SEQ ID NO: 1203240 - RNA, 16 nt, Mycobacterium bovis subsp bovis AF2122/97
agacgaccgugcuggg

SEQ ID NO: 1203241 - RNA, 15 nt, Mycobacterium bovis subsp bovis AF2122/97
agaccucaacccccu

SEQ ID NO: 1203242 - RNA, 23 nt, Mycobacterium bovis subsp bovis AF2122/97
agaccucgaccuggaugggcucg

SEQ ID NO: 1203243 - RNA, 20 nt, Mycobacterium bovis subsp bovis AF2122/97
agacccagcgcggcaacucc

SEQ ID NO: 1203244 - RNA, 13 nt, Mycobacterium bovis subsp bovis AF2122/97
agacccaccaccg

SEQ ID NO: 1203245 - RNA, 22 nt, Mycobacterium bovis subsp bovis AF2122/97
agaccguuacaccaucaaggac

SEQ ID NO: 1203246 - RNA, 16 nt, Mycobacterium bovis subsp bovis AF2122/97
agaccauggucauguu

SEQ ID NO: 1203247 - RNA, 17 nt, Mycobacterium bovis subsp bovis AF2122/97
agaccauggucauguuc

SEQ ID NO: 1203248 - RNA, 16 nt, Mycobacterium bovis subsp bovis AF2122/97
agaccaggcccagguc

SEQ ID NO: 1203249 - RNA, 20 nt, Mycobacterium bovis subsp bovis AF2122/97
agacgcaaaauccccucgca

SEQ ID NO: 1203250 - RNA, 16 nt, Mycobacterium bovis subsp bovis AF2122/97
agacgaugacagacau

SEQ ID NO: 1203251 - RNA, 11 nt, Mycobacterium bovis subsp bovis AF2122/97
agacgagccac

SEQ ID NO: 1203252 - RNA, 21 nt, Mycobacterium bovis subsp bovis AF2122/97
agacggcucagcgugcgcugg

SEQ ID NO: 1203253 - RNA, 13 nt, Mycobacterium bovis subsp bovis AF2122/97
agacggcugccac

SEQ ID NO: 1203254 - RNA, 23 nt, Mycobacterium bovis subsp bovis AF2122/97
agacguuccaucacggaccaggc

SEQ ID NO: 1203255 - RNA, 15 nt, Mycobacterium bovis subsp bovis AF2122/97
agacgugccaaugau

SEQ ID NO: 1203256 - RNA, 12 nt, Mycobacterium bovis subsp bovis AF2122/97
agacaucagugc

SEQ ID NO: 1203257 - RNA, 20 nt, Mycobacterium bovis subsp bovis AF2122/97
agacagacaggauugccgag

SEQ ID NO: 1203258 - RNA, 22 nt, Mycobacterium bovis subsp bovis AF2122/97
agacacgcccuaacccugcccu

SEQ ID NO: 1203259 - RNA, 18 nt, Mycobacterium bovis subsp bovis AF2122/97
agacacggcagcugcaau

SEQ ID NO: 1203260 - RNA, 18 nt, Mycobacterium bovis subsp bovis AF2122/97
agacacuaaagcccucga

SEQ ID NO: 1203261 - RNA, 15 nt, Mycobacterium bovis subsp bovis AF2122/97
agaacccacgcaugc

SEQ ID NO: 1203262 - RNA, 16 nt, Mycobacterium bovis subsp bovis AF2122/97
agaacaccggccaggc

SEQ ID NO: 1203263 - RNA, 14 nt, Mycobacterium bovis subsp bovis AF2122/97
agaacaacaucgcc

SEQ ID NO: 1203264 - RNA, 14 nt, Mycobacterium bovis subsp bovis AF2122/97
agaacaacggcgcg

SEQ ID NO: 1203265 - RNA, 20 nt, Mycobacterium bovis subsp bovis AF2122/97
agaacaacgggauccgcgcg

SEQ ID NO: 1203266 - RNA, 13 nt, Mycobacterium bovis subsp bovis AF2122/97
agaacgugcuggu

SEQ ID NO: 1203267 - RNA, 20 nt, Mycobacterium bovis subsp bovis AF2122/97
agaacgucgagacuucggug

SEQ ID NO: 1203268 - RNA, 20 nt, Mycobacterium bovis subsp bovis AF2122/97
agaacguuuucgucacccca

SEQ ID NO: 1203269 - RNA, 22 nt, Mycobacterium bovis subsp bovis AF2122/97
agaacucggcgucgugguggcc

SEQ ID NO: 1203270 - RNA, 19 nt, Mycobacterium bovis subsp bovis AF2122/97
agaacucguugagcagcug

SEQ ID NO: 1203271 - RNA, 13 nt, Mycobacterium bovis subsp bovis AF2122/97
agaacuggcugcu

SEQ ID NO: 1203272 - RNA, 16 nt, Mycobacterium bovis subsp bovis AF2122/97
agaacuggcugcuguu

SEQ ID NO: 1203273 - RNA, 19 nt, Mycobacterium bovis subsp bovis AF2122/97
agaaccggucgcagugcac

SEQ ID NO: 1203274 - RNA, 17 nt, Mycobacterium bovis subsp bovis AF2122/97
agaacgauguccgcgcg

SEQ ID NO: 1203275 - RNA, 20 nt, Mycobacterium bovis subsp bovis AF2122/97
agaacgcggccucgucgagu

SEQ ID NO: 1203276 - RNA, 18 nt, Mycobacterium bovis subsp bovis AF2122/97
agaacgcccgcugcagac

SEQ ID NO: 1203277 - RNA, 15 nt, Mycobacterium bovis subsp bovis AF2122/97
agaacgacgccaccg

SEQ ID NO: 1203278 - RNA, 18 nt, Mycobacterium bovis subsp bovis AF2122/97
acuucgaaucaggcucca

SEQ ID NO: 1203279 - RNA, 23 nt, Mycobacterium bovis subsp bovis AF2122/97
acuucgcguuucacgaaacccag

SEQ ID NO: 1203280 - RNA, 21 nt, Mycobacterium bovis subsp bovis AF2122/97
acuucgcuggaaaccucuucg

SEQ ID NO: 1203281 - RNA, 18 nt, Mycobacterium bovis subsp bovis AF2122/97
agaaagcccaggggagcu

SEQ ID NO: 1203282 - RNA, 22 nt, Mycobacterium bovis subsp bovis AF2122/97
agaaacgcgaugguggccgcca

SEQ ID NO: 1203283 - RNA, 16 nt, Mycobacterium bovis subsp bovis AF2122/97
agaaacccggcgacca

SEQ ID NO: 1203284 - RNA, 14 nt, Mycobacterium bovis subsp bovis AF2122/97
agaaacccugcugc

SEQ ID NO: 1203285 - RNA, 21 nt, Mycobacterium bovis subsp bovis AF2122/97
accgccggcggcggccgcagc

SEQ ID NO: 1203286 - RNA, 14 nt, Mycobacterium bovis subsp bovis AF2122/97
accgcccagugcca

SEQ ID NO: 1203287 - RNA, 20 nt, Mycobacterium bovis subsp bovis AF2122/97
accgcccagugccagaaccc

SEQ ID NO: 1203288 - RNA, 17 nt, Mycobacterium bovis subsp bovis AF2122/97
accgcccaguugggccu

SEQ ID NO: 1203289 - RNA, 20 nt, Mycobacterium bovis subsp bovis AF2122/97
accgccaucgccaacaccaa

SEQ ID NO: 1203290 - RNA, 20 nt, Mycobacterium bovis subsp bovis AF2122/97
accgccguugccaagcagcu

SEQ ID NO: 1203291 - RNA, 16 nt, Mycobacterium bovis subsp bovis AF2122/97
accgccgucccggcuc

SEQ ID NO: 1203292 - RNA, 14 nt, Mycobacterium bovis subsp bovis AF2122/97
accgccgucgccac

SEQ ID NO: 1203293 - RNA, 16 nt, Mycobacterium bovis subsp bovis AF2122/97
accgccguuugcgccg

SEQ ID NO: 1203294 - RNA, 21 nt, Mycobacterium bovis subsp bovis AF2122/97
accgccuccaccgccgcgcgg

SEQ ID NO: 1203295 - RNA, 17 nt, Mycobacterium bovis subsp bovis AF2122/97
accgccuuugccgccgg

SEQ ID NO: 1203296 - RNA, 24 nt, Mycobacterium bovis subsp bovis AF2122/97
accgcgaccaucgcgacggcaagc

SEQ ID NO: 1203297 - RNA, 17 nt, Mycobacterium bovis subsp bovis AF2122/97
accgcgccgaucaccac

SEQ ID NO: 1203298 - RNA, 20 nt, Mycobacterium bovis subsp bovis AF2122/97
accgcgccgaucaccaccgg

SEQ ID NO: 1203299 - RNA, 21 nt, Mycobacterium bovis subsp bovis AF2122/97
accgcgccgcgccgcgccgcc

SEQ ID NO: 1203300 - RNA, 23 nt, Mycobacterium bovis subsp bovis AF2122/97
accgccgucggguugcgacgaac

SEQ ID NO: 1203301 - RNA, 13 nt, Mycobacterium bovis subsp bovis AF2122/97
accgccugcgccu

SEQ ID NO: 1203302 - RNA, 13 nt, Mycobacterium bovis subsp bovis AF2122/97
accgccugcgccg

SEQ ID NO: 1203303 - RNA, 18 nt, Mycobacterium bovis subsp bovis AF2122/97
accgccugcgccgcccgc

SEQ ID NO: 1203304 - RNA, 13 nt, Mycobacterium bovis subsp bovis AF2122/97
accgcuggaucgc

SEQ ID NO: 1203305 - RNA, 14 nt, Mycobacterium bovis subsp bovis AF2122/97
accgcugccugccg

SEQ ID NO: 1203306 - RNA, 17 nt, Mycobacterium bovis subsp bovis AF2122/97
accgcugcuccucgcgg

SEQ ID NO: 1203307 - RNA, 14 nt, Mycobacterium bovis subsp bovis AF2122/97
accgcugucagccg

SEQ ID NO: 1203308 - RNA, 16 nt, Mycobacterium bovis subsp bovis AF2122/97
accgcugggacaacgu

SEQ ID NO: 1203309 - RNA, 18 nt, Mycobacterium bovis subsp bovis AF2122/97
accgcugaccgcaacgcg

SEQ ID NO: 1203310 - RNA, 18 nt, Mycobacterium bovis subsp bovis AF2122/97
accgcugccgcugccgaa

SEQ ID NO: 1203311 - RNA, 24 nt, Mycobacterium bovis subsp bovis AF2122/97
accgcucgucguccggccacgguc

SEQ ID NO: 1203312 - RNA, 17 nt, Mycobacterium bovis subsp bovis AF2122/97
accgcggaaggccagcu

SEQ ID NO: 1203313 - RNA, 19 nt, Mycobacterium bovis subsp bovis AF2122/97
accgcggaaggccagcucu

SEQ ID NO: 1203314 - RNA, 17 nt, Mycobacterium bovis subsp bovis AF2122/97
accgcggccaugacacg

SEQ ID NO: 1203315 - RNA, 17 nt, Mycobacterium bovis subsp bovis AF2122/97
accgcggacccgcagcu

SEQ ID NO: 1203316 - RNA, 16 nt, Mycobacterium bovis subsp bovis AF2122/97
accgcggauaggccgc

SEQ ID NO: 1203317 - RNA, 20 nt, Mycobacterium bovis subsp bovis AF2122/97
accgcucggaguugagcugu

SEQ ID NO: 1203318 - RNA, 16 nt, Mycobacterium bovis subsp bovis AF2122/97
accgcucgucgccggu

SEQ ID NO: 1203319 - RNA, 14 nt, Mycobacterium bovis subsp bovis AF2122/97
accgcgccguggac

SEQ ID NO: 1203320 - RNA, 20 nt, Mycobacterium bovis subsp bovis AF2122/97
accgcgccgucgucgagcac

SEQ ID NO: 1203321 - RNA, 14 nt, Mycobacterium bovis subsp bovis AF2122/97
accgcgacccggcc

SEQ ID NO: 1203322 - RNA, 17 nt, Mycobacterium bovis subsp bovis AF2122/97
accgcgcggaucucacc

SEQ ID NO: 1203323 - RNA, 23 nt, Mycobacterium bovis subsp bovis AF2122/97
accgcgcugguugaacaugucca

SEQ ID NO: 1203324 - RNA, 14 nt, Mycobacterium bovis subsp bovis AF2122/97
accgauuccagcgg

SEQ ID NO: 1203325 - RNA, 13 nt, Mycobacterium bovis subsp bovis AF2122/97
accgcaccugggc

SEQ ID NO: 1203326 - RNA, 16 nt, Mycobacterium bovis subsp bovis AF2122/97
accgcaucgucgagcc

SEQ ID NO: 1203327 - RNA, 14 nt, Mycobacterium bovis subsp bovis AF2122/97
accgcaucggcagc

SEQ ID NO: 1203328 - RNA, 19 nt, Mycobacterium bovis subsp bovis AF2122/97
accgccaccacccaggcca

SEQ ID NO: 1203329 - RNA, 17 nt, Mycobacterium bovis subsp bovis AF2122/97
accgccaucgccaacac

SEQ ID NO: 1203330 - RNA, 16 nt, Mycobacterium bovis subsp bovis AF2122/97
accgccaaccuacccu

SEQ ID NO: 1203331 - RNA, 18 nt, Mycobacterium bovis subsp bovis AF2122/97
accgccaacauuggugag

SEQ ID NO: 1203332 - RNA, 12 nt, Mycobacterium bovis subsp bovis AF2122/97
accccgccgagc

SEQ ID NO: 1203333 - RNA, 22 nt, Mycobacterium bovis subsp bovis AF2122/97
accccgccgagcgguugccuuc

SEQ ID NO: 1203334 - RNA, 19 nt, Mycobacterium bovis subsp bovis AF2122/97
accccgagcggagccgccg

SEQ ID NO: 1203335 - RNA, 19 nt, Mycobacterium bovis subsp bovis AF2122/97
accccgaggcaacaagcac

SEQ ID NO: 1203336 - RNA, 13 nt, Mycobacterium bovis subsp bovis AF2122/97
accccgccagccg

SEQ ID NO: 1203337 - RNA, 22 nt, Mycobacterium bovis subsp bovis AF2122/97
accccucacccagcuggguccc

SEQ ID NO: 1203338 - RNA, 19 nt, Mycobacterium bovis subsp bovis AF2122/97
accccuagaugccgguauc

SEQ ID NO: 1203339 - RNA, 16 nt, Mycobacterium bovis subsp bovis AF2122/97
accgauggcgcaccgg

SEQ ID NO: 1203340 - RNA, 19 nt, Mycobacterium bovis subsp bovis AF2122/97
accgauggcucacaugccc

SEQ ID NO: 1203341 - RNA, 23 nt, Mycobacterium bovis subsp bovis AF2122/97
accgaugguggugccaaccuggg

SEQ ID NO: 1203342 - RNA, 14 nt, Mycobacterium bovis subsp bovis AF2122/97
accgaugcugacga

SEQ ID NO: 1203343 - RNA, 12 nt, Mycobacterium bovis subsp bovis AF2122/97
accgaucggcag

SEQ ID NO: 1203344 - RNA, 18 nt, Mycobacterium bovis subsp bovis AF2122/97
accgaugaaccaggcggc

SEQ ID NO: 1203345 - RNA, 16 nt, Mycobacterium bovis subsp bovis AF2122/97
accgaucgaacagugc

SEQ ID NO: 1203346 - RNA, 21 nt, Mycobacterium bovis subsp bovis AF2122/97
accccuucgccagcgccacug

SEQ ID NO: 1203347 - RNA, 19 nt, Mycobacterium bovis subsp bovis AF2122/97
accccugguagcacccacg

SEQ ID NO: 1203348 - RNA, 14 nt, Mycobacterium bovis subsp bovis AF2122/97
accggcagcugcuc

SEQ ID NO: 1203349 - RNA, 15 nt, Mycobacterium bovis subsp bovis AF2122/97
accggcaugccgcca

SEQ ID NO: 1203350 - RNA, 21 nt, Mycobacterium bovis subsp bovis AF2122/97
accggcaugcgugccggcagc

SEQ ID NO: 1203351 - RNA, 17 nt, Mycobacterium bovis subsp bovis AF2122/97
accggccaccagcccga

SEQ ID NO: 1203352 - RNA, 20 nt, Mycobacterium bovis subsp bovis AF2122/97
accggccaucgaccguccgg

SEQ ID NO: 1203353 - RNA, 18 nt, Mycobacterium bovis subsp bovis AF2122/97
accggccagcggcccguc

SEQ ID NO: 1203354 - RNA, 13 nt, Mycobacterium bovis subsp bovis AF2122/97
accggccaguggg

SEQ ID NO: 1203355 - RNA, 18 nt, Mycobacterium bovis subsp bovis AF2122/97
accggccaacgccgccgc

SEQ ID NO: 1203356 - RNA, 21 nt, Mycobacterium bovis subsp bovis AF2122/97
accggccaacagucgcagcac

SEQ ID NO: 1203357 - RNA, 11 nt, Mycobacterium bovis subsp bovis AF2122/97
accggcacccg

SEQ ID NO: 1203358 - RNA, 18 nt, Mycobacterium bovis subsp bovis AF2122/97
accggcaccgccugcgcc

SEQ ID NO: 1203359 - RNA, 13 nt, Mycobacterium bovis subsp bovis AF2122/97
accggcacccccg

SEQ ID NO: 1203360 - RNA, 15 nt, Mycobacterium bovis subsp bovis AF2122/97
accggcaccagcggc

SEQ ID NO: 1203361 - RNA, 21 nt, Mycobacterium bovis subsp bovis AF2122/97
accggcaagccacgccggucg

SEQ ID NO: 1203362 - RNA, 14 nt, Mycobacterium bovis subsp bovis AF2122/97
accgcuucaggcgc

SEQ ID NO: 1203363 - RNA, 21 nt, Mycobacterium bovis subsp bovis AF2122/97
accgcuucaggcgccacugcu

SEQ ID NO: 1203364 - RNA, 21 nt, Mycobacterium bovis subsp bovis AF2122/97
accgcuuccagguugaagaau

SEQ ID NO: 1203365 - RNA, 16 nt, Mycobacterium bovis subsp bovis AF2122/97
accgcuucccccgguc

SEQ ID NO: 1203366 - RNA, 14 nt, Mycobacterium bovis subsp bovis AF2122/97
accggcgccgccgg

SEQ ID NO: 1203367 - RNA, 16 nt, Mycobacterium bovis subsp bovis AF2122/97
accggcgccgccgucg

SEQ ID NO: 1203368 - RNA, 12 nt, Mycobacterium bovis subsp bovis AF2122/97
accggcgccgcg

SEQ ID NO: 1203369 - RNA, 15 nt, Mycobacterium bovis subsp bovis AF2122/97
accggcgccuccggc

SEQ ID NO: 1203370 - RNA, 22 nt, Mycobacterium bovis subsp bovis AF2122/97
accggccuuuccagcaccccga

SEQ ID NO: 1203371 - RNA, 17 nt, Mycobacterium bovis subsp bovis AF2122/97
accggcgacgccggccu

SEQ ID NO: 1203372 - RNA, 10 nt, Mycobacterium bovis subsp bovis AF2122/97
accggcgcca

SEQ ID NO: 1203373 - RNA, 14 nt, Mycobacterium bovis subsp bovis AF2122/97
accggccggugcca

SEQ ID NO: 1203374 - RNA, 17 nt, Mycobacterium bovis subsp bovis AF2122/97
accggccgugccgccga

SEQ ID NO: 1203375 - RNA, 17 nt, Mycobacterium bovis subsp bovis AF2122/97
accggccgcuauggccc

SEQ ID NO: 1203376 - RNA, 21 nt, Mycobacterium bovis subsp bovis AF2122/97
accggccgcuauggcccgggc

SEQ ID NO: 1203377 - RNA, 17 nt, Mycobacterium bovis subsp bovis AF2122/97
accggcccagugggacu

SEQ ID NO: 1203378 - RNA, 17 nt, Mycobacterium bovis subsp bovis AF2122/97
accggccccaccggcac

SEQ ID NO: 1203379 - RNA, 19 nt, Mycobacterium bovis subsp bovis AF2122/97
accggcucguagcuggugc

SEQ ID NO: 1203380 - RNA, 18 nt, Mycobacterium bovis subsp bovis AF2122/97
accggcugaccgacccgg

SEQ ID NO: 1203381 - RNA, 22 nt, Mycobacterium bovis subsp bovis AF2122/97
accggcugaccggggcgcccgg

SEQ ID NO: 1203382 - RNA, 18 nt, Mycobacterium bovis subsp bovis AF2122/97
accggcugauucgagcca

SEQ ID NO: 1203383 - RNA, 22 nt, Mycobacterium bovis subsp bovis AF2122/97
accggcugauucgagccacaug

SEQ ID NO: 1203384 - RNA, 18 nt, Mycobacterium bovis subsp bovis AF2122/97
accggcugcaaccagcgg

SEQ ID NO: 1203385 - RNA, 13 nt, Mycobacterium bovis subsp bovis AF2122/97
accggcugcaggu

SEQ ID NO: 1203386 - RNA, 20 nt, Mycobacterium bovis subsp bovis AF2122/97
accggcgucugcccgcccag

SEQ ID NO: 1203387 - RNA, 16 nt, Mycobacterium bovis subsp bovis AF2122/97
accggcgugcugugcu

SEQ ID NO: 1203388 - RNA, 16 nt, Mycobacterium bovis subsp bovis AF2122/97
accggcuaugcuggcg

SEQ ID NO: 1203389 - RNA, 24 nt, Mycobacterium bovis subsp bovis AF2122/97
accggcuaugcuggcgcagcgcca

SEQ ID NO: 1203390 - RNA, 22 nt, Mycobacterium bovis subsp bovis AF2122/97
accggcucaaggacgcaccgcc

SEQ ID NO: 1203391 - RNA, 21 nt, Mycobacterium bovis subsp bovis AF2122/97
accggcucaccacgccggucg

SEQ ID NO: 1203392 - RNA, 20 nt, Mycobacterium bovis subsp bovis AF2122/97
accggcucacguaaccagug

SEQ ID NO: 1203393 - RNA, 16 nt, Mycobacterium bovis subsp bovis AF2122/97
accggcuccagcaugg

SEQ ID NO: 1203394 - RNA, 21 nt, Mycobacterium bovis subsp bovis AF2122/97
accggcggcgccggaggcggc

SEQ ID NO: 1203395 - RNA, 23 nt, Mycobacterium bovis subsp bovis AF2122/97
accggcgccuccggcaccuccag

SEQ ID NO: 1203396 - RNA, 19 nt, Mycobacterium bovis subsp bovis AF2122/97
accggcgggaugcgcgccc

SEQ ID NO: 1203397 - RNA, 19 nt, Mycobacterium bovis subsp bovis AF2122/97
accggcggucugcagugca

SEQ ID NO: 1203398 - RNA, 16 nt, Mycobacterium bovis subsp bovis AF2122/97
accgggugggucguuc

SEQ ID NO: 1203399 - RNA, 12 nt, Mycobacterium bovis subsp bovis AF2122/97
accgggugcagg

SEQ ID NO: 1203400 - RNA, 16 nt, Mycobacterium bovis subsp bovis AF2122/97
accgggucagcccagc

SEQ ID NO: 1203401 - RNA, 22 nt, Mycobacterium bovis subsp bovis AF2122/97
accgguaacgccaacaccggca

SEQ ID NO: 1203402 - RNA, 13 nt, Mycobacterium bovis subsp bovis AF2122/97
accggggcggccg

SEQ ID NO: 1203403 - RNA, 17 nt, Mycobacterium bovis subsp bovis AF2122/97
accggggcuuggguuga

SEQ ID NO: 1203404 - RNA, 23 nt, Mycobacterium bovis subsp bovis AF2122/97
accgggcggcguuugagaacaac

SEQ ID NO: 1203405 - RNA, 18 nt, Mycobacterium bovis subsp bovis AF2122/97
accggcuggugccaacug

SEQ ID NO: 1203406 - RNA, 21 nt, Mycobacterium bovis subsp bovis AF2122/97
accggcuggugccaacugcgc

SEQ ID NO: 1203407 - RNA, 22 nt, Mycobacterium bovis subsp bovis AF2122/97
accggcuggugccaacugcgcc

SEQ ID NO: 1203408 - RNA, 22 nt, Mycobacterium bovis subsp bovis AF2122/97
accggcuggugccuuaccaccg

SEQ ID NO: 1203409 - RNA, 15 nt, Mycobacterium bovis subsp bovis AF2122/97
accggcugggcgcca

SEQ ID NO: 1203410 - RNA, 12 nt, Mycobacterium bovis subsp bovis AF2122/97
accggcuggcca

SEQ ID NO: 1203411 - RNA, 17 nt, Mycobacterium bovis subsp bovis AF2122/97
accggcuggccaggugg

SEQ ID NO: 1203412 - RNA, 15 nt, Mycobacterium bovis subsp bovis AF2122/97
accggcuuggcggga

SEQ ID NO: 1203413 - RNA, 12 nt, Mycobacterium bovis subsp bovis AF2122/97
accggcuugccg

SEQ ID NO: 1203414 - RNA, 19 nt, Mycobacterium bovis subsp bovis AF2122/97
accgggaaccacggucagc

SEQ ID NO: 1203415 - RNA, 22 nt, Mycobacterium bovis subsp bovis AF2122/97
accggcuuggugaaccgcgcgg

SEQ ID NO: 1203416 - RNA, 14 nt, Mycobacterium bovis subsp bovis AF2122/97
accgggcaccagaa

SEQ ID NO: 1203417 - RNA, 18 nt, Mycobacterium bovis subsp bovis AF2122/97
accgggacaccaaaagga

SEQ ID NO: 1203418 - RNA, 23 nt, Mycobacterium bovis subsp bovis AF2122/97
accgggccucaugcuaggccacc

SEQ ID NO: 1203419 - RNA, 22 nt, Mycobacterium bovis subsp bovis AF2122/97
accggucggccauugcccgggc

SEQ ID NO: 1203420 - RNA, 18 nt, Mycobacterium bovis subsp bovis AF2122/97
accggugauggugaccag

SEQ ID NO: 1203421 - RNA, 16 nt, Mycobacterium bovis subsp bovis AF2122/97
accgguauagccaagu

SEQ ID NO: 1203422 - RNA, 15 nt, Mycobacterium bovis subsp bovis AF2122/97
accgguguagcagcg

SEQ ID NO: 1203423 - RNA, 14 nt, Mycobacterium bovis subsp bovis AF2122/97
accgguggcagccu

SEQ ID NO: 1203424 - RNA, 14 nt, Mycobacterium bovis subsp bovis AF2122/97
accggugccgcccg

SEQ ID NO: 1203425 - RNA, 23 nt, Mycobacterium bovis subsp bovis AF2122/97
accggugccgcccgcgccgccgc

SEQ ID NO: 1203426 - RNA, 22 nt, Mycobacterium bovis subsp bovis AF2122/97
accggugauggugaccagcagg

SEQ ID NO: 1203427 - RNA, 15 nt, Mycobacterium bovis subsp bovis AF2122/97
accggugcccaccac

SEQ ID NO: 1203428 - RNA, 14 nt, Mycobacterium bovis subsp bovis AF2122/97
accguacggccacg

SEQ ID NO: 1203429 - RNA, 20 nt, Mycobacterium bovis subsp bovis AF2122/97
accgucguacucggcggcca

SEQ ID NO: 1203430 - RNA, 22 nt, Mycobacterium bovis subsp bovis AF2122/97
accgucuccggcgccaccgccg

SEQ ID NO: 1203431 - RNA, 15 nt, Mycobacterium bovis subsp bovis AF2122/97
accgucuggccguug

SEQ ID NO: 1203432 - RNA, 16 nt, Mycobacterium bovis subsp bovis AF2122/97
accgucucgcaccgcg

SEQ ID NO: 1203433 - RNA, 22 nt, Mycobacterium bovis subsp bovis AF2122/97
accgugaccgagaagcccaccg

SEQ ID NO: 1203434 - RNA, 13 nt, Mycobacterium bovis subsp bovis AF2122/97
accgugaccgccg

SEQ ID NO: 1203435 - RNA, 21 nt, Mycobacterium bovis subsp bovis AF2122/97
accgugacagcggcauugcca

SEQ ID NO: 1203436 - RNA, 15 nt, Mycobacterium bovis subsp bovis AF2122/97
accgugaaccgcccg

SEQ ID NO: 1203437 - RNA, 16 nt, Mycobacterium bovis subsp bovis AF2122/97
accgugaaccgcccgc

SEQ ID NO: 1203438 - RNA, 23 nt, Mycobacterium bovis subsp bovis AF2122/97
accgucuggccguugcccgacuc

SEQ ID NO: 1203439 - RNA, 14 nt, Mycobacterium bovis subsp bovis AF2122/97
accgugccgcccgg

SEQ ID NO: 1203440 - RNA, 14 nt, Mycobacterium bovis subsp bovis AF2122/97
accgugcugggcau

SEQ ID NO: 1203441 - RNA, 13 nt, Mycobacterium bovis subsp bovis AF2122/97
accguggcagcug

SEQ ID NO: 1203442 - RNA, 19 nt, Mycobacterium bovis subsp bovis AF2122/97
accguggccucgaagggcu

SEQ ID NO: 1203443 - RNA, 15 nt, Mycobacterium bovis subsp bovis AF2122/97
accguggcgccgguc

SEQ ID NO: 1203444 - RNA, 15 nt, Mycobacterium bovis subsp bovis AF2122/97
accgugggccugccc

SEQ ID NO: 1203445 - RNA, 14 nt, Mycobacterium bovis subsp bovis AF2122/97
accguggcggccuc

SEQ ID NO: 1203446 - RNA, 15 nt, Mycobacterium bovis subsp bovis AF2122/97
accguggcggccucc

SEQ ID NO: 1203447 - RNA, 12 nt, Mycobacterium bovis subsp bovis AF2122/97
accgugucaccg

SEQ ID NO: 1203448 - RNA, 16 nt, Mycobacterium bovis subsp bovis AF2122/97
accgucagcgccgcug

SEQ ID NO: 1203449 - RNA, 23 nt, Mycobacterium bovis subsp bovis AF2122/97
accgucacgcguacgucggucca

SEQ ID NO: 1203450 - RNA, 19 nt, Mycobacterium bovis subsp bovis AF2122/97
accgucaccgagcccgauc

SEQ ID NO: 1203451 - RNA, 20 nt, Mycobacterium bovis subsp bovis AF2122/97
accgucagaccauccagguu

SEQ ID NO: 1203452 - RNA, 15 nt, Mycobacterium bovis subsp bovis AF2122/97
accguagcccugcuc

SEQ ID NO: 1203453 - RNA, 17 nt, Mycobacterium bovis subsp bovis AF2122/97
accgucaaccugcugca

SEQ ID NO: 1203454 - RNA, 14 nt, Mycobacterium bovis subsp bovis AF2122/97
accguauugaccag

SEQ ID NO: 1203455 - RNA, 16 nt, Mycobacterium bovis subsp bovis AF2122/97
accguucacccagcgg

SEQ ID NO: 1203456 - RNA, 19 nt, Mycobacterium bovis subsp bovis AF2122/97
accguucgaucagguucgu

SEQ ID NO: 1203457 - RNA, 16 nt, Mycobacterium bovis subsp bovis AF2122/97
accguguugcugucga

SEQ ID NO: 1203458 - RNA, 14 nt, Mycobacterium bovis subsp bovis AF2122/97
accuaacccgcacc

SEQ ID NO: 1203459 - RNA, 18 nt, Mycobacterium bovis subsp bovis AF2122/97
accuauccguucaauuuc

SEQ ID NO: 1203460 - RNA, 22 nt, Mycobacterium bovis subsp bovis AF2122/97
accuacgaagcguugaccgcgg

SEQ ID NO: 1203461 - RNA, 13 nt, Mycobacterium bovis subsp bovis AF2122/97
accuacccugcgc

SEQ ID NO: 1203462 - RNA, 21 nt, Mycobacterium bovis subsp bovis AF2122/97
accuaccgagaucaccgccac

SEQ ID NO: 1203463 - RNA, 16 nt, Mycobacterium bovis subsp bovis AF2122/97
accucggacugcagcg

SEQ ID NO: 1203464 - RNA, 19 nt, Mycobacterium bovis subsp bovis AF2122/97
accucgugguucugcaggu

SEQ ID NO: 1203465 - RNA, 16 nt, Mycobacterium bovis subsp bovis AF2122/97
accucguguccgggga

SEQ ID NO: 1203466 - RNA, 20 nt, Mycobacterium bovis subsp bovis AF2122/97
accucgucggcgacggccag

SEQ ID NO: 1203467 - RNA, 14 nt, Mycobacterium bovis subsp bovis AF2122/97
accucgucccacag

SEQ ID NO: 1203468 - RNA, 21 nt, Mycobacterium bovis subsp bovis AF2122/97
accucguauacccgggcgguc

SEQ ID NO: 1203469 - RNA, 14 nt, Mycobacterium bovis subsp bovis AF2122/97
accucgguggcugc

SEQ ID NO: 1203470 - RNA, 23 nt, Mycobacterium bovis subsp bovis AF2122/97
accucgucaaucaccaccgccag

SEQ ID NO: 1203471 - RNA, 11 nt, Mycobacterium bovis subsp bovis AF2122/97
accucuugccc

SEQ ID NO: 1203472 - RNA, 19 nt, Mycobacterium bovis subsp bovis AF2122/97
accucuucgggugcagcca

SEQ ID NO: 1203473 - RNA, 16 nt, Mycobacterium bovis subsp bovis AF2122/97
accucucugucgcguu

SEQ ID NO: 1203474 - RNA, 20 nt, Mycobacterium bovis subsp bovis AF2122/97
accucugcugagcugcucgc

SEQ ID NO: 1203475 - RNA, 22 nt, Mycobacterium bovis subsp bovis AF2122/97
accugacggaaguacuccaugg

SEQ ID NO: 1203476 - RNA, 15 nt, Mycobacterium bovis subsp bovis AF2122/97
accugacgcucgguc

SEQ ID NO: 1203477 - RNA, 13 nt, Mycobacterium bovis subsp bovis AF2122/97
accugaggcaccu

SEQ ID NO: 1203478 - RNA, 15 nt, Mycobacterium bovis subsp bovis AF2122/97
accugaagccagcgc

SEQ ID NO: 1203479 - RNA, 21 nt, Mycobacterium bovis subsp bovis AF2122/97
accucaucgcggucgccaccg

SEQ ID NO: 1203480 - RNA, 16 nt, Mycobacterium bovis subsp bovis AF2122/97
accucaugaucucacc

SEQ ID NO: 1203481 - RNA, 13 nt, Mycobacterium bovis subsp bovis AF2122/97
accuaugauucag

SEQ ID NO: 1203482 - RNA, 18 nt, Mycobacterium bovis subsp bovis AF2122/97
accucccacccccgguuc

SEQ ID NO: 1203483 - RNA, 17 nt, Mycobacterium bovis subsp bovis AF2122/97
accucccacgccgccgu

SEQ ID NO: 1203484 - RNA, 13 nt, Mycobacterium bovis subsp bovis AF2122/97
accucccgcagcc

SEQ ID NO: 1203485 - RNA, 18 nt, Mycobacterium bovis subsp bovis AF2122/97
accucccgcagccgggca

SEQ ID NO: 1203486 - RNA, 15 nt, Mycobacterium bovis subsp bovis AF2122/97
accuccggguccagg

SEQ ID NO: 1203487 - RNA, 19 nt, Mycobacterium bovis subsp bovis AF2122/97
accuccgcgacggcggcuc

SEQ ID NO: 1203488 - RNA, 18 nt, Mycobacterium bovis subsp bovis AF2122/97
accucgaaaccguggcca

SEQ ID NO: 1203489 - RNA, 19 nt, Mycobacterium bovis subsp bovis AF2122/97
accucgacgccccaggaca

SEQ ID NO: 1203490 - RNA, 20 nt, Mycobacterium bovis subsp bovis AF2122/97
accuccugcgagugcggcac

SEQ ID NO: 1203491 - RNA, 19 nt, Mycobacterium bovis subsp bovis AF2122/97
accuccugguugaccucgg

SEQ ID NO: 1203492 - RNA, 13 nt, Mycobacterium bovis subsp bovis AF2122/97
accucgccgcccu

SEQ ID NO: 1203493 - RNA, 20 nt, Mycobacterium bovis subsp bovis AF2122/97
accucgccggccgucagcac

SEQ ID NO: 1203494 - RNA, 17 nt, Mycobacterium bovis subsp bovis AF2122/97
accucgcccugcagacg

SEQ ID NO: 1203495 - RNA, 23 nt, Mycobacterium bovis subsp bovis AF2122/97
accucgccggccgucagcacaaa

SEQ ID NO: 1203496 - RNA, 21 nt, Mycobacterium bovis subsp bovis AF2122/97
accucgccaucgaccuugagc

SEQ ID NO: 1203497 - RNA, 13 nt, Mycobacterium bovis subsp bovis AF2122/97
accucgcccauga

SEQ ID NO: 1203498 - RNA, 22 nt, Mycobacterium bovis subsp bovis AF2122/97
accucgaccuggaugggcucga

SEQ ID NO: 1203499 - RNA, 20 nt, Mycobacterium bovis subsp bovis AF2122/97
accugggcgacaguaggguc

SEQ ID NO: 1203500 - RNA, 20 nt, Mycobacterium bovis subsp bovis AF2122/97
accugggcugccggccagac

SEQ ID NO: 1203501 - RNA, 21 nt, Mycobacterium bovis subsp bovis AF2122/97
accuggggccaccagaaccac

SEQ ID NO: 1203502 - RNA, 18 nt, Mycobacterium bovis subsp bovis AF2122/97
accugggccaucacgguc

SEQ ID NO: 1203503 - RNA, 14 nt, Mycobacterium bovis subsp bovis AF2122/97
accugggccaucac

SEQ ID NO: 1203504 - RNA, 23 nt, Mycobacterium bovis subsp bovis AF2122/97
accuguaguucgaugacugaauc

SEQ ID NO: 1203505 - RNA, 16 nt, Mycobacterium bovis subsp bovis AF2122/97
accugguuccagaggc

SEQ ID NO: 1203506 - RNA, 18 nt, Mycobacterium bovis subsp bovis AF2122/97
accugguuuacccgcaug

SEQ ID NO: 1203507 - RNA, 19 nt, Mycobacterium bovis subsp bovis AF2122/97
accugucaacauuucugag

SEQ ID NO: 1203508 - RNA, 23 nt, Mycobacterium bovis subsp bovis AF2122/97
accugcugggagggaccacccgg

SEQ ID NO: 1203509 - RNA, 21 nt, Mycobacterium bovis subsp bovis AF2122/97
accuggccugcggcaggugcg

SEQ ID NO: 1203510 - RNA, 12 nt, Mycobacterium bovis subsp bovis AF2122/97
accuggccacgg

SEQ ID NO: 1203511 - RNA, 15 nt, Mycobacterium bovis subsp bovis AF2122/97
accuggaucagggcu

SEQ ID NO: 1203512 - RNA, 16 nt, Mycobacterium bovis subsp bovis AF2122/97
accuggaucagggcuu

SEQ ID NO: 1203513 - RNA, 20 nt, Mycobacterium bovis subsp bovis AF2122/97
accugggccagcagccguuc

SEQ ID NO: 1203514 - RNA, 23 nt, Mycobacterium bovis subsp bovis AF2122/97
accugcgggaucgccgagaccgc

SEQ ID NO: 1203515 - RNA, 23 nt, Mycobacterium bovis subsp bovis AF2122/97
accugccgacucaucggccgcgg

SEQ ID NO: 1203516 - RNA, 17 nt, Mycobacterium bovis subsp bovis AF2122/97
accugcccgucccgcuc

SEQ ID NO: 1203517 - RNA, 14 nt, Mycobacterium bovis subsp bovis AF2122/97
accugcaugcccag

SEQ ID NO: 1203518 - RNA, 13 nt, Mycobacterium bovis subsp bovis AF2122/97
accugcaucacaa

SEQ ID NO: 1203519 - RNA, 19 nt, Mycobacterium bovis subsp bovis AF2122/97
accuuccucgaaaucgugu

SEQ ID NO: 1203520 - RNA, 15 nt, Mycobacterium bovis subsp bovis AF2122/97
accuuccucgcccuu

SEQ ID NO: 1203521 - RNA, 19 nt, Mycobacterium bovis subsp bovis AF2122/97
accuucggccgaccgggcu

SEQ ID NO: 1203522 - RNA, 16 nt, Mycobacterium bovis subsp bovis AF2122/97
accuucgggacaaagc

SEQ ID NO: 1203523 - RNA, 18 nt, Mycobacterium bovis subsp bovis AF2122/97
accuucugguccagcacc

SEQ ID NO: 1203524 - RNA, 17 nt, Mycobacterium bovis subsp bovis AF2122/97
accuuggcgaccaugcu

SEQ ID NO: 1203525 - RNA, 18 nt, Mycobacterium bovis subsp bovis AF2122/97
accuuggugcccagcagg

SEQ ID NO: 1203526 - RNA, 22 nt, Mycobacterium bovis subsp bovis AF2122/97
accuugcgguucggacacacag

SEQ ID NO: 1203527 - RNA, 18 nt, Mycobacterium bovis subsp bovis AF2122/97
accuugcggcagaccaag

SEQ ID NO: 1203528 - RNA, 16 nt, Mycobacterium bovis subsp bovis AF2122/97
accuugaucgagcagg

SEQ ID NO: 1203529 - RNA, 15 nt, Mycobacterium bovis subsp bovis AF2122/97
accuugaugccauac

SEQ ID NO: 1203530 - RNA, 13 nt, Mycobacterium bovis subsp bovis AF2122/97
acgaaaggcgcgu

SEQ ID NO: 1203531 - RNA, 23 nt, Mycobacterium bovis subsp bovis AF2122/97
acgacccuggccuuugagcgcgg

SEQ ID NO: 1203532 - RNA, 17 nt, Mycobacterium bovis subsp bovis AF2122/97
acgaccgcgcaacaccu

SEQ ID NO: 1203533 - RNA, 18 nt, Mycobacterium bovis subsp bovis AF2122/97
acgacccgggaaggaacc

SEQ ID NO: 1203534 - RNA, 23 nt, Mycobacterium bovis subsp bovis AF2122/97
acgaccccacccuaaucguuccg

SEQ ID NO: 1203535 - RNA, 13 nt, Mycobacterium bovis subsp bovis AF2122/97
acgaccccggcgg

SEQ ID NO: 1203536 - RNA, 21 nt, Mycobacterium bovis subsp bovis AF2122/97
acgacgaucgcgucgggcucg

SEQ ID NO: 1203537 - RNA, 13 nt, Mycobacterium bovis subsp bovis AF2122/97
acgaccguuugaa

SEQ ID NO: 1203538 - RNA, 19 nt, Mycobacterium bovis subsp bovis AF2122/97
acgacaugagcgccacgcc

SEQ ID NO: 1203539 - RNA, 16 nt, Mycobacterium bovis subsp bovis AF2122/97
acgacaugggcaggcc

SEQ ID NO: 1203540 - RNA, 23 nt, Mycobacterium bovis subsp bovis AF2122/97
acgacaucgagccaacgcgcaga

SEQ ID NO: 1203541 - RNA, 11 nt, Mycobacterium bovis subsp bovis AF2122/97
acgacauuggu

SEQ ID NO: 1203542 - RNA, 18 nt, Mycobacterium bovis subsp bovis AF2122/97
acgacaugggcaggccgc

SEQ ID NO: 1203543 - RNA, 13 nt, Mycobacterium bovis subsp bovis AF2122/97
acgaccagcagau

SEQ ID NO: 1203544 - RNA, 13 nt, Mycobacterium bovis subsp bovis AF2122/97
acgaccaccacca

SEQ ID NO: 1203545 - RNA, 12 nt, Mycobacterium bovis subsp bovis AF2122/97
acgaccagcaga

SEQ ID NO: 1203546 - RNA, 18 nt, Mycobacterium bovis subsp bovis AF2122/97
acgagcacacaacaccca

SEQ ID NO: 1203547 - RNA, 21 nt, Mycobacterium bovis subsp bovis AF2122/97
acgacuccuauugcagcacaa

SEQ ID NO: 1203548 - RNA, 19 nt, Mycobacterium bovis subsp bovis AF2122/97
acgacugaucaagugccag

SEQ ID NO: 1203549 - RNA, 12 nt, Mycobacterium bovis subsp bovis AF2122/97
acgacgccaccu

SEQ ID NO: 1203550 - RNA, 18 nt, Mycobacterium bovis subsp bovis AF2122/97
acgacucgcgguggccga

SEQ ID NO: 1203551 - RNA, 16 nt, Mycobacterium bovis subsp bovis AF2122/97
acgacucccccggcuc

SEQ ID NO: 1203552 - RNA, 21 nt, Mycobacterium bovis subsp bovis AF2122/97
acgacuccggcaagcacaccg

SEQ ID NO: 1203553 - RNA, 13 nt, Mycobacterium bovis subsp bovis AF2122/97
acgacgucggccg

SEQ ID NO: 1203554 - RNA, 20 nt, Mycobacterium bovis subsp bovis AF2122/97
acgacagucgcagucgcuaa

SEQ ID NO: 1203555 - RNA, 15 nt, Mycobacterium bovis subsp bovis AF2122/97
acgacaacacccacg

SEQ ID NO: 1203556 - RNA, 12 nt, Mycobacterium bovis subsp bovis AF2122/97
acgaaugcagca

SEQ ID NO: 1203557 - RNA, 13 nt, Mycobacterium bovis subsp bovis AF2122/97
acgaauggggcca

SEQ ID NO: 1203558 - RNA, 19 nt, Mycobacterium bovis subsp bovis AF2122/97
acgaagggaaggacgcgca

SEQ ID NO: 1203559 - RNA, 23 nt, Mycobacterium bovis subsp bovis AF2122/97
acgaaggucgcggucgagcaggu

SEQ ID NO: 1203560 - RNA, 22 nt, Mycobacterium bovis subsp bovis AF2122/97
acgaagucgaacggcuuggcgu

SEQ ID NO: 1203561 - RNA, 15 nt, Mycobacterium bovis subsp bovis AF2122/97
acgaagagcaccgcg

SEQ ID NO: 1203562 - RNA, 21 nt, Mycobacterium bovis subsp bovis AF2122/97
acgaagagggcgccgcgcgca

SEQ ID NO: 1203563 - RNA, 22 nt, Mycobacterium bovis subsp bovis AF2122/97
acgaagaucgcgugccacagca

SEQ ID NO: 1203564 - RNA, 16 nt, Mycobacterium bovis subsp bovis AF2122/97
acgaaccccacgcaga

SEQ ID NO: 1203565 - RNA, 16 nt, Mycobacterium bovis subsp bovis AF2122/97
acgaaccccaucagaa

SEQ ID NO: 1203566 - RNA, 18 nt, Mycobacterium bovis subsp bovis AF2122/97
acgaacaccccgggcgcc

SEQ ID NO: 1203567 - RNA, 12 nt, Mycobacterium bovis subsp bovis AF2122/97
acgaacaccccg

SEQ ID NO: 1203568 - RNA, 15 nt, Mycobacterium bovis subsp bovis AF2122/97
acgaaccgccgccgc

SEQ ID NO: 1203569 - RNA, 22 nt, Mycobacterium bovis subsp bovis AF2122/97
acgaacuccgcguugggcaccu

SEQ ID NO: 1203570 - RNA, 12 nt, Mycobacterium bovis subsp bovis AF2122/97
acgaacuggucu

SEQ ID NO: 1203571 - RNA, 19 nt, Mycobacterium bovis subsp bovis AF2122/97
acgaacugcagccauucuu

SEQ ID NO: 1203572 - RNA, 13 nt, Mycobacterium bovis subsp bovis AF2122/97
acgcaaaagaacc

SEQ ID NO: 1203573 - RNA, 17 nt, Mycobacterium bovis subsp bovis AF2122/97
acgcaacggugaucagc

SEQ ID NO: 1203574 - RNA, 22 nt, Mycobacterium bovis subsp bovis AF2122/97
acgaugccgccugguguacaca

SEQ ID NO: 1203575 - RNA, 22 nt, Mycobacterium bovis subsp bovis AF2122/97
acgaugccggcaagccugcgcu

SEQ ID NO: 1203576 - RNA, 13 nt, Mycobacterium bovis subsp bovis AF2122/97
acgaugcccuucu

SEQ ID NO: 1203577 - RNA, 22 nt, Mycobacterium bovis subsp bovis AF2122/97
acgaugcccuucugacuaucuc

SEQ ID NO: 1203578 - RNA, 19 nt, Mycobacterium bovis subsp bovis AF2122/97
acgauggcgucggccagga

SEQ ID NO: 1203579 - RNA, 19 nt, Mycobacterium bovis subsp bovis AF2122/97
acgaugguguacugcugcu

SEQ ID NO: 1203580 - RNA, 12 nt, Mycobacterium bovis subsp bovis AF2122/97
acgaugucaccc

SEQ ID NO: 1203581 - RNA, 15 nt, Mycobacterium bovis subsp bovis AF2122/97
acgaugucacccucc

SEQ ID NO: 1203582 - RNA, 18 nt, Mycobacterium bovis subsp bovis AF2122/97
acgaugaccaugaugacc

SEQ ID NO: 1203583 - RNA, 17 nt, Mycobacterium bovis subsp bovis AF2122/97
acgaugacggugggguc

SEQ ID NO: 1203584 - RNA, 21 nt, Mycobacterium bovis subsp bovis AF2122/97
acgaugacguugacgucgguc

SEQ ID NO: 1203585 - RNA, 15 nt, Mycobacterium bovis subsp bovis AF2122/97
acgaugaucccaagc

SEQ ID NO: 1203586 - RNA, 14 nt, Mycobacterium bovis subsp bovis AF2122/97
acgaucugcagcac

SEQ ID NO: 1203587 - RNA, 21 nt, Mycobacterium bovis subsp bovis AF2122/97
acgaucucguggaucugccuc

SEQ ID NO: 1203588 - RNA, 15 nt, Mycobacterium bovis subsp bovis AF2122/97
acgaucgugccggga

SEQ ID NO: 1203589 - RNA, 14 nt, Mycobacterium bovis subsp bovis AF2122/97
acgaucgaugaccu

SEQ ID NO: 1203590 - RNA, 23 nt, Mycobacterium bovis subsp bovis AF2122/97
acgaucagggugucgaagagcag

SEQ ID NO: 1203591 - RNA, 17 nt, Mycobacterium bovis subsp bovis AF2122/97
acgaucagcgaguagcc

SEQ ID NO: 1203592 - RNA, 14 nt, Mycobacterium bovis subsp bovis AF2122/97
acgaucaagcuggc

SEQ ID NO: 1203593 - RNA, 18 nt, Mycobacterium bovis subsp bovis AF2122/97
acgaggcaucguccacgc

SEQ ID NO: 1203594 - RNA, 15 nt, Mycobacterium bovis subsp bovis AF2122/97
acgagguugccgcac

SEQ ID NO: 1203595 - RNA, 14 nt, Mycobacterium bovis subsp bovis AF2122/97
acgaggucugcggc

SEQ ID NO: 1203596 - RNA, 16 nt, Mycobacterium bovis subsp bovis AF2122/97
acgagggccagcagcc

SEQ ID NO: 1203597 - RNA, 19 nt, Mycobacterium bovis subsp bovis AF2122/97
acgagcucaccugcgggug

SEQ ID NO: 1203598 - RNA, 17 nt, Mycobacterium bovis subsp bovis AF2122/97
acgagcuuccacgccgg

SEQ ID NO: 1203599 - RNA, 22 nt, Mycobacterium bovis subsp bovis AF2122/97
acgagccguccaauuccgcaga

SEQ ID NO: 1203600 - RNA, 16 nt, Mycobacterium bovis subsp bovis AF2122/97
acgagccagaggugga

SEQ ID NO: 1203601 - RNA, 23 nt, Mycobacterium bovis subsp bovis AF2122/97
acgagccgcaaaaucgaugacgg

SEQ ID NO: 1203602 - RNA, 14 nt, Mycobacterium bovis subsp bovis AF2122/97
acgagcagcaaucc

SEQ ID NO: 1203603 - RNA, 13 nt, Mycobacterium bovis subsp bovis AF2122/97
acgagcaccaucc

SEQ ID NO: 1203604 - RNA, 21 nt, Mycobacterium bovis subsp bovis AF2122/97
acgagcagauggugaacgugc

SEQ ID NO: 1203605 - RNA, 19 nt, Mycobacterium bovis subsp bovis AF2122/97
acgaguuaccgguggugcg

SEQ ID NO: 1203606 - RNA, 21 nt, Mycobacterium bovis subsp bovis AF2122/97
acgagucgccgcgggcagcga

SEQ ID NO: 1203607 - RNA, 21 nt, Mycobacterium bovis subsp bovis AF2122/97
acauggcggugcgcagcuugg

SEQ ID NO: 1203608 - RNA, 15 nt, Mycobacterium bovis subsp bovis AF2122/97
acauggcccggaggc

SEQ ID NO: 1203609 - RNA, 15 nt, Mycobacterium bovis subsp bovis AF2122/97
acauguguggcagcc

SEQ ID NO: 1203610 - RNA, 18 nt, Mycobacterium bovis subsp bovis AF2122/97
accaaagcgacgagcagc

SEQ ID NO: 1203611 - RNA, 22 nt, Mycobacterium bovis subsp bovis AF2122/97
acauuuuuguuguuauuuuugg

SEQ ID NO: 1203612 - RNA, 21 nt, Mycobacterium bovis subsp bovis AF2122/97
acauuucccagucauccaacg

SEQ ID NO: 1203613 - RNA, 17 nt, Mycobacterium bovis subsp bovis AF2122/97
accaacucggcgaccug

SEQ ID NO: 1203614 - RNA, 20 nt, Mycobacterium bovis subsp bovis AF2122/97
accaacgcuucugccugcgc

SEQ ID NO: 1203615 - RNA, 18 nt, Mycobacterium bovis subsp bovis AF2122/97
accaacgucgacuucagc

SEQ ID NO: 1203616 - RNA, 13 nt, Mycobacterium bovis subsp bovis AF2122/97
accaacgcgggaa

SEQ ID NO: 1203617 - RNA, 21 nt, Mycobacterium bovis subsp bovis AF2122/97
accaaccgggacaaccccuug

SEQ ID NO: 1203618 - RNA, 20 nt, Mycobacterium bovis subsp bovis AF2122/97
accaagguacuugcgcaacc

SEQ ID NO: 1203619 - RNA, 12 nt, Mycobacterium bovis subsp bovis AF2122/97
accaaggucggc

SEQ ID NO: 1203620 - RNA, 19 nt, Mycobacterium bovis subsp bovis AF2122/97
accaaggucuucaggccgc

SEQ ID NO: 1203621 - RNA, 19 nt, Mycobacterium bovis subsp bovis AF2122/97
accaagguguggccuugcg

SEQ ID NO: 1203622 - RNA, 18 nt, Mycobacterium bovis subsp bovis AF2122/97
accaagguguccagcacc

SEQ ID NO: 1203623 - RNA, 21 nt, Mycobacterium bovis subsp bovis AF2122/97
accaagucaugcccacgcugc

SEQ ID NO: 1203624 - RNA, 16 nt, Mycobacterium bovis subsp bovis AF2122/97
accaaguagucggguu

SEQ ID NO: 1203625 - RNA, 19 nt, Mycobacterium bovis subsp bovis AF2122/97
accaagcucggccagcacg

SEQ ID NO: 1203626 - RNA, 21 nt, Mycobacterium bovis subsp bovis AF2122/97
accacauuggcgaucagcagc

SEQ ID NO: 1203627 - RNA, 16 nt, Mycobacterium bovis subsp bovis AF2122/97
accaauuggucgaguc

SEQ ID NO: 1203628 - RNA, 15 nt, Mycobacterium bovis subsp bovis AF2122/97
accaauccaggccac

SEQ ID NO: 1203629 - RNA, 17 nt, Mycobacterium bovis subsp bovis AF2122/97
accaaucgcacgccagc

SEQ ID NO: 1203630 - RNA, 15 nt, Mycobacterium bovis subsp bovis AF2122/97
accacugcgcccgcc

SEQ ID NO: 1203631 - RNA, 19 nt, Mycobacterium bovis subsp bovis AF2122/97
accacugcgcccgccacgu

SEQ ID NO: 1203632 - RNA, 16 nt, Mycobacterium bovis subsp bovis AF2122/97
accacuggauggcucg

SEQ ID NO: 1203633 - RNA, 18 nt, Mycobacterium bovis subsp bovis AF2122/97
accacggugugcuaccaa

SEQ ID NO: 1203634 - RNA, 21 nt, Mycobacterium bovis subsp bovis AF2122/97
accacugcaugaacugcucgc

SEQ ID NO: 1203635 - RNA, 13 nt, Mycobacterium bovis subsp bovis AF2122/97
accagaagcagug

SEQ ID NO: 1203636 - RNA, 13 nt, Mycobacterium bovis subsp bovis AF2122/97
accagacugcagu

SEQ ID NO: 1203637 - RNA, 22 nt, Mycobacterium bovis subsp bovis AF2122/97
accagaugcaccucgcccugca

SEQ ID NO: 1203638 - RNA, 20 nt, Mycobacterium bovis subsp bovis AF2122/97
accagaucaacaucaucacu

SEQ ID NO: 1203639 - RNA, 12 nt, Mycobacterium bovis subsp bovis AF2122/97
accagccagccu

SEQ ID NO: 1203640 - RNA, 14 nt, Mycobacterium bovis subsp bovis AF2122/97
accagccaccacca

SEQ ID NO: 1203641 - RNA, 23 nt, Mycobacterium bovis subsp bovis AF2122/97
accagccuuuccggccgccugcc

SEQ ID NO: 1203642 - RNA, 22 nt, Mycobacterium bovis subsp bovis AF2122/97
accaccgccgccggcaccgccg

SEQ ID NO: 1203643 - RNA, 15 nt, Mycobacterium bovis subsp bovis AF2122/97
accaccgccggcccg

SEQ ID NO: 1203644 - RNA, 14 nt, Mycobacterium bovis subsp bovis AF2122/97
accaccgccgaagc

SEQ ID NO: 1203645 - RNA, 20 nt, Mycobacterium bovis subsp bovis AF2122/97
accaccggccccaccgacag

SEQ ID NO: 1203646 - RNA, 22 nt, Mycobacterium bovis subsp bovis AF2122/97
accaccgcugcgaagagcccgu

SEQ ID NO: 1203647 - RNA, 17 nt, Mycobacterium bovis subsp bovis AF2122/97
accaccggaaccaccag

SEQ ID NO: 1203648 - RNA, 14 nt, Mycobacterium bovis subsp bovis AF2122/97
accaccgcccacag

SEQ ID NO: 1203649 - RNA, 21 nt, Mycobacterium bovis subsp bovis AF2122/97
accaccgaaauacccagcgca

SEQ ID NO: 1203650 - RNA, 13 nt, Mycobacterium bovis subsp bovis AF2122/97
accaccaccgccg

SEQ ID NO: 1203651 - RNA, 22 nt, Mycobacterium bovis subsp bovis AF2122/97
accaccaagcucggccagcacg

SEQ ID NO: 1203652 - RNA, 14 nt, Mycobacterium bovis subsp bovis AF2122/97
accaccacggccag

SEQ ID NO: 1203653 - RNA, 22 nt, Mycobacterium bovis subsp bovis AF2122/97
accaccacguggcccuccucgg

SEQ ID NO: 1203654 - RNA, 15 nt, Mycobacterium bovis subsp bovis AF2122/97
accacccgccgcagc

SEQ ID NO: 1203655 - RNA, 20 nt, Mycobacterium bovis subsp bovis AF2122/97
accacccggcgcgaauuccu

SEQ ID NO: 1203656 - RNA, 15 nt, Mycobacterium bovis subsp bovis AF2122/97
accacccccggcagg

SEQ ID NO: 1203657 - RNA, 13 nt, Mycobacterium bovis subsp bovis AF2122/97
accaccccagggc

SEQ ID NO: 1203658 - RNA, 14 nt, Mycobacterium bovis subsp bovis AF2122/97
accacccaggccau

SEQ ID NO: 1203659 - RNA, 21 nt, Mycobacterium bovis subsp bovis AF2122/97
accacgaugaccggggacagc

SEQ ID NO: 1203660 - RNA, 13 nt, Mycobacterium bovis subsp bovis AF2122/97
accacgaugauca

SEQ ID NO: 1203661 - RNA, 18 nt, Mycobacterium bovis subsp bovis AF2122/97
accacgaucgcagugggc

SEQ ID NO: 1203662 - RNA, 14 nt, Mycobacterium bovis subsp bovis AF2122/97
accacgauggcggc

SEQ ID NO: 1203663 - RNA, 14 nt, Mycobacterium bovis subsp bovis AF2122/97
accacgagcagccg

SEQ ID NO: 1203664 - RNA, 16 nt, Mycobacterium bovis subsp bovis AF2122/97
accaccggccgucccg

SEQ ID NO: 1203665 - RNA, 23 nt, Mycobacterium bovis subsp bovis AF2122/97
accacggcggcggcguagcagaa

SEQ ID NO: 1203666 - RNA, 22 nt, Mycobacterium bovis subsp bovis AF2122/97
accacggcguugccgccggcuc

SEQ ID NO: 1203667 - RNA, 23 nt, Mycobacterium bovis subsp bovis AF2122/97
accagggugacggaguuggcccg

SEQ ID NO: 1203668 - RNA, 20 nt, Mycobacterium bovis subsp bovis AF2122/97
accaggguuggcaccgucag

SEQ ID NO: 1203669 - RNA, 21 nt, Mycobacterium bovis subsp bovis AF2122/97
accagggccuccacccgccac

SEQ ID NO: 1203670 - RNA, 12 nt, Mycobacterium bovis subsp bovis AF2122/97
accagggccacc

SEQ ID NO: 1203671 - RNA, 14 nt, Mycobacterium bovis subsp bovis AF2122/97
accagggcagcggc

SEQ ID NO: 1203672 - RNA, 18 nt, Mycobacterium bovis subsp bovis AF2122/97
accagggacgaugcccuc

SEQ ID NO: 1203673 - RNA, 16 nt, Mycobacterium bovis subsp bovis AF2122/97
accaggcggccgcguc

SEQ ID NO: 1203674 - RNA, 13 nt, Mycobacterium bovis subsp bovis AF2122/97
accaggcccgguu

SEQ ID NO: 1203675 - RNA, 23 nt, Mycobacterium bovis subsp bovis AF2122/97
accaggcuccggccggccagcac

SEQ ID NO: 1203676 - RNA, 16 nt, Mycobacterium bovis subsp bovis AF2122/97
accaggcggucagguc

SEQ ID NO: 1203677 - RNA, 16 nt, Mycobacterium bovis subsp bovis AF2122/97
accaggugccaggaug

SEQ ID NO: 1203678 - RNA, 15 nt, Mycobacterium bovis subsp bovis AF2122/97
accagguggccaggc

SEQ ID NO: 1203679 - RNA, 18 nt, Mycobacterium bovis subsp bovis AF2122/97
accagguggccaggccgu

SEQ ID NO: 1203680 - RNA, 18 nt, Mycobacterium bovis subsp bovis AF2122/97
accaggucgauaagggcu

SEQ ID NO: 1203681 - RNA, 15 nt, Mycobacterium bovis subsp bovis AF2122/97
accagguugccgagg

SEQ ID NO: 1203682 - RNA, 16 nt, Mycobacterium bovis subsp bovis AF2122/97
accagcgccccggcgc

SEQ ID NO: 1203683 - RNA, 18 nt, Mycobacterium bovis subsp bovis AF2122/97
accagcgcccggcccgcc

SEQ ID NO: 1203684 - RNA, 17 nt, Mycobacterium bovis subsp bovis AF2122/97
accagcgaguugagcau

SEQ ID NO: 1203685 - RNA, 16 nt, Mycobacterium bovis subsp bovis AF2122/97
accagcgaguugagca

SEQ ID NO: 1203686 - RNA, 17 nt, Mycobacterium bovis subsp bovis AF2122/97
accagcgaauccagccg

SEQ ID NO: 1203687 - RNA, 22 nt, Mycobacterium bovis subsp bovis AF2122/97
accagcgaaaugcccaucacca

SEQ ID NO: 1203688 - RNA, 16 nt, Mycobacterium bovis subsp bovis AF2122/97
accaggcgagccgcca

SEQ ID NO: 1203689 - RNA, 14 nt, Mycobacterium bovis subsp bovis AF2122/97
accaggccggugac

SEQ ID NO: 1203690 - RNA, 16 nt, Mycobacterium bovis subsp bovis AF2122/97
accaggccguccucgg

SEQ ID NO: 1203691 - RNA, 16 nt, Mycobacterium bovis subsp bovis AF2122/97
accaggccgaaaucca

SEQ ID NO: 1203692 - RNA, 17 nt, Mycobacterium bovis subsp bovis AF2122/97
accaggccgagccgccc

SEQ ID NO: 1203693 - RNA, 20 nt, Mycobacterium bovis subsp bovis AF2122/97
accaggccgagccgcccgcc

SEQ ID NO: 1203694 - RNA, 16 nt, Mycobacterium bovis subsp bovis AF2122/97
accagcgcuccagcac

SEQ ID NO: 1203695 - RNA, 17 nt, Mycobacterium bovis subsp bovis AF2122/97
accagcgcuccagcacc

SEQ ID NO: 1203696 - RNA, 14 nt, Mycobacterium bovis subsp bovis AF2122/97
accagcgcgagccc

SEQ ID NO: 1203697 - RNA, 16 nt, Mycobacterium bovis subsp bovis AF2122/97
accagcgcgagcccga

SEQ ID NO: 1203698 - RNA, 20 nt, Mycobacterium bovis subsp bovis AF2122/97
accaguaauacugccguucg

SEQ ID NO: 1203699 - RNA, 13 nt, Mycobacterium bovis subsp bovis AF2122/97
accaguccagcgg

SEQ ID NO: 1203700 - RNA, 20 nt, Mycobacterium bovis subsp bovis AF2122/97
accaguguggcgaugaccac

SEQ ID NO: 1203701 - RNA, 21 nt, Mycobacterium bovis subsp bovis AF2122/97
accaguguggcgaugaccacg

SEQ ID NO: 1203702 - RNA, 23 nt, Mycobacterium bovis subsp bovis AF2122/97
accaucaccgcgccagccuccac

SEQ ID NO: 1203703 - RNA, 15 nt, Mycobacterium bovis subsp bovis AF2122/97
accauaaaccgcugc

SEQ ID NO: 1203704 - RNA, 18 nt, Mycobacterium bovis subsp bovis AF2122/97
accauacccgcgcgcacc

SEQ ID NO: 1203705 - RNA, 15 nt, Mycobacterium bovis subsp bovis AF2122/97
acccagaugcaggcu

SEQ ID NO: 1203706 - RNA, 17 nt, Mycobacterium bovis subsp bovis AF2122/97
acccagcaccagggcgc

SEQ ID NO: 1203707 - RNA, 17 nt, Mycobacterium bovis subsp bovis AF2122/97
acccagacaccggcuau

SEQ ID NO: 1203708 - RNA, 14 nt, Mycobacterium bovis subsp bovis AF2122/97
acccagaccggcuc

SEQ ID NO: 1203709 - RNA, 15 nt, Mycobacterium bovis subsp bovis AF2122/97
acccagcacgcgcgc

SEQ ID NO: 1203710 - RNA, 14 nt, Mycobacterium bovis subsp bovis AF2122/97
acccagcccagccg

SEQ ID NO: 1203711 - RNA, 14 nt, Mycobacterium bovis subsp bovis AF2122/97
acccagccgcagcc

SEQ ID NO: 1203712 - RNA, 15 nt, Mycobacterium bovis subsp bovis AF2122/97
acccagcgcagcagc

SEQ ID NO: 1203713 - RNA, 19 nt, Mycobacterium bovis subsp bovis AF2122/97
acccagcgcgcugggaagc

SEQ ID NO: 1203714 - RNA, 14 nt, Mycobacterium bovis subsp bovis AF2122/97
acccagcgcagcag

SEQ ID NO: 1203715 - RNA, 15 nt, Mycobacterium bovis subsp bovis AF2122/97
acccagcgcccggcc

SEQ ID NO: 1203716 - RNA, 22 nt, Mycobacterium bovis subsp bovis AF2122/97
acccagcgccgacccaacccga

SEQ ID NO: 1203717 - RNA, 14 nt, Mycobacterium bovis subsp bovis AF2122/97
acccagcggcgcca

SEQ ID NO: 1203718 - RNA, 21 nt, Mycobacterium bovis subsp bovis AF2122/97
acccagcgugcccgccaccgg

SEQ ID NO: 1203719 - RNA, 17 nt, Mycobacterium bovis subsp bovis AF2122/97
accccaacagggcggca

SEQ ID NO: 1203720 - RNA, 20 nt, Mycobacterium bovis subsp bovis AF2122/97
accccacacccgggacgaac

SEQ ID NO: 1203721 - RNA, 18 nt, Mycobacterium bovis subsp bovis AF2122/97
accccaaucgaccgcccg

SEQ ID NO: 1203722 - RNA, 20 nt, Mycobacterium bovis subsp bovis AF2122/97
accccaaucgaccgcccgcc

SEQ ID NO: 1203723 - RNA, 18 nt, Mycobacterium bovis subsp bovis AF2122/97
accccgaauagucggcau

SEQ ID NO: 1203724 - RNA, 15 nt, Mycobacterium bovis subsp bovis AF2122/97
accccgagccgcagc

SEQ ID NO: 1203725 - RNA, 16 nt, Mycobacterium bovis subsp bovis AF2122/97
accccgagccuugagc

SEQ ID NO: 1203726 - RNA, 16 nt, Mycobacterium bovis subsp bovis AF2122/97
acccccgucgccaccg

SEQ ID NO: 1203727 - RNA, 22 nt, Mycobacterium bovis subsp bovis AF2122/97
acccccggccagcgucaacagc

SEQ ID NO: 1203728 - RNA, 20 nt, Mycobacterium bovis subsp bovis AF2122/97
acccccccccccacccacca

SEQ ID NO: 1203729 - RNA, 21 nt, Mycobacterium bovis subsp bovis AF2122/97
acccccccccccacccaccac

SEQ ID NO: 1203730 - RNA, 14 nt, Mycobacterium bovis subsp bovis AF2122/97
accccccgaccccg

SEQ ID NO: 1203731 - RNA, 18 nt, Mycobacterium bovis subsp bovis AF2122/97
acccccgauggcgucgcc

SEQ ID NO: 1203732 - RNA, 23 nt, Mycobacterium bovis subsp bovis AF2122/97
acccccgauggcgucgccggccc

SEQ ID NO: 1203733 - RNA, 13 nt, Mycobacterium bovis subsp bovis AF2122/97
accccacggccag

SEQ ID NO: 1203734 - RNA, 15 nt, Mycobacterium bovis subsp bovis AF2122/97
accccagccggcagc

SEQ ID NO: 1203735 - RNA, 15 nt, Mycobacterium bovis subsp bovis AF2122/97
accccagcggccacc

SEQ ID NO: 1203736 - RNA, 16 nt, Mycobacterium bovis subsp bovis AF2122/97
accccagcggccaccg

SEQ ID NO: 1203737 - RNA, 19 nt, Mycobacterium bovis subsp bovis AF2122/97
accccagucggccaagcug

SEQ ID NO: 1203738 - RNA, 21 nt, Mycobacterium bovis subsp bovis AF2122/97
accccaucagaaugccuggcc

SEQ ID NO: 1203739 - RNA, 21 nt, Mycobacterium bovis subsp bovis AF2122/97
accccaugaccgggaggcggc

SEQ ID NO: 1203740 - RNA, 13 nt, Mycobacterium bovis subsp bovis AF2122/97
accccauggccag

SEQ ID NO: 1203741 - RNA, 17 nt, Mycobacterium bovis subsp bovis AF2122/97
accccauggccagcgcu

SEQ ID NO: 1203742 - RNA, 15 nt, Mycobacterium bovis subsp bovis AF2122/97
accccauggccaccg

SEQ ID NO: 1203743 - RNA, 23 nt, Mycobacterium bovis subsp bovis AF2122/97
acccccaacugcgaaacgccacc

SEQ ID NO: 1203744 - RNA, 16 nt, Mycobacterium bovis subsp bovis AF2122/97
acccacacccagcgug

SEQ ID NO: 1203745 - RNA, 20 nt, Mycobacterium bovis subsp bovis AF2122/97
acccacaucagccgcaccag

SEQ ID NO: 1203746 - RNA, 15 nt, Mycobacterium bovis subsp bovis AF2122/97
acccaccaauccaca

SEQ ID NO: 1203747 - RNA, 17 nt, Mycobacterium bovis subsp bovis AF2122/97
acccaccaauccacaga

SEQ ID NO: 1203748 - RNA, 15 nt, Mycobacterium bovis subsp bovis AF2122/97
acccaccaccgcaac

SEQ ID NO: 1203749 - RNA, 17 nt, Mycobacterium bovis subsp bovis AF2122/97
acccaagaauucaccac

SEQ ID NO: 1203750 - RNA, 23 nt, Mycobacterium bovis subsp bovis AF2122/97
accauucccggacccaccaaucc

SEQ ID NO: 1203751 - RNA, 17 nt, Mycobacterium bovis subsp bovis AF2122/97
accauccagcccauccc

SEQ ID NO: 1203752 - RNA, 23 nt, Mycobacterium bovis subsp bovis AF2122/97
acagccggccaauggccugcagc

SEQ ID NO: 1203753 - RNA, 15 nt, Mycobacterium bovis subsp bovis AF2122/97
acagccgcgcugcga

SEQ ID NO: 1203754 - RNA, 18 nt, Mycobacterium bovis subsp bovis AF2122/97
acagccccaucaccaccg

SEQ ID NO: 1203755 - RNA, 12 nt, Mycobacterium bovis subsp bovis AF2122/97
acagcccggcgg

SEQ ID NO: 1203756 - RNA, 15 nt, Mycobacterium bovis subsp bovis AF2122/97
acagcccggcggcgg

SEQ ID NO: 1203757 - RNA, 19 nt, Mycobacterium bovis subsp bovis AF2122/97
acagccugcgccacaaugg

SEQ ID NO: 1203758 - RNA, 13 nt, Mycobacterium bovis subsp bovis AF2122/97
acagcgagcacac

SEQ ID NO: 1203759 - RNA, 23 nt, Mycobacterium bovis subsp bovis AF2122/97
acagcgaacagacaugcgcacca

SEQ ID NO: 1203760 - RNA, 18 nt, Mycobacterium bovis subsp bovis AF2122/97
acagcgaaccggcugggc

SEQ ID NO: 1203761 - RNA, 12 nt, Mycobacterium bovis subsp bovis AF2122/97
acagcgaacaga

SEQ ID NO: 1203762 - RNA, 16 nt, Mycobacterium bovis subsp bovis AF2122/97
acagcgcuacaaacga

SEQ ID NO: 1203763 - RNA, 16 nt, Mycobacterium bovis subsp bovis AF2122/97
acagcgcguagcgggc

SEQ ID NO: 1203764 - RNA, 23 nt, Mycobacterium bovis subsp bovis AF2122/97
acagcgccuggccggaauacccg

SEQ ID NO: 1203765 - RNA, 20 nt, Mycobacterium bovis subsp bovis AF2122/97
acagcggguucaacgcgcgc

SEQ ID NO: 1203766 - RNA, 21 nt, Mycobacterium bovis subsp bovis AF2122/97
acagcggcgacaugaucugcc

SEQ ID NO: 1203767 - RNA, 15 nt, Mycobacterium bovis subsp bovis AF2122/97
acagcgggggcagcg

SEQ ID NO: 1203768 - RNA, 18 nt, Mycobacterium bovis subsp bovis AF2122/97
acagcgguccagccaccg

SEQ ID NO: 1203769 - RNA, 14 nt, Mycobacterium bovis subsp bovis AF2122/97
acagcgucucggag

SEQ ID NO: 1203770 - RNA, 18 nt, Mycobacterium bovis subsp bovis AF2122/97
acaggcaucggaggaacc

SEQ ID NO: 1203771 - RNA, 14 nt, Mycobacterium bovis subsp bovis AF2122/97
acaggccccacacc

SEQ ID NO: 1203772 - RNA, 19 nt, Mycobacterium bovis subsp bovis AF2122/97
acaggcccgccagcagggc

SEQ ID NO: 1203773 - RNA, 19 nt, Mycobacterium bovis subsp bovis AF2122/97
acaggccguggcggacggc

SEQ ID NO: 1203774 - RNA, 23 nt, Mycobacterium bovis subsp bovis AF2122/97
acaggccgaagcucacacuggcu

SEQ ID NO: 1203775 - RNA, 19 nt, Mycobacterium bovis subsp bovis AF2122/97
acaggacaauggacaccaa

SEQ ID NO: 1203776 - RNA, 18 nt, Mycobacterium bovis subsp bovis AF2122/97
acagcuugcugcgcacca

SEQ ID NO: 1203777 - RNA, 22 nt, Mycobacterium bovis subsp bovis AF2122/97
acagcuuggagaucgccgccgg

SEQ ID NO: 1203778 - RNA, 16 nt, Mycobacterium bovis subsp bovis AF2122/97
acagcugggucggagu

SEQ ID NO: 1203779 - RNA, 18 nt, Mycobacterium bovis subsp bovis AF2122/97
acagcuucgcgcagccgg

SEQ ID NO: 1203780 - RNA, 15 nt, Mycobacterium bovis subsp bovis AF2122/97
acagcucgccuaguu

SEQ ID NO: 1203781 - RNA, 18 nt, Mycobacterium bovis subsp bovis AF2122/97
acagcguugccaggugcu

SEQ ID NO: 1203782 - RNA, 18 nt, Mycobacterium bovis subsp bovis AF2122/97
acagcugacgagccggug

SEQ ID NO: 1203783 - RNA, 14 nt, Mycobacterium bovis subsp bovis AF2122/97
acagcugcccgcca

SEQ ID NO: 1203784 - RNA, 16 nt, Mycobacterium bovis subsp bovis AF2122/97
acagcuggcggcagcg

SEQ ID NO: 1203785 - RNA, 19 nt, Mycobacterium bovis subsp bovis AF2122/97
acagaugcauccagcugcu

SEQ ID NO: 1203786 - RNA, 14 nt, Mycobacterium bovis subsp bovis AF2122/97
acagaugccaccca

SEQ ID NO: 1203787 - RNA, 20 nt, Mycobacterium bovis subsp bovis AF2122/97
acagauucggugccagcagg

SEQ ID NO: 1203788 - RNA, 22 nt, Mycobacterium bovis subsp bovis AF2122/97
acagauucggugccagcaggcc

SEQ ID NO: 1203789 - RNA, 18 nt, Mycobacterium bovis subsp bovis AF2122/97
acagcacauccagcccug

SEQ ID NO: 1203790 - RNA, 21 nt, Mycobacterium bovis subsp bovis AF2122/97
acagcaccacgugcgagggca

SEQ ID NO: 1203791 - RNA, 13 nt, Mycobacterium bovis subsp bovis AF2122/97
acagcacauccag

SEQ ID NO: 1203792 - RNA, 15 nt, Mycobacterium bovis subsp bovis AF2122/97
acagcaccguccucg

SEQ ID NO: 1203793 - RNA, 16 nt, Mycobacterium bovis subsp bovis AF2122/97
acagcaccgaacccgc

SEQ ID NO: 1203794 - RNA, 13 nt, Mycobacterium bovis subsp bovis AF2122/97
acagccacgcaca

SEQ ID NO: 1203795 - RNA, 17 nt, Mycobacterium bovis subsp bovis AF2122/97
acagccacgcacaauac

SEQ ID NO: 1203796 - RNA, 19 nt, Mycobacterium bovis subsp bovis AF2122/97
acacuggccgucggcguga

SEQ ID NO: 1203797 - RNA, 19 nt, Mycobacterium bovis subsp bovis AF2122/97
acaucgaggccacgccagc

SEQ ID NO: 1203798 - RNA, 23 nt, Mycobacterium bovis subsp bovis AF2122/97
acaucgaugucagugaucaccaa

SEQ ID NO: 1203799 - RNA, 23 nt, Mycobacterium bovis subsp bovis AF2122/97
acaucgagccaacgcgcagagcg

SEQ ID NO: 1203800 - RNA, 21 nt, Mycobacterium bovis subsp bovis AF2122/97
acaucguugacccggcgaugc

SEQ ID NO: 1203801 - RNA, 12 nt, Mycobacterium bovis subsp bovis AF2122/97
acaugcuggaga

SEQ ID NO: 1203802 - RNA, 13 nt, Mycobacterium bovis subsp bovis AF2122/97
acagugccucgcg

SEQ ID NO: 1203803 - RNA, 19 nt, Mycobacterium bovis subsp bovis AF2122/97
acagugucucacaaacugg

SEQ ID NO: 1203804 - RNA, 20 nt, Mycobacterium bovis subsp bovis AF2122/97
acagugaccugggcgcccca

SEQ ID NO: 1203805 - RNA, 23 nt, Mycobacterium bovis subsp bovis AF2122/97
acagucggugcagcgcacgcagc

SEQ ID NO: 1203806 - RNA, 20 nt, Mycobacterium bovis subsp bovis AF2122/97
acagucgaccggacacuccu

SEQ ID NO: 1203807 - RNA, 19 nt, Mycobacterium bovis subsp bovis AF2122/97
acagucgcagcacggcuuc

SEQ ID NO: 1203808 - RNA, 21 nt, Mycobacterium bovis subsp bovis AF2122/97
acagucgcagucgcuaagacu

SEQ ID NO: 1203809 - RNA, 19 nt, Mycobacterium bovis subsp bovis AF2122/97
acaggucgccggggccgcu

SEQ ID NO: 1203810 - RNA, 14 nt, Mycobacterium bovis subsp bovis AF2122/97
acaggugccagacc

SEQ ID NO: 1203811 - RNA, 14 nt, Mycobacterium bovis subsp bovis AF2122/97
acaggucagcgcug

SEQ ID NO: 1203812 - RNA, 13 nt, Mycobacterium bovis subsp bovis AF2122/97
acagguccggguu

SEQ ID NO: 1203813 - RNA, 14 nt, Mycobacterium bovis subsp bovis AF2122/97
acagguccugcgcc

SEQ ID NO: 1203814 - RNA, 23 nt, Mycobacterium bovis subsp bovis AF2122/97
acagguccugcgccgcacgccga

SEQ ID NO: 1203815 - RNA, 22 nt, Mycobacterium bovis subsp bovis AF2122/97
acagggugggggcaucaggguc

SEQ ID NO: 1203816 - RNA, 16 nt, Mycobacterium bovis subsp bovis AF2122/97
acaggcugaagacgaa

SEQ ID NO: 1203817 - RNA, 19 nt, Mycobacterium bovis subsp bovis AF2122/97
acaggcuugacugcacacc

SEQ ID NO: 1203818 - RNA, 20 nt, Mycobacterium bovis subsp bovis AF2122/97
acaggcuugacugcacacca

SEQ ID NO: 1203819 - RNA, 23 nt, Mycobacterium bovis subsp bovis AF2122/97
acaggcuugacugcacaccaccg

SEQ ID NO: 1203820 - RNA, 13 nt, Mycobacterium bovis subsp bovis AF2122/97
acaggcuuggcau

SEQ ID NO: 1203821 - RNA, 22 nt, Mycobacterium bovis subsp bovis AF2122/97
aacaacuuggccaucccggccu

SEQ ID NO: 1203822 - RNA, 13 nt, Mycobacterium bovis subsp bovis AF2122/97
aacaacuccagca

SEQ ID NO: 1203823 - RNA, 19 nt, Mycobacterium bovis subsp bovis AF2122/97
aacaacguucggcacaacc

SEQ ID NO: 1203824 - RNA, 16 nt, Mycobacterium bovis subsp bovis AF2122/97
aacaacgucugcagcc

SEQ ID NO: 1203825 - RNA, 23 nt, Mycobacterium bovis subsp bovis AF2122/97
aacaaccccgguugacucgcucc

SEQ ID NO: 1203826 - RNA, 15 nt, Mycobacterium bovis subsp bovis AF2122/97
aacaacagccgcagc

SEQ ID NO: 1203827 - RNA, 18 nt, Mycobacterium bovis subsp bovis AF2122/97
aacaacagccgcagccag

SEQ ID NO: 1203828 - RNA, 16 nt, Mycobacterium bovis subsp bovis AF2122/97
aacaacaucacugccu

SEQ ID NO: 1203829 - RNA, 21 nt, Mycobacterium bovis subsp bovis AF2122/97
aacaagguauggccggagcgc

SEQ ID NO: 1203830 - RNA, 23 nt, Mycobacterium bovis subsp bovis AF2122/97
aacaaacccaacaccagcagcac

SEQ ID NO: 1203831 - RNA, 20 nt, Mycobacterium bovis subsp bovis AF2122/97
aacacccacgugcugccuuu

SEQ ID NO: 1203832 - RNA, 13 nt, Mycobacterium bovis subsp bovis AF2122/97
aacacccgagcaa

SEQ ID NO: 1203833 - RNA, 13 nt, Mycobacterium bovis subsp bovis AF2122/97
aacacccgcccgg

SEQ ID NO: 1203834 - RNA, 14 nt, Mycobacterium bovis subsp bovis AF2122/97
aacaccccacacag

SEQ ID NO: 1203835 - RNA, 18 nt, Mycobacterium bovis subsp bovis AF2122/97
aacaccgucggcagcagc

SEQ ID NO: 1203836 - RNA, 19 nt, Mycobacterium bovis subsp bovis AF2122/97
aacaccgucggcagcagcg

SEQ ID NO: 1203837 - RNA, 20 nt, Mycobacterium bovis subsp bovis AF2122/97
aacaccgguaacgccaacac

SEQ ID NO: 1203838 - RNA, 20 nt, Mycobacterium bovis subsp bovis AF2122/97
aacaccucaccgcggaucga

SEQ ID NO: 1203839 - RNA, 18 nt, Mycobacterium bovis subsp bovis AF2122/97
aacaccaacgacagcgac

SEQ ID NO: 1203840 - RNA, 22 nt, Mycobacterium bovis subsp bovis AF2122/97
aacaccacaccgagcaccugac

SEQ ID NO: 1203841 - RNA, 22 nt, Mycobacterium bovis subsp bovis AF2122/97
aacaccaaccagugcagcucga

SEQ ID NO: 1203842 - RNA, 19 nt, Mycobacterium bovis subsp bovis AF2122/97
aacaccagauggcucucgg

SEQ ID NO: 1203843 - RNA, 13 nt, Mycobacterium bovis subsp bovis AF2122/97
aacaccagcgcgu

SEQ ID NO: 1203844 - RNA, 21 nt, Mycobacterium bovis subsp bovis AF2122/97
aacaauucacgcaccacaaac

SEQ ID NO: 1203845 - RNA, 16 nt, Mycobacterium bovis subsp bovis AF2122/97
aacaauuucugcagcc

SEQ ID NO: 1203846 - RNA, 23 nt, Mycobacterium bovis subsp bovis AF2122/97
aacacguggauguguaggugggg

SEQ ID NO: 1203847 - RNA, 23 nt, Mycobacterium bovis subsp bovis AF2122/97
aacagagucaccgcgcuggucag

SEQ ID NO: 1203848 - RNA, 14 nt, Mycobacterium bovis subsp bovis AF2122/97
aacagcaccgccgg

SEQ ID NO: 1203849 - RNA, 12 nt, Mycobacterium bovis subsp bovis AF2122/97
aacagcaccagu

SEQ ID NO: 1203850 - RNA, 13 nt, Mycobacterium bovis subsp bovis AF2122/97
aacagcaccagug

SEQ ID NO: 1203851 - RNA, 15 nt, Mycobacterium bovis subsp bovis AF2122/97
aacagcaggccucca

SEQ ID NO: 1203852 - RNA, 12 nt, Mycobacterium bovis subsp bovis AF2122/97
aacagccgcagc

SEQ ID NO: 1203853 - RNA, 20 nt, Mycobacterium bovis subsp bovis AF2122/97
aacagcgaaccggcugggcg

SEQ ID NO: 1203854 - RNA, 18 nt, Mycobacterium bovis subsp bovis AF2122/97
aacagcgacgccaugguc

SEQ ID NO: 1203855 - RNA, 14 nt, Mycobacterium bovis subsp bovis AF2122/97
aacaggaucagcga

SEQ ID NO: 1203856 - RNA, 18 nt, Mycobacterium bovis subsp bovis AF2122/97
aacaggcgucccgcccgg

SEQ ID NO: 1203857 - RNA, 15 nt, Mycobacterium bovis subsp bovis AF2122/97
aacaggccggugugc

SEQ ID NO: 1203858 - RNA, 12 nt, Mycobacterium bovis subsp bovis AF2122/97
aacaggccuagg

SEQ ID NO: 1203859 - RNA, 11 nt, Mycobacterium bovis subsp bovis AF2122/97
aacagguugaa

SEQ ID NO: 1203860 - RNA, 21 nt, Mycobacterium bovis subsp bovis AF2122/97
aacagguaagcagccagcaac

SEQ ID NO: 1203861 - RNA, 19 nt, Mycobacterium bovis subsp bovis AF2122/97
aacaguucacgaccccgga

SEQ ID NO: 1203862 - RNA, 16 nt, Mycobacterium bovis subsp bovis AF2122/97
aacagucgcagccagg

SEQ ID NO: 1203863 - RNA, 15 nt, Mycobacterium bovis subsp bovis AF2122/97
aacagugccucgcgu

SEQ ID NO: 1203864 - RNA, 14 nt, Mycobacterium bovis subsp bovis AF2122/97
aacagugccugggu

SEQ ID NO: 1203865 - RNA, 23 nt, Mycobacterium bovis subsp bovis AF2122/97
aacaucccagcgaaugcugacau

SEQ ID NO: 1203866 - RNA, 19 nt, Mycobacterium bovis subsp bovis AF2122/97
aacauccccgagcugucgg

SEQ ID NO: 1203867 - RNA, 13 nt, Mycobacterium bovis subsp bovis AF2122/97
aacaucaccgucg

SEQ ID NO: 1203868 - RNA, 15 nt, Mycobacterium bovis subsp bovis AF2122/97
aacaucacugccuug

SEQ ID NO: 1203869 - RNA, 14 nt, Mycobacterium bovis subsp bovis AF2122/97
aacaucgccagcgc

SEQ ID NO: 1203870 - RNA, 17 nt, Mycobacterium bovis subsp bovis AF2122/97
aacaucgacagcaucac

SEQ ID NO: 1203871 - RNA, 16 nt, Mycobacterium bovis subsp bovis AF2122/97
aacauccugggcaagu

SEQ ID NO: 1203872 - RNA, 20 nt, Mycobacterium bovis subsp bovis AF2122/97
aacaugaguggcaaucccgc

SEQ ID NO: 1203873 - RNA, 17 nt, Mycobacterium bovis subsp bovis AF2122/97
aacaugcucacgaucac

SEQ ID NO: 1203874 - RNA, 21 nt, Mycobacterium bovis subsp bovis AF2122/97
aacaugcuggagaaaccacug

SEQ ID NO: 1203875 - RNA, 21 nt, Mycobacterium bovis subsp bovis AF2122/97
aaccaaagcgacgagcagcaa

SEQ ID NO: 1203876 - RNA, 19 nt, Mycobacterium bovis subsp bovis AF2122/97
aaccagcgcgucucguuga

SEQ ID NO: 1203877 - RNA, 16 nt, Mycobacterium bovis subsp bovis AF2122/97
aaccagccaccaccag

SEQ ID NO: 1203878 - RNA, 20 nt, Mycobacterium bovis subsp bovis AF2122/97
aaccagccaccaccaggucg

SEQ ID NO: 1203879 - RNA, 11 nt, Mycobacterium bovis subsp bovis AF2122/97
aaccagcagca

SEQ ID NO: 1203880 - RNA, 13 nt, Mycobacterium bovis subsp bovis AF2122/97
aaccagcagcagg

SEQ ID NO: 1203881 - RNA, 18 nt, Mycobacterium bovis subsp bovis AF2122/97
aaccagaggucacgcagc

SEQ ID NO: 1203882 - RNA, 16 nt, Mycobacterium bovis subsp bovis AF2122/97
aaccacccgcaacaca

SEQ ID NO: 1203883 - RNA, 13 nt, Mycobacterium bovis subsp bovis AF2122/97
aaccaccagcacg

SEQ ID NO: 1203884 - RNA, 20 nt, Mycobacterium bovis subsp bovis AF2122/97
aaccacccaccggccaccag

SEQ ID NO: 1203885 - RNA, 18 nt, Mycobacterium bovis subsp bovis AF2122/97
aaccacggcggcaucacc

SEQ ID NO: 1203886 - RNA, 15 nt, Mycobacterium bovis subsp bovis AF2122/97
aaccacgagcaucaa

SEQ ID NO: 1203887 - RNA, 23 nt, Mycobacterium bovis subsp bovis AF2122/97
aacccaggucuuucgaauccccg

SEQ ID NO: 1203888 - RNA, 15 nt, Mycobacterium bovis subsp bovis AF2122/97
aacccaugaccuuca

SEQ ID NO: 1203889 - RNA, 19 nt, Mycobacterium bovis subsp bovis AF2122/97
aacccaccgcauuaagggu

SEQ ID NO: 1203890 - RNA, 21 nt, Mycobacterium bovis subsp bovis AF2122/97
aaccaucguuguugaccacca

SEQ ID NO: 1203891 - RNA, 18 nt, Mycobacterium bovis subsp bovis AF2122/97
aaccaugaccaccaaggu

SEQ ID NO: 1203892 - RNA, 12 nt, Mycobacterium bovis subsp bovis AF2122/97
aacccugcaccc

SEQ ID NO: 1203893 - RNA, 13 nt, Mycobacterium bovis subsp bovis AF2122/97
aacccucgccggu

SEQ ID NO: 1203894 - RNA, 23 nt, Mycobacterium bovis subsp bovis AF2122/97
aacccuagggcggugccgccgga

SEQ ID NO: 1203895 - RNA, 14 nt, Mycobacterium bovis subsp bovis AF2122/97
aaccgaauuguugu

SEQ ID NO: 1203896 - RNA, 23 nt, Mycobacterium bovis subsp bovis AF2122/97
aaccgaagccucggcaugcagcc

SEQ ID NO: 1203897 - RNA, 17 nt, Mycobacterium bovis subsp bovis AF2122/97
aacccggcuccagcacc

SEQ ID NO: 1203898 - RNA, 20 nt, Mycobacterium bovis subsp bovis AF2122/97
aacccgggcagcaucaacac

SEQ ID NO: 1203899 - RNA, 12 nt, Mycobacterium bovis subsp bovis AF2122/97
aacccggcggca

SEQ ID NO: 1203900 - RNA, 21 nt, Mycobacterium bovis subsp bovis AF2122/97
aacccguaggguggccgacga

SEQ ID NO: 1203901 - RNA, 15 nt, Mycobacterium bovis subsp bovis AF2122/97
aacccgucgagccgu

SEQ ID NO: 1203902 - RNA, 18 nt, Mycobacterium bovis subsp bovis AF2122/97
aacccggauacaacacag

SEQ ID NO: 1203903 - RNA, 14 nt, Mycobacterium bovis subsp bovis AF2122/97
aaccccuugccuuc

SEQ ID NO: 1203904 - RNA, 22 nt, Mycobacterium bovis subsp bovis AF2122/97
aaccccggccaccagcaugccu

SEQ ID NO: 1203905 - RNA, 19 nt, Mycobacterium bovis subsp bovis AF2122/97
aaccccgaagaccuggccu

SEQ ID NO: 1203906 - RNA, 13 nt, Mycobacterium bovis subsp bovis AF2122/97
aacccccggggcg

SEQ ID NO: 1203907 - RNA, 18 nt, Mycobacterium bovis subsp bovis AF2122/97
aaccccaucagaaugccu

SEQ ID NO: 1203908 - RNA, 18 nt, Mycobacterium bovis subsp bovis AF2122/97
aaccccaaguccagcagc

SEQ ID NO: 1203909 - RNA, 17 nt, Mycobacterium bovis subsp bovis AF2122/97
aaccgccccgugggccu

SEQ ID NO: 1203910 - RNA, 19 nt, Mycobacterium bovis subsp bovis AF2122/97
aaccgccccgugggccucg

SEQ ID NO: 1203911 - RNA, 13 nt, Mycobacterium bovis subsp bovis AF2122/97
aaccgcggaucga

SEQ ID NO: 1203912 - RNA, 16 nt, Mycobacterium bovis subsp bovis AF2122/97
aaccgauugagcccca

SEQ ID NO: 1203913 - RNA, 15 nt, Mycobacterium bovis subsp bovis AF2122/97
aaccgcaguucuuga

SEQ ID NO: 1203914 - RNA, 16 nt, Mycobacterium bovis subsp bovis AF2122/97
aaccgggcaaaucaag

SEQ ID NO: 1203915 - RNA, 20 nt, Mycobacterium bovis subsp bovis AF2122/97
aaccgggcagcaaaaaccag

SEQ ID NO: 1203916 - RNA, 22 nt, Mycobacterium bovis subsp bovis AF2122/97
aaccggucgauccccacaauca

SEQ ID NO: 1203917 - RNA, 14 nt, Mycobacterium bovis subsp bovis AF2122/97
aaccggucgcagug

SEQ ID NO: 1203918 - RNA, 15 nt, Mycobacterium bovis subsp bovis AF2122/97
aaccggucgcagugc

SEQ ID NO: 1203919 - RNA, 19 nt, Mycobacterium bovis subsp bovis AF2122/97
aaccggcgcaguagccgac

SEQ ID NO: 1203920 - RNA, 22 nt, Mycobacterium bovis subsp bovis AF2122/97
aaccggcauaacgaucccguga

SEQ ID NO: 1203921 - RNA, 19 nt, Mycobacterium bovis subsp bovis AF2122/97
aaccggaccuggguggcgu

SEQ ID NO: 1203922 - RNA, 22 nt, Mycobacterium bovis subsp bovis AF2122/97
aaccuguuccagcgugccuggu

SEQ ID NO: 1203923 - RNA, 17 nt, Mycobacterium bovis subsp bovis AF2122/97
aacgacaacacccacgu

SEQ ID NO: 1203924 - RNA, 16 nt, Mycobacterium bovis subsp bovis AF2122/97
aacgacacgccgcucc

SEQ ID NO: 1203925 - RNA, 20 nt, Mycobacterium bovis subsp bovis AF2122/97
aaccucaucgcggucgccac

SEQ ID NO: 1203926 - RNA, 19 nt, Mycobacterium bovis subsp bovis AF2122/97
aaccucggaucgccaggcc

SEQ ID NO: 1203927 - RNA, 19 nt, Mycobacterium bovis subsp bovis AF2122/97
aaccucgacgcccgcccug

SEQ ID NO: 1203928 - RNA, 16 nt, Mycobacterium bovis subsp bovis AF2122/97
aaccugcgaccaggcg

SEQ ID NO: 1203929 - RNA, 15 nt, Mycobacterium bovis subsp bovis AF2122/97
aaccuggcggucccg

SEQ ID NO: 1203930 - RNA, 19 nt, Mycobacterium bovis subsp bovis AF2122/97
aaccguuugacgcgcucgc

SEQ ID NO: 1203931 - RNA, 20 nt, Mycobacterium bovis subsp bovis AF2122/97
aaccguccccggcguccgac

SEQ ID NO: 1203932 - RNA, 19 nt, Mycobacterium bovis subsp bovis AF2122/97
aaccgugagcaccagcagc

SEQ ID NO: 1203933 - RNA, 21 nt, Mycobacterium bovis subsp bovis AF2122/97
aaccgugagcaccagcagcac

SEQ ID NO: 1203934 - RNA, 15 nt, Mycobacterium bovis subsp bovis AF2122/97
aaccgugcugggcau

SEQ ID NO: 1203935 - RNA, 13 nt, Mycobacterium bovis subsp bovis AF2122/97
aacgcaaagacag

SEQ ID NO: 1203936 - RNA, 16 nt, Mycobacterium bovis subsp bovis AF2122/97
aacgaugccgccggcg

SEQ ID NO: 1203937 - RNA, 22 nt, Mycobacterium bovis subsp bovis AF2122/97
aacgauggggcaagcccaaaaa

SEQ ID NO: 1203938 - RNA, 20 nt, Mycobacterium bovis subsp bovis AF2122/97
aacgaugguguaacggcggc

SEQ ID NO: 1203939 - RNA, 19 nt, Mycobacterium bovis subsp bovis AF2122/97
aacgaugaugaugaccaca

SEQ ID NO: 1203940 - RNA, 18 nt, Mycobacterium bovis subsp bovis AF2122/97
aacgcaggcagugagggu

SEQ ID NO: 1203941 - RNA, 14 nt, Mycobacterium bovis subsp bovis AF2122/97
aacgcagccagcgc

SEQ ID NO: 1203942 - RNA, 16 nt, Mycobacterium bovis subsp bovis AF2122/97
aacgaggucugcggcc

SEQ ID NO: 1203943 - RNA, 15 nt, Mycobacterium bovis subsp bovis AF2122/97
aacgaucagucgucu

SEQ ID NO: 1203944 - RNA, 18 nt, Mycobacterium bovis subsp bovis AF2122/97
aacgaucagucgucuuga

SEQ ID NO: 1203945 - RNA, 19 nt, Mycobacterium bovis subsp bovis AF2122/97
aacgacgucgccgacccgg

SEQ ID NO: 1203946 - RNA, 14 nt, Mycobacterium bovis subsp bovis AF2122/97
aacgacguugaucc

SEQ ID NO: 1203947 - RNA, 19 nt, Mycobacterium bovis subsp bovis AF2122/97
aacgaccuccacgcccugg

SEQ ID NO: 1203948 - RNA, 21 nt, Mycobacterium bovis subsp bovis AF2122/97
aacgacggccgucgccccaaa

SEQ ID NO: 1203949 - RNA, 21 nt, Mycobacterium bovis subsp bovis AF2122/97
aacgacuggguggugcucacc

SEQ ID NO: 1203950 - RNA, 20 nt, Mycobacterium bovis subsp bovis AF2122/97
aacgacuguggcgccgccgg

SEQ ID NO: 1203951 - RNA, 19 nt, Mycobacterium bovis subsp bovis AF2122/97
aacgagcaggauaaacccg

SEQ ID NO: 1203952 - RNA, 18 nt, Mycobacterium bovis subsp bovis AF2122/97
aacgagaugugagcacac

SEQ ID NO: 1203953 - RNA, 14 nt, Mycobacterium bovis subsp bovis AF2122/97
aacgccgccagcgc

SEQ ID NO: 1203954 - RNA, 22 nt, Mycobacterium bovis subsp bovis AF2122/97
aacgccgcccgcugggcucgcu

SEQ ID NO: 1203955 - RNA, 23 nt, Mycobacterium bovis subsp bovis AF2122/97
aacgccgucgucguagaacugca

SEQ ID NO: 1203956 - RNA, 19 nt, Mycobacterium bovis subsp bovis AF2122/97
aacgccucgccggccacca

SEQ ID NO: 1203957 - RNA, 14 nt, Mycobacterium bovis subsp bovis AF2122/97
aacgccagcaccag

SEQ ID NO: 1203958 - RNA, 17 nt, Mycobacterium bovis subsp bovis AF2122/97
aacgcccugacgguggu

SEQ ID NO: 1203959 - RNA, 11 nt, Mycobacterium bovis subsp bovis AF2122/97
aacgcccggcu

SEQ ID NO: 1203960 - RNA, 17 nt, Mycobacterium bovis subsp bovis AF2122/97
aacgccccggcgcggcc

SEQ ID NO: 1203961 - RNA, 22 nt, Mycobacterium bovis subsp bovis AF2122/97
aacgccacggcaucggccaccu

SEQ ID NO: 1203962 - RNA, 19 nt, Mycobacterium bovis subsp bovis AF2122/97
aacgccaccgucgcugccc

SEQ ID NO: 1203963 - RNA, 14 nt, Mycobacterium bovis subsp bovis AF2122/97
aacgcugcgcccgg

SEQ ID NO: 1203964 - RNA, 22 nt, Mycobacterium bovis subsp bovis AF2122/97
aacgcggugggcacagccagua

SEQ ID NO: 1203965 - RNA, 15 nt, Mycobacterium bovis subsp bovis AF2122/97
aacgcggcaccacgu

SEQ ID NO: 1203966 - RNA, 21 nt, Mycobacterium bovis subsp bovis AF2122/97
aacgcgcgcagccgggcaccg

SEQ ID NO: 1203967 - RNA, 17 nt, Mycobacterium bovis subsp bovis AF2122/97
aacggcacccugcggca

SEQ ID NO: 1203968 - RNA, 21 nt, Mycobacterium bovis subsp bovis AF2122/97
aacggauucccgcccagcagc

SEQ ID NO: 1203969 - RNA, 13 nt, Mycobacterium bovis subsp bovis AF2122/97
aacgcuuccagcg

SEQ ID NO: 1203970 - RNA, 15 nt, Mycobacterium bovis subsp bovis AF2122/97
aacgcuucugccugc

SEQ ID NO: 1203971 - RNA, 23 nt, Mycobacterium bovis subsp bovis AF2122/97
aacggggucaaucccacgcccgg

SEQ ID NO: 1203972 - RNA, 21 nt, Mycobacterium bovis subsp bovis AF2122/97
aacgggccggugcgcaccaga

SEQ ID NO: 1203973 - RNA, 17 nt, Mycobacterium bovis subsp bovis AF2122/97
aacgggcaaaccauugc

SEQ ID NO: 1203974 - RNA, 22 nt, Mycobacterium bovis subsp bovis AF2122/97
aacggcuuggcugccuccauca

SEQ ID NO: 1203975 - RNA, 13 nt, Mycobacterium bovis subsp bovis AF2122/97
aacggcggcaggc

SEQ ID NO: 1203976 - RNA, 16 nt, Mycobacterium bovis subsp bovis AF2122/97
aacggcggggccggcg

SEQ ID NO: 1203977 - RNA, 17 nt, Mycobacterium bovis subsp bovis AF2122/97
aacggcgguaagggcgg

SEQ ID NO: 1203978 - RNA, 20 nt, Mycobacterium bovis subsp bovis AF2122/97
aacggcacccugcggcaccu

SEQ ID NO: 1203979 - RNA, 18 nt, Mycobacterium bovis subsp bovis AF2122/97
aacgguacgccgccgcga

SEQ ID NO: 1203980 - RNA, 18 nt, Mycobacterium bovis subsp bovis AF2122/97
aacuacccgcccacggca

SEQ ID NO: 1203981 - RNA, 13 nt, Mycobacterium bovis subsp bovis AF2122/97
aacuaacggcagc

SEQ ID NO: 1203982 - RNA, 18 nt, Mycobacterium bovis subsp bovis AF2122/97
aacguuuugggcgccgga

SEQ ID NO: 1203983 - RNA, 20 nt, Mycobacterium bovis subsp bovis AF2122/97
aacgucgucgcgucgccagg

SEQ ID NO: 1203984 - RNA, 22 nt, Mycobacterium bovis subsp bovis AF2122/97
aacgucgucgcgucgccaggcc

SEQ ID NO: 1203985 - RNA, 22 nt, Mycobacterium bovis subsp bovis AF2122/97
aacgucacguggucggccaccc

SEQ ID NO: 1203986 - RNA, 12 nt, Mycobacterium bovis subsp bovis AF2122/97
aacgucagugcc

SEQ ID NO: 1203987 - RNA, 19 nt, Mycobacterium bovis subsp bovis AF2122/97
aacguauccccgaccacug

SEQ ID NO: 1203988 - RNA, 13 nt, Mycobacterium bovis subsp bovis AF2122/97
aacuccucgaccg

SEQ ID NO: 1203989 - RNA, 16 nt, Mycobacterium bovis subsp bovis AF2122/97
aacuccugcagcccgg

SEQ ID NO: 1203990 - RNA, 22 nt, Mycobacterium bovis subsp bovis AF2122/97
aacucgaagcgguguugccgga

SEQ ID NO: 1203991 - RNA, 19 nt, Mycobacterium bovis subsp bovis AF2122/97
aacuccagcacccgcugca

SEQ ID NO: 1203992 - RNA, 22 nt, Mycobacterium bovis subsp bovis AF2122/97
aacucaugcccgacgagucgcc

SEQ ID NO: 1203993 - RNA, 18 nt, Mycobacterium bovis subsp bovis AF2122/97
aacucaugggccaacuca

SEQ ID NO: 1203994 - RNA, 21 nt, Mycobacterium bovis subsp bovis AF2122/97
aacucacgcaggaaaaccccg

SEQ ID NO: 1203995 - RNA, 13 nt, Mycobacterium bovis subsp bovis AF2122/97
aacugggacugca

SEQ ID NO: 1203996 - RNA, 18 nt, Mycobacterium bovis subsp bovis AF2122/97
aacugggcggccuggucg

SEQ ID NO: 1203997 - RNA, 21 nt, Mycobacterium bovis subsp bovis AF2122/97
aacugggggccggcacugccg

SEQ ID NO: 1203998 - RNA, 21 nt, Mycobacterium bovis subsp bovis AF2122/97
aacuggaccggugccagcagu

SEQ ID NO: 1203999 - RNA, 14 nt, Mycobacterium bovis subsp bovis AF2122/97
aacuggaccacagc

SEQ ID NO: 1204000 - RNA, 12 nt, Mycobacterium bovis subsp bovis AF2122/97
aacuggacuggg

SEQ ID NO: 1204001 - RNA, 18 nt, Mycobacterium bovis subsp bovis AF2122/97
aacugcgccguucgcucc

SEQ ID NO: 1204002 - RNA, 20 nt, Mycobacterium bovis subsp bovis AF2122/97
aacugcgccguucgcucccc

SEQ ID NO: 1204003 - RNA, 21 nt, Mycobacterium bovis subsp bovis AF2122/97
aacugcgccguucgcuccccc

SEQ ID NO: 1204004 - RNA, 19 nt, Mycobacterium bovis subsp bovis AF2122/97
aacugccggacuaccgccg

SEQ ID NO: 1204005 - RNA, 22 nt, Mycobacterium bovis subsp bovis AF2122/97
aacugcagcggcuugcccaggc

SEQ ID NO: 1204006 - RNA, 20 nt, Mycobacterium bovis subsp bovis AF2122/97
aacuugacgaacucgccguc

SEQ ID NO: 1204007 - RNA, 21 nt, Mycobacterium bovis subsp bovis AF2122/97
aacuuggcggccagccgcucc

SEQ ID NO: 1204008 - RNA, 22 nt, Mycobacterium bovis subsp bovis AF2122/97
aacuucgacaacgcauccgaca

SEQ ID NO: 1204009 - RNA, 14 nt, Mycobacterium bovis subsp bovis AF2122/97
aacuucaacuggau

SEQ ID NO: 1204010 - RNA, 16 nt, Mycobacterium bovis subsp bovis AF2122/97
aagaaccugagcacca

SEQ ID NO: 1204011 - RNA, 12 nt, Mycobacterium bovis subsp bovis AF2122/97
aagaaccggcau

SEQ ID NO: 1204012 - RNA, 14 nt, Mycobacterium bovis subsp bovis AF2122/97
aagaacaugcucac

SEQ ID NO: 1204013 - RNA, 16 nt, Mycobacterium bovis subsp bovis AF2122/97
aagaagccgguguuga

SEQ ID NO: 1204014 - RNA, 12 nt, Mycobacterium bovis subsp bovis AF2122/97
aagaaggccagc

SEQ ID NO: 1204015 - RNA, 23 nt, Mycobacterium bovis subsp bovis AF2122/97
aagaaagacgcuguccaggucug

SEQ ID NO: 1204016 - RNA, 13 nt, Mycobacterium bovis subsp bovis AF2122/97
aauccacaaugcc

SEQ ID NO: 1204017 - RNA, 18 nt, Mycobacterium bovis subsp bovis AF2122/97
aauccacagauugauuua

SEQ ID NO: 1204018 - RNA, 16 nt, Mycobacterium bovis subsp bovis AF2122/97
aauccagcgccgaccu

SEQ ID NO: 1204019 - RNA, 19 nt, Mycobacterium bovis subsp bovis AF2122/97
aaucagggucugcgccgcc

SEQ ID NO: 1204020 - RNA, 19 nt, Mycobacterium bovis subsp bovis AF2122/97
aauccggcauacaucgccu

SEQ ID NO: 1204021 - RNA, 13 nt, Mycobacterium bovis subsp bovis AF2122/97
aauccgugcaggg

SEQ ID NO: 1204022 - RNA, 15 nt, Mycobacterium bovis subsp bovis AF2122/97
aauccggucgaugac

SEQ ID NO: 1204023 - RNA, 22 nt, Mycobacterium bovis subsp bovis AF2122/97
aauccggucggcccacacuagg

SEQ ID NO: 1204024 - RNA, 17 nt, Mycobacterium bovis subsp bovis AF2122/97
aauccugcgcugcacca

SEQ ID NO: 1204025 - RNA, 16 nt, Mycobacterium bovis subsp bovis AF2122/97
aauccugcgcugcacc

SEQ ID NO: 1204026 - RNA, 16 nt, Mycobacterium bovis subsp bovis AF2122/97
aauccgcacagguccg

SEQ ID NO: 1204027 - RNA, 22 nt, Mycobacterium bovis subsp bovis AF2122/97
aaucgcugaccgcguagaccag

SEQ ID NO: 1204028 - RNA, 21 nt, Mycobacterium bovis subsp bovis AF2122/97
aaucuaauucgccucgccuga

SEQ ID NO: 1204029 - RNA, 15 nt, Mycobacterium bovis subsp bovis AF2122/97
aaucgcccagugugc

SEQ ID NO: 1204030 - RNA, 18 nt, Mycobacterium bovis subsp bovis AF2122/97
aaucgcgucgagagaacg

SEQ ID NO: 1204031 - RNA, 14 nt, Mycobacterium bovis subsp bovis AF2122/97
aaucgccugcgaca

SEQ ID NO: 1204032 - RNA, 12 nt, Mycobacterium bovis subsp bovis AF2122/97
aaugccuggccc

SEQ ID NO: 1204033 - RNA, 21 nt, Mycobacterium bovis subsp bovis AF2122/97
aaugccggugccgggcaccac

SEQ ID NO: 1204034 - RNA, 21 nt, Mycobacterium bovis subsp bovis AF2122/97
aauggcgcugauggugcugcg

SEQ ID NO: 1204035 - RNA, 15 nt, Mycobacterium bovis subsp bovis AF2122/97
aaugcggucaacgac

SEQ ID NO: 1204036 - RNA, 19 nt, Mycobacterium bovis subsp bovis AF2122/97
aaugcgcuggcgccgccgg

SEQ ID NO: 1204037 - RNA, 14 nt, Mycobacterium bovis subsp bovis AF2122/97
aauggaccagcgcc

SEQ ID NO: 1204038 - RNA, 17 nt, Mycobacterium bovis subsp bovis AF2122/97
aauugcccuagcagcaa

SEQ ID NO: 1204039 - RNA, 13 nt, Mycobacterium bovis subsp bovis AF2122/97
aauugcccugacg

SEQ ID NO: 1204040 - RNA, 20 nt, Mycobacterium bovis subsp bovis AF2122/97
aauucuggugucaucaaucu

SEQ ID NO: 1204041 - RNA, 15 nt, Mycobacterium bovis subsp bovis AF2122/97
aauucgacugcaacu

SEQ ID NO: 1204042 - RNA, 16 nt, Mycobacterium bovis subsp bovis AF2122/97
aauuccgccugcuccu

SEQ ID NO: 1204043 - RNA, 17 nt, Mycobacterium bovis subsp bovis AF2122/97
aauuccggugaucgcgg

SEQ ID NO: 1204044 - RNA, 21 nt, Mycobacterium bovis subsp bovis AF2122/97
aauucgggcauggucgccgga

SEQ ID NO: 1204045 - RNA, 21 nt, Mycobacterium bovis subsp bovis AF2122/97
aauucguacagugucugccau

SEQ ID NO: 1204046 - RNA, 23 nt, Mycobacterium bovis subsp bovis AF2122/97
aauucauccauuucauucagugc

SEQ ID NO: 1204047 - RNA, 23 nt, Mycobacterium bovis subsp bovis AF2122/97
aauuccacaaauccaaaccuuug

SEQ ID NO: 1204048 - RNA, 17 nt, Mycobacterium bovis subsp bovis AF2122/97
aauagcccaagccgauc

SEQ ID NO: 1204049 - RNA, 13 nt, Mycobacterium bovis subsp bovis AF2122/97
aauacggcggcgc

SEQ ID NO: 1204050 - RNA, 14 nt, Mycobacterium bovis subsp bovis AF2122/97
aauaucucgccgua

SEQ ID NO: 1204051 - RNA, 17 nt, Mycobacterium bovis subsp bovis AF2122/97
aauaugccacagaccga

SEQ ID NO: 1204052 - RNA, 21 nt, Mycobacterium bovis subsp bovis AF2122/97
aauaugccacagaccgaacag

SEQ ID NO: 1204053 - RNA, 14 nt, Mycobacterium bovis subsp bovis AF2122/97
aauaugccgaugac

SEQ ID NO: 1204054 - RNA, 20 nt, Mycobacterium bovis subsp bovis AF2122/97
aaguggucuccggcaccgag

SEQ ID NO: 1204055 - RNA, 21 nt, Mycobacterium bovis subsp bovis AF2122/97
aagugcggugagauggcggug

SEQ ID NO: 1204056 - RNA, 18 nt, Mycobacterium bovis subsp bovis AF2122/97
aagugccucgcgggaagu

SEQ ID NO: 1204057 - RNA, 21 nt, Mycobacterium bovis subsp bovis AF2122/97
aagucuggagugaggcugugc

SEQ ID NO: 1204058 - RNA, 21 nt, Mycobacterium bovis subsp bovis AF2122/97
aagucgagcagauacagcgga

SEQ ID NO: 1204059 - RNA, 23 nt, Mycobacterium bovis subsp bovis AF2122/97
aagucgcccagucccaggugcug

SEQ ID NO: 1204060 - RNA, 15 nt, Mycobacterium bovis subsp bovis AF2122/97
aagucgcauggcggc

SEQ ID NO: 1204061 - RNA, 19 nt, Mycobacterium bovis subsp bovis AF2122/97
aagucucccggccgcaccc

SEQ ID NO: 1204062 - RNA, 19 nt, Mycobacterium bovis subsp bovis AF2122/97
aaguagccgacuaucggcc

SEQ ID NO: 1204063 - RNA, 22 nt, Mycobacterium bovis subsp bovis AF2122/97
aaguagccgaccggcagcgaug

SEQ ID NO: 1204064 - RNA, 22 nt, Mycobacterium bovis subsp bovis AF2122/97
aaguagguuuucggcggcucua

SEQ ID NO: 1204065 - RNA, 17 nt, Mycobacterium bovis subsp bovis AF2122/97
aaguagucgaaggucag

SEQ ID NO: 1204066 - RNA, 17 nt, Mycobacterium bovis subsp bovis AF2122/97
aagggucaucgccagcg

SEQ ID NO: 1204067 - RNA, 17 nt, Mycobacterium bovis subsp bovis AF2122/97
aaggggugugugcugcc

SEQ ID NO: 1204068 - RNA, 21 nt, Mycobacterium bovis subsp bovis AF2122/97
aagggauccgaagagccagca

SEQ ID NO: 1204069 - RNA, 24 nt, Mycobacterium bovis subsp bovis AF2122/97
aagggcaaccgccccuucccagua

SEQ ID NO: 1204070 - RNA, 14 nt, Mycobacterium bovis subsp bovis AF2122/97
aagggccggauggg

SEQ ID NO: 1204071 - RNA, 17 nt, Mycobacterium bovis subsp bovis AF2122/97
aaggauugcggaaaccc

SEQ ID NO: 1204072 - RNA, 21 nt, Mycobacterium bovis subsp bovis AF2122/97
aaggaugcugucagacggcgu

SEQ ID NO: 1204073 - RNA, 15 nt, Mycobacterium bovis subsp bovis AF2122/97
aaggcucaccaggcg

SEQ ID NO: 1204074 - RNA, 15 nt, Mycobacterium bovis subsp bovis AF2122/97
aaguacuccauggca

SEQ ID NO: 1204075 - RNA, 14 nt, Mycobacterium bovis subsp bovis AF2122/97
aaggucggccaggc

SEQ ID NO: 1204076 - RNA, 12 nt, Mycobacterium bovis subsp bovis AF2122/97
aagguccgugcc

SEQ ID NO: 1204077 - RNA, 20 nt, Mycobacterium bovis subsp bovis AF2122/97
aagguccgugccgaugccgg

SEQ ID NO: 1204078 - RNA, 22 nt, Mycobacterium bovis subsp bovis AF2122/97
aagguccgugccgaugccggcg

SEQ ID NO: 1204079 - RNA, 16 nt, Mycobacterium bovis subsp bovis AF2122/97
aagccgagcaucagau

SEQ ID NO: 1204080 - RNA, 14 nt, Mycobacterium bovis subsp bovis AF2122/97
aagccgacgaccag

SEQ ID NO: 1204081 - RNA, 15 nt, Mycobacterium bovis subsp bovis AF2122/97
aagccgagcaucaga

SEQ ID NO: 1204082 - RNA, 15 nt, Mycobacterium bovis subsp bovis AF2122/97
aagcccuggccagcg

SEQ ID NO: 1204083 - RNA, 17 nt, Mycobacterium bovis subsp bovis AF2122/97
aagcccuuguagcacac

SEQ ID NO: 1204084 - RNA, 20 nt, Mycobacterium bovis subsp bovis AF2122/97
aagccgaacaccgucagcgu

SEQ ID NO: 1204085 - RNA, 14 nt, Mycobacterium bovis subsp bovis AF2122/97
aagccgaccuucuc

SEQ ID NO: 1204086 - RNA, 14 nt, Mycobacterium bovis subsp bovis AF2122/97
aagcccuccucgau

SEQ ID NO: 1204087 - RNA, 19 nt, Mycobacterium bovis subsp bovis AF2122/97
aagcccgucgcggccggcg

SEQ ID NO: 1204088 - RNA, 21 nt, Mycobacterium bovis subsp bovis AF2122/97
aagcccgucgucgugcacgac

SEQ ID NO: 1204089 - RNA, 16 nt, Mycobacterium bovis subsp bovis AF2122/97
aagcccgagacggugu

SEQ ID NO: 1204090 - RNA, 18 nt, Mycobacterium bovis subsp bovis AF2122/97
aagcccauccccgcucga

SEQ ID NO: 1204091 - RNA, 16 nt, Mycobacterium bovis subsp bovis AF2122/97
aagccagcgcagccag

SEQ ID NO: 1204092 - RNA, 17 nt, Mycobacterium bovis subsp bovis AF2122/97
aagccguagaccaggcc

SEQ ID NO: 1204093 - RNA, 21 nt, Mycobacterium bovis subsp bovis AF2122/97
aagccgugcaccagcgaccag

SEQ ID NO: 1204094 - RNA, 15 nt, Mycobacterium bovis subsp bovis AF2122/97
aagccucagccgcuc

SEQ ID NO: 1204095 - RNA, 14 nt, Mycobacterium bovis subsp bovis AF2122/97
aagccggccacgca

SEQ ID NO: 1204096 - RNA, 13 nt, Mycobacterium bovis subsp bovis AF2122/97
aagccggccacua

SEQ ID NO: 1204097 - RNA, 14 nt, Mycobacterium bovis subsp bovis AF2122/97
aagccggccgggaa

SEQ ID NO: 1204098 - RNA, 23 nt, Mycobacterium bovis subsp bovis AF2122/97
aagccggcguuuaucagcaagag

SEQ ID NO: 1204099 - RNA, 21 nt, Mycobacterium bovis subsp bovis AF2122/97
aagccgggauugccgccaccu

SEQ ID NO: 1204100 - RNA, 22 nt, Mycobacterium bovis subsp bovis AF2122/97
aagccgcggcuaggccagcacg

SEQ ID NO: 1204101 - RNA, 14 nt, Mycobacterium bovis subsp bovis AF2122/97
aagccgcgcugcga

SEQ ID NO: 1204102 - RNA, 20 nt, Mycobacterium bovis subsp bovis AF2122/97
aagccgcggcuaggccagca

SEQ ID NO: 1204103 - RNA, 15 nt, Mycobacterium bovis subsp bovis AF2122/97
aagcgacgagcagca

SEQ ID NO: 1204104 - RNA, 17 nt, Mycobacterium bovis subsp bovis AF2122/97
aagcgacgagcagcaau

SEQ ID NO: 1204105 - RNA, 12 nt, Mycobacterium bovis subsp bovis AF2122/97
aagcgagcagcu

SEQ ID NO: 1204106 - RNA, 16 nt, Mycobacterium bovis subsp bovis AF2122/97
aagcgaugccgugcug

SEQ ID NO: 1204107 - RNA, 22 nt, Mycobacterium bovis subsp bovis AF2122/97
aaggacggcagccaccagcgac

SEQ ID NO: 1204108 - RNA, 17 nt, Mycobacterium bovis subsp bovis AF2122/97
aaggacggcagccacca

SEQ ID NO: 1204109 - RNA, 14 nt, Mycobacterium bovis subsp bovis AF2122/97
aaggaaccgggcaa

SEQ ID NO: 1204110 - RNA, 17 nt, Mycobacterium bovis subsp bovis AF2122/97
aagcuucggccuucuug

SEQ ID NO: 1204111 - RNA, 17 nt, Mycobacterium bovis subsp bovis AF2122/97
aagcugagucgugacaa

SEQ ID NO: 1204112 - RNA, 22 nt, Mycobacterium bovis subsp bovis AF2122/97
aagcugagucgugacaaccauc

SEQ ID NO: 1204113 - RNA, 16 nt, Mycobacterium bovis subsp bovis AF2122/97
aagcugaccgccagcg

SEQ ID NO: 1204114 - RNA, 23 nt, Mycobacterium bovis subsp bovis AF2122/97
aagcgcgcgcgugaagaacacgu

SEQ ID NO: 1204115 - RNA, 15 nt, Mycobacterium bovis subsp bovis AF2122/97
aagcgcgguugcgcu

SEQ ID NO: 1204116 - RNA, 23 nt, Mycobacterium bovis subsp bovis AF2122/97
aagcgcguuguugucgaucagaa

SEQ ID NO: 1204117 - RNA, 22 nt, Mycobacterium bovis subsp bovis AF2122/97
aagcggcugcccgagaucgcgu

SEQ ID NO: 1204118 - RNA, 18 nt, Mycobacterium bovis subsp bovis AF2122/97
aagcgccgaaacagcacc

SEQ ID NO: 1204119 - RNA, 15 nt, Mycobacterium bovis subsp bovis AF2122/97
aagcucacacuggcu

SEQ ID NO: 1204120 - RNA, 17 nt, Mycobacterium bovis subsp bovis AF2122/97
aagcucacacuggcuuu

SEQ ID NO: 1204121 - RNA, 13 nt, Mycobacterium bovis subsp bovis AF2122/97
aagcucagcuucu

SEQ ID NO: 1204122 - RNA, 21 nt, Mycobacterium bovis subsp bovis AF2122/97
uucuuggcgggcgccuugguc

SEQ ID NO: 1204123 - RNA, 16 nt, Mycobacterium bovis subsp bovis AF2122/97
uucuuggcgucuugga

SEQ ID NO: 1204124 - RNA, 22 nt, Mycobacterium bovis subsp bovis AF2122/97
uugagccgggcaaccagcagca

SEQ ID NO: 1204125 - RNA, 14 nt, Mycobacterium bovis subsp bovis AF2122/97
uugaggccggugaa

SEQ ID NO: 1204126 - RNA, 21 nt, Mycobacterium bovis subsp bovis AF2122/97
uugauguugccggaguugaag

SEQ ID NO: 1204127 - RNA, 16 nt, Mycobacterium bovis subsp bovis AF2122/97
uugaugcgugguuggc

SEQ ID NO: 1204128 - RNA, 16 nt, Mycobacterium bovis subsp bovis AF2122/97
uugaucgccggccugc

SEQ ID NO: 1204129 - RNA, 21 nt, Mycobacterium bovis subsp bovis AF2122/97
uugaucgacaacgcggcaccu

SEQ ID NO: 1204130 - RNA, 17 nt, Mycobacterium bovis subsp bovis AF2122/97
uugcagucgcgagguga

SEQ ID NO: 1204131 - RNA, 23 nt, Mycobacterium bovis subsp bovis AF2122/97
uugcagccggcauagcggcccau

SEQ ID NO: 1204132 - RNA, 23 nt, Mycobacterium bovis subsp bovis AF2122/97
uugcacucggcgcccuccuuggc

SEQ ID NO: 1204133 - RNA, 15 nt, Mycobacterium bovis subsp bovis AF2122/97
uugcacugcucguug

SEQ ID NO: 1204134 - RNA, 17 nt, Mycobacterium bovis subsp bovis AF2122/97
uugcacuguggaagaac

SEQ ID NO: 1204135 - RNA, 13 nt, Mycobacterium bovis subsp bovis AF2122/97
uugcaucaugccg

SEQ ID NO: 1204136 - RNA, 23 nt, Mycobacterium bovis subsp bovis AF2122/97
uugccaccgcuguucuuggugac

SEQ ID NO: 1204137 - RNA, 14 nt, Mycobacterium bovis subsp bovis AF2122/97
uugccacggcgccu

SEQ ID NO: 1204138 - RNA, 19 nt, Mycobacterium bovis subsp bovis AF2122/97
uugcgaaacgaauccgcca

SEQ ID NO: 1204139 - RNA, 13 nt, Mycobacterium bovis subsp bovis AF2122/97
uugcgaagcccac

SEQ ID NO: 1204140 - RNA, 12 nt, Mycobacterium bovis subsp bovis AF2122/97
uugcgcuuguug

SEQ ID NO: 1204141 - RNA, 15 nt, Mycobacterium bovis subsp bovis AF2122/97
uugcgcggucucgag

SEQ ID NO: 1204142 - RNA, 18 nt, Mycobacterium bovis subsp bovis AF2122/97
uugcggccgaauuccuca

SEQ ID NO: 1204143 - RNA, 13 nt, Mycobacterium bovis subsp bovis AF2122/97
uugcgggcgugga

SEQ ID NO: 1204144 - RNA, 23 nt, Mycobacterium bovis subsp bovis AF2122/97
uugcgggggaguaguggugggcg

SEQ ID NO: 1204145 - RNA, 16 nt, Mycobacterium bovis subsp bovis AF2122/97
uugcgggugguccagc

SEQ ID NO: 1204146 - RNA, 18 nt, Mycobacterium bovis subsp bovis AF2122/97
uugcggggugcucagcga

SEQ ID NO: 1204147 - RNA, 12 nt, Mycobacterium bovis subsp bovis AF2122/97
uugccggugcgc

SEQ ID NO: 1204148 - RNA, 19 nt, Mycobacterium bovis subsp bovis AF2122/97
uugccggcguugccgccgu

SEQ ID NO: 1204149 - RNA, 17 nt, Mycobacterium bovis subsp bovis AF2122/97
uugccucccuuuuccaa

SEQ ID NO: 1204150 - RNA, 20 nt, Mycobacterium bovis subsp bovis AF2122/97
uugccguuaccgccaaacgc

SEQ ID NO: 1204151 - RNA, 14 nt, Mycobacterium bovis subsp bovis AF2122/97
uugccagaucagca

SEQ ID NO: 1204152 - RNA, 23 nt, Mycobacterium bovis subsp bovis AF2122/97
uugccaggugcuguuugguugcg

SEQ ID NO: 1204153 - RNA, 14 nt, Mycobacterium bovis subsp bovis AF2122/97
uugcccaacaccca

SEQ ID NO: 1204154 - RNA, 19 nt, Mycobacterium bovis subsp bovis AF2122/97
uugcccaagcgcguuguug

SEQ ID NO: 1204155 - RNA, 23 nt, Mycobacterium bovis subsp bovis AF2122/97
uuggcaaagccgaaaucacugag

SEQ ID NO: 1204156 - RNA, 15 nt, Mycobacterium bovis subsp bovis AF2122/97
uuggaucccagcccg

SEQ ID NO: 1204157 - RNA, 14 nt, Mycobacterium bovis subsp bovis AF2122/97
uuggcaagcacgcg

SEQ ID NO: 1204158 - RNA, 15 nt, Mycobacterium bovis subsp bovis AF2122/97
uuggcaagcacggcg

SEQ ID NO: 1204159 - RNA, 16 nt, Mycobacterium bovis subsp bovis AF2122/97
uuggcagggccagcgg

SEQ ID NO: 1204160 - RNA, 15 nt, Mycobacterium bovis subsp bovis AF2122/97
uuggcagcccucugg

SEQ ID NO: 1204161 - RNA, 18 nt, Mycobacterium bovis subsp bovis AF2122/97
uugcgguaagccggcgug

SEQ ID NO: 1204162 - RNA, 16 nt, Mycobacterium bovis subsp bovis AF2122/97
uuggcguugaccagca

SEQ ID NO: 1204163 - RNA, 15 nt, Mycobacterium bovis subsp bovis AF2122/97
uuggcgucagcagca

SEQ ID NO: 1204164 - RNA, 16 nt, Mycobacterium bovis subsp bovis AF2122/97
uuggcgucagcagcaa

SEQ ID NO: 1204165 - RNA, 19 nt, Mycobacterium bovis subsp bovis AF2122/97
uuggcggaacuguagguca

SEQ ID NO: 1204166 - RNA, 15 nt, Mycobacterium bovis subsp bovis AF2122/97
uuggcucgggccaga

SEQ ID NO: 1204167 - RNA, 17 nt, Mycobacterium bovis subsp bovis AF2122/97
uuggcugccuccaucaa

SEQ ID NO: 1204168 - RNA, 16 nt, Mycobacterium bovis subsp bovis AF2122/97
uuggccggcgcugccc

SEQ ID NO: 1204169 - RNA, 17 nt, Mycobacterium bovis subsp bovis AF2122/97
uuggccguaccggugau

SEQ ID NO: 1204170 - RNA, 18 nt, Mycobacterium bovis subsp bovis AF2122/97
uuggccgccacaccgccg

SEQ ID NO: 1204171 - RNA, 16 nt, Mycobacterium bovis subsp bovis AF2122/97
uuggccgauguuguug

SEQ ID NO: 1204172 - RNA, 14 nt, Mycobacterium bovis subsp bovis AF2122/97
uuggccgcaaggcg

SEQ ID NO: 1204173 - RNA, 22 nt, Mycobacterium bovis subsp bovis AF2122/97
uuggccaugcuggucagcggcg

SEQ ID NO: 1204174 - RNA, 22 nt, Mycobacterium bovis subsp bovis AF2122/97
uuggcauugccgccagcccagc

SEQ ID NO: 1204175 - RNA, 23 nt, Mycobacterium bovis subsp bovis AF2122/97
uuggccaaccccauggccagcgc

SEQ ID NO: 1204176 - RNA, 20 nt, Mycobacterium bovis subsp bovis AF2122/97
uuggccaccaucgccgccgu

SEQ ID NO: 1204177 - RNA, 13 nt, Mycobacterium bovis subsp bovis AF2122/97
uuggccaccgccg

SEQ ID NO: 1204178 - RNA, 13 nt, Mycobacterium bovis subsp bovis AF2122/97
uuggcgaagcccg

SEQ ID NO: 1204179 - RNA, 16 nt, Mycobacterium bovis subsp bovis AF2122/97
uuggccgucaucuccg

SEQ ID NO: 1204180 - RNA, 21 nt, Mycobacterium bovis subsp bovis AF2122/97
uuggccucgagcgcuguggcc

SEQ ID NO: 1204181 - RNA, 12 nt, Mycobacterium bovis subsp bovis AF2122/97
uuggccugccgu

SEQ ID NO: 1204182 - RNA, 17 nt, Mycobacterium bovis subsp bovis AF2122/97
uuggcgccaaaaaggau

SEQ ID NO: 1204183 - RNA, 21 nt, Mycobacterium bovis subsp bovis AF2122/97
uuggcgccaccagucacgccc

SEQ ID NO: 1204184 - RNA, 15 nt, Mycobacterium bovis subsp bovis AF2122/97
uuggcgcgcagguag

SEQ ID NO: 1204185 - RNA, 13 nt, Mycobacterium bovis subsp bovis AF2122/97
uuggcgaucagca

SEQ ID NO: 1204186 - RNA, 16 nt, Mycobacterium bovis subsp bovis AF2122/97
uuggccuguucaacuc

SEQ ID NO: 1204187 - RNA, 22 nt, Mycobacterium bovis subsp bovis AF2122/97
uugguggauucgaucaggccuu

SEQ ID NO: 1204188 - RNA, 19 nt, Mycobacterium bovis subsp bovis AF2122/97
uugguggucgccacccgac

SEQ ID NO: 1204189 - RNA, 17 nt, Mycobacterium bovis subsp bovis AF2122/97
uuggugggccagcagca

SEQ ID NO: 1204190 - RNA, 15 nt, Mycobacterium bovis subsp bovis AF2122/97
uugguucuccccgcu

SEQ ID NO: 1204191 - RNA, 15 nt, Mycobacterium bovis subsp bovis AF2122/97
uuggugaggugguca

SEQ ID NO: 1204192 - RNA, 21 nt, Mycobacterium bovis subsp bovis AF2122/97
uuggugcccgacuugacggcg

SEQ ID NO: 1204193 - RNA, 18 nt, Mycobacterium bovis subsp bovis AF2122/97
uuggucgccgcuuucuug

SEQ ID NO: 1204194 - RNA, 16 nt, Mycobacterium bovis subsp bovis AF2122/97
uugguaguccugcuug

SEQ ID NO: 1204195 - RNA, 17 nt, Mycobacterium bovis subsp bovis AF2122/97
uugggugggugcagcac

SEQ ID NO: 1204196 - RNA, 17 nt, Mycobacterium bovis subsp bovis AF2122/97
uugggugccguugcguc

SEQ ID NO: 1204197 - RNA, 19 nt, Mycobacterium bovis subsp bovis AF2122/97
uuggguagcaaaccccgga

SEQ ID NO: 1204198 - RNA, 21 nt, Mycobacterium bovis subsp bovis AF2122/97
uugggcgcgggugcgccggcg

SEQ ID NO: 1204199 - RNA, 22 nt, Mycobacterium bovis subsp bovis AF2122/97
uugggcuuagggcgcccgcccc

SEQ ID NO: 1204200 - RNA, 22 nt, Mycobacterium bovis subsp bovis AF2122/97
uuggggcgcgugggcgugcagg

SEQ ID NO: 1204201 - RNA, 15 nt, Mycobacterium bovis subsp bovis AF2122/97
uugguagccagggcg

SEQ ID NO: 1204202 - RNA, 22 nt, Mycobacterium bovis subsp bovis AF2122/97
uugguagccggccgcuuggccg

SEQ ID NO: 1204203 - RNA, 18 nt, Mycobacterium bovis subsp bovis AF2122/97
uuggguuuuguuuggaga

SEQ ID NO: 1204204 - RNA, 14 nt, Mycobacterium bovis subsp bovis AF2122/97
uugugcugggugcc

SEQ ID NO: 1204205 - RNA, 15 nt, Mycobacterium bovis subsp bovis AF2122/97
uugugccuuagcugc

SEQ ID NO: 1204206 - RNA, 22 nt, Mycobacterium bovis subsp bovis AF2122/97
uugugaacggugucaacggcac

SEQ ID NO: 1204207 - RNA, 17 nt, Mycobacterium bovis subsp bovis AF2122/97
uugugacggugaauuca

SEQ ID NO: 1204208 - RNA, 21 nt, Mycobacterium bovis subsp bovis AF2122/97
uugucuagcggucgcuugcug

SEQ ID NO: 1204209 - RNA, 15 nt, Mycobacterium bovis subsp bovis AF2122/97
uugucgcggagucug

SEQ ID NO: 1204210 - RNA, 17 nt, Mycobacterium bovis subsp bovis AF2122/97
uuguggucgaguugaag

SEQ ID NO: 1204211 - RNA, 21 nt, Mycobacterium bovis subsp bovis AF2122/97
uugugggugcgacggcaggua

SEQ ID NO: 1204212 - RNA, 11 nt, Mycobacterium bovis subsp bovis AF2122/97
uuguucaacuc

SEQ ID NO: 1204213 - RNA, 23 nt, Mycobacterium bovis subsp bovis AF2122/97
uuguucgugaagcgggugccauc

SEQ ID NO: 1204214 - RNA, 18 nt, Mycobacterium bovis subsp bovis AF2122/97
uuguaggacaagugccgg

SEQ ID NO: 1204215 - RNA, 17 nt, Mycobacterium bovis subsp bovis AF2122/97
uuguagacggcaccccc

SEQ ID NO: 1204216 - RNA, 15 nt, Mycobacterium bovis subsp bovis AF2122/97
uugucgcggucagga

SEQ ID NO: 1204217 - RNA, 23 nt, Mycobacterium bovis subsp bovis AF2122/97
uugucgccggcauacaccgugac

SEQ ID NO: 1204218 - RNA, 13 nt, Mycobacterium bovis subsp bovis AF2122/97
uugucgcgcagca

SEQ ID NO: 1204219 - RNA, 22 nt, Mycobacterium bovis subsp bovis AF2122/97
uugucgaucagaaucugccucu

SEQ ID NO: 1204220 - RNA, 18 nt, Mycobacterium bovis subsp bovis AF2122/97
uuguccuaauucggggcc

SEQ ID NO: 1204221 - RNA, 22 nt, Mycobacterium bovis subsp bovis AF2122/97
uugucccuauaccgcuggggcu

SEQ ID NO: 1204222 - RNA, 12 nt, Mycobacterium bovis subsp bovis AF2122/97
uugucaaccaau

SEQ ID NO: 1204223 - RNA, 16 nt, Mycobacterium bovis subsp bovis AF2122/97
uuguaugcugcgcgcc

SEQ ID NO: 1204224 - RNA, 12 nt, Mycobacterium bovis subsp bovis AF2122/97
uucccggcucga

SEQ ID NO: 1204225 - RNA, 15 nt, Mycobacterium bovis subsp bovis AF2122/97
uuccccuguugcccc

SEQ ID NO: 1204226 - RNA, 15 nt, Mycobacterium bovis subsp bovis AF2122/97
uucccgcuugagcag

SEQ ID NO: 1204227 - RNA, 19 nt, Mycobacterium bovis subsp bovis AF2122/97
uuccgccggccccaccggu

SEQ ID NO: 1204228 - RNA, 17 nt, Mycobacterium bovis subsp bovis AF2122/97
uuccgcgaaggucucga

SEQ ID NO: 1204229 - RNA, 17 nt, Mycobacterium bovis subsp bovis AF2122/97
uucccuuguucccgaaa

SEQ ID NO: 1204230 - RNA, 18 nt, Mycobacterium bovis subsp bovis AF2122/97
uuccgcaaugaccuggcc

SEQ ID NO: 1204231 - RNA, 19 nt, Mycobacterium bovis subsp bovis AF2122/97
uuccgucugacccaccgcc

SEQ ID NO: 1204232 - RNA, 18 nt, Mycobacterium bovis subsp bovis AF2122/97
uuccugacgccauucauc

SEQ ID NO: 1204233 - RNA, 19 nt, Mycobacterium bovis subsp bovis AF2122/97
uucgaagggguacccgccc

SEQ ID NO: 1204234 - RNA, 13 nt, Mycobacterium bovis subsp bovis AF2122/97
uucgacaggccac

SEQ ID NO: 1204235 - RNA, 24 nt, Mycobacterium bovis subsp bovis AF2122/97
uucgacaggccaccgcagacgccg

SEQ ID NO: 1204236 - RNA, 16 nt, Mycobacterium bovis subsp bovis AF2122/97
uucgacgacagcaccg

SEQ ID NO: 1204237 - RNA, 13 nt, Mycobacterium bovis subsp bovis AF2122/97
uucgacccagcgg

SEQ ID NO: 1204238 - RNA, 18 nt, Mycobacterium bovis subsp bovis AF2122/97
uucgcccacagcuugccc

SEQ ID NO: 1204239 - RNA, 22 nt, Mycobacterium bovis subsp bovis AF2122/97
uucgccccugcacagcaggcuc

SEQ ID NO: 1204240 - RNA, 14 nt, Mycobacterium bovis subsp bovis AF2122/97
uucgcccuugccgc

SEQ ID NO: 1204241 - RNA, 13 nt, Mycobacterium bovis subsp bovis AF2122/97
uucgccagcgccg

SEQ ID NO: 1204242 - RNA, 18 nt, Mycobacterium bovis subsp bovis AF2122/97
uucgauugcgcugcaccg

SEQ ID NO: 1204243 - RNA, 21 nt, Mycobacterium bovis subsp bovis AF2122/97
uucgacggcggccaaggucga

SEQ ID NO: 1204244 - RNA, 14 nt, Mycobacterium bovis subsp bovis AF2122/97
uucgagugcagcgg

SEQ ID NO: 1204245 - RNA, 14 nt, Mycobacterium bovis subsp bovis AF2122/97
uucgagguggcugc

SEQ ID NO: 1204246 - RNA, 15 nt, Mycobacterium bovis subsp bovis AF2122/97
uucgaugccagugca

SEQ ID NO: 1204247 - RNA, 13 nt, Mycobacterium bovis subsp bovis AF2122/97
uucgaucaggccu

SEQ ID NO: 1204248 - RNA, 15 nt, Mycobacterium bovis subsp bovis AF2122/97
uucggggugcgccca

SEQ ID NO: 1204249 - RNA, 18 nt, Mycobacterium bovis subsp bovis AF2122/97
uucgggucgaucaccgac

SEQ ID NO: 1204250 - RNA, 18 nt, Mycobacterium bovis subsp bovis AF2122/97
uucgggcucguccagcaa

SEQ ID NO: 1204251 - RNA, 18 nt, Mycobacterium bovis subsp bovis AF2122/97
uucgggacgcgagugcgu

SEQ ID NO: 1204252 - RNA, 20 nt, Mycobacterium bovis subsp bovis AF2122/97
uucgguaggcaggccggcuc

SEQ ID NO: 1204253 - RNA, 15 nt, Mycobacterium bovis subsp bovis AF2122/97
uucgucgaaccuguc

SEQ ID NO: 1204254 - RNA, 22 nt, Mycobacterium bovis subsp bovis AF2122/97
uucgugaagcgggugccaucgg

SEQ ID NO: 1204255 - RNA, 15 nt, Mycobacterium bovis subsp bovis AF2122/97
uucgugagcggccag

SEQ ID NO: 1204256 - RNA, 22 nt, Mycobacterium bovis subsp bovis AF2122/97
uucgucgcggguguuccacacc

SEQ ID NO: 1204257 - RNA, 16 nt, Mycobacterium bovis subsp bovis AF2122/97
uucgucggagaacgcc

SEQ ID NO: 1204258 - RNA, 15 nt, Mycobacterium bovis subsp bovis AF2122/97
uucggcggucagcgg

SEQ ID NO: 1204259 - RNA, 17 nt, Mycobacterium bovis subsp bovis AF2122/97
uucggcgcugccaggcc

SEQ ID NO: 1204260 - RNA, 13 nt, Mycobacterium bovis subsp bovis AF2122/97
uucggcugccacc

SEQ ID NO: 1204261 - RNA, 20 nt, Mycobacterium bovis subsp bovis AF2122/97
uucggcugcgaaagccacuc

SEQ ID NO: 1204262 - RNA, 17 nt, Mycobacterium bovis subsp bovis AF2122/97
uucggccaacccgggcc

SEQ ID NO: 1204263 - RNA, 17 nt, Mycobacterium bovis subsp bovis AF2122/97
uucggccgaccgggcuc

SEQ ID NO: 1204264 - RNA, 18 nt, Mycobacterium bovis subsp bovis AF2122/97
uucggaugucccuugacg

SEQ ID NO: 1204265 - RNA, 16 nt, Mycobacterium bovis subsp bovis AF2122/97
uucggcagccaugcgg

SEQ ID NO: 1204266 - RNA, 19 nt, Mycobacterium bovis subsp bovis AF2122/97
uucggcaggaaugccgcgg

SEQ ID NO: 1204267 - RNA, 17 nt, Mycobacterium bovis subsp bovis AF2122/97
uucgcgugccagcgccc

SEQ ID NO: 1204268 - RNA, 18 nt, Mycobacterium bovis subsp bovis AF2122/97
uucgcgguagccgcggcc

SEQ ID NO: 1204269 - RNA, 16 nt, Mycobacterium bovis subsp bovis AF2122/97
uucuccucgugcagca

SEQ ID NO: 1204270 - RNA, 16 nt, Mycobacterium bovis subsp bovis AF2122/97
uucugacggcuugcgu

SEQ ID NO: 1204271 - RNA, 13 nt, Mycobacterium bovis subsp bovis AF2122/97
uucuggaaccccg

SEQ ID NO: 1204272 - RNA, 21 nt, Mycobacterium bovis subsp bovis AF2122/97
uucuggaaccccgagcugcca

SEQ ID NO: 1204273 - RNA, 14 nt, Mycobacterium bovis subsp bovis AF2122/97
uucuccagcucgaa

SEQ ID NO: 1204274 - RNA, 12 nt, Mycobacterium bovis subsp bovis AF2122/97
uucuagcccguu

SEQ ID NO: 1204275 - RNA, 18 nt, Mycobacterium bovis subsp bovis AF2122/97
uucuucaccgccuugguc

SEQ ID NO: 1204276 - RNA, 14 nt, Mycobacterium bovis subsp bovis AF2122/97
uucuucggacagca

SEQ ID NO: 1204277 - RNA, 15 nt, Mycobacterium bovis subsp bovis AF2122/97
uucuucggccagcuc

SEQ ID NO: 1204278 - RNA, 15 nt, Mycobacterium bovis subsp bovis AF2122/97
uucuucgcgaagaac

SEQ ID NO: 1204279 - RNA, 17 nt, Mycobacterium bovis subsp bovis AF2122/97
uucuucgcuaccuucuu

SEQ ID NO: 1204280 - RNA, 14 nt, Mycobacterium bovis subsp bovis AF2122/97
uucugguccagcac

SEQ ID NO: 1204281 - RNA, 15 nt, Mycobacterium bovis subsp bovis AF2122/97
uuccaagccgaccug

SEQ ID NO: 1204282 - RNA, 14 nt, Mycobacterium bovis subsp bovis AF2122/97
uuccaacuccugca

SEQ ID NO: 1204283 - RNA, 13 nt, Mycobacterium bovis subsp bovis AF2122/97
uuccaacaccaac

SEQ ID NO: 1204284 - RNA, 19 nt, Mycobacterium bovis subsp bovis AF2122/97
uuccaaaaucaucugcaca

SEQ ID NO: 1204285 - RNA, 20 nt, Mycobacterium bovis subsp bovis AF2122/97
uuccaaagggaguguuuggg

SEQ ID NO: 1204286 - RNA, 21 nt, Mycobacterium bovis subsp bovis AF2122/97
uuccaaagggaguguuugggu

SEQ ID NO: 1204287 - RNA, 14 nt, Mycobacterium bovis subsp bovis AF2122/97
uucaugaugacaau

SEQ ID NO: 1204288 - RNA, 22 nt, Mycobacterium bovis subsp bovis AF2122/97
uucaugcccguccugcaggaag

SEQ ID NO: 1204289 - RNA, 16 nt, Mycobacterium bovis subsp bovis AF2122/97
uucaucacgccgccgg

SEQ ID NO: 1204290 - RNA, 10 nt, Mycobacterium bovis subsp bovis AF2122/97
uucagcgcca

SEQ ID NO: 1204291 - RNA, 17 nt, Mycobacterium bovis subsp bovis AF2122/97
uucagguccaccgcugc

SEQ ID NO: 1204292 - RNA, 14 nt, Mycobacterium bovis subsp bovis AF2122/97
uucagcgccagcgc

SEQ ID NO: 1204293 - RNA, 22 nt, Mycobacterium bovis subsp bovis AF2122/97
uucaguucggccgucauggccc

SEQ ID NO: 1204294 - RNA, 18 nt, Mycobacterium bovis subsp bovis AF2122/97
uuauucacccgguaggug

SEQ ID NO: 1204295 - RNA, 15 nt, Mycobacterium bovis subsp bovis AF2122/97
uuagggcgcccgccc

SEQ ID NO: 1204296 - RNA, 22 nt, Mycobacterium bovis subsp bovis AF2122/97
uucaacucgggcagcuucaaca

SEQ ID NO: 1204297 - RNA, 14 nt, Mycobacterium bovis subsp bovis AF2122/97
uucacuggucuccc

SEQ ID NO: 1204298 - RNA, 19 nt, Mycobacterium bovis subsp bovis AF2122/97
ugggcaccuuggccaggaa

SEQ ID NO: 1204299 - RNA, 20 nt, Mycobacterium bovis subsp bovis AF2122/97
ugggcagaccgaucggcagg

SEQ ID NO: 1204300 - RNA, 19 nt, Mycobacterium bovis subsp bovis AF2122/97
ugggcagauauugccugcc

SEQ ID NO: 1204301 - RNA, 14 nt, Mycobacterium bovis subsp bovis AF2122/97
ugggcgccacagcc

SEQ ID NO: 1204302 - RNA, 19 nt, Mycobacterium bovis subsp bovis AF2122/97
ugggcgccgacaccggcug

SEQ ID NO: 1204303 - RNA, 15 nt, Mycobacterium bovis subsp bovis AF2122/97
ugggcagcagcgcgc

SEQ ID NO: 1204304 - RNA, 19 nt, Mycobacterium bovis subsp bovis AF2122/97
ugggcagccagaucuccag

SEQ ID NO: 1204305 - RNA, 16 nt, Mycobacterium bovis subsp bovis AF2122/97
ugggcggcccaccggc

SEQ ID NO: 1204306 - RNA, 17 nt, Mycobacterium bovis subsp bovis AF2122/97
ugggcggcccaccggcc

SEQ ID NO: 1204307 - RNA, 19 nt, Mycobacterium bovis subsp bovis AF2122/97
ugggcggccgggcucccca

SEQ ID NO: 1204308 - RNA, 19 nt, Mycobacterium bovis subsp bovis AF2122/97
ugggcgcggcaggccuggc

SEQ ID NO: 1204309 - RNA, 21 nt, Mycobacterium bovis subsp bovis AF2122/97
ugggcguacucggcgcgcagc

SEQ ID NO: 1204310 - RNA, 18 nt, Mycobacterium bovis subsp bovis AF2122/97
ugggcgugacgggcagga

SEQ ID NO: 1204311 - RNA, 16 nt, Mycobacterium bovis subsp bovis AF2122/97
ugggcgugcaggcugg

SEQ ID NO: 1204312 - RNA, 18 nt, Mycobacterium bovis subsp bovis AF2122/97
ugggcggcucgucgauug

SEQ ID NO: 1204313 - RNA, 16 nt, Mycobacterium bovis subsp bovis AF2122/97
ugggcgggauggccgc

SEQ ID NO: 1204314 - RNA, 15 nt, Mycobacterium bovis subsp bovis AF2122/97
ugggcguuggcggca

SEQ ID NO: 1204315 - RNA, 24 nt, Mycobacterium bovis subsp bovis AF2122/97
ugggcuaccgagauugggcuggga

SEQ ID NO: 1204316 - RNA, 18 nt, Mycobacterium bovis subsp bovis AF2122/97
ugggugcgucgacccagc

SEQ ID NO: 1204317 - RNA, 17 nt, Mycobacterium bovis subsp bovis AF2122/97
ugggucuggcaggccag

SEQ ID NO: 1204318 - RNA, 17 nt, Mycobacterium bovis subsp bovis AF2122/97
uggggcuauggcgcagc

SEQ ID NO: 1204319 - RNA, 21 nt, Mycobacterium bovis subsp bovis AF2122/97
uggggccgggcuccucugguu

SEQ ID NO: 1204320 - RNA, 23 nt, Mycobacterium bovis subsp bovis AF2122/97
uggggcagucccggugggcggcu

SEQ ID NO: 1204321 - RNA, 21 nt, Mycobacterium bovis subsp bovis AF2122/97
uggggcagccgggcgucgcug

SEQ ID NO: 1204322 - RNA, 22 nt, Mycobacterium bovis subsp bovis AF2122/97
uggggaucgaccauggucgauu

SEQ ID NO: 1204323 - RNA, 21 nt, Mycobacterium bovis subsp bovis AF2122/97
uggcguugaggacguggacuu

SEQ ID NO: 1204324 - RNA, 14 nt, Mycobacterium bovis subsp bovis AF2122/97
uggcguuguugacg

SEQ ID NO: 1204325 - RNA, 12 nt, Mycobacterium bovis subsp bovis AF2122/97
uggcgugcagca

SEQ ID NO: 1204326 - RNA, 14 nt, Mycobacterium bovis subsp bovis AF2122/97
uggcgucggccagg

SEQ ID NO: 1204327 - RNA, 11 nt, Mycobacterium bovis subsp bovis AF2122/97
uggcgugcaga

SEQ ID NO: 1204328 - RNA, 11 nt, Mycobacterium bovis subsp bovis AF2122/97
uggcgugcagc

SEQ ID NO: 1204329 - RNA, 15 nt, Mycobacterium bovis subsp bovis AF2122/97
uggcuucaacccggg

SEQ ID NO: 1204330 - RNA, 21 nt, Mycobacterium bovis subsp bovis AF2122/97
ugggcaauccggucagcgcgg

SEQ ID NO: 1204331 - RNA, 15 nt, Mycobacterium bovis subsp bovis AF2122/97
ugggauaccccuccg

SEQ ID NO: 1204332 - RNA, 19 nt, Mycobacterium bovis subsp bovis AF2122/97
ugggaucccagcgcagcgg

SEQ ID NO: 1204333 - RNA, 21 nt, Mycobacterium bovis subsp bovis AF2122/97
ugggauagcgcgguuggcuga

SEQ ID NO: 1204334 - RNA, 14 nt, Mycobacterium bovis subsp bovis AF2122/97
ugggagucccacca

SEQ ID NO: 1204335 - RNA, 20 nt, Mycobacterium bovis subsp bovis AF2122/97
ugggagcuacccgggccagg

SEQ ID NO: 1204336 - RNA, 20 nt, Mycobacterium bovis subsp bovis AF2122/97
uggucagugugaacuguccc

SEQ ID NO: 1204337 - RNA, 24 nt, Mycobacterium bovis subsp bovis AF2122/97
uggucagccgcggcggcagcaccc

SEQ ID NO: 1204338 - RNA, 13 nt, Mycobacterium bovis subsp bovis AF2122/97
uggucagcuggcc

SEQ ID NO: 1204339 - RNA, 20 nt, Mycobacterium bovis subsp bovis AF2122/97
uggucagccgcggcggcagc

SEQ ID NO: 1204340 - RNA, 15 nt, Mycobacterium bovis subsp bovis AF2122/97
uggucagcagcucca

SEQ ID NO: 1204341 - RNA, 17 nt, Mycobacterium bovis subsp bovis AF2122/97
uggucagcagauccgcg

SEQ ID NO: 1204342 - RNA, 15 nt, Mycobacterium bovis subsp bovis AF2122/97
uggucaccaccauca

SEQ ID NO: 1204343 - RNA, 21 nt, Mycobacterium bovis subsp bovis AF2122/97
uggucacgguucgcccgucgc

SEQ ID NO: 1204344 - RNA, 20 nt, Mycobacterium bovis subsp bovis AF2122/97
uggucacgcagucgggcagc

SEQ ID NO: 1204345 - RNA, 19 nt, Mycobacterium bovis subsp bovis AF2122/97
uggucaagacccgcaucca

SEQ ID NO: 1204346 - RNA, 14 nt, Mycobacterium bovis subsp bovis AF2122/97
uggucgcgccaccc

SEQ ID NO: 1204347 - RNA, 20 nt, Mycobacterium bovis subsp bovis AF2122/97
uggucgcggucccacggccg

SEQ ID NO: 1204348 - RNA, 13 nt, Mycobacterium bovis subsp bovis AF2122/97
uggucggccaccc

SEQ ID NO: 1204349 - RNA, 13 nt, Mycobacterium bovis subsp bovis AF2122/97
uggucgccccgau

SEQ ID NO: 1204350 - RNA, 18 nt, Mycobacterium bovis subsp bovis AF2122/97
uggucgccgcuuucuugg

SEQ ID NO: 1204351 - RNA, 18 nt, Mycobacterium bovis subsp bovis AF2122/97
uggucgcaccgccggccu

SEQ ID NO: 1204352 - RNA, 21 nt, Mycobacterium bovis subsp bovis AF2122/97
uggucgcaggauucccagucc

SEQ ID NO: 1204353 - RNA, 16 nt, Mycobacterium bovis subsp bovis AF2122/97
uggucgacgccgagac

SEQ ID NO: 1204354 - RNA, 20 nt, Mycobacterium bovis subsp bovis AF2122/97
uggucgacgucgguguaacc

SEQ ID NO: 1204355 - RNA, 15 nt, Mycobacterium bovis subsp bovis AF2122/97
uggucgagggcggcg

SEQ ID NO: 1204356 - RNA, 14 nt, Mycobacterium bovis subsp bovis AF2122/97
uggucgagugcgau

SEQ ID NO: 1204357 - RNA, 16 nt, Mycobacterium bovis subsp bovis AF2122/97
uggucgaucagguacu

SEQ ID NO: 1204358 - RNA, 18 nt, Mycobacterium bovis subsp bovis AF2122/97
uggucgauggcguacagc

SEQ ID NO: 1204359 - RNA, 22 nt, Mycobacterium bovis subsp bovis AF2122/97
uggucgaaacgguacgccgccg

SEQ ID NO: 1204360 - RNA, 20 nt, Mycobacterium bovis subsp bovis AF2122/97
ugguccuuguugugguggag

SEQ ID NO: 1204361 - RNA, 19 nt, Mycobacterium bovis subsp bovis AF2122/97
uggucccgaugaccuugcc

SEQ ID NO: 1204362 - RNA, 21 nt, Mycobacterium bovis subsp bovis AF2122/97
uggucccgagggcggcagcua

SEQ ID NO: 1204363 - RNA, 23 nt, Mycobacterium bovis subsp bovis AF2122/97
ugguccugauguucugcgggggu

SEQ ID NO: 1204364 - RNA, 18 nt, Mycobacterium bovis subsp bovis AF2122/97
ugguccaggcccuggcca

SEQ ID NO: 1204365 - RNA, 17 nt, Mycobacterium bovis subsp bovis AF2122/97
ugguccaaccagcacca

SEQ ID NO: 1204366 - RNA, 23 nt, Mycobacterium bovis subsp bovis AF2122/97
uggguuucaaagcgacagcgcgg

SEQ ID NO: 1204367 - RNA, 20 nt, Mycobacterium bovis subsp bovis AF2122/97
uggguugaaaacgcccggca

SEQ ID NO: 1204368 - RNA, 19 nt, Mycobacterium bovis subsp bovis AF2122/97
uggguugauuggccccggc

SEQ ID NO: 1204369 - RNA, 17 nt, Mycobacterium bovis subsp bovis AF2122/97
uggguugccagcgacgc

SEQ ID NO: 1204370 - RNA, 19 nt, Mycobacterium bovis subsp bovis AF2122/97
uggguguugcuggccgcga

SEQ ID NO: 1204371 - RNA, 20 nt, Mycobacterium bovis subsp bovis AF2122/97
uggguguugcuggccgcgau

SEQ ID NO: 1204372 - RNA, 13 nt, Mycobacterium bovis subsp bovis AF2122/97
ugguaaccagggc

SEQ ID NO: 1204373 - RNA, 16 nt, Mycobacterium bovis subsp bovis AF2122/97
ugguaaccagggcagc

SEQ ID NO: 1204374 - RNA, 13 nt, Mycobacterium bovis subsp bovis AF2122/97
ugguaccccagca

SEQ ID NO: 1204375 - RNA, 19 nt, Mycobacterium bovis subsp bovis AF2122/97
ugguaccggcggcgccgga

SEQ ID NO: 1204376 - RNA, 15 nt, Mycobacterium bovis subsp bovis AF2122/97
ugguaucugucggga

SEQ ID NO: 1204377 - RNA, 16 nt, Mycobacterium bovis subsp bovis AF2122/97
ugguauggguccucga

SEQ ID NO: 1204378 - RNA, 22 nt, Mycobacterium bovis subsp bovis AF2122/97
uggcgaaucuuugguagucugc

SEQ ID NO: 1204379 - RNA, 21 nt, Mycobacterium bovis subsp bovis AF2122/97
uggcgagggcuaccggcgccg

SEQ ID NO: 1204380 - RNA, 23 nt, Mycobacterium bovis subsp bovis AF2122/97
uggcgccgaaaaggucggggaac

SEQ ID NO: 1204381 - RNA, 18 nt, Mycobacterium bovis subsp bovis AF2122/97
uggcgcccgucuccagca

SEQ ID NO: 1204382 - RNA, 14 nt, Mycobacterium bovis subsp bovis AF2122/97
uggcgcccgugccg

SEQ ID NO: 1204383 - RNA, 14 nt, Mycobacterium bovis subsp bovis AF2122/97
uggcgcccgggccc

SEQ ID NO: 1204384 - RNA, 13 nt, Mycobacterium bovis subsp bovis AF2122/97
uggcgcccgucuc

SEQ ID NO: 1204385 - RNA, 15 nt, Mycobacterium bovis subsp bovis AF2122/97
uggcgaucuccagcg

SEQ ID NO: 1204386 - RNA, 18 nt, Mycobacterium bovis subsp bovis AF2122/97
uggcgaucaugagcagca

SEQ ID NO: 1204387 - RNA, 13 nt, Mycobacterium bovis subsp bovis AF2122/97
uggcgaucccgcc

SEQ ID NO: 1204388 - RNA, 20 nt, Mycobacterium bovis subsp bovis AF2122/97
uggcgccgccggcaccgccg

SEQ ID NO: 1204389 - RNA, 13 nt, Mycobacterium bovis subsp bovis AF2122/97
uggcgccgcgccg

SEQ ID NO: 1204390 - RNA, 14 nt, Mycobacterium bovis subsp bovis AF2122/97
uggcgccggccagc

SEQ ID NO: 1204391 - RNA, 12 nt, Mycobacterium bovis subsp bovis AF2122/97
uggcgccggccg

SEQ ID NO: 1204392 - RNA, 14 nt, Mycobacterium bovis subsp bovis AF2122/97
uggcgccggggccg

SEQ ID NO: 1204393 - RNA, 18 nt, Mycobacterium bovis subsp bovis AF2122/97
uggcgccggggccgccga

SEQ ID NO: 1204394 - RNA, 15 nt, Mycobacterium bovis subsp bovis AF2122/97
uggcgcugaagccga

SEQ ID NO: 1204395 - RNA, 15 nt, Mycobacterium bovis subsp bovis AF2122/97
uggcgccgucggccg

SEQ ID NO: 1204396 - RNA, 23 nt, Mycobacterium bovis subsp bovis AF2122/97
uggcgguguaacccggaaccagc

SEQ ID NO: 1204397 - RNA, 14 nt, Mycobacterium bovis subsp bovis AF2122/97
uggcggugcgcagc

SEQ ID NO: 1204398 - RNA, 22 nt, Mycobacterium bovis subsp bovis AF2122/97
uggcggucggcagaccgaccuc

SEQ ID NO: 1204399 - RNA, 20 nt, Mycobacterium bovis subsp bovis AF2122/97
uggcgguccggaaauuccgg

SEQ ID NO: 1204400 - RNA, 19 nt, Mycobacterium bovis subsp bovis AF2122/97
uggcgggucggucgguaac

SEQ ID NO: 1204401 - RNA, 22 nt, Mycobacterium bovis subsp bovis AF2122/97
uggcgggugacuucguggccuu

SEQ ID NO: 1204402 - RNA, 19 nt, Mycobacterium bovis subsp bovis AF2122/97
uggcggccagcgcaccgcc

SEQ ID NO: 1204403 - RNA, 15 nt, Mycobacterium bovis subsp bovis AF2122/97
uggcggccagcgcac

SEQ ID NO: 1204404 - RNA, 21 nt, Mycobacterium bovis subsp bovis AF2122/97
uggcggcauacauccaggcug

SEQ ID NO: 1204405 - RNA, 22 nt, Mycobacterium bovis subsp bovis AF2122/97
uggcgggaucgagagccgaccg

SEQ ID NO: 1204406 - RNA, 21 nt, Mycobacterium bovis subsp bovis AF2122/97
uggcggcuucgccccgaggau

SEQ ID NO: 1204407 - RNA, 15 nt, Mycobacterium bovis subsp bovis AF2122/97
uggcgcugcuggcag

SEQ ID NO: 1204408 - RNA, 15 nt, Mycobacterium bovis subsp bovis AF2122/97
uggcgcugcucugag

SEQ ID NO: 1204409 - RNA, 16 nt, Mycobacterium bovis subsp bovis AF2122/97
uggcgcuucggccacu

SEQ ID NO: 1204410 - RNA, 20 nt, Mycobacterium bovis subsp bovis AF2122/97
uggcggcaggugcggcggca

SEQ ID NO: 1204411 - RNA, 19 nt, Mycobacterium bovis subsp bovis AF2122/97
uggcggcagguguuggugc

SEQ ID NO: 1204412 - RNA, 21 nt, Mycobacterium bovis subsp bovis AF2122/97
uggcggcagguguuggugcgg

SEQ ID NO: 1204413 - RNA, 17 nt, Mycobacterium bovis subsp bovis AF2122/97
uggcggacagggcggca

SEQ ID NO: 1204414 - RNA, 20 nt, Mycobacterium bovis subsp bovis AF2122/97
uggcggaauucaggaagggc

SEQ ID NO: 1204415 - RNA, 19 nt, Mycobacterium bovis subsp bovis AF2122/97
uggccgcgcaggggcggcg

SEQ ID NO: 1204416 - RNA, 15 nt, Mycobacterium bovis subsp bovis AF2122/97
uggccgcgcaggcuu

SEQ ID NO: 1204417 - RNA, 17 nt, Mycobacterium bovis subsp bovis AF2122/97
uggccgcgccggucguc

SEQ ID NO: 1204418 - RNA, 17 nt, Mycobacterium bovis subsp bovis AF2122/97
uggccgcgccucggucu

SEQ ID NO: 1204419 - RNA, 22 nt, Mycobacterium bovis subsp bovis AF2122/97
uggccgcggcggucugggugag

SEQ ID NO: 1204420 - RNA, 20 nt, Mycobacterium bovis subsp bovis AF2122/97
uggccgcgcucaucgcggcg

SEQ ID NO: 1204421 - RNA, 17 nt, Mycobacterium bovis subsp bovis AF2122/97
uggccgccggcgcuggc

SEQ ID NO: 1204422 - RNA, 14 nt, Mycobacterium bovis subsp bovis AF2122/97
uggccgccgggcag

SEQ ID NO: 1204423 - RNA, 14 nt, Mycobacterium bovis subsp bovis AF2122/97
uggccgccgucgac

SEQ ID NO: 1204424 - RNA, 16 nt, Mycobacterium bovis subsp bovis AF2122/97
uggccgccgccccggc

SEQ ID NO: 1204425 - RNA, 10 nt, Mycobacterium bovis subsp bovis AF2122/97
uggccgccgg

SEQ ID NO: 1204426 - RNA, 18 nt, Mycobacterium bovis subsp bovis AF2122/97
uggccgccggcgccgcca

SEQ ID NO: 1204427 - RNA, 21 nt, Mycobacterium bovis subsp bovis AF2122/97
uggccgccgcgaggaugcuga

SEQ ID NO: 1204428 - RNA, 17 nt, Mycobacterium bovis subsp bovis AF2122/97
uggccgccgccaccugu

SEQ ID NO: 1204429 - RNA, 15 nt, Mycobacterium bovis subsp bovis AF2122/97
uggccgccccggccg

SEQ ID NO: 1204430 - RNA, 15 nt, Mycobacterium bovis subsp bovis AF2122/97
uggccgcugccagcc

SEQ ID NO: 1204431 - RNA, 18 nt, Mycobacterium bovis subsp bovis AF2122/97
uggccgcucuccaccccg

SEQ ID NO: 1204432 - RNA, 20 nt, Mycobacterium bovis subsp bovis AF2122/97
uggccggaucgaagaccagc

SEQ ID NO: 1204433 - RNA, 14 nt, Mycobacterium bovis subsp bovis AF2122/97
uggccgcugugggc

SEQ ID NO: 1204434 - RNA, 15 nt, Mycobacterium bovis subsp bovis AF2122/97
uggccggcaggucca

SEQ ID NO: 1204435 - RNA, 18 nt, Mycobacterium bovis subsp bovis AF2122/97
uggccgugcccgaaggaa

SEQ ID NO: 1204436 - RNA, 17 nt, Mycobacterium bovis subsp bovis AF2122/97
uggccgucgggugcagc

SEQ ID NO: 1204437 - RNA, 22 nt, Mycobacterium bovis subsp bovis AF2122/97
uggccgucagccaggugcccaa

SEQ ID NO: 1204438 - RNA, 15 nt, Mycobacterium bovis subsp bovis AF2122/97
uggccgucgcuggug

SEQ ID NO: 1204439 - RNA, 19 nt, Mycobacterium bovis subsp bovis AF2122/97
uggccgucgcugguggcgg

SEQ ID NO: 1204440 - RNA, 20 nt, Mycobacterium bovis subsp bovis AF2122/97
uggccgggucgaucaccgac

SEQ ID NO: 1204441 - RNA, 19 nt, Mycobacterium bovis subsp bovis AF2122/97
uggccgggucgucuuccag

SEQ ID NO: 1204442 - RNA, 20 nt, Mycobacterium bovis subsp bovis AF2122/97
uggccguaccggugaucgug

SEQ ID NO: 1204443 - RNA, 21 nt, Mycobacterium bovis subsp bovis AF2122/97
uggccggcgcugcccgggcug

SEQ ID NO: 1204444 - RNA, 14 nt, Mycobacterium bovis subsp bovis AF2122/97
uggccucgaagggc

SEQ ID NO: 1204445 - RNA, 18 nt, Mycobacterium bovis subsp bovis AF2122/97
uggccucccacucaccca

SEQ ID NO: 1204446 - RNA, 19 nt, Mycobacterium bovis subsp bovis AF2122/97
uggccguggucgagguggg

SEQ ID NO: 1204447 - RNA, 19 nt, Mycobacterium bovis subsp bovis AF2122/97
uggccuuugagcgcggcca

SEQ ID NO: 1204448 - RNA, 13 nt, Mycobacterium bovis subsp bovis AF2122/97
uggcgaacagcac

SEQ ID NO: 1204449 - RNA, 18 nt, Mycobacterium bovis subsp bovis AF2122/97
uggcgaaggacaacagcc

SEQ ID NO: 1204450 - RNA, 19 nt, Mycobacterium bovis subsp bovis AF2122/97
uggcgaaggacaacagccg

SEQ ID NO: 1204451 - RNA, 23 nt, Mycobacterium bovis subsp bovis AF2122/97
uggccaggcccaagccguggccg

SEQ ID NO: 1204452 - RNA, 16 nt, Mycobacterium bovis subsp bovis AF2122/97
uggccagccagcgggu

SEQ ID NO: 1204453 - RNA, 21 nt, Mycobacterium bovis subsp bovis AF2122/97
uggccagcgcggcgucgccuu

SEQ ID NO: 1204454 - RNA, 19 nt, Mycobacterium bovis subsp bovis AF2122/97
uggccgcaaggcguguagc

SEQ ID NO: 1204455 - RNA, 18 nt, Mycobacterium bovis subsp bovis AF2122/97
uggccgaugugggcggag

SEQ ID NO: 1204456 - RNA, 20 nt, Mycobacterium bovis subsp bovis AF2122/97
uggccgauuccgcgcguccg

SEQ ID NO: 1204457 - RNA, 16 nt, Mycobacterium bovis subsp bovis AF2122/97
uggccgcaucgccuca

SEQ ID NO: 1204458 - RNA, 17 nt, Mycobacterium bovis subsp bovis AF2122/97
uggccgagcagggccgg

SEQ ID NO: 1204459 - RNA, 14 nt, Mycobacterium bovis subsp bovis AF2122/97
uggccaugcucuug

SEQ ID NO: 1204460 - RNA, 13 nt, Mycobacterium bovis subsp bovis AF2122/97
uggccgaugagcc

SEQ ID NO: 1204461 - RNA, 11 nt, Mycobacterium bovis subsp bovis AF2122/97
uggccaccacc

SEQ ID NO: 1204462 - RNA, 17 nt, Mycobacterium bovis subsp bovis AF2122/97
uggccagcagcagcgcu

SEQ ID NO: 1204463 - RNA, 15 nt, Mycobacterium bovis subsp bovis AF2122/97
uggccagcagcagcg

SEQ ID NO: 1204464 - RNA, 13 nt, Mycobacterium bovis subsp bovis AF2122/97
uggccagcagccg

SEQ ID NO: 1204465 - RNA, 24 nt, Mycobacterium bovis subsp bovis AF2122/97
uggccaccaaacgcugcuggcaug

SEQ ID NO: 1204466 - RNA, 18 nt, Mycobacterium bovis subsp bovis AF2122/97
uggccacacucagcaccc

SEQ ID NO: 1204467 - RNA, 17 nt, Mycobacterium bovis subsp bovis AF2122/97
uggccaaccccauggcc

SEQ ID NO: 1204468 - RNA, 13 nt, Mycobacterium bovis subsp bovis AF2122/97
uggcagcgcaccc

SEQ ID NO: 1204469 - RNA, 18 nt, Mycobacterium bovis subsp bovis AF2122/97
uggcagcgcggccgggcg

SEQ ID NO: 1204470 - RNA, 13 nt, Mycobacterium bovis subsp bovis AF2122/97
uggcagccugcug

SEQ ID NO: 1204471 - RNA, 14 nt, Mycobacterium bovis subsp bovis AF2122/97
uggcagccugcugc

SEQ ID NO: 1204472 - RNA, 19 nt, Mycobacterium bovis subsp bovis AF2122/97
uggcagcgccgauggccgc

SEQ ID NO: 1204473 - RNA, 14 nt, Mycobacterium bovis subsp bovis AF2122/97
uggcagccccagcu

SEQ ID NO: 1204474 - RNA, 15 nt, Mycobacterium bovis subsp bovis AF2122/97
uggcagccagcggcg

SEQ ID NO: 1204475 - RNA, 16 nt, Mycobacterium bovis subsp bovis AF2122/97
uggcagcgguguagcc

SEQ ID NO: 1204476 - RNA, 23 nt, Mycobacterium bovis subsp bovis AF2122/97
uggcagcgguguagccggcgccg

SEQ ID NO: 1204477 - RNA, 22 nt, Mycobacterium bovis subsp bovis AF2122/97
uggcagcggccuccgggccaug

SEQ ID NO: 1204478 - RNA, 21 nt, Mycobacterium bovis subsp bovis AF2122/97
uggcaccgucagaccauccag

SEQ ID NO: 1204479 - RNA, 14 nt, Mycobacterium bovis subsp bovis AF2122/97
uggcaccucgcccu

SEQ ID NO: 1204480 - RNA, 16 nt, Mycobacterium bovis subsp bovis AF2122/97
uggcaccgacagcagu

SEQ ID NO: 1204481 - RNA, 19 nt, Mycobacterium bovis subsp bovis AF2122/97
uggcacaguccgcgaagug

SEQ ID NO: 1204482 - RNA, 23 nt, Mycobacterium bovis subsp bovis AF2122/97
uggcaaccgaauugaacugagga

SEQ ID NO: 1204483 - RNA, 14 nt, Mycobacterium bovis subsp bovis AF2122/97
ugcguucggccggg

SEQ ID NO: 1204484 - RNA, 17 nt, Mycobacterium bovis subsp bovis AF2122/97
ugcguucggccgggccg

SEQ ID NO: 1204485 - RNA, 14 nt, Mycobacterium bovis subsp bovis AF2122/97
ugcguucgccgccc

SEQ ID NO: 1204486 - RNA, 17 nt, Mycobacterium bovis subsp bovis AF2122/97
uggauucuucagcgcgg

SEQ ID NO: 1204487 - RNA, 16 nt, Mycobacterium bovis subsp bovis AF2122/97
ugcguucaucauccac

SEQ ID NO: 1204488 - RNA, 19 nt, Mycobacterium bovis subsp bovis AF2122/97
ugcguuccaucgccgacgc

SEQ ID NO: 1204489 - RNA, 21 nt, Mycobacterium bovis subsp bovis AF2122/97
uggauuggcgucagcagcaac

SEQ ID NO: 1204490 - RNA, 19 nt, Mycobacterium bovis subsp bovis AF2122/97
uggauuggcgucagcagca

SEQ ID NO: 1204491 - RNA, 14 nt, Mycobacterium bovis subsp bovis AF2122/97
uggugaccugacgc

SEQ ID NO: 1204492 - RNA, 22 nt, Mycobacterium bovis subsp bovis AF2122/97
uggugacguagauguugccgcc

SEQ ID NO: 1204493 - RNA, 15 nt, Mycobacterium bovis subsp bovis AF2122/97
ugguuucacuacggg

SEQ ID NO: 1204494 - RNA, 21 nt, Mycobacterium bovis subsp bovis AF2122/97
uguaacccguuaccgauuggc

SEQ ID NO: 1204495 - RNA, 15 nt, Mycobacterium bovis subsp bovis AF2122/97
uguagggcuuccagg

SEQ ID NO: 1204496 - RNA, 23 nt, Mycobacterium bovis subsp bovis AF2122/97
uguagucgauguacaccggcugg

SEQ ID NO: 1204497 - RNA, 15 nt, Mycobacterium bovis subsp bovis AF2122/97
uguaguagagccugg

SEQ ID NO: 1204498 - RNA, 23 nt, Mycobacterium bovis subsp bovis AF2122/97
uguaguccucgguggccuucugg

SEQ ID NO: 1204499 - RNA, 17 nt, Mycobacterium bovis subsp bovis AF2122/97
uguaggccucggcagca

SEQ ID NO: 1204500 - RNA, 17 nt, Mycobacterium bovis subsp bovis AF2122/97
ugucauccccggccagc

SEQ ID NO: 1204501 - RNA, 18 nt, Mycobacterium bovis subsp bovis AF2122/97
uguaugacaggucacggu

SEQ ID NO: 1204502 - RNA, 20 nt, Mycobacterium bovis subsp bovis AF2122/97
uguaugcguuacgccgcgag

SEQ ID NO: 1204503 - RNA, 23 nt, Mycobacterium bovis subsp bovis AF2122/97
ugucaagcgaugucccaucgcgu

SEQ ID NO: 1204504 - RNA, 20 nt, Mycobacterium bovis subsp bovis AF2122/97
ugucgcgcaaaauaugcagu

SEQ ID NO: 1204505 - RNA, 16 nt, Mycobacterium bovis subsp bovis AF2122/97
ugucgcggguucgagu

SEQ ID NO: 1204506 - RNA, 17 nt, Mycobacterium bovis subsp bovis AF2122/97
ugucgcugccgccgccg

SEQ ID NO: 1204507 - RNA, 13 nt, Mycobacterium bovis subsp bovis AF2122/97
ugucgggaugaau

SEQ ID NO: 1204508 - RNA, 13 nt, Mycobacterium bovis subsp bovis AF2122/97
ugucgggauuggc

SEQ ID NO: 1204509 - RNA, 16 nt, Mycobacterium bovis subsp bovis AF2122/97
ugucggggauucgucg

SEQ ID NO: 1204510 - RNA, 24 nt, Mycobacterium bovis subsp bovis AF2122/97
ugucgggcaccgguuugacgucca

SEQ ID NO: 1204511 - RNA, 18 nt, Mycobacterium bovis subsp bovis AF2122/97
ugucgggcacggugauga

SEQ ID NO: 1204512 - RNA, 17 nt, Mycobacterium bovis subsp bovis AF2122/97
ugucggugguaccggcg

SEQ ID NO: 1204513 - RNA, 16 nt, Mycobacterium bovis subsp bovis AF2122/97
uguccagguggcgcgg

SEQ ID NO: 1204514 - RNA, 18 nt, Mycobacterium bovis subsp bovis AF2122/97
ugucgccgcuuggcccgg

SEQ ID NO: 1204515 - RNA, 18 nt, Mycobacterium bovis subsp bovis AF2122/97
ugucgccgucgcggcacg

SEQ ID NO: 1204516 - RNA, 20 nt, Mycobacterium bovis subsp bovis AF2122/97
ugucgccgaacgccaccacc

SEQ ID NO: 1204517 - RNA, 22 nt, Mycobacterium bovis subsp bovis AF2122/97
uguccagcgcgacguccaccag

SEQ ID NO: 1204518 - RNA, 22 nt, Mycobacterium bovis subsp bovis AF2122/97
ugucgccacaccggggcggccg

SEQ ID NO: 1204519 - RNA, 13 nt, Mycobacterium bovis subsp bovis AF2122/97
uguccaccaccgg

SEQ ID NO: 1204520 - RNA, 18 nt, Mycobacterium bovis subsp bovis AF2122/97
ugugcaggacguuugaga

SEQ ID NO: 1204521 - RNA, 21 nt, Mycobacterium bovis subsp bovis AF2122/97
ugugcaggaucacgccgccgg

SEQ ID NO: 1204522 - RNA, 17 nt, Mycobacterium bovis subsp bovis AF2122/97
ugugcagggacccggcg

SEQ ID NO: 1204523 - RNA, 17 nt, Mycobacterium bovis subsp bovis AF2122/97
ugugcgauccagggccg

SEQ ID NO: 1204524 - RNA, 16 nt, Mycobacterium bovis subsp bovis AF2122/97
ugugcgagcugcgggu

SEQ ID NO: 1204525 - RNA, 23 nt, Mycobacterium bovis subsp bovis AF2122/97
ugugcgaccacaucaugccagcc

SEQ ID NO: 1204526 - RNA, 17 nt, Mycobacterium bovis subsp bovis AF2122/97
ugugccuacuugcucga

SEQ ID NO: 1204527 - RNA, 15 nt, Mycobacterium bovis subsp bovis AF2122/97
ugucugcucgcgccg

SEQ ID NO: 1204528 - RNA, 19 nt, Mycobacterium bovis subsp bovis AF2122/97
ugucuuagccagcagcaca

SEQ ID NO: 1204529 - RNA, 19 nt, Mycobacterium bovis subsp bovis AF2122/97
ugugacgggcacaaccaga

SEQ ID NO: 1204530 - RNA, 13 nt, Mycobacterium bovis subsp bovis AF2122/97
ugugaguccagcc

SEQ ID NO: 1204531 - RNA, 21 nt, Mycobacterium bovis subsp bovis AF2122/97
ugugagcacaccgacagcacc

SEQ ID NO: 1204532 - RNA, 11 nt, Mycobacterium bovis subsp bovis AF2122/97
ugugagcagac

SEQ ID NO: 1204533 - RNA, 13 nt, Mycobacterium bovis subsp bovis AF2122/97
ugugaccgucagc

SEQ ID NO: 1204534 - RNA, 12 nt, Mycobacterium bovis subsp bovis AF2122/97
ugugacaucggg

SEQ ID NO: 1204535 - RNA, 21 nt, Mycobacterium bovis subsp bovis AF2122/97
ugugaccaacccggcucgggu

SEQ ID NO: 1204536 - RNA, 20 nt, Mycobacterium bovis subsp bovis AF2122/97
ugugggccauguggacggca

SEQ ID NO: 1204537 - RNA, 13 nt, Mycobacterium bovis subsp bovis AF2122/97
uguggggccgggc

SEQ ID NO: 1204538 - RNA, 16 nt, Mycobacterium bovis subsp bovis AF2122/97
ugugggugguuguguc

SEQ ID NO: 1204539 - RNA, 21 nt, Mycobacterium bovis subsp bovis AF2122/97
ugugggugguugugucggccu

SEQ ID NO: 1204540 - RNA, 15 nt, Mycobacterium bovis subsp bovis AF2122/97
uguggucaccaggcc

SEQ ID NO: 1204541 - RNA, 15 nt, Mycobacterium bovis subsp bovis AF2122/97
uguggucacccgcag

SEQ ID NO: 1204542 - RNA, 14 nt, Mycobacterium bovis subsp bovis AF2122/97
uguggucccggcac

SEQ ID NO: 1204543 - RNA, 19 nt, Mycobacterium bovis subsp bovis AF2122/97
uguggucgaguugaagaau

SEQ ID NO: 1204544 - RNA, 18 nt, Mycobacterium bovis subsp bovis AF2122/97
ugugguuggugcuggccu

SEQ ID NO: 1204545 - RNA, 15 nt, Mycobacterium bovis subsp bovis AF2122/97
uguggugacagagcg

SEQ ID NO: 1204546 - RNA, 18 nt, Mycobacterium bovis subsp bovis AF2122/97
uguggucuucaucgccgu

SEQ ID NO: 1204547 - RNA, 15 nt, Mycobacterium bovis subsp bovis AF2122/97
ugugucaacaggacc

SEQ ID NO: 1204548 - RNA, 20 nt, Mycobacterium bovis subsp bovis AF2122/97
uguggccguggguuugagcc

SEQ ID NO: 1204549 - RNA, 24 nt, Mycobacterium bovis subsp bovis AF2122/97
uguggcccacauguccagcguccu

SEQ ID NO: 1204550 - RNA, 13 nt, Mycobacterium bovis subsp bovis AF2122/97
uguggcccgucau

SEQ ID NO: 1204551 - RNA, 15 nt, Mycobacterium bovis subsp bovis AF2122/97
uguggcuuugacugc

SEQ ID NO: 1204552 - RNA, 13 nt, Mycobacterium bovis subsp bovis AF2122/97
ugugcggccaggc

SEQ ID NO: 1204553 - RNA, 15 nt, Mycobacterium bovis subsp bovis AF2122/97
ugugcgucuccagcu

SEQ ID NO: 1204554 - RNA, 19 nt, Mycobacterium bovis subsp bovis AF2122/97
uguguccgaaggcuugucg

SEQ ID NO: 1204555 - RNA, 18 nt, Mycobacterium bovis subsp bovis AF2122/97
uguguccgcucgccgcca

SEQ ID NO: 1204556 - RNA, 23 nt, Mycobacterium bovis subsp bovis AF2122/97
ugugucgaccuucucgaugcuga

SEQ ID NO: 1204557 - RNA, 12 nt, Mycobacterium bovis subsp bovis AF2122/97
uguguggcagcc

SEQ ID NO: 1204558 - RNA, 20 nt, Mycobacterium bovis subsp bovis AF2122/97
ugugugcaagccgaacaccg

SEQ ID NO: 1204559 - RNA, 12 nt, Mycobacterium bovis subsp bovis AF2122/97
ugugugcagcag

SEQ ID NO: 1204560 - RNA, 16 nt, Mycobacterium bovis subsp bovis AF2122/97
ugugugcagcagcauc

SEQ ID NO: 1204561 - RNA, 13 nt, Mycobacterium bovis subsp bovis AF2122/97
uguguggcagccc

SEQ ID NO: 1204562 - RNA, 17 nt, Mycobacterium bovis subsp bovis AF2122/97
uuaccgccguugccgcc

SEQ ID NO: 1204563 - RNA, 15 nt, Mycobacterium bovis subsp bovis AF2122/97
uuaccauauccggac

SEQ ID NO: 1204564 - RNA, 17 nt, Mycobacterium bovis subsp bovis AF2122/97
uuacauagaccaccggc

SEQ ID NO: 1204565 - RNA, 11 nt, Mycobacterium bovis subsp bovis AF2122/97
uuacgcugccg

SEQ ID NO: 1204566 - RNA, 14 nt, Mycobacterium bovis subsp bovis AF2122/97
uuagcgguguggga

SEQ ID NO: 1204567 - RNA, 21 nt, Mycobacterium bovis subsp bovis AF2122/97
uuagcgcuugccgcugagccc

SEQ ID NO: 1204568 - RNA, 20 nt, Mycobacterium bovis subsp bovis AF2122/97
uuagcgcaugggccuuguug

SEQ ID NO: 1204569 - RNA, 20 nt, Mycobacterium bovis subsp bovis AF2122/97
uuaacacccugggcaaacug

SEQ ID NO: 1204570 - RNA, 13 nt, Mycobacterium bovis subsp bovis AF2122/97
uguuuggugguuu

SEQ ID NO: 1204571 - RNA, 14 nt, Mycobacterium bovis subsp bovis AF2122/97
uguuuuugcacuga

SEQ ID NO: 1204572 - RNA, 19 nt, Mycobacterium bovis subsp bovis AF2122/97
uguuuuuguauguucggcg

SEQ ID NO: 1204573 - RNA, 22 nt, Mycobacterium bovis subsp bovis AF2122/97
uguuuugucaggauauuucuaa

SEQ ID NO: 1204574 - RNA, 24 nt, Mycobacterium bovis subsp bovis AF2122/97
uguuugccggcuuugagccgcucg

SEQ ID NO: 1204575 - RNA, 14 nt, Mycobacterium bovis subsp bovis AF2122/97
uguucacgccgccg

SEQ ID NO: 1204576 - RNA, 20 nt, Mycobacterium bovis subsp bovis AF2122/97
uguucacccacuccgccgau

SEQ ID NO: 1204577 - RNA, 17 nt, Mycobacterium bovis subsp bovis AF2122/97
uguuauuuuuggccaug

SEQ ID NO: 1204578 - RNA, 17 nt, Mycobacterium bovis subsp bovis AF2122/97
uguucaaucccuccgcc

SEQ ID NO: 1204579 - RNA, 15 nt, Mycobacterium bovis subsp bovis AF2122/97
uguuauugaugcccg

SEQ ID NO: 1204580 - RNA, 19 nt, Mycobacterium bovis subsp bovis AF2122/97
uguuaucgaagcccgaguu

SEQ ID NO: 1204581 - RNA, 15 nt, Mycobacterium bovis subsp bovis AF2122/97
uguuccaacacuggg

SEQ ID NO: 1204582 - RNA, 18 nt, Mycobacterium bovis subsp bovis AF2122/97
uguuccaacuccugcagc

SEQ ID NO: 1204583 - RNA, 21 nt, Mycobacterium bovis subsp bovis AF2122/97
uguuccacaccaggccgagcc

SEQ ID NO: 1204584 - RNA, 15 nt, Mycobacterium bovis subsp bovis AF2122/97
uguuccacaccaggc

SEQ ID NO: 1204585 - RNA, 18 nt, Mycobacterium bovis subsp bovis AF2122/97
uguucauuccgaacaaca

SEQ ID NO: 1204586 - RNA, 20 nt, Mycobacterium bovis subsp bovis AF2122/97
uguuccagaaggccgcaccg

SEQ ID NO: 1204587 - RNA, 19 nt, Mycobacterium bovis subsp bovis AF2122/97
uguuccgugcgggucgucc

SEQ ID NO: 1204588 - RNA, 22 nt, Mycobacterium bovis subsp bovis AF2122/97
uguuccccgucgccagggccuu

SEQ ID NO: 1204589 - RNA, 23 nt, Mycobacterium bovis subsp bovis AF2122/97
uguucgugccggcguugccgaaa

SEQ ID NO: 1204590 - RNA, 15 nt, Mycobacterium bovis subsp bovis AF2122/97
uguucgacgggccgg

SEQ ID NO: 1204591 - RNA, 18 nt, Mycobacterium bovis subsp bovis AF2122/97
uguucggugguccuggcg

SEQ ID NO: 1204592 - RNA, 15 nt, Mycobacterium bovis subsp bovis AF2122/97
uguucggucuugccg

SEQ ID NO: 1204593 - RNA, 18 nt, Mycobacterium bovis subsp bovis AF2122/97
uguucggagcugggcuga

SEQ ID NO: 1204594 - RNA, 18 nt, Mycobacterium bovis subsp bovis AF2122/97
uguucuggauacccagcg

SEQ ID NO: 1204595 - RNA, 18 nt, Mycobacterium bovis subsp bovis AF2122/97
uguugagcuggaccuccg

SEQ ID NO: 1204596 - RNA, 16 nt, Mycobacterium bovis subsp bovis AF2122/97
uguugacgcccgaguu

SEQ ID NO: 1204597 - RNA, 19 nt, Mycobacterium bovis subsp bovis AF2122/97
uguugcugucgaaguuggu

SEQ ID NO: 1204598 - RNA, 16 nt, Mycobacterium bovis subsp bovis AF2122/97
uguugcgcacccgcgg

SEQ ID NO: 1204599 - RNA, 18 nt, Mycobacterium bovis subsp bovis AF2122/97
uguugauugaccugcugg

SEQ ID NO: 1204600 - RNA, 10 nt, Mycobacterium bovis subsp bovis AF2122/97
uguuguugaa

SEQ ID NO: 1204601 - RNA, 16 nt, Mycobacterium bovis subsp bovis AF2122/97
uguuggugccagccgg

SEQ ID NO: 1204602 - RNA, 16 nt, Mycobacterium bovis subsp bovis AF2122/97
uguuggcguggaucuu

SEQ ID NO: 1204603 - RNA, 15 nt, Mycobacterium bovis subsp bovis AF2122/97
ugcacccgccagggc

SEQ ID NO: 1204604 - RNA, 13 nt, Mycobacterium bovis subsp bovis AF2122/97
ugcaccccaugac

SEQ ID NO: 1204605 - RNA, 22 nt, Mycobacterium bovis subsp bovis AF2122/97
ugcacccagccgugcccaagcu

SEQ ID NO: 1204606 - RNA, 19 nt, Mycobacterium bovis subsp bovis AF2122/97
ugcacgagcggacagggag

SEQ ID NO: 1204607 - RNA, 21 nt, Mycobacterium bovis subsp bovis AF2122/97
ugauuucgcguaacuugccgc

SEQ ID NO: 1204608 - RNA, 16 nt, Mycobacterium bovis subsp bovis AF2122/97
ugcacgccggcgcugg

SEQ ID NO: 1204609 - RNA, 19 nt, Mycobacterium bovis subsp bovis AF2122/97
ugcacgccucaaaaaucgu

SEQ ID NO: 1204610 - RNA, 24 nt, Mycobacterium bovis subsp bovis AF2122/97
ugcacggacaguuccccgggcucg

SEQ ID NO: 1204611 - RNA, 21 nt, Mycobacterium bovis subsp bovis AF2122/97
ugcacggccaugaucacaccg

SEQ ID NO: 1204612 - RNA, 12 nt, Mycobacterium bovis subsp bovis AF2122/97
ugcacggccggg

SEQ ID NO: 1204613 - RNA, 17 nt, Mycobacterium bovis subsp bovis AF2122/97
ugcacgcucggcgccgu

SEQ ID NO: 1204614 - RNA, 14 nt, Mycobacterium bovis subsp bovis AF2122/97
ugcagaaacagccg

SEQ ID NO: 1204615 - RNA, 14 nt, Mycobacterium bovis subsp bovis AF2122/97
ugcacggugcccag

SEQ ID NO: 1204616 - RNA, 21 nt, Mycobacterium bovis subsp bovis AF2122/97
ugcacggucaugccgccgccg

SEQ ID NO: 1204617 - RNA, 15 nt, Mycobacterium bovis subsp bovis AF2122/97
ugcaggaccagaacu

SEQ ID NO: 1204618 - RNA, 13 nt, Mycobacterium bovis subsp bovis AF2122/97
ugcaggaccagca

SEQ ID NO: 1204619 - RNA, 22 nt, Mycobacterium bovis subsp bovis AF2122/97
ugcaggacguuugagaccccaa

SEQ ID NO: 1204620 - RNA, 23 nt, Mycobacterium bovis subsp bovis AF2122/97
ugcaggacguuugagaccccaac

SEQ ID NO: 1204621 - RNA, 15 nt, Mycobacterium bovis subsp bovis AF2122/97
ugcaggaucaaaacc

SEQ ID NO: 1204622 - RNA, 16 nt, Mycobacterium bovis subsp bovis AF2122/97
ugcaggcccaggcugu

SEQ ID NO: 1204623 - RNA, 16 nt, Mycobacterium bovis subsp bovis AF2122/97
ugcaggauucggcggu

SEQ ID NO: 1204624 - RNA, 21 nt, Mycobacterium bovis subsp bovis AF2122/97
ugcagcgcaggauucugcuga

SEQ ID NO: 1204625 - RNA, 21 nt, Mycobacterium bovis subsp bovis AF2122/97
ugcagcgcgguggucagcacc

SEQ ID NO: 1204626 - RNA, 20 nt, Mycobacterium bovis subsp bovis AF2122/97
ugcagcgcaggauucugcug

SEQ ID NO: 1204627 - RNA, 15 nt, Mycobacterium bovis subsp bovis AF2122/97
ugcaggaaaguggcc

SEQ ID NO: 1204628 - RNA, 13 nt, Mycobacterium bovis subsp bovis AF2122/97
ugcaggaaggcuu

SEQ ID NO: 1204629 - RNA, 18 nt, Mycobacterium bovis subsp bovis AF2122/97
ugcagcagcauccggccg

SEQ ID NO: 1204630 - RNA, 18 nt, Mycobacterium bovis subsp bovis AF2122/97
ugcagacggguggcccga

SEQ ID NO: 1204631 - RNA, 21 nt, Mycobacterium bovis subsp bovis AF2122/97
ugcagacaggcggcggccugg

SEQ ID NO: 1204632 - RNA, 13 nt, Mycobacterium bovis subsp bovis AF2122/97
ugcagcagcgcgc

SEQ ID NO: 1204633 - RNA, 13 nt, Mycobacterium bovis subsp bovis AF2122/97
ugcagccacauac

SEQ ID NO: 1204634 - RNA, 13 nt, Mycobacterium bovis subsp bovis AF2122/97
ugcaggcggccgc

SEQ ID NO: 1204635 - RNA, 22 nt, Mycobacterium bovis subsp bovis AF2122/97
ugcaggcggccuugccgggccg

SEQ ID NO: 1204636 - RNA, 21 nt, Mycobacterium bovis subsp bovis AF2122/97
ugcaggcugguuucggccgca

SEQ ID NO: 1204637 - RNA, 12 nt, Mycobacterium bovis subsp bovis AF2122/97
ugcagggccugg

SEQ ID NO: 1204638 - RNA, 18 nt, Mycobacterium bovis subsp bovis AF2122/97
ugcagggcccgcaacauc

SEQ ID NO: 1204639 - RNA, 18 nt, Mycobacterium bovis subsp bovis AF2122/97
ugcagggccacuggccgg

SEQ ID NO: 1204640 - RNA, 20 nt, Mycobacterium bovis subsp bovis AF2122/97
ugcagggcugcuacucugca

SEQ ID NO: 1204641 - RNA, 15 nt, Mycobacterium bovis subsp bovis AF2122/97
ugcagggccuggcca

SEQ ID NO: 1204642 - RNA, 21 nt, Mycobacterium bovis subsp bovis AF2122/97
ugcauccacugcggcgcuggg

SEQ ID NO: 1204643 - RNA, 18 nt, Mycobacterium bovis subsp bovis AF2122/97
ugcauccauccugccuua

SEQ ID NO: 1204644 - RNA, 19 nt, Mycobacterium bovis subsp bovis AF2122/97
ugcaucgcgauuccggcgg

SEQ ID NO: 1204645 - RNA, 16 nt, Mycobacterium bovis subsp bovis AF2122/97
ugcaucgccugcgccu

SEQ ID NO: 1204646 - RNA, 15 nt, Mycobacterium bovis subsp bovis AF2122/97
ugcaucgaucaccgc

SEQ ID NO: 1204647 - RNA, 16 nt, Mycobacterium bovis subsp bovis AF2122/97
ugcaucgccaccaccg

SEQ ID NO: 1204648 - RNA, 22 nt, Mycobacterium bovis subsp bovis AF2122/97
ugcaugcccagaaaaccgccgc

SEQ ID NO: 1204649 - RNA, 20 nt, Mycobacterium bovis subsp bovis AF2122/97
ugcauggcuugcucugcgca

SEQ ID NO: 1204650 - RNA, 19 nt, Mycobacterium bovis subsp bovis AF2122/97
ugccaacacauugccggcc

SEQ ID NO: 1204651 - RNA, 21 nt, Mycobacterium bovis subsp bovis AF2122/97
ugccaacaccggcgaucaccg

SEQ ID NO: 1204652 - RNA, 14 nt, Mycobacterium bovis subsp bovis AF2122/97
ugccaaccugggcc

SEQ ID NO: 1204653 - RNA, 21 nt, Mycobacterium bovis subsp bovis AF2122/97
ugccaacgacaggcgcccaca

SEQ ID NO: 1204654 - RNA, 15 nt, Mycobacterium bovis subsp bovis AF2122/97
ugccaaacgccgccc

SEQ ID NO: 1204655 - RNA, 23 nt, Mycobacterium bovis subsp bovis AF2122/97
ugccaaacgccgcccgccgguga

SEQ ID NO: 1204656 - RNA, 21 nt, Mycobacterium bovis subsp bovis AF2122/97
ugccaaaggacgacaccgcga

SEQ ID NO: 1204657 - RNA, 22 nt, Mycobacterium bovis subsp bovis AF2122/97
ugccacgcucggugcugcgccg

SEQ ID NO: 1204658 - RNA, 17 nt, Mycobacterium bovis subsp bovis AF2122/97
ugccacguucgcgggcg

SEQ ID NO: 1204659 - RNA, 17 nt, Mycobacterium bovis subsp bovis AF2122/97
ugccacucgaugcuuuc

SEQ ID NO: 1204660 - RNA, 18 nt, Mycobacterium bovis subsp bovis AF2122/97
ugccacaggcguuuccgc

SEQ ID NO: 1204661 - RNA, 18 nt, Mycobacterium bovis subsp bovis AF2122/97
ugccacaucccacggugg

SEQ ID NO: 1204662 - RNA, 18 nt, Mycobacterium bovis subsp bovis AF2122/97
ugccacugccguugccgc

SEQ ID NO: 1204663 - RNA, 19 nt, Mycobacterium bovis subsp bovis AF2122/97
ugccacugccguugccgcc

SEQ ID NO: 1204664 - RNA, 14 nt, Mycobacterium bovis subsp bovis AF2122/97
ugccagaucagcac

SEQ ID NO: 1204665 - RNA, 21 nt, Mycobacterium bovis subsp bovis AF2122/97
ugccagccgucaccgcgaccc

SEQ ID NO: 1204666 - RNA, 21 nt, Mycobacterium bovis subsp bovis AF2122/97
ugccagccgucgucagguggc

SEQ ID NO: 1204667 - RNA, 14 nt, Mycobacterium bovis subsp bovis AF2122/97
ugccagcgccgccg

SEQ ID NO: 1204668 - RNA, 16 nt, Mycobacterium bovis subsp bovis AF2122/97
ugccagcagcaaucag

SEQ ID NO: 1204669 - RNA, 19 nt, Mycobacterium bovis subsp bovis AF2122/97
ugccagcaggccgaagaaa

SEQ ID NO: 1204670 - RNA, 13 nt, Mycobacterium bovis subsp bovis AF2122/97
ugccaggccgcug

SEQ ID NO: 1204671 - RNA, 15 nt, Mycobacterium bovis subsp bovis AF2122/97
ugccaggccgcugac

SEQ ID NO: 1204672 - RNA, 20 nt, Mycobacterium bovis subsp bovis AF2122/97
ugccaggacuggcaccgcca

SEQ ID NO: 1204673 - RNA, 13 nt, Mycobacterium bovis subsp bovis AF2122/97
ugccagggcgggc

SEQ ID NO: 1204674 - RNA, 19 nt, Mycobacterium bovis subsp bovis AF2122/97
ugccagucgaucgcggccc

SEQ ID NO: 1204675 - RNA, 16 nt, Mycobacterium bovis subsp bovis AF2122/97
ugccagugccgcccac

SEQ ID NO: 1204676 - RNA, 23 nt, Mycobacterium bovis subsp bovis AF2122/97
ugccagugccgcccaccacacag

SEQ ID NO: 1204677 - RNA, 15 nt, Mycobacterium bovis subsp bovis AF2122/97
ugcccaagcagucca

SEQ ID NO: 1204678 - RNA, 12 nt, Mycobacterium bovis subsp bovis AF2122/97
ugcccaagcccu

SEQ ID NO: 1204679 - RNA, 20 nt, Mycobacterium bovis subsp bovis AF2122/97
ugccaugggcaauggugguu

SEQ ID NO: 1204680 - RNA, 15 nt, Mycobacterium bovis subsp bovis AF2122/97
ugccauacagcaccc

SEQ ID NO: 1204681 - RNA, 16 nt, Mycobacterium bovis subsp bovis AF2122/97
ugccauaggacaggaa

SEQ ID NO: 1204682 - RNA, 17 nt, Mycobacterium bovis subsp bovis AF2122/97
ugccaucaaggccaccu

SEQ ID NO: 1204683 - RNA, 16 nt, Mycobacterium bovis subsp bovis AF2122/97
ugccaucggcaccagc

SEQ ID NO: 1204684 - RNA, 18 nt, Mycobacterium bovis subsp bovis AF2122/97
ugccaucggcaccagcgc

SEQ ID NO: 1204685 - RNA, 20 nt, Mycobacterium bovis subsp bovis AF2122/97
ugccaucggcaccagcgcgc

SEQ ID NO: 1204686 - RNA, 14 nt, Mycobacterium bovis subsp bovis AF2122/97
ugcccgcgcggcca

SEQ ID NO: 1204687 - RNA, 13 nt, Mycobacterium bovis subsp bovis AF2122/97
ugcccgcgcggcg

SEQ ID NO: 1204688 - RNA, 21 nt, Mycobacterium bovis subsp bovis AF2122/97
ugcccgccguagaccagccgu

SEQ ID NO: 1204689 - RNA, 20 nt, Mycobacterium bovis subsp bovis AF2122/97
ugcccgcgaacgaucccgcc

SEQ ID NO: 1204690 - RNA, 14 nt, Mycobacterium bovis subsp bovis AF2122/97
ugcccgcguugcca

SEQ ID NO: 1204691 - RNA, 18 nt, Mycobacterium bovis subsp bovis AF2122/97
ugcccgcguugccaaagc

SEQ ID NO: 1204692 - RNA, 20 nt, Mycobacterium bovis subsp bovis AF2122/97
ugcccggacucuccccuggc

SEQ ID NO: 1204693 - RNA, 22 nt, Mycobacterium bovis subsp bovis AF2122/97
ugcccgggguauucccgcagau

SEQ ID NO: 1204694 - RNA, 20 nt, Mycobacterium bovis subsp bovis AF2122/97
ugcccgggacaaguucggua

SEQ ID NO: 1204695 - RNA, 19 nt, Mycobacterium bovis subsp bovis AF2122/97
ugcccgggcggucgaagac

SEQ ID NO: 1204696 - RNA, 14 nt, Mycobacterium bovis subsp bovis AF2122/97
ugcccggcgcgaag

SEQ ID NO: 1204697 - RNA, 22 nt, Mycobacterium bovis subsp bovis AF2122/97
ugcccggcuccuccccggcccg

SEQ ID NO: 1204698 - RNA, 15 nt, Mycobacterium bovis subsp bovis AF2122/97
ugcccgguuucuucu

SEQ ID NO: 1204699 - RNA, 18 nt, Mycobacterium bovis subsp bovis AF2122/97
ugcccgccagcgccgccg

SEQ ID NO: 1204700 - RNA, 14 nt, Mycobacterium bovis subsp bovis AF2122/97
ugcccgcaccgcgu

SEQ ID NO: 1204701 - RNA, 19 nt, Mycobacterium bovis subsp bovis AF2122/97
ugcccgcauugccaacgcc

SEQ ID NO: 1204702 - RNA, 16 nt, Mycobacterium bovis subsp bovis AF2122/97
ugcccgcaccacaccg

SEQ ID NO: 1204703 - RNA, 14 nt, Mycobacterium bovis subsp bovis AF2122/97
ugcccgcauugcca

SEQ ID NO: 1204704 - RNA, 21 nt, Mycobacterium bovis subsp bovis AF2122/97
ugcccgaugguacccgcgccg

SEQ ID NO: 1204705 - RNA, 15 nt, Mycobacterium bovis subsp bovis AF2122/97
ugcccgcaacgccaa

SEQ ID NO: 1204706 - RNA, 15 nt, Mycobacterium bovis subsp bovis AF2122/97
ugcccgaucagccgu

SEQ ID NO: 1204707 - RNA, 22 nt, Mycobacterium bovis subsp bovis AF2122/97
ugcccgauacccggugauggug

SEQ ID NO: 1204708 - RNA, 18 nt, Mycobacterium bovis subsp bovis AF2122/97
ugcccgagcccagccggg

SEQ ID NO: 1204709 - RNA, 21 nt, Mycobacterium bovis subsp bovis AF2122/97
ugcccgagcccagcgccucca

SEQ ID NO: 1204710 - RNA, 15 nt, Mycobacterium bovis subsp bovis AF2122/97
ugcccgacacccgca

SEQ ID NO: 1204711 - RNA, 22 nt, Mycobacterium bovis subsp bovis AF2122/97
ugcccgaccacaccgggauggg

SEQ ID NO: 1204712 - RNA, 20 nt, Mycobacterium bovis subsp bovis AF2122/97
ugccccuucaaagcggccuc

SEQ ID NO: 1204713 - RNA, 14 nt, Mycobacterium bovis subsp bovis AF2122/97
ugccccuccgggcg

SEQ ID NO: 1204714 - RNA, 19 nt, Mycobacterium bovis subsp bovis AF2122/97
ugccccguugagcagcacc

SEQ ID NO: 1204715 - RNA, 19 nt, Mycobacterium bovis subsp bovis AF2122/97
ugcccagcgcacggaccau

SEQ ID NO: 1204716 - RNA, 20 nt, Mycobacterium bovis subsp bovis AF2122/97
ugcccagcgaauccaggccg

SEQ ID NO: 1204717 - RNA, 15 nt, Mycobacterium bovis subsp bovis AF2122/97
ugcccagcgccgaau

SEQ ID NO: 1204718 - RNA, 23 nt, Mycobacterium bovis subsp bovis AF2122/97
ugcccaggaaggcgacgccgaaa

SEQ ID NO: 1204719 - RNA, 18 nt, Mycobacterium bovis subsp bovis AF2122/97
ugcccaggucuccaucaa

SEQ ID NO: 1204720 - RNA, 19 nt, Mycobacterium bovis subsp bovis AF2122/97
ugcccacggcgaccacgcc

SEQ ID NO: 1204721 - RNA, 18 nt, Mycobacterium bovis subsp bovis AF2122/97
ugcccaccgccugggcgg

SEQ ID NO: 1204722 - RNA, 19 nt, Mycobacterium bovis subsp bovis AF2122/97
ugcccagcagaccaagucc

SEQ ID NO: 1204723 - RNA, 15 nt, Mycobacterium bovis subsp bovis AF2122/97
ugcccagcagcgcga

SEQ ID NO: 1204724 - RNA, 23 nt, Mycobacterium bovis subsp bovis AF2122/97
ugcccagcacccccugcaccguc

SEQ ID NO: 1204725 - RNA, 20 nt, Mycobacterium bovis subsp bovis AF2122/97
ugcccacggagggcaggaga

SEQ ID NO: 1204726 - RNA, 19 nt, Mycobacterium bovis subsp bovis AF2122/97
ugcccacguuggccaggcc

SEQ ID NO: 1204727 - RNA, 19 nt, Mycobacterium bovis subsp bovis AF2122/97
ugcccagaaaaccgccgca

SEQ ID NO: 1204728 - RNA, 20 nt, Mycobacterium bovis subsp bovis AF2122/97
ugccccgaccgccguggccg

SEQ ID NO: 1204729 - RNA, 20 nt, Mycobacterium bovis subsp bovis AF2122/97
ugccccgcaucgcccaagcc

SEQ ID NO: 1204730 - RNA, 15 nt, Mycobacterium bovis subsp bovis AF2122/97
ugcccccgccggccg

SEQ ID NO: 1204731 - RNA, 19 nt, Mycobacterium bovis subsp bovis AF2122/97
ugcccccguucuggaaccc

SEQ ID NO: 1204732 - RNA, 20 nt, Mycobacterium bovis subsp bovis AF2122/97
ugcccccguugccgccuguc

SEQ ID NO: 1204733 - RNA, 16 nt, Mycobacterium bovis subsp bovis AF2122/97
ugccccgaaccgcgcu

SEQ ID NO: 1204734 - RNA, 14 nt, Mycobacterium bovis subsp bovis AF2122/97
ugccccgccuuggc

SEQ ID NO: 1204735 - RNA, 16 nt, Mycobacterium bovis subsp bovis AF2122/97
ugccccgccuuggcca

SEQ ID NO: 1204736 - RNA, 21 nt, Mycobacterium bovis subsp bovis AF2122/97
ugccccgccuuggccaccauc

SEQ ID NO: 1204737 - RNA, 14 nt, Mycobacterium bovis subsp bovis AF2122/97
ugccccgccgagcg

SEQ ID NO: 1204738 - RNA, 13 nt, Mycobacterium bovis subsp bovis AF2122/97
ugccccgccgcca

SEQ ID NO: 1204739 - RNA, 21 nt, Mycobacterium bovis subsp bovis AF2122/97
ugccccgccguaccgaagcgg

SEQ ID NO: 1204740 - RNA, 17 nt, Mycobacterium bovis subsp bovis AF2122/97
ugccccagggcagugcg

SEQ ID NO: 1204741 - RNA, 14 nt, Mycobacterium bovis subsp bovis AF2122/97
ugcccccgccggcc

SEQ ID NO: 1204742 - RNA, 16 nt, Mycobacterium bovis subsp bovis AF2122/97
ugcccaucacgcccca

SEQ ID NO: 1204743 - RNA, 15 nt, Mycobacterium bovis subsp bovis AF2122/97
ugcccauagccaggu

SEQ ID NO: 1204744 - RNA, 15 nt, Mycobacterium bovis subsp bovis AF2122/97
ugcccaucccggccg

SEQ ID NO: 1204745 - RNA, 15 nt, Mycobacterium bovis subsp bovis AF2122/97
ugccgccgugguugc

SEQ ID NO: 1204746 - RNA, 14 nt, Mycobacterium bovis subsp bovis AF2122/97
ugccgccguuaccg

SEQ ID NO: 1204747 - RNA, 16 nt, Mycobacterium bovis subsp bovis AF2122/97
ugccgccguucccacc

SEQ ID NO: 1204748 - RNA, 19 nt, Mycobacterium bovis subsp bovis AF2122/97
ugccgccgucgccgccgcu

SEQ ID NO: 1204749 - RNA, 17 nt, Mycobacterium bovis subsp bovis AF2122/97
ugccgccggugccgcca

SEQ ID NO: 1204750 - RNA, 22 nt, Mycobacterium bovis subsp bovis AF2122/97
ugccgccgucguugcccgaccc

SEQ ID NO: 1204751 - RNA, 22 nt, Mycobacterium bovis subsp bovis AF2122/97
ugccgccgggugcaacggcguu

SEQ ID NO: 1204752 - RNA, 17 nt, Mycobacterium bovis subsp bovis AF2122/97
ugccgccggugccaccc

SEQ ID NO: 1204753 - RNA, 14 nt, Mycobacterium bovis subsp bovis AF2122/97
ugccgccggugccg

SEQ ID NO: 1204754 - RNA, 22 nt, Mycobacterium bovis subsp bovis AF2122/97
ugccgccggugccgaucagcag

SEQ ID NO: 1204755 - RNA, 20 nt, Mycobacterium bovis subsp bovis AF2122/97
ugccgccgguuccgccggcc

SEQ ID NO: 1204756 - RNA, 21 nt, Mycobacterium bovis subsp bovis AF2122/97
ugccgccgucgccacgcccag

SEQ ID NO: 1204757 - RNA, 19 nt, Mycobacterium bovis subsp bovis AF2122/97
ugccgccggcgccgccguu

SEQ ID NO: 1204758 - RNA, 20 nt, Mycobacterium bovis subsp bovis AF2122/97
ugccgccggccccgccgcua

SEQ ID NO: 1204759 - RNA, 23 nt, Mycobacterium bovis subsp bovis AF2122/97
ugccgccggccccgccggcgccg

SEQ ID NO: 1204760 - RNA, 16 nt, Mycobacterium bovis subsp bovis AF2122/97
ugccgccggcgccacc

SEQ ID NO: 1204761 - RNA, 23 nt, Mycobacterium bovis subsp bovis AF2122/97
ugccgccggcgccacccgcgccg

SEQ ID NO: 1204762 - RNA, 14 nt, Mycobacterium bovis subsp bovis AF2122/97
ugccgccgcggcag

SEQ ID NO: 1204763 - RNA, 19 nt, Mycobacterium bovis subsp bovis AF2122/97
ugccgccgcggccacaacc

SEQ ID NO: 1204764 - RNA, 13 nt, Mycobacterium bovis subsp bovis AF2122/97
ugccgccgcggcg

SEQ ID NO: 1204765 - RNA, 12 nt, Mycobacterium bovis subsp bovis AF2122/97
ugccgcgcggcg

SEQ ID NO: 1204766 - RNA, 19 nt, Mycobacterium bovis subsp bovis AF2122/97
ugccgcgcagcugccgcac

SEQ ID NO: 1204767 - RNA, 21 nt, Mycobacterium bovis subsp bovis AF2122/97
ugccgcgcagcugccgcaccc

SEQ ID NO: 1204768 - RNA, 14 nt, Mycobacterium bovis subsp bovis AF2122/97
ugccgcgcagcugc

SEQ ID NO: 1204769 - RNA, 20 nt, Mycobacterium bovis subsp bovis AF2122/97
ugccgcgaucgggcccagca

SEQ ID NO: 1204770 - RNA, 17 nt, Mycobacterium bovis subsp bovis AF2122/97
ugccgccugcgccgcca

SEQ ID NO: 1204771 - RNA, 19 nt, Mycobacterium bovis subsp bovis AF2122/97
ugccgccguugccgccguu

SEQ ID NO: 1204772 - RNA, 15 nt, Mycobacterium bovis subsp bovis AF2122/97
ugccggacaaccugg

SEQ ID NO: 1204773 - RNA, 19 nt, Mycobacterium bovis subsp bovis AF2122/97
ugccggacagccacgcaca

SEQ ID NO: 1204774 - RNA, 19 nt, Mycobacterium bovis subsp bovis AF2122/97
ugccggaggaucgcugguu

SEQ ID NO: 1204775 - RNA, 20 nt, Mycobacterium bovis subsp bovis AF2122/97
ugccggacugccgcaggaag

SEQ ID NO: 1204776 - RNA, 21 nt, Mycobacterium bovis subsp bovis AF2122/97
ugccgcuuagcaaucggcagg

SEQ ID NO: 1204777 - RNA, 21 nt, Mycobacterium bovis subsp bovis AF2122/97
ugccgcggccaccgccgccgc

SEQ ID NO: 1204778 - RNA, 16 nt, Mycobacterium bovis subsp bovis AF2122/97
ugccgcggccggcgug

SEQ ID NO: 1204779 - RNA, 20 nt, Mycobacterium bovis subsp bovis AF2122/97
ugccgcggaggcggccagcc

SEQ ID NO: 1204780 - RNA, 22 nt, Mycobacterium bovis subsp bovis AF2122/97
ugccgcugcgccgucgcagcca

SEQ ID NO: 1204781 - RNA, 16 nt, Mycobacterium bovis subsp bovis AF2122/97
ugccgcugagcccugc

SEQ ID NO: 1204782 - RNA, 18 nt, Mycobacterium bovis subsp bovis AF2122/97
ugccgcugagcccugcgc

SEQ ID NO: 1204783 - RNA, 23 nt, Mycobacterium bovis subsp bovis AF2122/97
ugccguaguaaggagccgggccg

SEQ ID NO: 1204784 - RNA, 20 nt, Mycobacterium bovis subsp bovis AF2122/97
ugccgucaagauugaacgag

SEQ ID NO: 1204785 - RNA, 16 nt, Mycobacterium bovis subsp bovis AF2122/97
ugccguccggcgcugg

SEQ ID NO: 1204786 - RNA, 16 nt, Mycobacterium bovis subsp bovis AF2122/97
ugccgucagggucagc

SEQ ID NO: 1204787 - RNA, 17 nt, Mycobacterium bovis subsp bovis AF2122/97
ugccgucagggucagcu

SEQ ID NO: 1204788 - RNA, 13 nt, Mycobacterium bovis subsp bovis AF2122/97
ugccgggccgcgc

SEQ ID NO: 1204789 - RNA, 23 nt, Mycobacterium bovis subsp bovis AF2122/97
ugccgggccgcgcgggccgccgc

SEQ ID NO: 1204790 - RNA, 13 nt, Mycobacterium bovis subsp bovis AF2122/97
ugccgggcaccac

SEQ ID NO: 1204791 - RNA, 14 nt, Mycobacterium bovis subsp bovis AF2122/97
ugccgggcccagca

SEQ ID NO: 1204792 - RNA, 20 nt, Mycobacterium bovis subsp bovis AF2122/97
ugccggcguugccgaaaccc

SEQ ID NO: 1204793 - RNA, 15 nt, Mycobacterium bovis subsp bovis AF2122/97
ugccgggaucgccgu

SEQ ID NO: 1204794 - RNA, 22 nt, Mycobacterium bovis subsp bovis AF2122/97
ugccggcuuaaggcccuggccg

SEQ ID NO: 1204795 - RNA, 22 nt, Mycobacterium bovis subsp bovis AF2122/97
ugccggaggaucgcugguuugc

SEQ ID NO: 1204796 - RNA, 14 nt, Mycobacterium bovis subsp bovis AF2122/97
ugccggcaacagcu

SEQ ID NO: 1204797 - RNA, 23 nt, Mycobacterium bovis subsp bovis AF2122/97
ugccuacaccggcaagccacgcc

SEQ ID NO: 1204798 - RNA, 14 nt, Mycobacterium bovis subsp bovis AF2122/97
ugccuaccgggccc

SEQ ID NO: 1204799 - RNA, 14 nt, Mycobacterium bovis subsp bovis AF2122/97
ugccguggccgcca

SEQ ID NO: 1204800 - RNA, 23 nt, Mycobacterium bovis subsp bovis AF2122/97
ugccgugcugaacuccgccgcga

SEQ ID NO: 1204801 - RNA, 15 nt, Mycobacterium bovis subsp bovis AF2122/97
ugccgugcugggccg

SEQ ID NO: 1204802 - RNA, 22 nt, Mycobacterium bovis subsp bovis AF2122/97
ugccgugccgguguguccagcg

SEQ ID NO: 1204803 - RNA, 18 nt, Mycobacterium bovis subsp bovis AF2122/97
ugccgugguggacgaugc

SEQ ID NO: 1204804 - RNA, 23 nt, Mycobacterium bovis subsp bovis AF2122/97
ugccguucaugccauggauguag

SEQ ID NO: 1204805 - RNA, 13 nt, Mycobacterium bovis subsp bovis AF2122/97
ugccguugcgauc

SEQ ID NO: 1204806 - RNA, 21 nt, Mycobacterium bovis subsp bovis AF2122/97
ugccgccgauaccgccggccc

SEQ ID NO: 1204807 - RNA, 17 nt, Mycobacterium bovis subsp bovis AF2122/97
ugccgccgacgggaacc

SEQ ID NO: 1204808 - RNA, 17 nt, Mycobacterium bovis subsp bovis AF2122/97
ugccgccgacgccgccg

SEQ ID NO: 1204809 - RNA, 11 nt, Mycobacterium bovis subsp bovis AF2122/97
ugccgccgaag

SEQ ID NO: 1204810 - RNA, 15 nt, Mycobacterium bovis subsp bovis AF2122/97
ugccgccgaacagcu

SEQ ID NO: 1204811 - RNA, 17 nt, Mycobacterium bovis subsp bovis AF2122/97
ugccgcccuugccgccc

SEQ ID NO: 1204812 - RNA, 17 nt, Mycobacterium bovis subsp bovis AF2122/97
ugccgccgccggcgccg

SEQ ID NO: 1204813 - RNA, 14 nt, Mycobacterium bovis subsp bovis AF2122/97
ugccgccgccuccg

SEQ ID NO: 1204814 - RNA, 22 nt, Mycobacterium bovis subsp bovis AF2122/97
ugccgccgccuccgccgaggcc

SEQ ID NO: 1204815 - RNA, 22 nt, Mycobacterium bovis subsp bovis AF2122/97
ugccgcccgcgccgccggaccc

SEQ ID NO: 1204816 - RNA, 15 nt, Mycobacterium bovis subsp bovis AF2122/97
ugccgcccucaccgc

SEQ ID NO: 1204817 - RNA, 17 nt, Mycobacterium bovis subsp bovis AF2122/97
ugccgcccgcgccuccg

SEQ ID NO: 1204818 - RNA, 14 nt, Mycobacterium bovis subsp bovis AF2122/97
ugccgcccgcgccg

SEQ ID NO: 1204819 - RNA, 17 nt, Mycobacterium bovis subsp bovis AF2122/97
ugccgcccgcgccgccc

SEQ ID NO: 1204820 - RNA, 19 nt, Mycobacterium bovis subsp bovis AF2122/97
ugccgcccgcgccgccgcu

SEQ ID NO: 1204821 - RNA, 15 nt, Mycobacterium bovis subsp bovis AF2122/97
ugccgcccccggcac

SEQ ID NO: 1204822 - RNA, 17 nt, Mycobacterium bovis subsp bovis AF2122/97
ugccgcccacgcugccc

SEQ ID NO: 1204823 - RNA, 17 nt, Mycobacterium bovis subsp bovis AF2122/97
ugccgccaucgccgccg

SEQ ID NO: 1204824 - RNA, 19 nt, Mycobacterium bovis subsp bovis AF2122/97
ugccgcccaccacacagcc

SEQ ID NO: 1204825 - RNA, 23 nt, Mycobacterium bovis subsp bovis AF2122/97
ugccgccaccgcugucgauggac

SEQ ID NO: 1204826 - RNA, 20 nt, Mycobacterium bovis subsp bovis AF2122/97
ugccgccaccuuggcugggc

SEQ ID NO: 1204827 - RNA, 16 nt, Mycobacterium bovis subsp bovis AF2122/97
ugccgccaccggcguc

SEQ ID NO: 1204828 - RNA, 16 nt, Mycobacterium bovis subsp bovis AF2122/97
ugccgccagcccagcc

SEQ ID NO: 1204829 - RNA, 19 nt, Mycobacterium bovis subsp bovis AF2122/97
ugccgccagccccagcguu

SEQ ID NO: 1204830 - RNA, 16 nt, Mycobacterium bovis subsp bovis AF2122/97
ugccgaucagcagugg

SEQ ID NO: 1204831 - RNA, 17 nt, Mycobacterium bovis subsp bovis AF2122/97
ugccgaucagcccggcc

SEQ ID NO: 1204832 - RNA, 12 nt, Mycobacterium bovis subsp bovis AF2122/97
ugccgagcagac

SEQ ID NO: 1204833 - RNA, 13 nt, Mycobacterium bovis subsp bovis AF2122/97
ugccgauccccag

SEQ ID NO: 1204834 - RNA, 16 nt, Mycobacterium bovis subsp bovis AF2122/97
ugccgauccccaggcc

SEQ ID NO: 1204835 - RNA, 23 nt, Mycobacterium bovis subsp bovis AF2122/97
ugccgaucccgugguggcgccau

SEQ ID NO: 1204836 - RNA, 20 nt, Mycobacterium bovis subsp bovis AF2122/97
ugccgaugcgacgcagaccg

SEQ ID NO: 1204837 - RNA, 16 nt, Mycobacterium bovis subsp bovis AF2122/97
ugccgauggugauggg

SEQ ID NO: 1204838 - RNA, 13 nt, Mycobacterium bovis subsp bovis AF2122/97
ugccgcagcggcg

SEQ ID NO: 1204839 - RNA, 17 nt, Mycobacterium bovis subsp bovis AF2122/97
ugccgcagacgcggcag

SEQ ID NO: 1204840 - RNA, 18 nt, Mycobacterium bovis subsp bovis AF2122/97
ugccgcaccaaggccgcc

SEQ ID NO: 1204841 - RNA, 18 nt, Mycobacterium bovis subsp bovis AF2122/97
ugccgcaccggugcucgu

SEQ ID NO: 1204842 - RNA, 14 nt, Mycobacterium bovis subsp bovis AF2122/97
ugcccugcccgaag

SEQ ID NO: 1204843 - RNA, 18 nt, Mycobacterium bovis subsp bovis AF2122/97
ugcccugacgccccgcca

SEQ ID NO: 1204844 - RNA, 16 nt, Mycobacterium bovis subsp bovis AF2122/97
ugcccugauugaagcc

SEQ ID NO: 1204845 - RNA, 14 nt, Mycobacterium bovis subsp bovis AF2122/97
ugcccuagcagcaa

SEQ ID NO: 1204846 - RNA, 19 nt, Mycobacterium bovis subsp bovis AF2122/97
ugcccucaacgucccagcc

SEQ ID NO: 1204847 - RNA, 16 nt, Mycobacterium bovis subsp bovis AF2122/97
ugcccguggugauggu

SEQ ID NO: 1204848 - RNA, 22 nt, Mycobacterium bovis subsp bovis AF2122/97
ugcccguguuaaagaagccuga

SEQ ID NO: 1204849 - RNA, 22 nt, Mycobacterium bovis subsp bovis AF2122/97
ugcccguucaugcggcggcgcu

SEQ ID NO: 1204850 - RNA, 17 nt, Mycobacterium bovis subsp bovis AF2122/97
ugcccuggaccagcggg

SEQ ID NO: 1204851 - RNA, 16 nt, Mycobacterium bovis subsp bovis AF2122/97
ugcccugggugauggc

SEQ ID NO: 1204852 - RNA, 21 nt, Mycobacterium bovis subsp bovis AF2122/97
ugcccuugcggaagaagugcu

SEQ ID NO: 1204853 - RNA, 14 nt, Mycobacterium bovis subsp bovis AF2122/97
ugcccuugaagaaa

SEQ ID NO: 1204854 - RNA, 18 nt, Mycobacterium bovis subsp bovis AF2122/97
ugccgaacuccgcggaac

SEQ ID NO: 1204855 - RNA, 16 nt, Mycobacterium bovis subsp bovis AF2122/97
ugccgaacgccagacc

SEQ ID NO: 1204856 - RNA, 17 nt, Mycobacterium bovis subsp bovis AF2122/97
ugccgaacgccagaccg

SEQ ID NO: 1204857 - RNA, 18 nt, Mycobacterium bovis subsp bovis AF2122/97
ugccgaaccacgcgcccg

SEQ ID NO: 1204858 - RNA, 15 nt, Mycobacterium bovis subsp bovis AF2122/97
ugccgaauugggcga

SEQ ID NO: 1204859 - RNA, 19 nt, Mycobacterium bovis subsp bovis AF2122/97
ugccgaaguugaagaagcc

SEQ ID NO: 1204860 - RNA, 21 nt, Mycobacterium bovis subsp bovis AF2122/97
ugccgacgaucgacgccgcca

SEQ ID NO: 1204861 - RNA, 21 nt, Mycobacterium bovis subsp bovis AF2122/97
ugccgaccggcacccgcggcg

SEQ ID NO: 1204862 - RNA, 23 nt, Mycobacterium bovis subsp bovis AF2122/97
ugccgacgaacgaaccgccgccg

SEQ ID NO: 1204863 - RNA, 16 nt, Mycobacterium bovis subsp bovis AF2122/97
ugccgacggugauggg

SEQ ID NO: 1204864 - RNA, 15 nt, Mycobacterium bovis subsp bovis AF2122/97
ugccgagaacaccgg

SEQ ID NO: 1204865 - RNA, 23 nt, Mycobacterium bovis subsp bovis AF2122/97
ugccgaccgguuggguagcaccg

SEQ ID NO: 1204866 - RNA, 21 nt, Mycobacterium bovis subsp bovis AF2122/97
ugccgacaguuuaccgugccg

SEQ ID NO: 1204867 - RNA, 13 nt, Mycobacterium bovis subsp bovis AF2122/97
ugccgaccagcau

SEQ ID NO: 1204868 - RNA, 15 nt, Mycobacterium bovis subsp bovis AF2122/97
ugccgaccagcgcgc

SEQ ID NO: 1204869 - RNA, 21 nt, Mycobacterium bovis subsp bovis AF2122/97
ugccgacccgccgcgcccggc

SEQ ID NO: 1204870 - RNA, 16 nt, Mycobacterium bovis subsp bovis AF2122/97
ugccgauacagcacau

SEQ ID NO: 1204871 - RNA, 19 nt, Mycobacterium bovis subsp bovis AF2122/97
ugccgagcuucagcgcgcu

SEQ ID NO: 1204872 - RNA, 21 nt, Mycobacterium bovis subsp bovis AF2122/97
ugccgagcgugcgcugguggc

SEQ ID NO: 1204873 - RNA, 15 nt, Mycobacterium bovis subsp bovis AF2122/97
ugccgagaucccagc

SEQ ID NO: 1204874 - RNA, 21 nt, Mycobacterium bovis subsp bovis AF2122/97
ugcgacgcagaccguccagca

SEQ ID NO: 1204875 - RNA, 16 nt, Mycobacterium bovis subsp bovis AF2122/97
ugcgacgcccgccuuc

SEQ ID NO: 1204876 - RNA, 18 nt, Mycobacterium bovis subsp bovis AF2122/97
ugcgacggccggcaagca

SEQ ID NO: 1204877 - RNA, 19 nt, Mycobacterium bovis subsp bovis AF2122/97
ugcgacguucuugggaccg

SEQ ID NO: 1204878 - RNA, 19 nt, Mycobacterium bovis subsp bovis AF2122/97
ugcgaccgcgccaacagau

SEQ ID NO: 1204879 - RNA, 22 nt, Mycobacterium bovis subsp bovis AF2122/97
ugcgacccgcagaccgccaccg

SEQ ID NO: 1204880 - RNA, 13 nt, Mycobacterium bovis subsp bovis AF2122/97
ugcgacccgggcg

SEQ ID NO: 1204881 - RNA, 14 nt, Mycobacterium bovis subsp bovis AF2122/97
ugcgaccacaucau

SEQ ID NO: 1204882 - RNA, 18 nt, Mycobacterium bovis subsp bovis AF2122/97
ugcgaccacaucaugcca

SEQ ID NO: 1204883 - RNA, 11 nt, Mycobacterium bovis subsp bovis AF2122/97
ugccuccagaa

SEQ ID NO: 1204884 - RNA, 14 nt, Mycobacterium bovis subsp bovis AF2122/97
ugccucccgcgccg

SEQ ID NO: 1204885 - RNA, 21 nt, Mycobacterium bovis subsp bovis AF2122/97
ugccugcgcgagugccagucc

SEQ ID NO: 1204886 - RNA, 18 nt, Mycobacterium bovis subsp bovis AF2122/97
ugccuggucgcggggccg

SEQ ID NO: 1204887 - RNA, 23 nt, Mycobacterium bovis subsp bovis AF2122/97
ugcgcagcgugaaaugcacgauc

SEQ ID NO: 1204888 - RNA, 15 nt, Mycobacterium bovis subsp bovis AF2122/97
ugcgcagccaggugu

SEQ ID NO: 1204889 - RNA, 20 nt, Mycobacterium bovis subsp bovis AF2122/97
ugcgcaacuucuucagcagc

SEQ ID NO: 1204890 - RNA, 16 nt, Mycobacterium bovis subsp bovis AF2122/97
ugcgcaacgcgucguc

SEQ ID NO: 1204891 - RNA, 21 nt, Mycobacterium bovis subsp bovis AF2122/97
ugcgcaacuucuucagcagcg

SEQ ID NO: 1204892 - RNA, 16 nt, Mycobacterium bovis subsp bovis AF2122/97
ugcgcagaacaccacc

SEQ ID NO: 1204893 - RNA, 17 nt, Mycobacterium bovis subsp bovis AF2122/97
ugcgcagaacaccaccg

SEQ ID NO: 1204894 - RNA, 15 nt, Mycobacterium bovis subsp bovis AF2122/97
ugcgacugugaaucu

SEQ ID NO: 1204895 - RNA, 19 nt, Mycobacterium bovis subsp bovis AF2122/97
ugcgacugcgaaugcuggg

SEQ ID NO: 1204896 - RNA, 19 nt, Mycobacterium bovis subsp bovis AF2122/97
ugcgagaggugcugcaccu

SEQ ID NO: 1204897 - RNA, 22 nt, Mycobacterium bovis subsp bovis AF2122/97
ugcgauucacacucgggcggcu

SEQ ID NO: 1204898 - RNA, 14 nt, Mycobacterium bovis subsp bovis AF2122/97
ugcgcaacccagcc

SEQ ID NO: 1204899 - RNA, 16 nt, Mycobacterium bovis subsp bovis AF2122/97
ugcgauugcgcacacc

SEQ ID NO: 1204900 - RNA, 17 nt, Mycobacterium bovis subsp bovis AF2122/97
ugcgcaucgccaccauc

SEQ ID NO: 1204901 - RNA, 21 nt, Mycobacterium bovis subsp bovis AF2122/97
ugcgcccacccgcgccuaccc

SEQ ID NO: 1204902 - RNA, 19 nt, Mycobacterium bovis subsp bovis AF2122/97
ugcgcccaccgaaaccggu

SEQ ID NO: 1204903 - RNA, 13 nt, Mycobacterium bovis subsp bovis AF2122/97
ugcgcccagcacg

SEQ ID NO: 1204904 - RNA, 15 nt, Mycobacterium bovis subsp bovis AF2122/97
ugcgcccagcgaccc

SEQ ID NO: 1204905 - RNA, 19 nt, Mycobacterium bovis subsp bovis AF2122/97
ugcgcagggccuggaagac

SEQ ID NO: 1204906 - RNA, 15 nt, Mycobacterium bovis subsp bovis AF2122/97
aaauggccaccggcg

SEQ ID NO: 1204907 - RNA, 15 nt, Mycobacterium bovis subsp bovis AF2122/97
ugcgccuugaccaca

SEQ ID NO: 1204908 - RNA, 15 nt, Mycobacterium bovis subsp bovis AF2122/97
ugcgcgaccacccgc

SEQ ID NO: 1204909 - RNA, 17 nt, Mycobacterium bovis subsp bovis AF2122/97
ugcgcgaccgaccagcc

SEQ ID NO: 1204910 - RNA, 21 nt, Mycobacterium bovis subsp bovis AF2122/97
ugcgcgaugcgauucugcguc

SEQ ID NO: 1204911 - RNA, 17 nt, Mycobacterium bovis subsp bovis AF2122/97
ugcgccuggcuggccag

SEQ ID NO: 1204912 - RNA, 21 nt, Mycobacterium bovis subsp bovis AF2122/97
aaaugguucgcacaccuccuc

SEQ ID NO: 1204913 - RNA, 18 nt, Mycobacterium bovis subsp bovis AF2122/97
ugcggccgcugaucaaca

SEQ ID NO: 1204914 - RNA, 12 nt, Mycobacterium bovis subsp bovis AF2122/97
ugcgggcagcac

SEQ ID NO: 1204915 - RNA, 18 nt, Mycobacterium bovis subsp bovis AF2122/97
ugcgggcagccgcccgcc

SEQ ID NO: 1204916 - RNA, 15 nt, Mycobacterium bovis subsp bovis AF2122/97
ugcggcccgggcucg

SEQ ID NO: 1204917 - RNA, 19 nt, Mycobacterium bovis subsp bovis AF2122/97
ugcggcccggguggcccgg

SEQ ID NO: 1204918 - RNA, 15 nt, Mycobacterium bovis subsp bovis AF2122/97
ugcggcaacagcgcc

SEQ ID NO: 1204919 - RNA, 18 nt, Mycobacterium bovis subsp bovis AF2122/97
ugcggccacucgcccgau

SEQ ID NO: 1204920 - RNA, 23 nt, Mycobacterium bovis subsp bovis AF2122/97
ugcggccaggcgguacgggucgc

SEQ ID NO: 1204921 - RNA, 21 nt, Mycobacterium bovis subsp bovis AF2122/97
ugcggggggccuuaucccacc

SEQ ID NO: 1204922 - RNA, 17 nt, Mycobacterium bovis subsp bovis AF2122/97
ugcgggguugaccgugg

SEQ ID NO: 1204923 - RNA, 14 nt, Mycobacterium bovis subsp bovis AF2122/97
ugcggggccgggcg

SEQ ID NO: 1204924 - RNA, 20 nt, Mycobacterium bovis subsp bovis AF2122/97
ugcgggggaguagugguggg

SEQ ID NO: 1204925 - RNA, 16 nt, Mycobacterium bovis subsp bovis AF2122/97
ugcgggcucucggcgu

SEQ ID NO: 1204926 - RNA, 18 nt, Mycobacterium bovis subsp bovis AF2122/97
ugcgggcuuugccaacaa

SEQ ID NO: 1204927 - RNA, 23 nt, Mycobacterium bovis subsp bovis AF2122/97
ugcgggccuccugcuggcccugc

SEQ ID NO: 1204928 - RNA, 22 nt, Mycobacterium bovis subsp bovis AF2122/97
ugcgggcccucuaugcgggcag

SEQ ID NO: 1204929 - RNA, 12 nt, Mycobacterium bovis subsp bovis AF2122/97
ugcgggccaggc

SEQ ID NO: 1204930 - RNA, 15 nt, Mycobacterium bovis subsp bovis AF2122/97
ugcgggcccacgccc

SEQ ID NO: 1204931 - RNA, 16 nt, Mycobacterium bovis subsp bovis AF2122/97
ugcgggccgccaggcg

SEQ ID NO: 1204932 - RNA, 19 nt, Mycobacterium bovis subsp bovis AF2122/97
ugcgggccgugacccucag

SEQ ID NO: 1204933 - RNA, 16 nt, Mycobacterium bovis subsp bovis AF2122/97
ugcgggugggcacacc

SEQ ID NO: 1204934 - RNA, 17 nt, Mycobacterium bovis subsp bovis AF2122/97
ugcgggugucgggcagc

SEQ ID NO: 1204935 - RNA, 19 nt, Mycobacterium bovis subsp bovis AF2122/97
ugcgggugucgggcagcaa

SEQ ID NO: 1204936 - RNA, 17 nt, Mycobacterium bovis subsp bovis AF2122/97
ugcggguggauuggugc

SEQ ID NO: 1204937 - RNA, 15 nt, Mycobacterium bovis subsp bovis AF2122/97
ugcgguaguugcagu

SEQ ID NO: 1204938 - RNA, 18 nt, Mycobacterium bovis subsp bovis AF2122/97
ugcgguauugcccgggcg

SEQ ID NO: 1204939 - RNA, 14 nt, Mycobacterium bovis subsp bovis AF2122/97
ugcggucagauucg

SEQ ID NO: 1204940 - RNA, 19 nt, Mycobacterium bovis subsp bovis AF2122/97
ugcguagccgugggccacg

SEQ ID NO: 1204941 - RNA, 20 nt, Mycobacterium bovis subsp bovis AF2122/97
ugcguagccgugggccacga

SEQ ID NO: 1204942 - RNA, 13 nt, Mycobacterium bovis subsp bovis AF2122/97
ugcguaugcccac

SEQ ID NO: 1204943 - RNA, 22 nt, Mycobacterium bovis subsp bovis AF2122/97
ugcggaucacucccccacacac

SEQ ID NO: 1204944 - RNA, 23 nt, Mycobacterium bovis subsp bovis AF2122/97
ugcggaucacucccccacacacc

SEQ ID NO: 1204945 - RNA, 14 nt, Mycobacterium bovis subsp bovis AF2122/97
ugcgcugcagcuga

SEQ ID NO: 1204946 - RNA, 18 nt, Mycobacterium bovis subsp bovis AF2122/97
ugcggacaguucccggcc

SEQ ID NO: 1204947 - RNA, 17 nt, Mycobacterium bovis subsp bovis AF2122/97
ugcgcgugacgaccagc

SEQ ID NO: 1204948 - RNA, 22 nt, Mycobacterium bovis subsp bovis AF2122/97
ugcgcuccaacaacuccagcag

SEQ ID NO: 1204949 - RNA, 14 nt, Mycobacterium bovis subsp bovis AF2122/97
ugcgcucacuggcg

SEQ ID NO: 1204950 - RNA, 15 nt, Mycobacterium bovis subsp bovis AF2122/97
ugcgcucacuggcga

SEQ ID NO: 1204951 - RNA, 16 nt, Mycobacterium bovis subsp bovis AF2122/97
ugcgcggcuugucgcg

SEQ ID NO: 1204952 - RNA, 15 nt, Mycobacterium bovis subsp bovis AF2122/97
ugcgcggugaugguu

SEQ ID NO: 1204953 - RNA, 16 nt, Mycobacterium bovis subsp bovis AF2122/97
ugcgcgucggugucga

SEQ ID NO: 1204954 - RNA, 20 nt, Mycobacterium bovis subsp bovis AF2122/97
ugcgcgucucgagcgcgccg

SEQ ID NO: 1204955 - RNA, 17 nt, Mycobacterium bovis subsp bovis AF2122/97
ugcgcgucgagcgaccc

SEQ ID NO: 1204956 - RNA, 15 nt, Mycobacterium bovis subsp bovis AF2122/97
ugcgcggccauggca

SEQ ID NO: 1204957 - RNA, 19 nt, Mycobacterium bovis subsp bovis AF2122/97
ugcgcggaguacuccagcc

SEQ ID NO: 1204958 - RNA, 15 nt, Mycobacterium bovis subsp bovis AF2122/97
ugcgcgcgcagcuga

SEQ ID NO: 1204959 - RNA, 16 nt, Mycobacterium bovis subsp bovis AF2122/97
ugcgcgcucggccagc

SEQ ID NO: 1204960 - RNA, 20 nt, Mycobacterium bovis subsp bovis AF2122/97
ugcgcgcucggccagcauca

SEQ ID NO: 1204961 - RNA, 13 nt, Mycobacterium bovis subsp bovis AF2122/97
ugcgcgccaggcu

SEQ ID NO: 1204962 - RNA, 17 nt, Mycobacterium bovis subsp bovis AF2122/97
ugcgcgcccaccgggcg

SEQ ID NO: 1204963 - RNA, 22 nt, Mycobacterium bovis subsp bovis AF2122/97
ugaccuugcccugcgugcagau

SEQ ID NO: 1204964 - RNA, 17 nt, Mycobacterium bovis subsp bovis AF2122/97
ugagacagaccgggccc

SEQ ID NO: 1204965 - RNA, 15 nt, Mycobacterium bovis subsp bovis AF2122/97
ugagacaaaggugcc

SEQ ID NO: 1204966 - RNA, 18 nt, Mycobacterium bovis subsp bovis AF2122/97
ugagcagacgcaaaagaa

SEQ ID NO: 1204967 - RNA, 16 nt, Mycobacterium bovis subsp bovis AF2122/97
ugagcagacccagucc

SEQ ID NO: 1204968 - RNA, 17 nt, Mycobacterium bovis subsp bovis AF2122/97
ugagcagacccgugccg

SEQ ID NO: 1204969 - RNA, 16 nt, Mycobacterium bovis subsp bovis AF2122/97
ugagcagcacccauac

SEQ ID NO: 1204970 - RNA, 22 nt, Mycobacterium bovis subsp bovis AF2122/97
ugagcacgauauugggauacuc

SEQ ID NO: 1204971 - RNA, 15 nt, Mycobacterium bovis subsp bovis AF2122/97
ugagcaccugagccu

SEQ ID NO: 1204972 - RNA, 21 nt, Mycobacterium bovis subsp bovis AF2122/97
ugagcaccugggcgcgcuggc

SEQ ID NO: 1204973 - RNA, 23 nt, Mycobacterium bovis subsp bovis AF2122/97
ugagaucgcccgaguugaagaag

SEQ ID NO: 1204974 - RNA, 12 nt, Mycobacterium bovis subsp bovis AF2122/97
ugagcaccagca

SEQ ID NO: 1204975 - RNA, 15 nt, Mycobacterium bovis subsp bovis AF2122/97
ugagcaccagcagca

SEQ ID NO: 1204976 - RNA, 20 nt, Mycobacterium bovis subsp bovis AF2122/97
ugagcaccagcagcaccaac

SEQ ID NO: 1204977 - RNA, 19 nt, Mycobacterium bovis subsp bovis AF2122/97
ugagcacaccgacagcacc

SEQ ID NO: 1204978 - RNA, 23 nt, Mycobacterium bovis subsp bovis AF2122/97
ugagcaugcccagcgcacggacc

SEQ ID NO: 1204979 - RNA, 19 nt, Mycobacterium bovis subsp bovis AF2122/97
ugagccaccaacaccgcgu

SEQ ID NO: 1204980 - RNA, 16 nt, Mycobacterium bovis subsp bovis AF2122/97
ugagccaccaacaccg

SEQ ID NO: 1204981 - RNA, 20 nt, Mycobacterium bovis subsp bovis AF2122/97
ugagccaccaacaccgcguc

SEQ ID NO: 1204982 - RNA, 17 nt, Mycobacterium bovis subsp bovis AF2122/97
ugagcagggcggcgaac

SEQ ID NO: 1204983 - RNA, 15 nt, Mycobacterium bovis subsp bovis AF2122/97
ugagccgguggcccg

SEQ ID NO: 1204984 - RNA, 16 nt, Mycobacterium bovis subsp bovis AF2122/97
ugagccgugccgccag

SEQ ID NO: 1204985 - RNA, 19 nt, Mycobacterium bovis subsp bovis AF2122/97
ugagccgcagcaccucguc

SEQ ID NO: 1204986 - RNA, 14 nt, Mycobacterium bovis subsp bovis AF2122/97
ugagccgagccagc

SEQ ID NO: 1204987 - RNA, 15 nt, Mycobacterium bovis subsp bovis AF2122/97
ugagccaugccgcuc

SEQ ID NO: 1204988 - RNA, 22 nt, Mycobacterium bovis subsp bovis AF2122/97
ugagcccagccgcgggccgcgu

SEQ ID NO: 1204989 - RNA, 21 nt, Mycobacterium bovis subsp bovis AF2122/97
ugagcccgggauaccgcucag

SEQ ID NO: 1204990 - RNA, 22 nt, Mycobacterium bovis subsp bovis AF2122/97
ugaggccggugaacggcagcac

SEQ ID NO: 1204991 - RNA, 18 nt, Mycobacterium bovis subsp bovis AF2122/97
ugaguaccaauccaggcc

SEQ ID NO: 1204992 - RNA, 14 nt, Mycobacterium bovis subsp bovis AF2122/97
ugaguagguccacg

SEQ ID NO: 1204993 - RNA, 14 nt, Mycobacterium bovis subsp bovis AF2122/97
ugagcgccgcggcg

SEQ ID NO: 1204994 - RNA, 13 nt, Mycobacterium bovis subsp bovis AF2122/97
ugagcgccgaugu

SEQ ID NO: 1204995 - RNA, 21 nt, Mycobacterium bovis subsp bovis AF2122/97
ugagcgccggcaucgcgcaac

SEQ ID NO: 1204996 - RNA, 23 nt, Mycobacterium bovis subsp bovis AF2122/97
ugagcgccgcuaauggauccagc

SEQ ID NO: 1204997 - RNA, 20 nt, Mycobacterium bovis subsp bovis AF2122/97
ugagcgccggcaucgcgcaa

SEQ ID NO: 1204998 - RNA, 20 nt, Mycobacterium bovis subsp bovis AF2122/97
ugagcgcgaaguacgacgac

SEQ ID NO: 1204999 - RNA, 13 nt, Mycobacterium bovis subsp bovis AF2122/97
ugagcgcgcuggc

SEQ ID NO: 1205000 - RNA, 21 nt, Mycobacterium bovis subsp bovis AF2122/97
ugagcgcggguggcagcggcg

SEQ ID NO: 1205001 - RNA, 20 nt, Mycobacterium bovis subsp bovis AF2122/97
ugagcgcucgaaagagccgc

SEQ ID NO: 1205002 - RNA, 16 nt, Mycobacterium bovis subsp bovis AF2122/97
ugagcuuccgcgcgca

SEQ ID NO: 1205003 - RNA, 17 nt, Mycobacterium bovis subsp bovis AF2122/97
ugagcuuggucgccggg

SEQ ID NO: 1205004 - RNA, 21 nt, Mycobacterium bovis subsp bovis AF2122/97
ugaggaucccggccgggucga

SEQ ID NO: 1205005 - RNA, 22 nt, Mycobacterium bovis subsp bovis AF2122/97
ugagucguaguaggcgccgcga

SEQ ID NO: 1205006 - RNA, 14 nt, Mycobacterium bovis subsp bovis AF2122/97
ugaguccagccggc

SEQ ID NO: 1205007 - RNA, 19 nt, Mycobacterium bovis subsp bovis AF2122/97
ugauccccagcuccggguc

SEQ ID NO: 1205008 - RNA, 13 nt, Mycobacterium bovis subsp bovis AF2122/97
ugaucccauccag

SEQ ID NO: 1205009 - RNA, 21 nt, Mycobacterium bovis subsp bovis AF2122/97
ugaucggguacccaucugcuc

SEQ ID NO: 1205010 - RNA, 14 nt, Mycobacterium bovis subsp bovis AF2122/97
ugaucaccgucgua

SEQ ID NO: 1205011 - RNA, 19 nt, Mycobacterium bovis subsp bovis AF2122/97
ugaucaccgugguggcgua

SEQ ID NO: 1205012 - RNA, 16 nt, Mycobacterium bovis subsp bovis AF2122/97
ugaucacucacccggg

SEQ ID NO: 1205013 - RNA, 15 nt, Mycobacterium bovis subsp bovis AF2122/97
ugaucacauucagca

SEQ ID NO: 1205014 - RNA, 21 nt, Mycobacterium bovis subsp bovis AF2122/97
ugaucaaggcgcucccggagc

SEQ ID NO: 1205015 - RNA, 22 nt, Mycobacterium bovis subsp bovis AF2122/97
ugauggcguauagcaugccgcg

SEQ ID NO: 1205016 - RNA, 20 nt, Mycobacterium bovis subsp bovis AF2122/97
ugauggcgcgaucggugccg

SEQ ID NO: 1205017 - RNA, 15 nt, Mycobacterium bovis subsp bovis AF2122/97
ugauggacaccagcc

SEQ ID NO: 1205018 - RNA, 20 nt, Mycobacterium bovis subsp bovis AF2122/97
ugaugcugccggcaccaacc

SEQ ID NO: 1205019 - RNA, 20 nt, Mycobacterium bovis subsp bovis AF2122/97
ugaugcucgacaaccacggc

SEQ ID NO: 1205020 - RNA, 19 nt, Mycobacterium bovis subsp bovis AF2122/97
ugaugcgcugggccagggu

SEQ ID NO: 1205021 - RNA, 21 nt, Mycobacterium bovis subsp bovis AF2122/97
ugaugccguucggacccaccu

SEQ ID NO: 1205022 - RNA, 12 nt, Mycobacterium bovis subsp bovis AF2122/97
ugaugccgaugu

SEQ ID NO: 1205023 - RNA, 15 nt, Mycobacterium bovis subsp bovis AF2122/97
ugauuggggccaggu

SEQ ID NO: 1205024 - RNA, 22 nt, Mycobacterium bovis subsp bovis AF2122/97
ugauucugguucagccauucua

SEQ ID NO: 1205025 - RNA, 19 nt, Mycobacterium bovis subsp bovis AF2122/97
ugauguagggcugcuccug

SEQ ID NO: 1205026 - RNA, 21 nt, Mycobacterium bovis subsp bovis AF2122/97
ugaugucaacgugucccaagc

SEQ ID NO: 1205027 - RNA, 15 nt, Mycobacterium bovis subsp bovis AF2122/97
ugaugugcagcgagu

SEQ ID NO: 1205028 - RNA, 13 nt, Mycobacterium bovis subsp bovis AF2122/97
ugauggugccauc

SEQ ID NO: 1205029 - RNA, 22 nt, Mycobacterium bovis subsp bovis AF2122/97
ugauggucacggcgucgacugg

SEQ ID NO: 1205030 - RNA, 18 nt, Mycobacterium bovis subsp bovis AF2122/97
ugauggucagcuggccgc

SEQ ID NO: 1205031 - RNA, 18 nt, Mycobacterium bovis subsp bovis AF2122/97
ugauggucaccgucugca

SEQ ID NO: 1205032 - RNA, 23 nt, Mycobacterium bovis subsp bovis AF2122/97
ugaugggggugcacgccuugagc

SEQ ID NO: 1205033 - RNA, 14 nt, Mycobacterium bovis subsp bovis AF2122/97
ugaugggucaccuc

SEQ ID NO: 1205034 - RNA, 18 nt, Mycobacterium bovis subsp bovis AF2122/97
ugauguagggcugcuccu

SEQ ID NO: 1205035 - RNA, 21 nt, Mycobacterium bovis subsp bovis AF2122/97
ugauguagcggcguuccgggc

SEQ ID NO: 1205036 - RNA, 17 nt, Mycobacterium bovis subsp bovis AF2122/97
ugauggugugcagcagc

SEQ ID NO: 1205037 - RNA, 16 nt, Mycobacterium bovis subsp bovis AF2122/97
ugaugguucaugaaca

SEQ ID NO: 1205038 - RNA, 15 nt, Mycobacterium bovis subsp bovis AF2122/97
ugaauguugccgccg

SEQ ID NO: 1205039 - RNA, 16 nt, Mycobacterium bovis subsp bovis AF2122/97
ugaaugugcauagcaa

SEQ ID NO: 1205040 - RNA, 13 nt, Mycobacterium bovis subsp bovis AF2122/97
ugaauugcgcgcc

SEQ ID NO: 1205041 - RNA, 17 nt, Mycobacterium bovis subsp bovis AF2122/97
ugaauuucgaugaggug

SEQ ID NO: 1205042 - RNA, 21 nt, Mycobacterium bovis subsp bovis AF2122/97
ugaauccggcauacaucgccu

SEQ ID NO: 1205043 - RNA, 17 nt, Mycobacterium bovis subsp bovis AF2122/97
ugaauccagaccaugcg

SEQ ID NO: 1205044 - RNA, 15 nt, Mycobacterium bovis subsp bovis AF2122/97
ugacaccggccacca

SEQ ID NO: 1205045 - RNA, 20 nt, Mycobacterium bovis subsp bovis AF2122/97
ugacaccggccaccagcccg

SEQ ID NO: 1205046 - RNA, 17 nt, Mycobacterium bovis subsp bovis AF2122/97
ugacacccaccucgcca

SEQ ID NO: 1205047 - RNA, 23 nt, Mycobacterium bovis subsp bovis AF2122/97
ugacacccaucgaccgcccgcca

SEQ ID NO: 1205048 - RNA, 21 nt, Mycobacterium bovis subsp bovis AF2122/97
ugacaccgaaccgccgcugcc

SEQ ID NO: 1205049 - RNA, 13 nt, Mycobacterium bovis subsp bovis AF2122/97
ugacacaacaccg

SEQ ID NO: 1205050 - RNA, 17 nt, Mycobacterium bovis subsp bovis AF2122/97
ugacagacacagcaccg

SEQ ID NO: 1205051 - RNA, 18 nt, Mycobacterium bovis subsp bovis AF2122/97
ugacaaccaucgguggcc

SEQ ID NO: 1205052 - RNA, 14 nt, Mycobacterium bovis subsp bovis AF2122/97
ugacaaggaugguc

SEQ ID NO: 1205053 - RNA, 12 nt, Mycobacterium bovis subsp bovis AF2122/97
ugacccacugca

SEQ ID NO: 1205054 - RNA, 14 nt, Mycobacterium bovis subsp bovis AF2122/97
ugaccgccgcgccg

SEQ ID NO: 1205055 - RNA, 21 nt, Mycobacterium bovis subsp bovis AF2122/97
ugaccgcggugacucggccuc

SEQ ID NO: 1205056 - RNA, 15 nt, Mycobacterium bovis subsp bovis AF2122/97
ugaccgcugcccagu

SEQ ID NO: 1205057 - RNA, 24 nt, Mycobacterium bovis subsp bovis AF2122/97
ugaccggcgauuccaccuuggcca

SEQ ID NO: 1205058 - RNA, 21 nt, Mycobacterium bovis subsp bovis AF2122/97
ugaccucuucgggcagcgcgu

SEQ ID NO: 1205059 - RNA, 19 nt, Mycobacterium bovis subsp bovis AF2122/97
ugaccucgugguucugcag

SEQ ID NO: 1205060 - RNA, 13 nt, Mycobacterium bovis subsp bovis AF2122/97
ugaccuguuuggg

SEQ ID NO: 1205061 - RNA, 17 nt, Mycobacterium bovis subsp bovis AF2122/97
ugaccugggcgccccag

SEQ ID NO: 1205062 - RNA, 13 nt, Mycobacterium bovis subsp bovis AF2122/97
ugacagugaccug

SEQ ID NO: 1205063 - RNA, 19 nt, Mycobacterium bovis subsp bovis AF2122/97
ugaccagcaaccaccccag

SEQ ID NO: 1205064 - RNA, 23 nt, Mycobacterium bovis subsp bovis AF2122/97
ugaccagggugacggaguuggcc

SEQ ID NO: 1205065 - RNA, 19 nt, Mycobacterium bovis subsp bovis AF2122/97
ugaccaggaaugucuccag

SEQ ID NO: 1205066 - RNA, 11 nt, Mycobacterium bovis subsp bovis AF2122/97
ugaccaggcgg

SEQ ID NO: 1205067 - RNA, 22 nt, Mycobacterium bovis subsp bovis AF2122/97
ugaccaggaagcagaaguccuc

SEQ ID NO: 1205068 - RNA, 18 nt, Mycobacterium bovis subsp bovis AF2122/97
ugaccagccuuaugcagu

SEQ ID NO: 1205069 - RNA, 20 nt, Mycobacterium bovis subsp bovis AF2122/97
ugaccaucgacccgaucacg

SEQ ID NO: 1205070 - RNA, 11 nt, Mycobacterium bovis subsp bovis AF2122/97
ugaccaggugc

SEQ ID NO: 1205071 - RNA, 14 nt, Mycobacterium bovis subsp bovis AF2122/97
ucuucggaacgcca

SEQ ID NO: 1205072 - RNA, 20 nt, Mycobacterium bovis subsp bovis AF2122/97
ucuucgguuaaggugcgauc

SEQ ID NO: 1205073 - RNA, 16 nt, Mycobacterium bovis subsp bovis AF2122/97
ugaacaccggcgccuc

SEQ ID NO: 1205074 - RNA, 23 nt, Mycobacterium bovis subsp bovis AF2122/97
ugaacaagauucgcucaccaccg

SEQ ID NO: 1205075 - RNA, 15 nt, Mycobacterium bovis subsp bovis AF2122/97
ugaagccgggcgcuu

SEQ ID NO: 1205076 - RNA, 13 nt, Mycobacterium bovis subsp bovis AF2122/97
ugaaggcgccggu

SEQ ID NO: 1205077 - RNA, 17 nt, Mycobacterium bovis subsp bovis AF2122/97
ugaacgacauccggccg

SEQ ID NO: 1205078 - RNA, 18 nt, Mycobacterium bovis subsp bovis AF2122/97
ugaacgaucggaccacca

SEQ ID NO: 1205079 - RNA, 12 nt, Mycobacterium bovis subsp bovis AF2122/97
ugaacgccgcca

SEQ ID NO: 1205080 - RNA, 23 nt, Mycobacterium bovis subsp bovis AF2122/97
ugaacgcacccgaauuugucggc

SEQ ID NO: 1205081 - RNA, 14 nt, Mycobacterium bovis subsp bovis AF2122/97
ugaacgcaccaacg

SEQ ID NO: 1205082 - RNA, 20 nt, Mycobacterium bovis subsp bovis AF2122/97
ugaagaacaugcucacgauc

SEQ ID NO: 1205083 - RNA, 22 nt, Mycobacterium bovis subsp bovis AF2122/97
ugaagaacaugcucacgaucac

SEQ ID NO: 1205084 - RNA, 21 nt, Mycobacterium bovis subsp bovis AF2122/97
ugaaguggcgucagugcagaa

SEQ ID NO: 1205085 - RNA, 15 nt, Mycobacterium bovis subsp bovis AF2122/97
ugaaguuggcguggu

SEQ ID NO: 1205086 - RNA, 15 nt, Mycobacterium bovis subsp bovis AF2122/97
ugaaguugggaagug

SEQ ID NO: 1205087 - RNA, 23 nt, Mycobacterium bovis subsp bovis AF2122/97
ucgcgacgcgcgagaacacccgu

SEQ ID NO: 1205088 - RNA, 19 nt, Mycobacterium bovis subsp bovis AF2122/97
ucgcgagcagacgcggaau

SEQ ID NO: 1205089 - RNA, 15 nt, Mycobacterium bovis subsp bovis AF2122/97
ucgccugcgggaacg

SEQ ID NO: 1205090 - RNA, 12 nt, Mycobacterium bovis subsp bovis AF2122/97
ucgccuggaaga

SEQ ID NO: 1205091 - RNA, 16 nt, Mycobacterium bovis subsp bovis AF2122/97
ucgcgaaacaccagac

SEQ ID NO: 1205092 - RNA, 22 nt, Mycobacterium bovis subsp bovis AF2122/97
ucgcgcaaggcgccgcagggcc

SEQ ID NO: 1205093 - RNA, 15 nt, Mycobacterium bovis subsp bovis AF2122/97
ucgcgcaaccgggcg

SEQ ID NO: 1205094 - RNA, 18 nt, Mycobacterium bovis subsp bovis AF2122/97
ucgcgcagcgccgccacc

SEQ ID NO: 1205095 - RNA, 13 nt, Mycobacterium bovis subsp bovis AF2122/97
ucgcgcagcgcga

SEQ ID NO: 1205096 - RNA, 19 nt, Mycobacterium bovis subsp bovis AF2122/97
ucgcgcccgcugagccagc

SEQ ID NO: 1205097 - RNA, 14 nt, Mycobacterium bovis subsp bovis AF2122/97
ucgcgccaggccac

SEQ ID NO: 1205098 - RNA, 15 nt, Mycobacterium bovis subsp bovis AF2122/97
ucgcgccaggccacg

SEQ ID NO: 1205099 - RNA, 15 nt, Mycobacterium bovis subsp bovis AF2122/97
ucgcgcagcuccacc

SEQ ID NO: 1205100 - RNA, 17 nt, Mycobacterium bovis subsp bovis AF2122/97
ucgcgcaggaagcccac

SEQ ID NO: 1205101 - RNA, 23 nt, Mycobacterium bovis subsp bovis AF2122/97
ucgcgcauugccgacgcgcggcc

SEQ ID NO: 1205102 - RNA, 17 nt, Mycobacterium bovis subsp bovis AF2122/97
ucgcgcauugcgcuucc

SEQ ID NO: 1205103 - RNA, 24 nt, Mycobacterium bovis subsp bovis AF2122/97
ucgccgccguugccgccggcgccg

SEQ ID NO: 1205104 - RNA, 23 nt, Mycobacterium bovis subsp bovis AF2122/97
ucgccgccguugccgccgguguu

SEQ ID NO: 1205105 - RNA, 15 nt, Mycobacterium bovis subsp bovis AF2122/97
ucgccgccggcgccg

SEQ ID NO: 1205106 - RNA, 20 nt, Mycobacterium bovis subsp bovis AF2122/97
ucgccgccggcuccggcggu

SEQ ID NO: 1205107 - RNA, 14 nt, Mycobacterium bovis subsp bovis AF2122/97
ucgccgccgggcag

SEQ ID NO: 1205108 - RNA, 18 nt, Mycobacterium bovis subsp bovis AF2122/97
ucgccgccgucaccgccc

SEQ ID NO: 1205109 - RNA, 22 nt, Mycobacterium bovis subsp bovis AF2122/97
ucgccgccgucaccgcccuugc

SEQ ID NO: 1205110 - RNA, 14 nt, Mycobacterium bovis subsp bovis AF2122/97
ucgccgcgccguag

SEQ ID NO: 1205111 - RNA, 15 nt, Mycobacterium bovis subsp bovis AF2122/97
ucgccgcgacugcac

SEQ ID NO: 1205112 - RNA, 17 nt, Mycobacterium bovis subsp bovis AF2122/97
ucgccgcuuggcccggc

SEQ ID NO: 1205113 - RNA, 20 nt, Mycobacterium bovis subsp bovis AF2122/97
ucgccgcggcggcagcggcg

SEQ ID NO: 1205114 - RNA, 21 nt, Mycobacterium bovis subsp bovis AF2122/97
ucgccggaucguucgcgugcc

SEQ ID NO: 1205115 - RNA, 16 nt, Mycobacterium bovis subsp bovis AF2122/97
ucgccggaccagagcc

SEQ ID NO: 1205116 - RNA, 19 nt, Mycobacterium bovis subsp bovis AF2122/97
ucgccggaauacaccagcg

SEQ ID NO: 1205117 - RNA, 13 nt, Mycobacterium bovis subsp bovis AF2122/97
ucgccggccaccc

SEQ ID NO: 1205118 - RNA, 22 nt, Mycobacterium bovis subsp bovis AF2122/97
ucgccggaugcugucagcagcc

SEQ ID NO: 1205119 - RNA, 18 nt, Mycobacterium bovis subsp bovis AF2122/97
ucgccggaucuugccgcu

SEQ ID NO: 1205120 - RNA, 14 nt, Mycobacterium bovis subsp bovis AF2122/97
ucgccggcaccgga

SEQ ID NO: 1205121 - RNA, 17 nt, Mycobacterium bovis subsp bovis AF2122/97
ucgccggcgaaguuggu

SEQ ID NO: 1205122 - RNA, 14 nt, Mycobacterium bovis subsp bovis AF2122/97
ucgccggccggccc

SEQ ID NO: 1205123 - RNA, 15 nt, Mycobacterium bovis subsp bovis AF2122/97
ucgccggccggcccg

SEQ ID NO: 1205124 - RNA, 14 nt, Mycobacterium bovis subsp bovis AF2122/97
ucgccggcgccaag

SEQ ID NO: 1205125 - RNA, 21 nt, Mycobacterium bovis subsp bovis AF2122/97
ucgccggcuucgcccagagcc

SEQ ID NO: 1205126 - RNA, 21 nt, Mycobacterium bovis subsp bovis AF2122/97
ucgccgggcuuggccgcgccg

SEQ ID NO: 1205127 - RNA, 18 nt, Mycobacterium bovis subsp bovis AF2122/97
ucgccgggcaacgcgaac

SEQ ID NO: 1205128 - RNA, 17 nt, Mycobacterium bovis subsp bovis AF2122/97
ucgccgguguccuuggc

SEQ ID NO: 1205129 - RNA, 18 nt, Mycobacterium bovis subsp bovis AF2122/97
ucgccgguguccuuggcc

SEQ ID NO: 1205130 - RNA, 23 nt, Mycobacterium bovis subsp bovis AF2122/97
ucgccggcgcgccgggcggcgcg

SEQ ID NO: 1205131 - RNA, 16 nt, Mycobacterium bovis subsp bovis AF2122/97
ucgccgggucagcccg

SEQ ID NO: 1205132 - RNA, 16 nt, Mycobacterium bovis subsp bovis AF2122/97
ucgccucggcgcugcg

SEQ ID NO: 1205133 - RNA, 17 nt, Mycobacterium bovis subsp bovis AF2122/97
ucgccugcacgcccggc

SEQ ID NO: 1205134 - RNA, 19 nt, Mycobacterium bovis subsp bovis AF2122/97
ucgccucgacgcggcaggc

SEQ ID NO: 1205135 - RNA, 24 nt, Mycobacterium bovis subsp bovis AF2122/97
ucgccuccagcagguccgcggccg

SEQ ID NO: 1205136 - RNA, 15 nt, Mycobacterium bovis subsp bovis AF2122/97
ucgccuccaggcgcc

SEQ ID NO: 1205137 - RNA, 19 nt, Mycobacterium bovis subsp bovis AF2122/97
ucgccuccaggcgccaccc

SEQ ID NO: 1205138 - RNA, 17 nt, Mycobacterium bovis subsp bovis AF2122/97
ucgcccauuggccaggu

SEQ ID NO: 1205139 - RNA, 17 nt, Mycobacterium bovis subsp bovis AF2122/97
ucgcccauuucggcacg

SEQ ID NO: 1205140 - RNA, 21 nt, Mycobacterium bovis subsp bovis AF2122/97
ucgcccccuggauggcgcccu

SEQ ID NO: 1205141 - RNA, 20 nt, Mycobacterium bovis subsp bovis AF2122/97
ucgccccugcacagcaggcu

SEQ ID NO: 1205142 - RNA, 16 nt, Mycobacterium bovis subsp bovis AF2122/97
ucgcccucccgggccc

SEQ ID NO: 1205143 - RNA, 17 nt, Mycobacterium bovis subsp bovis AF2122/97
ucgcccgccgccaccag

SEQ ID NO: 1205144 - RNA, 19 nt, Mycobacterium bovis subsp bovis AF2122/97
ucgcccgccgccaccagcu

SEQ ID NO: 1205145 - RNA, 11 nt, Mycobacterium bovis subsp bovis AF2122/97
ucgcccaggcg

SEQ ID NO: 1205146 - RNA, 13 nt, Mycobacterium bovis subsp bovis AF2122/97
ucgcccaggcgcg

SEQ ID NO: 1205147 - RNA, 14 nt, Mycobacterium bovis subsp bovis AF2122/97
ucgcccagucccag

SEQ ID NO: 1205148 - RNA, 23 nt, Mycobacterium bovis subsp bovis AF2122/97
ucgccaucguuucacccgggcug

SEQ ID NO: 1205149 - RNA, 14 nt, Mycobacterium bovis subsp bovis AF2122/97
ucgccaugcugccc

SEQ ID NO: 1205150 - RNA, 17 nt, Mycobacterium bovis subsp bovis AF2122/97
ucgcccuuagggucgcc

SEQ ID NO: 1205151 - RNA, 19 nt, Mycobacterium bovis subsp bovis AF2122/97
ucgcccugacccggagccg

SEQ ID NO: 1205152 - RNA, 19 nt, Mycobacterium bovis subsp bovis AF2122/97
ucgccgacccgccgcggac

SEQ ID NO: 1205153 - RNA, 14 nt, Mycobacterium bovis subsp bovis AF2122/97
ucgccgacgcgaag

SEQ ID NO: 1205154 - RNA, 12 nt, Mycobacterium bovis subsp bovis AF2122/97
ucgccgaagugg

SEQ ID NO: 1205155 - RNA, 17 nt, Mycobacterium bovis subsp bovis AF2122/97
ucgccgaaucucaccgu

SEQ ID NO: 1205156 - RNA, 15 nt, Mycobacterium bovis subsp bovis AF2122/97
ucgccgacagcgccu

SEQ ID NO: 1205157 - RNA, 15 nt, Mycobacterium bovis subsp bovis AF2122/97
ucgccgcccgugccg

SEQ ID NO: 1205158 - RNA, 13 nt, Mycobacterium bovis subsp bovis AF2122/97
ucgccgcccggcg

SEQ ID NO: 1205159 - RNA, 21 nt, Mycobacterium bovis subsp bovis AF2122/97
ucgccgccgaaaaccucgccc

SEQ ID NO: 1205160 - RNA, 15 nt, Mycobacterium bovis subsp bovis AF2122/97
ucgccgcccuggccg

SEQ ID NO: 1205161 - RNA, 15 nt, Mycobacterium bovis subsp bovis AF2122/97
ucgccgcagcgucgu

SEQ ID NO: 1205162 - RNA, 14 nt, Mycobacterium bovis subsp bovis AF2122/97
ucgccgccagcgcu

SEQ ID NO: 1205163 - RNA, 22 nt, Mycobacterium bovis subsp bovis AF2122/97
ucgccgaugauguuuuccccgc

SEQ ID NO: 1205164 - RNA, 23 nt, Mycobacterium bovis subsp bovis AF2122/97
ucgccgaugauguuuuccccgcc

SEQ ID NO: 1205165 - RNA, 21 nt, Mycobacterium bovis subsp bovis AF2122/97
ucgccgaguaccggccagccg

SEQ ID NO: 1205166 - RNA, 21 nt, Mycobacterium bovis subsp bovis AF2122/97
ucgccgaggacgccggcgccg

SEQ ID NO: 1205167 - RNA, 21 nt, Mycobacterium bovis subsp bovis AF2122/97
ucgccgaggccucggccagcg

SEQ ID NO: 1205168 - RNA, 12 nt, Mycobacterium bovis subsp bovis AF2122/97
ucgccagcggca

SEQ ID NO: 1205169 - RNA, 18 nt, Mycobacterium bovis subsp bovis AF2122/97
ucgccagcgccggccagg

SEQ ID NO: 1205170 - RNA, 18 nt, Mycobacterium bovis subsp bovis AF2122/97
ucgccagcugacacccgc

SEQ ID NO: 1205171 - RNA, 23 nt, Mycobacterium bovis subsp bovis AF2122/97
ucgccaggccuaggccgaggccg

SEQ ID NO: 1205172 - RNA, 16 nt, Mycobacterium bovis subsp bovis AF2122/97
ucgccagggccuuggc

SEQ ID NO: 1205173 - RNA, 21 nt, Mycobacterium bovis subsp bovis AF2122/97
ucgccagguggccgcucucca

SEQ ID NO: 1205174 - RNA, 15 nt, Mycobacterium bovis subsp bovis AF2122/97
ucgccaaccagucgc

SEQ ID NO: 1205175 - RNA, 18 nt, Mycobacterium bovis subsp bovis AF2122/97
ucgccaacgccagcacca

SEQ ID NO: 1205176 - RNA, 21 nt, Mycobacterium bovis subsp bovis AF2122/97
ucgccaccgccggcagcaucg

SEQ ID NO: 1205177 - RNA, 14 nt, Mycobacterium bovis subsp bovis AF2122/97
ucgccacgcccagc

SEQ ID NO: 1205178 - RNA, 20 nt, Mycobacterium bovis subsp bovis AF2122/97
ucgccacuguugaagaagcc

SEQ ID NO: 1205179 - RNA, 21 nt, Mycobacterium bovis subsp bovis AF2122/97
ucgccacuguugaagaagccc

SEQ ID NO: 1205180 - RNA, 15 nt, Mycobacterium bovis subsp bovis AF2122/97
ucgccagaccgcacc

SEQ ID NO: 1205181 - RNA, 16 nt, Mycobacterium bovis subsp bovis AF2122/97
ucgccaccaccggaac

SEQ ID NO: 1205182 - RNA, 16 nt, Mycobacterium bovis subsp bovis AF2122/97
ucgccacaccggggcg

SEQ ID NO: 1205183 - RNA, 24 nt, Mycobacterium bovis subsp bovis AF2122/97
ucgccaccaucguugccggugccg

SEQ ID NO: 1205184 - RNA, 23 nt, Mycobacterium bovis subsp bovis AF2122/97
ucgcugcccaugcggcaggugcc

SEQ ID NO: 1205185 - RNA, 21 nt, Mycobacterium bovis subsp bovis AF2122/97
ucgcugcgaagccgagcauca

SEQ ID NO: 1205186 - RNA, 16 nt, Mycobacterium bovis subsp bovis AF2122/97
ucgcugcgacuggugc

SEQ ID NO: 1205187 - RNA, 19 nt, Mycobacterium bovis subsp bovis AF2122/97
ucgcugcggcgcuggccag

SEQ ID NO: 1205188 - RNA, 19 nt, Mycobacterium bovis subsp bovis AF2122/97
ucgcugcggugggccaggu

SEQ ID NO: 1205189 - RNA, 21 nt, Mycobacterium bovis subsp bovis AF2122/97
ucgcuggcgacccaaaaugcc

SEQ ID NO: 1205190 - RNA, 15 nt, Mycobacterium bovis subsp bovis AF2122/97
ucgcuggccaggccg

SEQ ID NO: 1205191 - RNA, 14 nt, Mycobacterium bovis subsp bovis AF2122/97
ucgcuggccgcgag

SEQ ID NO: 1205192 - RNA, 20 nt, Mycobacterium bovis subsp bovis AF2122/97
ucgcugacccgggccgggcc

SEQ ID NO: 1205193 - RNA, 15 nt, Mycobacterium bovis subsp bovis AF2122/97
ucgcugauccgggcg

SEQ ID NO: 1205194 - RNA, 16 nt, Mycobacterium bovis subsp bovis AF2122/97
ucgcugcaccagcugc

SEQ ID NO: 1205195 - RNA, 14 nt, Mycobacterium bovis subsp bovis AF2122/97
ucgcucgcugaugc

SEQ ID NO: 1205196 - RNA, 15 nt, Mycobacterium bovis subsp bovis AF2122/97
ucgcucgccgagcug

SEQ ID NO: 1205197 - RNA, 20 nt, Mycobacterium bovis subsp bovis AF2122/97
ucgcucaguuuggcgggugc

SEQ ID NO: 1205198 - RNA, 13 nt, Mycobacterium bovis subsp bovis AF2122/97
ucgcucagggugu

SEQ ID NO: 1205199 - RNA, 14 nt, Mycobacterium bovis subsp bovis AF2122/97
ucgcucaccggcug

SEQ ID NO: 1205200 - RNA, 15 nt, Mycobacterium bovis subsp bovis AF2122/97
ucgcuaauugcggcc

SEQ ID NO: 1205201 - RNA, 17 nt, Mycobacterium bovis subsp bovis AF2122/97
ucgcuaccuucuuggcu

SEQ ID NO: 1205202 - RNA, 20 nt, Mycobacterium bovis subsp bovis AF2122/97
ucgcgggccgcgucgaacug

SEQ ID NO: 1205203 - RNA, 22 nt, Mycobacterium bovis subsp bovis AF2122/97
ucgcggcggcgauccggucggg

SEQ ID NO: 1205204 - RNA, 20 nt, Mycobacterium bovis subsp bovis AF2122/97
ucgcggcgcuggcugcggua

SEQ ID NO: 1205205 - RNA, 17 nt, Mycobacterium bovis subsp bovis AF2122/97
ucgcggccgagacggcg

SEQ ID NO: 1205206 - RNA, 20 nt, Mycobacterium bovis subsp bovis AF2122/97
ucgcggccguggaugucgcg

SEQ ID NO: 1205207 - RNA, 14 nt, Mycobacterium bovis subsp bovis AF2122/97
ucgcggcgcagguc

SEQ ID NO: 1205208 - RNA, 21 nt, Mycobacterium bovis subsp bovis AF2122/97
ucgcggcgccgucgucagcgg

SEQ ID NO: 1205209 - RNA, 22 nt, Mycobacterium bovis subsp bovis AF2122/97
ucgcguaacuugccgcauauca

SEQ ID NO: 1205210 - RNA, 21 nt, Mycobacterium bovis subsp bovis AF2122/97
ucgcggucccacggccggccg

SEQ ID NO: 1205211 - RNA, 17 nt, Mycobacterium bovis subsp bovis AF2122/97
ucgcgucugggugcagg

SEQ ID NO: 1205212 - RNA, 16 nt, Mycobacterium bovis subsp bovis AF2122/97
ucgcgucacaccagcg

SEQ ID NO: 1205213 - RNA, 15 nt, Mycobacterium bovis subsp bovis AF2122/97
ucgcgugccacagca

SEQ ID NO: 1205214 - RNA, 16 nt, Mycobacterium bovis subsp bovis AF2122/97
ucgcgucgagagaacg

SEQ ID NO: 1205215 - RNA, 21 nt, Mycobacterium bovis subsp bovis AF2122/97
ucgcgcgaccuggucgaacug

SEQ ID NO: 1205216 - RNA, 13 nt, Mycobacterium bovis subsp bovis AF2122/97
ucgcgcgcgaaac

SEQ ID NO: 1205217 - RNA, 19 nt, Mycobacterium bovis subsp bovis AF2122/97
ucgcgcugcggcccacacc

SEQ ID NO: 1205218 - RNA, 12 nt, Mycobacterium bovis subsp bovis AF2122/97
ucgcgcugauca

SEQ ID NO: 1205219 - RNA, 15 nt, Mycobacterium bovis subsp bovis AF2122/97
ucgcggauugccgcg

SEQ ID NO: 1205220 - RNA, 13 nt, Mycobacterium bovis subsp bovis AF2122/97
ucgcggacccgcg

SEQ ID NO: 1205221 - RNA, 19 nt, Mycobacterium bovis subsp bovis AF2122/97
ucgcggagccgucgcauca

SEQ ID NO: 1205222 - RNA, 16 nt, Mycobacterium bovis subsp bovis AF2122/97
ucggaaugcuggggcc

SEQ ID NO: 1205223 - RNA, 15 nt, Mycobacterium bovis subsp bovis AF2122/97
ucggaauacaacagc

SEQ ID NO: 1205224 - RNA, 15 nt, Mycobacterium bovis subsp bovis AF2122/97
ucggacaacacggcg

SEQ ID NO: 1205225 - RNA, 14 nt, Mycobacterium bovis subsp bovis AF2122/97
ucggaccacccggc

SEQ ID NO: 1205226 - RNA, 14 nt, Mycobacterium bovis subsp bovis AF2122/97
ucggacagcgccug

SEQ ID NO: 1205227 - RNA, 14 nt, Mycobacterium bovis subsp bovis AF2122/97
ucggacagggugcg

SEQ ID NO: 1205228 - RNA, 23 nt, Mycobacterium bovis subsp bovis AF2122/97
ucggaaacggaccuccucgccca

SEQ ID NO: 1205229 - RNA, 23 nt, Mycobacterium bovis subsp bovis AF2122/97
ucggaacuagccaguuacguugu

SEQ ID NO: 1205230 - RNA, 15 nt, Mycobacterium bovis subsp bovis AF2122/97
ucggagcugggcuga

SEQ ID NO: 1205231 - RNA, 23 nt, Mycobacterium bovis subsp bovis AF2122/97
ucggaggaaccccgcgcggugcc

SEQ ID NO: 1205232 - RNA, 18 nt, Mycobacterium bovis subsp bovis AF2122/97
ucggaccagcugccggcg

SEQ ID NO: 1205233 - RNA, 13 nt, Mycobacterium bovis subsp bovis AF2122/97
ucggacccacccu

SEQ ID NO: 1205234 - RNA, 19 nt, Mycobacterium bovis subsp bovis AF2122/97
ucggcauugcgcaggaugu

SEQ ID NO: 1205235 - RNA, 19 nt, Mycobacterium bovis subsp bovis AF2122/97
ucggccaccggcgucugcc

SEQ ID NO: 1205236 - RNA, 21 nt, Mycobacterium bovis subsp bovis AF2122/97
ucggcaucggcgacgaacuga

SEQ ID NO: 1205237 - RNA, 15 nt, Mycobacterium bovis subsp bovis AF2122/97
ucggcauccaggcug

SEQ ID NO: 1205238 - RNA, 13 nt, Mycobacterium bovis subsp bovis AF2122/97
ucggcacuuagcc

SEQ ID NO: 1205239 - RNA, 17 nt, Mycobacterium bovis subsp bovis AF2122/97
ucggcacuuagcccgau

SEQ ID NO: 1205240 - RNA, 21 nt, Mycobacterium bovis subsp bovis AF2122/97
ucggcacgccgggcaucggcg

SEQ ID NO: 1205241 - RNA, 19 nt, Mycobacterium bovis subsp bovis AF2122/97
ucggcaccccacgccugcc

SEQ ID NO: 1205242 - RNA, 15 nt, Mycobacterium bovis subsp bovis AF2122/97
ucggcaccgcggccg

SEQ ID NO: 1205243 - RNA, 21 nt, Mycobacterium bovis subsp bovis AF2122/97
ucggcaccgucucgcaccgcg

SEQ ID NO: 1205244 - RNA, 20 nt, Mycobacterium bovis subsp bovis AF2122/97
ucggcacgacccgggaagga

SEQ ID NO: 1205245 - RNA, 22 nt, Mycobacterium bovis subsp bovis AF2122/97
ucggcacgacccgggaaggaac

SEQ ID NO: 1205246 - RNA, 18 nt, Mycobacterium bovis subsp bovis AF2122/97
ucggcacggauuuucgca

SEQ ID NO: 1205247 - RNA, 22 nt, Mycobacterium bovis subsp bovis AF2122/97
ucggcacgucguugggcauguc

SEQ ID NO: 1205248 - RNA, 12 nt, Mycobacterium bovis subsp bovis AF2122/97
ucggcagcagcg

SEQ ID NO: 1205249 - RNA, 16 nt, Mycobacterium bovis subsp bovis AF2122/97
ucggcagcaggacacc

SEQ ID NO: 1205250 - RNA, 18 nt, Mycobacterium bovis subsp bovis AF2122/97
ucggcagccaugcggcug

SEQ ID NO: 1205251 - RNA, 22 nt, Mycobacterium bovis subsp bovis AF2122/97
ucggcaggguggccagcaggcg

SEQ ID NO: 1205252 - RNA, 20 nt, Mycobacterium bovis subsp bovis AF2122/97
ucggaugucucggcaccaca

SEQ ID NO: 1205253 - RNA, 18 nt, Mycobacterium bovis subsp bovis AF2122/97
ucggaugucucggcacca

SEQ ID NO: 1205254 - RNA, 15 nt, Mycobacterium bovis subsp bovis AF2122/97
ucggagucaccagca

SEQ ID NO: 1205255 - RNA, 20 nt, Mycobacterium bovis subsp bovis AF2122/97
ucggcaaggacguggcgcug

SEQ ID NO: 1205256 - RNA, 12 nt, Mycobacterium bovis subsp bovis AF2122/97
ucggcaccagcg

SEQ ID NO: 1205257 - RNA, 18 nt, Mycobacterium bovis subsp bovis AF2122/97
ucggcaccagcgcgcgcc

SEQ ID NO: 1205258 - RNA, 19 nt, Mycobacterium bovis subsp bovis AF2122/97
ucggcaaaccaagcgcgcc

SEQ ID NO: 1205259 - RNA, 15 nt, Mycobacterium bovis subsp bovis AF2122/97
ucggcaaccaaccgc

SEQ ID NO: 1205260 - RNA, 20 nt, Mycobacterium bovis subsp bovis AF2122/97
ucggcaaccaccucgugggc

SEQ ID NO: 1205261 - RNA, 22 nt, Mycobacterium bovis subsp bovis AF2122/97
ucggcaacgacccgccgcccca

SEQ ID NO: 1205262 - RNA, 15 nt, Mycobacterium bovis subsp bovis AF2122/97
ucgggcagcgcggcc

SEQ ID NO: 1205263 - RNA, 16 nt, Mycobacterium bovis subsp bovis AF2122/97
ucgggcagcgcggcca

SEQ ID NO: 1205264 - RNA, 22 nt, Mycobacterium bovis subsp bovis AF2122/97
ucgggcagauaugacggcagac

SEQ ID NO: 1205265 - RNA, 12 nt, Mycobacterium bovis subsp bovis AF2122/97
ucgggcagcacc

SEQ ID NO: 1205266 - RNA, 22 nt, Mycobacterium bovis subsp bovis AF2122/97
ucgggcaugacgaauugguugc

SEQ ID NO: 1205267 - RNA, 15 nt, Mycobacterium bovis subsp bovis AF2122/97
ucgggcaacucggug

SEQ ID NO: 1205268 - RNA, 20 nt, Mycobacterium bovis subsp bovis AF2122/97
ucgggcaaccugccgggcca

SEQ ID NO: 1205269 - RNA, 17 nt, Mycobacterium bovis subsp bovis AF2122/97
ucgggcaacggcagccc

SEQ ID NO: 1205270 - RNA, 20 nt, Mycobacterium bovis subsp bovis AF2122/97
ucgggcaccccgaccaccag

SEQ ID NO: 1205271 - RNA, 11 nt, Mycobacterium bovis subsp bovis AF2122/97
ucgggcaccug

SEQ ID NO: 1205272 - RNA, 22 nt, Mycobacterium bovis subsp bovis AF2122/97
ucgggaccggggacgcgcccca

SEQ ID NO: 1205273 - RNA, 19 nt, Mycobacterium bovis subsp bovis AF2122/97
ucgggccguccucccacag

SEQ ID NO: 1205274 - RNA, 17 nt, Mycobacterium bovis subsp bovis AF2122/97
ucgggcccuccggcgca

SEQ ID NO: 1205275 - RNA, 21 nt, Mycobacterium bovis subsp bovis AF2122/97
ucgggccggccgccgcgggac

SEQ ID NO: 1205276 - RNA, 17 nt, Mycobacterium bovis subsp bovis AF2122/97
ucgggcgugucgggaac

SEQ ID NO: 1205277 - RNA, 19 nt, Mycobacterium bovis subsp bovis AF2122/97
ucgggcggcgucgcggauc

SEQ ID NO: 1205278 - RNA, 19 nt, Mycobacterium bovis subsp bovis AF2122/97
ucgggcgcggggcggccug

SEQ ID NO: 1205279 - RNA, 19 nt, Mycobacterium bovis subsp bovis AF2122/97
ucgggcuugcgcagcagcg

SEQ ID NO: 1205280 - RNA, 17 nt, Mycobacterium bovis subsp bovis AF2122/97
ucgggcugccgcaugcg

SEQ ID NO: 1205281 - RNA, 12 nt, Mycobacterium bovis subsp bovis AF2122/97
ucggggcccccg

SEQ ID NO: 1205282 - RNA, 16 nt, Mycobacterium bovis subsp bovis AF2122/97
ucggggagcugcggcg

SEQ ID NO: 1205283 - RNA, 21 nt, Mycobacterium bovis subsp bovis AF2122/97
ucggggaguucgcgcagcacc

SEQ ID NO: 1205284 - RNA, 18 nt, Mycobacterium bovis subsp bovis AF2122/97
ucgggucgaucaccgaca

SEQ ID NO: 1205285 - RNA, 12 nt, Mycobacterium bovis subsp bovis AF2122/97
ucgggugcagcc

SEQ ID NO: 1205286 - RNA, 13 nt, Mycobacterium bovis subsp bovis AF2122/97
ucgggugcauucu

SEQ ID NO: 1205287 - RNA, 13 nt, Mycobacterium bovis subsp bovis AF2122/97
ucgggguugacug

SEQ ID NO: 1205288 - RNA, 13 nt, Mycobacterium bovis subsp bovis AF2122/97
ucgggucagcacc

SEQ ID NO: 1205289 - RNA, 19 nt, Mycobacterium bovis subsp bovis AF2122/97
ucggggucgcaggccaggg

SEQ ID NO: 1205290 - RNA, 13 nt, Mycobacterium bovis subsp bovis AF2122/97
ucgggguugcgga

SEQ ID NO: 1205291 - RNA, 23 nt, Mycobacterium bovis subsp bovis AF2122/97
ucgggguuuaguuuaucggccgu

SEQ ID NO: 1205292 - RNA, 17 nt, Mycobacterium bovis subsp bovis AF2122/97
ucggggggaucucgguc

SEQ ID NO: 1205293 - RNA, 15 nt, Mycobacterium bovis subsp bovis AF2122/97
ucggggugcacaccg

SEQ ID NO: 1205294 - RNA, 18 nt, Mycobacterium bovis subsp bovis AF2122/97
ucgguaccgacggcacca

SEQ ID NO: 1205295 - RNA, 13 nt, Mycobacterium bovis subsp bovis AF2122/97
ucgguagucgaug

SEQ ID NO: 1205296 - RNA, 15 nt, Mycobacterium bovis subsp bovis AF2122/97
ucggguucuucaacu

SEQ ID NO: 1205297 - RNA, 21 nt, Mycobacterium bovis subsp bovis AF2122/97
ucgguucgccccugcacagca

SEQ ID NO: 1205298 - RNA, 22 nt, Mycobacterium bovis subsp bovis AF2122/97
ucgguguggcccaacaccgcca

SEQ ID NO: 1205299 - RNA, 22 nt, Mycobacterium bovis subsp bovis AF2122/97
ucgguguagagagccauguccu

SEQ ID NO: 1205300 - RNA, 22 nt, Mycobacterium bovis subsp bovis AF2122/97
ucggugggcuugccgcgcacca

SEQ ID NO: 1205301 - RNA, 16 nt, Mycobacterium bovis subsp bovis AF2122/97
ucggugucuuccaacc

SEQ ID NO: 1205302 - RNA, 14 nt, Mycobacterium bovis subsp bovis AF2122/97
ucgguuagcgcggc

SEQ ID NO: 1205303 - RNA, 16 nt, Mycobacterium bovis subsp bovis AF2122/97
ucgguuagcgcggcca

SEQ ID NO: 1205304 - RNA, 16 nt, Mycobacterium bovis subsp bovis AF2122/97
ucgguuagcugcucug

SEQ ID NO: 1205305 - RNA, 18 nt, Mycobacterium bovis subsp bovis AF2122/97
ucggugguggcgucgaug

SEQ ID NO: 1205306 - RNA, 22 nt, Mycobacterium bovis subsp bovis AF2122/97
ucggugccggggcugccgccgu

SEQ ID NO: 1205307 - RNA, 14 nt, Mycobacterium bovis subsp bovis AF2122/97
ucggugcagcccgc

SEQ ID NO: 1205308 - RNA, 21 nt, Mycobacterium bovis subsp bovis AF2122/97
ucggugcagcccgccgcugaa

SEQ ID NO: 1205309 - RNA, 23 nt, Mycobacterium bovis subsp bovis AF2122/97
ucggugcggaacaccgcccggcc

SEQ ID NO: 1205310 - RNA, 15 nt, Mycobacterium bovis subsp bovis AF2122/97
ucggugcgcgcggcg

SEQ ID NO: 1205311 - RNA, 13 nt, Mycobacterium bovis subsp bovis AF2122/97
ucggugcacggcg

SEQ ID NO: 1205312 - RNA, 22 nt, Mycobacterium bovis subsp bovis AF2122/97
ucggugacgaagagcaccgcgc

SEQ ID NO: 1205313 - RNA, 16 nt, Mycobacterium bovis subsp bovis AF2122/97
ucggugagcgggcaag

SEQ ID NO: 1205314 - RNA, 22 nt, Mycobacterium bovis subsp bovis AF2122/97
ucggugagcccguugaccugcg

SEQ ID NO: 1205315 - RNA, 17 nt, Mycobacterium bovis subsp bovis AF2122/97
ucggugaccuguuuggg

SEQ ID NO: 1205316 - RNA, 20 nt, Mycobacterium bovis subsp bovis AF2122/97
ucggugacggucaaaugaau

SEQ ID NO: 1205317 - RNA, 18 nt, Mycobacterium bovis subsp bovis AF2122/97
ucggucgggggugcucgg

SEQ ID NO: 1205318 - RNA, 15 nt, Mycobacterium bovis subsp bovis AF2122/97
ucggucguccggauc

SEQ ID NO: 1205319 - RNA, 20 nt, Mycobacterium bovis subsp bovis AF2122/97
ucggucucauagugcagguc

SEQ ID NO: 1205320 - RNA, 16 nt, Mycobacterium bovis subsp bovis AF2122/97
ucggugaacgccgccc

SEQ ID NO: 1205321 - RNA, 17 nt, Mycobacterium bovis subsp bovis AF2122/97
ucgguccacccaagcuc

SEQ ID NO: 1205322 - RNA, 13 nt, Mycobacterium bovis subsp bovis AF2122/97
ucggucugcaugc

SEQ ID NO: 1205323 - RNA, 23 nt, Mycobacterium bovis subsp bovis AF2122/97
ucggugaaaaaggcgacucggug

SEQ ID NO: 1205324 - RNA, 19 nt, Mycobacterium bovis subsp bovis AF2122/97
ucggucagcgggcacgccg

SEQ ID NO: 1205325 - RNA, 22 nt, Mycobacterium bovis subsp bovis AF2122/97
ucggucaagucugucuggcccc

SEQ ID NO: 1205326 - RNA, 22 nt, Mycobacterium bovis subsp bovis AF2122/97
ucggucaauucggugcgcuggc

SEQ ID NO: 1205327 - RNA, 13 nt, Mycobacterium bovis subsp bovis AF2122/97
ucggcccgcugac

SEQ ID NO: 1205328 - RNA, 16 nt, Mycobacterium bovis subsp bovis AF2122/97
ucggcccgugccacag

SEQ ID NO: 1205329 - RNA, 17 nt, Mycobacterium bovis subsp bovis AF2122/97
ucggccgacaccgccac

SEQ ID NO: 1205330 - RNA, 18 nt, Mycobacterium bovis subsp bovis AF2122/97
ucggccgaugcgcagugc

SEQ ID NO: 1205331 - RNA, 14 nt, Mycobacterium bovis subsp bovis AF2122/97
ucggccgcaaggcg

SEQ ID NO: 1205332 - RNA, 15 nt, Mycobacterium bovis subsp bovis AF2122/97
ucggccgcaaggcgc

SEQ ID NO: 1205333 - RNA, 22 nt, Mycobacterium bovis subsp bovis AF2122/97
ucggccgccgaauuggcggaac

SEQ ID NO: 1205334 - RNA, 15 nt, Mycobacterium bovis subsp bovis AF2122/97
ucggcccagcgcgcc

SEQ ID NO: 1205335 - RNA, 21 nt, Mycobacterium bovis subsp bovis AF2122/97
ucggccauugcccgggcggga

SEQ ID NO: 1205336 - RNA, 20 nt, Mycobacterium bovis subsp bovis AF2122/97
ucggccaucguccagcagga

SEQ ID NO: 1205337 - RNA, 19 nt, Mycobacterium bovis subsp bovis AF2122/97
ucggccagcuccgccugcc

SEQ ID NO: 1205338 - RNA, 13 nt, Mycobacterium bovis subsp bovis AF2122/97
ucggccaggauga

SEQ ID NO: 1205339 - RNA, 17 nt, Mycobacterium bovis subsp bovis AF2122/97
ucggccaucguccagca

SEQ ID NO: 1205340 - RNA, 20 nt, Mycobacterium bovis subsp bovis AF2122/97
ucggcgagccgugcuaccca

SEQ ID NO: 1205341 - RNA, 24 nt, Mycobacterium bovis subsp bovis AF2122/97
ucggcgaucgucaagccgggcacg

SEQ ID NO: 1205342 - RNA, 14 nt, Mycobacterium bovis subsp bovis AF2122/97
ucggcgaccggccg

SEQ ID NO: 1205343 - RNA, 24 nt, Mycobacterium bovis subsp bovis AF2122/97
ucggcgaccgccugcgcggcugcc

SEQ ID NO: 1205344 - RNA, 22 nt, Mycobacterium bovis subsp bovis AF2122/97
ucggcgaacgccguggugcgca

SEQ ID NO: 1205345 - RNA, 16 nt, Mycobacterium bovis subsp bovis AF2122/97
ucggcgaccaccagcg

SEQ ID NO: 1205346 - RNA, 16 nt, Mycobacterium bovis subsp bovis AF2122/97
ucggcgaccagcugug

SEQ ID NO: 1205347 - RNA, 19 nt, Mycobacterium bovis subsp bovis AF2122/97
ucggcgaugcgcaccagca

SEQ ID NO: 1205348 - RNA, 19 nt, Mycobacterium bovis subsp bovis AF2122/97
ucggcgcccgcucggccgc

SEQ ID NO: 1205349 - RNA, 12 nt, Mycobacterium bovis subsp bovis AF2122/97
ucggcgccgaag

SEQ ID NO: 1205350 - RNA, 12 nt, Mycobacterium bovis subsp bovis AF2122/97
ucggcgccagau

SEQ ID NO: 1205351 - RNA, 16 nt, Mycobacterium bovis subsp bovis AF2122/97
ucggccugcgccggcg

SEQ ID NO: 1205352 - RNA, 20 nt, Mycobacterium bovis subsp bovis AF2122/97
ucggccugccggcagcggcg

SEQ ID NO: 1205353 - RNA, 18 nt, Mycobacterium bovis subsp bovis AF2122/97
ucggccugcugcugcagc

SEQ ID NO: 1205354 - RNA, 19 nt, Mycobacterium bovis subsp bovis AF2122/97
ucggccuguucggcggcug

SEQ ID NO: 1205355 - RNA, 20 nt, Mycobacterium bovis subsp bovis AF2122/97
ucggcgaaccacggcagcca

SEQ ID NO: 1205356 - RNA, 17 nt, Mycobacterium bovis subsp bovis AF2122/97
ucggcgaaacccgggau

SEQ ID NO: 1205357 - RNA, 16 nt, Mycobacterium bovis subsp bovis AF2122/97
ucggccggcaccccac

SEQ ID NO: 1205358 - RNA, 21 nt, Mycobacterium bovis subsp bovis AF2122/97
ucggcgccgccguccagcgcc

SEQ ID NO: 1205359 - RNA, 21 nt, Mycobacterium bovis subsp bovis AF2122/97
ucggcgcgcaccucggcgaag

SEQ ID NO: 1205360 - RNA, 20 nt, Mycobacterium bovis subsp bovis AF2122/97
ucggcgccucggaccagacc

SEQ ID NO: 1205361 - RNA, 17 nt, Mycobacterium bovis subsp bovis AF2122/97
ucggcgcgccgcacacg

SEQ ID NO: 1205362 - RNA, 15 nt, Mycobacterium bovis subsp bovis AF2122/97
ucggcggccaccaug

SEQ ID NO: 1205363 - RNA, 15 nt, Mycobacterium bovis subsp bovis AF2122/97
ucggcggcaacggcg

SEQ ID NO: 1205364 - RNA, 21 nt, Mycobacterium bovis subsp bovis AF2122/97
ucggcgcugacgacccuccgc

SEQ ID NO: 1205365 - RNA, 22 nt, Mycobacterium bovis subsp bovis AF2122/97
ucggcgcugaucgcgcgcaccg

SEQ ID NO: 1205366 - RNA, 16 nt, Mycobacterium bovis subsp bovis AF2122/97
ucggcgcugcgcaccg

SEQ ID NO: 1205367 - RNA, 18 nt, Mycobacterium bovis subsp bovis AF2122/97
ucggcgcugcgcaccgcc

SEQ ID NO: 1205368 - RNA, 15 nt, Mycobacterium bovis subsp bovis AF2122/97
ucggcggccguggcc

SEQ ID NO: 1205369 - RNA, 13 nt, Mycobacterium bovis subsp bovis AF2122/97
ucggcggccggca

SEQ ID NO: 1205370 - RNA, 20 nt, Mycobacterium bovis subsp bovis AF2122/97
ucggcggcgaccgccagcgu

SEQ ID NO: 1205371 - RNA, 22 nt, Mycobacterium bovis subsp bovis AF2122/97
ucggcggccucgcugcucagca

SEQ ID NO: 1205372 - RNA, 15 nt, Mycobacterium bovis subsp bovis AF2122/97
ucggcggcagcggcg

SEQ ID NO: 1205373 - RNA, 22 nt, Mycobacterium bovis subsp bovis AF2122/97
ucggcggcuucgauugcgcugc

SEQ ID NO: 1205374 - RNA, 22 nt, Mycobacterium bovis subsp bovis AF2122/97
ucggcggcuucguggcggcgcg

SEQ ID NO: 1205375 - RNA, 18 nt, Mycobacterium bovis subsp bovis AF2122/97
ucggcggcgucuucgucg

SEQ ID NO: 1205376 - RNA, 15 nt, Mycobacterium bovis subsp bovis AF2122/97
ucggcggcuuggccg

SEQ ID NO: 1205377 - RNA, 15 nt, Mycobacterium bovis subsp bovis AF2122/97
ucggcgugcaggguc

SEQ ID NO: 1205378 - RNA, 19 nt, Mycobacterium bovis subsp bovis AF2122/97
ucggcgucaccguguugca

SEQ ID NO: 1205379 - RNA, 22 nt, Mycobacterium bovis subsp bovis AF2122/97
ucggcggugaaaucgcacagcg

SEQ ID NO: 1205380 - RNA, 13 nt, Mycobacterium bovis subsp bovis AF2122/97
ucggcggugagca

SEQ ID NO: 1205381 - RNA, 16 nt, Mycobacterium bovis subsp bovis AF2122/97
ucggcggcggcgccuu

SEQ ID NO: 1205382 - RNA, 23 nt, Mycobacterium bovis subsp bovis AF2122/97
ucggcggugaaaucgcacagcgc

SEQ ID NO: 1205383 - RNA, 22 nt, Mycobacterium bovis subsp bovis AF2122/97
ucggcucgagucgcagcacggg

SEQ ID NO: 1205384 - RNA, 12 nt, Mycobacterium bovis subsp bovis AF2122/97
ucggcucagcaa

SEQ ID NO: 1205385 - RNA, 18 nt, Mycobacterium bovis subsp bovis AF2122/97
ucggcguguccgccgaac

SEQ ID NO: 1205386 - RNA, 13 nt, Mycobacterium bovis subsp bovis AF2122/97
ucggcuaccuaac

SEQ ID NO: 1205387 - RNA, 15 nt, Mycobacterium bovis subsp bovis AF2122/97
ucggcuaccuaaccc

SEQ ID NO: 1205388 - RNA, 16 nt, Mycobacterium bovis subsp bovis AF2122/97
ucggcuaccuaacccg

SEQ ID NO: 1205389 - RNA, 20 nt, Mycobacterium bovis subsp bovis AF2122/97
ucggcuaccuuguccggccc

SEQ ID NO: 1205390 - RNA, 22 nt, Mycobacterium bovis subsp bovis AF2122/97
ucggcuggugggggagcggccg

SEQ ID NO: 1205391 - RNA, 18 nt, Mycobacterium bovis subsp bovis AF2122/97
ucggcugccgcggcugcc

SEQ ID NO: 1205392 - RNA, 14 nt, Mycobacterium bovis subsp bovis AF2122/97
ucggcuggacggcg

SEQ ID NO: 1205393 - RNA, 15 nt, Mycobacterium bovis subsp bovis AF2122/97
ucgggacgaaaaaau

SEQ ID NO: 1205394 - RNA, 19 nt, Mycobacterium bovis subsp bovis AF2122/97
ucgggaccggcuugccgcc

SEQ ID NO: 1205395 - RNA, 22 nt, Mycobacterium bovis subsp bovis AF2122/97
ucgggaacgccgaacaccgccg

SEQ ID NO: 1205396 - RNA, 14 nt, Mycobacterium bovis subsp bovis AF2122/97
ucggcuuggcugug

SEQ ID NO: 1205397 - RNA, 18 nt, Mycobacterium bovis subsp bovis AF2122/97
ucgucggcgacggccagc

SEQ ID NO: 1205398 - RNA, 14 nt, Mycobacterium bovis subsp bovis AF2122/97
ucgucggcaggcag

SEQ ID NO: 1205399 - RNA, 18 nt, Mycobacterium bovis subsp bovis AF2122/97
ucgucggcgggcugcagu

SEQ ID NO: 1205400 - RNA, 20 nt, Mycobacterium bovis subsp bovis AF2122/97
ucgucggcgcggcugucgug

SEQ ID NO: 1205401 - RNA, 16 nt, Mycobacterium bovis subsp bovis AF2122/97
ucgucggcgccggcgg

SEQ ID NO: 1205402 - RNA, 17 nt, Mycobacterium bovis subsp bovis AF2122/97
ucgucgggacgccgccc

SEQ ID NO: 1205403 - RNA, 20 nt, Mycobacterium bovis subsp bovis AF2122/97
ucgucgguaaugccgggccc

SEQ ID NO: 1205404 - RNA, 22 nt, Mycobacterium bovis subsp bovis AF2122/97
ucgucgccgucggugccgccgc

SEQ ID NO: 1205405 - RNA, 13 nt, Mycobacterium bovis subsp bovis AF2122/97
ucgucgccagggc

SEQ ID NO: 1205406 - RNA, 15 nt, Mycobacterium bovis subsp bovis AF2122/97
ucgucgccagggccg

SEQ ID NO: 1205407 - RNA, 14 nt, Mycobacterium bovis subsp bovis AF2122/97
ucgucgcccaggcg

SEQ ID NO: 1205408 - RNA, 20 nt, Mycobacterium bovis subsp bovis AF2122/97
ucgucgcugagcagcgccgc

SEQ ID NO: 1205409 - RNA, 22 nt, Mycobacterium bovis subsp bovis AF2122/97
ucgucgcccaggcgugucgucg

SEQ ID NO: 1205410 - RNA, 14 nt, Mycobacterium bovis subsp bovis AF2122/97
ucgucgaccaggcc

SEQ ID NO: 1205411 - RNA, 18 nt, Mycobacterium bovis subsp bovis AF2122/97
ucgucgaacuuugucgcg

SEQ ID NO: 1205412 - RNA, 23 nt, Mycobacterium bovis subsp bovis AF2122/97
ucguccuggaaccaaaccugggc

SEQ ID NO: 1205413 - RNA, 15 nt, Mycobacterium bovis subsp bovis AF2122/97
ucguccucgcuggau

SEQ ID NO: 1205414 - RNA, 16 nt, Mycobacterium bovis subsp bovis AF2122/97
ucguccggugcgaucc

SEQ ID NO: 1205415 - RNA, 16 nt, Mycobacterium bovis subsp bovis AF2122/97
ucgucgagcaccaccc

SEQ ID NO: 1205416 - RNA, 21 nt, Mycobacterium bovis subsp bovis AF2122/97
ucgucgagcaccacccgggcc

SEQ ID NO: 1205417 - RNA, 22 nt, Mycobacterium bovis subsp bovis AF2122/97
ucgucgagcaccacccgggccu

SEQ ID NO: 1205418 - RNA, 22 nt, Mycobacterium bovis subsp bovis AF2122/97
ucgucgacgcgucguggucggc

SEQ ID NO: 1205419 - RNA, 15 nt, Mycobacterium bovis subsp bovis AF2122/97
ucgucgacgagguca

SEQ ID NO: 1205420 - RNA, 16 nt, Mycobacterium bovis subsp bovis AF2122/97
ucgucgacggccuggg

SEQ ID NO: 1205421 - RNA, 16 nt, Mycobacterium bovis subsp bovis AF2122/97
ucgucgaguuggccau

SEQ ID NO: 1205422 - RNA, 21 nt, Mycobacterium bovis subsp bovis AF2122/97
ucgucccgcggcgcggagagc

SEQ ID NO: 1205423 - RNA, 13 nt, Mycobacterium bovis subsp bovis AF2122/97
ucguccgcugacc

SEQ ID NO: 1205424 - RNA, 21 nt, Mycobacterium bovis subsp bovis AF2122/97
ucguccgcggucucagugcuc

SEQ ID NO: 1205425 - RNA, 13 nt, Mycobacterium bovis subsp bovis AF2122/97
ucguccggccacg

SEQ ID NO: 1205426 - RNA, 14 nt, Mycobacterium bovis subsp bovis AF2122/97
ucguccccagaccg

SEQ ID NO: 1205427 - RNA, 15 nt, Mycobacterium bovis subsp bovis AF2122/97
ucgucaugccagucg

SEQ ID NO: 1205428 - RNA, 21 nt, Mycobacterium bovis subsp bovis AF2122/97
ucguccagcgaucccggugag

SEQ ID NO: 1205429 - RNA, 11 nt, Mycobacterium bovis subsp bovis AF2122/97
ucgucaggccc

SEQ ID NO: 1205430 - RNA, 20 nt, Mycobacterium bovis subsp bovis AF2122/97
ucguagacagucugcgacug

SEQ ID NO: 1205431 - RNA, 15 nt, Mycobacterium bovis subsp bovis AF2122/97
ucguacucccaggcc

SEQ ID NO: 1205432 - RNA, 20 nt, Mycobacterium bovis subsp bovis AF2122/97
ucguaaucggcaaugagcua

SEQ ID NO: 1205433 - RNA, 14 nt, Mycobacterium bovis subsp bovis AF2122/97
ucgucaccccacca

SEQ ID NO: 1205434 - RNA, 15 nt, Mycobacterium bovis subsp bovis AF2122/97
ucguauugauccagg

SEQ ID NO: 1205435 - RNA, 20 nt, Mycobacterium bovis subsp bovis AF2122/97
ucguagggauagcagugcag

SEQ ID NO: 1205436 - RNA, 20 nt, Mycobacterium bovis subsp bovis AF2122/97
ucguagcgcgcauagggcug

SEQ ID NO: 1205437 - RNA, 14 nt, Mycobacterium bovis subsp bovis AF2122/97
ucgucucggccacg

SEQ ID NO: 1205438 - RNA, 20 nt, Mycobacterium bovis subsp bovis AF2122/97
ucgucguguuggccgggucg

SEQ ID NO: 1205439 - RNA, 20 nt, Mycobacterium bovis subsp bovis AF2122/97
ucgucguaccguucgggccg

SEQ ID NO: 1205440 - RNA, 23 nt, Mycobacterium bovis subsp bovis AF2122/97
ucgugacguuguaggagaacguc

SEQ ID NO: 1205441 - RNA, 19 nt, Mycobacterium bovis subsp bovis AF2122/97
ucgugagcuuuaucugcau

SEQ ID NO: 1205442 - RNA, 23 nt, Mycobacterium bovis subsp bovis AF2122/97
ucgugagacugggcgcuggaggc

SEQ ID NO: 1205443 - RNA, 12 nt, Mycobacterium bovis subsp bovis AF2122/97
ucgugagccagc

SEQ ID NO: 1205444 - RNA, 16 nt, Mycobacterium bovis subsp bovis AF2122/97
ucguggaucugccucu

SEQ ID NO: 1205445 - RNA, 15 nt, Mycobacterium bovis subsp bovis AF2122/97
ucguggcgcucggcg

SEQ ID NO: 1205446 - RNA, 22 nt, Mycobacterium bovis subsp bovis AF2122/97
ucguggcgccgccccauacuug

SEQ ID NO: 1205447 - RNA, 15 nt, Mycobacterium bovis subsp bovis AF2122/97
ucguggaucugccuc

SEQ ID NO: 1205448 - RNA, 23 nt, Mycobacterium bovis subsp bovis AF2122/97
ucguggagauacauuucccaguc

SEQ ID NO: 1205449 - RNA, 20 nt, Mycobacterium bovis subsp bovis AF2122/97
ucguguccaccggaccgacc

SEQ ID NO: 1205450 - RNA, 13 nt, Mycobacterium bovis subsp bovis AF2122/97
ucgugguaaccau

SEQ ID NO: 1205451 - RNA, 14 nt, Mycobacterium bovis subsp bovis AF2122/97
ucgugcagcccaag

SEQ ID NO: 1205452 - RNA, 21 nt, Mycobacterium bovis subsp bovis AF2122/97
ucgugcacgacgacaucgagc

SEQ ID NO: 1205453 - RNA, 16 nt, Mycobacterium bovis subsp bovis AF2122/97
ucgugccggcguugcc

SEQ ID NO: 1205454 - RNA, 13 nt, Mycobacterium bovis subsp bovis AF2122/97
ucgugccggcguu

SEQ ID NO: 1205455 - RNA, 16 nt, Mycobacterium bovis subsp bovis AF2122/97
ucguguuggccggguc

SEQ ID NO: 1205456 - RNA, 22 nt, Mycobacterium bovis subsp bovis AF2122/97
ucguuaucgacaccaccauucc

SEQ ID NO: 1205457 - RNA, 15 nt, Mycobacterium bovis subsp bovis AF2122/97
ucguuggggcugccg

SEQ ID NO: 1205458 - RNA, 16 nt, Mycobacterium bovis subsp bovis AF2122/97
ucguuguccagcgucu

SEQ ID NO: 1205459 - RNA, 13 nt, Mycobacterium bovis subsp bovis AF2122/97
ucguugucuuggg

SEQ ID NO: 1205460 - RNA, 23 nt, Mycobacterium bovis subsp bovis AF2122/97
ucguugucagcgaacggccagga

SEQ ID NO: 1205461 - RNA, 14 nt, Mycobacterium bovis subsp bovis AF2122/97
ucguugccagggcg

SEQ ID NO: 1205462 - RNA, 19 nt, Mycobacterium bovis subsp bovis AF2122/97
ucguugcuggcggccagca

SEQ ID NO: 1205463 - RNA, 22 nt, Mycobacterium bovis subsp bovis AF2122/97
ucguugaugcggcuauuggccu

SEQ ID NO: 1205464 - RNA, 13 nt, Mycobacterium bovis subsp bovis AF2122/97
ucuccaccuucug

SEQ ID NO: 1205465 - RNA, 14 nt, Mycobacterium bovis subsp bovis AF2122/97
ucuccagauguccg

SEQ ID NO: 1205466 - RNA, 18 nt, Mycobacterium bovis subsp bovis AF2122/97
ucucaugcaucugcuucu

SEQ ID NO: 1205467 - RNA, 23 nt, Mycobacterium bovis subsp bovis AF2122/97
ucuccgccaacaacuucucgucg

SEQ ID NO: 1205468 - RNA, 12 nt, Mycobacterium bovis subsp bovis AF2122/97
ucuccgccgccc

SEQ ID NO: 1205469 - RNA, 14 nt, Mycobacterium bovis subsp bovis AF2122/97
ucucccuugccgcc

SEQ ID NO: 1205470 - RNA, 18 nt, Mycobacterium bovis subsp bovis AF2122/97
ucucccggcugaugccug

SEQ ID NO: 1205471 - RNA, 20 nt, Mycobacterium bovis subsp bovis AF2122/97
ucuccccguccugccagucc

SEQ ID NO: 1205472 - RNA, 12 nt, Mycobacterium bovis subsp bovis AF2122/97
ucuccaugcucg

SEQ ID NO: 1205473 - RNA, 17 nt, Mycobacterium bovis subsp bovis AF2122/97
ucucgaccgcgccugga

SEQ ID NO: 1205474 - RNA, 18 nt, Mycobacterium bovis subsp bovis AF2122/97
ucucgaccgcgccuggag

SEQ ID NO: 1205475 - RNA, 19 nt, Mycobacterium bovis subsp bovis AF2122/97
ucucgaccguauugaccag

SEQ ID NO: 1205476 - RNA, 22 nt, Mycobacterium bovis subsp bovis AF2122/97
ucucgaccguauugaccagcgg

SEQ ID NO: 1205477 - RNA, 13 nt, Mycobacterium bovis subsp bovis AF2122/97
ucucgagccgcgg

SEQ ID NO: 1205478 - RNA, 14 nt, Mycobacterium bovis subsp bovis AF2122/97
ucucgaguccaggc

SEQ ID NO: 1205479 - RNA, 16 nt, Mycobacterium bovis subsp bovis AF2122/97
ucucgccguuggcggc

SEQ ID NO: 1205480 - RNA, 20 nt, Mycobacterium bovis subsp bovis AF2122/97
ucucgccgggaaacaccggc

SEQ ID NO: 1205481 - RNA, 20 nt, Mycobacterium bovis subsp bovis AF2122/97
ucucgccgaccuuggcgucg

SEQ ID NO: 1205482 - RNA, 19 nt, Mycobacterium bovis subsp bovis AF2122/97
ucucgaucggcgcaaucaa

SEQ ID NO: 1205483 - RNA, 21 nt, Mycobacterium bovis subsp bovis AF2122/97
ucucgaucggcgcaaucaacg

SEQ ID NO: 1205484 - RNA, 21 nt, Mycobacterium bovis subsp bovis AF2122/97
ucucgaucuggucaagacccg

SEQ ID NO: 1205485 - RNA, 15 nt, Mycobacterium bovis subsp bovis AF2122/97
ucucgcaagggggag

SEQ ID NO: 1205486 - RNA, 17 nt, Mycobacterium bovis subsp bovis AF2122/97
ucucgcaccagucgucg

SEQ ID NO: 1205487 - RNA, 15 nt, Mycobacterium bovis subsp bovis AF2122/97
ucucgcaccgcgccg

SEQ ID NO: 1205488 - RNA, 14 nt, Mycobacterium bovis subsp bovis AF2122/97
ucucgcccacccgc

SEQ ID NO: 1205489 - RNA, 17 nt, Mycobacterium bovis subsp bovis AF2122/97
ucuccuccaccagugcc

SEQ ID NO: 1205490 - RNA, 14 nt, Mycobacterium bovis subsp bovis AF2122/97
ucuccuccagagac

SEQ ID NO: 1205491 - RNA, 19 nt, Mycobacterium bovis subsp bovis AF2122/97
ucuccggcaacagcaccag

SEQ ID NO: 1205492 - RNA, 18 nt, Mycobacterium bovis subsp bovis AF2122/97
ucuccgugagccggaccg

SEQ ID NO: 1205493 - RNA, 15 nt, Mycobacterium bovis subsp bovis AF2122/97
ucuccuggaaaggac

SEQ ID NO: 1205494 - RNA, 22 nt, Mycobacterium bovis subsp bovis AF2122/97
ucuccuggaaaggacggccggc

SEQ ID NO: 1205495 - RNA, 21 nt, Mycobacterium bovis subsp bovis AF2122/97
ucuccuccgcguagagcagca

SEQ ID NO: 1205496 - RNA, 19 nt, Mycobacterium bovis subsp bovis AF2122/97
ucuccuccggaaagcucuc

SEQ ID NO: 1205497 - RNA, 18 nt, Mycobacterium bovis subsp bovis AF2122/97
ucugaaaauugacccccu

SEQ ID NO: 1205498 - RNA, 16 nt, Mycobacterium bovis subsp bovis AF2122/97
ucugcaccggcaggcg

SEQ ID NO: 1205499 - RNA, 19 nt, Mycobacterium bovis subsp bovis AF2122/97
ucugcagcgucuccuugag

SEQ ID NO: 1205500 - RNA, 17 nt, Mycobacterium bovis subsp bovis AF2122/97
ucugcaggcccaggcug

SEQ ID NO: 1205501 - RNA, 21 nt, Mycobacterium bovis subsp bovis AF2122/97
ucugcagcacgcgugguucgg

SEQ ID NO: 1205502 - RNA, 23 nt, Mycobacterium bovis subsp bovis AF2122/97
ucugcagacgguccgcuacggcg

SEQ ID NO: 1205503 - RNA, 21 nt, Mycobacterium bovis subsp bovis AF2122/97
ucugagcgcggguggcagcgg

SEQ ID NO: 1205504 - RNA, 12 nt, Mycobacterium bovis subsp bovis AF2122/97
ucucggccaggg

SEQ ID NO: 1205505 - RNA, 13 nt, Mycobacterium bovis subsp bovis AF2122/97
ucucggccggcgg

SEQ ID NO: 1205506 - RNA, 23 nt, Mycobacterium bovis subsp bovis AF2122/97
ucucggaccacaucuggucacgg

SEQ ID NO: 1205507 - RNA, 13 nt, Mycobacterium bovis subsp bovis AF2122/97
ucucggcaccaca

SEQ ID NO: 1205508 - RNA, 14 nt, Mycobacterium bovis subsp bovis AF2122/97
ucucggcaccacag

SEQ ID NO: 1205509 - RNA, 18 nt, Mycobacterium bovis subsp bovis AF2122/97
ucucguuggugccuucac

SEQ ID NO: 1205510 - RNA, 18 nt, Mycobacterium bovis subsp bovis AF2122/97
ucucugagcgggcgggcc

SEQ ID NO: 1205511 - RNA, 13 nt, Mycobacterium bovis subsp bovis AF2122/97
ucucucuuggugc

SEQ ID NO: 1205512 - RNA, 17 nt, Mycobacterium bovis subsp bovis AF2122/97
aaaugcuucgaccgccg

SEQ ID NO: 1205513 - RNA, 22 nt, Mycobacterium bovis subsp bovis AF2122/97
aaaugcuucgccaacugcggca

SEQ ID NO: 1205514 - RNA, 12 nt, Mycobacterium bovis subsp bovis AF2122/97
ucuucaacuccg

SEQ ID NO: 1205515 - RNA, 18 nt, Mycobacterium bovis subsp bovis AF2122/97
ucuucccauuucggcaaa

SEQ ID NO: 1205516 - RNA, 23 nt, Mycobacterium bovis subsp bovis AF2122/97
ucuuccggccacucaacgaccug

SEQ ID NO: 1205517 - RNA, 18 nt, Mycobacterium bovis subsp bovis AF2122/97
ucuucgcuaccuucuugg

SEQ ID NO: 1205518 - RNA, 16 nt, Mycobacterium bovis subsp bovis AF2122/97
ucuuccucggccaccc

SEQ ID NO: 1205519 - RNA, 15 nt, Mycobacterium bovis subsp bovis AF2122/97
ucugggccgcuccac

SEQ ID NO: 1205520 - RNA, 14 nt, Mycobacterium bovis subsp bovis AF2122/97
ucuggcucgcgaac

SEQ ID NO: 1205521 - RNA, 16 nt, Mycobacterium bovis subsp bovis AF2122/97
ucuggucggcggccuc

SEQ ID NO: 1205522 - RNA, 13 nt, Mycobacterium bovis subsp bovis AF2122/97
ucuggcaggccag

SEQ ID NO: 1205523 - RNA, 22 nt, Mycobacterium bovis subsp bovis AF2122/97
ucuggcaggugaacugguugac

SEQ ID NO: 1205524 - RNA, 18 nt, Mycobacterium bovis subsp bovis AF2122/97
ucuggcuacgggccgcgg

SEQ ID NO: 1205525 - RNA, 22 nt, Mycobacterium bovis subsp bovis AF2122/97
ucuggaugucccaugcacggcc

SEQ ID NO: 1205526 - RNA, 18 nt, Mycobacterium bovis subsp bovis AF2122/97
ucugccacguugaucccg

SEQ ID NO: 1205527 - RNA, 13 nt, Mycobacterium bovis subsp bovis AF2122/97
ucugcaugcgcug

SEQ ID NO: 1205528 - RNA, 16 nt, Mycobacterium bovis subsp bovis AF2122/97
ucugccaggcgcagcu

SEQ ID NO: 1205529 - RNA, 18 nt, Mycobacterium bovis subsp bovis AF2122/97
ucuagcuugacaacccug

SEQ ID NO: 1205530 - RNA, 16 nt, Mycobacterium bovis subsp bovis AF2122/97
ucuaggccucagaacc

SEQ ID NO: 1205531 - RNA, 16 nt, Mycobacterium bovis subsp bovis AF2122/97
ucuagcaaagccagcg

SEQ ID NO: 1205532 - RNA, 15 nt, Mycobacterium bovis subsp bovis AF2122/97
ucuagcggccuagga

SEQ ID NO: 1205533 - RNA, 19 nt, Mycobacterium bovis subsp bovis AF2122/97
ucuauccggcgcagguucu

SEQ ID NO: 1205534 - RNA, 13 nt, Mycobacterium bovis subsp bovis AF2122/97
ucucaccgggccc

SEQ ID NO: 1205535 - RNA, 22 nt, Mycobacterium bovis subsp bovis AF2122/97
aaaugcgggcuuugccaacaaa

SEQ ID NO: 1205536 - RNA, 23 nt, Mycobacterium bovis subsp bovis AF2122/97
aaaugccugcccaccuucgaguu

SEQ ID NO: 1205537 - RNA, 14 nt, Mycobacterium bovis subsp bovis AF2122/97
ucucaucccagucg

SEQ ID NO: 1205538 - RNA, 21 nt, Mycobacterium bovis subsp bovis AF2122/97
ucucaagggcaucaaccaacu

SEQ ID NO: 1205539 - RNA, 23 nt, Mycobacterium bovis subsp bovis AF2122/97
ucguuugcgccaggaguggccac

SEQ ID NO: 1205540 - RNA, 18 nt, Mycobacterium bovis subsp bovis AF2122/97
ucuaccagccgccccggc

SEQ ID NO: 1205541 - RNA, 15 nt, Mycobacterium bovis subsp bovis AF2122/97
ucuaccuuuuuggca

SEQ ID NO: 1205542 - RNA, 20 nt, Mycobacterium bovis subsp bovis AF2122/97
ucaaaaagcucggcccuguu

SEQ ID NO: 1205543 - RNA, 19 nt, Mycobacterium bovis subsp bovis AF2122/97
ucaaacccgaaaacccaac

SEQ ID NO: 1205544 - RNA, 21 nt, Mycobacterium bovis subsp bovis AF2122/97
ucaaacccgaaaacccaacac

SEQ ID NO: 1205545 - RNA, 15 nt, Mycobacterium bovis subsp bovis AF2122/97
ucaaaaucagggugc

SEQ ID NO: 1205546 - RNA, 16 nt, Mycobacterium bovis subsp bovis AF2122/97
uauuucucccagccca

SEQ ID NO: 1205547 - RNA, 13 nt, Mycobacterium bovis subsp bovis AF2122/97
uauuaccgcuugc

SEQ ID NO: 1205548 - RNA, 17 nt, Mycobacterium bovis subsp bovis AF2122/97
uauccggacuugaccag

SEQ ID NO: 1205549 - RNA, 20 nt, Mycobacterium bovis subsp bovis AF2122/97
uauccggaucggccugucca

SEQ ID NO: 1205550 - RNA, 19 nt, Mycobacterium bovis subsp bovis AF2122/97
uauucgccagcgccggaug

SEQ ID NO: 1205551 - RNA, 18 nt, Mycobacterium bovis subsp bovis AF2122/97
ucaagaaggccagcgcgc

SEQ ID NO: 1205552 - RNA, 19 nt, Mycobacterium bovis subsp bovis AF2122/97
ucaagaaggccagcgcgcc

SEQ ID NO: 1205553 - RNA, 17 nt, Mycobacterium bovis subsp bovis AF2122/97
ucaagaagaacucggug

SEQ ID NO: 1205554 - RNA, 17 nt, Mycobacterium bovis subsp bovis AF2122/97
ucaacgugucccaagcc

SEQ ID NO: 1205555 - RNA, 22 nt, Mycobacterium bovis subsp bovis AF2122/97
ucaacguauccccgaccacuga

SEQ ID NO: 1205556 - RNA, 22 nt, Mycobacterium bovis subsp bovis AF2122/97
ucaacgucacccccuucacccu

SEQ ID NO: 1205557 - RNA, 20 nt, Mycobacterium bovis subsp bovis AF2122/97
ucaaaugaaccgcacccuga

SEQ ID NO: 1205558 - RNA, 20 nt, Mycobacterium bovis subsp bovis AF2122/97
ucaagguuucgacaucacuc

SEQ ID NO: 1205559 - RNA, 18 nt, Mycobacterium bovis subsp bovis AF2122/97
ucaagggggucgagcgcu

SEQ ID NO: 1205560 - RNA, 14 nt, Mycobacterium bovis subsp bovis AF2122/97
ucaaggugaucagc

SEQ ID NO: 1205561 - RNA, 15 nt, Mycobacterium bovis subsp bovis AF2122/97
ucaaggaagccgcgg

SEQ ID NO: 1205562 - RNA, 16 nt, Mycobacterium bovis subsp bovis AF2122/97
ucaaggccuuucaaca

SEQ ID NO: 1205563 - RNA, 18 nt, Mycobacterium bovis subsp bovis AF2122/97
ucaagaucggugccagca

SEQ ID NO: 1205564 - RNA, 19 nt, Mycobacterium bovis subsp bovis AF2122/97
ucaagauuaccgaagcccg

SEQ ID NO: 1205565 - RNA, 21 nt, Mycobacterium bovis subsp bovis AF2122/97
ucaagcacacuggccacaauc

SEQ ID NO: 1205566 - RNA, 12 nt, Mycobacterium bovis subsp bovis AF2122/97
ucaagcacagcc

SEQ ID NO: 1205567 - RNA, 21 nt, Mycobacterium bovis subsp bovis AF2122/97
ucaaguggcaaccgcaccgca

SEQ ID NO: 1205568 - RNA, 23 nt, Mycobacterium bovis subsp bovis AF2122/97
ucaaucccuccgccaaggaggcc

SEQ ID NO: 1205569 - RNA, 21 nt, Mycobacterium bovis subsp bovis AF2122/97
ucaaucucggucggaguaagc

SEQ ID NO: 1205570 - RNA, 18 nt, Mycobacterium bovis subsp bovis AF2122/97
ucaaucuucccaccuuua

SEQ ID NO: 1205571 - RNA, 14 nt, Mycobacterium bovis subsp bovis AF2122/97
ucaaugcuggcagc

SEQ ID NO: 1205572 - RNA, 19 nt, Mycobacterium bovis subsp bovis AF2122/97
ucacacauuucgaggcgcu

SEQ ID NO: 1205573 - RNA, 16 nt, Mycobacterium bovis subsp bovis AF2122/97
ucacaccccaggcacc

SEQ ID NO: 1205574 - RNA, 23 nt, Mycobacterium bovis subsp bovis AF2122/97
ucacaccacgguuggccaccagc

SEQ ID NO: 1205575 - RNA, 23 nt, Mycobacterium bovis subsp bovis AF2122/97
ucacaacugcccgacgaccauuc

SEQ ID NO: 1205576 - RNA, 23 nt, Mycobacterium bovis subsp bovis AF2122/97
ucacacguuggcagcccucuggu

SEQ ID NO: 1205577 - RNA, 14 nt, Mycobacterium bovis subsp bovis AF2122/97
ucacauucagcacg

SEQ ID NO: 1205578 - RNA, 15 nt, Mycobacterium bovis subsp bovis AF2122/97
ucacauuggccaggu

SEQ ID NO: 1205579 - RNA, 17 nt, Mycobacterium bovis subsp bovis AF2122/97
ucaccaacgcgggaacg

SEQ ID NO: 1205580 - RNA, 17 nt, Mycobacterium bovis subsp bovis AF2122/97
ucaccaaguucagcacg

SEQ ID NO: 1205581 - RNA, 20 nt, Mycobacterium bovis subsp bovis AF2122/97
ucacccacauggugauccac

SEQ ID NO: 1205582 - RNA, 22 nt, Mycobacterium bovis subsp bovis AF2122/97
ucacccacccgcaccgcgguac

SEQ ID NO: 1205583 - RNA, 19 nt, Mycobacterium bovis subsp bovis AF2122/97
ucacccacuccgccgauag

SEQ ID NO: 1205584 - RNA, 18 nt, Mycobacterium bovis subsp bovis AF2122/97
ucaccagccaccccugcg

SEQ ID NO: 1205585 - RNA, 19 nt, Mycobacterium bovis subsp bovis AF2122/97
ucaccgcguagaccccaau

SEQ ID NO: 1205586 - RNA, 20 nt, Mycobacterium bovis subsp bovis AF2122/97
ucaccgcguaguccaggccg

SEQ ID NO: 1205587 - RNA, 14 nt, Mycobacterium bovis subsp bovis AF2122/97
ucaccgcgcugaac

SEQ ID NO: 1205588 - RNA, 14 nt, Mycobacterium bovis subsp bovis AF2122/97
ucaccggcauacag

SEQ ID NO: 1205589 - RNA, 18 nt, Mycobacterium bovis subsp bovis AF2122/97
ucaccggcauacagccgg

SEQ ID NO: 1205590 - RNA, 16 nt, Mycobacterium bovis subsp bovis AF2122/97
ucaccgccgggaagcc

SEQ ID NO: 1205591 - RNA, 20 nt, Mycobacterium bovis subsp bovis AF2122/97
ucaccgccguuaccgccguu

SEQ ID NO: 1205592 - RNA, 15 nt, Mycobacterium bovis subsp bovis AF2122/97
ucaccgccgcggccg

SEQ ID NO: 1205593 - RNA, 15 nt, Mycobacterium bovis subsp bovis AF2122/97
ucaccgcccuugccg

SEQ ID NO: 1205594 - RNA, 17 nt, Mycobacterium bovis subsp bovis AF2122/97
ucaccgcccuugccgcc

SEQ ID NO: 1205595 - RNA, 23 nt, Mycobacterium bovis subsp bovis AF2122/97
ucaccgucauugccaccaagucc

SEQ ID NO: 1205596 - RNA, 17 nt, Mycobacterium bovis subsp bovis AF2122/97
ucaccgugggccugccc

SEQ ID NO: 1205597 - RNA, 16 nt, Mycobacterium bovis subsp bovis AF2122/97
ucaccgugguggcgua

SEQ ID NO: 1205598 - RNA, 15 nt, Mycobacterium bovis subsp bovis AF2122/97
ucaccguuggccgcg

SEQ ID NO: 1205599 - RNA, 19 nt, Mycobacterium bovis subsp bovis AF2122/97
ucaccggcgcccagcgccu

SEQ ID NO: 1205600 - RNA, 17 nt, Mycobacterium bovis subsp bovis AF2122/97
ucaccgacaccgugccg

SEQ ID NO: 1205601 - RNA, 16 nt, Mycobacterium bovis subsp bovis AF2122/97
ucaccgacgucgccaa

SEQ ID NO: 1205602 - RNA, 19 nt, Mycobacterium bovis subsp bovis AF2122/97
ucaccgacaugacgcggcc

SEQ ID NO: 1205603 - RNA, 22 nt, Mycobacterium bovis subsp bovis AF2122/97
ucaccgaucccgcggccgggcc

SEQ ID NO: 1205604 - RNA, 18 nt, Mycobacterium bovis subsp bovis AF2122/97
ucaccgaucgaacagugc

SEQ ID NO: 1205605 - RNA, 19 nt, Mycobacterium bovis subsp bovis AF2122/97
ucaccgauucggccagcgc

SEQ ID NO: 1205606 - RNA, 14 nt, Mycobacterium bovis subsp bovis AF2122/97
ucaccgccagcccc

SEQ ID NO: 1205607 - RNA, 13 nt, Mycobacterium bovis subsp bovis AF2122/97
ucaccgccaccac

SEQ ID NO: 1205608 - RNA, 17 nt, Mycobacterium bovis subsp bovis AF2122/97
ucaccgccaccaccagg

SEQ ID NO: 1205609 - RNA, 19 nt, Mycobacterium bovis subsp bovis AF2122/97
ucaccgaacgacccuggcc

SEQ ID NO: 1205610 - RNA, 20 nt, Mycobacterium bovis subsp bovis AF2122/97
ucaccgaaacgaugcggccu

SEQ ID NO: 1205611 - RNA, 14 nt, Mycobacterium bovis subsp bovis AF2122/97
ucaccccuucgcca

SEQ ID NO: 1205612 - RNA, 17 nt, Mycobacterium bovis subsp bovis AF2122/97
ucacccaggcgccgaug

SEQ ID NO: 1205613 - RNA, 17 nt, Mycobacterium bovis subsp bovis AF2122/97
ucacccagcgccgaccc

SEQ ID NO: 1205614 - RNA, 19 nt, Mycobacterium bovis subsp bovis AF2122/97
ucacccccuucacccuccc

SEQ ID NO: 1205615 - RNA, 17 nt, Mycobacterium bovis subsp bovis AF2122/97
ucacgaccugcucaucc

SEQ ID NO: 1205616 - RNA, 14 nt, Mycobacterium bovis subsp bovis AF2122/97
ucacgacgccgaau

SEQ ID NO: 1205617 - RNA, 13 nt, Mycobacterium bovis subsp bovis AF2122/97
ucacgagccaggg

SEQ ID NO: 1205618 - RNA, 15 nt, Mycobacterium bovis subsp bovis AF2122/97
ucacgagcaaaccag

SEQ ID NO: 1205619 - RNA, 19 nt, Mycobacterium bovis subsp bovis AF2122/97
ucaccucgucgacaaacca

SEQ ID NO: 1205620 - RNA, 16 nt, Mycobacterium bovis subsp bovis AF2122/97
ucaccucggugccggc

SEQ ID NO: 1205621 - RNA, 20 nt, Mycobacterium bovis subsp bovis AF2122/97
ucaccuggugugcgggagac

SEQ ID NO: 1205622 - RNA, 21 nt, Mycobacterium bovis subsp bovis AF2122/97
ucaccuucggccgaccgggcu

SEQ ID NO: 1205623 - RNA, 18 nt, Mycobacterium bovis subsp bovis AF2122/97
ucaccuucgucgcggccg

SEQ ID NO: 1205624 - RNA, 22 nt, Mycobacterium bovis subsp bovis AF2122/97
ucacgguggugucagccaccgg

SEQ ID NO: 1205625 - RNA, 18 nt, Mycobacterium bovis subsp bovis AF2122/97
ucacgguagcguucgucg

SEQ ID NO: 1205626 - RNA, 21 nt, Mycobacterium bovis subsp bovis AF2122/97
ucacgggcuaccggcagcugc

SEQ ID NO: 1205627 - RNA, 21 nt, Mycobacterium bovis subsp bovis AF2122/97
ucacgcuggccuccagcuugg

SEQ ID NO: 1205628 - RNA, 17 nt, Mycobacterium bovis subsp bovis AF2122/97
ucacgcucacccggcgu

SEQ ID NO: 1205629 - RNA, 19 nt, Mycobacterium bovis subsp bovis AF2122/97
ucacgcacccggcgcaaca

SEQ ID NO: 1205630 - RNA, 22 nt, Mycobacterium bovis subsp bovis AF2122/97
ucacgcagcacccugcgggccg

SEQ ID NO: 1205631 - RNA, 18 nt, Mycobacterium bovis subsp bovis AF2122/97
ucacgcgaaugacgaucc

SEQ ID NO: 1205632 - RNA, 16 nt, Mycobacterium bovis subsp bovis AF2122/97
ucacgguugccgcgau

SEQ ID NO: 1205633 - RNA, 13 nt, Mycobacterium bovis subsp bovis AF2122/97
ucacuccaugauc

SEQ ID NO: 1205634 - RNA, 16 nt, Mycobacterium bovis subsp bovis AF2122/97
ucacuccaugauccag

SEQ ID NO: 1205635 - RNA, 23 nt, Mycobacterium bovis subsp bovis AF2122/97
uccagcaggccgggacagcgccg

SEQ ID NO: 1205636 - RNA, 18 nt, Mycobacterium bovis subsp bovis AF2122/97
uccagcagcgacgcugcc

SEQ ID NO: 1205637 - RNA, 13 nt, Mycobacterium bovis subsp bovis AF2122/97
uccagcagcgagu

SEQ ID NO: 1205638 - RNA, 13 nt, Mycobacterium bovis subsp bovis AF2122/97
uccagcaccagca

SEQ ID NO: 1205639 - RNA, 15 nt, Mycobacterium bovis subsp bovis AF2122/97
uccagcaccaccgga

SEQ ID NO: 1205640 - RNA, 23 nt, Mycobacterium bovis subsp bovis AF2122/97
uccagcaccgggaagucgggguc

SEQ ID NO: 1205641 - RNA, 16 nt, Mycobacterium bovis subsp bovis AF2122/97
uccagcaaccucgguu

SEQ ID NO: 1205642 - RNA, 22 nt, Mycobacterium bovis subsp bovis AF2122/97
uccagcaaggccagcacggcuu

SEQ ID NO: 1205643 - RNA, 22 nt, Mycobacterium bovis subsp bovis AF2122/97
uccagccgacggcagugcugca

SEQ ID NO: 1205644 - RNA, 18 nt, Mycobacterium bovis subsp bovis AF2122/97
uccagccgucggcgcugc

SEQ ID NO: 1205645 - RNA, 21 nt, Mycobacterium bovis subsp bovis AF2122/97
uccagccgugcggcggcugcc

SEQ ID NO: 1205646 - RNA, 19 nt, Mycobacterium bovis subsp bovis AF2122/97
uccagccgggugccggcau

SEQ ID NO: 1205647 - RNA, 20 nt, Mycobacterium bovis subsp bovis AF2122/97
uccagcccaacucggccagc

SEQ ID NO: 1205648 - RNA, 20 nt, Mycobacterium bovis subsp bovis AF2122/97
uccagcgaggagcagggcuc

SEQ ID NO: 1205649 - RNA, 14 nt, Mycobacterium bovis subsp bovis AF2122/97
uccagcgugccugg

SEQ ID NO: 1205650 - RNA, 22 nt, Mycobacterium bovis subsp bovis AF2122/97
uccagggagcggcugcacgccu

SEQ ID NO: 1205651 - RNA, 16 nt, Mycobacterium bovis subsp bovis AF2122/97
uccaggguggucgucg

SEQ ID NO: 1205652 - RNA, 14 nt, Mycobacterium bovis subsp bovis AF2122/97
uccagggccacgau

SEQ ID NO: 1205653 - RNA, 16 nt, Mycobacterium bovis subsp bovis AF2122/97
uccagcuugccgaccu

SEQ ID NO: 1205654 - RNA, 17 nt, Mycobacterium bovis subsp bovis AF2122/97
uccaguccaugugccca

SEQ ID NO: 1205655 - RNA, 15 nt, Mycobacterium bovis subsp bovis AF2122/97
uccagaucaacgcgu

SEQ ID NO: 1205656 - RNA, 16 nt, Mycobacterium bovis subsp bovis AF2122/97
uccagauacaggaaca

SEQ ID NO: 1205657 - RNA, 17 nt, Mycobacterium bovis subsp bovis AF2122/97
uccagauaccaccgccg

SEQ ID NO: 1205658 - RNA, 22 nt, Mycobacterium bovis subsp bovis AF2122/97
uccagauaccaccgccgcugcc

SEQ ID NO: 1205659 - RNA, 20 nt, Mycobacterium bovis subsp bovis AF2122/97
uccagagacaugucgcugcc

SEQ ID NO: 1205660 - RNA, 23 nt, Mycobacterium bovis subsp bovis AF2122/97
uccagagcuggcuacgggccgcu

SEQ ID NO: 1205661 - RNA, 19 nt, Mycobacterium bovis subsp bovis AF2122/97
uccagacaugucaggccgu

SEQ ID NO: 1205662 - RNA, 19 nt, Mycobacterium bovis subsp bovis AF2122/97
uccaccgggcccgccggcc

SEQ ID NO: 1205663 - RNA, 17 nt, Mycobacterium bovis subsp bovis AF2122/97
uccaccggaccgaccac

SEQ ID NO: 1205664 - RNA, 23 nt, Mycobacterium bovis subsp bovis AF2122/97
uccaccgcugccggcagcguccg

SEQ ID NO: 1205665 - RNA, 16 nt, Mycobacterium bovis subsp bovis AF2122/97
uccaccguuagccagg

SEQ ID NO: 1205666 - RNA, 18 nt, Mycobacterium bovis subsp bovis AF2122/97
uccaccguuagccagguc

SEQ ID NO: 1205667 - RNA, 17 nt, Mycobacterium bovis subsp bovis AF2122/97
uccaccgguccagggcc

SEQ ID NO: 1205668 - RNA, 23 nt, Mycobacterium bovis subsp bovis AF2122/97
uccaccuuggccagacccaccac

SEQ ID NO: 1205669 - RNA, 19 nt, Mycobacterium bovis subsp bovis AF2122/97
uccacugacgucucaucaa

SEQ ID NO: 1205670 - RNA, 15 nt, Mycobacterium bovis subsp bovis AF2122/97
uccacuccccagccc

SEQ ID NO: 1205671 - RNA, 16 nt, Mycobacterium bovis subsp bovis AF2122/97
uccacucgaccugaug

SEQ ID NO: 1205672 - RNA, 18 nt, Mycobacterium bovis subsp bovis AF2122/97
uccaaagggaguguuugg

SEQ ID NO: 1205673 - RNA, 19 nt, Mycobacterium bovis subsp bovis AF2122/97
uccaauugcgaaccggccg

SEQ ID NO: 1205674 - RNA, 23 nt, Mycobacterium bovis subsp bovis AF2122/97
uccaauugcgcugaagcccaugg

SEQ ID NO: 1205675 - RNA, 17 nt, Mycobacterium bovis subsp bovis AF2122/97
uccaauugcggccgcgc

SEQ ID NO: 1205676 - RNA, 12 nt, Mycobacterium bovis subsp bovis AF2122/97
uccaccacccug

SEQ ID NO: 1205677 - RNA, 15 nt, Mycobacterium bovis subsp bovis AF2122/97
uccaccacccugcac

SEQ ID NO: 1205678 - RNA, 16 nt, Mycobacterium bovis subsp bovis AF2122/97
uccacaucggcucuga

SEQ ID NO: 1205679 - RNA, 13 nt, Mycobacterium bovis subsp bovis AF2122/97
uccaccgccgaca

SEQ ID NO: 1205680 - RNA, 19 nt, Mycobacterium bovis subsp bovis AF2122/97
uccaccgacguggccagcc

SEQ ID NO: 1205681 - RNA, 16 nt, Mycobacterium bovis subsp bovis AF2122/97
uccaccacgcaaaagu

SEQ ID NO: 1205682 - RNA, 20 nt, Mycobacterium bovis subsp bovis AF2122/97
uccaccacgcuggccucguc

SEQ ID NO: 1205683 - RNA, 18 nt, Mycobacterium bovis subsp bovis AF2122/97
ucaugguggggaccgcga

SEQ ID NO: 1205684 - RNA, 12 nt, Mycobacterium bovis subsp bovis AF2122/97
ucaugggaucag

SEQ ID NO: 1205685 - RNA, 14 nt, Mycobacterium bovis subsp bovis AF2122/97
ucaugggaucaggc

SEQ ID NO: 1205686 - RNA, 23 nt, Mycobacterium bovis subsp bovis AF2122/97
ucauucgugggaaccaccagcac

SEQ ID NO: 1205687 - RNA, 17 nt, Mycobacterium bovis subsp bovis AF2122/97
uccaaaagccucagccg

SEQ ID NO: 1205688 - RNA, 13 nt, Mycobacterium bovis subsp bovis AF2122/97
ucaugcuggaagu

SEQ ID NO: 1205689 - RNA, 19 nt, Mycobacterium bovis subsp bovis AF2122/97
ucaugcgagucgucccagu

SEQ ID NO: 1205690 - RNA, 20 nt, Mycobacterium bovis subsp bovis AF2122/97
ucaugcgagucgucccaguc

SEQ ID NO: 1205691 - RNA, 21 nt, Mycobacterium bovis subsp bovis AF2122/97
ucaugcgagucgucccagucc

SEQ ID NO: 1205692 - RNA, 23 nt, Mycobacterium bovis subsp bovis AF2122/97
ucaugccgacgacaacagccagc

SEQ ID NO: 1205693 - RNA, 20 nt, Mycobacterium bovis subsp bovis AF2122/97
ucaugcacgccguagcaucg

SEQ ID NO: 1205694 - RNA, 20 nt, Mycobacterium bovis subsp bovis AF2122/97
ucaugagccgcugcgccagg

SEQ ID NO: 1205695 - RNA, 20 nt, Mycobacterium bovis subsp bovis AF2122/97
ucaucucggugguggccaug

SEQ ID NO: 1205696 - RNA, 16 nt, Mycobacterium bovis subsp bovis AF2122/97
ucaucucgguggacgg

SEQ ID NO: 1205697 - RNA, 21 nt, Mycobacterium bovis subsp bovis AF2122/97
ucaucucggugguggccauga

SEQ ID NO: 1205698 - RNA, 20 nt, Mycobacterium bovis subsp bovis AF2122/97
ucaucgggguggccaccagc

SEQ ID NO: 1205699 - RNA, 16 nt, Mycobacterium bovis subsp bovis AF2122/97
ucaucgugguaaccau

SEQ ID NO: 1205700 - RNA, 17 nt, Mycobacterium bovis subsp bovis AF2122/97
ucaucaccggcgcaccg

SEQ ID NO: 1205701 - RNA, 14 nt, Mycobacterium bovis subsp bovis AF2122/97
ucaucaacgacacc

SEQ ID NO: 1205702 - RNA, 22 nt, Mycobacterium bovis subsp bovis AF2122/97
ucauagccguugcgggccaggc

SEQ ID NO: 1205703 - RNA, 17 nt, Mycobacterium bovis subsp bovis AF2122/97
ucauagacagggccgcu

SEQ ID NO: 1205704 - RNA, 13 nt, Mycobacterium bovis subsp bovis AF2122/97
ucauagaccaguc

SEQ ID NO: 1205705 - RNA, 22 nt, Mycobacterium bovis subsp bovis AF2122/97
ucauagaaauacaggcccggca

SEQ ID NO: 1205706 - RNA, 22 nt, Mycobacterium bovis subsp bovis AF2122/97
ucauaggcccgcacgaucucgu

SEQ ID NO: 1205707 - RNA, 20 nt, Mycobacterium bovis subsp bovis AF2122/97
ucauagcgcaccaccgucuc

SEQ ID NO: 1205708 - RNA, 15 nt, Mycobacterium bovis subsp bovis AF2122/97
ucaucgaccuggcca

SEQ ID NO: 1205709 - RNA, 18 nt, Mycobacterium bovis subsp bovis AF2122/97
ucaucgaccuggccacgg

SEQ ID NO: 1205710 - RNA, 16 nt, Mycobacterium bovis subsp bovis AF2122/97
ucaucgagcugaccug

SEQ ID NO: 1205711 - RNA, 20 nt, Mycobacterium bovis subsp bovis AF2122/97
ucaucgagucgaagaaccug

SEQ ID NO: 1205712 - RNA, 15 nt, Mycobacterium bovis subsp bovis AF2122/97
ucaucgcagucaugu

SEQ ID NO: 1205713 - RNA, 16 nt, Mycobacterium bovis subsp bovis AF2122/97
ucaucgcgcacgcccu

SEQ ID NO: 1205714 - RNA, 22 nt, Mycobacterium bovis subsp bovis AF2122/97
ucaucgcggcgaacaucaccgu

SEQ ID NO: 1205715 - RNA, 20 nt, Mycobacterium bovis subsp bovis AF2122/97
ucaucccgauguaccccagc

SEQ ID NO: 1205716 - RNA, 15 nt, Mycobacterium bovis subsp bovis AF2122/97
ucauccccggccagc

SEQ ID NO: 1205717 - RNA, 17 nt, Mycobacterium bovis subsp bovis AF2122/97
ucauccauccgggccgc

SEQ ID NO: 1205718 - RNA, 21 nt, Mycobacterium bovis subsp bovis AF2122/97
ucaucccaagcguccgcugca

SEQ ID NO: 1205719 - RNA, 18 nt, Mycobacterium bovis subsp bovis AF2122/97
ucauccgggcgaccacca

SEQ ID NO: 1205720 - RNA, 17 nt, Mycobacterium bovis subsp bovis AF2122/97
ucauccgacaagcuguc

SEQ ID NO: 1205721 - RNA, 19 nt, Mycobacterium bovis subsp bovis AF2122/97
ucaucauauccgccccagc

SEQ ID NO: 1205722 - RNA, 14 nt, Mycobacterium bovis subsp bovis AF2122/97
ucaucagcggcgcc

SEQ ID NO: 1205723 - RNA, 19 nt, Mycobacterium bovis subsp bovis AF2122/97
ucaucacuaaccuggcgua

SEQ ID NO: 1205724 - RNA, 15 nt, Mycobacterium bovis subsp bovis AF2122/97
ucaucauggccggau

SEQ ID NO: 1205725 - RNA, 15 nt, Mycobacterium bovis subsp bovis AF2122/97
ucauccaccccugag

SEQ ID NO: 1205726 - RNA, 20 nt, Mycobacterium bovis subsp bovis AF2122/97
ucauccacuccgccaacauc

SEQ ID NO: 1205727 - RNA, 13 nt, Mycobacterium bovis subsp bovis AF2122/97
ucaguucccgaac

SEQ ID NO: 1205728 - RNA, 20 nt, Mycobacterium bovis subsp bovis AF2122/97
ucauaaagguccaaccaccg

SEQ ID NO: 1205729 - RNA, 22 nt, Mycobacterium bovis subsp bovis AF2122/97
ucaggggaucccccgcgcgaac

SEQ ID NO: 1205730 - RNA, 22 nt, Mycobacterium bovis subsp bovis AF2122/97
ucagggguggcgcgggccggcg

SEQ ID NO: 1205731 - RNA, 20 nt, Mycobacterium bovis subsp bovis AF2122/97
ucaggaaccacccaccggcc

SEQ ID NO: 1205732 - RNA, 20 nt, Mycobacterium bovis subsp bovis AF2122/97
ucaggaaaccggcgcggaac

SEQ ID NO: 1205733 - RNA, 21 nt, Mycobacterium bovis subsp bovis AF2122/97
ucaggaagauuucugggccgc

SEQ ID NO: 1205734 - RNA, 22 nt, Mycobacterium bovis subsp bovis AF2122/97
ucagcuuggacccugcgccgcc

SEQ ID NO: 1205735 - RNA, 17 nt, Mycobacterium bovis subsp bovis AF2122/97
ucagcuuuaucggcccu

SEQ ID NO: 1205736 - RNA, 17 nt, Mycobacterium bovis subsp bovis AF2122/97
ucagcgccgcgcgcgcc

SEQ ID NO: 1205737 - RNA, 21 nt, Mycobacterium bovis subsp bovis AF2122/97
ucagcgcgcgccgcuggguga

SEQ ID NO: 1205738 - RNA, 23 nt, Mycobacterium bovis subsp bovis AF2122/97
ucagcgcggcacggugugcggca

SEQ ID NO: 1205739 - RNA, 12 nt, Mycobacterium bovis subsp bovis AF2122/97
ucagcgcgcugc

SEQ ID NO: 1205740 - RNA, 21 nt, Mycobacterium bovis subsp bovis AF2122/97
ucagcgcgaccgucaggguca

SEQ ID NO: 1205741 - RNA, 13 nt, Mycobacterium bovis subsp bovis AF2122/97
ucagcgugucgcc

SEQ ID NO: 1205742 - RNA, 15 nt, Mycobacterium bovis subsp bovis AF2122/97
ucagcgugcgcuggc

SEQ ID NO: 1205743 - RNA, 13 nt, Mycobacterium bovis subsp bovis AF2122/97
ucagcuggccgcg

SEQ ID NO: 1205744 - RNA, 18 nt, Mycobacterium bovis subsp bovis AF2122/97
ucagcugugcgacccgca

SEQ ID NO: 1205745 - RNA, 18 nt, Mycobacterium bovis subsp bovis AF2122/97
ucagcugggcaucaucag

SEQ ID NO: 1205746 - RNA, 12 nt, Mycobacterium bovis subsp bovis AF2122/97
ucagcucaccac

SEQ ID NO: 1205747 - RNA, 14 nt, Mycobacterium bovis subsp bovis AF2122/97
ucagcuagguauug

SEQ ID NO: 1205748 - RNA, 16 nt, Mycobacterium bovis subsp bovis AF2122/97
ucagcuaccuccgcca

SEQ ID NO: 1205749 - RNA, 22 nt, Mycobacterium bovis subsp bovis AF2122/97
ucagcgaagccgggucucggug

SEQ ID NO: 1205750 - RNA, 22 nt, Mycobacterium bovis subsp bovis AF2122/97
ucagcgaccucacugcggcgcc

SEQ ID NO: 1205751 - RNA, 21 nt, Mycobacterium bovis subsp bovis AF2122/97
ucagccugauauccgcggauc

SEQ ID NO: 1205752 - RNA, 16 nt, Mycobacterium bovis subsp bovis AF2122/97
ucagccgugcgggccg

SEQ ID NO: 1205753 - RNA, 15 nt, Mycobacterium bovis subsp bovis AF2122/97
ucagccguggcaguc

SEQ ID NO: 1205754 - RNA, 21 nt, Mycobacterium bovis subsp bovis AF2122/97
ucagccgggugcgcacccggg

SEQ ID NO: 1205755 - RNA, 17 nt, Mycobacterium bovis subsp bovis AF2122/97
ucagccgguggucugcg

SEQ ID NO: 1205756 - RNA, 18 nt, Mycobacterium bovis subsp bovis AF2122/97
ucagccgugccgugguga

SEQ ID NO: 1205757 - RNA, 19 nt, Mycobacterium bovis subsp bovis AF2122/97
ucagccguccgggcggccu

SEQ ID NO: 1205758 - RNA, 13 nt, Mycobacterium bovis subsp bovis AF2122/97
ucagccgcgcgcc

SEQ ID NO: 1205759 - RNA, 21 nt, Mycobacterium bovis subsp bovis AF2122/97
ucagccgcggcggcagcaccc

SEQ ID NO: 1205760 - RNA, 19 nt, Mycobacterium bovis subsp bovis AF2122/97
ucagccaguccagcgcgcc

SEQ ID NO: 1205761 - RNA, 21 nt, Mycobacterium bovis subsp bovis AF2122/97
ucagccaggccagugccaccu

SEQ ID NO: 1205762 - RNA, 21 nt, Mycobacterium bovis subsp bovis AF2122/97
ucacuguugcccuugggacug

SEQ ID NO: 1205763 - RNA, 18 nt, Mycobacterium bovis subsp bovis AF2122/97
ucacucguugaccggccg

SEQ ID NO: 1205764 - RNA, 11 nt, Mycobacterium bovis subsp bovis AF2122/97
ucacugagauc

SEQ ID NO: 1205765 - RNA, 16 nt, Mycobacterium bovis subsp bovis AF2122/97
uaggcgaucucacgca

SEQ ID NO: 1205766 - RNA, 20 nt, Mycobacterium bovis subsp bovis AF2122/97
uaggcgauaucgcccggaac

SEQ ID NO: 1205767 - RNA, 13 nt, Mycobacterium bovis subsp bovis AF2122/97
uaggcgaccagau

SEQ ID NO: 1205768 - RNA, 15 nt, Mycobacterium bovis subsp bovis AF2122/97
uaggcccggucuugg

SEQ ID NO: 1205769 - RNA, 11 nt, Mycobacterium bovis subsp bovis AF2122/97
uaggcccagca

SEQ ID NO: 1205770 - RNA, 14 nt, Mycobacterium bovis subsp bovis AF2122/97
uaggccucggcagc

SEQ ID NO: 1205771 - RNA, 15 nt, Mycobacterium bovis subsp bovis AF2122/97
uaggccucggcagca

SEQ ID NO: 1205772 - RNA, 20 nt, Mycobacterium bovis subsp bovis AF2122/97
uaggccccgccagcgccggu

SEQ ID NO: 1205773 - RNA, 12 nt, Mycobacterium bovis subsp bovis AF2122/97
uaggccagcccg

SEQ ID NO: 1205774 - RNA, 16 nt, Mycobacterium bovis subsp bovis AF2122/97
uaggcaugccacacac

SEQ ID NO: 1205775 - RNA, 15 nt, Mycobacterium bovis subsp bovis AF2122/97
uaggccaccacugcg

SEQ ID NO: 1205776 - RNA, 16 nt, Mycobacterium bovis subsp bovis AF2122/97
uagggccgccaucccc

SEQ ID NO: 1205777 - RNA, 22 nt, Mycobacterium bovis subsp bovis AF2122/97
uagggcugaccgaagaagcccg

SEQ ID NO: 1205778 - RNA, 20 nt, Mycobacterium bovis subsp bovis AF2122/97
uaggcggcguuugaggcagc

SEQ ID NO: 1205779 - RNA, 13 nt, Mycobacterium bovis subsp bovis AF2122/97
uaggcuccaagca

SEQ ID NO: 1205780 - RNA, 19 nt, Mycobacterium bovis subsp bovis AF2122/97
uaggcuccaagcaauucca

SEQ ID NO: 1205781 - RNA, 14 nt, Mycobacterium bovis subsp bovis AF2122/97
uaggcucccacucc

SEQ ID NO: 1205782 - RNA, 21 nt, Mycobacterium bovis subsp bovis AF2122/97
uaguagugagaaaucaaaucc

SEQ ID NO: 1205783 - RNA, 18 nt, Mycobacterium bovis subsp bovis AF2122/97
uaggucgaccacccgcag

SEQ ID NO: 1205784 - RNA, 23 nt, Mycobacterium bovis subsp bovis AF2122/97
uaggucgaccacccgcagggcau

SEQ ID NO: 1205785 - RNA, 21 nt, Mycobacterium bovis subsp bovis AF2122/97
uaguucaccaacgcgggaacg

SEQ ID NO: 1205786 - RNA, 16 nt, Mycobacterium bovis subsp bovis AF2122/97
uaguccgcauccgcga

SEQ ID NO: 1205787 - RNA, 21 nt, Mycobacterium bovis subsp bovis AF2122/97
uaguccgcgccgacggccagc

SEQ ID NO: 1205788 - RNA, 22 nt, Mycobacterium bovis subsp bovis AF2122/97
uaguccggcacugcggccaguc

SEQ ID NO: 1205789 - RNA, 20 nt, Mycobacterium bovis subsp bovis AF2122/97
uagugcaaugguucgugcac

SEQ ID NO: 1205790 - RNA, 15 nt, Mycobacterium bovis subsp bovis AF2122/97
uagugcucgcagcca

SEQ ID NO: 1205791 - RNA, 20 nt, Mycobacterium bovis subsp bovis AF2122/97
uauccacggucgaccaggac

SEQ ID NO: 1205792 - RNA, 11 nt, Mycobacterium bovis subsp bovis AF2122/97
uauagaagccg

SEQ ID NO: 1205793 - RNA, 17 nt, Mycobacterium bovis subsp bovis AF2122/97
uauagcucacgguggcc

SEQ ID NO: 1205794 - RNA, 20 nt, Mycobacterium bovis subsp bovis AF2122/97
uauagcccguagccgaucag

SEQ ID NO: 1205795 - RNA, 23 nt, Mycobacterium bovis subsp bovis AF2122/97
uauagccgguugucgcagcgcac

SEQ ID NO: 1205796 - RNA, 15 nt, Mycobacterium bovis subsp bovis AF2122/97
uagcgaagaacuggg

SEQ ID NO: 1205797 - RNA, 18 nt, Mycobacterium bovis subsp bovis AF2122/97
uagcgaagugcgcgcugg

SEQ ID NO: 1205798 - RNA, 23 nt, Mycobacterium bovis subsp bovis AF2122/97
uagcgcccaccguagacgacauc

SEQ ID NO: 1205799 - RNA, 15 nt, Mycobacterium bovis subsp bovis AF2122/97
uagcgcaccaccguc

SEQ ID NO: 1205800 - RNA, 17 nt, Mycobacterium bovis subsp bovis AF2122/97
uagcgagcgcacaccgg

SEQ ID NO: 1205801 - RNA, 19 nt, Mycobacterium bovis subsp bovis AF2122/97
uagcgccgcgcccaccaug

SEQ ID NO: 1205802 - RNA, 19 nt, Mycobacterium bovis subsp bovis AF2122/97
uagcgcgaaagcgccgaaa

SEQ ID NO: 1205803 - RNA, 21 nt, Mycobacterium bovis subsp bovis AF2122/97
uagcgcuugccgcugagcccu

SEQ ID NO: 1205804 - RNA, 20 nt, Mycobacterium bovis subsp bovis AF2122/97
uagcgcgggccuggcccacg

SEQ ID NO: 1205805 - RNA, 14 nt, Mycobacterium bovis subsp bovis AF2122/97
uagcggcucaccgc

SEQ ID NO: 1205806 - RNA, 18 nt, Mycobacterium bovis subsp bovis AF2122/97
uagcggaucaggucuggc

SEQ ID NO: 1205807 - RNA, 19 nt, Mycobacterium bovis subsp bovis AF2122/97
uagcggaucgcggucagcg

SEQ ID NO: 1205808 - RNA, 22 nt, Mycobacterium bovis subsp bovis AF2122/97
uagcggcuugaacagcugaucc

SEQ ID NO: 1205809 - RNA, 23 nt, Mycobacterium bovis subsp bovis AF2122/97
uagccgcugcacguggccacggc

SEQ ID NO: 1205810 - RNA, 16 nt, Mycobacterium bovis subsp bovis AF2122/97
uagccgauccagcagg

SEQ ID NO: 1205811 - RNA, 15 nt, Mycobacterium bovis subsp bovis AF2122/97
uagccgaccagcgcu

SEQ ID NO: 1205812 - RNA, 18 nt, Mycobacterium bovis subsp bovis AF2122/97
uagccgacgccggugccg

SEQ ID NO: 1205813 - RNA, 13 nt, Mycobacterium bovis subsp bovis AF2122/97
uagccgagccagu

SEQ ID NO: 1205814 - RNA, 12 nt, Mycobacterium bovis subsp bovis AF2122/97
uagcccugcuca

SEQ ID NO: 1205815 - RNA, 15 nt, Mycobacterium bovis subsp bovis AF2122/97
uagccgaacagcgga

SEQ ID NO: 1205816 - RNA, 23 nt, Mycobacterium bovis subsp bovis AF2122/97
uagcccuugccguguucgggggc

SEQ ID NO: 1205817 - RNA, 16 nt, Mycobacterium bovis subsp bovis AF2122/97
uagccgccggugccgc

SEQ ID NO: 1205818 - RNA, 14 nt, Mycobacterium bovis subsp bovis AF2122/97
uagccgcggccaca

SEQ ID NO: 1205819 - RNA, 21 nt, Mycobacterium bovis subsp bovis AF2122/97
uagccgcuugggccugggccg

SEQ ID NO: 1205820 - RNA, 15 nt, Mycobacterium bovis subsp bovis AF2122/97
uagccggguugccug

SEQ ID NO: 1205821 - RNA, 22 nt, Mycobacterium bovis subsp bovis AF2122/97
uagccguugccgccgaacagcu

SEQ ID NO: 1205822 - RNA, 20 nt, Mycobacterium bovis subsp bovis AF2122/97
uagccauucgguguggccgu

SEQ ID NO: 1205823 - RNA, 23 nt, Mycobacterium bovis subsp bovis AF2122/97
uagccauucgguguggccguggg

SEQ ID NO: 1205824 - RNA, 16 nt, Mycobacterium bovis subsp bovis AF2122/97
uagcccggcagcacgu

SEQ ID NO: 1205825 - RNA, 20 nt, Mycobacterium bovis subsp bovis AF2122/97
uagccagcgucucaaggccu

SEQ ID NO: 1205826 - RNA, 16 nt, Mycobacterium bovis subsp bovis AF2122/97
uagccacgcaagcaaa

SEQ ID NO: 1205827 - RNA, 14 nt, Mycobacterium bovis subsp bovis AF2122/97
uagccacgcccaca

SEQ ID NO: 1205828 - RNA, 16 nt, Mycobacterium bovis subsp bovis AF2122/97
uagccaccaagcacaa

SEQ ID NO: 1205829 - RNA, 22 nt, Mycobacterium bovis subsp bovis AF2122/97
uagccaugggauucggccagac

SEQ ID NO: 1205830 - RNA, 20 nt, Mycobacterium bovis subsp bovis AF2122/97
uagccaggcaaccggucagc

SEQ ID NO: 1205831 - RNA, 17 nt, Mycobacterium bovis subsp bovis AF2122/97
uagccagucggccaccu

SEQ ID NO: 1205832 - RNA, 13 nt, Mycobacterium bovis subsp bovis AF2122/97
uagcuguggcccg

SEQ ID NO: 1205833 - RNA, 13 nt, Mycobacterium bovis subsp bovis AF2122/97
uagcuuccggucc

SEQ ID NO: 1205834 - RNA, 13 nt, Mycobacterium bovis subsp bovis AF2122/97
uagcuuagcugcc

SEQ ID NO: 1205835 - RNA, 13 nt, Mycobacterium bovis subsp bovis AF2122/97
uagcugccggccc

SEQ ID NO: 1205836 - RNA, 22 nt, Mycobacterium bovis subsp bovis AF2122/97
uagcugcgcagcgcaaacaucu

SEQ ID NO: 1205837 - RNA, 14 nt, Mycobacterium bovis subsp bovis AF2122/97
uagcucccugggcg

SEQ ID NO: 1205838 - RNA, 18 nt, Mycobacterium bovis subsp bovis AF2122/97
uagcucgguaggccggca

SEQ ID NO: 1205839 - RNA, 23 nt, Mycobacterium bovis subsp bovis AF2122/97
uagcucgucgaggaagaucaccu

SEQ ID NO: 1205840 - RNA, 14 nt, Mycobacterium bovis subsp bovis AF2122/97
uagcuccuauggca

SEQ ID NO: 1205841 - RNA, 19 nt, Mycobacterium bovis subsp bovis AF2122/97
uagcucgcugaccuuguug

SEQ ID NO: 1205842 - RNA, 19 nt, Mycobacterium bovis subsp bovis AF2122/97
uagcgucgucccagcgcgg

SEQ ID NO: 1205843 - RNA, 14 nt, Mycobacterium bovis subsp bovis AF2122/97
uaggaccaccagcg

SEQ ID NO: 1205844 - RNA, 16 nt, Mycobacterium bovis subsp bovis AF2122/97
uaggaccaccagcgcu

SEQ ID NO: 1205845 - RNA, 22 nt, Mycobacterium bovis subsp bovis AF2122/97
uaggaccaccagcgcuccagca

SEQ ID NO: 1205846 - RNA, 16 nt, Mycobacterium bovis subsp bovis AF2122/97
uaggacccagccagcu

SEQ ID NO: 1205847 - RNA, 19 nt, Mycobacterium bovis subsp bovis AF2122/97
uaggacuugauaucggcgg

SEQ ID NO: 1205848 - RNA, 22 nt, Mycobacterium bovis subsp bovis AF2122/97
uaggcaaccuuuggccgcugug

SEQ ID NO: 1205849 - RNA, 17 nt, Mycobacterium bovis subsp bovis AF2122/97
uagcagcgccagcagcu

SEQ ID NO: 1205850 - RNA, 13 nt, Mycobacterium bovis subsp bovis AF2122/97
uagcagccgcuga

SEQ ID NO: 1205851 - RNA, 13 nt, Mycobacterium bovis subsp bovis AF2122/97
uagcagugcagca

SEQ ID NO: 1205852 - RNA, 14 nt, Mycobacterium bovis subsp bovis AF2122/97
uagcagugcagcaa

SEQ ID NO: 1205853 - RNA, 20 nt, Mycobacterium bovis subsp bovis AF2122/97
uagcaaucggcaggauuccc

SEQ ID NO: 1205854 - RNA, 15 nt, Mycobacterium bovis subsp bovis AF2122/97
uagcaccacaucggu

SEQ ID NO: 1205855 - RNA, 23 nt, Mycobacterium bovis subsp bovis AF2122/97
uagcaccaguucccuacacccau

SEQ ID NO: 1205856 - RNA, 11 nt, Mycobacterium bovis subsp bovis AF2122/97
uagcacccacg

SEQ ID NO: 1205857 - RNA, 16 nt, Mycobacterium bovis subsp bovis AF2122/97
uagcacaucaugaaga

SEQ ID NO: 1205858 - RNA, 18 nt, Mycobacterium bovis subsp bovis AF2122/97
uagaggacugcggucugg

SEQ ID NO: 1205859 - RNA, 13 nt, Mycobacterium bovis subsp bovis AF2122/97
uagagcagcagcg

SEQ ID NO: 1205860 - RNA, 17 nt, Mycobacterium bovis subsp bovis AF2122/97
uagaucacccgcagccg

SEQ ID NO: 1205861 - RNA, 16 nt, Mycobacterium bovis subsp bovis AF2122/97
uagaucaucuggcugg

SEQ ID NO: 1205862 - RNA, 14 nt, Mycobacterium bovis subsp bovis AF2122/97
uagaucugggcugg

SEQ ID NO: 1205863 - RNA, 16 nt, Mycobacterium bovis subsp bovis AF2122/97
uagauaugcacccgca

SEQ ID NO: 1205864 - RNA, 16 nt, Mycobacterium bovis subsp bovis AF2122/97
uagaucaagaucugcu

SEQ ID NO: 1205865 - RNA, 18 nt, Mycobacterium bovis subsp bovis AF2122/97
uagaucaagaucugcuug

SEQ ID NO: 1205866 - RNA, 20 nt, Mycobacterium bovis subsp bovis AF2122/97
uagaugcgugcggcagugcc

SEQ ID NO: 1205867 - RNA, 19 nt, Mycobacterium bovis subsp bovis AF2122/97
uagaugcggaacgccgagc

SEQ ID NO: 1205868 - RNA, 19 nt, Mycobacterium bovis subsp bovis AF2122/97
uagauggugguggcccggc

SEQ ID NO: 1205869 - RNA, 20 nt, Mycobacterium bovis subsp bovis AF2122/97
uagauggugguggcccggcu

SEQ ID NO: 1205870 - RNA, 16 nt, Mycobacterium bovis subsp bovis AF2122/97
uagaugacgggcucgu

SEQ ID NO: 1205871 - RNA, 14 nt, Mycobacterium bovis subsp bovis AF2122/97
uagauguugccgcc

SEQ ID NO: 1205872 - RNA, 21 nt, Mycobacterium bovis subsp bovis AF2122/97
uaccgccggcgccggugccgc

SEQ ID NO: 1205873 - RNA, 20 nt, Mycobacterium bovis subsp bovis AF2122/97
uaccgccggcggcggccgca

SEQ ID NO: 1205874 - RNA, 19 nt, Mycobacterium bovis subsp bovis AF2122/97
uaccgccggcuccgccguu

SEQ ID NO: 1205875 - RNA, 18 nt, Mycobacterium bovis subsp bovis AF2122/97
uaccgccggccccaccgg

SEQ ID NO: 1205876 - RNA, 21 nt, Mycobacterium bovis subsp bovis AF2122/97
uaccgccgcgcagccgcucga

SEQ ID NO: 1205877 - RNA, 14 nt, Mycobacterium bovis subsp bovis AF2122/97
uaccgcgaagcugc

SEQ ID NO: 1205878 - RNA, 16 nt, Mycobacterium bovis subsp bovis AF2122/97
uaccgcgcguugaagu

SEQ ID NO: 1205879 - RNA, 18 nt, Mycobacterium bovis subsp bovis AF2122/97
uaccgcccgcgccaccgg

SEQ ID NO: 1205880 - RNA, 16 nt, Mycobacterium bovis subsp bovis AF2122/97
uaccgccagcgccacc

SEQ ID NO: 1205881 - RNA, 22 nt, Mycobacterium bovis subsp bovis AF2122/97
uaccacuguuacggccacaccg

SEQ ID NO: 1205882 - RNA, 14 nt, Mycobacterium bovis subsp bovis AF2122/97
uaccaccggcaccg

SEQ ID NO: 1205883 - RNA, 17 nt, Mycobacterium bovis subsp bovis AF2122/97
uaccaccgucaccgccg

SEQ ID NO: 1205884 - RNA, 20 nt, Mycobacterium bovis subsp bovis AF2122/97
uaccaccgucaccgccggca

SEQ ID NO: 1205885 - RNA, 20 nt, Mycobacterium bovis subsp bovis AF2122/97
uaccaccgucuccggcgcca

SEQ ID NO: 1205886 - RNA, 15 nt, Mycobacterium bovis subsp bovis AF2122/97
uaccggucagcaccu

SEQ ID NO: 1205887 - RNA, 13 nt, Mycobacterium bovis subsp bovis AF2122/97
uaccggcggcgcc

SEQ ID NO: 1205888 - RNA, 20 nt, Mycobacterium bovis subsp bovis AF2122/97
uaccggcgccgcgcggcuug

SEQ ID NO: 1205889 - RNA, 18 nt, Mycobacterium bovis subsp bovis AF2122/97
uaccggccgccaucaucg

SEQ ID NO: 1205890 - RNA, 17 nt, Mycobacterium bovis subsp bovis AF2122/97
uaccggccuuuccagca

SEQ ID NO: 1205891 - RNA, 15 nt, Mycobacterium bovis subsp bovis AF2122/97
uaccgggaucccacg

SEQ ID NO: 1205892 - RNA, 16 nt, Mycobacterium bovis subsp bovis AF2122/97
uaccggcuggccaggu

SEQ ID NO: 1205893 - RNA, 16 nt, Mycobacterium bovis subsp bovis AF2122/97
uacgaacucaccgcca

SEQ ID NO: 1205894 - RNA, 18 nt, Mycobacterium bovis subsp bovis AF2122/97
uacggaccguggcagcug

SEQ ID NO: 1205895 - RNA, 13 nt, Mycobacterium bovis subsp bovis AF2122/97
uacgggugaucuu

SEQ ID NO: 1205896 - RNA, 21 nt, Mycobacterium bovis subsp bovis AF2122/97
uacggcaauacccgccgcgau

SEQ ID NO: 1205897 - RNA, 13 nt, Mycobacterium bovis subsp bovis AF2122/97
uacggccacaccg

SEQ ID NO: 1205898 - RNA, 16 nt, Mycobacterium bovis subsp bovis AF2122/97
uacgguugaugcaucc

SEQ ID NO: 1205899 - RNA, 13 nt, Mycobacterium bovis subsp bovis AF2122/97
uacuaugccaacg

SEQ ID NO: 1205900 - RNA, 15 nt, Mycobacterium bovis subsp bovis AF2122/97
uacuccacccaggcc

SEQ ID NO: 1205901 - RNA, 20 nt, Mycobacterium bovis subsp bovis AF2122/97
uagaagccgacguugaagcc

SEQ ID NO: 1205902 - RNA, 13 nt, Mycobacterium bovis subsp bovis AF2122/97
uagaccugguuga

SEQ ID NO: 1205903 - RNA, 20 nt, Mycobacterium bovis subsp bovis AF2122/97
uagacuagccgauccagcag

SEQ ID NO: 1205904 - RNA, 13 nt, Mycobacterium bovis subsp bovis AF2122/97
uagacgugcacca

SEQ ID NO: 1205905 - RNA, 15 nt, Mycobacterium bovis subsp bovis AF2122/97
uagacuugcugcucc

SEQ ID NO: 1205906 - RNA, 18 nt, Mycobacterium bovis subsp bovis AF2122/97
uagaccgcagucgcuggg

SEQ ID NO: 1205907 - RNA, 15 nt, Mycobacterium bovis subsp bovis AF2122/97
uagaccaugaagaac

SEQ ID NO: 1205908 - RNA, 20 nt, Mycobacterium bovis subsp bovis AF2122/97
uagacagucugcgacuggau

SEQ ID NO: 1205909 - RNA, 19 nt, Mycobacterium bovis subsp bovis AF2122/97
uacuucaucggcacaggcg

SEQ ID NO: 1205910 - RNA, 16 nt, Mycobacterium bovis subsp bovis AF2122/97
uacugguuagagacuu

SEQ ID NO: 1205911 - RNA, 16 nt, Mycobacterium bovis subsp bovis AF2122/97
uacucgaaacccaugu

SEQ ID NO: 1205912 - RNA, 16 nt, Mycobacterium bovis subsp bovis AF2122/97
uacuccgacggcccgg

SEQ ID NO: 1205913 - RNA, 21 nt, Mycobacterium bovis subsp bovis AF2122/97
uacuccgacggcccggugagc

SEQ ID NO: 1205914 - RNA, 21 nt, Mycobacterium bovis subsp bovis AF2122/97
uaacgacgguuccgccaccgg

SEQ ID NO: 1205915 - RNA, 14 nt, Mycobacterium bovis subsp bovis AF2122/97
uaacgacugacaac

SEQ ID NO: 1205916 - RNA, 22 nt, Mycobacterium bovis subsp bovis AF2122/97
uaauccgggcaaucacaucaaa

SEQ ID NO: 1205917 - RNA, 17 nt, Mycobacterium bovis subsp bovis AF2122/97
uaauggcgugcagaccc

SEQ ID NO: 1205918 - RNA, 20 nt, Mycobacterium bovis subsp bovis AF2122/97
uacagcuugaucgccgaggc

SEQ ID NO: 1205919 - RNA, 21 nt, Mycobacterium bovis subsp bovis AF2122/97
uacagcuugaucgccgaggcc

SEQ ID NO: 1205920 - RNA, 19 nt, Mycobacterium bovis subsp bovis AF2122/97
uacaggaagucgcggacgu

SEQ ID NO: 1205921 - RNA, 15 nt, Mycobacterium bovis subsp bovis AF2122/97
uacaggccacgcacc

SEQ ID NO: 1205922 - RNA, 16 nt, Mycobacterium bovis subsp bovis AF2122/97
uacagcgccuggguga

SEQ ID NO: 1205923 - RNA, 20 nt, Mycobacterium bovis subsp bovis AF2122/97
uacagcaucaaccguccccg

SEQ ID NO: 1205924 - RNA, 16 nt, Mycobacterium bovis subsp bovis AF2122/97
uacaugucacacccac

SEQ ID NO: 1205925 - RNA, 13 nt, Mycobacterium bovis subsp bovis AF2122/97
uacauuucccagu

SEQ ID NO: 1205926 - RNA, 15 nt, Mycobacterium bovis subsp bovis AF2122/97
uacauuucccaguca

SEQ ID NO: 1205927 - RNA, 19 nt, Mycobacterium bovis subsp bovis AF2122/97
uacacauaggugcggggcc

SEQ ID NO: 1205928 - RNA, 21 nt, Mycobacterium bovis subsp bovis AF2122/97
uacacaucgucacugccaccu

SEQ ID NO: 1205929 - RNA, 15 nt, Mycobacterium bovis subsp bovis AF2122/97
uacaaccugaugcuc

SEQ ID NO: 1205930 - RNA, 22 nt, Mycobacterium bovis subsp bovis AF2122/97
gugccggggccccaugccgacc

SEQ ID NO: 1205931 - RNA, 15 nt, Mycobacterium bovis subsp bovis AF2122/97
gugccggggcugccg

SEQ ID NO: 1205932 - RNA, 15 nt, Mycobacterium bovis subsp bovis AF2122/97
gugccgggcaccacc

SEQ ID NO: 1205933 - RNA, 21 nt, Mycobacterium bovis subsp bovis AF2122/97
gugccgucggcgugcagcagc

SEQ ID NO: 1205934 - RNA, 22 nt, Mycobacterium bovis subsp bovis AF2122/97
gugccgucggcgugcagcagcu

SEQ ID NO: 1205935 - RNA, 20 nt, Mycobacterium bovis subsp bovis AF2122/97
gugccggacuuggccugcgg

SEQ ID NO: 1205936 - RNA, 21 nt, Mycobacterium bovis subsp bovis AF2122/97
gugccggacuuggccugcggu

SEQ ID NO: 1205937 - RNA, 14 nt, Mycobacterium bovis subsp bovis AF2122/97
gugccgccagcaac

SEQ ID NO: 1205938 - RNA, 11 nt, Mycobacterium bovis subsp bovis AF2122/97
gugccgcccag

SEQ ID NO: 1205939 - RNA, 16 nt, Mycobacterium bovis subsp bovis AF2122/97
gugccgccgcggccac

SEQ ID NO: 1205940 - RNA, 15 nt, Mycobacterium bovis subsp bovis AF2122/97
gugccgcccaggagc

SEQ ID NO: 1205941 - RNA, 16 nt, Mycobacterium bovis subsp bovis AF2122/97
gugccgcccaggagca

SEQ ID NO: 1205942 - RNA, 17 nt, Mycobacterium bovis subsp bovis AF2122/97
gugccgcccgcgccucc

SEQ ID NO: 1205943 - RNA, 18 nt, Mycobacterium bovis subsp bovis AF2122/97
gugccgcugcauccgcag

SEQ ID NO: 1205944 - RNA, 17 nt, Mycobacterium bovis subsp bovis AF2122/97
gugccgcggccaccgcc

SEQ ID NO: 1205945 - RNA, 13 nt, Mycobacterium bovis subsp bovis AF2122/97
gugccgccgacac

SEQ ID NO: 1205946 - RNA, 20 nt, Mycobacterium bovis subsp bovis AF2122/97
gugccgccggugccgccugc

SEQ ID NO: 1205947 - RNA, 22 nt, Mycobacterium bovis subsp bovis AF2122/97
gugccgccugcgccgccagcgc

SEQ ID NO: 1205948 - RNA, 16 nt, Mycobacterium bovis subsp bovis AF2122/97
gugccguuccagcauc

SEQ ID NO: 1205949 - RNA, 17 nt, Mycobacterium bovis subsp bovis AF2122/97
gugccucgaggacggcg

SEQ ID NO: 1205950 - RNA, 20 nt, Mycobacterium bovis subsp bovis AF2122/97
gugccucgauuguggccagc

SEQ ID NO: 1205951 - RNA, 23 nt, Mycobacterium bovis subsp bovis AF2122/97
gugccucgauuguggccagcgcu

SEQ ID NO: 1205952 - RNA, 13 nt, Mycobacterium bovis subsp bovis AF2122/97
gugccucgcagcc

SEQ ID NO: 1205953 - RNA, 13 nt, Mycobacterium bovis subsp bovis AF2122/97
gugccguggugga

SEQ ID NO: 1205954 - RNA, 17 nt, Mycobacterium bovis subsp bovis AF2122/97
gugccgucggugccgcg

SEQ ID NO: 1205955 - RNA, 13 nt, Mycobacterium bovis subsp bovis AF2122/97
gugccgugcucac

SEQ ID NO: 1205956 - RNA, 13 nt, Mycobacterium bovis subsp bovis AF2122/97
gugccguggauug

SEQ ID NO: 1205957 - RNA, 22 nt, Mycobacterium bovis subsp bovis AF2122/97
gugccucgcguucgcugguccu

SEQ ID NO: 1205958 - RNA, 21 nt, Mycobacterium bovis subsp bovis AF2122/97
gugccugucagaaggaucagc

SEQ ID NO: 1205959 - RNA, 13 nt, Mycobacterium bovis subsp bovis AF2122/97
gugccuggccggu

SEQ ID NO: 1205960 - RNA, 16 nt, Mycobacterium bovis subsp bovis AF2122/97
gugccuggccggugcg

SEQ ID NO: 1205961 - RNA, 22 nt, Mycobacterium bovis subsp bovis AF2122/97
gugccuucuucgcuaccuucuu

SEQ ID NO: 1205962 - RNA, 17 nt, Mycobacterium bovis subsp bovis AF2122/97
gugccuuucggcagacc

SEQ ID NO: 1205963 - RNA, 20 nt, Mycobacterium bovis subsp bovis AF2122/97
gugcgacaacacgaccucuu

SEQ ID NO: 1205964 - RNA, 16 nt, Mycobacterium bovis subsp bovis AF2122/97
gugccacuucuucacu

SEQ ID NO: 1205965 - RNA, 19 nt, Mycobacterium bovis subsp bovis AF2122/97
gugccaccgcgacggcagg

SEQ ID NO: 1205966 - RNA, 15 nt, Mycobacterium bovis subsp bovis AF2122/97
gugccagcacuccac

SEQ ID NO: 1205967 - RNA, 13 nt, Mycobacterium bovis subsp bovis AF2122/97
gugccacuuccac

SEQ ID NO: 1205968 - RNA, 16 nt, Mycobacterium bovis subsp bovis AF2122/97
gugccaaacgccgccc

SEQ ID NO: 1205969 - RNA, 19 nt, Mycobacterium bovis subsp bovis AF2122/97
gugccacagcucgccguga

SEQ ID NO: 1205970 - RNA, 17 nt, Mycobacterium bovis subsp bovis AF2122/97
gugccaauuccagcccc

SEQ ID NO: 1205971 - RNA, 18 nt, Mycobacterium bovis subsp bovis AF2122/97
gugccaauuccagccccc

SEQ ID NO: 1205972 - RNA, 14 nt, Mycobacterium bovis subsp bovis AF2122/97
gugccagcgccccg

SEQ ID NO: 1205973 - RNA, 12 nt, Mycobacterium bovis subsp bovis AF2122/97
gugccagcugcc

SEQ ID NO: 1205974 - RNA, 15 nt, Mycobacterium bovis subsp bovis AF2122/97
gugccacgccugagc

SEQ ID NO: 1205975 - RNA, 16 nt, Mycobacterium bovis subsp bovis AF2122/97
gugccagcaggggacg

SEQ ID NO: 1205976 - RNA, 12 nt, Mycobacterium bovis subsp bovis AF2122/97
gugccagccgga

SEQ ID NO: 1205977 - RNA, 22 nt, Mycobacterium bovis subsp bovis AF2122/97
gugcccaacccacucgcagcag

SEQ ID NO: 1205978 - RNA, 24 nt, Mycobacterium bovis subsp bovis AF2122/97
gugcccaacccacucgcagcagca

SEQ ID NO: 1205979 - RNA, 19 nt, Mycobacterium bovis subsp bovis AF2122/97
gugcccaaggccaggaucu

SEQ ID NO: 1205980 - RNA, 15 nt, Mycobacterium bovis subsp bovis AF2122/97
gugccaucgggcgcg

SEQ ID NO: 1205981 - RNA, 15 nt, Mycobacterium bovis subsp bovis AF2122/97
gugccaucgguggug

SEQ ID NO: 1205982 - RNA, 17 nt, Mycobacterium bovis subsp bovis AF2122/97
gugccaucggugguggc

SEQ ID NO: 1205983 - RNA, 14 nt, Mycobacterium bovis subsp bovis AF2122/97
gugccaguccgaug

SEQ ID NO: 1205984 - RNA, 18 nt, Mycobacterium bovis subsp bovis AF2122/97
gugccagugccagcgucc

SEQ ID NO: 1205985 - RNA, 20 nt, Mycobacterium bovis subsp bovis AF2122/97
gugcccggcuccuccccggc

SEQ ID NO: 1205986 - RNA, 14 nt, Mycobacterium bovis subsp bovis AF2122/97
gugccgaacaggga

SEQ ID NO: 1205987 - RNA, 15 nt, Mycobacterium bovis subsp bovis AF2122/97
gugccgacccgccgc

SEQ ID NO: 1205988 - RNA, 14 nt, Mycobacterium bovis subsp bovis AF2122/97
gugccgagcuggcg

SEQ ID NO: 1205989 - RNA, 20 nt, Mycobacterium bovis subsp bovis AF2122/97
gugccgagcuugucgagcag

SEQ ID NO: 1205990 - RNA, 22 nt, Mycobacterium bovis subsp bovis AF2122/97
gugccgagcgugcgcugguggc

SEQ ID NO: 1205991 - RNA, 13 nt, Mycobacterium bovis subsp bovis AF2122/97
gugccgagcuggc

SEQ ID NO: 1205992 - RNA, 14 nt, Mycobacterium bovis subsp bovis AF2122/97
gugccgaucgaugc

SEQ ID NO: 1205993 - RNA, 14 nt, Mycobacterium bovis subsp bovis AF2122/97
gugccccgcccggc

SEQ ID NO: 1205994 - RNA, 15 nt, Mycobacterium bovis subsp bovis AF2122/97
gugccccgagcugcc

SEQ ID NO: 1205995 - RNA, 18 nt, Mycobacterium bovis subsp bovis AF2122/97
gugcccccggugccgccc

SEQ ID NO: 1205996 - RNA, 23 nt, Mycobacterium bovis subsp bovis AF2122/97
gugcccggaauguaguccagcuc

SEQ ID NO: 1205997 - RNA, 19 nt, Mycobacterium bovis subsp bovis AF2122/97
gugcccgcguugccaaagc

SEQ ID NO: 1205998 - RNA, 13 nt, Mycobacterium bovis subsp bovis AF2122/97
gugcccgcgcggc

SEQ ID NO: 1205999 - RNA, 16 nt, Mycobacterium bovis subsp bovis AF2122/97
gugcccgcacugccgc

SEQ ID NO: 1206000 - RNA, 12 nt, Mycobacterium bovis subsp bovis AF2122/97
gugccccgccga

SEQ ID NO: 1206001 - RNA, 15 nt, Mycobacterium bovis subsp bovis AF2122/97
gugccccgccgagcg

SEQ ID NO: 1206002 - RNA, 15 nt, Mycobacterium bovis subsp bovis AF2122/97
gugcccgaaggaaaa

SEQ ID NO: 1206003 - RNA, 13 nt, Mycobacterium bovis subsp bovis AF2122/97
gugcaggugcggg

SEQ ID NO: 1206004 - RNA, 19 nt, Mycobacterium bovis subsp bovis AF2122/97
gugcagguggccgucgccg

SEQ ID NO: 1206005 - RNA, 17 nt, Mycobacterium bovis subsp bovis AF2122/97
gugcagcgaucccggca

SEQ ID NO: 1206006 - RNA, 23 nt, Mycobacterium bovis subsp bovis AF2122/97
gugcagcgacuccguaccggguu

SEQ ID NO: 1206007 - RNA, 17 nt, Mycobacterium bovis subsp bovis AF2122/97
gugcaggucguccaucg

SEQ ID NO: 1206008 - RNA, 21 nt, Mycobacterium bovis subsp bovis AF2122/97
gugcaggugcccggccaaaau

SEQ ID NO: 1206009 - RNA, 17 nt, Mycobacterium bovis subsp bovis AF2122/97
gugcaaccacggcggca

SEQ ID NO: 1206010 - RNA, 17 nt, Mycobacterium bovis subsp bovis AF2122/97
gugcaaccauggcggcu

SEQ ID NO: 1206011 - RNA, 22 nt, Mycobacterium bovis subsp bovis AF2122/97
gugcaaccccaaguccagcagc

SEQ ID NO: 1206012 - RNA, 12 nt, Mycobacterium bovis subsp bovis AF2122/97
gugcaccaggua

SEQ ID NO: 1206013 - RNA, 14 nt, Mycobacterium bovis subsp bovis AF2122/97
gugcacagcaguga

SEQ ID NO: 1206014 - RNA, 14 nt, Mycobacterium bovis subsp bovis AF2122/97
gugcaccaucauca

SEQ ID NO: 1206015 - RNA, 20 nt, Mycobacterium bovis subsp bovis AF2122/97
gugcaccaucaucaccucuc

SEQ ID NO: 1206016 - RNA, 19 nt, Mycobacterium bovis subsp bovis AF2122/97
gugcaccgaagauggccag

SEQ ID NO: 1206017 - RNA, 21 nt, Mycobacterium bovis subsp bovis AF2122/97
gugcacacaauucgggcguga

SEQ ID NO: 1206018 - RNA, 21 nt, Mycobacterium bovis subsp bovis AF2122/97
gugcaaccauggcggcuccgc

SEQ ID NO: 1206019 - RNA, 21 nt, Mycobacterium bovis subsp bovis AF2122/97
gugcacacugguggugcccgg

SEQ ID NO: 1206020 - RNA, 22 nt, Mycobacterium bovis subsp bovis AF2122/97
gugcacagacacggcagcugca

SEQ ID NO: 1206021 - RNA, 18 nt, Mycobacterium bovis subsp bovis AF2122/97
gugcaccucguguccggg

SEQ ID NO: 1206022 - RNA, 20 nt, Mycobacterium bovis subsp bovis AF2122/97
gugcagcaccagccaaauca

SEQ ID NO: 1206023 - RNA, 19 nt, Mycobacterium bovis subsp bovis AF2122/97
gugcaccuggaucagggcu

SEQ ID NO: 1206024 - RNA, 21 nt, Mycobacterium bovis subsp bovis AF2122/97
gugcacgaaguccuggcagac

SEQ ID NO: 1206025 - RNA, 21 nt, Mycobacterium bovis subsp bovis AF2122/97
gugcagcgacuccguaccggg

SEQ ID NO: 1206026 - RNA, 19 nt, Mycobacterium bovis subsp bovis AF2122/97
gugcagcccaaggcgacga

SEQ ID NO: 1206027 - RNA, 16 nt, Mycobacterium bovis subsp bovis AF2122/97
gugcagccgcaggugg

SEQ ID NO: 1206028 - RNA, 14 nt, Mycobacterium bovis subsp bovis AF2122/97
gugcagcccgccgg

SEQ ID NO: 1206029 - RNA, 18 nt, Mycobacterium bovis subsp bovis AF2122/97
gugcagcacgugugcggg

SEQ ID NO: 1206030 - RNA, 21 nt, Mycobacterium bovis subsp bovis AF2122/97
gugcagcacguccgcggagcu

SEQ ID NO: 1206031 - RNA, 18 nt, Mycobacterium bovis subsp bovis AF2122/97
gugcagccaaaucagaug

SEQ ID NO: 1206032 - RNA, 18 nt, Mycobacterium bovis subsp bovis AF2122/97
gucuaggccaaaccccug

SEQ ID NO: 1206033 - RNA, 23 nt, Mycobacterium bovis subsp bovis AF2122/97
gucuaugaucuggucccguggcg

SEQ ID NO: 1206034 - RNA, 23 nt, Mycobacterium bovis subsp bovis AF2122/97
gugauacagcgccaggggugugc

SEQ ID NO: 1206035 - RNA, 17 nt, Mycobacterium bovis subsp bovis AF2122/97
gugauggccgaccagcc

SEQ ID NO: 1206036 - RNA, 16 nt, Mycobacterium bovis subsp bovis AF2122/97
gugauggagccgguga

SEQ ID NO: 1206037 - RNA, 14 nt, Mycobacterium bovis subsp bovis AF2122/97
gugaugggggagcc

SEQ ID NO: 1206038 - RNA, 17 nt, Mycobacterium bovis subsp bovis AF2122/97
gugauggugugcagcag

SEQ ID NO: 1206039 - RNA, 19 nt, Mycobacterium bovis subsp bovis AF2122/97
gugauggugugcagcagca

SEQ ID NO: 1206040 - RNA, 17 nt, Mycobacterium bovis subsp bovis AF2122/97
gugauggugaccagcag

SEQ ID NO: 1206041 - RNA, 19 nt, Mycobacterium bovis subsp bovis AF2122/97
gugauguagggcugcuccu

SEQ ID NO: 1206042 - RNA, 14 nt, Mycobacterium bovis subsp bovis AF2122/97
gugaugucggugcg

SEQ ID NO: 1206043 - RNA, 15 nt, Mycobacterium bovis subsp bovis AF2122/97
gugaugcggucgcgg

SEQ ID NO: 1206044 - RNA, 18 nt, Mycobacterium bovis subsp bovis AF2122/97
gugaugcguucggccggg

SEQ ID NO: 1206045 - RNA, 13 nt, Mycobacterium bovis subsp bovis AF2122/97
gugaugcccuggg

SEQ ID NO: 1206046 - RNA, 13 nt, Mycobacterium bovis subsp bovis AF2122/97
gugaugccgauga

SEQ ID NO: 1206047 - RNA, 13 nt, Mycobacterium bovis subsp bovis AF2122/97
gugaucagcagca

SEQ ID NO: 1206048 - RNA, 21 nt, Mycobacterium bovis subsp bovis AF2122/97
gugaucagcaggaucggcagc

SEQ ID NO: 1206049 - RNA, 18 nt, Mycobacterium bovis subsp bovis AF2122/97
gugaucagcgcaucgccg

SEQ ID NO: 1206050 - RNA, 14 nt, Mycobacterium bovis subsp bovis AF2122/97
gugaucacggucgg

SEQ ID NO: 1206051 - RNA, 21 nt, Mycobacterium bovis subsp bovis AF2122/97
gugaugaccgcguagagcagc

SEQ ID NO: 1206052 - RNA, 12 nt, Mycobacterium bovis subsp bovis AF2122/97
gugcgcgcggcg

SEQ ID NO: 1206053 - RNA, 13 nt, Mycobacterium bovis subsp bovis AF2122/97
gugcgccgguccu

SEQ ID NO: 1206054 - RNA, 13 nt, Mycobacterium bovis subsp bovis AF2122/97
gugcgccgcagca

SEQ ID NO: 1206055 - RNA, 13 nt, Mycobacterium bovis subsp bovis AF2122/97
gugcgccgcagcc

SEQ ID NO: 1206056 - RNA, 12 nt, Mycobacterium bovis subsp bovis AF2122/97
gugcgcagguac

SEQ ID NO: 1206057 - RNA, 20 nt, Mycobacterium bovis subsp bovis AF2122/97
gugcgcacugaggcucaggu

SEQ ID NO: 1206058 - RNA, 13 nt, Mycobacterium bovis subsp bovis AF2122/97
gugcgcccaucau

SEQ ID NO: 1206059 - RNA, 21 nt, Mycobacterium bovis subsp bovis AF2122/97
gugcgccauucccgguggcug

SEQ ID NO: 1206060 - RNA, 21 nt, Mycobacterium bovis subsp bovis AF2122/97
gugcgacugcgaaugcugggc

SEQ ID NO: 1206061 - RNA, 16 nt, Mycobacterium bovis subsp bovis AF2122/97
gugcgagaagcaggga

SEQ ID NO: 1206062 - RNA, 15 nt, Mycobacterium bovis subsp bovis AF2122/97
gugcgagggcacggc

SEQ ID NO: 1206063 - RNA, 19 nt, Mycobacterium bovis subsp bovis AF2122/97
gugcgaucgcaacaccggu

SEQ ID NO: 1206064 - RNA, 15 nt, Mycobacterium bovis subsp bovis AF2122/97
gugcgcaacccagcc

SEQ ID NO: 1206065 - RNA, 12 nt, Mycobacterium bovis subsp bovis AF2122/97
gugcgcaccagc

SEQ ID NO: 1206066 - RNA, 17 nt, Mycobacterium bovis subsp bovis AF2122/97
gugcgauaccuagcccc

SEQ ID NO: 1206067 - RNA, 14 nt, Mycobacterium bovis subsp bovis AF2122/97
gugcguccgcaaca

SEQ ID NO: 1206068 - RNA, 15 nt, Mycobacterium bovis subsp bovis AF2122/97
gugcguccgcaacag

SEQ ID NO: 1206069 - RNA, 13 nt, Mycobacterium bovis subsp bovis AF2122/97
gugcgguggugcg

SEQ ID NO: 1206070 - RNA, 21 nt, Mycobacterium bovis subsp bovis AF2122/97
gugcgggccggucgugccggg

SEQ ID NO: 1206071 - RNA, 19 nt, Mycobacterium bovis subsp bovis AF2122/97
gugcgggcuucaacacacu

SEQ ID NO: 1206072 - RNA, 17 nt, Mycobacterium bovis subsp bovis AF2122/97
gugcggguggugccggc

SEQ ID NO: 1206073 - RNA, 18 nt, Mycobacterium bovis subsp bovis AF2122/97
gugcggguucacugccgg

SEQ ID NO: 1206074 - RNA, 16 nt, Mycobacterium bovis subsp bovis AF2122/97
gugcgggggcgaccug

SEQ ID NO: 1206075 - RNA, 18 nt, Mycobacterium bovis subsp bovis AF2122/97
gugcggugagauggcggu

SEQ ID NO: 1206076 - RNA, 23 nt, Mycobacterium bovis subsp bovis AF2122/97
gugcgguauuugaacgcccgcuu

SEQ ID NO: 1206077 - RNA, 13 nt, Mycobacterium bovis subsp bovis AF2122/97
gugcggcgcggcg

SEQ ID NO: 1206078 - RNA, 15 nt, Mycobacterium bovis subsp bovis AF2122/97
gugcggcgcaugcaa

SEQ ID NO: 1206079 - RNA, 22 nt, Mycobacterium bovis subsp bovis AF2122/97
gugcggcccaaccggucguggu

SEQ ID NO: 1206080 - RNA, 21 nt, Mycobacterium bovis subsp bovis AF2122/97
gugcggcguauugcggccugu

SEQ ID NO: 1206081 - RNA, 13 nt, Mycobacterium bovis subsp bovis AF2122/97
gugcggcggcugc

SEQ ID NO: 1206082 - RNA, 18 nt, Mycobacterium bovis subsp bovis AF2122/97
gugcggcguuguggcgug

SEQ ID NO: 1206083 - RNA, 13 nt, Mycobacterium bovis subsp bovis AF2122/97
gugcggcugcaac

SEQ ID NO: 1206084 - RNA, 19 nt, Mycobacterium bovis subsp bovis AF2122/97
gugcggcagcgguggcuug

SEQ ID NO: 1206085 - RNA, 13 nt, Mycobacterium bovis subsp bovis AF2122/97
gugcggcagcccc

SEQ ID NO: 1206086 - RNA, 19 nt, Mycobacterium bovis subsp bovis AF2122/97
gugcggaauggucagguuc

SEQ ID NO: 1206087 - RNA, 22 nt, Mycobacterium bovis subsp bovis AF2122/97
gugcggaucacucccccacaca

SEQ ID NO: 1206088 - RNA, 22 nt, Mycobacterium bovis subsp bovis AF2122/97
gugcucagcgcgcgccgcuggg

SEQ ID NO: 1206089 - RNA, 17 nt, Mycobacterium bovis subsp bovis AF2122/97
gugcucacauccgguca

SEQ ID NO: 1206090 - RNA, 23 nt, Mycobacterium bovis subsp bovis AF2122/97
gugcgugcggucgauccggccag

SEQ ID NO: 1206091 - RNA, 17 nt, Mycobacterium bovis subsp bovis AF2122/97
gugcguuggaugaaguc

SEQ ID NO: 1206092 - RNA, 20 nt, Mycobacterium bovis subsp bovis AF2122/97
gugcuaccggcuuggcggga

SEQ ID NO: 1206093 - RNA, 20 nt, Mycobacterium bovis subsp bovis AF2122/97
gugcucccgauaauccuuug

SEQ ID NO: 1206094 - RNA, 20 nt, Mycobacterium bovis subsp bovis AF2122/97
gugcucgccggaucuugccg

SEQ ID NO: 1206095 - RNA, 14 nt, Mycobacterium bovis subsp bovis AF2122/97
gugcucgccggcac

SEQ ID NO: 1206096 - RNA, 22 nt, Mycobacterium bovis subsp bovis AF2122/97
gugcucgccguaagcaccagcc

SEQ ID NO: 1206097 - RNA, 19 nt, Mycobacterium bovis subsp bovis AF2122/97
gugcucgcgaucugcucgu

SEQ ID NO: 1206098 - RNA, 18 nt, Mycobacterium bovis subsp bovis AF2122/97
gugcucuucggcaccacc

SEQ ID NO: 1206099 - RNA, 13 nt, Mycobacterium bovis subsp bovis AF2122/97
gugcuuggcagcg

SEQ ID NO: 1206100 - RNA, 18 nt, Mycobacterium bovis subsp bovis AF2122/97
gugcugcaccuggcgcag

SEQ ID NO: 1206101 - RNA, 19 nt, Mycobacterium bovis subsp bovis AF2122/97
gugcugcaccguuuccggc

SEQ ID NO: 1206102 - RNA, 20 nt, Mycobacterium bovis subsp bovis AF2122/97
gugcugcaaggaauuccggc

SEQ ID NO: 1206103 - RNA, 17 nt, Mycobacterium bovis subsp bovis AF2122/97
gugcugaugggucaggc

SEQ ID NO: 1206104 - RNA, 14 nt, Mycobacterium bovis subsp bovis AF2122/97
gugcugaccgcgcc

SEQ ID NO: 1206105 - RNA, 14 nt, Mycobacterium bovis subsp bovis AF2122/97
gugcugccuuggga

SEQ ID NO: 1206106 - RNA, 12 nt, Mycobacterium bovis subsp bovis AF2122/97
gugcugcggcug

SEQ ID NO: 1206107 - RNA, 13 nt, Mycobacterium bovis subsp bovis AF2122/97
gugcugccgcaca

SEQ ID NO: 1206108 - RNA, 15 nt, Mycobacterium bovis subsp bovis AF2122/97
gugcugccgccuugg

SEQ ID NO: 1206109 - RNA, 23 nt, Mycobacterium bovis subsp bovis AF2122/97
gugcugccggagacacccgccag

SEQ ID NO: 1206110 - RNA, 21 nt, Mycobacterium bovis subsp bovis AF2122/97
gugcuggaaguaguccccaac

SEQ ID NO: 1206111 - RNA, 20 nt, Mycobacterium bovis subsp bovis AF2122/97
guggccgggcgguaggcuug

SEQ ID NO: 1206112 - RNA, 16 nt, Mycobacterium bovis subsp bovis AF2122/97
guggccgcugccagcc

SEQ ID NO: 1206113 - RNA, 14 nt, Mycobacterium bovis subsp bovis AF2122/97
guggccgugggugu

SEQ ID NO: 1206114 - RNA, 16 nt, Mycobacterium bovis subsp bovis AF2122/97
guggccggggugccgg

SEQ ID NO: 1206115 - RNA, 22 nt, Mycobacterium bovis subsp bovis AF2122/97
guggccgugaagggauccggaa

SEQ ID NO: 1206116 - RNA, 18 nt, Mycobacterium bovis subsp bovis AF2122/97
guggccgcugccagccgu

SEQ ID NO: 1206117 - RNA, 14 nt, Mycobacterium bovis subsp bovis AF2122/97
guggccucauccac

SEQ ID NO: 1206118 - RNA, 22 nt, Mycobacterium bovis subsp bovis AF2122/97
guggcgcccgucuccagcacca

SEQ ID NO: 1206119 - RNA, 16 nt, Mycobacterium bovis subsp bovis AF2122/97
guggcgccgaccugga

SEQ ID NO: 1206120 - RNA, 22 nt, Mycobacterium bovis subsp bovis AF2122/97
guggcgccguugucggcgguga

SEQ ID NO: 1206121 - RNA, 15 nt, Mycobacterium bovis subsp bovis AF2122/97
guggcgccggccacg

SEQ ID NO: 1206122 - RNA, 20 nt, Mycobacterium bovis subsp bovis AF2122/97
guggcgcugcgucguggaga

SEQ ID NO: 1206123 - RNA, 16 nt, Mycobacterium bovis subsp bovis AF2122/97
guggacucgggcgcug

SEQ ID NO: 1206124 - RNA, 19 nt, Mycobacterium bovis subsp bovis AF2122/97
guggacucgggcgcugaug

SEQ ID NO: 1206125 - RNA, 21 nt, Mycobacterium bovis subsp bovis AF2122/97
guggacuucagcaggcccagc

SEQ ID NO: 1206126 - RNA, 13 nt, Mycobacterium bovis subsp bovis AF2122/97
guggcccgcggug

SEQ ID NO: 1206127 - RNA, 18 nt, Mycobacterium bovis subsp bovis AF2122/97
guggccgccaccucccag

SEQ ID NO: 1206128 - RNA, 13 nt, Mycobacterium bovis subsp bovis AF2122/97
guggccgacagcg

SEQ ID NO: 1206129 - RNA, 16 nt, Mycobacterium bovis subsp bovis AF2122/97
guggccgcgcaggggc

SEQ ID NO: 1206130 - RNA, 16 nt, Mycobacterium bovis subsp bovis AF2122/97
guggccgccggcgcug

SEQ ID NO: 1206131 - RNA, 22 nt, Mycobacterium bovis subsp bovis AF2122/97
guggacaucgggcggcaccgcu

SEQ ID NO: 1206132 - RNA, 13 nt, Mycobacterium bovis subsp bovis AF2122/97
guggaauggcgcc

SEQ ID NO: 1206133 - RNA, 15 nt, Mycobacterium bovis subsp bovis AF2122/97
guggacacggcgcug

SEQ ID NO: 1206134 - RNA, 19 nt, Mycobacterium bovis subsp bovis AF2122/97
guggacagaugcauccagc

SEQ ID NO: 1206135 - RNA, 14 nt, Mycobacterium bovis subsp bovis AF2122/97
guggaccggccugg

SEQ ID NO: 1206136 - RNA, 21 nt, Mycobacterium bovis subsp bovis AF2122/97
guggaccggcuccgguaggcg

SEQ ID NO: 1206137 - RNA, 22 nt, Mycobacterium bovis subsp bovis AF2122/97
guggaccggcuccgguaggcga

SEQ ID NO: 1206138 - RNA, 22 nt, Mycobacterium bovis subsp bovis AF2122/97
guggacggcauagcagccagcg

SEQ ID NO: 1206139 - RNA, 21 nt, Mycobacterium bovis subsp bovis AF2122/97
guggcuggacccgcauggcgc

SEQ ID NO: 1206140 - RNA, 20 nt, Mycobacterium bovis subsp bovis AF2122/97
guggcugaacaccgcgggca

SEQ ID NO: 1206141 - RNA, 14 nt, Mycobacterium bovis subsp bovis AF2122/97
guggcggcaggugu

SEQ ID NO: 1206142 - RNA, 22 nt, Mycobacterium bovis subsp bovis AF2122/97
gugggaacuggaccacagccgc

SEQ ID NO: 1206143 - RNA, 21 nt, Mycobacterium bovis subsp bovis AF2122/97
guggcuuugacugcugggggu

SEQ ID NO: 1206144 - RNA, 16 nt, Mycobacterium bovis subsp bovis AF2122/97
guggcuggcaugccgg

SEQ ID NO: 1206145 - RNA, 13 nt, Mycobacterium bovis subsp bovis AF2122/97
guggcuggcugug

SEQ ID NO: 1206146 - RNA, 14 nt, Mycobacterium bovis subsp bovis AF2122/97
guggcuucacccaa

SEQ ID NO: 1206147 - RNA, 13 nt, Mycobacterium bovis subsp bovis AF2122/97
gugggcgccgucg

SEQ ID NO: 1206148 - RNA, 21 nt, Mycobacterium bovis subsp bovis AF2122/97
gugggcgccgacaccggcuga

SEQ ID NO: 1206149 - RNA, 23 nt, Mycobacterium bovis subsp bovis AF2122/97
gugggcggagccgaugaccugcc

SEQ ID NO: 1206150 - RNA, 23 nt, Mycobacterium bovis subsp bovis AF2122/97
gugggcgacggcggcgucgauga

SEQ ID NO: 1206151 - RNA, 19 nt, Mycobacterium bovis subsp bovis AF2122/97
gugggccucgaucagcgcc

SEQ ID NO: 1206152 - RNA, 16 nt, Mycobacterium bovis subsp bovis AF2122/97
gugggccguggguguc

SEQ ID NO: 1206153 - RNA, 19 nt, Mycobacterium bovis subsp bovis AF2122/97
gugggcgugacguagugca

SEQ ID NO: 1206154 - RNA, 13 nt, Mycobacterium bovis subsp bovis AF2122/97
gugggcgugcagg

SEQ ID NO: 1206155 - RNA, 16 nt, Mycobacterium bovis subsp bovis AF2122/97
gugguaaccagggcag

SEQ ID NO: 1206156 - RNA, 15 nt, Mycobacterium bovis subsp bovis AF2122/97
gugggcuuggcugug

SEQ ID NO: 1206157 - RNA, 18 nt, Mycobacterium bovis subsp bovis AF2122/97
gugguaaccauauggccc

SEQ ID NO: 1206158 - RNA, 21 nt, Mycobacterium bovis subsp bovis AF2122/97
gugguaaccauauggcccgcg

SEQ ID NO: 1206159 - RNA, 18 nt, Mycobacterium bovis subsp bovis AF2122/97
guggucugccagcacccu

SEQ ID NO: 1206160 - RNA, 21 nt, Mycobacterium bovis subsp bovis AF2122/97
guggucgucccgauggcggug

SEQ ID NO: 1206161 - RNA, 17 nt, Mycobacterium bovis subsp bovis AF2122/97
guggucgaucagguacu

SEQ ID NO: 1206162 - RNA, 17 nt, Mycobacterium bovis subsp bovis AF2122/97
guggucggcugugguga

SEQ ID NO: 1206163 - RNA, 21 nt, Mycobacterium bovis subsp bovis AF2122/97
guggucgguggcuacgcccca

SEQ ID NO: 1206164 - RNA, 19 nt, Mycobacterium bovis subsp bovis AF2122/97
guggugaaguagucggcgc

SEQ ID NO: 1206165 - RNA, 20 nt, Mycobacterium bovis subsp bovis AF2122/97
guggugaccgacgcggacag

SEQ ID NO: 1206166 - RNA, 16 nt, Mycobacterium bovis subsp bovis AF2122/97
guggucuuggcccggc

SEQ ID NO: 1206167 - RNA, 18 nt, Mycobacterium bovis subsp bovis AF2122/97
guggucuuggcccggcgg

SEQ ID NO: 1206168 - RNA, 14 nt, Mycobacterium bovis subsp bovis AF2122/97
guggugcgcuggcc

SEQ ID NO: 1206169 - RNA, 15 nt, Mycobacterium bovis subsp bovis AF2122/97
guggugccaaccugg

SEQ ID NO: 1206170 - RNA, 15 nt, Mycobacterium bovis subsp bovis AF2122/97
guggucgacccggcc

SEQ ID NO: 1206171 - RNA, 14 nt, Mycobacterium bovis subsp bovis AF2122/97
guggucaucgccac

SEQ ID NO: 1206172 - RNA, 14 nt, Mycobacterium bovis subsp bovis AF2122/97
gugguccaaccggg

SEQ ID NO: 1206173 - RNA, 14 nt, Mycobacterium bovis subsp bovis AF2122/97
guggucagcaccca

SEQ ID NO: 1206174 - RNA, 20 nt, Mycobacterium bovis subsp bovis AF2122/97
gugguacgugcgagcccacc

SEQ ID NO: 1206175 - RNA, 16 nt, Mycobacterium bovis subsp bovis AF2122/97
gugguagaggaacaga

SEQ ID NO: 1206176 - RNA, 16 nt, Mycobacterium bovis subsp bovis AF2122/97
gugguaggccggugcg

SEQ ID NO: 1206177 - RNA, 18 nt, Mycobacterium bovis subsp bovis AF2122/97
gugguaggacgccagcaa

SEQ ID NO: 1206178 - RNA, 13 nt, Mycobacterium bovis subsp bovis AF2122/97
gugguaggccggg

SEQ ID NO: 1206179 - RNA, 18 nt, Mycobacterium bovis subsp bovis AF2122/97
gugguuugcgcccugagc

SEQ ID NO: 1206180 - RNA, 23 nt, Mycobacterium bovis subsp bovis AF2122/97
guggugggcgugacugguggcgc

SEQ ID NO: 1206181 - RNA, 15 nt, Mycobacterium bovis subsp bovis AF2122/97
guggugggcuuggcu

SEQ ID NO: 1206182 - RNA, 16 nt, Mycobacterium bovis subsp bovis AF2122/97
gugguggacgccaugg

SEQ ID NO: 1206183 - RNA, 15 nt, Mycobacterium bovis subsp bovis AF2122/97
gugguggagcggcgc

SEQ ID NO: 1206184 - RNA, 19 nt, Mycobacterium bovis subsp bovis AF2122/97
gugguuuggaccgcugaug

SEQ ID NO: 1206185 - RNA, 12 nt, Mycobacterium bovis subsp bovis AF2122/97
gugguuuugggc

SEQ ID NO: 1206186 - RNA, 20 nt, Mycobacterium bovis subsp bovis AF2122/97
guguacaccgcgcccgccga

SEQ ID NO: 1206187 - RNA, 23 nt, Mycobacterium bovis subsp bovis AF2122/97
guguagggcggcguugagcuggc

SEQ ID NO: 1206188 - RNA, 13 nt, Mycobacterium bovis subsp bovis AF2122/97
guguccgagcggc

SEQ ID NO: 1206189 - RNA, 23 nt, Mycobacterium bovis subsp bovis AF2122/97
guguccgagcggcccuucaccag

SEQ ID NO: 1206190 - RNA, 13 nt, Mycobacterium bovis subsp bovis AF2122/97
guguauuggggug

SEQ ID NO: 1206191 - RNA, 14 nt, Mycobacterium bovis subsp bovis AF2122/97
guguauuggggugg

SEQ ID NO: 1206192 - RNA, 22 nt, Mycobacterium bovis subsp bovis AF2122/97
guguaugcauccacugcggcgc

SEQ ID NO: 1206193 - RNA, 14 nt, Mycobacterium bovis subsp bovis AF2122/97
gugucaacggcacc

SEQ ID NO: 1206194 - RNA, 21 nt, Mycobacterium bovis subsp bovis AF2122/97
gugucccggaccaucgccugc

SEQ ID NO: 1206195 - RNA, 16 nt, Mycobacterium bovis subsp bovis AF2122/97
guguccucgguguccu

SEQ ID NO: 1206196 - RNA, 19 nt, Mycobacterium bovis subsp bovis AF2122/97
gugucgaugcgcagcccgu

SEQ ID NO: 1206197 - RNA, 14 nt, Mycobacterium bovis subsp bovis AF2122/97
gugucgaugcgcgc

SEQ ID NO: 1206198 - RNA, 16 nt, Mycobacterium bovis subsp bovis AF2122/97
guguuguaggccgggc

SEQ ID NO: 1206199 - RNA, 23 nt, Mycobacterium bovis subsp bovis AF2122/97
guguugguggauucgaucaggcc

SEQ ID NO: 1206200 - RNA, 16 nt, Mycobacterium bovis subsp bovis AF2122/97
guguuguugaagcccg

SEQ ID NO: 1206201 - RNA, 15 nt, Mycobacterium bovis subsp bovis AF2122/97
gugucggccagcaac

SEQ ID NO: 1206202 - RNA, 14 nt, Mycobacterium bovis subsp bovis AF2122/97
guuagcaccaguuc

SEQ ID NO: 1206203 - RNA, 22 nt, Mycobacterium bovis subsp bovis AF2122/97
guuagcguagcccgaguuguug

SEQ ID NO: 1206204 - RNA, 23 nt, Mycobacterium bovis subsp bovis AF2122/97
guuagcgcggccagcagcagaug

SEQ ID NO: 1206205 - RNA, 14 nt, Mycobacterium bovis subsp bovis AF2122/97
guuagcggcgggca

SEQ ID NO: 1206206 - RNA, 22 nt, Mycobacterium bovis subsp bovis AF2122/97
guuagcauugaguucggccacc

SEQ ID NO: 1206207 - RNA, 21 nt, Mycobacterium bovis subsp bovis AF2122/97
guuaucccagacugucgagcg

SEQ ID NO: 1206208 - RNA, 14 nt, Mycobacterium bovis subsp bovis AF2122/97
guuaucgaagcccg

SEQ ID NO: 1206209 - RNA, 20 nt, Mycobacterium bovis subsp bovis AF2122/97
guuaucgacaccaccauucc

SEQ ID NO: 1206210 - RNA, 13 nt, Mycobacterium bovis subsp bovis AF2122/97
guucgacccccgc

SEQ ID NO: 1206211 - RNA, 20 nt, Mycobacterium bovis subsp bovis AF2122/97
guucgaguccugguacccca

SEQ ID NO: 1206212 - RNA, 13 nt, Mycobacterium bovis subsp bovis AF2122/97
guucgaugacuga

SEQ ID NO: 1206213 - RNA, 23 nt, Mycobacterium bovis subsp bovis AF2122/97
guucgauggcaucggccaucucg

SEQ ID NO: 1206214 - RNA, 17 nt, Mycobacterium bovis subsp bovis AF2122/97
guucgucgguugccacg

SEQ ID NO: 1206215 - RNA, 17 nt, Mycobacterium bovis subsp bovis AF2122/97
guucgucgucgcugaau

SEQ ID NO: 1206216 - RNA, 17 nt, Mycobacterium bovis subsp bovis AF2122/97
guucggcccgcaaacag

SEQ ID NO: 1206217 - RNA, 14 nt, Mycobacterium bovis subsp bovis AF2122/97
guucguagcgggca

SEQ ID NO: 1206218 - RNA, 20 nt, Mycobacterium bovis subsp bovis AF2122/97
guucggccgucauggcccga

SEQ ID NO: 1206219 - RNA, 15 nt, Mycobacterium bovis subsp bovis AF2122/97
guucggugagguccu

SEQ ID NO: 1206220 - RNA, 13 nt, Mycobacterium bovis subsp bovis AF2122/97
guucgcucccccg

SEQ ID NO: 1206221 - RNA, 14 nt, Mycobacterium bovis subsp bovis AF2122/97
guucgcucccccgc

SEQ ID NO: 1206222 - RNA, 22 nt, Mycobacterium bovis subsp bovis AF2122/97
guucgcucggggacucauggcc

SEQ ID NO: 1206223 - RNA, 17 nt, Mycobacterium bovis subsp bovis AF2122/97
guucggcacaaccaacg

SEQ ID NO: 1206224 - RNA, 15 nt, Mycobacterium bovis subsp bovis AF2122/97
guucggcagcgggcu

SEQ ID NO: 1206225 - RNA, 20 nt, Mycobacterium bovis subsp bovis AF2122/97
guuccccgagaacggcgggc

SEQ ID NO: 1206226 - RNA, 19 nt, Mycobacterium bovis subsp bovis AF2122/97
guucccgaauggcaucagu

SEQ ID NO: 1206227 - RNA, 22 nt, Mycobacterium bovis subsp bovis AF2122/97
guuccagccgacggcagugcug

SEQ ID NO: 1206228 - RNA, 23 nt, Mycobacterium bovis subsp bovis AF2122/97
guucccucggcacggucgcccga

SEQ ID NO: 1206229 - RNA, 13 nt, Mycobacterium bovis subsp bovis AF2122/97
guuccggccggcu

SEQ ID NO: 1206230 - RNA, 22 nt, Mycobacterium bovis subsp bovis AF2122/97
guucccggugaccacuugcagc

SEQ ID NO: 1206231 - RNA, 19 nt, Mycobacterium bovis subsp bovis AF2122/97
guuccguugaugccgccgg

SEQ ID NO: 1206232 - RNA, 23 nt, Mycobacterium bovis subsp bovis AF2122/97
guucauaaagguccaaccaccgg

SEQ ID NO: 1206233 - RNA, 20 nt, Mycobacterium bovis subsp bovis AF2122/97
guucaacgcgcgcacgccac

SEQ ID NO: 1206234 - RNA, 19 nt, Mycobacterium bovis subsp bovis AF2122/97
guucacaaacggaacagcc

SEQ ID NO: 1206235 - RNA, 19 nt, Mycobacterium bovis subsp bovis AF2122/97
guucguggcuggcaugccg

SEQ ID NO: 1206236 - RNA, 15 nt, Mycobacterium bovis subsp bovis AF2122/97
guucgugagcggcca

SEQ ID NO: 1206237 - RNA, 19 nt, Mycobacterium bovis subsp bovis AF2122/97
guucuucucucgggccagu

SEQ ID NO: 1206238 - RNA, 23 nt, Mycobacterium bovis subsp bovis AF2122/97
guugaaauugaugaucugcagcu

SEQ ID NO: 1206239 - RNA, 21 nt, Mycobacterium bovis subsp bovis AF2122/97
guugaacaauccgguguugag

SEQ ID NO: 1206240 - RNA, 17 nt, Mycobacterium bovis subsp bovis AF2122/97
guugaccuccuccuccg

SEQ ID NO: 1206241 - RNA, 15 nt, Mycobacterium bovis subsp bovis AF2122/97
guugaccggccggac

SEQ ID NO: 1206242 - RNA, 20 nt, Mycobacterium bovis subsp bovis AF2122/97
guugaccgggucgccgauga

SEQ ID NO: 1206243 - RNA, 13 nt, Mycobacterium bovis subsp bovis AF2122/97
guugaccagcacg

SEQ ID NO: 1206244 - RNA, 15 nt, Mycobacterium bovis subsp bovis AF2122/97
guugaccaggccgac

SEQ ID NO: 1206245 - RNA, 18 nt, Mycobacterium bovis subsp bovis AF2122/97
guugacggugucuugcca

SEQ ID NO: 1206246 - RNA, 20 nt, Mycobacterium bovis subsp bovis AF2122/97
guugacgguugccccggcga

SEQ ID NO: 1206247 - RNA, 18 nt, Mycobacterium bovis subsp bovis AF2122/97
guugacggucagccgcgg

SEQ ID NO: 1206248 - RNA, 15 nt, Mycobacterium bovis subsp bovis AF2122/97
guugaacauguccag

SEQ ID NO: 1206249 - RNA, 14 nt, Mycobacterium bovis subsp bovis AF2122/97
guugaagaagcccg

SEQ ID NO: 1206250 - RNA, 17 nt, Mycobacterium bovis subsp bovis AF2122/97
guugaagccgcccgagu

SEQ ID NO: 1206251 - RNA, 22 nt, Mycobacterium bovis subsp bovis AF2122/97
guugaaucccagauaugcagga

SEQ ID NO: 1206252 - RNA, 16 nt, Mycobacterium bovis subsp bovis AF2122/97
guugaucucgccggug

SEQ ID NO: 1206253 - RNA, 13 nt, Mycobacterium bovis subsp bovis AF2122/97
guugaugaagguc

SEQ ID NO: 1206254 - RNA, 13 nt, Mycobacterium bovis subsp bovis AF2122/97
guugaugaccagg

SEQ ID NO: 1206255 - RNA, 20 nt, Mycobacterium bovis subsp bovis AF2122/97
guugaugccgccggagucga

SEQ ID NO: 1206256 - RNA, 17 nt, Mycobacterium bovis subsp bovis AF2122/97
guugaugcggaugucgu

SEQ ID NO: 1206257 - RNA, 21 nt, Mycobacterium bovis subsp bovis AF2122/97
guugaucgcguagcuggccag

SEQ ID NO: 1206258 - RNA, 21 nt, Mycobacterium bovis subsp bovis AF2122/97
guugaucaagaaggccagcgc

SEQ ID NO: 1206259 - RNA, 15 nt, Mycobacterium bovis subsp bovis AF2122/97
guugaucagccagac

SEQ ID NO: 1206260 - RNA, 16 nt, Mycobacterium bovis subsp bovis AF2122/97
guugaucagugccagg

SEQ ID NO: 1206261 - RNA, 17 nt, Mycobacterium bovis subsp bovis AF2122/97
guugauuucggcggcga

SEQ ID NO: 1206262 - RNA, 14 nt, Mycobacterium bovis subsp bovis AF2122/97
guuguuggccagac

SEQ ID NO: 1206263 - RNA, 18 nt, Mycobacterium bovis subsp bovis AF2122/97
guugugucggccuggcag

SEQ ID NO: 1206264 - RNA, 20 nt, Mycobacterium bovis subsp bovis AF2122/97
guuguucaacucgggcagcu

SEQ ID NO: 1206265 - RNA, 20 nt, Mycobacterium bovis subsp bovis AF2122/97
guuuacccgcauggacgcga

SEQ ID NO: 1206266 - RNA, 23 nt, Mycobacterium bovis subsp bovis AF2122/97
guuuauaccucgccgcccugucc

SEQ ID NO: 1206267 - RNA, 18 nt, Mycobacterium bovis subsp bovis AF2122/97
guuuaggcgauucugcgu

SEQ ID NO: 1206268 - RNA, 17 nt, Mycobacterium bovis subsp bovis AF2122/97
guugcccgacccgccga

SEQ ID NO: 1206269 - RNA, 17 nt, Mycobacterium bovis subsp bovis AF2122/97
guugcccgagcggcuga

SEQ ID NO: 1206270 - RNA, 17 nt, Mycobacterium bovis subsp bovis AF2122/97
guugcccguucaugcgg

SEQ ID NO: 1206271 - RNA, 17 nt, Mycobacterium bovis subsp bovis AF2122/97
guugccgaaacccgagu

SEQ ID NO: 1206272 - RNA, 23 nt, Mycobacterium bovis subsp bovis AF2122/97
guugccagcgacgcggucaucga

SEQ ID NO: 1206273 - RNA, 20 nt, Mycobacterium bovis subsp bovis AF2122/97
guugccaccguugccgccgu

SEQ ID NO: 1206274 - RNA, 18 nt, Mycobacterium bovis subsp bovis AF2122/97
guugccaagcagcugggc

SEQ ID NO: 1206275 - RNA, 16 nt, Mycobacterium bovis subsp bovis AF2122/97
guugccaucaaggcca

SEQ ID NO: 1206276 - RNA, 17 nt, Mycobacterium bovis subsp bovis AF2122/97
guugccaucaaggccac

SEQ ID NO: 1206277 - RNA, 19 nt, Mycobacterium bovis subsp bovis AF2122/97
guugccaucaaggccaccu

SEQ ID NO: 1206278 - RNA, 20 nt, Mycobacterium bovis subsp bovis AF2122/97
guugccaucaaggccaccuc

SEQ ID NO: 1206279 - RNA, 18 nt, Mycobacterium bovis subsp bovis AF2122/97
guuggcaccgucagacca

SEQ ID NO: 1206280 - RNA, 17 nt, Mycobacterium bovis subsp bovis AF2122/97
guugccgaagcccgagc

SEQ ID NO: 1206281 - RNA, 16 nt, Mycobacterium bovis subsp bovis AF2122/97
guugucguugcuggug

SEQ ID NO: 1206282 - RNA, 23 nt, Mycobacterium bovis subsp bovis AF2122/97
guugugcgcacucuuuccuuccg

SEQ ID NO: 1206283 - RNA, 23 nt, Mycobacterium bovis subsp bovis AF2122/97
guugugccgcaagccucguggug

SEQ ID NO: 1206284 - RNA, 23 nt, Mycobacterium bovis subsp bovis AF2122/97
guuguagcccaaaaacggcagca

SEQ ID NO: 1206285 - RNA, 21 nt, Mycobacterium bovis subsp bovis AF2122/97
guugggcgcgaaacgccgcaa

SEQ ID NO: 1206286 - RNA, 18 nt, Mycobacterium bovis subsp bovis AF2122/97
guugggccgacugggcgc

SEQ ID NO: 1206287 - RNA, 23 nt, Mycobacterium bovis subsp bovis AF2122/97
guugggcgagaccgcgagcagca

SEQ ID NO: 1206288 - RNA, 20 nt, Mycobacterium bovis subsp bovis AF2122/97
guugggaugacacgucuauc

SEQ ID NO: 1206289 - RNA, 18 nt, Mycobacterium bovis subsp bovis AF2122/97
guuggcuugcgcgcaggu

SEQ ID NO: 1206290 - RNA, 17 nt, Mycobacterium bovis subsp bovis AF2122/97
guuggccaggcccgagu

SEQ ID NO: 1206291 - RNA, 19 nt, Mycobacterium bovis subsp bovis AF2122/97
guugguacccaccagggug

SEQ ID NO: 1206292 - RNA, 20 nt, Mycobacterium bovis subsp bovis AF2122/97
guugggugggugcagcacgu

SEQ ID NO: 1206293 - RNA, 18 nt, Mycobacterium bovis subsp bovis AF2122/97
uaaaggccuugggcggca

SEQ ID NO: 1206294 - RNA, 21 nt, Mycobacterium bovis subsp bovis AF2122/97
uaaacaccgcgaacuugcuga

SEQ ID NO: 1206295 - RNA, 20 nt, Mycobacterium bovis subsp bovis AF2122/97
uaaacauacaaaaacaccac

SEQ ID NO: 1206296 - RNA, 22 nt, Mycobacterium bovis subsp bovis AF2122/97
uaaacccggcgagggcaacgag

SEQ ID NO: 1206297 - RNA, 12 nt, Mycobacterium bovis subsp bovis AF2122/97
uaaaccccuggc

SEQ ID NO: 1206298 - RNA, 14 nt, Mycobacterium bovis subsp bovis AF2122/97
uaacccagcaccac

SEQ ID NO: 1206299 - RNA, 16 nt, Mycobacterium bovis subsp bovis AF2122/97
uaacccagcaccacaa

SEQ ID NO: 1206300 - RNA, 20 nt, Mycobacterium bovis subsp bovis AF2122/97
uaaccgcgucgaccggaacc

SEQ ID NO: 1206301 - RNA, 20 nt, Mycobacterium bovis subsp bovis AF2122/97
uaaaugccugcccaccuucg

SEQ ID NO: 1206302 - RNA, 21 nt, Mycobacterium bovis subsp bovis AF2122/97
uaaaugggugugcugccaccg

SEQ ID NO: 1206303 - RNA, 17 nt, Mycobacterium bovis subsp bovis AF2122/97
uaacaacaccaccagca

SEQ ID NO: 1206304 - RNA, 16 nt, Mycobacterium bovis subsp bovis AF2122/97
guuugaacgcaugcga

SEQ ID NO: 1206305 - RNA, 16 nt, Mycobacterium bovis subsp bovis AF2122/97
guuugcagcgggauca

SEQ ID NO: 1206306 - RNA, 16 nt, Mycobacterium bovis subsp bovis AF2122/97
guuugcacgcaccaca

SEQ ID NO: 1206307 - RNA, 20 nt, Mycobacterium bovis subsp bovis AF2122/97
guuugcacgcaccacaaucc

SEQ ID NO: 1206308 - RNA, 17 nt, Mycobacterium bovis subsp bovis AF2122/97
guuugaugcgggcggca

SEQ ID NO: 1206309 - RNA, 19 nt, Mycobacterium bovis subsp bovis AF2122/97
guuugaugcgggcggcaag

SEQ ID NO: 1206310 - RNA, 20 nt, Mycobacterium bovis subsp bovis AF2122/97
guuuggccgacagccaccgc

SEQ ID NO: 1206311 - RNA, 20 nt, Mycobacterium bovis subsp bovis AF2122/97
guuuggugucgaucagcucc

SEQ ID NO: 1206312 - RNA, 15 nt, Mycobacterium bovis subsp bovis AF2122/97
guuuggugcagccgc

SEQ ID NO: 1206313 - RNA, 17 nt, Mycobacterium bovis subsp bovis AF2122/97
guuuguuuuugccuccc

SEQ ID NO: 1206314 - RNA, 14 nt, Mycobacterium bovis subsp bovis AF2122/97
aaaucagccaggcg

SEQ ID NO: 1206315 - RNA, 12 nt, Mycobacterium bovis subsp bovis AF2122/97
aaaucagaugcg

SEQ ID NO: 1206316 - RNA, 19 nt, Mycobacterium bovis subsp bovis AF2122/97
aaaucagaugcgaaggcau

SEQ ID NO: 1206317 - RNA, 20 nt, Mycobacterium bovis subsp bovis AF2122/97
guuuucgcgcuugaaacuga

SEQ ID NO: 1206318 - RNA, 18 nt, Mycobacterium bovis subsp bovis AF2122/97
guuuucggccgccaguac

SEQ ID NO: 1206319 - RNA, 15 nt, Mycobacterium bovis subsp bovis AF2122/97
uaaaaagcccagcga

SEQ ID NO: 1206320 - RNA, 19 nt, Mycobacterium bovis subsp bovis AF2122/97
guagcaggucgugaaacca

SEQ ID NO: 1206321 - RNA, 13 nt, Mycobacterium bovis subsp bovis AF2122/97
guagcagcggcuc

SEQ ID NO: 1206322 - RNA, 17 nt, Mycobacterium bovis subsp bovis AF2122/97
guagcagcggcucggcg

SEQ ID NO: 1206323 - RNA, 22 nt, Mycobacterium bovis subsp bovis AF2122/97
guagccauucgguguggccgug

SEQ ID NO: 1206324 - RNA, 14 nt, Mycobacterium bovis subsp bovis AF2122/97
guagcccagccggg

SEQ ID NO: 1206325 - RNA, 16 nt, Mycobacterium bovis subsp bovis AF2122/97
guagcagacgcagcca

SEQ ID NO: 1206326 - RNA, 18 nt, Mycobacterium bovis subsp bovis AF2122/97
guagcagacgcagccacg

SEQ ID NO: 1206327 - RNA, 14 nt, Mycobacterium bovis subsp bovis AF2122/97
guagcacagcagca

SEQ ID NO: 1206328 - RNA, 15 nt, Mycobacterium bovis subsp bovis AF2122/97
guagcacccacggcg

SEQ ID NO: 1206329 - RNA, 20 nt, Mycobacterium bovis subsp bovis AF2122/97
guagaucucuucggagccga

SEQ ID NO: 1206330 - RNA, 20 nt, Mycobacterium bovis subsp bovis AF2122/97
guagaucuucggccgcacug

SEQ ID NO: 1206331 - RNA, 16 nt, Mycobacterium bovis subsp bovis AF2122/97
guagauuccugguucc

SEQ ID NO: 1206332 - RNA, 20 nt, Mycobacterium bovis subsp bovis AF2122/97
guagaugguggucaccacca

SEQ ID NO: 1206333 - RNA, 13 nt, Mycobacterium bovis subsp bovis AF2122/97
guagaugguggug

SEQ ID NO: 1206334 - RNA, 17 nt, Mycobacterium bovis subsp bovis AF2122/97
guagacuugcugcuccu

SEQ ID NO: 1206335 - RNA, 13 nt, Mycobacterium bovis subsp bovis AF2122/97
guagacggggcga

SEQ ID NO: 1206336 - RNA, 20 nt, Mycobacterium bovis subsp bovis AF2122/97
guagacgugcgucaggugcg

SEQ ID NO: 1206337 - RNA, 16 nt, Mycobacterium bovis subsp bovis AF2122/97
guagacgccaugcacg

SEQ ID NO: 1206338 - RNA, 14 nt, Mycobacterium bovis subsp bovis AF2122/97
guagaccucuucgg

SEQ ID NO: 1206339 - RNA, 23 nt, Mycobacterium bovis subsp bovis AF2122/97
guagaccccaaucgaccgcccgc

SEQ ID NO: 1206340 - RNA, 20 nt, Mycobacterium bovis subsp bovis AF2122/97
guagaccggaaaccacagcg

SEQ ID NO: 1206341 - RNA, 17 nt, Mycobacterium bovis subsp bovis AF2122/97
guagaccacgccgguga

SEQ ID NO: 1206342 - RNA, 13 nt, Mycobacterium bovis subsp bovis AF2122/97
guagaccagcagg

SEQ ID NO: 1206343 - RNA, 21 nt, Mycobacterium bovis subsp bovis AF2122/97
guagaccagugaccgcagucc

SEQ ID NO: 1206344 - RNA, 19 nt, Mycobacterium bovis subsp bovis AF2122/97
guagaucaucuggcuggug

SEQ ID NO: 1206345 - RNA, 13 nt, Mycobacterium bovis subsp bovis AF2122/97
guagaagcgggcg

SEQ ID NO: 1206346 - RNA, 17 nt, Mycobacterium bovis subsp bovis AF2122/97
guacuucgcggcgguga

SEQ ID NO: 1206347 - RNA, 22 nt, Mycobacterium bovis subsp bovis AF2122/97
guacuggcguugccaccggagc

SEQ ID NO: 1206348 - RNA, 19 nt, Mycobacterium bovis subsp bovis AF2122/97
guacugucgucgcccugac

SEQ ID NO: 1206349 - RNA, 17 nt, Mycobacterium bovis subsp bovis AF2122/97
guacucggcauccaggc

SEQ ID NO: 1206350 - RNA, 17 nt, Mycobacterium bovis subsp bovis AF2122/97
guacucgcggcgcggcc

SEQ ID NO: 1206351 - RNA, 18 nt, Mycobacterium bovis subsp bovis AF2122/97
guacuccagccgcaacac

SEQ ID NO: 1206352 - RNA, 17 nt, Mycobacterium bovis subsp bovis AF2122/97
guacggugguaagacgc

SEQ ID NO: 1206353 - RNA, 16 nt, Mycobacterium bovis subsp bovis AF2122/97
guaguccucgguggcc

SEQ ID NO: 1206354 - RNA, 22 nt, Mycobacterium bovis subsp bovis AF2122/97
guagucccacugccacuccuga

SEQ ID NO: 1206355 - RNA, 14 nt, Mycobacterium bovis subsp bovis AF2122/97
guaguaguucagcc

SEQ ID NO: 1206356 - RNA, 14 nt, Mycobacterium bovis subsp bovis AF2122/97
guaguaggccuggc

SEQ ID NO: 1206357 - RNA, 20 nt, Mycobacterium bovis subsp bovis AF2122/97
guagucgccggucaggcuca

SEQ ID NO: 1206358 - RNA, 19 nt, Mycobacterium bovis subsp bovis AF2122/97
guagucgcgaccgcgggcc

SEQ ID NO: 1206359 - RNA, 22 nt, Mycobacterium bovis subsp bovis AF2122/97
guagucggccagcucgcgggcc

SEQ ID NO: 1206360 - RNA, 23 nt, Mycobacterium bovis subsp bovis AF2122/97
guagucguugucuugggucagga

SEQ ID NO: 1206361 - RNA, 18 nt, Mycobacterium bovis subsp bovis AF2122/97
guagucacggucguggug

SEQ ID NO: 1206362 - RNA, 18 nt, Mycobacterium bovis subsp bovis AF2122/97
guagugcagcugcaauga

SEQ ID NO: 1206363 - RNA, 16 nt, Mycobacterium bovis subsp bovis AF2122/97
guaguggugggcgugg

SEQ ID NO: 1206364 - RNA, 13 nt, Mycobacterium bovis subsp bovis AF2122/97
guagggugggucg

SEQ ID NO: 1206365 - RNA, 23 nt, Mycobacterium bovis subsp bovis AF2122/97
guagguccuugucggccccggcc

SEQ ID NO: 1206366 - RNA, 13 nt, Mycobacterium bovis subsp bovis AF2122/97
guaggugggcucg

SEQ ID NO: 1206367 - RNA, 14 nt, Mycobacterium bovis subsp bovis AF2122/97
guaggugacgacgu

SEQ ID NO: 1206368 - RNA, 15 nt, Mycobacterium bovis subsp bovis AF2122/97
guagguugcgccccg

SEQ ID NO: 1206369 - RNA, 16 nt, Mycobacterium bovis subsp bovis AF2122/97
guaggcgaccgccauu

SEQ ID NO: 1206370 - RNA, 17 nt, Mycobacterium bovis subsp bovis AF2122/97
guaggcgaugagcgugc

SEQ ID NO: 1206371 - RNA, 20 nt, Mycobacterium bovis subsp bovis AF2122/97
guaggccaccacugcgcccg

SEQ ID NO: 1206372 - RNA, 16 nt, Mycobacterium bovis subsp bovis AF2122/97
guaggccggggcgucg

SEQ ID NO: 1206373 - RNA, 19 nt, Mycobacterium bovis subsp bovis AF2122/97
guaggccuccgcugccgcc

SEQ ID NO: 1206374 - RNA, 17 nt, Mycobacterium bovis subsp bovis AF2122/97
guagcgccgcacuucuu

SEQ ID NO: 1206375 - RNA, 13 nt, Mycobacterium bovis subsp bovis AF2122/97
guagcgcaccaca

SEQ ID NO: 1206376 - RNA, 20 nt, Mycobacterium bovis subsp bovis AF2122/97
guagcgcaaccgcgcuugga

SEQ ID NO: 1206377 - RNA, 22 nt, Mycobacterium bovis subsp bovis AF2122/97
guagccgagguucaaagcagcg

SEQ ID NO: 1206378 - RNA, 14 nt, Mycobacterium bovis subsp bovis AF2122/97
guagccggccgcuu

SEQ ID NO: 1206379 - RNA, 14 nt, Mycobacterium bovis subsp bovis AF2122/97
guagccgcugcacg

SEQ ID NO: 1206380 - RNA, 15 nt, Mycobacterium bovis subsp bovis AF2122/97
guagccgcccucccu

SEQ ID NO: 1206381 - RNA, 21 nt, Mycobacterium bovis subsp bovis AF2122/97
guagccgugggccacgaugau

SEQ ID NO: 1206382 - RNA, 18 nt, Mycobacterium bovis subsp bovis AF2122/97
guagcgagcccacguggg

SEQ ID NO: 1206383 - RNA, 13 nt, Mycobacterium bovis subsp bovis AF2122/97
guagcgacgccau

SEQ ID NO: 1206384 - RNA, 20 nt, Mycobacterium bovis subsp bovis AF2122/97
guaggcaggaucgccugagc

SEQ ID NO: 1206385 - RNA, 19 nt, Mycobacterium bovis subsp bovis AF2122/97
guagcugacggccugcaac

SEQ ID NO: 1206386 - RNA, 16 nt, Mycobacterium bovis subsp bovis AF2122/97
guagcugcgcagcgca

SEQ ID NO: 1206387 - RNA, 19 nt, Mycobacterium bovis subsp bovis AF2122/97
guagcuggucccacaccuc

SEQ ID NO: 1206388 - RNA, 22 nt, Mycobacterium bovis subsp bovis AF2122/97
guagcuggugcguagcccaccc

SEQ ID NO: 1206389 - RNA, 22 nt, Mycobacterium bovis subsp bovis AF2122/97
guaggacaccaccguggccucg

SEQ ID NO: 1206390 - RNA, 19 nt, Mycobacterium bovis subsp bovis AF2122/97
guagcucgguaggccggca

SEQ ID NO: 1206391 - RNA, 20 nt, Mycobacterium bovis subsp bovis AF2122/97
guagcucuuugagugccgcg

SEQ ID NO: 1206392 - RNA, 16 nt, Mycobacterium bovis subsp bovis AF2122/97
guagcguccaggucau

SEQ ID NO: 1206393 - RNA, 19 nt, Mycobacterium bovis subsp bovis AF2122/97
guagcgucgcacccagggc

SEQ ID NO: 1206394 - RNA, 14 nt, Mycobacterium bovis subsp bovis AF2122/97
guauagaccaggua

SEQ ID NO: 1206395 - RNA, 21 nt, Mycobacterium bovis subsp bovis AF2122/97
guauagccgacgccggugccg

SEQ ID NO: 1206396 - RNA, 20 nt, Mycobacterium bovis subsp bovis AF2122/97
guauccggcagaccggugcu

SEQ ID NO: 1206397 - RNA, 19 nt, Mycobacterium bovis subsp bovis AF2122/97
guauccgacuggccccgcc

SEQ ID NO: 1206398 - RNA, 20 nt, Mycobacterium bovis subsp bovis AF2122/97
guauccaugucgcgccaggc

SEQ ID NO: 1206399 - RNA, 14 nt, Mycobacterium bovis subsp bovis AF2122/97
guaucgagaugcca

SEQ ID NO: 1206400 - RNA, 23 nt, Mycobacterium bovis subsp bovis AF2122/97
guaucgaagcucaauuccaugca

SEQ ID NO: 1206401 - RNA, 16 nt, Mycobacterium bovis subsp bovis AF2122/97
guauggccgccaccgc

SEQ ID NO: 1206402 - RNA, 17 nt, Mycobacterium bovis subsp bovis AF2122/97
guaugcccggacgggga

SEQ ID NO: 1206403 - RNA, 21 nt, Mycobacterium bovis subsp bovis AF2122/97
guauuccgggguaucgacccu

SEQ ID NO: 1206404 - RNA, 21 nt, Mycobacterium bovis subsp bovis AF2122/97
guauucccgcuuggcgugacc

SEQ ID NO: 1206405 - RNA, 16 nt, Mycobacterium bovis subsp bovis AF2122/97
guauugauacugcccg

SEQ ID NO: 1206406 - RNA, 18 nt, Mycobacterium bovis subsp bovis AF2122/97
gucaacaccaugguggug

SEQ ID NO: 1206407 - RNA, 16 nt, Mycobacterium bovis subsp bovis AF2122/97
gucaacacccgcccgg

SEQ ID NO: 1206408 - RNA, 18 nt, Mycobacterium bovis subsp bovis AF2122/97
gucaacagauaaggauca

SEQ ID NO: 1206409 - RNA, 18 nt, Mycobacterium bovis subsp bovis AF2122/97
gucaacagcggcaagaag

SEQ ID NO: 1206410 - RNA, 19 nt, Mycobacterium bovis subsp bovis AF2122/97
gucaacaggccguggcgga

SEQ ID NO: 1206411 - RNA, 16 nt, Mycobacterium bovis subsp bovis AF2122/97
gucaccaaacccgaug

SEQ ID NO: 1206412 - RNA, 19 nt, Mycobacterium bovis subsp bovis AF2122/97
gucaccacgaucgcagugg

SEQ ID NO: 1206413 - RNA, 13 nt, Mycobacterium bovis subsp bovis AF2122/97
gucaccggccgcc

SEQ ID NO: 1206414 - RNA, 19 nt, Mycobacterium bovis subsp bovis AF2122/97
gucaccgucugcaccggca

SEQ ID NO: 1206415 - RNA, 22 nt, Mycobacterium bovis subsp bovis AF2122/97
gucaccgucugcaccggcaggc

SEQ ID NO: 1206416 - RNA, 17 nt, Mycobacterium bovis subsp bovis AF2122/97
gucaccguuggccgcgc

SEQ ID NO: 1206417 - RNA, 19 nt, Mycobacterium bovis subsp bovis AF2122/97
gucaccggcuucggccagc

SEQ ID NO: 1206418 - RNA, 20 nt, Mycobacterium bovis subsp bovis AF2122/97
gucaccggcuucuccuccag

SEQ ID NO: 1206419 - RNA, 19 nt, Mycobacterium bovis subsp bovis AF2122/97
gucaccggcgucgcugccu

SEQ ID NO: 1206420 - RNA, 16 nt, Mycobacterium bovis subsp bovis AF2122/97
gucaccggucaccgcg

SEQ ID NO: 1206421 - RNA, 21 nt, Mycobacterium bovis subsp bovis AF2122/97
gucaccggucaccgcgcagcg

SEQ ID NO: 1206422 - RNA, 15 nt, Mycobacterium bovis subsp bovis AF2122/97
gucaccugcugcaac

SEQ ID NO: 1206423 - RNA, 16 nt, Mycobacterium bovis subsp bovis AF2122/97
gucaccugcugcaacc

SEQ ID NO: 1206424 - RNA, 20 nt, Mycobacterium bovis subsp bovis AF2122/97
gucaccuucuuggcggguga

SEQ ID NO: 1206425 - RNA, 15 nt, Mycobacterium bovis subsp bovis AF2122/97
gucaccuuggccggg

SEQ ID NO: 1206426 - RNA, 19 nt, Mycobacterium bovis subsp bovis AF2122/97
gucacgaucacgauguccu

SEQ ID NO: 1206427 - RNA, 16 nt, Mycobacterium bovis subsp bovis AF2122/97
gucacgaucgugccgg

SEQ ID NO: 1206428 - RNA, 16 nt, Mycobacterium bovis subsp bovis AF2122/97
gucacugugacgccgg

SEQ ID NO: 1206429 - RNA, 16 nt, Mycobacterium bovis subsp bovis AF2122/97
gucaaggugcgccgcc

SEQ ID NO: 1206430 - RNA, 15 nt, Mycobacterium bovis subsp bovis AF2122/97
gucaacgcgcggcuc

SEQ ID NO: 1206431 - RNA, 13 nt, Mycobacterium bovis subsp bovis AF2122/97
gucaacgacagcc

SEQ ID NO: 1206432 - RNA, 12 nt, Mycobacterium bovis subsp bovis AF2122/97
gucaaccgcgcc

SEQ ID NO: 1206433 - RNA, 18 nt, Mycobacterium bovis subsp bovis AF2122/97
gucaacggccgacuuggu

SEQ ID NO: 1206434 - RNA, 18 nt, Mycobacterium bovis subsp bovis AF2122/97
gucaaguucgccagcaac

SEQ ID NO: 1206435 - RNA, 17 nt, Mycobacterium bovis subsp bovis AF2122/97
gucaaguggcaaccgca

SEQ ID NO: 1206436 - RNA, 15 nt, Mycobacterium bovis subsp bovis AF2122/97
gucacagcucaccau

SEQ ID NO: 1206437 - RNA, 15 nt, Mycobacterium bovis subsp bovis AF2122/97
gucacauagcucaac

SEQ ID NO: 1206438 - RNA, 13 nt, Mycobacterium bovis subsp bovis AF2122/97
gucacaaacccag

SEQ ID NO: 1206439 - RNA, 19 nt, Mycobacterium bovis subsp bovis AF2122/97
gucagcacccaacccggcg

SEQ ID NO: 1206440 - RNA, 17 nt, Mycobacterium bovis subsp bovis AF2122/97
gucagcacaaacccagu

SEQ ID NO: 1206441 - RNA, 12 nt, Mycobacterium bovis subsp bovis AF2122/97
gucagcggcggc

SEQ ID NO: 1206442 - RNA, 22 nt, Mycobacterium bovis subsp bovis AF2122/97
gucagcuccauccccuuggugg

SEQ ID NO: 1206443 - RNA, 15 nt, Mycobacterium bovis subsp bovis AF2122/97
gucagcucgaccuga

SEQ ID NO: 1206444 - RNA, 19 nt, Mycobacterium bovis subsp bovis AF2122/97
gucagcucggcagcaucuc

SEQ ID NO: 1206445 - RNA, 16 nt, Mycobacterium bovis subsp bovis AF2122/97
gucagcgggcagcagg

SEQ ID NO: 1206446 - RNA, 16 nt, Mycobacterium bovis subsp bovis AF2122/97
gucagaccgcgaacag

SEQ ID NO: 1206447 - RNA, 14 nt, Mycobacterium bovis subsp bovis AF2122/97
gucagauagugcau

SEQ ID NO: 1206448 - RNA, 18 nt, Mycobacterium bovis subsp bovis AF2122/97
gucaguaauucggccauc

SEQ ID NO: 1206449 - RNA, 15 nt, Mycobacterium bovis subsp bovis AF2122/97
gucagugaucaccaa

SEQ ID NO: 1206450 - RNA, 21 nt, Mycobacterium bovis subsp bovis AF2122/97
gucaguccucaucgagcgcgc

SEQ ID NO: 1206451 - RNA, 17 nt, Mycobacterium bovis subsp bovis AF2122/97
gucaugccagucgccga

SEQ ID NO: 1206452 - RNA, 14 nt, Mycobacterium bovis subsp bovis AF2122/97
gucaugcccaccgc

SEQ ID NO: 1206453 - RNA, 14 nt, Mycobacterium bovis subsp bovis AF2122/97
gucaugcccaggug

SEQ ID NO: 1206454 - RNA, 22 nt, Mycobacterium bovis subsp bovis AF2122/97
gucauacccagcucgucgcuga

SEQ ID NO: 1206455 - RNA, 16 nt, Mycobacterium bovis subsp bovis AF2122/97
guccacgccgugcuug

SEQ ID NO: 1206456 - RNA, 15 nt, Mycobacterium bovis subsp bovis AF2122/97
guccacgggaucugc

SEQ ID NO: 1206457 - RNA, 16 nt, Mycobacterium bovis subsp bovis AF2122/97
guccacugaucaggcc

SEQ ID NO: 1206458 - RNA, 14 nt, Mycobacterium bovis subsp bovis AF2122/97
guccagcaccugcc

SEQ ID NO: 1206459 - RNA, 19 nt, Mycobacterium bovis subsp bovis AF2122/97
guccagcaacagcgagcgg

SEQ ID NO: 1206460 - RNA, 20 nt, Mycobacterium bovis subsp bovis AF2122/97
guccagauaggccaaccggu

SEQ ID NO: 1206461 - RNA, 18 nt, Mycobacterium bovis subsp bovis AF2122/97
guccagaccguagcggcc

SEQ ID NO: 1206462 - RNA, 17 nt, Mycobacterium bovis subsp bovis AF2122/97
guccgacaccggcggca

SEQ ID NO: 1206463 - RNA, 23 nt, Mycobacterium bovis subsp bovis AF2122/97
gucccuuguggucugccagcacc

SEQ ID NO: 1206464 - RNA, 15 nt, Mycobacterium bovis subsp bovis AF2122/97
guccgaaccaccugu

SEQ ID NO: 1206465 - RNA, 19 nt, Mycobacterium bovis subsp bovis AF2122/97
gucccugugucgccgucgc

SEQ ID NO: 1206466 - RNA, 18 nt, Mycobacterium bovis subsp bovis AF2122/97
gucccgugcgcgcgcagc

SEQ ID NO: 1206467 - RNA, 21 nt, Mycobacterium bovis subsp bovis AF2122/97
gucccucgccaaccagucgca

SEQ ID NO: 1206468 - RNA, 20 nt, Mycobacterium bovis subsp bovis AF2122/97
guccccgacgucaggcagcu

SEQ ID NO: 1206469 - RNA, 14 nt, Mycobacterium bovis subsp bovis AF2122/97
guccccgcagcgcc

SEQ ID NO: 1206470 - RNA, 21 nt, Mycobacterium bovis subsp bovis AF2122/97
guccccgcagcucgaccagga

SEQ ID NO: 1206471 - RNA, 13 nt, Mycobacterium bovis subsp bovis AF2122/97
gucccccgcccac

SEQ ID NO: 1206472 - RNA, 23 nt, Mycobacterium bovis subsp bovis AF2122/97
guccccaggugggcagcaggccc

SEQ ID NO: 1206473 - RNA, 14 nt, Mycobacterium bovis subsp bovis AF2122/97
guccccaggugggc

SEQ ID NO: 1206474 - RNA, 21 nt, Mycobacterium bovis subsp bovis AF2122/97
guccccaggugggcagcaggc

SEQ ID NO: 1206475 - RNA, 21 nt, Mycobacterium bovis subsp bovis AF2122/97
guccccggcugccagcgccgc

SEQ ID NO: 1206476 - RNA, 20 nt, Mycobacterium bovis subsp bovis AF2122/97
guccccgccgucgccaccau

SEQ ID NO: 1206477 - RNA, 19 nt, Mycobacterium bovis subsp bovis AF2122/97
gucccggcggucagcggcu

SEQ ID NO: 1206478 - RNA, 20 nt, Mycobacterium bovis subsp bovis AF2122/97
gucccggcgguuggugcagc

SEQ ID NO: 1206479 - RNA, 12 nt, Mycobacterium bovis subsp bovis AF2122/97
gucccggcuggg

SEQ ID NO: 1206480 - RNA, 19 nt, Mycobacterium bovis subsp bovis AF2122/97
gucccguucgcccgcccgu

SEQ ID NO: 1206481 - RNA, 15 nt, Mycobacterium bovis subsp bovis AF2122/97
gucccguugccgccc

SEQ ID NO: 1206482 - RNA, 20 nt, Mycobacterium bovis subsp bovis AF2122/97
gucccgucacucaccccaac

SEQ ID NO: 1206483 - RNA, 24 nt, Mycobacterium bovis subsp bovis AF2122/97
guccagccaacgggaacaacggcg

SEQ ID NO: 1206484 - RNA, 13 nt, Mycobacterium bovis subsp bovis AF2122/97
guccagggccugu

SEQ ID NO: 1206485 - RNA, 16 nt, Mycobacterium bovis subsp bovis AF2122/97
guccaggucggccgcc

SEQ ID NO: 1206486 - RNA, 14 nt, Mycobacterium bovis subsp bovis AF2122/97
guccagggcgacga

SEQ ID NO: 1206487 - RNA, 18 nt, Mycobacterium bovis subsp bovis AF2122/97
guccaguggcagccagcg

SEQ ID NO: 1206488 - RNA, 21 nt, Mycobacterium bovis subsp bovis AF2122/97
guccauguggggucagugcgg

SEQ ID NO: 1206489 - RNA, 21 nt, Mycobacterium bovis subsp bovis AF2122/97
guccauguuuugcugcaugcc

SEQ ID NO: 1206490 - RNA, 14 nt, Mycobacterium bovis subsp bovis AF2122/97
gucccacggccggc

SEQ ID NO: 1206491 - RNA, 15 nt, Mycobacterium bovis subsp bovis AF2122/97
gucccacgccagcgc

SEQ ID NO: 1206492 - RNA, 19 nt, Mycobacterium bovis subsp bovis AF2122/97
gucgaagaaccggccgacg

SEQ ID NO: 1206493 - RNA, 13 nt, Mycobacterium bovis subsp bovis AF2122/97
gucgaagagcagg

SEQ ID NO: 1206494 - RNA, 17 nt, Mycobacterium bovis subsp bovis AF2122/97
gucgacuucagcggccg

SEQ ID NO: 1206495 - RNA, 21 nt, Mycobacterium bovis subsp bovis AF2122/97
gucgaaucuucugagacugcc

SEQ ID NO: 1206496 - RNA, 20 nt, Mycobacterium bovis subsp bovis AF2122/97
gucgaagugguaguccaggg

SEQ ID NO: 1206497 - RNA, 16 nt, Mycobacterium bovis subsp bovis AF2122/97
gucgacaaacagcgcc

SEQ ID NO: 1206498 - RNA, 22 nt, Mycobacterium bovis subsp bovis AF2122/97
gucgagacgcuuuccgccgcac

SEQ ID NO: 1206499 - RNA, 20 nt, Mycobacterium bovis subsp bovis AF2122/97
gucgagcaccucgaaggccc

SEQ ID NO: 1206500 - RNA, 19 nt, Mycobacterium bovis subsp bovis AF2122/97
gucgagcaccuuggggugg

SEQ ID NO: 1206501 - RNA, 17 nt, Mycobacterium bovis subsp bovis AF2122/97
gucgaggcgcaggucaa

SEQ ID NO: 1206502 - RNA, 21 nt, Mycobacterium bovis subsp bovis AF2122/97
gucgagauccucgucgagguc

SEQ ID NO: 1206503 - RNA, 22 nt, Mycobacterium bovis subsp bovis AF2122/97
gucgagauagccgacgucgccg

SEQ ID NO: 1206504 - RNA, 19 nt, Mycobacterium bovis subsp bovis AF2122/97
gucgagauuggguccagcg

SEQ ID NO: 1206505 - RNA, 22 nt, Mycobacterium bovis subsp bovis AF2122/97
gucgagauuggguccagcgagg

SEQ ID NO: 1206506 - RNA, 13 nt, Mycobacterium bovis subsp bovis AF2122/97
gucgacuugcagg

SEQ ID NO: 1206507 - RNA, 16 nt, Mycobacterium bovis subsp bovis AF2122/97
gucgaugcgcgccggc

SEQ ID NO: 1206508 - RNA, 21 nt, Mycobacterium bovis subsp bovis AF2122/97
gucgaugccggcuggcggcgu

SEQ ID NO: 1206509 - RNA, 17 nt, Mycobacterium bovis subsp bovis AF2122/97
gucgaugccggcugccg

SEQ ID NO: 1206510 - RNA, 20 nt, Mycobacterium bovis subsp bovis AF2122/97
gucgauggggacggcggcga

SEQ ID NO: 1206511 - RNA, 21 nt, Mycobacterium bovis subsp bovis AF2122/97
gucgaugcgcugcucacgcag

SEQ ID NO: 1206512 - RNA, 18 nt, Mycobacterium bovis subsp bovis AF2122/97
gucgaugcugacgguggg

SEQ ID NO: 1206513 - RNA, 14 nt, Mycobacterium bovis subsp bovis AF2122/97
gucgaugacgccgu

SEQ ID NO: 1206514 - RNA, 20 nt, Mycobacterium bovis subsp bovis AF2122/97
gucgagugccucgaccugga

SEQ ID NO: 1206515 - RNA, 21 nt, Mycobacterium bovis subsp bovis AF2122/97
gucgaucucggcgcagggacu

SEQ ID NO: 1206516 - RNA, 21 nt, Mycobacterium bovis subsp bovis AF2122/97
gucgaguagccguagccgccg

SEQ ID NO: 1206517 - RNA, 22 nt, Mycobacterium bovis subsp bovis AF2122/97
gucgagguucucccgcgcuugg

SEQ ID NO: 1206518 - RNA, 17 nt, Mycobacterium bovis subsp bovis AF2122/97
gucgaggucagcucccg

SEQ ID NO: 1206519 - RNA, 17 nt, Mycobacterium bovis subsp bovis AF2122/97
gucgaggucagugggcg

SEQ ID NO: 1206520 - RNA, 17 nt, Mycobacterium bovis subsp bovis AF2122/97
gucgaggucggcgauca

SEQ ID NO: 1206521 - RNA, 19 nt, Mycobacterium bovis subsp bovis AF2122/97
gucgauguccccggcggca

SEQ ID NO: 1206522 - RNA, 18 nt, Mycobacterium bovis subsp bovis AF2122/97
gucgauuagcccacccau

SEQ ID NO: 1206523 - RNA, 16 nt, Mycobacterium bovis subsp bovis AF2122/97
gucgauuggcucgccg

SEQ ID NO: 1206524 - RNA, 15 nt, Mycobacterium bovis subsp bovis AF2122/97
gucgcaggccagggu

SEQ ID NO: 1206525 - RNA, 14 nt, Mycobacterium bovis subsp bovis AF2122/97
gucgcagcucgucg

SEQ ID NO: 1206526 - RNA, 15 nt, Mycobacterium bovis subsp bovis AF2122/97
gucgccaacgccagc

SEQ ID NO: 1206527 - RNA, 22 nt, Mycobacterium bovis subsp bovis AF2122/97
gucgccaacgccagcaccagcg

SEQ ID NO: 1206528 - RNA, 15 nt, Mycobacterium bovis subsp bovis AF2122/97
gucgccaagcccagg

SEQ ID NO: 1206529 - RNA, 22 nt, Mycobacterium bovis subsp bovis AF2122/97
gucgccaagaucggguggcggg

SEQ ID NO: 1206530 - RNA, 16 nt, Mycobacterium bovis subsp bovis AF2122/97
gucgccaagugcaggg

SEQ ID NO: 1206531 - RNA, 15 nt, Mycobacterium bovis subsp bovis AF2122/97
gucgcagugcacccg

SEQ ID NO: 1206532 - RNA, 14 nt, Mycobacterium bovis subsp bovis AF2122/97
gucgaacaugaucc

SEQ ID NO: 1206533 - RNA, 22 nt, Mycobacterium bovis subsp bovis AF2122/97
gucgaacagcgaaccggcuggg

SEQ ID NO: 1206534 - RNA, 12 nt, Mycobacterium bovis subsp bovis AF2122/97
gucgaacgcccc

SEQ ID NO: 1206535 - RNA, 17 nt, Mycobacterium bovis subsp bovis AF2122/97
gucgaaccaguccucgg

SEQ ID NO: 1206536 - RNA, 18 nt, Mycobacterium bovis subsp bovis AF2122/97
gucgaaccgccggcugcg

SEQ ID NO: 1206537 - RNA, 18 nt, Mycobacterium bovis subsp bovis AF2122/97
gucgaacggcagcccggg

SEQ ID NO: 1206538 - RNA, 23 nt, Mycobacterium bovis subsp bovis AF2122/97
gucgaaacgguacgccgccgcga

SEQ ID NO: 1206539 - RNA, 20 nt, Mycobacterium bovis subsp bovis AF2122/97
guccuggcguagugcagcug

SEQ ID NO: 1206540 - RNA, 19 nt, Mycobacterium bovis subsp bovis AF2122/97
guccugacgguacagcucc

SEQ ID NO: 1206541 - RNA, 21 nt, Mycobacterium bovis subsp bovis AF2122/97
guccugaaaacaccgcacggu

SEQ ID NO: 1206542 - RNA, 16 nt, Mycobacterium bovis subsp bovis AF2122/97
guccucgggcaggcgg

SEQ ID NO: 1206543 - RNA, 23 nt, Mycobacterium bovis subsp bovis AF2122/97
guccucgucuucgucgguguccu

SEQ ID NO: 1206544 - RNA, 19 nt, Mycobacterium bovis subsp bovis AF2122/97
guccucggcggacccggug

SEQ ID NO: 1206545 - RNA, 14 nt, Mycobacterium bovis subsp bovis AF2122/97
guccgcccagcacc

SEQ ID NO: 1206546 - RNA, 17 nt, Mycobacterium bovis subsp bovis AF2122/97
guccgccacggcgggcg

SEQ ID NO: 1206547 - RNA, 18 nt, Mycobacterium bovis subsp bovis AF2122/97
guccgagggcgucgccgc

SEQ ID NO: 1206548 - RNA, 18 nt, Mycobacterium bovis subsp bovis AF2122/97
guccgcccagccgcagca

SEQ ID NO: 1206549 - RNA, 21 nt, Mycobacterium bovis subsp bovis AF2122/97
guccgcgaacgauuucggccc

SEQ ID NO: 1206550 - RNA, 14 nt, Mycobacterium bovis subsp bovis AF2122/97
guccgccugcaccg

SEQ ID NO: 1206551 - RNA, 23 nt, Mycobacterium bovis subsp bovis AF2122/97
guccgcgaagugcuugggccgcu

SEQ ID NO: 1206552 - RNA, 17 nt, Mycobacterium bovis subsp bovis AF2122/97
guccgcgacuuccugua

SEQ ID NO: 1206553 - RNA, 15 nt, Mycobacterium bovis subsp bovis AF2122/97
guccgcgauggccgc

SEQ ID NO: 1206554 - RNA, 15 nt, Mycobacterium bovis subsp bovis AF2122/97
guccgccgccugcgc

SEQ ID NO: 1206555 - RNA, 23 nt, Mycobacterium bovis subsp bovis AF2122/97
guccgcgcccaccggcuagcugu

SEQ ID NO: 1206556 - RNA, 15 nt, Mycobacterium bovis subsp bovis AF2122/97
guccgcgcccgagcc

SEQ ID NO: 1206557 - RNA, 19 nt, Mycobacterium bovis subsp bovis AF2122/97
guccggugcugguccagcc

SEQ ID NO: 1206558 - RNA, 22 nt, Mycobacterium bovis subsp bovis AF2122/97
guccggugcugguccagccggu

SEQ ID NO: 1206559 - RNA, 21 nt, Mycobacterium bovis subsp bovis AF2122/97
guccgguggacgaucuggcag

SEQ ID NO: 1206560 - RNA, 13 nt, Mycobacterium bovis subsp bovis AF2122/97
guccggugauggu

SEQ ID NO: 1206561 - RNA, 14 nt, Mycobacterium bovis subsp bovis AF2122/97
guccggugcaccag

SEQ ID NO: 1206562 - RNA, 13 nt, Mycobacterium bovis subsp bovis AF2122/97
guccggugcuggu

SEQ ID NO: 1206563 - RNA, 17 nt, Mycobacterium bovis subsp bovis AF2122/97
guccguacuugccaccc

SEQ ID NO: 1206564 - RNA, 22 nt, Mycobacterium bovis subsp bovis AF2122/97
guccucgcuauugggugcagug

SEQ ID NO: 1206565 - RNA, 22 nt, Mycobacterium bovis subsp bovis AF2122/97
guccucgaaacgcuuacccagc

SEQ ID NO: 1206566 - RNA, 16 nt, Mycobacterium bovis subsp bovis AF2122/97
guccucgauccgggcg

SEQ ID NO: 1206567 - RNA, 21 nt, Mycobacterium bovis subsp bovis AF2122/97
guccucgagcggcagaugaau

SEQ ID NO: 1206568 - RNA, 15 nt, Mycobacterium bovis subsp bovis AF2122/97
guccguggacaagca

SEQ ID NO: 1206569 - RNA, 19 nt, Mycobacterium bovis subsp bovis AF2122/97
guccguggacaagcacagc

SEQ ID NO: 1206570 - RNA, 13 nt, Mycobacterium bovis subsp bovis AF2122/97
guccgucggggac

SEQ ID NO: 1206571 - RNA, 14 nt, Mycobacterium bovis subsp bovis AF2122/97
guccgucggggaca

SEQ ID NO: 1206572 - RNA, 16 nt, Mycobacterium bovis subsp bovis AF2122/97
gucgccaggcccccuc

SEQ ID NO: 1206573 - RNA, 18 nt, Mycobacterium bovis subsp bovis AF2122/97
gucgccacccgacaugcg

SEQ ID NO: 1206574 - RNA, 14 nt, Mycobacterium bovis subsp bovis AF2122/97
gucgccaccgccgg

SEQ ID NO: 1206575 - RNA, 14 nt, Mycobacterium bovis subsp bovis AF2122/97
gucgccccaugcgg

SEQ ID NO: 1206576 - RNA, 21 nt, Mycobacterium bovis subsp bovis AF2122/97
gucgcccagucccaggugcug

SEQ ID NO: 1206577 - RNA, 17 nt, Mycobacterium bovis subsp bovis AF2122/97
gucgccccaagcgccug

SEQ ID NO: 1206578 - RNA, 14 nt, Mycobacterium bovis subsp bovis AF2122/97
gucgccagggccgc

SEQ ID NO: 1206579 - RNA, 17 nt, Mycobacterium bovis subsp bovis AF2122/97
gucgcgcagcuccaccg

SEQ ID NO: 1206580 - RNA, 15 nt, Mycobacterium bovis subsp bovis AF2122/97
gucgcgcgaccuggu

SEQ ID NO: 1206581 - RNA, 13 nt, Mycobacterium bovis subsp bovis AF2122/97
gucgcgccugccc

SEQ ID NO: 1206582 - RNA, 16 nt, Mycobacterium bovis subsp bovis AF2122/97
gucgcgcccucagccg

SEQ ID NO: 1206583 - RNA, 16 nt, Mycobacterium bovis subsp bovis AF2122/97
gucgcggguggcuucc

SEQ ID NO: 1206584 - RNA, 15 nt, Mycobacterium bovis subsp bovis AF2122/97
gucgcgcuggcgccg

SEQ ID NO: 1206585 - RNA, 14 nt, Mycobacterium bovis subsp bovis AF2122/97
gucgcgcugaaggu

SEQ ID NO: 1206586 - RNA, 14 nt, Mycobacterium bovis subsp bovis AF2122/97
gucgcgcgcucgcg

SEQ ID NO: 1206587 - RNA, 13 nt, Mycobacterium bovis subsp bovis AF2122/97
gucgcgguggugg

SEQ ID NO: 1206588 - RNA, 15 nt, Mycobacterium bovis subsp bovis AF2122/97
gucgcggucgcccgc

SEQ ID NO: 1206589 - RNA, 15 nt, Mycobacterium bovis subsp bovis AF2122/97
gucgcgguggcggcg

SEQ ID NO: 1206590 - RNA, 15 nt, Mycobacterium bovis subsp bovis AF2122/97
gucggagaccagcuc

SEQ ID NO: 1206591 - RNA, 16 nt, Mycobacterium bovis subsp bovis AF2122/97
gucggagccggccacc

SEQ ID NO: 1206592 - RNA, 23 nt, Mycobacterium bovis subsp bovis AF2122/97
gucggaggugaaccccgccggca

SEQ ID NO: 1206593 - RNA, 20 nt, Mycobacterium bovis subsp bovis AF2122/97
gucggauagccucggcggcg

SEQ ID NO: 1206594 - RNA, 16 nt, Mycobacterium bovis subsp bovis AF2122/97
gucggaaugcuggggc

SEQ ID NO: 1206595 - RNA, 16 nt, Mycobacterium bovis subsp bovis AF2122/97
gucggaaugggcgcca

SEQ ID NO: 1206596 - RNA, 14 nt, Mycobacterium bovis subsp bovis AF2122/97
gucggacagcgagu

SEQ ID NO: 1206597 - RNA, 14 nt, Mycobacterium bovis subsp bovis AF2122/97
gucggaccagcugc

SEQ ID NO: 1206598 - RNA, 16 nt, Mycobacterium bovis subsp bovis AF2122/97
gucggacucguccuuc

SEQ ID NO: 1206599 - RNA, 17 nt, Mycobacterium bovis subsp bovis AF2122/97
gucgcguugagcgcagc

SEQ ID NO: 1206600 - RNA, 16 nt, Mycobacterium bovis subsp bovis AF2122/97
gucgcgucgccaggcc

SEQ ID NO: 1206601 - RNA, 16 nt, Mycobacterium bovis subsp bovis AF2122/97
gucgcgucggcugccg

SEQ ID NO: 1206602 - RNA, 13 nt, Mycobacterium bovis subsp bovis AF2122/97
gucggccggcggu

SEQ ID NO: 1206603 - RNA, 19 nt, Mycobacterium bovis subsp bovis AF2122/97
gucggcgaacgcguccagc

SEQ ID NO: 1206604 - RNA, 15 nt, Mycobacterium bovis subsp bovis AF2122/97
gucggcgaagcgggc

SEQ ID NO: 1206605 - RNA, 19 nt, Mycobacterium bovis subsp bovis AF2122/97
gucggcgaccaccagcgcc

SEQ ID NO: 1206606 - RNA, 15 nt, Mycobacterium bovis subsp bovis AF2122/97
gucggcgaccgcgcu

SEQ ID NO: 1206607 - RNA, 18 nt, Mycobacterium bovis subsp bovis AF2122/97
gucggcccgcucaccuug

SEQ ID NO: 1206608 - RNA, 16 nt, Mycobacterium bovis subsp bovis AF2122/97
gucggaucggcgccgc

SEQ ID NO: 1206609 - RNA, 22 nt, Mycobacterium bovis subsp bovis AF2122/97
gucggcaaccaaccgcgcgagc

SEQ ID NO: 1206610 - RNA, 16 nt, Mycobacterium bovis subsp bovis AF2122/97
gucggcaacgacccgc

SEQ ID NO: 1206611 - RNA, 20 nt, Mycobacterium bovis subsp bovis AF2122/97
gucguagaggugccuuugga

SEQ ID NO: 1206612 - RNA, 13 nt, Mycobacterium bovis subsp bovis AF2122/97
gucguaggccgca

SEQ ID NO: 1206613 - RNA, 14 nt, Mycobacterium bovis subsp bovis AF2122/97
gucguagagauacg

SEQ ID NO: 1206614 - RNA, 16 nt, Mycobacterium bovis subsp bovis AF2122/97
gucguacucggcggcc

SEQ ID NO: 1206615 - RNA, 23 nt, Mycobacterium bovis subsp bovis AF2122/97
gucguagccacgcaugggccagg

SEQ ID NO: 1206616 - RNA, 21 nt, Mycobacterium bovis subsp bovis AF2122/97
gucgucaaacacucugaucug

SEQ ID NO: 1206617 - RNA, 19 nt, Mycobacterium bovis subsp bovis AF2122/97
gucgucaccgugggccugc

SEQ ID NO: 1206618 - RNA, 12 nt, Mycobacterium bovis subsp bovis AF2122/97
gucggucccagg

SEQ ID NO: 1206619 - RNA, 23 nt, Mycobacterium bovis subsp bovis AF2122/97
gucggucggaucggcgccgcaua

SEQ ID NO: 1206620 - RNA, 21 nt, Mycobacterium bovis subsp bovis AF2122/97
gucguacucccaggccgccgc

SEQ ID NO: 1206621 - RNA, 19 nt, Mycobacterium bovis subsp bovis AF2122/97
gucguaccgcucggcggca

SEQ ID NO: 1206622 - RNA, 15 nt, Mycobacterium bovis subsp bovis AF2122/97
gucggucuggcuggu

SEQ ID NO: 1206623 - RNA, 21 nt, Mycobacterium bovis subsp bovis AF2122/97
gucggugaaauucgcggcggu

SEQ ID NO: 1206624 - RNA, 22 nt, Mycobacterium bovis subsp bovis AF2122/97
gucggucagcugugcgacccgc

SEQ ID NO: 1206625 - RNA, 15 nt, Mycobacterium bovis subsp bovis AF2122/97
gucggcggcgaccgc

SEQ ID NO: 1206626 - RNA, 17 nt, Mycobacterium bovis subsp bovis AF2122/97
gucgggugcagcacggc

SEQ ID NO: 1206627 - RNA, 22 nt, Mycobacterium bovis subsp bovis AF2122/97
gucgggguguucgaugggugca

SEQ ID NO: 1206628 - RNA, 19 nt, Mycobacterium bovis subsp bovis AF2122/97
gucgggguuucaggcggca

SEQ ID NO: 1206629 - RNA, 15 nt, Mycobacterium bovis subsp bovis AF2122/97
gucggguggcugcug

SEQ ID NO: 1206630 - RNA, 18 nt, Mycobacterium bovis subsp bovis AF2122/97
gucggguugguuggcucg

SEQ ID NO: 1206631 - RNA, 14 nt, Mycobacterium bovis subsp bovis AF2122/97
gucggcgcggcugu

SEQ ID NO: 1206632 - RNA, 12 nt, Mycobacterium bovis subsp bovis AF2122/97
gucggcgcgccg

SEQ ID NO: 1206633 - RNA, 19 nt, Mycobacterium bovis subsp bovis AF2122/97
gucggcgauggccagcacg

SEQ ID NO: 1206634 - RNA, 16 nt, Mycobacterium bovis subsp bovis AF2122/97
gucggcgauggcggca

SEQ ID NO: 1206635 - RNA, 17 nt, Mycobacterium bovis subsp bovis AF2122/97
gucggcgacguccaguc

SEQ ID NO: 1206636 - RNA, 15 nt, Mycobacterium bovis subsp bovis AF2122/97
gucggcgacuccucu

SEQ ID NO: 1206637 - RNA, 20 nt, Mycobacterium bovis subsp bovis AF2122/97
gucggcgagcaauuccucag

SEQ ID NO: 1206638 - RNA, 14 nt, Mycobacterium bovis subsp bovis AF2122/97
gucgucgcugagca

SEQ ID NO: 1206639 - RNA, 16 nt, Mycobacterium bovis subsp bovis AF2122/97
gucgucgauuagccca

SEQ ID NO: 1206640 - RNA, 20 nt, Mycobacterium bovis subsp bovis AF2122/97
gucgucgacaguuuucaccg

SEQ ID NO: 1206641 - RNA, 20 nt, Mycobacterium bovis subsp bovis AF2122/97
gucgucgaccaggccacugc

SEQ ID NO: 1206642 - RNA, 14 nt, Mycobacterium bovis subsp bovis AF2122/97
gucgucgagcgcgc

SEQ ID NO: 1206643 - RNA, 14 nt, Mycobacterium bovis subsp bovis AF2122/97
gucgucgccgccgg

SEQ ID NO: 1206644 - RNA, 16 nt, Mycobacterium bovis subsp bovis AF2122/97
gucgucgcggccgcuc

SEQ ID NO: 1206645 - RNA, 18 nt, Mycobacterium bovis subsp bovis AF2122/97
gucgucccagggcugccg

SEQ ID NO: 1206646 - RNA, 20 nt, Mycobacterium bovis subsp bovis AF2122/97
gucguccuguccgggcugca

SEQ ID NO: 1206647 - RNA, 19 nt, Mycobacterium bovis subsp bovis AF2122/97
gucgucccgauggcggugg

SEQ ID NO: 1206648 - RNA, 18 nt, Mycobacterium bovis subsp bovis AF2122/97
gucguccgcugacccgcc

SEQ ID NO: 1206649 - RNA, 23 nt, Mycobacterium bovis subsp bovis AF2122/97
gucguccaucgcgucgucuucuu

SEQ ID NO: 1206650 - RNA, 15 nt, Mycobacterium bovis subsp bovis AF2122/97
gucgucccagggcug

SEQ ID NO: 1206651 - RNA, 17 nt, Mycobacterium bovis subsp bovis AF2122/97
gucuaaggaugaccuuc

SEQ ID NO: 1206652 - RNA, 13 nt, Mycobacterium bovis subsp bovis AF2122/97
gucuaaugagguc

SEQ ID NO: 1206653 - RNA, 15 nt, Mycobacterium bovis subsp bovis AF2122/97
gguucgcucggggac

SEQ ID NO: 1206654 - RNA, 14 nt, Mycobacterium bovis subsp bovis AF2122/97
gguucgaguccugg

SEQ ID NO: 1206655 - RNA, 20 nt, Mycobacterium bovis subsp bovis AF2122/97
gguucgccccugcacagcag

SEQ ID NO: 1206656 - RNA, 21 nt, Mycobacterium bovis subsp bovis AF2122/97
gguucggacacacaggcggcg

SEQ ID NO: 1206657 - RNA, 14 nt, Mycobacterium bovis subsp bovis AF2122/97
gguucggccagaac

SEQ ID NO: 1206658 - RNA, 13 nt, Mycobacterium bovis subsp bovis AF2122/97
gguucgcccagcc

SEQ ID NO: 1206659 - RNA, 16 nt, Mycobacterium bovis subsp bovis AF2122/97
gguucgccccugcaca

SEQ ID NO: 1206660 - RNA, 15 nt, Mycobacterium bovis subsp bovis AF2122/97
gguuccacggccagg

SEQ ID NO: 1206661 - RNA, 14 nt, Mycobacterium bovis subsp bovis AF2122/97
gguucccgggcagc

SEQ ID NO: 1206662 - RNA, 18 nt, Mycobacterium bovis subsp bovis AF2122/97
gguucccgggcagccgca

SEQ ID NO: 1206663 - RNA, 19 nt, Mycobacterium bovis subsp bovis AF2122/97
gguucccgggcagccgcac

SEQ ID NO: 1206664 - RNA, 18 nt, Mycobacterium bovis subsp bovis AF2122/97
gguuccgaucucaagggc

SEQ ID NO: 1206665 - RNA, 18 nt, Mycobacterium bovis subsp bovis AF2122/97
gguuccggcgugcagcac

SEQ ID NO: 1206666 - RNA, 15 nt, Mycobacterium bovis subsp bovis AF2122/97
gguuccgccggcccc

SEQ ID NO: 1206667 - RNA, 22 nt, Mycobacterium bovis subsp bovis AF2122/97
gguuccgguguaggccugcccc

SEQ ID NO: 1206668 - RNA, 16 nt, Mycobacterium bovis subsp bovis AF2122/97
gguuagggcgugucuu

SEQ ID NO: 1206669 - RNA, 21 nt, Mycobacterium bovis subsp bovis AF2122/97
gguuagggacuuuccggcgca

SEQ ID NO: 1206670 - RNA, 14 nt, Mycobacterium bovis subsp bovis AF2122/97
gguuacccgcagcg

SEQ ID NO: 1206671 - RNA, 21 nt, Mycobacterium bovis subsp bovis AF2122/97
gguuaucgccgagauccgcgc

SEQ ID NO: 1206672 - RNA, 16 nt, Mycobacterium bovis subsp bovis AF2122/97
gguuauguauccgcgc

SEQ ID NO: 1206673 - RNA, 16 nt, Mycobacterium bovis subsp bovis AF2122/97
gguuaucccagacugu

SEQ ID NO: 1206674 - RNA, 23 nt, Mycobacterium bovis subsp bovis AF2122/97
gguggucacgcagucgggcagcg

SEQ ID NO: 1206675 - RNA, 15 nt, Mycobacterium bovis subsp bovis AF2122/97
ggugguaccggcggc

SEQ ID NO: 1206676 - RNA, 15 nt, Mycobacterium bovis subsp bovis AF2122/97
ggugguagcggcggu

SEQ ID NO: 1206677 - RNA, 21 nt, Mycobacterium bovis subsp bovis AF2122/97
gguggucgacccggccaggag

SEQ ID NO: 1206678 - RNA, 20 nt, Mycobacterium bovis subsp bovis AF2122/97
gguggucagguuggcacgcu

SEQ ID NO: 1206679 - RNA, 14 nt, Mycobacterium bovis subsp bovis AF2122/97
gguggucgggcgca

SEQ ID NO: 1206680 - RNA, 13 nt, Mycobacterium bovis subsp bovis AF2122/97
ggugguggccggg

SEQ ID NO: 1206681 - RNA, 18 nt, Mycobacterium bovis subsp bovis AF2122/97
gguggugccaaccugggc

SEQ ID NO: 1206682 - RNA, 18 nt, Mycobacterium bovis subsp bovis AF2122/97
gguggugccgcggccacc

SEQ ID NO: 1206683 - RNA, 13 nt, Mycobacterium bovis subsp bovis AF2122/97
gguggugacacga

SEQ ID NO: 1206684 - RNA, 11 nt, Mycobacterium bovis subsp bovis AF2122/97
gguggugcucg

SEQ ID NO: 1206685 - RNA, 13 nt, Mycobacterium bovis subsp bovis AF2122/97
gguggugagcuga

SEQ ID NO: 1206686 - RNA, 15 nt, Mycobacterium bovis subsp bovis AF2122/97
ggugguuguggcggg

SEQ ID NO: 1206687 - RNA, 23 nt, Mycobacterium bovis subsp bovis AF2122/97
ggugguuagguggcuggcugugc

SEQ ID NO: 1206688 - RNA, 16 nt, Mycobacterium bovis subsp bovis AF2122/97
ggugguucccgacauc

SEQ ID NO: 1206689 - RNA, 18 nt, Mycobacterium bovis subsp bovis AF2122/97
gguguccagccacgcugu

SEQ ID NO: 1206690 - RNA, 23 nt, Mycobacterium bovis subsp bovis AF2122/97
gguguccuccagcugcgcgggcg

SEQ ID NO: 1206691 - RNA, 16 nt, Mycobacterium bovis subsp bovis AF2122/97
ggugucgaugcgcagc

SEQ ID NO: 1206692 - RNA, 19 nt, Mycobacterium bovis subsp bovis AF2122/97
ggugucgaugcgcagcccg

SEQ ID NO: 1206693 - RNA, 18 nt, Mycobacterium bovis subsp bovis AF2122/97
ggugucgauuggcucgcc

SEQ ID NO: 1206694 - RNA, 18 nt, Mycobacterium bovis subsp bovis AF2122/97
ggugucgccgaacaccga

SEQ ID NO: 1206695 - RNA, 11 nt, Mycobacterium bovis subsp bovis AF2122/97
gguguccuugg

SEQ ID NO: 1206696 - RNA, 16 nt, Mycobacterium bovis subsp bovis AF2122/97
ggugucggccagcaac

SEQ ID NO: 1206697 - RNA, 14 nt, Mycobacterium bovis subsp bovis AF2122/97
ggugucgggcagca

SEQ ID NO: 1206698 - RNA, 19 nt, Mycobacterium bovis subsp bovis AF2122/97
gguguagccggcgccgccg

SEQ ID NO: 1206699 - RNA, 14 nt, Mycobacterium bovis subsp bovis AF2122/97
gguguagcccagcc

SEQ ID NO: 1206700 - RNA, 18 nt, Mycobacterium bovis subsp bovis AF2122/97
gguguagcccagccgggu

SEQ ID NO: 1206701 - RNA, 13 nt, Mycobacterium bovis subsp bovis AF2122/97
gguguagagagcc

SEQ ID NO: 1206702 - RNA, 23 nt, Mycobacterium bovis subsp bovis AF2122/97
gguguacagucgcgcgcucgcgg

SEQ ID NO: 1206703 - RNA, 19 nt, Mycobacterium bovis subsp bovis AF2122/97
gguguaggccugcccccgg

SEQ ID NO: 1206704 - RNA, 22 nt, Mycobacterium bovis subsp bovis AF2122/97
ggugugcugccaccggccggcg

SEQ ID NO: 1206705 - RNA, 22 nt, Mycobacterium bovis subsp bovis AF2122/97
ggugugcuugcucgggucgugc

SEQ ID NO: 1206706 - RNA, 21 nt, Mycobacterium bovis subsp bovis AF2122/97
ggugugcgggguugggcggag

SEQ ID NO: 1206707 - RNA, 15 nt, Mycobacterium bovis subsp bovis AF2122/97
ggugugcgggcggug

SEQ ID NO: 1206708 - RNA, 13 nt, Mycobacterium bovis subsp bovis AF2122/97
ggugugcgcgcca

SEQ ID NO: 1206709 - RNA, 15 nt, Mycobacterium bovis subsp bovis AF2122/97
ggugugcggcagccc

SEQ ID NO: 1206710 - RNA, 20 nt, Mycobacterium bovis subsp bovis AF2122/97
gguguguucggagcugggcu

SEQ ID NO: 1206711 - RNA, 20 nt, Mycobacterium bovis subsp bovis AF2122/97
gguguggucaccaggccgaa

SEQ ID NO: 1206712 - RNA, 16 nt, Mycobacterium bovis subsp bovis AF2122/97
gguguggucgguggcg

SEQ ID NO: 1206713 - RNA, 21 nt, Mycobacterium bovis subsp bovis AF2122/97
ggugucgucaucggggccugc

SEQ ID NO: 1206714 - RNA, 15 nt, Mycobacterium bovis subsp bovis AF2122/97
ggugucgggcagcaa

SEQ ID NO: 1206715 - RNA, 17 nt, Mycobacterium bovis subsp bovis AF2122/97
ggugucggggcccccgc

SEQ ID NO: 1206716 - RNA, 17 nt, Mycobacterium bovis subsp bovis AF2122/97
ggugucgucgaucgcgg

SEQ ID NO: 1206717 - RNA, 12 nt, Mycobacterium bovis subsp bovis AF2122/97
ggugugcaggga

SEQ ID NO: 1206718 - RNA, 19 nt, Mycobacterium bovis subsp bovis AF2122/97
ggugugcaucgacucacgg

SEQ ID NO: 1206719 - RNA, 13 nt, Mycobacterium bovis subsp bovis AF2122/97
gguguugaggccg

SEQ ID NO: 1206720 - RNA, 15 nt, Mycobacterium bovis subsp bovis AF2122/97
gguguuccaggucau

SEQ ID NO: 1206721 - RNA, 18 nt, Mycobacterium bovis subsp bovis AF2122/97
gguguuuauggcccuggg

SEQ ID NO: 1206722 - RNA, 21 nt, Mycobacterium bovis subsp bovis AF2122/97
gguguuuauggcccugggccc

SEQ ID NO: 1206723 - RNA, 23 nt, Mycobacterium bovis subsp bovis AF2122/97
gguguugccggagacgucgccgc

SEQ ID NO: 1206724 - RNA, 21 nt, Mycobacterium bovis subsp bovis AF2122/97
gguguuuccgaaacccgccgc

SEQ ID NO: 1206725 - RNA, 21 nt, Mycobacterium bovis subsp bovis AF2122/97
gguuugcacggcgcgccagaa

SEQ ID NO: 1206726 - RNA, 17 nt, Mycobacterium bovis subsp bovis AF2122/97
gguuuccggccugcacg

SEQ ID NO: 1206727 - RNA, 18 nt, Mycobacterium bovis subsp bovis AF2122/97
gguuuccuccggcagcag

SEQ ID NO: 1206728 - RNA, 18 nt, Mycobacterium bovis subsp bovis AF2122/97
gguugcucgagcgguggc

SEQ ID NO: 1206729 - RNA, 14 nt, Mycobacterium bovis subsp bovis AF2122/97
gguugcgccaggaa

SEQ ID NO: 1206730 - RNA, 15 nt, Mycobacterium bovis subsp bovis AF2122/97
gguugcgcucacccg

SEQ ID NO: 1206731 - RNA, 16 nt, Mycobacterium bovis subsp bovis AF2122/97
gguuggcugaugacgc

SEQ ID NO: 1206732 - RNA, 16 nt, Mycobacterium bovis subsp bovis AF2122/97
gguuggcguugguggu

SEQ ID NO: 1206733 - RNA, 18 nt, Mycobacterium bovis subsp bovis AF2122/97
gguuggccgaacagcugc

SEQ ID NO: 1206734 - RNA, 12 nt, Mycobacterium bovis subsp bovis AF2122/97
gguuggagcccg

SEQ ID NO: 1206735 - RNA, 20 nt, Mycobacterium bovis subsp bovis AF2122/97
gguuggagcgccagccgcug

SEQ ID NO: 1206736 - RNA, 20 nt, Mycobacterium bovis subsp bovis AF2122/97
gguugucguugcuggugugc

SEQ ID NO: 1206737 - RNA, 13 nt, Mycobacterium bovis subsp bovis AF2122/97
gguugguccucgg

SEQ ID NO: 1206738 - RNA, 20 nt, Mycobacterium bovis subsp bovis AF2122/97
gguuggugauugcggccgcc

SEQ ID NO: 1206739 - RNA, 21 nt, Mycobacterium bovis subsp bovis AF2122/97
gguuguucaacucgggcagcu

SEQ ID NO: 1206740 - RNA, 17 nt, Mycobacterium bovis subsp bovis AF2122/97
gguugugucggccuggc

SEQ ID NO: 1206741 - RNA, 18 nt, Mycobacterium bovis subsp bovis AF2122/97
gguugccaacgaaccgcu

SEQ ID NO: 1206742 - RNA, 18 nt, Mycobacterium bovis subsp bovis AF2122/97
gguugcccgcauugccaa

SEQ ID NO: 1206743 - RNA, 18 nt, Mycobacterium bovis subsp bovis AF2122/97
gguugccuuugcggcggg

SEQ ID NO: 1206744 - RNA, 11 nt, Mycobacterium bovis subsp bovis AF2122/97
gguugcccuug

SEQ ID NO: 1206745 - RNA, 14 nt, Mycobacterium bovis subsp bovis AF2122/97
gguugccggcggcg

SEQ ID NO: 1206746 - RNA, 16 nt, Mycobacterium bovis subsp bovis AF2122/97
gguugcaaaccgcugc

SEQ ID NO: 1206747 - RNA, 17 nt, Mycobacterium bovis subsp bovis AF2122/97
gguucuuccacagcgcg

SEQ ID NO: 1206748 - RNA, 23 nt, Mycobacterium bovis subsp bovis AF2122/97
gguucuguuccagaaggccgcac

SEQ ID NO: 1206749 - RNA, 15 nt, Mycobacterium bovis subsp bovis AF2122/97
gguugaccgaguuga

SEQ ID NO: 1206750 - RNA, 22 nt, Mycobacterium bovis subsp bovis AF2122/97
gguugaccgccaccccggucgg

SEQ ID NO: 1206751 - RNA, 18 nt, Mycobacterium bovis subsp bovis AF2122/97
gguugaacgaccucugca

SEQ ID NO: 1206752 - RNA, 13 nt, Mycobacterium bovis subsp bovis AF2122/97
ggugcccagcgcu

SEQ ID NO: 1206753 - RNA, 15 nt, Mycobacterium bovis subsp bovis AF2122/97
ggugcccggccgcca

SEQ ID NO: 1206754 - RNA, 21 nt, Mycobacterium bovis subsp bovis AF2122/97
ggugccaccagugagcccgcu

SEQ ID NO: 1206755 - RNA, 19 nt, Mycobacterium bovis subsp bovis AF2122/97
ggugccaaacgccgcccgc

SEQ ID NO: 1206756 - RNA, 22 nt, Mycobacterium bovis subsp bovis AF2122/97
ggugccagcaccacgucgacga

SEQ ID NO: 1206757 - RNA, 19 nt, Mycobacterium bovis subsp bovis AF2122/97
ggugccagcacuccaccgc

SEQ ID NO: 1206758 - RNA, 21 nt, Mycobacterium bovis subsp bovis AF2122/97
ggugccagaccagggcagcgg

SEQ ID NO: 1206759 - RNA, 12 nt, Mycobacterium bovis subsp bovis AF2122/97
ggugccagcagg

SEQ ID NO: 1206760 - RNA, 12 nt, Mycobacterium bovis subsp bovis AF2122/97
ggugcaggugag

SEQ ID NO: 1206761 - RNA, 17 nt, Mycobacterium bovis subsp bovis AF2122/97
ggugcaggugagugcgg

SEQ ID NO: 1206762 - RNA, 19 nt, Mycobacterium bovis subsp bovis AF2122/97
ggugcagcacggcgccgcc

SEQ ID NO: 1206763 - RNA, 21 nt, Mycobacterium bovis subsp bovis AF2122/97
ggugcacgccuugagccgagg

SEQ ID NO: 1206764 - RNA, 14 nt, Mycobacterium bovis subsp bovis AF2122/97
ggugcagcccgccg

SEQ ID NO: 1206765 - RNA, 16 nt, Mycobacterium bovis subsp bovis AF2122/97
ggugcagcacggcgcc

SEQ ID NO: 1206766 - RNA, 19 nt, Mycobacterium bovis subsp bovis AF2122/97
ggugcagaucggcucaccg

SEQ ID NO: 1206767 - RNA, 17 nt, Mycobacterium bovis subsp bovis AF2122/97
ggugaguccgcugagcg

SEQ ID NO: 1206768 - RNA, 20 nt, Mycobacterium bovis subsp bovis AF2122/97
ggugaguccgcugagcgggc

SEQ ID NO: 1206769 - RNA, 13 nt, Mycobacterium bovis subsp bovis AF2122/97
ggugagugcgucu

SEQ ID NO: 1206770 - RNA, 22 nt, Mycobacterium bovis subsp bovis AF2122/97
ggugagugcgucucgguggcug

SEQ ID NO: 1206771 - RNA, 21 nt, Mycobacterium bovis subsp bovis AF2122/97
ggugauagaggauaucgccga

SEQ ID NO: 1206772 - RNA, 16 nt, Mycobacterium bovis subsp bovis AF2122/97
ggugaucuucuucagg

SEQ ID NO: 1206773 - RNA, 23 nt, Mycobacterium bovis subsp bovis AF2122/97
ggugaucagcaggaucggcagca

SEQ ID NO: 1206774 - RNA, 18 nt, Mycobacterium bovis subsp bovis AF2122/97
ggugaucagcucagugau

SEQ ID NO: 1206775 - RNA, 19 nt, Mycobacterium bovis subsp bovis AF2122/97
ggugaucaaaccggcggcg

SEQ ID NO: 1206776 - RNA, 16 nt, Mycobacterium bovis subsp bovis AF2122/97
ggugaucaccgacacc

SEQ ID NO: 1206777 - RNA, 15 nt, Mycobacterium bovis subsp bovis AF2122/97
ggugaucagcaggau

SEQ ID NO: 1206778 - RNA, 19 nt, Mycobacterium bovis subsp bovis AF2122/97
ggugaugggcaugguggug

SEQ ID NO: 1206779 - RNA, 18 nt, Mycobacterium bovis subsp bovis AF2122/97
ggugaugcccagcgccga

SEQ ID NO: 1206780 - RNA, 17 nt, Mycobacterium bovis subsp bovis AF2122/97
ggugauggugaccagca

SEQ ID NO: 1206781 - RNA, 13 nt, Mycobacterium bovis subsp bovis AF2122/97
ggugaugguggcg

SEQ ID NO: 1206782 - RNA, 18 nt, Mycobacterium bovis subsp bovis AF2122/97
ggugauugcggccgccga

SEQ ID NO: 1206783 - RNA, 17 nt, Mycobacterium bovis subsp bovis AF2122/97
ggugcacaacccgugca

SEQ ID NO: 1206784 - RNA, 14 nt, Mycobacterium bovis subsp bovis AF2122/97
ggugcacagcagug

SEQ ID NO: 1206785 - RNA, 16 nt, Mycobacterium bovis subsp bovis AF2122/97
ggcuccgccgcgggcu

SEQ ID NO: 1206786 - RNA, 20 nt, Mycobacterium bovis subsp bovis AF2122/97
ggcuccgccacuggcgccgg

SEQ ID NO: 1206787 - RNA, 22 nt, Mycobacterium bovis subsp bovis AF2122/97
ggcuccgcccggcgugucgccg

SEQ ID NO: 1206788 - RNA, 17 nt, Mycobacterium bovis subsp bovis AF2122/97
ggcuccgcagcgaagac

SEQ ID NO: 1206789 - RNA, 22 nt, Mycobacterium bovis subsp bovis AF2122/97
ggcuccgaacauggccagcauc

SEQ ID NO: 1206790 - RNA, 20 nt, Mycobacterium bovis subsp bovis AF2122/97
ggcucagucacgcacucccg

SEQ ID NO: 1206791 - RNA, 17 nt, Mycobacterium bovis subsp bovis AF2122/97
ggcucaggugcucagcu

SEQ ID NO: 1206792 - RNA, 12 nt, Mycobacterium bovis subsp bovis AF2122/97
ggugaccaacac

SEQ ID NO: 1206793 - RNA, 18 nt, Mycobacterium bovis subsp bovis AF2122/97
ggugaccaacaccccccc

SEQ ID NO: 1206794 - RNA, 16 nt, Mycobacterium bovis subsp bovis AF2122/97
ggugacccgcuauucg

SEQ ID NO: 1206795 - RNA, 23 nt, Mycobacterium bovis subsp bovis AF2122/97
ggugacccgcuauucggcggcau

SEQ ID NO: 1206796 - RNA, 16 nt, Mycobacterium bovis subsp bovis AF2122/97
ggugacaaauggggug

SEQ ID NO: 1206797 - RNA, 16 nt, Mycobacterium bovis subsp bovis AF2122/97
ggugacaucgcgaggc

SEQ ID NO: 1206798 - RNA, 19 nt, Mycobacterium bovis subsp bovis AF2122/97
ggcuccuccccggcccgcu

SEQ ID NO: 1206799 - RNA, 21 nt, Mycobacterium bovis subsp bovis AF2122/97
ggcuccuccgguaucggcgac

SEQ ID NO: 1206800 - RNA, 16 nt, Mycobacterium bovis subsp bovis AF2122/97
ggugaauaaggcugca

SEQ ID NO: 1206801 - RNA, 16 nt, Mycobacterium bovis subsp bovis AF2122/97
ggcuccggcggcagcg

SEQ ID NO: 1206802 - RNA, 12 nt, Mycobacterium bovis subsp bovis AF2122/97
ggcuccggccgc

SEQ ID NO: 1206803 - RNA, 20 nt, Mycobacterium bovis subsp bovis AF2122/97
ggcuccgggaugaagcucga

SEQ ID NO: 1206804 - RNA, 19 nt, Mycobacterium bovis subsp bovis AF2122/97
ggugacgacaugguuggug

SEQ ID NO: 1206805 - RNA, 14 nt, Mycobacterium bovis subsp bovis AF2122/97
ggugaccgcgggcg

SEQ ID NO: 1206806 - RNA, 19 nt, Mycobacterium bovis subsp bovis AF2122/97
ggugaccgacgcggacagg

SEQ ID NO: 1206807 - RNA, 14 nt, Mycobacterium bovis subsp bovis AF2122/97
ggugacgugguggg

SEQ ID NO: 1206808 - RNA, 19 nt, Mycobacterium bovis subsp bovis AF2122/97
ggugacguggugggcuugg

SEQ ID NO: 1206809 - RNA, 16 nt, Mycobacterium bovis subsp bovis AF2122/97
ggugacgguguuggug

SEQ ID NO: 1206810 - RNA, 22 nt, Mycobacterium bovis subsp bovis AF2122/97
ggugacggcggcugucggccgg

SEQ ID NO: 1206811 - RNA, 13 nt, Mycobacterium bovis subsp bovis AF2122/97
ggugacggcggca

SEQ ID NO: 1206812 - RNA, 15 nt, Mycobacterium bovis subsp bovis AF2122/97
ggugacggcggcugu

SEQ ID NO: 1206813 - RNA, 13 nt, Mycobacterium bovis subsp bovis AF2122/97
ggugacgccagcc

SEQ ID NO: 1206814 - RNA, 17 nt, Mycobacterium bovis subsp bovis AF2122/97
ggugacgccgccagcac

SEQ ID NO: 1206815 - RNA, 19 nt, Mycobacterium bovis subsp bovis AF2122/97
ggugacgcccgcuccgcgg

SEQ ID NO: 1206816 - RNA, 20 nt, Mycobacterium bovis subsp bovis AF2122/97
ggugagaucaugaggugagc

SEQ ID NO: 1206817 - RNA, 18 nt, Mycobacterium bovis subsp bovis AF2122/97
ggugacucggcaccugga

SEQ ID NO: 1206818 - RNA, 23 nt, Mycobacterium bovis subsp bovis AF2122/97
ggugacgguguugguggucgggu

SEQ ID NO: 1206819 - RNA, 13 nt, Mycobacterium bovis subsp bovis AF2122/97
ggugagccgagcc

SEQ ID NO: 1206820 - RNA, 15 nt, Mycobacterium bovis subsp bovis AF2122/97
ggugagcgagcgcgc

SEQ ID NO: 1206821 - RNA, 18 nt, Mycobacterium bovis subsp bovis AF2122/97
ggugagccucggcgagcc

SEQ ID NO: 1206822 - RNA, 21 nt, Mycobacterium bovis subsp bovis AF2122/97
ggugagccucggcgagccgug

SEQ ID NO: 1206823 - RNA, 23 nt, Mycobacterium bovis subsp bovis AF2122/97
ggugagcaccugggcgcgcuggc

SEQ ID NO: 1206824 - RNA, 23 nt, Mycobacterium bovis subsp bovis AF2122/97
ggugagggaacccacaguggcuc

SEQ ID NO: 1206825 - RNA, 22 nt, Mycobacterium bovis subsp bovis AF2122/97
gguggccaucgcgcggaccaga

SEQ ID NO: 1206826 - RNA, 17 nt, Mycobacterium bovis subsp bovis AF2122/97
gguggccaugacggcuc

SEQ ID NO: 1206827 - RNA, 21 nt, Mycobacterium bovis subsp bovis AF2122/97
gguggccaugacggcuccgau

SEQ ID NO: 1206828 - RNA, 16 nt, Mycobacterium bovis subsp bovis AF2122/97
gguggccagcacgugc

SEQ ID NO: 1206829 - RNA, 15 nt, Mycobacterium bovis subsp bovis AF2122/97
gguggcagcggcgau

SEQ ID NO: 1206830 - RNA, 14 nt, Mycobacterium bovis subsp bovis AF2122/97
gguggccagcaggc

SEQ ID NO: 1206831 - RNA, 17 nt, Mycobacterium bovis subsp bovis AF2122/97
gguggccagccagcggg

SEQ ID NO: 1206832 - RNA, 17 nt, Mycobacterium bovis subsp bovis AF2122/97
gguggccagcggagcgc

SEQ ID NO: 1206833 - RNA, 21 nt, Mycobacterium bovis subsp bovis AF2122/97
gguggaguuuccgaagcccgg

SEQ ID NO: 1206834 - RNA, 16 nt, Mycobacterium bovis subsp bovis AF2122/97
gguggagcggcgcggg

SEQ ID NO: 1206835 - RNA, 23 nt, Mycobacterium bovis subsp bovis AF2122/97
gguggagcggcgcgggggugggc

SEQ ID NO: 1206836 - RNA, 19 nt, Mycobacterium bovis subsp bovis AF2122/97
gguggauucgaucaggccu

SEQ ID NO: 1206837 - RNA, 23 nt, Mycobacterium bovis subsp bovis AF2122/97
gguggcaaucgaggaaggugugc

SEQ ID NO: 1206838 - RNA, 17 nt, Mycobacterium bovis subsp bovis AF2122/97
gguggcaccggcggcga

SEQ ID NO: 1206839 - RNA, 19 nt, Mycobacterium bovis subsp bovis AF2122/97
gguggcacgcugagcgucc

SEQ ID NO: 1206840 - RNA, 14 nt, Mycobacterium bovis subsp bovis AF2122/97
gguggcacggcccc

SEQ ID NO: 1206841 - RNA, 16 nt, Mycobacterium bovis subsp bovis AF2122/97
gguggcacggccccug

SEQ ID NO: 1206842 - RNA, 16 nt, Mycobacterium bovis subsp bovis AF2122/97
gguggacggcaggcgg

SEQ ID NO: 1206843 - RNA, 14 nt, Mycobacterium bovis subsp bovis AF2122/97
gguggaccggccug

SEQ ID NO: 1206844 - RNA, 15 nt, Mycobacterium bovis subsp bovis AF2122/97
gguggagagccgacg

SEQ ID NO: 1206845 - RNA, 21 nt, Mycobacterium bovis subsp bovis AF2122/97
gguggacgagccagaggugga

SEQ ID NO: 1206846 - RNA, 22 nt, Mycobacterium bovis subsp bovis AF2122/97
ggugcuuccucgcgagcucccu

SEQ ID NO: 1206847 - RNA, 16 nt, Mycobacterium bovis subsp bovis AF2122/97
gguggaaaaagcccga

SEQ ID NO: 1206848 - RNA, 16 nt, Mycobacterium bovis subsp bovis AF2122/97
ggugcuguuugguugc

SEQ ID NO: 1206849 - RNA, 15 nt, Mycobacterium bovis subsp bovis AF2122/97
ggugcuggucgccgc

SEQ ID NO: 1206850 - RNA, 19 nt, Mycobacterium bovis subsp bovis AF2122/97
ggugcuggucgccgcggca

SEQ ID NO: 1206851 - RNA, 16 nt, Mycobacterium bovis subsp bovis AF2122/97
ggugcugguggcggca

SEQ ID NO: 1206852 - RNA, 17 nt, Mycobacterium bovis subsp bovis AF2122/97
gguggcggcgagcagca

SEQ ID NO: 1206853 - RNA, 13 nt, Mycobacterium bovis subsp bovis AF2122/97
gguggcggccucc

SEQ ID NO: 1206854 - RNA, 15 nt, Mycobacterium bovis subsp bovis AF2122/97
gguggcgccggggcg

SEQ ID NO: 1206855 - RNA, 17 nt, Mycobacterium bovis subsp bovis AF2122/97
gguggcgccggggcgca

SEQ ID NO: 1206856 - RNA, 10 nt, Mycobacterium bovis subsp bovis AF2122/97
gguggcggca

SEQ ID NO: 1206857 - RNA, 20 nt, Mycobacterium bovis subsp bovis AF2122/97
gguggcggcgagcagcaggu

SEQ ID NO: 1206858 - RNA, 13 nt, Mycobacterium bovis subsp bovis AF2122/97
gguggcggcggcg

SEQ ID NO: 1206859 - RNA, 18 nt, Mycobacterium bovis subsp bovis AF2122/97
gguggcggggugggugac

SEQ ID NO: 1206860 - RNA, 23 nt, Mycobacterium bovis subsp bovis AF2122/97
gguggcggucaccacgcggcggu

SEQ ID NO: 1206861 - RNA, 22 nt, Mycobacterium bovis subsp bovis AF2122/97
gguggcguuugaugcgggcggc

SEQ ID NO: 1206862 - RNA, 23 nt, Mycobacterium bovis subsp bovis AF2122/97
gguggcgucaccgccggugcuga

SEQ ID NO: 1206863 - RNA, 13 nt, Mycobacterium bovis subsp bovis AF2122/97
gguggcguggugg

SEQ ID NO: 1206864 - RNA, 15 nt, Mycobacterium bovis subsp bovis AF2122/97
gguggccggggugcc

SEQ ID NO: 1206865 - RNA, 15 nt, Mycobacterium bovis subsp bovis AF2122/97
gguggccgcggcggu

SEQ ID NO: 1206866 - RNA, 16 nt, Mycobacterium bovis subsp bovis AF2122/97
gguggcccgggccacc

SEQ ID NO: 1206867 - RNA, 22 nt, Mycobacterium bovis subsp bovis AF2122/97
gguggcgccauccccgccggcg

SEQ ID NO: 1206868 - RNA, 16 nt, Mycobacterium bovis subsp bovis AF2122/97
ggugggcagcagcugg

SEQ ID NO: 1206869 - RNA, 24 nt, Mycobacterium bovis subsp bovis AF2122/97
gguggcuggccgccaccgcacgca

SEQ ID NO: 1206870 - RNA, 16 nt, Mycobacterium bovis subsp bovis AF2122/97
gguggcuugccccgcc

SEQ ID NO: 1206871 - RNA, 15 nt, Mycobacterium bovis subsp bovis AF2122/97
gguggcucggguggu

SEQ ID NO: 1206872 - RNA, 20 nt, Mycobacterium bovis subsp bovis AF2122/97
gguggcucgggugguuugcg

SEQ ID NO: 1206873 - RNA, 14 nt, Mycobacterium bovis subsp bovis AF2122/97
ggugggucggggcg

SEQ ID NO: 1206874 - RNA, 18 nt, Mycobacterium bovis subsp bovis AF2122/97
gguggggauggcgcccag

SEQ ID NO: 1206875 - RNA, 17 nt, Mycobacterium bovis subsp bovis AF2122/97
gguggggcgguggccgg

SEQ ID NO: 1206876 - RNA, 18 nt, Mycobacterium bovis subsp bovis AF2122/97
ggugccgcggccaccgcc

SEQ ID NO: 1206877 - RNA, 16 nt, Mycobacterium bovis subsp bovis AF2122/97
ggugccgccugugcca

SEQ ID NO: 1206878 - RNA, 18 nt, Mycobacterium bovis subsp bovis AF2122/97
ggugccgccgccggcgcc

SEQ ID NO: 1206879 - RNA, 15 nt, Mycobacterium bovis subsp bovis AF2122/97
ggugccgcggcuagg

SEQ ID NO: 1206880 - RNA, 14 nt, Mycobacterium bovis subsp bovis AF2122/97
ggugccgggguggc

SEQ ID NO: 1206881 - RNA, 19 nt, Mycobacterium bovis subsp bovis AF2122/97
ggugccggcguaggcagga

SEQ ID NO: 1206882 - RNA, 22 nt, Mycobacterium bovis subsp bovis AF2122/97
ggugccggcgucgcuggccagg

SEQ ID NO: 1206883 - RNA, 19 nt, Mycobacterium bovis subsp bovis AF2122/97
ggugccggcguugccgccg

SEQ ID NO: 1206884 - RNA, 16 nt, Mycobacterium bovis subsp bovis AF2122/97
ggugccggggcugccg

SEQ ID NO: 1206885 - RNA, 16 nt, Mycobacterium bovis subsp bovis AF2122/97
ggugccgccaccaccg

SEQ ID NO: 1206886 - RNA, 19 nt, Mycobacterium bovis subsp bovis AF2122/97
ggugccgccaucgccgccg

SEQ ID NO: 1206887 - RNA, 17 nt, Mycobacterium bovis subsp bovis AF2122/97
ggugcccggccgccagc

SEQ ID NO: 1206888 - RNA, 15 nt, Mycobacterium bovis subsp bovis AF2122/97
ggugccgcagcaggg

SEQ ID NO: 1206889 - RNA, 20 nt, Mycobacterium bovis subsp bovis AF2122/97
ggugccgccaucgccgccgg

SEQ ID NO: 1206890 - RNA, 12 nt, Mycobacterium bovis subsp bovis AF2122/97
ggugccgcccga

SEQ ID NO: 1206891 - RNA, 12 nt, Mycobacterium bovis subsp bovis AF2122/97
ggugccgcccgc

SEQ ID NO: 1206892 - RNA, 14 nt, Mycobacterium bovis subsp bovis AF2122/97
ggugccgcccgcgc

SEQ ID NO: 1206893 - RNA, 19 nt, Mycobacterium bovis subsp bovis AF2122/97
ggugccgcccgcgccgccg

SEQ ID NO: 1206894 - RNA, 21 nt, Mycobacterium bovis subsp bovis AF2122/97
ggugccgagcacucggccacg

SEQ ID NO: 1206895 - RNA, 14 nt, Mycobacterium bovis subsp bovis AF2122/97
ggugccgcagcagg

SEQ ID NO: 1206896 - RNA, 16 nt, Mycobacterium bovis subsp bovis AF2122/97
ggugccgacccgccgc

SEQ ID NO: 1206897 - RNA, 16 nt, Mycobacterium bovis subsp bovis AF2122/97
ggugcgcagggccugg

SEQ ID NO: 1206898 - RNA, 23 nt, Mycobacterium bovis subsp bovis AF2122/97
ggugcgcauggacaacagcuugg

SEQ ID NO: 1206899 - RNA, 14 nt, Mycobacterium bovis subsp bovis AF2122/97
ggugccggugcucc

SEQ ID NO: 1206900 - RNA, 18 nt, Mycobacterium bovis subsp bovis AF2122/97
ggugccgucagcggcggc

SEQ ID NO: 1206901 - RNA, 19 nt, Mycobacterium bovis subsp bovis AF2122/97
ggugccgguguugccgccg

SEQ ID NO: 1206902 - RNA, 19 nt, Mycobacterium bovis subsp bovis AF2122/97
ggugccgucagcggcggcc

SEQ ID NO: 1206903 - RNA, 22 nt, Mycobacterium bovis subsp bovis AF2122/97
ggugccgugaucggcgcccggg

SEQ ID NO: 1206904 - RNA, 23 nt, Mycobacterium bovis subsp bovis AF2122/97
ggugccgugcucacggcaggcgg

SEQ ID NO: 1206905 - RNA, 24 nt, Mycobacterium bovis subsp bovis AF2122/97
ggugccgugcucacggcaggcggu

SEQ ID NO: 1206906 - RNA, 21 nt, Mycobacterium bovis subsp bovis AF2122/97
ggugccguggauugcgccagg

SEQ ID NO: 1206907 - RNA, 23 nt, Mycobacterium bovis subsp bovis AF2122/97
ggugccguugcgucugcucggcg

SEQ ID NO: 1206908 - RNA, 20 nt, Mycobacterium bovis subsp bovis AF2122/97
ggugcgcugcgaucaccccc

SEQ ID NO: 1206909 - RNA, 16 nt, Mycobacterium bovis subsp bovis AF2122/97
ggugcgcuggcggcgc

SEQ ID NO: 1206910 - RNA, 15 nt, Mycobacterium bovis subsp bovis AF2122/97
ggugcggccgcggcg

SEQ ID NO: 1206911 - RNA, 15 nt, Mycobacterium bovis subsp bovis AF2122/97
ggugcggccgggucg

SEQ ID NO: 1206912 - RNA, 16 nt, Mycobacterium bovis subsp bovis AF2122/97
ggugcgcccgccggcg

SEQ ID NO: 1206913 - RNA, 16 nt, Mycobacterium bovis subsp bovis AF2122/97
ggugcgccgcagcagg

SEQ ID NO: 1206914 - RNA, 16 nt, Mycobacterium bovis subsp bovis AF2122/97
ggugcgcacggcggcc

SEQ ID NO: 1206915 - RNA, 15 nt, Mycobacterium bovis subsp bovis AF2122/97
ggugcgcgcggucga

SEQ ID NO: 1206916 - RNA, 15 nt, Mycobacterium bovis subsp bovis AF2122/97
ggugcgcgaccagga

SEQ ID NO: 1206917 - RNA, 24 nt, Mycobacterium bovis subsp bovis AF2122/97
ggugcgcgaggucggcggcgcagg

SEQ ID NO: 1206918 - RNA, 16 nt, Mycobacterium bovis subsp bovis AF2122/97
ggugcgucacagccgg

SEQ ID NO: 1206919 - RNA, 18 nt, Mycobacterium bovis subsp bovis AF2122/97
ggugcgucacagccgggu

SEQ ID NO: 1206920 - RNA, 18 nt, Mycobacterium bovis subsp bovis AF2122/97
ggugcgggcuaggcggcg

SEQ ID NO: 1206921 - RNA, 18 nt, Mycobacterium bovis subsp bovis AF2122/97
ggugcuaaccgacgcuga

SEQ ID NO: 1206922 - RNA, 16 nt, Mycobacterium bovis subsp bovis AF2122/97
ggugcucaccuccacg

SEQ ID NO: 1206923 - RNA, 15 nt, Mycobacterium bovis subsp bovis AF2122/97
ggugcuacuggugug

SEQ ID NO: 1206924 - RNA, 17 nt, Mycobacterium bovis subsp bovis AF2122/97
ggugcucggucgaugcu

SEQ ID NO: 1206925 - RNA, 24 nt, Mycobacterium bovis subsp bovis AF2122/97
ggugcucgucaccaaacccgaugg

SEQ ID NO: 1206926 - RNA, 15 nt, Mycobacterium bovis subsp bovis AF2122/97
ggugcucagcggcuc

SEQ ID NO: 1206927 - RNA, 16 nt, Mycobacterium bovis subsp bovis AF2122/97
ggugcugaccccgccg

SEQ ID NO: 1206928 - RNA, 16 nt, Mycobacterium bovis subsp bovis AF2122/97
ggugcugcgcgcggcg

SEQ ID NO: 1206929 - RNA, 13 nt, Mycobacterium bovis subsp bovis AF2122/97
ggugcuggcagga

SEQ ID NO: 1206930 - RNA, 22 nt, Mycobacterium bovis subsp bovis AF2122/97
guacggaccguggcagcugcuc

SEQ ID NO: 1206931 - RNA, 13 nt, Mycobacterium bovis subsp bovis AF2122/97
guacgggcaggcc

SEQ ID NO: 1206932 - RNA, 15 nt, Mycobacterium bovis subsp bovis AF2122/97
guacggcucggcgcu

SEQ ID NO: 1206933 - RNA, 16 nt, Mycobacterium bovis subsp bovis AF2122/97
guacggcucggcgcug

SEQ ID NO: 1206934 - RNA, 12 nt, Mycobacterium bovis subsp bovis AF2122/97
guacgcggcugc

SEQ ID NO: 1206935 - RNA, 19 nt, Mycobacterium bovis subsp bovis AF2122/97
guacgccaggugcagcacc

SEQ ID NO: 1206936 - RNA, 23 nt, Mycobacterium bovis subsp bovis AF2122/97
guacgacccccgaucaggccgac

SEQ ID NO: 1206937 - RNA, 18 nt, Mycobacterium bovis subsp bovis AF2122/97
guacgacccccgaucagg

SEQ ID NO: 1206938 - RNA, 13 nt, Mycobacterium bovis subsp bovis AF2122/97
guaccccagcgcc

SEQ ID NO: 1206939 - RNA, 14 nt, Mycobacterium bovis subsp bovis AF2122/97
guacccaucugcuc

SEQ ID NO: 1206940 - RNA, 13 nt, Mycobacterium bovis subsp bovis AF2122/97
guacccaccuccc

SEQ ID NO: 1206941 - RNA, 23 nt, Mycobacterium bovis subsp bovis AF2122/97
guaccccagcgcugucguaccgc

SEQ ID NO: 1206942 - RNA, 21 nt, Mycobacterium bovis subsp bovis AF2122/97
guaccgauagccugcggcggc

SEQ ID NO: 1206943 - RNA, 17 nt, Mycobacterium bovis subsp bovis AF2122/97
guaccgauccaguucac

SEQ ID NO: 1206944 - RNA, 14 nt, Mycobacterium bovis subsp bovis AF2122/97
guaccgccgcugcc

SEQ ID NO: 1206945 - RNA, 22 nt, Mycobacterium bovis subsp bovis AF2122/97
guaccgcacgcaauucaaauga

SEQ ID NO: 1206946 - RNA, 18 nt, Mycobacterium bovis subsp bovis AF2122/97
guaccgccacuggcgcug

SEQ ID NO: 1206947 - RNA, 14 nt, Mycobacterium bovis subsp bovis AF2122/97
guaccgcccaguug

SEQ ID NO: 1206948 - RNA, 18 nt, Mycobacterium bovis subsp bovis AF2122/97
guacccguuaugcgccgc

SEQ ID NO: 1206949 - RNA, 15 nt, Mycobacterium bovis subsp bovis AF2122/97
guaccgagcagcaga

SEQ ID NO: 1206950 - RNA, 22 nt, Mycobacterium bovis subsp bovis AF2122/97
guaccggcggcgccggaggcgg

SEQ ID NO: 1206951 - RNA, 13 nt, Mycobacterium bovis subsp bovis AF2122/97
guaccggccagcc

SEQ ID NO: 1206952 - RNA, 21 nt, Mycobacterium bovis subsp bovis AF2122/97
guaccggcuucgucggccagc

SEQ ID NO: 1206953 - RNA, 14 nt, Mycobacterium bovis subsp bovis AF2122/97
guaccgggacgaau

SEQ ID NO: 1206954 - RNA, 16 nt, Mycobacterium bovis subsp bovis AF2122/97
guaccggagcagcuca

SEQ ID NO: 1206955 - RNA, 18 nt, Mycobacterium bovis subsp bovis AF2122/97
guaccucaacaccaggcc

SEQ ID NO: 1206956 - RNA, 13 nt, Mycobacterium bovis subsp bovis AF2122/97
guaccagcuggcc

SEQ ID NO: 1206957 - RNA, 18 nt, Mycobacterium bovis subsp bovis AF2122/97
guaccaaccugcgcggcg

SEQ ID NO: 1206958 - RNA, 14 nt, Mycobacterium bovis subsp bovis AF2122/97
guacagcggcggcg

SEQ ID NO: 1206959 - RNA, 21 nt, Mycobacterium bovis subsp bovis AF2122/97
guacagaucgagggggacgcu

SEQ ID NO: 1206960 - RNA, 21 nt, Mycobacterium bovis subsp bovis AF2122/97
guacacguaccgguccagugu

SEQ ID NO: 1206961 - RNA, 24 nt, Mycobacterium bovis subsp bovis AF2122/97
guacacguccaguggcagccagcg

SEQ ID NO: 1206962 - RNA, 16 nt, Mycobacterium bovis subsp bovis AF2122/97
guacaucgaggccacg

SEQ ID NO: 1206963 - RNA, 15 nt, Mycobacterium bovis subsp bovis AF2122/97
guacagucgcgcgcu

SEQ ID NO: 1206964 - RNA, 16 nt, Mycobacterium bovis subsp bovis AF2122/97
guacagucgcgcgcuc

SEQ ID NO: 1206965 - RNA, 22 nt, Mycobacterium bovis subsp bovis AF2122/97
guacacauaggugcggggccgg

SEQ ID NO: 1206966 - RNA, 19 nt, Mycobacterium bovis subsp bovis AF2122/97
guacacaucgucacugcca

SEQ ID NO: 1206967 - RNA, 13 nt, Mycobacterium bovis subsp bovis AF2122/97
guacacacgauga

SEQ ID NO: 1206968 - RNA, 16 nt, Mycobacterium bovis subsp bovis AF2122/97
guacaacgacacgccg

SEQ ID NO: 1206969 - RNA, 12 nt, Mycobacterium bovis subsp bovis AF2122/97
guaauugcaggu

SEQ ID NO: 1206970 - RNA, 17 nt, Mycobacterium bovis subsp bovis AF2122/97
guaaugcugcugcagca

SEQ ID NO: 1206971 - RNA, 16 nt, Mycobacterium bovis subsp bovis AF2122/97
guaaucgagcgcggca

SEQ ID NO: 1206972 - RNA, 16 nt, Mycobacterium bovis subsp bovis AF2122/97
aaauagauucccggcu

SEQ ID NO: 1206973 - RNA, 19 nt, Mycobacterium bovis subsp bovis AF2122/97
guaagggacaccagcucga

SEQ ID NO: 1206974 - RNA, 15 nt, Mycobacterium bovis subsp bovis AF2122/97
guaaggagccgggcc

SEQ ID NO: 1206975 - RNA, 13 nt, Mycobacterium bovis subsp bovis AF2122/97
guaaccuccucga

SEQ ID NO: 1206976 - RNA, 23 nt, Mycobacterium bovis subsp bovis AF2122/97
guaacccguuaccgauuggcccg

SEQ ID NO: 1206977 - RNA, 21 nt, Mycobacterium bovis subsp bovis AF2122/97
guaaccccaccuggaguccag

SEQ ID NO: 1206978 - RNA, 17 nt, Mycobacterium bovis subsp bovis AF2122/97
guaacgccgcucaucca

SEQ ID NO: 1206979 - RNA, 14 nt, Mycobacterium bovis subsp bovis AF2122/97
guaacgccgcucau

SEQ ID NO: 1206980 - RNA, 20 nt, Mycobacterium bovis subsp bovis AF2122/97
guaagaaucgaagcggcugc

SEQ ID NO: 1206981 - RNA, 23 nt, Mycobacterium bovis subsp bovis AF2122/97
guaagacgccgaacgcgagguuc

SEQ ID NO: 1206982 - RNA, 22 nt, Mycobacterium bovis subsp bovis AF2122/97
guaacucgaguagucgcuggcc

SEQ ID NO: 1206983 - RNA, 15 nt, Mycobacterium bovis subsp bovis AF2122/97
guaaaccggcugacc

SEQ ID NO: 1206984 - RNA, 19 nt, Mycobacterium bovis subsp bovis AF2122/97
guaaaccagguggccaggc

SEQ ID NO: 1206985 - RNA, 14 nt, Mycobacterium bovis subsp bovis AF2122/97
guaaagcucaccac

SEQ ID NO: 1206986 - RNA, 22 nt, Mycobacterium bovis subsp bovis AF2122/97
guaaacguugggaaaagcccgg

SEQ ID NO: 1206987 - RNA, 12 nt, Mycobacterium bovis subsp bovis AF2122/97
gcaacuucagca

SEQ ID NO: 1206988 - RNA, 16 nt, Mycobacterium bovis subsp bovis AF2122/97
gcaacuuugagcagaa

SEQ ID NO: 1206989 - RNA, 16 nt, Mycobacterium bovis subsp bovis AF2122/97
gcaagaaucagcagca

SEQ ID NO: 1206990 - RNA, 17 nt, Mycobacterium bovis subsp bovis AF2122/97
gcaagaaucagcagcag

SEQ ID NO: 1206991 - RNA, 12 nt, Mycobacterium bovis subsp bovis AF2122/97
gcaagaaucagc

SEQ ID NO: 1206992 - RNA, 14 nt, Mycobacterium bovis subsp bovis AF2122/97
aaagcgccagcagc

SEQ ID NO: 1206993 - RNA, 20 nt, Mycobacterium bovis subsp bovis AF2122/97
aaagcgccgaaacagcaccc

SEQ ID NO: 1206994 - RNA, 23 nt, Mycobacterium bovis subsp bovis AF2122/97
gcaacugcagguucuugaccagc

SEQ ID NO: 1206995 - RNA, 21 nt, Mycobacterium bovis subsp bovis AF2122/97
gcaacuagccgcugccuggcc

SEQ ID NO: 1206996 - RNA, 20 nt, Mycobacterium bovis subsp bovis AF2122/97
gcaacuccggucaacacccg

SEQ ID NO: 1206997 - RNA, 23 nt, Mycobacterium bovis subsp bovis AF2122/97
gcaacuccggucaacacccgccc

SEQ ID NO: 1206998 - RNA, 15 nt, Mycobacterium bovis subsp bovis AF2122/97
gcaacucguccagca

SEQ ID NO: 1206999 - RNA, 16 nt, Mycobacterium bovis subsp bovis AF2122/97
gcaacucguccagcag

SEQ ID NO: 1207000 - RNA, 17 nt, Mycobacterium bovis subsp bovis AF2122/97
gcaacucguccagcagu

SEQ ID NO: 1207001 - RNA, 18 nt, Mycobacterium bovis subsp bovis AF2122/97
gcaacucguccagcagug

SEQ ID NO: 1207002 - RNA, 20 nt, Mycobacterium bovis subsp bovis AF2122/97
gcaacguagccagcagcggc

SEQ ID NO: 1207003 - RNA, 21 nt, Mycobacterium bovis subsp bovis AF2122/97
gcaacguagccagcagcggcu

SEQ ID NO: 1207004 - RNA, 20 nt, Mycobacterium bovis subsp bovis AF2122/97
gcaacgucgcugaaaucggu

SEQ ID NO: 1207005 - RNA, 17 nt, Mycobacterium bovis subsp bovis AF2122/97
gcaacgugugcaccauc

SEQ ID NO: 1207006 - RNA, 20 nt, Mycobacterium bovis subsp bovis AF2122/97
gcaacgggggcgccggagcc

SEQ ID NO: 1207007 - RNA, 14 nt, Mycobacterium bovis subsp bovis AF2122/97
gcaacgggucgggu

SEQ ID NO: 1207008 - RNA, 20 nt, Mycobacterium bovis subsp bovis AF2122/97
gcaacggcggcaacggcggc

SEQ ID NO: 1207009 - RNA, 23 nt, Mycobacterium bovis subsp bovis AF2122/97
gcaacggcggcaacggcggcauc

SEQ ID NO: 1207010 - RNA, 17 nt, Mycobacterium bovis subsp bovis AF2122/97
gcaacggcggcaggccg

SEQ ID NO: 1207011 - RNA, 20 nt, Mycobacterium bovis subsp bovis AF2122/97
gcaacggcggcaucggcggc

SEQ ID NO: 1207012 - RNA, 14 nt, Mycobacterium bovis subsp bovis AF2122/97
gcaacggcggggcc

SEQ ID NO: 1207013 - RNA, 20 nt, Mycobacterium bovis subsp bovis AF2122/97
gcaacggcggggccggcggc

SEQ ID NO: 1207014 - RNA, 21 nt, Mycobacterium bovis subsp bovis AF2122/97
gcaacggcggggccggcggcu

SEQ ID NO: 1207015 - RNA, 20 nt, Mycobacterium bovis subsp bovis AF2122/97
gcaacgcccaacgucgccag

SEQ ID NO: 1207016 - RNA, 23 nt, Mycobacterium bovis subsp bovis AF2122/97
gcaacgcccaacgucgccagguc

SEQ ID NO: 1207017 - RNA, 24 nt, Mycobacterium bovis subsp bovis AF2122/97
gcaacgcccaacgucgccagguca

SEQ ID NO: 1207018 - RNA, 21 nt, Mycobacterium bovis subsp bovis AF2122/97
gcaacggauuggugggccagc

SEQ ID NO: 1207019 - RNA, 20 nt, Mycobacterium bovis subsp bovis AF2122/97
gcaacggaggugccggcgcc

SEQ ID NO: 1207020 - RNA, 18 nt, Mycobacterium bovis subsp bovis AF2122/97
gcaacgcuucggcagcuc

SEQ ID NO: 1207021 - RNA, 19 nt, Mycobacterium bovis subsp bovis AF2122/97
gcaaccgggaggccaccgc

SEQ ID NO: 1207022 - RNA, 13 nt, Mycobacterium bovis subsp bovis AF2122/97
gcaaccgccgcca

SEQ ID NO: 1207023 - RNA, 15 nt, Mycobacterium bovis subsp bovis AF2122/97
gcaaccgccgccacc

SEQ ID NO: 1207024 - RNA, 20 nt, Mycobacterium bovis subsp bovis AF2122/97
gcaaccgugccgcaucaccc

SEQ ID NO: 1207025 - RNA, 18 nt, Mycobacterium bovis subsp bovis AF2122/97
gaucacacuggccugcuc

SEQ ID NO: 1207026 - RNA, 16 nt, Mycobacterium bovis subsp bovis AF2122/97
gcaaccgccccuuccc

SEQ ID NO: 1207027 - RNA, 20 nt, Mycobacterium bovis subsp bovis AF2122/97
gaucacauaggucacaaacg

SEQ ID NO: 1207028 - RNA, 19 nt, Mycobacterium bovis subsp bovis AF2122/97
gcaacgauuuuagcggcug

SEQ ID NO: 1207029 - RNA, 20 nt, Mycobacterium bovis subsp bovis AF2122/97
gcaacgaagccggcgccggc

SEQ ID NO: 1207030 - RNA, 17 nt, Mycobacterium bovis subsp bovis AF2122/97
gcaacgacccgccgccc

SEQ ID NO: 1207031 - RNA, 18 nt, Mycobacterium bovis subsp bovis AF2122/97
gcaacgaauagguucccu

SEQ ID NO: 1207032 - RNA, 15 nt, Mycobacterium bovis subsp bovis AF2122/97
gcaacgaagccggcg

SEQ ID NO: 1207033 - RNA, 13 nt, Mycobacterium bovis subsp bovis AF2122/97
gcaacgacacgcc

SEQ ID NO: 1207034 - RNA, 20 nt, Mycobacterium bovis subsp bovis AF2122/97
gcaaccuaaauugccgggcc

SEQ ID NO: 1207035 - RNA, 20 nt, Mycobacterium bovis subsp bovis AF2122/97
gcaaccugccgggccacggc

SEQ ID NO: 1207036 - RNA, 16 nt, Mycobacterium bovis subsp bovis AF2122/97
gcaaccuuuggccgcu

SEQ ID NO: 1207037 - RNA, 22 nt, Mycobacterium bovis subsp bovis AF2122/97
gcaauacggcggcgccgcccaa

SEQ ID NO: 1207038 - RNA, 21 nt, Mycobacterium bovis subsp bovis AF2122/97
gcaauacccgccgcgaugcca

SEQ ID NO: 1207039 - RNA, 15 nt, Mycobacterium bovis subsp bovis AF2122/97
gcaauaugccacaga

SEQ ID NO: 1207040 - RNA, 21 nt, Mycobacterium bovis subsp bovis AF2122/97
gcaauaucuuuagcgcgugcu

SEQ ID NO: 1207041 - RNA, 20 nt, Mycobacterium bovis subsp bovis AF2122/97
gcaauagccggguugccugc

SEQ ID NO: 1207042 - RNA, 14 nt, Mycobacterium bovis subsp bovis AF2122/97
gcaagucgaacgga

SEQ ID NO: 1207043 - RNA, 18 nt, Mycobacterium bovis subsp bovis AF2122/97
gcaagugaauaccccaga

SEQ ID NO: 1207044 - RNA, 18 nt, Mycobacterium bovis subsp bovis AF2122/97
gcaaguccugcagcuggc

SEQ ID NO: 1207045 - RNA, 12 nt, Mycobacterium bovis subsp bovis AF2122/97
gcaagguggcau

SEQ ID NO: 1207046 - RNA, 17 nt, Mycobacterium bovis subsp bovis AF2122/97
gcaagugugagcagacc

SEQ ID NO: 1207047 - RNA, 18 nt, Mycobacterium bovis subsp bovis AF2122/97
gcaaguugagcagcuugg

SEQ ID NO: 1207048 - RNA, 14 nt, Mycobacterium bovis subsp bovis AF2122/97
gcaaggucaacggg

SEQ ID NO: 1207049 - RNA, 18 nt, Mycobacterium bovis subsp bovis AF2122/97
gcaagcugagucgugaca

SEQ ID NO: 1207050 - RNA, 14 nt, Mycobacterium bovis subsp bovis AF2122/97
gcaagcugguaggu

SEQ ID NO: 1207051 - RNA, 13 nt, Mycobacterium bovis subsp bovis AF2122/97
gcaagcugaccgc

SEQ ID NO: 1207052 - RNA, 17 nt, Mycobacterium bovis subsp bovis AF2122/97
gcaaggacaagccgcug

SEQ ID NO: 1207053 - RNA, 12 nt, Mycobacterium bovis subsp bovis AF2122/97
gcaaggcccgca

SEQ ID NO: 1207054 - RNA, 20 nt, Mycobacterium bovis subsp bovis AF2122/97
gcaagcacaccgccagcggc

SEQ ID NO: 1207055 - RNA, 20 nt, Mycobacterium bovis subsp bovis AF2122/97
gcaagagccgcagccacguc

SEQ ID NO: 1207056 - RNA, 20 nt, Mycobacterium bovis subsp bovis AF2122/97
gcaagccaaccagcccggcc

SEQ ID NO: 1207057 - RNA, 21 nt, Mycobacterium bovis subsp bovis AF2122/97
gcaagccgacaucggcggccc

SEQ ID NO: 1207058 - RNA, 16 nt, Mycobacterium bovis subsp bovis AF2122/97
gcaagcgccgcgcuug

SEQ ID NO: 1207059 - RNA, 22 nt, Mycobacterium bovis subsp bovis AF2122/97
gcaagccguugcacggccggga

SEQ ID NO: 1207060 - RNA, 16 nt, Mycobacterium bovis subsp bovis AF2122/97
gcaagccucgugguga

SEQ ID NO: 1207061 - RNA, 20 nt, Mycobacterium bovis subsp bovis AF2122/97
gcaauccggucagcgcggcg

SEQ ID NO: 1207062 - RNA, 16 nt, Mycobacterium bovis subsp bovis AF2122/97
gcaaugaccugcagcg

SEQ ID NO: 1207063 - RNA, 23 nt, Mycobacterium bovis subsp bovis AF2122/97
gcaaugaccuggccgcccgcugc

SEQ ID NO: 1207064 - RNA, 23 nt, Mycobacterium bovis subsp bovis AF2122/97
gcaaugaccccggcguugccgcc

SEQ ID NO: 1207065 - RNA, 15 nt, Mycobacterium bovis subsp bovis AF2122/97
gcaaugaccugcagc

SEQ ID NO: 1207066 - RNA, 23 nt, Mycobacterium bovis subsp bovis AF2122/97
gcaaucccgcggucgaucaggcc

SEQ ID NO: 1207067 - RNA, 23 nt, Mycobacterium bovis subsp bovis AF2122/97
gcaauccgcaaaacgagcuucca

SEQ ID NO: 1207068 - RNA, 20 nt, Mycobacterium bovis subsp bovis AF2122/97
gcaaucccgccaucugccug

SEQ ID NO: 1207069 - RNA, 21 nt, Mycobacterium bovis subsp bovis AF2122/97
gcaauccaaggcucagcagcg

SEQ ID NO: 1207070 - RNA, 17 nt, Mycobacterium bovis subsp bovis AF2122/97
gcaaucaggaaccgcuc

SEQ ID NO: 1207071 - RNA, 20 nt, Mycobacterium bovis subsp bovis AF2122/97
gcaaucaacgucacccccuu

SEQ ID NO: 1207072 - RNA, 13 nt, Mycobacterium bovis subsp bovis AF2122/97
gcaaucagcuggu

SEQ ID NO: 1207073 - RNA, 16 nt, Mycobacterium bovis subsp bovis AF2122/97
gcaaucaggaaccgcu

SEQ ID NO: 1207074 - RNA, 12 nt, Mycobacterium bovis subsp bovis AF2122/97
gcaaucacauca

SEQ ID NO: 1207075 - RNA, 13 nt, Mycobacterium bovis subsp bovis AF2122/97
gcaauggcgcggu

SEQ ID NO: 1207076 - RNA, 16 nt, Mycobacterium bovis subsp bovis AF2122/97
gcaauggccagcacca

SEQ ID NO: 1207077 - RNA, 16 nt, Mycobacterium bovis subsp bovis AF2122/97
gcaauggcggccuugc

SEQ ID NO: 1207078 - RNA, 15 nt, Mycobacterium bovis subsp bovis AF2122/97
gcaaugcccgaccgg

SEQ ID NO: 1207079 - RNA, 20 nt, Mycobacterium bovis subsp bovis AF2122/97
gcaaugcggcccggguggcc

SEQ ID NO: 1207080 - RNA, 23 nt, Mycobacterium bovis subsp bovis AF2122/97
gcaaugucggcagggcccccagu

SEQ ID NO: 1207081 - RNA, 23 nt, Mycobacterium bovis subsp bovis AF2122/97
gcaauuucagccuuguugccgcc

SEQ ID NO: 1207082 - RNA, 18 nt, Mycobacterium bovis subsp bovis AF2122/97
gcacaaacauacgccacc

SEQ ID NO: 1207083 - RNA, 16 nt, Mycobacterium bovis subsp bovis AF2122/97
gcacaggaucacccac

SEQ ID NO: 1207084 - RNA, 21 nt, Mycobacterium bovis subsp bovis AF2122/97
gcacaggcauuuucacugugc

SEQ ID NO: 1207085 - RNA, 18 nt, Mycobacterium bovis subsp bovis AF2122/97
gcacaggcggccagcauc

SEQ ID NO: 1207086 - RNA, 15 nt, Mycobacterium bovis subsp bovis AF2122/97
gcacaggucagcgcu

SEQ ID NO: 1207087 - RNA, 15 nt, Mycobacterium bovis subsp bovis AF2122/97
gcacagguccggguu

SEQ ID NO: 1207088 - RNA, 22 nt, Mycobacterium bovis subsp bovis AF2122/97
gcacagguccggguuggccacc

SEQ ID NO: 1207089 - RNA, 19 nt, Mycobacterium bovis subsp bovis AF2122/97
gcacaggcggccagcaucg

SEQ ID NO: 1207090 - RNA, 14 nt, Mycobacterium bovis subsp bovis AF2122/97
gcacagugcggccc

SEQ ID NO: 1207091 - RNA, 18 nt, Mycobacterium bovis subsp bovis AF2122/97
gcacaggugccaaacgcc

SEQ ID NO: 1207092 - RNA, 14 nt, Mycobacterium bovis subsp bovis AF2122/97
gcacagcagcaacg

SEQ ID NO: 1207093 - RNA, 14 nt, Mycobacterium bovis subsp bovis AF2122/97
gcacagcagugaac

SEQ ID NO: 1207094 - RNA, 14 nt, Mycobacterium bovis subsp bovis AF2122/97
gcacagcgcagccu

SEQ ID NO: 1207095 - RNA, 21 nt, Mycobacterium bovis subsp bovis AF2122/97
gcacagccgcuuggcgcggcc

SEQ ID NO: 1207096 - RNA, 12 nt, Mycobacterium bovis subsp bovis AF2122/97
gcacagcccggc

SEQ ID NO: 1207097 - RNA, 13 nt, Mycobacterium bovis subsp bovis AF2122/97
gcacauaggcgau

SEQ ID NO: 1207098 - RNA, 15 nt, Mycobacterium bovis subsp bovis AF2122/97
gcacauaguccgagc

SEQ ID NO: 1207099 - RNA, 14 nt, Mycobacterium bovis subsp bovis AF2122/97
gcacauccugcagc

SEQ ID NO: 1207100 - RNA, 20 nt, Mycobacterium bovis subsp bovis AF2122/97
gcacaugcucgacgcccgcc

SEQ ID NO: 1207101 - RNA, 22 nt, Mycobacterium bovis subsp bovis AF2122/97
gcacaugcucgacgcccgccac

SEQ ID NO: 1207102 - RNA, 13 nt, Mycobacterium bovis subsp bovis AF2122/97
gcacaccggcuuu

SEQ ID NO: 1207103 - RNA, 13 nt, Mycobacterium bovis subsp bovis AF2122/97
gcacaccgcccgc

SEQ ID NO: 1207104 - RNA, 16 nt, Mycobacterium bovis subsp bovis AF2122/97
gcacaccgccagcggc

SEQ ID NO: 1207105 - RNA, 17 nt, Mycobacterium bovis subsp bovis AF2122/97
gcacaccgacgccgcca

SEQ ID NO: 1207106 - RNA, 21 nt, Mycobacterium bovis subsp bovis AF2122/97
gcacaccgaucggcaaaccgu

SEQ ID NO: 1207107 - RNA, 15 nt, Mycobacterium bovis subsp bovis AF2122/97
gcacaccugcgcggc

SEQ ID NO: 1207108 - RNA, 23 nt, Mycobacterium bovis subsp bovis AF2122/97
gcacaccugcgcggcgugcgcgg

SEQ ID NO: 1207109 - RNA, 17 nt, Mycobacterium bovis subsp bovis AF2122/97
gcacaccgguggcgccc

SEQ ID NO: 1207110 - RNA, 13 nt, Mycobacterium bovis subsp bovis AF2122/97
gcacaccgucguc

SEQ ID NO: 1207111 - RNA, 19 nt, Mycobacterium bovis subsp bovis AF2122/97
gcacaccgguggacccggc

SEQ ID NO: 1207112 - RNA, 18 nt, Mycobacterium bovis subsp bovis AF2122/97
gcacaccggcacugccca

SEQ ID NO: 1207113 - RNA, 17 nt, Mycobacterium bovis subsp bovis AF2122/97
gcacaccgacagcaccc

SEQ ID NO: 1207114 - RNA, 18 nt, Mycobacterium bovis subsp bovis AF2122/97
gcacaccgacagcaccca

SEQ ID NO: 1207115 - RNA, 16 nt, Mycobacterium bovis subsp bovis AF2122/97
gcacacccgguuggcc

SEQ ID NO: 1207116 - RNA, 22 nt, Mycobacterium bovis subsp bovis AF2122/97
gcacacccgucaugcccaccgc

SEQ ID NO: 1207117 - RNA, 11 nt, Mycobacterium bovis subsp bovis AF2122/97
gcacaccaccg

SEQ ID NO: 1207118 - RNA, 14 nt, Mycobacterium bovis subsp bovis AF2122/97
gcacacggccuugc

SEQ ID NO: 1207119 - RNA, 16 nt, Mycobacterium bovis subsp bovis AF2122/97
gcacacgcgugcacca

SEQ ID NO: 1207120 - RNA, 22 nt, Mycobacterium bovis subsp bovis AF2122/97
gcacacgcuuguacaagucgac

SEQ ID NO: 1207121 - RNA, 15 nt, Mycobacterium bovis subsp bovis AF2122/97
gcacacuccuagcca

SEQ ID NO: 1207122 - RNA, 15 nt, Mycobacterium bovis subsp bovis AF2122/97
gcacacuccugcacc

SEQ ID NO: 1207123 - RNA, 20 nt, Mycobacterium bovis subsp bovis AF2122/97
gcacaccaacaccgcggcgc

SEQ ID NO: 1207124 - RNA, 16 nt, Mycobacterium bovis subsp bovis AF2122/97
gcacaaucgguugcac

SEQ ID NO: 1207125 - RNA, 19 nt, Mycobacterium bovis subsp bovis AF2122/97
gcacaauacggucagcaga

SEQ ID NO: 1207126 - RNA, 20 nt, Mycobacterium bovis subsp bovis AF2122/97
gcacaagcuggggaacagca

SEQ ID NO: 1207127 - RNA, 22 nt, Mycobacterium bovis subsp bovis AF2122/97
gcacaaguucuucgacagcgcg

SEQ ID NO: 1207128 - RNA, 16 nt, Mycobacterium bovis subsp bovis AF2122/97
gcacaacgcccaccac

SEQ ID NO: 1207129 - RNA, 13 nt, Mycobacterium bovis subsp bovis AF2122/97
gcacaagcccagc

SEQ ID NO: 1207130 - RNA, 14 nt, Mycobacterium bovis subsp bovis AF2122/97
gcaccgccgguggc

SEQ ID NO: 1207131 - RNA, 23 nt, Mycobacterium bovis subsp bovis AF2122/97
gcaccgccgguggcgccggggcc

SEQ ID NO: 1207132 - RNA, 15 nt, Mycobacterium bovis subsp bovis AF2122/97
gcaccgccggcgccc

SEQ ID NO: 1207133 - RNA, 13 nt, Mycobacterium bovis subsp bovis AF2122/97
gcaccgccgcccc

SEQ ID NO: 1207134 - RNA, 17 nt, Mycobacterium bovis subsp bovis AF2122/97
gcaccgccgcgccggcg

SEQ ID NO: 1207135 - RNA, 12 nt, Mycobacterium bovis subsp bovis AF2122/97
gcaccgccgccc

SEQ ID NO: 1207136 - RNA, 15 nt, Mycobacterium bovis subsp bovis AF2122/97
gcaccgccgccgccc

SEQ ID NO: 1207137 - RNA, 14 nt, Mycobacterium bovis subsp bovis AF2122/97
gcaccgccgcgccg

SEQ ID NO: 1207138 - RNA, 17 nt, Mycobacterium bovis subsp bovis AF2122/97
gcaccgccacccugacc

SEQ ID NO: 1207139 - RNA, 14 nt, Mycobacterium bovis subsp bovis AF2122/97
gcaccgccagccac

SEQ ID NO: 1207140 - RNA, 16 nt, Mycobacterium bovis subsp bovis AF2122/97
gcaccgccagccacca

SEQ ID NO: 1207141 - RNA, 20 nt, Mycobacterium bovis subsp bovis AF2122/97
gcaccgcgguacgccggucg

SEQ ID NO: 1207142 - RNA, 18 nt, Mycobacterium bovis subsp bovis AF2122/97
gcaccgcgguacgccggu

SEQ ID NO: 1207143 - RNA, 20 nt, Mycobacterium bovis subsp bovis AF2122/97
gcaccgcugaccccggcagc

SEQ ID NO: 1207144 - RNA, 24 nt, Mycobacterium bovis subsp bovis AF2122/97
gcaccgcugaccccggcagcgccc

SEQ ID NO: 1207145 - RNA, 18 nt, Mycobacterium bovis subsp bovis AF2122/97
gcaccgcugccgcugccg

SEQ ID NO: 1207146 - RNA, 14 nt, Mycobacterium bovis subsp bovis AF2122/97
gcaccgcuguugca

SEQ ID NO: 1207147 - RNA, 14 nt, Mycobacterium bovis subsp bovis AF2122/97
gcaccgcggccagc

SEQ ID NO: 1207148 - RNA, 16 nt, Mycobacterium bovis subsp bovis AF2122/97
gcaccgcgccgcgccg

SEQ ID NO: 1207149 - RNA, 14 nt, Mycobacterium bovis subsp bovis AF2122/97
gcaccgcgccggcg

SEQ ID NO: 1207150 - RNA, 14 nt, Mycobacterium bovis subsp bovis AF2122/97
gcaccgcgccgcgc

SEQ ID NO: 1207151 - RNA, 18 nt, Mycobacterium bovis subsp bovis AF2122/97
gcaccgcgaacauggugc

SEQ ID NO: 1207152 - RNA, 18 nt, Mycobacterium bovis subsp bovis AF2122/97
gcaccgccugcgccgccc

SEQ ID NO: 1207153 - RNA, 16 nt, Mycobacterium bovis subsp bovis AF2122/97
gcaccgccugcgccuu

SEQ ID NO: 1207154 - RNA, 21 nt, Mycobacterium bovis subsp bovis AF2122/97
gcaccgacgucggcuucaccu

SEQ ID NO: 1207155 - RNA, 18 nt, Mycobacterium bovis subsp bovis AF2122/97
gcaccgacuucagcaacg

SEQ ID NO: 1207156 - RNA, 16 nt, Mycobacterium bovis subsp bovis AF2122/97
gcaccgagcugagcgg

SEQ ID NO: 1207157 - RNA, 17 nt, Mycobacterium bovis subsp bovis AF2122/97
gcaccgagcugagcggc

SEQ ID NO: 1207158 - RNA, 18 nt, Mycobacterium bovis subsp bovis AF2122/97
gcaccgagcugagcggcc

SEQ ID NO: 1207159 - RNA, 14 nt, Mycobacterium bovis subsp bovis AF2122/97
gcaccgacggcgca

SEQ ID NO: 1207160 - RNA, 19 nt, Mycobacterium bovis subsp bovis AF2122/97
gcaccgacaucgucaucca

SEQ ID NO: 1207161 - RNA, 15 nt, Mycobacterium bovis subsp bovis AF2122/97
gcaccgaccgcaccg

SEQ ID NO: 1207162 - RNA, 14 nt, Mycobacterium bovis subsp bovis AF2122/97
gcaccgcacggagg

SEQ ID NO: 1207163 - RNA, 16 nt, Mycobacterium bovis subsp bovis AF2122/97
gcaccgauggcgcacc

SEQ ID NO: 1207164 - RNA, 18 nt, Mycobacterium bovis subsp bovis AF2122/97
gcaccgaugccgaagccc

SEQ ID NO: 1207165 - RNA, 19 nt, Mycobacterium bovis subsp bovis AF2122/97
gcaccgaugccgaagcccc

SEQ ID NO: 1207166 - RNA, 20 nt, Mycobacterium bovis subsp bovis AF2122/97
gcaccgaugccgaagccccc

SEQ ID NO: 1207167 - RNA, 18 nt, Mycobacterium bovis subsp bovis AF2122/97
gcaccgaggccgccgaga

SEQ ID NO: 1207168 - RNA, 16 nt, Mycobacterium bovis subsp bovis AF2122/97
gcaccgaggccgccga

SEQ ID NO: 1207169 - RNA, 17 nt, Mycobacterium bovis subsp bovis AF2122/97
gcacccggggggccucg

SEQ ID NO: 1207170 - RNA, 13 nt, Mycobacterium bovis subsp bovis AF2122/97
gcacccggggugc

SEQ ID NO: 1207171 - RNA, 17 nt, Mycobacterium bovis subsp bovis AF2122/97
gcacccggggugcccgg

SEQ ID NO: 1207172 - RNA, 18 nt, Mycobacterium bovis subsp bovis AF2122/97
gcacccggcuguucucgc

SEQ ID NO: 1207173 - RNA, 20 nt, Mycobacterium bovis subsp bovis AF2122/97
gcacccggugagaagaagcc

SEQ ID NO: 1207174 - RNA, 21 nt, Mycobacterium bovis subsp bovis AF2122/97
gcacccgguugugcgcgcgcc

SEQ ID NO: 1207175 - RNA, 22 nt, Mycobacterium bovis subsp bovis AF2122/97
gcacccgguugugcgcgcgccc

SEQ ID NO: 1207176 - RNA, 20 nt, Mycobacterium bovis subsp bovis AF2122/97
gcacccgucacaagcugaca

SEQ ID NO: 1207177 - RNA, 15 nt, Mycobacterium bovis subsp bovis AF2122/97
gcacccugcggcacc

SEQ ID NO: 1207178 - RNA, 24 nt, Mycobacterium bovis subsp bovis AF2122/97
gcacccugcgggccgagaucacgc

SEQ ID NO: 1207179 - RNA, 23 nt, Mycobacterium bovis subsp bovis AF2122/97
gcacccguucgugagcggccagg

SEQ ID NO: 1207180 - RNA, 21 nt, Mycobacterium bovis subsp bovis AF2122/97
gcacccggugagaagaagccc

SEQ ID NO: 1207181 - RNA, 21 nt, Mycobacterium bovis subsp bovis AF2122/97
gcaccgacagcccgaacgagg

SEQ ID NO: 1207182 - RNA, 19 nt, Mycobacterium bovis subsp bovis AF2122/97
gcaccgaacccgccaccgc

SEQ ID NO: 1207183 - RNA, 20 nt, Mycobacterium bovis subsp bovis AF2122/97
gcaccgaagauggccagcgc

SEQ ID NO: 1207184 - RNA, 16 nt, Mycobacterium bovis subsp bovis AF2122/97
gcaccgaagauggcca

SEQ ID NO: 1207185 - RNA, 17 nt, Mycobacterium bovis subsp bovis AF2122/97
gcaccgaagauggccag

SEQ ID NO: 1207186 - RNA, 23 nt, Mycobacterium bovis subsp bovis AF2122/97
gcaccgaaaaacaccagcgaggc

SEQ ID NO: 1207187 - RNA, 17 nt, Mycobacterium bovis subsp bovis AF2122/97
gcaccgaacccgccacc

SEQ ID NO: 1207188 - RNA, 18 nt, Mycobacterium bovis subsp bovis AF2122/97
gcaccgggaugugcggcu

SEQ ID NO: 1207189 - RNA, 11 nt, Mycobacterium bovis subsp bovis AF2122/97
gcaccggggcu

SEQ ID NO: 1207190 - RNA, 19 nt, Mycobacterium bovis subsp bovis AF2122/97
gcaccggggugugcgggcg

SEQ ID NO: 1207191 - RNA, 15 nt, Mycobacterium bovis subsp bovis AF2122/97
gcaccggugacgcac

SEQ ID NO: 1207192 - RNA, 18 nt, Mycobacterium bovis subsp bovis AF2122/97
gcaccggugacgcacagc

SEQ ID NO: 1207193 - RNA, 21 nt, Mycobacterium bovis subsp bovis AF2122/97
gcaccggugacgcacagcagc

SEQ ID NO: 1207194 - RNA, 17 nt, Mycobacterium bovis subsp bovis AF2122/97
gcaccggugcccaccac

SEQ ID NO: 1207195 - RNA, 16 nt, Mycobacterium bovis subsp bovis AF2122/97
gcaccgucgcggguca

SEQ ID NO: 1207196 - RNA, 20 nt, Mycobacterium bovis subsp bovis AF2122/97
gcaccgucggcaccagcagc

SEQ ID NO: 1207197 - RNA, 23 nt, Mycobacterium bovis subsp bovis AF2122/97
gcaccgguuugacguccagggcc

SEQ ID NO: 1207198 - RNA, 18 nt, Mycobacterium bovis subsp bovis AF2122/97
gcaccgguuuucgccggc

SEQ ID NO: 1207199 - RNA, 16 nt, Mycobacterium bovis subsp bovis AF2122/97
gcaccggcuugggcca

SEQ ID NO: 1207200 - RNA, 21 nt, Mycobacterium bovis subsp bovis AF2122/97
gcaccggcuugggccaggccc

SEQ ID NO: 1207201 - RNA, 22 nt, Mycobacterium bovis subsp bovis AF2122/97
gcaccggcgcgggcacgcccuc

SEQ ID NO: 1207202 - RNA, 17 nt, Mycobacterium bovis subsp bovis AF2122/97
gcaccggcucgacugcc

SEQ ID NO: 1207203 - RNA, 14 nt, Mycobacterium bovis subsp bovis AF2122/97
gcaccggccgugcc

SEQ ID NO: 1207204 - RNA, 19 nt, Mycobacterium bovis subsp bovis AF2122/97
gcaccggccgugccgccga

SEQ ID NO: 1207205 - RNA, 18 nt, Mycobacterium bovis subsp bovis AF2122/97
gcaccgcuucaggcgcca

SEQ ID NO: 1207206 - RNA, 21 nt, Mycobacterium bovis subsp bovis AF2122/97
gcaccggagucgcccgguccg

SEQ ID NO: 1207207 - RNA, 12 nt, Mycobacterium bovis subsp bovis AF2122/97
gcaccuggcgcg

SEQ ID NO: 1207208 - RNA, 18 nt, Mycobacterium bovis subsp bovis AF2122/97
gcaccugggcgcgcuggc

SEQ ID NO: 1207209 - RNA, 15 nt, Mycobacterium bovis subsp bovis AF2122/97
gcaccugcgcgcggc

SEQ ID NO: 1207210 - RNA, 16 nt, Mycobacterium bovis subsp bovis AF2122/97
gcaccugccguuccgg

SEQ ID NO: 1207211 - RNA, 15 nt, Mycobacterium bovis subsp bovis AF2122/97
gcaccucggccagcu

SEQ ID NO: 1207212 - RNA, 14 nt, Mycobacterium bovis subsp bovis AF2122/97
gcaccucgcccugc

SEQ ID NO: 1207213 - RNA, 14 nt, Mycobacterium bovis subsp bovis AF2122/97
gcaccucgaaggcc

SEQ ID NO: 1207214 - RNA, 17 nt, Mycobacterium bovis subsp bovis AF2122/97
gcaccucgaccgccaac

SEQ ID NO: 1207215 - RNA, 14 nt, Mycobacterium bovis subsp bovis AF2122/97
gcaccucccgggcg

SEQ ID NO: 1207216 - RNA, 18 nt, Mycobacterium bovis subsp bovis AF2122/97
gcaccuccagcaccaccg

SEQ ID NO: 1207217 - RNA, 18 nt, Mycobacterium bovis subsp bovis AF2122/97
gcaccgucgggcccagcc

SEQ ID NO: 1207218 - RNA, 21 nt, Mycobacterium bovis subsp bovis AF2122/97
gcaccgugcggggggcagcuc

SEQ ID NO: 1207219 - RNA, 16 nt, Mycobacterium bovis subsp bovis AF2122/97
gcaccgugugggcccc

SEQ ID NO: 1207220 - RNA, 23 nt, Mycobacterium bovis subsp bovis AF2122/97
gcaccgucgggcccagccggacc

SEQ ID NO: 1207221 - RNA, 22 nt, Mycobacterium bovis subsp bovis AF2122/97
gcaccguuaccgccgucgccac

SEQ ID NO: 1207222 - RNA, 13 nt, Mycobacterium bovis subsp bovis AF2122/97
gcacccccugcac

SEQ ID NO: 1207223 - RNA, 15 nt, Mycobacterium bovis subsp bovis AF2122/97
gcaccccauggccac

SEQ ID NO: 1207224 - RNA, 13 nt, Mycobacterium bovis subsp bovis AF2122/97
gcaccccacggcc

SEQ ID NO: 1207225 - RNA, 17 nt, Mycobacterium bovis subsp bovis AF2122/97
gcacccagacgauggcc

SEQ ID NO: 1207226 - RNA, 17 nt, Mycobacterium bovis subsp bovis AF2122/97
gcacccagucggcgccg

SEQ ID NO: 1207227 - RNA, 21 nt, Mycobacterium bovis subsp bovis AF2122/97
gcacccagggcguuggcggcu

SEQ ID NO: 1207228 - RNA, 22 nt, Mycobacterium bovis subsp bovis AF2122/97
gcacccaucccguucagcgacc

SEQ ID NO: 1207229 - RNA, 23 nt, Mycobacterium bovis subsp bovis AF2122/97
gcacccaucccguucagcgacca

SEQ ID NO: 1207230 - RNA, 18 nt, Mycobacterium bovis subsp bovis AF2122/97
gcacccgagccgcacagc

SEQ ID NO: 1207231 - RNA, 19 nt, Mycobacterium bovis subsp bovis AF2122/97
gcacccgaguuauagaagc

SEQ ID NO: 1207232 - RNA, 23 nt, Mycobacterium bovis subsp bovis AF2122/97
gcacccgauaguucuggcccgca

SEQ ID NO: 1207233 - RNA, 20 nt, Mycobacterium bovis subsp bovis AF2122/97
gcaccccuuugacgccgagc

SEQ ID NO: 1207234 - RNA, 16 nt, Mycobacterium bovis subsp bovis AF2122/97
gcacccgaauagccag

SEQ ID NO: 1207235 - RNA, 20 nt, Mycobacterium bovis subsp bovis AF2122/97
gcacccgaauagccagcguc

SEQ ID NO: 1207236 - RNA, 19 nt, Mycobacterium bovis subsp bovis AF2122/97
gcaccccgccgggggcacc

SEQ ID NO: 1207237 - RNA, 14 nt, Mycobacterium bovis subsp bovis AF2122/97
gcacccgcgccagu

SEQ ID NO: 1207238 - RNA, 22 nt, Mycobacterium bovis subsp bovis AF2122/97
gcacccgcgcgacgccguccuc

SEQ ID NO: 1207239 - RNA, 14 nt, Mycobacterium bovis subsp bovis AF2122/97
gcacccgcucggcc

SEQ ID NO: 1207240 - RNA, 19 nt, Mycobacterium bovis subsp bovis AF2122/97
gcacccgcuccagcucggc

SEQ ID NO: 1207241 - RNA, 20 nt, Mycobacterium bovis subsp bovis AF2122/97
gcacccgccgugcccccggc

SEQ ID NO: 1207242 - RNA, 13 nt, Mycobacterium bovis subsp bovis AF2122/97
gcacccggccacc

SEQ ID NO: 1207243 - RNA, 23 nt, Mycobacterium bovis subsp bovis AF2122/97
gcacccgggccugggacggcggc

SEQ ID NO: 1207244 - RNA, 14 nt, Mycobacterium bovis subsp bovis AF2122/97
gcacccggccgcgc

SEQ ID NO: 1207245 - RNA, 23 nt, Mycobacterium bovis subsp bovis AF2122/97
gcacccggcagagcacgcgcggc

SEQ ID NO: 1207246 - RNA, 12 nt, Mycobacterium bovis subsp bovis AF2122/97
gcacccgcuggc

SEQ ID NO: 1207247 - RNA, 13 nt, Mycobacterium bovis subsp bovis AF2122/97
gcacccgcugguc

SEQ ID NO: 1207248 - RNA, 24 nt, Mycobacterium bovis subsp bovis AF2122/97
gcacccgcuggucgagcagugccu

SEQ ID NO: 1207249 - RNA, 15 nt, Mycobacterium bovis subsp bovis AF2122/97
gcacccgcugcacgc

SEQ ID NO: 1207250 - RNA, 19 nt, Mycobacterium bovis subsp bovis AF2122/97
gcacccgcucggccgccgg

SEQ ID NO: 1207251 - RNA, 21 nt, Mycobacterium bovis subsp bovis AF2122/97
gcacccgcucggcgcgcgggu

SEQ ID NO: 1207252 - RNA, 21 nt, Mycobacterium bovis subsp bovis AF2122/97
gcacccggaucuggugggugc

SEQ ID NO: 1207253 - RNA, 19 nt, Mycobacterium bovis subsp bovis AF2122/97
gcacccacuuuucgguggc

SEQ ID NO: 1207254 - RNA, 22 nt, Mycobacterium bovis subsp bovis AF2122/97
gcacccacuuuucgguggcggc

SEQ ID NO: 1207255 - RNA, 12 nt, Mycobacterium bovis subsp bovis AF2122/97
gcacccagaccg

SEQ ID NO: 1207256 - RNA, 16 nt, Mycobacterium bovis subsp bovis AF2122/97
gcacccaacuccauca

SEQ ID NO: 1207257 - RNA, 23 nt, Mycobacterium bovis subsp bovis AF2122/97
gcacccaauacacccaacucaug

SEQ ID NO: 1207258 - RNA, 15 nt, Mycobacterium bovis subsp bovis AF2122/97
gcacccaaugccacc

SEQ ID NO: 1207259 - RNA, 15 nt, Mycobacterium bovis subsp bovis AF2122/97
gcacccacaucagcc

SEQ ID NO: 1207260 - RNA, 17 nt, Mycobacterium bovis subsp bovis AF2122/97
gcacccacaucagccgc

SEQ ID NO: 1207261 - RNA, 21 nt, Mycobacterium bovis subsp bovis AF2122/97
gcaccaugggucuggcaggcc

SEQ ID NO: 1207262 - RNA, 15 nt, Mycobacterium bovis subsp bovis AF2122/97
gcacccaaccaggcc

SEQ ID NO: 1207263 - RNA, 19 nt, Mycobacterium bovis subsp bovis AF2122/97
gcaccauuguuccgucccc

SEQ ID NO: 1207264 - RNA, 14 nt, Mycobacterium bovis subsp bovis AF2122/97
gcaccauccggucc

SEQ ID NO: 1207265 - RNA, 20 nt, Mycobacterium bovis subsp bovis AF2122/97
gcaccauccggucccgccgu

SEQ ID NO: 1207266 - RNA, 14 nt, Mycobacterium bovis subsp bovis AF2122/97
gcaccaucggcgag

SEQ ID NO: 1207267 - RNA, 17 nt, Mycobacterium bovis subsp bovis AF2122/97
gcaccagguugcaaccu

SEQ ID NO: 1207268 - RNA, 12 nt, Mycobacterium bovis subsp bovis AF2122/97
gcaccagccggu

SEQ ID NO: 1207269 - RNA, 13 nt, Mycobacterium bovis subsp bovis AF2122/97
gcaccagccagcc

SEQ ID NO: 1207270 - RNA, 12 nt, Mycobacterium bovis subsp bovis AF2122/97
gcaccagcggca

SEQ ID NO: 1207271 - RNA, 22 nt, Mycobacterium bovis subsp bovis AF2122/97
gcaccagcggcugaccgggcag

SEQ ID NO: 1207272 - RNA, 16 nt, Mycobacterium bovis subsp bovis AF2122/97
gcaccagcggcugacc

SEQ ID NO: 1207273 - RNA, 19 nt, Mycobacterium bovis subsp bovis AF2122/97
gcaccagcgcgcgccgagc

SEQ ID NO: 1207274 - RNA, 19 nt, Mycobacterium bovis subsp bovis AF2122/97
gcaccagcucacccggagc

SEQ ID NO: 1207275 - RNA, 23 nt, Mycobacterium bovis subsp bovis AF2122/97
gcaccagcucacccggagcaccc

SEQ ID NO: 1207276 - RNA, 20 nt, Mycobacterium bovis subsp bovis AF2122/97
gcaccagcugucgggcagcu

SEQ ID NO: 1207277 - RNA, 20 nt, Mycobacterium bovis subsp bovis AF2122/97
gcaccagccaaaucagccag

SEQ ID NO: 1207278 - RNA, 18 nt, Mycobacterium bovis subsp bovis AF2122/97
gcaccagcagccagccca

SEQ ID NO: 1207279 - RNA, 15 nt, Mycobacterium bovis subsp bovis AF2122/97
gcaccagcacacccg

SEQ ID NO: 1207280 - RNA, 20 nt, Mycobacterium bovis subsp bovis AF2122/97
gcaccagagugguguucucc

SEQ ID NO: 1207281 - RNA, 21 nt, Mycobacterium bovis subsp bovis AF2122/97
gcaccagaucuucgagcgcau

SEQ ID NO: 1207282 - RNA, 13 nt, Mycobacterium bovis subsp bovis AF2122/97
gcaccacggcggc

SEQ ID NO: 1207283 - RNA, 17 nt, Mycobacterium bovis subsp bovis AF2122/97
gcaccacggcggccacc

SEQ ID NO: 1207284 - RNA, 20 nt, Mycobacterium bovis subsp bovis AF2122/97
gcaccaccccagcggccacc

SEQ ID NO: 1207285 - RNA, 19 nt, Mycobacterium bovis subsp bovis AF2122/97
gcaccaccacccgauccac

SEQ ID NO: 1207286 - RNA, 22 nt, Mycobacterium bovis subsp bovis AF2122/97
gcaccacauccaucuccauguu

SEQ ID NO: 1207287 - RNA, 20 nt, Mycobacterium bovis subsp bovis AF2122/97
gcaccaccacgugaucagau

SEQ ID NO: 1207288 - RNA, 16 nt, Mycobacterium bovis subsp bovis AF2122/97
gcaccaccgcggcggc

SEQ ID NO: 1207289 - RNA, 14 nt, Mycobacterium bovis subsp bovis AF2122/97
gcaccaccggcccc

SEQ ID NO: 1207290 - RNA, 16 nt, Mycobacterium bovis subsp bovis AF2122/97
gcaccaccggccccac

SEQ ID NO: 1207291 - RNA, 17 nt, Mycobacterium bovis subsp bovis AF2122/97
gcaccaccggccccacc

SEQ ID NO: 1207292 - RNA, 14 nt, Mycobacterium bovis subsp bovis AF2122/97
gcaccacgagcagc

SEQ ID NO: 1207293 - RNA, 15 nt, Mycobacterium bovis subsp bovis AF2122/97
gcaccacgagcagcc

SEQ ID NO: 1207294 - RNA, 17 nt, Mycobacterium bovis subsp bovis AF2122/97
gcaccaccugggcggca

SEQ ID NO: 1207295 - RNA, 19 nt, Mycobacterium bovis subsp bovis AF2122/97
gcaccaccacaccggagcc

SEQ ID NO: 1207296 - RNA, 23 nt, Mycobacterium bovis subsp bovis AF2122/97
gcaccacauuggcgaucagcagc

SEQ ID NO: 1207297 - RNA, 14 nt, Mycobacterium bovis subsp bovis AF2122/97
gcaccacagugcca

SEQ ID NO: 1207298 - RNA, 21 nt, Mycobacterium bovis subsp bovis AF2122/97
gcaccacaccgugggcgacgg

SEQ ID NO: 1207299 - RNA, 19 nt, Mycobacterium bovis subsp bovis AF2122/97
gcaccacaccacgguggcc

SEQ ID NO: 1207300 - RNA, 20 nt, Mycobacterium bovis subsp bovis AF2122/97
gcaccacaaacaccccacac

SEQ ID NO: 1207301 - RNA, 22 nt, Mycobacterium bovis subsp bovis AF2122/97
gcaccacaaacaccccacacag

SEQ ID NO: 1207302 - RNA, 14 nt, Mycobacterium bovis subsp bovis AF2122/97
gcaccacaauccac

SEQ ID NO: 1207303 - RNA, 19 nt, Mycobacterium bovis subsp bovis AF2122/97
gcaccacaauccacgcacu

SEQ ID NO: 1207304 - RNA, 18 nt, Mycobacterium bovis subsp bovis AF2122/97
gcaccacaccacgguggc

SEQ ID NO: 1207305 - RNA, 14 nt, Mycobacterium bovis subsp bovis AF2122/97
gcaccaacgccacc

SEQ ID NO: 1207306 - RNA, 16 nt, Mycobacterium bovis subsp bovis AF2122/97
gcaccaagacgccacc

SEQ ID NO: 1207307 - RNA, 21 nt, Mycobacterium bovis subsp bovis AF2122/97
gcaccaaggccgccugcaaca

SEQ ID NO: 1207308 - RNA, 19 nt, Mycobacterium bovis subsp bovis AF2122/97
gcaccaagcagcgaccagc

SEQ ID NO: 1207309 - RNA, 19 nt, Mycobacterium bovis subsp bovis AF2122/97
gcacgccgaccggcccgca

SEQ ID NO: 1207310 - RNA, 17 nt, Mycobacterium bovis subsp bovis AF2122/97
gcacgccgaccgguggc

SEQ ID NO: 1207311 - RNA, 19 nt, Mycobacterium bovis subsp bovis AF2122/97
gcacgccgaccgguggcac

SEQ ID NO: 1207312 - RNA, 21 nt, Mycobacterium bovis subsp bovis AF2122/97
gcacgccgaccgguggcaccg

SEQ ID NO: 1207313 - RNA, 15 nt, Mycobacterium bovis subsp bovis AF2122/97
gcacgccgcgugccg

SEQ ID NO: 1207314 - RNA, 16 nt, Mycobacterium bovis subsp bovis AF2122/97
gcacgccggcaugcca

SEQ ID NO: 1207315 - RNA, 14 nt, Mycobacterium bovis subsp bovis AF2122/97
gcacgccgccggcc

SEQ ID NO: 1207316 - RNA, 12 nt, Mycobacterium bovis subsp bovis AF2122/97
gcacgcccggcg

SEQ ID NO: 1207317 - RNA, 15 nt, Mycobacterium bovis subsp bovis AF2122/97
gcacgcccacagcug

SEQ ID NO: 1207318 - RNA, 16 nt, Mycobacterium bovis subsp bovis AF2122/97
gcacgccaccgggacg

SEQ ID NO: 1207319 - RNA, 14 nt, Mycobacterium bovis subsp bovis AF2122/97
gcacgccagcccca

SEQ ID NO: 1207320 - RNA, 17 nt, Mycobacterium bovis subsp bovis AF2122/97
gcacgcaccacaaucca

SEQ ID NO: 1207321 - RNA, 14 nt, Mycobacterium bovis subsp bovis AF2122/97
gcacgcagagccaa

SEQ ID NO: 1207322 - RNA, 20 nt, Mycobacterium bovis subsp bovis AF2122/97
gcacgcaaugucggcagggc

SEQ ID NO: 1207323 - RNA, 18 nt, Mycobacterium bovis subsp bovis AF2122/97
gcacgauggugugcagca

SEQ ID NO: 1207324 - RNA, 13 nt, Mycobacterium bovis subsp bovis AF2122/97
gcacgauccgcac

SEQ ID NO: 1207325 - RNA, 23 nt, Mycobacterium bovis subsp bovis AF2122/97
gcacgauccgcacccggccgcgc

SEQ ID NO: 1207326 - RNA, 15 nt, Mycobacterium bovis subsp bovis AF2122/97
gcacgauccagcugu

SEQ ID NO: 1207327 - RNA, 14 nt, Mycobacterium bovis subsp bovis AF2122/97
gcacgauccagcug

SEQ ID NO: 1207328 - RNA, 18 nt, Mycobacterium bovis subsp bovis AF2122/97
gcacgacgcgacacgccg

SEQ ID NO: 1207329 - RNA, 23 nt, Mycobacterium bovis subsp bovis AF2122/97
gcacgaaauugggcgauucugcg

SEQ ID NO: 1207330 - RNA, 20 nt, Mycobacterium bovis subsp bovis AF2122/97
gcacgacccgggaaggaacc

SEQ ID NO: 1207331 - RNA, 12 nt, Mycobacterium bovis subsp bovis AF2122/97
gcacgacccggg

SEQ ID NO: 1207332 - RNA, 17 nt, Mycobacterium bovis subsp bovis AF2122/97
gcacgacccgggaagga

SEQ ID NO: 1207333 - RNA, 21 nt, Mycobacterium bovis subsp bovis AF2122/97
gcacgacaccucgaaggcacu

SEQ ID NO: 1207334 - RNA, 16 nt, Mycobacterium bovis subsp bovis AF2122/97
gcacgacgggggagca

SEQ ID NO: 1207335 - RNA, 19 nt, Mycobacterium bovis subsp bovis AF2122/97
gcacgacgacaaccggcca

SEQ ID NO: 1207336 - RNA, 23 nt, Mycobacterium bovis subsp bovis AF2122/97
gcacgaccugguuauucgacucg

SEQ ID NO: 1207337 - RNA, 16 nt, Mycobacterium bovis subsp bovis AF2122/97
gcacgacgccggccug

SEQ ID NO: 1207338 - RNA, 22 nt, Mycobacterium bovis subsp bovis AF2122/97
gcacgacgccggccuggccgcc

SEQ ID NO: 1207339 - RNA, 16 nt, Mycobacterium bovis subsp bovis AF2122/97
gcacgcuggcgggcac

SEQ ID NO: 1207340 - RNA, 19 nt, Mycobacterium bovis subsp bovis AF2122/97
gcacggaaggcccggcgcg

SEQ ID NO: 1207341 - RNA, 20 nt, Mycobacterium bovis subsp bovis AF2122/97
gcacggaaggucgacauggg

SEQ ID NO: 1207342 - RNA, 15 nt, Mycobacterium bovis subsp bovis AF2122/97
gcacggagccgccgg

SEQ ID NO: 1207343 - RNA, 23 nt, Mycobacterium bovis subsp bovis AF2122/97
gcacggaaucgcaucuagguuca

SEQ ID NO: 1207344 - RNA, 20 nt, Mycobacterium bovis subsp bovis AF2122/97
gcacggacaguuccccgggc

SEQ ID NO: 1207345 - RNA, 14 nt, Mycobacterium bovis subsp bovis AF2122/97
gcacgcucgcgcac

SEQ ID NO: 1207346 - RNA, 14 nt, Mycobacterium bovis subsp bovis AF2122/97
gcacgcucguuugg

SEQ ID NO: 1207347 - RNA, 14 nt, Mycobacterium bovis subsp bovis AF2122/97
gcacgcucugcgcc

SEQ ID NO: 1207348 - RNA, 21 nt, Mycobacterium bovis subsp bovis AF2122/97
gcacgcugagcguccgacaac

SEQ ID NO: 1207349 - RNA, 22 nt, Mycobacterium bovis subsp bovis AF2122/97
gcacgcugaguccccagguggg

SEQ ID NO: 1207350 - RNA, 18 nt, Mycobacterium bovis subsp bovis AF2122/97
gcacgcgguucaccacgu

SEQ ID NO: 1207351 - RNA, 23 nt, Mycobacterium bovis subsp bovis AF2122/97
gcacgcgggagguacccccagca

SEQ ID NO: 1207352 - RNA, 20 nt, Mycobacterium bovis subsp bovis AF2122/97
gcacgcgcgcaggccgccgc

SEQ ID NO: 1207353 - RNA, 22 nt, Mycobacterium bovis subsp bovis AF2122/97
gcacgcgcgcaggccgccgcca

SEQ ID NO: 1207354 - RNA, 14 nt, Mycobacterium bovis subsp bovis AF2122/97
gcacgcgcgcgacc

SEQ ID NO: 1207355 - RNA, 19 nt, Mycobacterium bovis subsp bovis AF2122/97
gcacgcgcaguuuggcggc

SEQ ID NO: 1207356 - RNA, 21 nt, Mycobacterium bovis subsp bovis AF2122/97
gcacgcgcaguuuggcggcgc

SEQ ID NO: 1207357 - RNA, 22 nt, Mycobacterium bovis subsp bovis AF2122/97
gcacgcggacaugacagccccg

SEQ ID NO: 1207358 - RNA, 19 nt, Mycobacterium bovis subsp bovis AF2122/97
gcacgggaaucgcucgcgc

SEQ ID NO: 1207359 - RNA, 17 nt, Mycobacterium bovis subsp bovis AF2122/97
gcacggcgaggugcucg

SEQ ID NO: 1207360 - RNA, 18 nt, Mycobacterium bovis subsp bovis AF2122/97
gcacggcuucggcgagcg

SEQ ID NO: 1207361 - RNA, 20 nt, Mycobacterium bovis subsp bovis AF2122/97
gcacggcuucggcgagcgca

SEQ ID NO: 1207362 - RNA, 14 nt, Mycobacterium bovis subsp bovis AF2122/97
gcacggcgccgcca

SEQ ID NO: 1207363 - RNA, 13 nt, Mycobacterium bovis subsp bovis AF2122/97
gcacggcgcgcca

SEQ ID NO: 1207364 - RNA, 13 nt, Mycobacterium bovis subsp bovis AF2122/97
gcacggcgcggcg

SEQ ID NO: 1207365 - RNA, 22 nt, Mycobacterium bovis subsp bovis AF2122/97
gcacggccaccgcgcaacccgg

SEQ ID NO: 1207366 - RNA, 14 nt, Mycobacterium bovis subsp bovis AF2122/97
gcacggccccugcc

SEQ ID NO: 1207367 - RNA, 18 nt, Mycobacterium bovis subsp bovis AF2122/97
gcacggccccugccacga

SEQ ID NO: 1207368 - RNA, 13 nt, Mycobacterium bovis subsp bovis AF2122/97
gcacggccgggac

SEQ ID NO: 1207369 - RNA, 16 nt, Mycobacterium bovis subsp bovis AF2122/97
gcacggugcccagggc

SEQ ID NO: 1207370 - RNA, 15 nt, Mycobacterium bovis subsp bovis AF2122/97
gcacggugcccaggg

SEQ ID NO: 1207371 - RNA, 18 nt, Mycobacterium bovis subsp bovis AF2122/97
gcacggugaucagcagca

SEQ ID NO: 1207372 - RNA, 20 nt, Mycobacterium bovis subsp bovis AF2122/97
gcacgggucgucaugccagu

SEQ ID NO: 1207373 - RNA, 12 nt, Mycobacterium bovis subsp bovis AF2122/97
gcacgguggcaa

SEQ ID NO: 1207374 - RNA, 20 nt, Mycobacterium bovis subsp bovis AF2122/97
gcacgguggcuucgacggcg

SEQ ID NO: 1207375 - RNA, 23 nt, Mycobacterium bovis subsp bovis AF2122/97
gcacgguggcuucgacggcggcc

SEQ ID NO: 1207376 - RNA, 22 nt, Mycobacterium bovis subsp bovis AF2122/97
gcacguaacgccgcucauccag

SEQ ID NO: 1207377 - RNA, 17 nt, Mycobacterium bovis subsp bovis AF2122/97
gcacggugggcgcuggg

SEQ ID NO: 1207378 - RNA, 20 nt, Mycobacterium bovis subsp bovis AF2122/97
gcacgguguugcgcacccgc

SEQ ID NO: 1207379 - RNA, 21 nt, Mycobacterium bovis subsp bovis AF2122/97
gcacucgcccaagcgcagccu

SEQ ID NO: 1207380 - RNA, 16 nt, Mycobacterium bovis subsp bovis AF2122/97
gcacuccagcggcggg

SEQ ID NO: 1207381 - RNA, 22 nt, Mycobacterium bovis subsp bovis AF2122/97
gcacuccacgaucggcccagcc

SEQ ID NO: 1207382 - RNA, 20 nt, Mycobacterium bovis subsp bovis AF2122/97
gcacuccagcggcgggggcg

SEQ ID NO: 1207383 - RNA, 16 nt, Mycobacterium bovis subsp bovis AF2122/97
gcacuccaccgcuggc

SEQ ID NO: 1207384 - RNA, 13 nt, Mycobacterium bovis subsp bovis AF2122/97
gcacucaucgccg

SEQ ID NO: 1207385 - RNA, 19 nt, Mycobacterium bovis subsp bovis AF2122/97
gcacucguagaacgucugg

SEQ ID NO: 1207386 - RNA, 21 nt, Mycobacterium bovis subsp bovis AF2122/97
gcacucguugccgaccaugca

SEQ ID NO: 1207387 - RNA, 20 nt, Mycobacterium bovis subsp bovis AF2122/97
gcacugaugucacccgcccg

SEQ ID NO: 1207388 - RNA, 16 nt, Mycobacterium bovis subsp bovis AF2122/97
gcacguuuacauagac

SEQ ID NO: 1207389 - RNA, 14 nt, Mycobacterium bovis subsp bovis AF2122/97
gcacguuggcggcc

SEQ ID NO: 1207390 - RNA, 17 nt, Mycobacterium bovis subsp bovis AF2122/97
gcacguucagccaggcg

SEQ ID NO: 1207391 - RNA, 17 nt, Mycobacterium bovis subsp bovis AF2122/97
gcacguugauccgcgca

SEQ ID NO: 1207392 - RNA, 21 nt, Mycobacterium bovis subsp bovis AF2122/97
gcacuagcccgaccgguccag

SEQ ID NO: 1207393 - RNA, 18 nt, Mycobacterium bovis subsp bovis AF2122/97
gcacguucacgcgcggau

SEQ ID NO: 1207394 - RNA, 16 nt, Mycobacterium bovis subsp bovis AF2122/97
gcacgucgcauugugc

SEQ ID NO: 1207395 - RNA, 15 nt, Mycobacterium bovis subsp bovis AF2122/97
gcacgucggcgggcg

SEQ ID NO: 1207396 - RNA, 21 nt, Mycobacterium bovis subsp bovis AF2122/97
gcacgucggcgggcgugugca

SEQ ID NO: 1207397 - RNA, 17 nt, Mycobacterium bovis subsp bovis AF2122/97
gcacgucggcugccgca

SEQ ID NO: 1207398 - RNA, 13 nt, Mycobacterium bovis subsp bovis AF2122/97
gcacgucgagcag

SEQ ID NO: 1207399 - RNA, 19 nt, Mycobacterium bovis subsp bovis AF2122/97
gcacguccgcggagcucaa

SEQ ID NO: 1207400 - RNA, 16 nt, Mycobacterium bovis subsp bovis AF2122/97
gcacgucgaaaucggu

SEQ ID NO: 1207401 - RNA, 19 nt, Mycobacterium bovis subsp bovis AF2122/97
gcacgucgaaaucggugca

SEQ ID NO: 1207402 - RNA, 20 nt, Mycobacterium bovis subsp bovis AF2122/97
gcacgucgaaaucggugcac

SEQ ID NO: 1207403 - RNA, 18 nt, Mycobacterium bovis subsp bovis AF2122/97
gcacgucgacccccugcc

SEQ ID NO: 1207404 - RNA, 15 nt, Mycobacterium bovis subsp bovis AF2122/97
gcacuucggcgaagu

SEQ ID NO: 1207405 - RNA, 16 nt, Mycobacterium bovis subsp bovis AF2122/97
gcacuuccagcccggc

SEQ ID NO: 1207406 - RNA, 17 nt, Mycobacterium bovis subsp bovis AF2122/97
gcacuuccagcccggca

SEQ ID NO: 1207407 - RNA, 16 nt, Mycobacterium bovis subsp bovis AF2122/97
gcacuuggcccccgac

SEQ ID NO: 1207408 - RNA, 18 nt, Mycobacterium bovis subsp bovis AF2122/97
gcacuuggcccccgacgg

SEQ ID NO: 1207409 - RNA, 18 nt, Mycobacterium bovis subsp bovis AF2122/97
gcacuuggacccggccgg

SEQ ID NO: 1207410 - RNA, 21 nt, Mycobacterium bovis subsp bovis AF2122/97
gcagaaacaacgucgccgcgg

SEQ ID NO: 1207411 - RNA, 16 nt, Mycobacterium bovis subsp bovis AF2122/97
gcacugcccggggugc

SEQ ID NO: 1207412 - RNA, 13 nt, Mycobacterium bovis subsp bovis AF2122/97
gcacugcccagca

SEQ ID NO: 1207413 - RNA, 18 nt, Mycobacterium bovis subsp bovis AF2122/97
gcacugcccagcagacca

SEQ ID NO: 1207414 - RNA, 13 nt, Mycobacterium bovis subsp bovis AF2122/97
gcacugcggccag

SEQ ID NO: 1207415 - RNA, 20 nt, Mycobacterium bovis subsp bovis AF2122/97
gcacugcugguugaugaagg

SEQ ID NO: 1207416 - RNA, 16 nt, Mycobacterium bovis subsp bovis AF2122/97
gcacugcgccggccgg

SEQ ID NO: 1207417 - RNA, 14 nt, Mycobacterium bovis subsp bovis AF2122/97
gcacugcgcgugcu

SEQ ID NO: 1207418 - RNA, 21 nt, Mycobacterium bovis subsp bovis AF2122/97
gcacugcgcgugcucgacgcg

SEQ ID NO: 1207419 - RNA, 22 nt, Mycobacterium bovis subsp bovis AF2122/97
gcacuggcccccacaccacgcu

SEQ ID NO: 1207420 - RNA, 14 nt, Mycobacterium bovis subsp bovis AF2122/97
gcacuuaccgagcc

SEQ ID NO: 1207421 - RNA, 16 nt, Mycobacterium bovis subsp bovis AF2122/97
gcacugggcuggccag

SEQ ID NO: 1207422 - RNA, 16 nt, Mycobacterium bovis subsp bovis AF2122/97
gcacuguggaagaacc

SEQ ID NO: 1207423 - RNA, 23 nt, Mycobacterium bovis subsp bovis AF2122/97
gcagagucgcacugcgccggccg

SEQ ID NO: 1207424 - RNA, 15 nt, Mycobacterium bovis subsp bovis AF2122/97
gcagaguucccugau

SEQ ID NO: 1207425 - RNA, 12 nt, Mycobacterium bovis subsp bovis AF2122/97
gcagaggcggcu

SEQ ID NO: 1207426 - RNA, 17 nt, Mycobacterium bovis subsp bovis AF2122/97
gcagagcacgcgcggcg

SEQ ID NO: 1207427 - RNA, 18 nt, Mycobacterium bovis subsp bovis AF2122/97
gcagagccccggcaagcg

SEQ ID NO: 1207428 - RNA, 15 nt, Mycobacterium bovis subsp bovis AF2122/97
gcagaucaccgccag

SEQ ID NO: 1207429 - RNA, 16 nt, Mycobacterium bovis subsp bovis AF2122/97
gcagauauugccugcc

SEQ ID NO: 1207430 - RNA, 12 nt, Mycobacterium bovis subsp bovis AF2122/97
gcagauccaggc

SEQ ID NO: 1207431 - RNA, 15 nt, Mycobacterium bovis subsp bovis AF2122/97
gcagaucucacggag

SEQ ID NO: 1207432 - RNA, 22 nt, Mycobacterium bovis subsp bovis AF2122/97
gcagaucgaaaucagcccgcgc

SEQ ID NO: 1207433 - RNA, 16 nt, Mycobacterium bovis subsp bovis AF2122/97
gcagauccccgccacc

SEQ ID NO: 1207434 - RNA, 14 nt, Mycobacterium bovis subsp bovis AF2122/97
gcagaugagcgcgg

SEQ ID NO: 1207435 - RNA, 21 nt, Mycobacterium bovis subsp bovis AF2122/97
gcagaugaauugccgggcgca

SEQ ID NO: 1207436 - RNA, 15 nt, Mycobacterium bovis subsp bovis AF2122/97
gcagauuccucuuca

SEQ ID NO: 1207437 - RNA, 17 nt, Mycobacterium bovis subsp bovis AF2122/97
gcagaugggccuccacc

SEQ ID NO: 1207438 - RNA, 23 nt, Mycobacterium bovis subsp bovis AF2122/97
gcagauggugaacgugccuuccu

SEQ ID NO: 1207439 - RNA, 14 nt, Mycobacterium bovis subsp bovis AF2122/97
gcagacgccgcguu

SEQ ID NO: 1207440 - RNA, 20 nt, Mycobacterium bovis subsp bovis AF2122/97
gcagacgaaguagccgacca

SEQ ID NO: 1207441 - RNA, 20 nt, Mycobacterium bovis subsp bovis AF2122/97
gcagacgcagaaucgcauga

SEQ ID NO: 1207442 - RNA, 21 nt, Mycobacterium bovis subsp bovis AF2122/97
gcagacgcagaaucgcaugau

SEQ ID NO: 1207443 - RNA, 19 nt, Mycobacterium bovis subsp bovis AF2122/97
gcagacgcauaagcccccg

SEQ ID NO: 1207444 - RNA, 16 nt, Mycobacterium bovis subsp bovis AF2122/97
gcagaccgaucggcag

SEQ ID NO: 1207445 - RNA, 14 nt, Mycobacterium bovis subsp bovis AF2122/97
gcagaccaugguca

SEQ ID NO: 1207446 - RNA, 17 nt, Mycobacterium bovis subsp bovis AF2122/97
gcagaccaccagugagg

SEQ ID NO: 1207447 - RNA, 20 nt, Mycobacterium bovis subsp bovis AF2122/97
gcagacguaaaagcccccgc

SEQ ID NO: 1207448 - RNA, 17 nt, Mycobacterium bovis subsp bovis AF2122/97
gcagacggcugccacgc

SEQ ID NO: 1207449 - RNA, 14 nt, Mycobacterium bovis subsp bovis AF2122/97
gcagacucgagguc

SEQ ID NO: 1207450 - RNA, 19 nt, Mycobacterium bovis subsp bovis AF2122/97
gcagacgugguagccggcg

SEQ ID NO: 1207451 - RNA, 13 nt, Mycobacterium bovis subsp bovis AF2122/97
gcagagaccaagg

SEQ ID NO: 1207452 - RNA, 16 nt, Mycobacterium bovis subsp bovis AF2122/97
gcagagaccaaggucc

SEQ ID NO: 1207453 - RNA, 12 nt, Mycobacterium bovis subsp bovis AF2122/97
gcagaacacgcu

SEQ ID NO: 1207454 - RNA, 22 nt, Mycobacterium bovis subsp bovis AF2122/97
gcagaaacaucgacagcaucac

SEQ ID NO: 1207455 - RNA, 14 nt, Mycobacterium bovis subsp bovis AF2122/97
gcagaaccgccaac

SEQ ID NO: 1207456 - RNA, 18 nt, Mycobacterium bovis subsp bovis AF2122/97
gcagaacucgcguauccc

SEQ ID NO: 1207457 - RNA, 14 nt, Mycobacterium bovis subsp bovis AF2122/97
gcagaaggccagcg

SEQ ID NO: 1207458 - RNA, 15 nt, Mycobacterium bovis subsp bovis AF2122/97
gcagaaggccagcga

SEQ ID NO: 1207459 - RNA, 15 nt, Mycobacterium bovis subsp bovis AF2122/97
gcagacacugcugcg

SEQ ID NO: 1207460 - RNA, 18 nt, Mycobacterium bovis subsp bovis AF2122/97
gcagacacgagucgccag

SEQ ID NO: 1207461 - RNA, 20 nt, Mycobacterium bovis subsp bovis AF2122/97
gcagacacgagucgccagac

SEQ ID NO: 1207462 - RNA, 21 nt, Mycobacterium bovis subsp bovis AF2122/97
gcagaauccggucgaugaccu

SEQ ID NO: 1207463 - RNA, 22 nt, Mycobacterium bovis subsp bovis AF2122/97
gcagaauccggucggcccacac

SEQ ID NO: 1207464 - RNA, 22 nt, Mycobacterium bovis subsp bovis AF2122/97
gcagaagucguugcgcggucuc

SEQ ID NO: 1207465 - RNA, 15 nt, Mycobacterium bovis subsp bovis AF2122/97
gcagcauccggccgu

SEQ ID NO: 1207466 - RNA, 15 nt, Mycobacterium bovis subsp bovis AF2122/97
gcagcaucuccgccg

SEQ ID NO: 1207467 - RNA, 21 nt, Mycobacterium bovis subsp bovis AF2122/97
gcagcaucuccgucggccagg

SEQ ID NO: 1207468 - RNA, 19 nt, Mycobacterium bovis subsp bovis AF2122/97
gcagcaucggcaccccggc

SEQ ID NO: 1207469 - RNA, 12 nt, Mycobacterium bovis subsp bovis AF2122/97
gcagcaggugag

SEQ ID NO: 1207470 - RNA, 16 nt, Mycobacterium bovis subsp bovis AF2122/97
gcagcagcgcgcgggu

SEQ ID NO: 1207471 - RNA, 13 nt, Mycobacterium bovis subsp bovis AF2122/97
gcagcagcgggcu

SEQ ID NO: 1207472 - RNA, 17 nt, Mycobacterium bovis subsp bovis AF2122/97
gcagcagcggugcagcc

SEQ ID NO: 1207473 - RNA, 15 nt, Mycobacterium bovis subsp bovis AF2122/97
gcagcagcggcggcg

SEQ ID NO: 1207474 - RNA, 20 nt, Mycobacterium bovis subsp bovis AF2122/97
gcagcaggggacgaccaugc

SEQ ID NO: 1207475 - RNA, 12 nt, Mycobacterium bovis subsp bovis AF2122/97
gcagcaggacac

SEQ ID NO: 1207476 - RNA, 14 nt, Mycobacterium bovis subsp bovis AF2122/97
gcagcagcuugacc

SEQ ID NO: 1207477 - RNA, 17 nt, Mycobacterium bovis subsp bovis AF2122/97
gcagcagcgggcgcgcu

SEQ ID NO: 1207478 - RNA, 13 nt, Mycobacterium bovis subsp bovis AF2122/97
gcagcagcugguc

SEQ ID NO: 1207479 - RNA, 23 nt, Mycobacterium bovis subsp bovis AF2122/97
gcagcagcuggucgugggccacc

SEQ ID NO: 1207480 - RNA, 15 nt, Mycobacterium bovis subsp bovis AF2122/97
gcagccagcgccaug

SEQ ID NO: 1207481 - RNA, 22 nt, Mycobacterium bovis subsp bovis AF2122/97
gcagccagacugcauccagagc

SEQ ID NO: 1207482 - RNA, 13 nt, Mycobacterium bovis subsp bovis AF2122/97
gcagccaggcacg

SEQ ID NO: 1207483 - RNA, 15 nt, Mycobacterium bovis subsp bovis AF2122/97
gcagccagggcgccg

SEQ ID NO: 1207484 - RNA, 22 nt, Mycobacterium bovis subsp bovis AF2122/97
gcagccacguagacaaggccaa

SEQ ID NO: 1207485 - RNA, 19 nt, Mycobacterium bovis subsp bovis AF2122/97
gcagccacauacaggcccg

SEQ ID NO: 1207486 - RNA, 21 nt, Mycobacterium bovis subsp bovis AF2122/97
gcagccacauacaggcccgcc

SEQ ID NO: 1207487 - RNA, 14 nt, Mycobacterium bovis subsp bovis AF2122/97
gcagccacccgaca

SEQ ID NO: 1207488 - RNA, 16 nt, Mycobacterium bovis subsp bovis AF2122/97
gcagcauggcccuggc

SEQ ID NO: 1207489 - RNA, 17 nt, Mycobacterium bovis subsp bovis AF2122/97
gcagcacggcggccacg

SEQ ID NO: 1207490 - RNA, 21 nt, Mycobacterium bovis subsp bovis AF2122/97
gcagcacgggugagcaccacg

SEQ ID NO: 1207491 - RNA, 16 nt, Mycobacterium bovis subsp bovis AF2122/97
gcagcacggucugggu

SEQ ID NO: 1207492 - RNA, 23 nt, Mycobacterium bovis subsp bovis AF2122/97
gcagcacucgcccaagcgcagcc

SEQ ID NO: 1207493 - RNA, 21 nt, Mycobacterium bovis subsp bovis AF2122/97
gcagcacuuggacccggccgg

SEQ ID NO: 1207494 - RNA, 21 nt, Mycobacterium bovis subsp bovis AF2122/97
gcagcagaugcgaaaguggug

SEQ ID NO: 1207495 - RNA, 23 nt, Mycobacterium bovis subsp bovis AF2122/97
gcagcaccgucggcaccagcagc

SEQ ID NO: 1207496 - RNA, 20 nt, Mycobacterium bovis subsp bovis AF2122/97
gcagcaccgucgggcccagc

SEQ ID NO: 1207497 - RNA, 20 nt, Mycobacterium bovis subsp bovis AF2122/97
gcagcaccgacgugauggug

SEQ ID NO: 1207498 - RNA, 13 nt, Mycobacterium bovis subsp bovis AF2122/97
gcagcacccccuc

SEQ ID NO: 1207499 - RNA, 13 nt, Mycobacterium bovis subsp bovis AF2122/97
gcagcacccgcgc

SEQ ID NO: 1207500 - RNA, 16 nt, Mycobacterium bovis subsp bovis AF2122/97
gcagcacgaccugguu

SEQ ID NO: 1207501 - RNA, 14 nt, Mycobacterium bovis subsp bovis AF2122/97
gcagcacgauccag

SEQ ID NO: 1207502 - RNA, 14 nt, Mycobacterium bovis subsp bovis AF2122/97
gcagcacgccagcc

SEQ ID NO: 1207503 - RNA, 17 nt, Mycobacterium bovis subsp bovis AF2122/97
gcagcacgauccagcug

SEQ ID NO: 1207504 - RNA, 22 nt, Mycobacterium bovis subsp bovis AF2122/97
gcagcacauacgauuucgacga

SEQ ID NO: 1207505 - RNA, 15 nt, Mycobacterium bovis subsp bovis AF2122/97
gcagcaccaaggucu

SEQ ID NO: 1207506 - RNA, 14 nt, Mycobacterium bovis subsp bovis AF2122/97
gcagcaccacaucc

SEQ ID NO: 1207507 - RNA, 13 nt, Mycobacterium bovis subsp bovis AF2122/97
gcagcaccagcca

SEQ ID NO: 1207508 - RNA, 16 nt, Mycobacterium bovis subsp bovis AF2122/97
gcagcaccagcgccuu

SEQ ID NO: 1207509 - RNA, 21 nt, Mycobacterium bovis subsp bovis AF2122/97
gcagcaauccaaggcucagca

SEQ ID NO: 1207510 - RNA, 13 nt, Mycobacterium bovis subsp bovis AF2122/97
gcagcaacacgau

SEQ ID NO: 1207511 - RNA, 14 nt, Mycobacterium bovis subsp bovis AF2122/97
gcagcaacgacguc

SEQ ID NO: 1207512 - RNA, 14 nt, Mycobacterium bovis subsp bovis AF2122/97
gcagcaagccgccg

SEQ ID NO: 1207513 - RNA, 12 nt, Mycobacterium bovis subsp bovis AF2122/97
gcagcaacaccu

SEQ ID NO: 1207514 - RNA, 21 nt, Mycobacterium bovis subsp bovis AF2122/97
gcagcgugcacacccgcaaug

SEQ ID NO: 1207515 - RNA, 18 nt, Mycobacterium bovis subsp bovis AF2122/97
gcagcgugcagcggcggg

SEQ ID NO: 1207516 - RNA, 20 nt, Mycobacterium bovis subsp bovis AF2122/97
gcagcgugcagcggcgggcg

SEQ ID NO: 1207517 - RNA, 15 nt, Mycobacterium bovis subsp bovis AF2122/97
gcagcgugggcagcg

SEQ ID NO: 1207518 - RNA, 19 nt, Mycobacterium bovis subsp bovis AF2122/97
gcagcgucgucuagcggga

SEQ ID NO: 1207519 - RNA, 19 nt, Mycobacterium bovis subsp bovis AF2122/97
gcagcgucggugccaccac

SEQ ID NO: 1207520 - RNA, 15 nt, Mycobacterium bovis subsp bovis AF2122/97
gcagcgggcgguguc

SEQ ID NO: 1207521 - RNA, 17 nt, Mycobacterium bovis subsp bovis AF2122/97
gcagcggcucggcggcg

SEQ ID NO: 1207522 - RNA, 19 nt, Mycobacterium bovis subsp bovis AF2122/97
gcagcgggccacugagcca

SEQ ID NO: 1207523 - RNA, 18 nt, Mycobacterium bovis subsp bovis AF2122/97
gcagcggccagcccagcc

SEQ ID NO: 1207524 - RNA, 21 nt, Mycobacterium bovis subsp bovis AF2122/97
gcagcgcuucggcggucgccg

SEQ ID NO: 1207525 - RNA, 20 nt, Mycobacterium bovis subsp bovis AF2122/97
gcagcggaccgcugccugcc

SEQ ID NO: 1207526 - RNA, 23 nt, Mycobacterium bovis subsp bovis AF2122/97
gcagcggaccgcugccugccgcg

SEQ ID NO: 1207527 - RNA, 16 nt, Mycobacterium bovis subsp bovis AF2122/97
gcagcggcgcgcugca

SEQ ID NO: 1207528 - RNA, 13 nt, Mycobacterium bovis subsp bovis AF2122/97
gcagcggcgcggu

SEQ ID NO: 1207529 - RNA, 11 nt, Mycobacterium bovis subsp bovis AF2122/97
gcagcggcgga

SEQ ID NO: 1207530 - RNA, 14 nt, Mycobacterium bovis subsp bovis AF2122/97
gcagcggcgccgcc

SEQ ID NO: 1207531 - RNA, 20 nt, Mycobacterium bovis subsp bovis AF2122/97
gcagcggcgcauaggcggcc

SEQ ID NO: 1207532 - RNA, 18 nt, Mycobacterium bovis subsp bovis AF2122/97
gcagcggcgggcgaugac

SEQ ID NO: 1207533 - RNA, 21 nt, Mycobacterium bovis subsp bovis AF2122/97
gcagcggcuugcccaggcgca

SEQ ID NO: 1207534 - RNA, 17 nt, Mycobacterium bovis subsp bovis AF2122/97
gcagcggcuaacgaagc

SEQ ID NO: 1207535 - RNA, 12 nt, Mycobacterium bovis subsp bovis AF2122/97
gcagcgccaggc

SEQ ID NO: 1207536 - RNA, 18 nt, Mycobacterium bovis subsp bovis AF2122/97
gcagcgccagcgggauga

SEQ ID NO: 1207537 - RNA, 16 nt, Mycobacterium bovis subsp bovis AF2122/97
gcagcgccaucgaggu

SEQ ID NO: 1207538 - RNA, 15 nt, Mycobacterium bovis subsp bovis AF2122/97
gcagcgccagcagcu

SEQ ID NO: 1207539 - RNA, 22 nt, Mycobacterium bovis subsp bovis AF2122/97
gcagcgcgacccguagcuuggc

SEQ ID NO: 1207540 - RNA, 14 nt, Mycobacterium bovis subsp bovis AF2122/97
gcagcgccugcggc

SEQ ID NO: 1207541 - RNA, 18 nt, Mycobacterium bovis subsp bovis AF2122/97
gcagcgccugcggcagca

SEQ ID NO: 1207542 - RNA, 20 nt, Mycobacterium bovis subsp bovis AF2122/97
gcagcgccugcggcagcacc

SEQ ID NO: 1207543 - RNA, 18 nt, Mycobacterium bovis subsp bovis AF2122/97
gcagcgccuaccagcacc

SEQ ID NO: 1207544 - RNA, 14 nt, Mycobacterium bovis subsp bovis AF2122/97
gcagcgcgaucacc

SEQ ID NO: 1207545 - RNA, 19 nt, Mycobacterium bovis subsp bovis AF2122/97
gcagcgcgcccgacacccg

SEQ ID NO: 1207546 - RNA, 18 nt, Mycobacterium bovis subsp bovis AF2122/97
gcagcgcgccguucgccu

SEQ ID NO: 1207547 - RNA, 20 nt, Mycobacterium bovis subsp bovis AF2122/97
gcagcgcgaugucgccggcg

SEQ ID NO: 1207548 - RNA, 22 nt, Mycobacterium bovis subsp bovis AF2122/97
gcagcgcuggcuacgccuccuu

SEQ ID NO: 1207549 - RNA, 17 nt, Mycobacterium bovis subsp bovis AF2122/97
gcagcgcuucggcgguc

SEQ ID NO: 1207550 - RNA, 16 nt, Mycobacterium bovis subsp bovis AF2122/97
gcagcgcggccgggcg

SEQ ID NO: 1207551 - RNA, 17 nt, Mycobacterium bovis subsp bovis AF2122/97
gcagcgcggccagagcc

SEQ ID NO: 1207552 - RNA, 22 nt, Mycobacterium bovis subsp bovis AF2122/97
gcagcgcggccagagccgcgcg

SEQ ID NO: 1207553 - RNA, 15 nt, Mycobacterium bovis subsp bovis AF2122/97
gcagcgcgcggaugg

SEQ ID NO: 1207554 - RNA, 15 nt, Mycobacterium bovis subsp bovis AF2122/97
gcagcgcgcugaggu

SEQ ID NO: 1207555 - RNA, 19 nt, Mycobacterium bovis subsp bovis AF2122/97
gcagcccgguggugcuguc

SEQ ID NO: 1207556 - RNA, 14 nt, Mycobacterium bovis subsp bovis AF2122/97
gcagcccgggcagc

SEQ ID NO: 1207557 - RNA, 15 nt, Mycobacterium bovis subsp bovis AF2122/97
gcagcccgggcagca

SEQ ID NO: 1207558 - RNA, 17 nt, Mycobacterium bovis subsp bovis AF2122/97
gcagcccgggcagcacc

SEQ ID NO: 1207559 - RNA, 14 nt, Mycobacterium bovis subsp bovis AF2122/97
gcagcccgcuggcc

SEQ ID NO: 1207560 - RNA, 19 nt, Mycobacterium bovis subsp bovis AF2122/97
gcagccgaugcugcgggcg

SEQ ID NO: 1207561 - RNA, 18 nt, Mycobacterium bovis subsp bovis AF2122/97
gcagcccugcgcagccgc

SEQ ID NO: 1207562 - RNA, 19 nt, Mycobacterium bovis subsp bovis AF2122/97
gcagccgaaguggcgccuu

SEQ ID NO: 1207563 - RNA, 13 nt, Mycobacterium bovis subsp bovis AF2122/97
gcagcccgccgga

SEQ ID NO: 1207564 - RNA, 18 nt, Mycobacterium bovis subsp bovis AF2122/97
gcagcccgcgaguauggg

SEQ ID NO: 1207565 - RNA, 13 nt, Mycobacterium bovis subsp bovis AF2122/97
gcagcccggcggc

SEQ ID NO: 1207566 - RNA, 17 nt, Mycobacterium bovis subsp bovis AF2122/97
gcagccccugccgaucc

SEQ ID NO: 1207567 - RNA, 21 nt, Mycobacterium bovis subsp bovis AF2122/97
gcagccgcucgacggcccgcc

SEQ ID NO: 1207568 - RNA, 18 nt, Mycobacterium bovis subsp bovis AF2122/97
gcagccgcugaucugccg

SEQ ID NO: 1207569 - RNA, 19 nt, Mycobacterium bovis subsp bovis AF2122/97
gcagccggcggagaaggcg

SEQ ID NO: 1207570 - RNA, 13 nt, Mycobacterium bovis subsp bovis AF2122/97
gcagccggcgggc

SEQ ID NO: 1207571 - RNA, 11 nt, Mycobacterium bovis subsp bovis AF2122/97
gcagccgggca

SEQ ID NO: 1207572 - RNA, 15 nt, Mycobacterium bovis subsp bovis AF2122/97
gcagccgggcaccac

SEQ ID NO: 1207573 - RNA, 16 nt, Mycobacterium bovis subsp bovis AF2122/97
gcagccgcgaguccag

SEQ ID NO: 1207574 - RNA, 19 nt, Mycobacterium bovis subsp bovis AF2122/97
gcagccgcccgcccaccuc

SEQ ID NO: 1207575 - RNA, 21 nt, Mycobacterium bovis subsp bovis AF2122/97
gcagccgcgcgguacugcgca

SEQ ID NO: 1207576 - RNA, 13 nt, Mycobacterium bovis subsp bovis AF2122/97
gcagccgcccgcc

SEQ ID NO: 1207577 - RNA, 17 nt, Mycobacterium bovis subsp bovis AF2122/97
gcagccgcccgccagga

SEQ ID NO: 1207578 - RNA, 15 nt, Mycobacterium bovis subsp bovis AF2122/97
gcagccgcagguggg

SEQ ID NO: 1207579 - RNA, 20 nt, Mycobacterium bovis subsp bovis AF2122/97
gcagccgcauaggccccgcc

SEQ ID NO: 1207580 - RNA, 21 nt, Mycobacterium bovis subsp bovis AF2122/97
gcagcgacggcagcucggggc

SEQ ID NO: 1207581 - RNA, 20 nt, Mycobacterium bovis subsp bovis AF2122/97
gcagcgaccgucguccagac

SEQ ID NO: 1207582 - RNA, 23 nt, Mycobacterium bovis subsp bovis AF2122/97
gcagcgagacuucgacgcggcga

SEQ ID NO: 1207583 - RNA, 22 nt, Mycobacterium bovis subsp bovis AF2122/97
gcagcgaggagcccggucccuu

SEQ ID NO: 1207584 - RNA, 13 nt, Mycobacterium bovis subsp bovis AF2122/97
gcagcgaugacga

SEQ ID NO: 1207585 - RNA, 23 nt, Mycobacterium bovis subsp bovis AF2122/97
gcagcgcacugcccggggugcug

SEQ ID NO: 1207586 - RNA, 14 nt, Mycobacterium bovis subsp bovis AF2122/97
gcagcgcauccggu

SEQ ID NO: 1207587 - RNA, 13 nt, Mycobacterium bovis subsp bovis AF2122/97
gcagcgcaaccac

SEQ ID NO: 1207588 - RNA, 22 nt, Mycobacterium bovis subsp bovis AF2122/97
gcagcgcaaugcaucgcggcgg

SEQ ID NO: 1207589 - RNA, 14 nt, Mycobacterium bovis subsp bovis AF2122/97
gcagccgggcgucg

SEQ ID NO: 1207590 - RNA, 21 nt, Mycobacterium bovis subsp bovis AF2122/97
gcagcgaaacgagccggugcg

SEQ ID NO: 1207591 - RNA, 13 nt, Mycobacterium bovis subsp bovis AF2122/97
gcagccugcagcg

SEQ ID NO: 1207592 - RNA, 17 nt, Mycobacterium bovis subsp bovis AF2122/97
gcagccugcgccgcgcg

SEQ ID NO: 1207593 - RNA, 13 nt, Mycobacterium bovis subsp bovis AF2122/97
gcagccugcugca

SEQ ID NO: 1207594 - RNA, 17 nt, Mycobacterium bovis subsp bovis AF2122/97
gcaggcauucccgcggc

SEQ ID NO: 1207595 - RNA, 12 nt, Mycobacterium bovis subsp bovis AF2122/97
gcaggccacugc

SEQ ID NO: 1207596 - RNA, 17 nt, Mycobacterium bovis subsp bovis AF2122/97
gcaggccccacuggugc

SEQ ID NO: 1207597 - RNA, 13 nt, Mycobacterium bovis subsp bovis AF2122/97
gcaggccauggga

SEQ ID NO: 1207598 - RNA, 14 nt, Mycobacterium bovis subsp bovis AF2122/97
gcaggccaugggaa

SEQ ID NO: 1207599 - RNA, 16 nt, Mycobacterium bovis subsp bovis AF2122/97
gcaggcccacccgggc

SEQ ID NO: 1207600 - RNA, 17 nt, Mycobacterium bovis subsp bovis AF2122/97
gcaggcccacccgggcg

SEQ ID NO: 1207601 - RNA, 19 nt, Mycobacterium bovis subsp bovis AF2122/97
gcaggcccuggccacccag

SEQ ID NO: 1207602 - RNA, 18 nt, Mycobacterium bovis subsp bovis AF2122/97
gcaggcccgacggcgccc

SEQ ID NO: 1207603 - RNA, 15 nt, Mycobacterium bovis subsp bovis AF2122/97
gcaggcggccgccgg

SEQ ID NO: 1207604 - RNA, 15 nt, Mycobacterium bovis subsp bovis AF2122/97
gcaggcggccuugcc

SEQ ID NO: 1207605 - RNA, 21 nt, Mycobacterium bovis subsp bovis AF2122/97
gcaggcgggaacgaucgauga

SEQ ID NO: 1207606 - RNA, 16 nt, Mycobacterium bovis subsp bovis AF2122/97
gcagcucgggcaggga

SEQ ID NO: 1207607 - RNA, 23 nt, Mycobacterium bovis subsp bovis AF2122/97
gcagcucggggcgaugagccugc

SEQ ID NO: 1207608 - RNA, 17 nt, Mycobacterium bovis subsp bovis AF2122/97
gcagcucggccgaggcg

SEQ ID NO: 1207609 - RNA, 15 nt, Mycobacterium bovis subsp bovis AF2122/97
gcagcucgcuguaga

SEQ ID NO: 1207610 - RNA, 17 nt, Mycobacterium bovis subsp bovis AF2122/97
gcagcucgauacccagg

SEQ ID NO: 1207611 - RNA, 19 nt, Mycobacterium bovis subsp bovis AF2122/97
gcagcucgauacccaggau

SEQ ID NO: 1207612 - RNA, 15 nt, Mycobacterium bovis subsp bovis AF2122/97
gcagcucgaccagga

SEQ ID NO: 1207613 - RNA, 14 nt, Mycobacterium bovis subsp bovis AF2122/97
gcaggaucggcuug

SEQ ID NO: 1207614 - RNA, 12 nt, Mycobacterium bovis subsp bovis AF2122/97
gcagcugagccg

SEQ ID NO: 1207615 - RNA, 10 nt, Mycobacterium bovis subsp bovis AF2122/97
gcagcugacg

SEQ ID NO: 1207616 - RNA, 21 nt, Mycobacterium bovis subsp bovis AF2122/97
gcagcugaaaauaggccgggc

SEQ ID NO: 1207617 - RNA, 22 nt, Mycobacterium bovis subsp bovis AF2122/97
gcaggauucccagucgcggcgc

SEQ ID NO: 1207618 - RNA, 17 nt, Mycobacterium bovis subsp bovis AF2122/97
gcaggauucccagucca

SEQ ID NO: 1207619 - RNA, 16 nt, Mycobacterium bovis subsp bovis AF2122/97
gcaggcagggcagccc

SEQ ID NO: 1207620 - RNA, 14 nt, Mycobacterium bovis subsp bovis AF2122/97
gcagguccaucugg

SEQ ID NO: 1207621 - RNA, 22 nt, Mycobacterium bovis subsp bovis AF2122/97
gcagguauaccgagggucgggc

SEQ ID NO: 1207622 - RNA, 16 nt, Mycobacterium bovis subsp bovis AF2122/97
gcagguacaucaccac

SEQ ID NO: 1207623 - RNA, 17 nt, Mycobacterium bovis subsp bovis AF2122/97
gcaggguggccagcagg

SEQ ID NO: 1207624 - RNA, 18 nt, Mycobacterium bovis subsp bovis AF2122/97
gcagggugccggcgccgc

SEQ ID NO: 1207625 - RNA, 14 nt, Mycobacterium bovis subsp bovis AF2122/97
gcagggaucacccc

SEQ ID NO: 1207626 - RNA, 22 nt, Mycobacterium bovis subsp bovis AF2122/97
gcaggcuucugggguuggcucg

SEQ ID NO: 1207627 - RNA, 20 nt, Mycobacterium bovis subsp bovis AF2122/97
gcaggcuuccagccacagcc

SEQ ID NO: 1207628 - RNA, 17 nt, Mycobacterium bovis subsp bovis AF2122/97
gcaggcuuucauugaca

SEQ ID NO: 1207629 - RNA, 16 nt, Mycobacterium bovis subsp bovis AF2122/97
gcaggcuugccgaugg

SEQ ID NO: 1207630 - RNA, 16 nt, Mycobacterium bovis subsp bovis AF2122/97
gcaggcuuccagccac

SEQ ID NO: 1207631 - RNA, 19 nt, Mycobacterium bovis subsp bovis AF2122/97
gcaggcuuucauugacacu

SEQ ID NO: 1207632 - RNA, 22 nt, Mycobacterium bovis subsp bovis AF2122/97
gcaggucgaucugcgccaucac

SEQ ID NO: 1207633 - RNA, 22 nt, Mycobacterium bovis subsp bovis AF2122/97
gcaggucgagcgcccacuggug

SEQ ID NO: 1207634 - RNA, 23 nt, Mycobacterium bovis subsp bovis AF2122/97
gcaggucgaugcugccagccaug

SEQ ID NO: 1207635 - RNA, 15 nt, Mycobacterium bovis subsp bovis AF2122/97
gcaggucgcaccaca

SEQ ID NO: 1207636 - RNA, 18 nt, Mycobacterium bovis subsp bovis AF2122/97
gcaggugaacgccggugc

SEQ ID NO: 1207637 - RNA, 19 nt, Mycobacterium bovis subsp bovis AF2122/97
gcaggugaacgccggugcg

SEQ ID NO: 1207638 - RNA, 14 nt, Mycobacterium bovis subsp bovis AF2122/97
gcaggugcugggcg

SEQ ID NO: 1207639 - RNA, 12 nt, Mycobacterium bovis subsp bovis AF2122/97
gcaggugcccau

SEQ ID NO: 1207640 - RNA, 13 nt, Mycobacterium bovis subsp bovis AF2122/97
gcaggugccuucu

SEQ ID NO: 1207641 - RNA, 16 nt, Mycobacterium bovis subsp bovis AF2122/97
gcaggugcccgaggug

SEQ ID NO: 1207642 - RNA, 19 nt, Mycobacterium bovis subsp bovis AF2122/97
gcagguggagugcacagac

SEQ ID NO: 1207643 - RNA, 17 nt, Mycobacterium bovis subsp bovis AF2122/97
gcagguguugcacgagc

SEQ ID NO: 1207644 - RNA, 16 nt, Mycobacterium bovis subsp bovis AF2122/97
gcagguuaggguccag

SEQ ID NO: 1207645 - RNA, 18 nt, Mycobacterium bovis subsp bovis AF2122/97
gcagguugcguugcagga

SEQ ID NO: 1207646 - RNA, 17 nt, Mycobacterium bovis subsp bovis AF2122/97
gcagguuggccaccgcc

SEQ ID NO: 1207647 - RNA, 14 nt, Mycobacterium bovis subsp bovis AF2122/97
gcaguacaccgccc

SEQ ID NO: 1207648 - RNA, 16 nt, Mycobacterium bovis subsp bovis AF2122/97
gcaguacaccgcccgg

SEQ ID NO: 1207649 - RNA, 18 nt, Mycobacterium bovis subsp bovis AF2122/97
gcaguacaccgcccggcc

SEQ ID NO: 1207650 - RNA, 13 nt, Mycobacterium bovis subsp bovis AF2122/97
gcaugggccaggu

SEQ ID NO: 1207651 - RNA, 16 nt, Mycobacterium bovis subsp bovis AF2122/97
gcauggcggcuggugc

SEQ ID NO: 1207652 - RNA, 18 nt, Mycobacterium bovis subsp bovis AF2122/97
gcauggcggcuggugcgg

SEQ ID NO: 1207653 - RNA, 22 nt, Mycobacterium bovis subsp bovis AF2122/97
gcaugcgugacccgacaugguc

SEQ ID NO: 1207654 - RNA, 23 nt, Mycobacterium bovis subsp bovis AF2122/97
gcaugauccccguugacccagac

SEQ ID NO: 1207655 - RNA, 18 nt, Mycobacterium bovis subsp bovis AF2122/97
gcaugagucgaaccaggu

SEQ ID NO: 1207656 - RNA, 16 nt, Mycobacterium bovis subsp bovis AF2122/97
gcaugccggcgaagcc

SEQ ID NO: 1207657 - RNA, 14 nt, Mycobacterium bovis subsp bovis AF2122/97
gcaugccgggaagg

SEQ ID NO: 1207658 - RNA, 17 nt, Mycobacterium bovis subsp bovis AF2122/97
gcaugcgaggggcggca

SEQ ID NO: 1207659 - RNA, 14 nt, Mycobacterium bovis subsp bovis AF2122/97
gcaucgguccaaag

SEQ ID NO: 1207660 - RNA, 16 nt, Mycobacterium bovis subsp bovis AF2122/97
gcaucgguccaaagca

SEQ ID NO: 1207661 - RNA, 21 nt, Mycobacterium bovis subsp bovis AF2122/97
gcaucgguucguagcgggcaa

SEQ ID NO: 1207662 - RNA, 15 nt, Mycobacterium bovis subsp bovis AF2122/97
gcaucggugcagccc

SEQ ID NO: 1207663 - RNA, 16 nt, Mycobacterium bovis subsp bovis AF2122/97
gcaucggugcagcccg

SEQ ID NO: 1207664 - RNA, 24 nt, Mycobacterium bovis subsp bovis AF2122/97
gcaucgucgccaagcccaggcgau

SEQ ID NO: 1207665 - RNA, 16 nt, Mycobacterium bovis subsp bovis AF2122/97
gcaucgucgccgagcg

SEQ ID NO: 1207666 - RNA, 18 nt, Mycobacterium bovis subsp bovis AF2122/97
gcaugacauacagcgggc

SEQ ID NO: 1207667 - RNA, 23 nt, Mycobacterium bovis subsp bovis AF2122/97
gcaugaccccgucagcgggcagc

SEQ ID NO: 1207668 - RNA, 20 nt, Mycobacterium bovis subsp bovis AF2122/97
gcaugaacugcucgccgagg

SEQ ID NO: 1207669 - RNA, 12 nt, Mycobacterium bovis subsp bovis AF2122/97
gcauugaagaag

SEQ ID NO: 1207670 - RNA, 14 nt, Mycobacterium bovis subsp bovis AF2122/97
gcauugaagaagcc

SEQ ID NO: 1207671 - RNA, 17 nt, Mycobacterium bovis subsp bovis AF2122/97
gcauugaagaagcccga

SEQ ID NO: 1207672 - RNA, 20 nt, Mycobacterium bovis subsp bovis AF2122/97
gcauugaccaauccacugau

SEQ ID NO: 1207673 - RNA, 13 nt, Mycobacterium bovis subsp bovis AF2122/97
gcauugucgccgg

SEQ ID NO: 1207674 - RNA, 20 nt, Mycobacterium bovis subsp bovis AF2122/97
gccaaaaaggaucccgccgc

SEQ ID NO: 1207675 - RNA, 22 nt, Mycobacterium bovis subsp bovis AF2122/97
gcauguuccccgucgccagggc

SEQ ID NO: 1207676 - RNA, 22 nt, Mycobacterium bovis subsp bovis AF2122/97
gcauguuccuugcggccgcuga

SEQ ID NO: 1207677 - RNA, 19 nt, Mycobacterium bovis subsp bovis AF2122/97
gcaugugggaacuggacca

SEQ ID NO: 1207678 - RNA, 21 nt, Mycobacterium bovis subsp bovis AF2122/97
gcaugugaaagacaacccgcu

SEQ ID NO: 1207679 - RNA, 22 nt, Mycobacterium bovis subsp bovis AF2122/97
gcaugugacaucgggccgccga

SEQ ID NO: 1207680 - RNA, 21 nt, Mycobacterium bovis subsp bovis AF2122/97
gcaucgggcuugcgcagcagc

SEQ ID NO: 1207681 - RNA, 22 nt, Mycobacterium bovis subsp bovis AF2122/97
gcaucgggcuugcgcagcagcg

SEQ ID NO: 1207682 - RNA, 17 nt, Mycobacterium bovis subsp bovis AF2122/97
gcaucggucaaugccac

SEQ ID NO: 1207683 - RNA, 15 nt, Mycobacterium bovis subsp bovis AF2122/97
gcaucggcggcaagg

SEQ ID NO: 1207684 - RNA, 22 nt, Mycobacterium bovis subsp bovis AF2122/97
gcaucggcgggucugggucagg

SEQ ID NO: 1207685 - RNA, 13 nt, Mycobacterium bovis subsp bovis AF2122/97
gcaucggcgguuc

SEQ ID NO: 1207686 - RNA, 21 nt, Mycobacterium bovis subsp bovis AF2122/97
gcaucggcgguuccauacagc

SEQ ID NO: 1207687 - RNA, 14 nt, Mycobacterium bovis subsp bovis AF2122/97
gcaucggcagcagc

SEQ ID NO: 1207688 - RNA, 14 nt, Mycobacterium bovis subsp bovis AF2122/97
gcaucggcagcccc

SEQ ID NO: 1207689 - RNA, 14 nt, Mycobacterium bovis subsp bovis AF2122/97
gcaucggcccccaa

SEQ ID NO: 1207690 - RNA, 21 nt, Mycobacterium bovis subsp bovis AF2122/97
gcaucgcgccuuugagcccgc

SEQ ID NO: 1207691 - RNA, 15 nt, Mycobacterium bovis subsp bovis AF2122/97
gcaucgcgggcggcg

SEQ ID NO: 1207692 - RNA, 16 nt, Mycobacterium bovis subsp bovis AF2122/97
gcaucgccuccaggcg

SEQ ID NO: 1207693 - RNA, 18 nt, Mycobacterium bovis subsp bovis AF2122/97
gcaucgccuccaggcgcc

SEQ ID NO: 1207694 - RNA, 14 nt, Mycobacterium bovis subsp bovis AF2122/97
gcaucgccuccucg

SEQ ID NO: 1207695 - RNA, 15 nt, Mycobacterium bovis subsp bovis AF2122/97
gcaucgccuccucga

SEQ ID NO: 1207696 - RNA, 16 nt, Mycobacterium bovis subsp bovis AF2122/97
gcaucgccugcgccuu

SEQ ID NO: 1207697 - RNA, 17 nt, Mycobacterium bovis subsp bovis AF2122/97
gcaucgcgagccagcug

SEQ ID NO: 1207698 - RNA, 18 nt, Mycobacterium bovis subsp bovis AF2122/97
gcaucgcggaagcgggcg

SEQ ID NO: 1207699 - RNA, 14 nt, Mycobacterium bovis subsp bovis AF2122/97
gcaucgcggcggcg

SEQ ID NO: 1207700 - RNA, 15 nt, Mycobacterium bovis subsp bovis AF2122/97
gcaucgcggcggcgc

SEQ ID NO: 1207701 - RNA, 20 nt, Mycobacterium bovis subsp bovis AF2122/97
gcaucgcgagccagcugcuc

SEQ ID NO: 1207702 - RNA, 21 nt, Mycobacterium bovis subsp bovis AF2122/97
gcaucgccgucaacgccucug

SEQ ID NO: 1207703 - RNA, 23 nt, Mycobacterium bovis subsp bovis AF2122/97
gcaucgccgucaacgccucugcu

SEQ ID NO: 1207704 - RNA, 16 nt, Mycobacterium bovis subsp bovis AF2122/97
gcauccggucucggcc

SEQ ID NO: 1207705 - RNA, 17 nt, Mycobacterium bovis subsp bovis AF2122/97
gcaucccgguccagccc

SEQ ID NO: 1207706 - RNA, 13 nt, Mycobacterium bovis subsp bovis AF2122/97
gcaucccgggcag

SEQ ID NO: 1207707 - RNA, 23 nt, Mycobacterium bovis subsp bovis AF2122/97
gcaucccgggcaguccaggcacu

SEQ ID NO: 1207708 - RNA, 14 nt, Mycobacterium bovis subsp bovis AF2122/97
gcauccgcggggag

SEQ ID NO: 1207709 - RNA, 15 nt, Mycobacterium bovis subsp bovis AF2122/97
gcauccgcgguuggc

SEQ ID NO: 1207710 - RNA, 17 nt, Mycobacterium bovis subsp bovis AF2122/97
gcaucagcggcgccagu

SEQ ID NO: 1207711 - RNA, 18 nt, Mycobacterium bovis subsp bovis AF2122/97
gcaucagcgccagcgagc

SEQ ID NO: 1207712 - RNA, 16 nt, Mycobacterium bovis subsp bovis AF2122/97
gcaucagcuuuugcac

SEQ ID NO: 1207713 - RNA, 19 nt, Mycobacterium bovis subsp bovis AF2122/97
gcauccccagcacaaccag

SEQ ID NO: 1207714 - RNA, 19 nt, Mycobacterium bovis subsp bovis AF2122/97
gcaucagauucgcgcuggc

SEQ ID NO: 1207715 - RNA, 14 nt, Mycobacterium bovis subsp bovis AF2122/97
gcaguagccgacca

SEQ ID NO: 1207716 - RNA, 17 nt, Mycobacterium bovis subsp bovis AF2122/97
gcaguagccgaccagga

SEQ ID NO: 1207717 - RNA, 13 nt, Mycobacterium bovis subsp bovis AF2122/97
gcaguagcuagca

SEQ ID NO: 1207718 - RNA, 22 nt, Mycobacterium bovis subsp bovis AF2122/97
gcagguuggccaccgcccagug

SEQ ID NO: 1207719 - RNA, 19 nt, Mycobacterium bovis subsp bovis AF2122/97
gcauaccgaacagcaccuc

SEQ ID NO: 1207720 - RNA, 18 nt, Mycobacterium bovis subsp bovis AF2122/97
gcauacgguugaugcauc

SEQ ID NO: 1207721 - RNA, 14 nt, Mycobacterium bovis subsp bovis AF2122/97
gcaucaccuggcgu

SEQ ID NO: 1207722 - RNA, 17 nt, Mycobacterium bovis subsp bovis AF2122/97
gcaucaccgccgcggcc

SEQ ID NO: 1207723 - RNA, 22 nt, Mycobacterium bovis subsp bovis AF2122/97
gcaucaccacuggacccgccca

SEQ ID NO: 1207724 - RNA, 22 nt, Mycobacterium bovis subsp bovis AF2122/97
gcaucaccacccgaccgccauc

SEQ ID NO: 1207725 - RNA, 19 nt, Mycobacterium bovis subsp bovis AF2122/97
gcauagggccaccgccgcc

SEQ ID NO: 1207726 - RNA, 20 nt, Mycobacterium bovis subsp bovis AF2122/97
gcauagguaguugcucggcu

SEQ ID NO: 1207727 - RNA, 13 nt, Mycobacterium bovis subsp bovis AF2122/97
gcauaggcuuccg

SEQ ID NO: 1207728 - RNA, 16 nt, Mycobacterium bovis subsp bovis AF2122/97
gccaagcccaggcgau

SEQ ID NO: 1207729 - RNA, 17 nt, Mycobacterium bovis subsp bovis AF2122/97
gccaagcgacucgccgg

SEQ ID NO: 1207730 - RNA, 18 nt, Mycobacterium bovis subsp bovis AF2122/97
gccaagcucggcccagcg

SEQ ID NO: 1207731 - RNA, 16 nt, Mycobacterium bovis subsp bovis AF2122/97
gccaaguacugggcca

SEQ ID NO: 1207732 - RNA, 18 nt, Mycobacterium bovis subsp bovis AF2122/97
gccaaguugcagcgggcc

SEQ ID NO: 1207733 - RNA, 21 nt, Mycobacterium bovis subsp bovis AF2122/97
gccaagugagcgaucgggugc

SEQ ID NO: 1207734 - RNA, 22 nt, Mycobacterium bovis subsp bovis AF2122/97
gccaaucaccguaauuucuuca

SEQ ID NO: 1207735 - RNA, 15 nt, Mycobacterium bovis subsp bovis AF2122/97
gccaauggccugcag

SEQ ID NO: 1207736 - RNA, 17 nt, Mycobacterium bovis subsp bovis AF2122/97
gccaauggccugcagcg

SEQ ID NO: 1207737 - RNA, 12 nt, Mycobacterium bovis subsp bovis AF2122/97
gccacaaagaag

SEQ ID NO: 1207738 - RNA, 23 nt, Mycobacterium bovis subsp bovis AF2122/97
gccaaugauucggcacgccgggc

SEQ ID NO: 1207739 - RNA, 16 nt, Mycobacterium bovis subsp bovis AF2122/97
gccaaucgcccagugu

SEQ ID NO: 1207740 - RNA, 14 nt, Mycobacterium bovis subsp bovis AF2122/97
gccaauccggcggc

SEQ ID NO: 1207741 - RNA, 18 nt, Mycobacterium bovis subsp bovis AF2122/97
gccaaugcgggaaaccca

SEQ ID NO: 1207742 - RNA, 16 nt, Mycobacterium bovis subsp bovis AF2122/97
gccaaugcccaggugu

SEQ ID NO: 1207743 - RNA, 19 nt, Mycobacterium bovis subsp bovis AF2122/97
gccaaugcccuuggccagc

SEQ ID NO: 1207744 - RNA, 23 nt, Mycobacterium bovis subsp bovis AF2122/97
gccaaugcccuuggccagcaggg

SEQ ID NO: 1207745 - RNA, 16 nt, Mycobacterium bovis subsp bovis AF2122/97
gccaaccagcccggcc

SEQ ID NO: 1207746 - RNA, 16 nt, Mycobacterium bovis subsp bovis AF2122/97
gccaacccaauuggga

SEQ ID NO: 1207747 - RNA, 17 nt, Mycobacterium bovis subsp bovis AF2122/97
gccaacccgggccgcca

SEQ ID NO: 1207748 - RNA, 19 nt, Mycobacterium bovis subsp bovis AF2122/97
gccaacaccgccagcauga

SEQ ID NO: 1207749 - RNA, 23 nt, Mycobacterium bovis subsp bovis AF2122/97
gccaacaccgccagcaugacacc

SEQ ID NO: 1207750 - RNA, 12 nt, Mycobacterium bovis subsp bovis AF2122/97
gccaacagaugc

SEQ ID NO: 1207751 - RNA, 16 nt, Mycobacterium bovis subsp bovis AF2122/97
gccaacagaugccacc

SEQ ID NO: 1207752 - RNA, 18 nt, Mycobacterium bovis subsp bovis AF2122/97
gccaacaacaucagcgac

SEQ ID NO: 1207753 - RNA, 18 nt, Mycobacterium bovis subsp bovis AF2122/97
gccaacaacccaacaaaa

SEQ ID NO: 1207754 - RNA, 22 nt, Mycobacterium bovis subsp bovis AF2122/97
gccaacaacccaacaaaaggcc

SEQ ID NO: 1207755 - RNA, 16 nt, Mycobacterium bovis subsp bovis AF2122/97
gccaaacgccgcccgc

SEQ ID NO: 1207756 - RNA, 21 nt, Mycobacterium bovis subsp bovis AF2122/97
gccaaaagggcggcagcgagg

SEQ ID NO: 1207757 - RNA, 16 nt, Mycobacterium bovis subsp bovis AF2122/97
gccaaaacgagcagau

SEQ ID NO: 1207758 - RNA, 22 nt, Mycobacterium bovis subsp bovis AF2122/97
gccaaaacgagcagauggugaa

SEQ ID NO: 1207759 - RNA, 19 nt, Mycobacterium bovis subsp bovis AF2122/97
gccaacuuggcggccagcc

SEQ ID NO: 1207760 - RNA, 18 nt, Mycobacterium bovis subsp bovis AF2122/97
gccaacucuucagcaagc

SEQ ID NO: 1207761 - RNA, 19 nt, Mycobacterium bovis subsp bovis AF2122/97
gccaacucggcgaugacau

SEQ ID NO: 1207762 - RNA, 22 nt, Mycobacterium bovis subsp bovis AF2122/97
gccaacucggcgaugacaucac

SEQ ID NO: 1207763 - RNA, 20 nt, Mycobacterium bovis subsp bovis AF2122/97
gccaacugggccgagcgcgc

SEQ ID NO: 1207764 - RNA, 18 nt, Mycobacterium bovis subsp bovis AF2122/97
gccaacugggccgagcgc

SEQ ID NO: 1207765 - RNA, 19 nt, Mycobacterium bovis subsp bovis AF2122/97
gccaacgugacgccggcca

SEQ ID NO: 1207766 - RNA, 21 nt, Mycobacterium bovis subsp bovis AF2122/97
gccaacgugacgccggccagu

SEQ ID NO: 1207767 - RNA, 15 nt, Mycobacterium bovis subsp bovis AF2122/97
gccaacguugcgcca

SEQ ID NO: 1207768 - RNA, 20 nt, Mycobacterium bovis subsp bovis AF2122/97
gccaacguugcgccagcggu

SEQ ID NO: 1207769 - RNA, 17 nt, Mycobacterium bovis subsp bovis AF2122/97
gccaacuccucagccgc

SEQ ID NO: 1207770 - RNA, 16 nt, Mycobacterium bovis subsp bovis AF2122/97
gccaacuccagcaccc

SEQ ID NO: 1207771 - RNA, 18 nt, Mycobacterium bovis subsp bovis AF2122/97
gccaacgcgucccgccgc

SEQ ID NO: 1207772 - RNA, 20 nt, Mycobacterium bovis subsp bovis AF2122/97
gccaacgcgucccgccgcac

SEQ ID NO: 1207773 - RNA, 18 nt, Mycobacterium bovis subsp bovis AF2122/97
gccaacgaugaugaugac

SEQ ID NO: 1207774 - RNA, 20 nt, Mycobacterium bovis subsp bovis AF2122/97
gccaacccgucuuaucggcg

SEQ ID NO: 1207775 - RNA, 17 nt, Mycobacterium bovis subsp bovis AF2122/97
gccaacccugcggcguc

SEQ ID NO: 1207776 - RNA, 15 nt, Mycobacterium bovis subsp bovis AF2122/97
gccaaccgcaggccg

SEQ ID NO: 1207777 - RNA, 24 nt, Mycobacterium bovis subsp bovis AF2122/97
gccaaccggcgcaguagccgacca

SEQ ID NO: 1207778 - RNA, 14 nt, Mycobacterium bovis subsp bovis AF2122/97
gccaaccugggcca

SEQ ID NO: 1207779 - RNA, 20 nt, Mycobacterium bovis subsp bovis AF2122/97
gccaaccucugcugagcugc

SEQ ID NO: 1207780 - RNA, 15 nt, Mycobacterium bovis subsp bovis AF2122/97
gccacccgguccacc

SEQ ID NO: 1207781 - RNA, 12 nt, Mycobacterium bovis subsp bovis AF2122/97
gccacccuugcc

SEQ ID NO: 1207782 - RNA, 15 nt, Mycobacterium bovis subsp bovis AF2122/97
gccacccuugccgcc

SEQ ID NO: 1207783 - RNA, 16 nt, Mycobacterium bovis subsp bovis AF2122/97
gccaccgaacgcggcc

SEQ ID NO: 1207784 - RNA, 19 nt, Mycobacterium bovis subsp bovis AF2122/97
gccaccgaacgcggccacc

SEQ ID NO: 1207785 - RNA, 23 nt, Mycobacterium bovis subsp bovis AF2122/97
gccaccgaacuugcggaccuggc

SEQ ID NO: 1207786 - RNA, 15 nt, Mycobacterium bovis subsp bovis AF2122/97
gccaccgaagccgcc

SEQ ID NO: 1207787 - RNA, 17 nt, Mycobacterium bovis subsp bovis AF2122/97
gccaccgaagccgccgg

SEQ ID NO: 1207788 - RNA, 15 nt, Mycobacterium bovis subsp bovis AF2122/97
gccaccgaccccgga

SEQ ID NO: 1207789 - RNA, 16 nt, Mycobacterium bovis subsp bovis AF2122/97
gccaccgaccgcauga

SEQ ID NO: 1207790 - RNA, 17 nt, Mycobacterium bovis subsp bovis AF2122/97
gccaccgaccgcaugau

SEQ ID NO: 1207791 - RNA, 20 nt, Mycobacterium bovis subsp bovis AF2122/97
gccaccgaucgacugcagcc

SEQ ID NO: 1207792 - RNA, 18 nt, Mycobacterium bovis subsp bovis AF2122/97
gccaccgcacgcacgcca

SEQ ID NO: 1207793 - RNA, 14 nt, Mycobacterium bovis subsp bovis AF2122/97
gccaccgagcccuc

SEQ ID NO: 1207794 - RNA, 16 nt, Mycobacterium bovis subsp bovis AF2122/97
gccaccgaggcguuca

SEQ ID NO: 1207795 - RNA, 20 nt, Mycobacterium bovis subsp bovis AF2122/97
gccaccgagaucaugccggc

SEQ ID NO: 1207796 - RNA, 22 nt, Mycobacterium bovis subsp bovis AF2122/97
gccaccgacgacaucgguggcc

SEQ ID NO: 1207797 - RNA, 18 nt, Mycobacterium bovis subsp bovis AF2122/97
gccaccgccaccacccag

SEQ ID NO: 1207798 - RNA, 17 nt, Mycobacterium bovis subsp bovis AF2122/97
gccaccgccaccgcggc

SEQ ID NO: 1207799 - RNA, 20 nt, Mycobacterium bovis subsp bovis AF2122/97
gccaccgccaccgcggccug

SEQ ID NO: 1207800 - RNA, 21 nt, Mycobacterium bovis subsp bovis AF2122/97
gccaccggcgucugcccgccc

SEQ ID NO: 1207801 - RNA, 16 nt, Mycobacterium bovis subsp bovis AF2122/97
gccaccggcgccgccc

SEQ ID NO: 1207802 - RNA, 20 nt, Mycobacterium bovis subsp bovis AF2122/97
gccaccggcgccgcccgcgc

SEQ ID NO: 1207803 - RNA, 18 nt, Mycobacterium bovis subsp bovis AF2122/97
gccaccggcgccgccguc

SEQ ID NO: 1207804 - RNA, 23 nt, Mycobacterium bovis subsp bovis AF2122/97
gccaccggcgccgccgucgccgc

SEQ ID NO: 1207805 - RNA, 18 nt, Mycobacterium bovis subsp bovis AF2122/97
gccaccggccggcgcagu

SEQ ID NO: 1207806 - RNA, 18 nt, Mycobacterium bovis subsp bovis AF2122/97
gccaccggcgccaccggc

SEQ ID NO: 1207807 - RNA, 21 nt, Mycobacterium bovis subsp bovis AF2122/97
gccaccggcaaucggcggcac

SEQ ID NO: 1207808 - RNA, 17 nt, Mycobacterium bovis subsp bovis AF2122/97
gccaccgcccagugcca

SEQ ID NO: 1207809 - RNA, 16 nt, Mycobacterium bovis subsp bovis AF2122/97
gccaccggugccggcg

SEQ ID NO: 1207810 - RNA, 22 nt, Mycobacterium bovis subsp bovis AF2122/97
gccaccuguuggcaugccgccc

SEQ ID NO: 1207811 - RNA, 21 nt, Mycobacterium bovis subsp bovis AF2122/97
gccaccgguaccgaucagcag

SEQ ID NO: 1207812 - RNA, 18 nt, Mycobacterium bovis subsp bovis AF2122/97
gccaccgguaccgccggc

SEQ ID NO: 1207813 - RNA, 19 nt, Mycobacterium bovis subsp bovis AF2122/97
gccaccgggcgugcggcgg

SEQ ID NO: 1207814 - RNA, 20 nt, Mycobacterium bovis subsp bovis AF2122/97
gccaccgggcgugcggcggc

SEQ ID NO: 1207815 - RNA, 20 nt, Mycobacterium bovis subsp bovis AF2122/97
gccaccggugagcgcagcuu

SEQ ID NO: 1207816 - RNA, 15 nt, Mycobacterium bovis subsp bovis AF2122/97
gccaccggggucacc

SEQ ID NO: 1207817 - RNA, 22 nt, Mycobacterium bovis subsp bovis AF2122/97
gccacccgcgcgaugcuggcga

SEQ ID NO: 1207818 - RNA, 16 nt, Mycobacterium bovis subsp bovis AF2122/97
gccacccgcgccgccc

SEQ ID NO: 1207819 - RNA, 12 nt, Mycobacterium bovis subsp bovis AF2122/97
gccacccgcaac

SEQ ID NO: 1207820 - RNA, 18 nt, Mycobacterium bovis subsp bovis AF2122/97
gccacccgcggugccugc

SEQ ID NO: 1207821 - RNA, 22 nt, Mycobacterium bovis subsp bovis AF2122/97
gccacccgcggugccugcagcu

SEQ ID NO: 1207822 - RNA, 22 nt, Mycobacterium bovis subsp bovis AF2122/97
gccacccggacauagccgcgcu

SEQ ID NO: 1207823 - RNA, 23 nt, Mycobacterium bovis subsp bovis AF2122/97
gccaccccugcgguccgcugcca

SEQ ID NO: 1207824 - RNA, 22 nt, Mycobacterium bovis subsp bovis AF2122/97
gccacccagaugcagcggucca

SEQ ID NO: 1207825 - RNA, 21 nt, Mycobacterium bovis subsp bovis AF2122/97
gccacccagcaccagggcgcg

SEQ ID NO: 1207826 - RNA, 15 nt, Mycobacterium bovis subsp bovis AF2122/97
gccacacucccgcgc

SEQ ID NO: 1207827 - RNA, 19 nt, Mycobacterium bovis subsp bovis AF2122/97
gccacacucgccagggcca

SEQ ID NO: 1207828 - RNA, 21 nt, Mycobacterium bovis subsp bovis AF2122/97
gccacacucgccagggccauc

SEQ ID NO: 1207829 - RNA, 21 nt, Mycobacterium bovis subsp bovis AF2122/97
gccacaccgucacgccaccgc

SEQ ID NO: 1207830 - RNA, 14 nt, Mycobacterium bovis subsp bovis AF2122/97
gccacaaccucguc

SEQ ID NO: 1207831 - RNA, 15 nt, Mycobacterium bovis subsp bovis AF2122/97
gccacaccgccgcca

SEQ ID NO: 1207832 - RNA, 18 nt, Mycobacterium bovis subsp bovis AF2122/97
gccacaccuuggccgccg

SEQ ID NO: 1207833 - RNA, 19 nt, Mycobacterium bovis subsp bovis AF2122/97
gccacaccuuggccgccgg

SEQ ID NO: 1207834 - RNA, 20 nt, Mycobacterium bovis subsp bovis AF2122/97
gccacaccuuggccgccggc

SEQ ID NO: 1207835 - RNA, 14 nt, Mycobacterium bovis subsp bovis AF2122/97
gccacacggggccg

SEQ ID NO: 1207836 - RNA, 16 nt, Mycobacterium bovis subsp bovis AF2122/97
gccacagcccggcggc

SEQ ID NO: 1207837 - RNA, 20 nt, Mycobacterium bovis subsp bovis AF2122/97
gccacgguggagcgcgccuc

SEQ ID NO: 1207838 - RNA, 22 nt, Mycobacterium bovis subsp bovis AF2122/97
gccacgguggagcgcgccucgc

SEQ ID NO: 1207839 - RNA, 14 nt, Mycobacterium bovis subsp bovis AF2122/97
gccacgguccggcc

SEQ ID NO: 1207840 - RNA, 20 nt, Mycobacterium bovis subsp bovis AF2122/97
gccacgguccggcccaccag

SEQ ID NO: 1207841 - RNA, 19 nt, Mycobacterium bovis subsp bovis AF2122/97
gccacgguggagcgcgccu

SEQ ID NO: 1207842 - RNA, 22 nt, Mycobacterium bovis subsp bovis AF2122/97
gccacggugucgcgaugcuucc

SEQ ID NO: 1207843 - RNA, 17 nt, Mycobacterium bovis subsp bovis AF2122/97
gccacgguucgggcagc

SEQ ID NO: 1207844 - RNA, 18 nt, Mycobacterium bovis subsp bovis AF2122/97
gccacgguucgggcagca

SEQ ID NO: 1207845 - RNA, 19 nt, Mycobacterium bovis subsp bovis AF2122/97
gccacgguugguccaaugc

SEQ ID NO: 1207846 - RNA, 19 nt, Mycobacterium bovis subsp bovis AF2122/97
gccacguacuccaccgcgc

SEQ ID NO: 1207847 - RNA, 15 nt, Mycobacterium bovis subsp bovis AF2122/97
gccacguagcagcag

SEQ ID NO: 1207848 - RNA, 17 nt, Mycobacterium bovis subsp bovis AF2122/97
gccacguagcagcagac

SEQ ID NO: 1207849 - RNA, 14 nt, Mycobacterium bovis subsp bovis AF2122/97
gccacguagcagcg

SEQ ID NO: 1207850 - RNA, 13 nt, Mycobacterium bovis subsp bovis AF2122/97
gccacggcugccc

SEQ ID NO: 1207851 - RNA, 21 nt, Mycobacterium bovis subsp bovis AF2122/97
gccacggguagcugccgcggc

SEQ ID NO: 1207852 - RNA, 19 nt, Mycobacterium bovis subsp bovis AF2122/97
gccacggcuguggccgcaa

SEQ ID NO: 1207853 - RNA, 21 nt, Mycobacterium bovis subsp bovis AF2122/97
gccacggcuguggccgcaauc

SEQ ID NO: 1207854 - RNA, 18 nt, Mycobacterium bovis subsp bovis AF2122/97
gccacggcuucgccgcgg

SEQ ID NO: 1207855 - RNA, 19 nt, Mycobacterium bovis subsp bovis AF2122/97
gccacggcuuugcggcgcg

SEQ ID NO: 1207856 - RNA, 22 nt, Mycobacterium bovis subsp bovis AF2122/97
gccacggcuuugcggcgcgacc

SEQ ID NO: 1207857 - RNA, 18 nt, Mycobacterium bovis subsp bovis AF2122/97
gccacggcaucggccacc

SEQ ID NO: 1207858 - RNA, 22 nt, Mycobacterium bovis subsp bovis AF2122/97
gccacggcagcgcccagaucgc

SEQ ID NO: 1207859 - RNA, 14 nt, Mycobacterium bovis subsp bovis AF2122/97
gccacgauccuugg

SEQ ID NO: 1207860 - RNA, 19 nt, Mycobacterium bovis subsp bovis AF2122/97
gccacgacgaacaccagcg

SEQ ID NO: 1207861 - RNA, 21 nt, Mycobacterium bovis subsp bovis AF2122/97
gccaccuuggcguugaccagc

SEQ ID NO: 1207862 - RNA, 17 nt, Mycobacterium bovis subsp bovis AF2122/97
gccaccuugugcaggcc

SEQ ID NO: 1207863 - RNA, 18 nt, Mycobacterium bovis subsp bovis AF2122/97
gccacugcuuccggaaca

SEQ ID NO: 1207864 - RNA, 15 nt, Mycobacterium bovis subsp bovis AF2122/97
gccacugccagccgu

SEQ ID NO: 1207865 - RNA, 15 nt, Mycobacterium bovis subsp bovis AF2122/97
gccacugccgaccag

SEQ ID NO: 1207866 - RNA, 18 nt, Mycobacterium bovis subsp bovis AF2122/97
gccacugccguugccgcc

SEQ ID NO: 1207867 - RNA, 15 nt, Mycobacterium bovis subsp bovis AF2122/97
gccacucgcccgcug

SEQ ID NO: 1207868 - RNA, 17 nt, Mycobacterium bovis subsp bovis AF2122/97
gccacucgcccgcugcc

SEQ ID NO: 1207869 - RNA, 22 nt, Mycobacterium bovis subsp bovis AF2122/97
gccacuccgguggccaacaccg

SEQ ID NO: 1207870 - RNA, 17 nt, Mycobacterium bovis subsp bovis AF2122/97
gccacugauucgcaggc

SEQ ID NO: 1207871 - RNA, 14 nt, Mycobacterium bovis subsp bovis AF2122/97
gccacuagcccuga

SEQ ID NO: 1207872 - RNA, 22 nt, Mycobacterium bovis subsp bovis AF2122/97
gccacgucccaggacuccggcc

SEQ ID NO: 1207873 - RNA, 18 nt, Mycobacterium bovis subsp bovis AF2122/97
gccacuacggccuggcca

SEQ ID NO: 1207874 - RNA, 13 nt, Mycobacterium bovis subsp bovis AF2122/97
gccacguccugcc

SEQ ID NO: 1207875 - RNA, 16 nt, Mycobacterium bovis subsp bovis AF2122/97
gccacgucgagcaccc

SEQ ID NO: 1207876 - RNA, 19 nt, Mycobacterium bovis subsp bovis AF2122/97
gccacguccucagccgugc

SEQ ID NO: 1207877 - RNA, 21 nt, Mycobacterium bovis subsp bovis AF2122/97
gccacguccucagccgugccc

SEQ ID NO: 1207878 - RNA, 16 nt, Mycobacterium bovis subsp bovis AF2122/97
gccacguucgcggcca

SEQ ID NO: 1207879 - RNA, 12 nt, Mycobacterium bovis subsp bovis AF2122/97
gccccgagcugc

SEQ ID NO: 1207880 - RNA, 16 nt, Mycobacterium bovis subsp bovis AF2122/97
gccccgaccgcguaca

SEQ ID NO: 1207881 - RNA, 21 nt, Mycobacterium bovis subsp bovis AF2122/97
gcccccgacuccggcaggccc

SEQ ID NO: 1207882 - RNA, 21 nt, Mycobacterium bovis subsp bovis AF2122/97
gcccccgccauugccgccggc

SEQ ID NO: 1207883 - RNA, 23 nt, Mycobacterium bovis subsp bovis AF2122/97
gccccccagugcagacaggcggc

SEQ ID NO: 1207884 - RNA, 23 nt, Mycobacterium bovis subsp bovis AF2122/97
gccccccagacaauccgccgccg

SEQ ID NO: 1207885 - RNA, 13 nt, Mycobacterium bovis subsp bovis AF2122/97
gccccccggggcc

SEQ ID NO: 1207886 - RNA, 14 nt, Mycobacterium bovis subsp bovis AF2122/97
gccccccggggccg

SEQ ID NO: 1207887 - RNA, 14 nt, Mycobacterium bovis subsp bovis AF2122/97
gccccccgcgccug

SEQ ID NO: 1207888 - RNA, 20 nt, Mycobacterium bovis subsp bovis AF2122/97
gccccgccaccucgccggcc

SEQ ID NO: 1207889 - RNA, 18 nt, Mycobacterium bovis subsp bovis AF2122/97
gccccgcaucgcccaagc

SEQ ID NO: 1207890 - RNA, 23 nt, Mycobacterium bovis subsp bovis AF2122/97
gccccgauaaaaaccacccccac

SEQ ID NO: 1207891 - RNA, 15 nt, Mycobacterium bovis subsp bovis AF2122/97
gccccgcggcgccgc

SEQ ID NO: 1207892 - RNA, 17 nt, Mycobacterium bovis subsp bovis AF2122/97
gccccgcgccggccgca

SEQ ID NO: 1207893 - RNA, 20 nt, Mycobacterium bovis subsp bovis AF2122/97
gccccgcgcguucggcgagc

SEQ ID NO: 1207894 - RNA, 15 nt, Mycobacterium bovis subsp bovis AF2122/97
gccccgcggagcgca

SEQ ID NO: 1207895 - RNA, 12 nt, Mycobacterium bovis subsp bovis AF2122/97
gccccgcggcgc

SEQ ID NO: 1207896 - RNA, 13 nt, Mycobacterium bovis subsp bovis AF2122/97
gcccccagguaac

SEQ ID NO: 1207897 - RNA, 15 nt, Mycobacterium bovis subsp bovis AF2122/97
gccccaucaccaccg

SEQ ID NO: 1207898 - RNA, 15 nt, Mycobacterium bovis subsp bovis AF2122/97
gccccaguccgaagc

SEQ ID NO: 1207899 - RNA, 22 nt, Mycobacterium bovis subsp bovis AF2122/97
gccccagggggcgugccgccgc

SEQ ID NO: 1207900 - RNA, 19 nt, Mycobacterium bovis subsp bovis AF2122/97
gccccaggugguucaaccg

SEQ ID NO: 1207901 - RNA, 15 nt, Mycobacterium bovis subsp bovis AF2122/97
gccccagguuccgcu

SEQ ID NO: 1207902 - RNA, 22 nt, Mycobacterium bovis subsp bovis AF2122/97
gccccagcugcggucgcggcug

SEQ ID NO: 1207903 - RNA, 15 nt, Mycobacterium bovis subsp bovis AF2122/97
gcccgccaccggagg

SEQ ID NO: 1207904 - RNA, 18 nt, Mycobacterium bovis subsp bovis AF2122/97
gcccgccaccggaggugc

SEQ ID NO: 1207905 - RNA, 13 nt, Mycobacterium bovis subsp bovis AF2122/97
gcccgccaccggc

SEQ ID NO: 1207906 - RNA, 19 nt, Mycobacterium bovis subsp bovis AF2122/97
gcccgcauugccaacgccc

SEQ ID NO: 1207907 - RNA, 15 nt, Mycobacterium bovis subsp bovis AF2122/97
gcccgcauccgcacc

SEQ ID NO: 1207908 - RNA, 14 nt, Mycobacterium bovis subsp bovis AF2122/97
gcccgcaucgcggc

SEQ ID NO: 1207909 - RNA, 23 nt, Mycobacterium bovis subsp bovis AF2122/97
gcccgcaccgcugaccccggcag

SEQ ID NO: 1207910 - RNA, 21 nt, Mycobacterium bovis subsp bovis AF2122/97
gcccgcacguuggcggccagc

SEQ ID NO: 1207911 - RNA, 16 nt, Mycobacterium bovis subsp bovis AF2122/97
gcccgcacugccgccg

SEQ ID NO: 1207912 - RNA, 17 nt, Mycobacterium bovis subsp bovis AF2122/97
gcccgcacugccgccgg

SEQ ID NO: 1207913 - RNA, 13 nt, Mycobacterium bovis subsp bovis AF2122/97
gcccgcagcagca

SEQ ID NO: 1207914 - RNA, 19 nt, Mycobacterium bovis subsp bovis AF2122/97
gcccgcacccguccggccg

SEQ ID NO: 1207915 - RNA, 13 nt, Mycobacterium bovis subsp bovis AF2122/97
gcccgcaccaccg

SEQ ID NO: 1207916 - RNA, 22 nt, Mycobacterium bovis subsp bovis AF2122/97
gcccgacaccgccccgccgcga

SEQ ID NO: 1207917 - RNA, 21 nt, Mycobacterium bovis subsp bovis AF2122/97
gcccgacccaucaccagcggc

SEQ ID NO: 1207918 - RNA, 14 nt, Mycobacterium bovis subsp bovis AF2122/97
gcccgacccaucac

SEQ ID NO: 1207919 - RNA, 17 nt, Mycobacterium bovis subsp bovis AF2122/97
gcccgacccaucaccag

SEQ ID NO: 1207920 - RNA, 19 nt, Mycobacterium bovis subsp bovis AF2122/97
gcccgacccaucaccagcg

SEQ ID NO: 1207921 - RNA, 16 nt, Mycobacterium bovis subsp bovis AF2122/97
gcccgacccggccgau

SEQ ID NO: 1207922 - RNA, 20 nt, Mycobacterium bovis subsp bovis AF2122/97
gcccgauugaguucggcggc

SEQ ID NO: 1207923 - RNA, 23 nt, Mycobacterium bovis subsp bovis AF2122/97
gcccgauggugccgacccgccgc

SEQ ID NO: 1207924 - RNA, 18 nt, Mycobacterium bovis subsp bovis AF2122/97
gcccgaugguggugccga

SEQ ID NO: 1207925 - RNA, 24 nt, Mycobacterium bovis subsp bovis AF2122/97
gcccgacacccgcauggcagcggc

SEQ ID NO: 1207926 - RNA, 21 nt, Mycobacterium bovis subsp bovis AF2122/97
gcccgaugguacccgcgccgc

SEQ ID NO: 1207927 - RNA, 18 nt, Mycobacterium bovis subsp bovis AF2122/97
gcccgauggugccgaccc

SEQ ID NO: 1207928 - RNA, 15 nt, Mycobacterium bovis subsp bovis AF2122/97
gcccgcaacgccaac

SEQ ID NO: 1207929 - RNA, 21 nt, Mycobacterium bovis subsp bovis AF2122/97
gcccgcaauuguucgcggccg

SEQ ID NO: 1207930 - RNA, 21 nt, Mycobacterium bovis subsp bovis AF2122/97
gcccgaaugcggugaguccgc

SEQ ID NO: 1207931 - RNA, 19 nt, Mycobacterium bovis subsp bovis AF2122/97
gccccugucaacgccgcgg

SEQ ID NO: 1207932 - RNA, 14 nt, Mycobacterium bovis subsp bovis AF2122/97
gccccugcacagca

SEQ ID NO: 1207933 - RNA, 15 nt, Mycobacterium bovis subsp bovis AF2122/97
gccccugcacagcag

SEQ ID NO: 1207934 - RNA, 16 nt, Mycobacterium bovis subsp bovis AF2122/97
gccccugcacagcagg

SEQ ID NO: 1207935 - RNA, 18 nt, Mycobacterium bovis subsp bovis AF2122/97
gccccugcacagcaggcu

SEQ ID NO: 1207936 - RNA, 20 nt, Mycobacterium bovis subsp bovis AF2122/97
gccccugcgcggccaccuca

SEQ ID NO: 1207937 - RNA, 18 nt, Mycobacterium bovis subsp bovis AF2122/97
gccccggcaagcgcagac

SEQ ID NO: 1207938 - RNA, 20 nt, Mycobacterium bovis subsp bovis AF2122/97
gccccuccaggggcuggugc

SEQ ID NO: 1207939 - RNA, 15 nt, Mycobacterium bovis subsp bovis AF2122/97
gccccuccgcgccga

SEQ ID NO: 1207940 - RNA, 22 nt, Mycobacterium bovis subsp bovis AF2122/97
gccccucgucgucaucgagcgg

SEQ ID NO: 1207941 - RNA, 16 nt, Mycobacterium bovis subsp bovis AF2122/97
gccccugaaggccagc

SEQ ID NO: 1207942 - RNA, 18 nt, Mycobacterium bovis subsp bovis AF2122/97
gcccagcgaccaguggug

SEQ ID NO: 1207943 - RNA, 19 nt, Mycobacterium bovis subsp bovis AF2122/97
gcccagcgcccgcgcggcc

SEQ ID NO: 1207944 - RNA, 14 nt, Mycobacterium bovis subsp bovis AF2122/97
gcccagccgagcgg

SEQ ID NO: 1207945 - RNA, 18 nt, Mycobacterium bovis subsp bovis AF2122/97
gcccagccgagcggcggc

SEQ ID NO: 1207946 - RNA, 20 nt, Mycobacterium bovis subsp bovis AF2122/97
gcccagccgagcguggcguu

SEQ ID NO: 1207947 - RNA, 20 nt, Mycobacterium bovis subsp bovis AF2122/97
gcccagcaggcccuuggcga

SEQ ID NO: 1207948 - RNA, 17 nt, Mycobacterium bovis subsp bovis AF2122/97
gcccagccgccagcccg

SEQ ID NO: 1207949 - RNA, 23 nt, Mycobacterium bovis subsp bovis AF2122/97
gcccaggccgaucagcgcggcgc

SEQ ID NO: 1207950 - RNA, 16 nt, Mycobacterium bovis subsp bovis AF2122/97
gcccagcgccuccagc

SEQ ID NO: 1207951 - RNA, 16 nt, Mycobacterium bovis subsp bovis AF2122/97
gcccagcgcgccagcu

SEQ ID NO: 1207952 - RNA, 15 nt, Mycobacterium bovis subsp bovis AF2122/97
gcccagcgcuagccg

SEQ ID NO: 1207953 - RNA, 20 nt, Mycobacterium bovis subsp bovis AF2122/97
gcccagauguuuagcguccg

SEQ ID NO: 1207954 - RNA, 22 nt, Mycobacterium bovis subsp bovis AF2122/97
gcccagcaccaccgcggugugc

SEQ ID NO: 1207955 - RNA, 20 nt, Mycobacterium bovis subsp bovis AF2122/97
gcccagcacccucaggcaau

SEQ ID NO: 1207956 - RNA, 14 nt, Mycobacterium bovis subsp bovis AF2122/97
gcccagcagcaccu

SEQ ID NO: 1207957 - RNA, 19 nt, Mycobacterium bovis subsp bovis AF2122/97
gcccagcagcaccugcacc

SEQ ID NO: 1207958 - RNA, 12 nt, Mycobacterium bovis subsp bovis AF2122/97
gcccagcagcac

SEQ ID NO: 1207959 - RNA, 18 nt, Mycobacterium bovis subsp bovis AF2122/97
gcccagcacguaacccag

SEQ ID NO: 1207960 - RNA, 19 nt, Mycobacterium bovis subsp bovis AF2122/97
gcccagauagagcuggugc

SEQ ID NO: 1207961 - RNA, 16 nt, Mycobacterium bovis subsp bovis AF2122/97
gcccagaccgacccgc

SEQ ID NO: 1207962 - RNA, 17 nt, Mycobacterium bovis subsp bovis AF2122/97
gcccagaccgccgacgc

SEQ ID NO: 1207963 - RNA, 15 nt, Mycobacterium bovis subsp bovis AF2122/97
gcccagagccgcugc

SEQ ID NO: 1207964 - RNA, 22 nt, Mycobacterium bovis subsp bovis AF2122/97
gcccagagccgcugcggcaccg

SEQ ID NO: 1207965 - RNA, 19 nt, Mycobacterium bovis subsp bovis AF2122/97
gcccaagguggcggccagu

SEQ ID NO: 1207966 - RNA, 17 nt, Mycobacterium bovis subsp bovis AF2122/97
gcccaagcucagggugg

SEQ ID NO: 1207967 - RNA, 15 nt, Mycobacterium bovis subsp bovis AF2122/97
gcccagguugccuug

SEQ ID NO: 1207968 - RNA, 18 nt, Mycobacterium bovis subsp bovis AF2122/97
gcccaugcuucggagacc

SEQ ID NO: 1207969 - RNA, 21 nt, Mycobacterium bovis subsp bovis AF2122/97
gcccagugggacaggucggca

SEQ ID NO: 1207970 - RNA, 15 nt, Mycobacterium bovis subsp bovis AF2122/97
gcccaguuccgcugc

SEQ ID NO: 1207971 - RNA, 17 nt, Mycobacterium bovis subsp bovis AF2122/97
gcccaucucaugcaucu

SEQ ID NO: 1207972 - RNA, 21 nt, Mycobacterium bovis subsp bovis AF2122/97
gcccaucucaugcaucugcuu

SEQ ID NO: 1207973 - RNA, 14 nt, Mycobacterium bovis subsp bovis AF2122/97
gccccacagcgugc

SEQ ID NO: 1207974 - RNA, 14 nt, Mycobacterium bovis subsp bovis AF2122/97
gcccauggccacca

SEQ ID NO: 1207975 - RNA, 15 nt, Mycobacterium bovis subsp bovis AF2122/97
gcccauuucgagcuc

SEQ ID NO: 1207976 - RNA, 18 nt, Mycobacterium bovis subsp bovis AF2122/97
gccccaccauucgcgggc

SEQ ID NO: 1207977 - RNA, 17 nt, Mycobacterium bovis subsp bovis AF2122/97
gccccacccgcaugccc

SEQ ID NO: 1207978 - RNA, 14 nt, Mycobacterium bovis subsp bovis AF2122/97
gccccacccgccgc

SEQ ID NO: 1207979 - RNA, 13 nt, Mycobacterium bovis subsp bovis AF2122/97
gccccaccggccg

SEQ ID NO: 1207980 - RNA, 11 nt, Mycobacterium bovis subsp bovis AF2122/97
gccccaccggu

SEQ ID NO: 1207981 - RNA, 12 nt, Mycobacterium bovis subsp bovis AF2122/97
gccccaccggua

SEQ ID NO: 1207982 - RNA, 14 nt, Mycobacterium bovis subsp bovis AF2122/97
gccccaccgacagc

SEQ ID NO: 1207983 - RNA, 23 nt, Mycobacterium bovis subsp bovis AF2122/97
gccccagauauugaaccgggcca

SEQ ID NO: 1207984 - RNA, 21 nt, Mycobacterium bovis subsp bovis AF2122/97
gccaguguugcgcugcggcca

SEQ ID NO: 1207985 - RNA, 14 nt, Mycobacterium bovis subsp bovis AF2122/97
gccaguucgcggcu

SEQ ID NO: 1207986 - RNA, 15 nt, Mycobacterium bovis subsp bovis AF2122/97
gccaguucggugagc

SEQ ID NO: 1207987 - RNA, 18 nt, Mycobacterium bovis subsp bovis AF2122/97
gccaguucggcggccgcc

SEQ ID NO: 1207988 - RNA, 16 nt, Mycobacterium bovis subsp bovis AF2122/97
gccagugaacgcgcgu

SEQ ID NO: 1207989 - RNA, 18 nt, Mycobacterium bovis subsp bovis AF2122/97
gccagugaacgcgcgugc

SEQ ID NO: 1207990 - RNA, 21 nt, Mycobacterium bovis subsp bovis AF2122/97
gccagugaacgcgcgugcagc

SEQ ID NO: 1207991 - RNA, 16 nt, Mycobacterium bovis subsp bovis AF2122/97
gccagugcgcgcguca

SEQ ID NO: 1207992 - RNA, 15 nt, Mycobacterium bovis subsp bovis AF2122/97
gccagugccaccugg

SEQ ID NO: 1207993 - RNA, 22 nt, Mycobacterium bovis subsp bovis AF2122/97
gccagugccaccugggcgggcu

SEQ ID NO: 1207994 - RNA, 13 nt, Mycobacterium bovis subsp bovis AF2122/97
gccagugccgccc

SEQ ID NO: 1207995 - RNA, 21 nt, Mycobacterium bovis subsp bovis AF2122/97
gccagugcguggugggcggga

SEQ ID NO: 1207996 - RNA, 20 nt, Mycobacterium bovis subsp bovis AF2122/97
gccaguccgaaagccgccga

SEQ ID NO: 1207997 - RNA, 13 nt, Mycobacterium bovis subsp bovis AF2122/97
gccaguccgcagc

SEQ ID NO: 1207998 - RNA, 19 nt, Mycobacterium bovis subsp bovis AF2122/97
gccaguccggacggcagcc

SEQ ID NO: 1207999 - RNA, 14 nt, Mycobacterium bovis subsp bovis AF2122/97
gccaguccgcgcgc

SEQ ID NO: 1208000 - RNA, 14 nt, Mycobacterium bovis subsp bovis AF2122/97
gccaguccgcagcg

SEQ ID NO: 1208001 - RNA, 20 nt, Mycobacterium bovis subsp bovis AF2122/97
gccaguccgcagcguccagc

SEQ ID NO: 1208002 - RNA, 19 nt, Mycobacterium bovis subsp bovis AF2122/97
gccaguaugcggugcccgc

SEQ ID NO: 1208003 - RNA, 13 nt, Mycobacterium bovis subsp bovis AF2122/97
gccaguccagcgc

SEQ ID NO: 1208004 - RNA, 15 nt, Mycobacterium bovis subsp bovis AF2122/97
gccaguccagcgcgc

SEQ ID NO: 1208005 - RNA, 22 nt, Mycobacterium bovis subsp bovis AF2122/97
gccaguccagcgcgccacccag

SEQ ID NO: 1208006 - RNA, 20 nt, Mycobacterium bovis subsp bovis AF2122/97
gccaggugcccaagcagucc

SEQ ID NO: 1208007 - RNA, 13 nt, Mycobacterium bovis subsp bovis AF2122/97
gccaggugcagca

SEQ ID NO: 1208008 - RNA, 14 nt, Mycobacterium bovis subsp bovis AF2122/97
gccaggugcagcac

SEQ ID NO: 1208009 - RNA, 17 nt, Mycobacterium bovis subsp bovis AF2122/97
gccaggugaugccgccg

SEQ ID NO: 1208010 - RNA, 22 nt, Mycobacterium bovis subsp bovis AF2122/97
gccaggugaugccgccgugguu

SEQ ID NO: 1208011 - RNA, 19 nt, Mycobacterium bovis subsp bovis AF2122/97
gccaggucggugggcggcg

SEQ ID NO: 1208012 - RNA, 16 nt, Mycobacterium bovis subsp bovis AF2122/97
gccaggucuccuuggg

SEQ ID NO: 1208013 - RNA, 19 nt, Mycobacterium bovis subsp bovis AF2122/97
gccaggucuccuugggcga

SEQ ID NO: 1208014 - RNA, 17 nt, Mycobacterium bovis subsp bovis AF2122/97
gccagguuuugccgcgu

SEQ ID NO: 1208015 - RNA, 17 nt, Mycobacterium bovis subsp bovis AF2122/97
gccaguaacgcccacaa

SEQ ID NO: 1208016 - RNA, 22 nt, Mycobacterium bovis subsp bovis AF2122/97
gccagguccgccggugccgccg

SEQ ID NO: 1208017 - RNA, 20 nt, Mycobacterium bovis subsp bovis AF2122/97
gccaggucagccgcgcgggu

SEQ ID NO: 1208018 - RNA, 20 nt, Mycobacterium bovis subsp bovis AF2122/97
gccaggucagcuccaucccc

SEQ ID NO: 1208019 - RNA, 16 nt, Mycobacterium bovis subsp bovis AF2122/97
gccaggucagccgcgc

SEQ ID NO: 1208020 - RNA, 15 nt, Mycobacterium bovis subsp bovis AF2122/97
gccaggucggccacc

SEQ ID NO: 1208021 - RNA, 20 nt, Mycobacterium bovis subsp bovis AF2122/97
gccaggucggcgaugaugac

SEQ ID NO: 1208022 - RNA, 21 nt, Mycobacterium bovis subsp bovis AF2122/97
gccagggucacaaacccagca

SEQ ID NO: 1208023 - RNA, 17 nt, Mycobacterium bovis subsp bovis AF2122/97
gccagggucccgccgcc

SEQ ID NO: 1208024 - RNA, 19 nt, Mycobacterium bovis subsp bovis AF2122/97
gccagggcccuagccggcg

SEQ ID NO: 1208025 - RNA, 15 nt, Mycobacterium bovis subsp bovis AF2122/97
gccagggaggggccg

SEQ ID NO: 1208026 - RNA, 22 nt, Mycobacterium bovis subsp bovis AF2122/97
gccagggcccuagccggcgcgc

SEQ ID NO: 1208027 - RNA, 14 nt, Mycobacterium bovis subsp bovis AF2122/97
gccaggggcgcagc

SEQ ID NO: 1208028 - RNA, 20 nt, Mycobacterium bovis subsp bovis AF2122/97
gccacuguugaagaagcccg

SEQ ID NO: 1208029 - RNA, 21 nt, Mycobacterium bovis subsp bovis AF2122/97
gccacuguugaagaagcccga

SEQ ID NO: 1208030 - RNA, 17 nt, Mycobacterium bovis subsp bovis AF2122/97
gccaggcuugcggcacc

SEQ ID NO: 1208031 - RNA, 14 nt, Mycobacterium bovis subsp bovis AF2122/97
gccaggcuggccaa

SEQ ID NO: 1208032 - RNA, 14 nt, Mycobacterium bovis subsp bovis AF2122/97
gccaucgccgccgg

SEQ ID NO: 1208033 - RNA, 20 nt, Mycobacterium bovis subsp bovis AF2122/97
gccaucgcccgaugcgccag

SEQ ID NO: 1208034 - RNA, 14 nt, Mycobacterium bovis subsp bovis AF2122/97
gccauccccgccgg

SEQ ID NO: 1208035 - RNA, 15 nt, Mycobacterium bovis subsp bovis AF2122/97
gccaucccgccgccc

SEQ ID NO: 1208036 - RNA, 20 nt, Mycobacterium bovis subsp bovis AF2122/97
gccauccccggagcgauccg

SEQ ID NO: 1208037 - RNA, 14 nt, Mycobacterium bovis subsp bovis AF2122/97
gccauccccuggcc

SEQ ID NO: 1208038 - RNA, 23 nt, Mycobacterium bovis subsp bovis AF2122/97
gccaucacggcggggaucgcugg

SEQ ID NO: 1208039 - RNA, 17 nt, Mycobacterium bovis subsp bovis AF2122/97
gccaucagaaccuccuc

SEQ ID NO: 1208040 - RNA, 21 nt, Mycobacterium bovis subsp bovis AF2122/97
gccaucaacgacuucgggaac

SEQ ID NO: 1208041 - RNA, 15 nt, Mycobacterium bovis subsp bovis AF2122/97
gccaucaaggccacc

SEQ ID NO: 1208042 - RNA, 18 nt, Mycobacterium bovis subsp bovis AF2122/97
gccauagugaggccgacc

SEQ ID NO: 1208043 - RNA, 18 nt, Mycobacterium bovis subsp bovis AF2122/97
gccaguugguagccgccc

SEQ ID NO: 1208044 - RNA, 18 nt, Mycobacterium bovis subsp bovis AF2122/97
gccauaaccgguggggac

SEQ ID NO: 1208045 - RNA, 15 nt, Mycobacterium bovis subsp bovis AF2122/97
gccauagcccgagcg

SEQ ID NO: 1208046 - RNA, 16 nt, Mycobacterium bovis subsp bovis AF2122/97
gccauaggcccacggc

SEQ ID NO: 1208047 - RNA, 16 nt, Mycobacterium bovis subsp bovis AF2122/97
gccauagcgggcggua

SEQ ID NO: 1208048 - RNA, 15 nt, Mycobacterium bovis subsp bovis AF2122/97
gccauggaucccacg

SEQ ID NO: 1208049 - RNA, 20 nt, Mycobacterium bovis subsp bovis AF2122/97
gccauguagccguugccgcc

SEQ ID NO: 1208050 - RNA, 15 nt, Mycobacterium bovis subsp bovis AF2122/97
gccaucggacagcau

SEQ ID NO: 1208051 - RNA, 19 nt, Mycobacterium bovis subsp bovis AF2122/97
gccaucgggucacccccgg

SEQ ID NO: 1208052 - RNA, 17 nt, Mycobacterium bovis subsp bovis AF2122/97
gccaucguccagcagga

SEQ ID NO: 1208053 - RNA, 16 nt, Mycobacterium bovis subsp bovis AF2122/97
gccaucgucgcgccgc

SEQ ID NO: 1208054 - RNA, 18 nt, Mycobacterium bovis subsp bovis AF2122/97
gccaucgucgaagaccuc

SEQ ID NO: 1208055 - RNA, 13 nt, Mycobacterium bovis subsp bovis AF2122/97
gccaugaucacac

SEQ ID NO: 1208056 - RNA, 15 nt, Mycobacterium bovis subsp bovis AF2122/97
gccaugagcgcgccc

SEQ ID NO: 1208057 - RNA, 23 nt, Mycobacterium bovis subsp bovis AF2122/97
gccaugagcgcgcccaaccuggg

SEQ ID NO: 1208058 - RNA, 19 nt, Mycobacterium bovis subsp bovis AF2122/97
gccaugaucacaccgcugc

SEQ ID NO: 1208059 - RNA, 15 nt, Mycobacterium bovis subsp bovis AF2122/97
gccauguccaccagc

SEQ ID NO: 1208060 - RNA, 19 nt, Mycobacterium bovis subsp bovis AF2122/97
gccauuccagaucaacgcg

SEQ ID NO: 1208061 - RNA, 14 nt, Mycobacterium bovis subsp bovis AF2122/97
gccauuccagccgg

SEQ ID NO: 1208062 - RNA, 16 nt, Mycobacterium bovis subsp bovis AF2122/97
gccauucuucgaucag

SEQ ID NO: 1208063 - RNA, 21 nt, Mycobacterium bovis subsp bovis AF2122/97
gccauugacgccguugccgcc

SEQ ID NO: 1208064 - RNA, 16 nt, Mycobacterium bovis subsp bovis AF2122/97
gcccaaaagcgcggca

SEQ ID NO: 1208065 - RNA, 18 nt, Mycobacterium bovis subsp bovis AF2122/97
gcccaaaaggaagaccuc

SEQ ID NO: 1208066 - RNA, 18 nt, Mycobacterium bovis subsp bovis AF2122/97
gcccaacucggccagcuu

SEQ ID NO: 1208067 - RNA, 23 nt, Mycobacterium bovis subsp bovis AF2122/97
gcccaagcccucgacguccaucc

SEQ ID NO: 1208068 - RNA, 14 nt, Mycobacterium bovis subsp bovis AF2122/97
gcccaagaucucgc

SEQ ID NO: 1208069 - RNA, 17 nt, Mycobacterium bovis subsp bovis AF2122/97
gcccgccucaucggcaa

SEQ ID NO: 1208070 - RNA, 18 nt, Mycobacterium bovis subsp bovis AF2122/97
gcccgccucgcagcgaca

SEQ ID NO: 1208071 - RNA, 20 nt, Mycobacterium bovis subsp bovis AF2122/97
gcccgccucugucuucagcu

SEQ ID NO: 1208072 - RNA, 19 nt, Mycobacterium bovis subsp bovis AF2122/97
gcccgccggccccgccggc

SEQ ID NO: 1208073 - RNA, 21 nt, Mycobacterium bovis subsp bovis AF2122/97
gcccgggguccaucggggccg

SEQ ID NO: 1208074 - RNA, 18 nt, Mycobacterium bovis subsp bovis AF2122/97
gcccgggucuccggcgca

SEQ ID NO: 1208075 - RNA, 19 nt, Mycobacterium bovis subsp bovis AF2122/97
gcccgggucuccggcgcac

SEQ ID NO: 1208076 - RNA, 16 nt, Mycobacterium bovis subsp bovis AF2122/97
gcccgggugacgggaa

SEQ ID NO: 1208077 - RNA, 23 nt, Mycobacterium bovis subsp bovis AF2122/97
gcccggguaucgccaguggugca

SEQ ID NO: 1208078 - RNA, 17 nt, Mycobacterium bovis subsp bovis AF2122/97
gcccggggcgcacagcu

SEQ ID NO: 1208079 - RNA, 22 nt, Mycobacterium bovis subsp bovis AF2122/97
gcccggggcgcucgugauguug

SEQ ID NO: 1208080 - RNA, 15 nt, Mycobacterium bovis subsp bovis AF2122/97
gcccggggcgguggg

SEQ ID NO: 1208081 - RNA, 16 nt, Mycobacterium bovis subsp bovis AF2122/97
gcccgguacgccgcgc

SEQ ID NO: 1208082 - RNA, 19 nt, Mycobacterium bovis subsp bovis AF2122/97
gcccgguacgccgcgccga

SEQ ID NO: 1208083 - RNA, 21 nt, Mycobacterium bovis subsp bovis AF2122/97
gcccggguuggccgaacagcu

SEQ ID NO: 1208084 - RNA, 17 nt, Mycobacterium bovis subsp bovis AF2122/97
gcccgccaccggcgcga

SEQ ID NO: 1208085 - RNA, 12 nt, Mycobacterium bovis subsp bovis AF2122/97
gcccgccagcgc

SEQ ID NO: 1208086 - RNA, 13 nt, Mycobacterium bovis subsp bovis AF2122/97
gcccgccagccca

SEQ ID NO: 1208087 - RNA, 15 nt, Mycobacterium bovis subsp bovis AF2122/97
gcccgccagcccagc

SEQ ID NO: 1208088 - RNA, 19 nt, Mycobacterium bovis subsp bovis AF2122/97
gcccgccagcgauccacca

SEQ ID NO: 1208089 - RNA, 18 nt, Mycobacterium bovis subsp bovis AF2122/97
gcccgccaucagcccggc

SEQ ID NO: 1208090 - RNA, 19 nt, Mycobacterium bovis subsp bovis AF2122/97
gcccgccaucauggcggcc

SEQ ID NO: 1208091 - RNA, 13 nt, Mycobacterium bovis subsp bovis AF2122/97
gcccgcccaccuc

SEQ ID NO: 1208092 - RNA, 16 nt, Mycobacterium bovis subsp bovis AF2122/97
gcccgccggacccgcc

SEQ ID NO: 1208093 - RNA, 15 nt, Mycobacterium bovis subsp bovis AF2122/97
gcccgccggcaguga

SEQ ID NO: 1208094 - RNA, 16 nt, Mycobacterium bovis subsp bovis AF2122/97
gcccgccggcagugag

SEQ ID NO: 1208095 - RNA, 13 nt, Mycobacterium bovis subsp bovis AF2122/97
gcccgccggcccc

SEQ ID NO: 1208096 - RNA, 15 nt, Mycobacterium bovis subsp bovis AF2122/97
gcccgccggccccgc

SEQ ID NO: 1208097 - RNA, 21 nt, Mycobacterium bovis subsp bovis AF2122/97
gcccggucgcugauccgggcg

SEQ ID NO: 1208098 - RNA, 22 nt, Mycobacterium bovis subsp bovis AF2122/97
gcccggucccuuuguggggccg

SEQ ID NO: 1208099 - RNA, 19 nt, Mycobacterium bovis subsp bovis AF2122/97
gcccgguccgccgcagacc

SEQ ID NO: 1208100 - RNA, 21 nt, Mycobacterium bovis subsp bovis AF2122/97
gcccggucuauuugccugccg

SEQ ID NO: 1208101 - RNA, 21 nt, Mycobacterium bovis subsp bovis AF2122/97
gcccggucauggucagcagaa

SEQ ID NO: 1208102 - RNA, 17 nt, Mycobacterium bovis subsp bovis AF2122/97
gcccgguaguacuagca

SEQ ID NO: 1208103 - RNA, 15 nt, Mycobacterium bovis subsp bovis AF2122/97
gcccggugcggugca

SEQ ID NO: 1208104 - RNA, 22 nt, Mycobacterium bovis subsp bovis AF2122/97
gcccggucucgacggcggccgc

SEQ ID NO: 1208105 - RNA, 23 nt, Mycobacterium bovis subsp bovis AF2122/97
gcccggugagcuuagcgcauggg

SEQ ID NO: 1208106 - RNA, 14 nt, Mycobacterium bovis subsp bovis AF2122/97
gcccggugcuaccg

SEQ ID NO: 1208107 - RNA, 22 nt, Mycobacterium bovis subsp bovis AF2122/97
gcccgguguucaucacgccgcc

SEQ ID NO: 1208108 - RNA, 15 nt, Mycobacterium bovis subsp bovis AF2122/97
gcccgguucagcgcu

SEQ ID NO: 1208109 - RNA, 18 nt, Mycobacterium bovis subsp bovis AF2122/97
gcccgucccgcucgagca

SEQ ID NO: 1208110 - RNA, 18 nt, Mycobacterium bovis subsp bovis AF2122/97
gcccguccaggcgcugca

SEQ ID NO: 1208111 - RNA, 13 nt, Mycobacterium bovis subsp bovis AF2122/97
gcccgucacgccc

SEQ ID NO: 1208112 - RNA, 15 nt, Mycobacterium bovis subsp bovis AF2122/97
gcccguagcugcgca

SEQ ID NO: 1208113 - RNA, 17 nt, Mycobacterium bovis subsp bovis AF2122/97
gcccguagcugcgcagc

SEQ ID NO: 1208114 - RNA, 16 nt, Mycobacterium bovis subsp bovis AF2122/97
gcccguagacccacag

SEQ ID NO: 1208115 - RNA, 17 nt, Mycobacterium bovis subsp bovis AF2122/97
gcccguagacgccgagc

SEQ ID NO: 1208116 - RNA, 22 nt, Mycobacterium bovis subsp bovis AF2122/97
gcccgguucgaggaucccgcug

SEQ ID NO: 1208117 - RNA, 22 nt, Mycobacterium bovis subsp bovis AF2122/97
gcccuauacgcaacaggccaac

SEQ ID NO: 1208118 - RNA, 18 nt, Mycobacterium bovis subsp bovis AF2122/97
gcccuagccggcgcgccc

SEQ ID NO: 1208119 - RNA, 17 nt, Mycobacterium bovis subsp bovis AF2122/97
gcccucagccgcggcca

SEQ ID NO: 1208120 - RNA, 20 nt, Mycobacterium bovis subsp bovis AF2122/97
gcccucagcuagcgcgggcu

SEQ ID NO: 1208121 - RNA, 15 nt, Mycobacterium bovis subsp bovis AF2122/97
gcccucacgccaagu

SEQ ID NO: 1208122 - RNA, 12 nt, Mycobacterium bovis subsp bovis AF2122/97
gcccucagccgc

SEQ ID NO: 1208123 - RNA, 17 nt, Mycobacterium bovis subsp bovis AF2122/97
gcccuccagggcccugc

SEQ ID NO: 1208124 - RNA, 18 nt, Mycobacterium bovis subsp bovis AF2122/97
gcccucauaggccugcag

SEQ ID NO: 1208125 - RNA, 15 nt, Mycobacterium bovis subsp bovis AF2122/97
gcccucgaucgccac

SEQ ID NO: 1208126 - RNA, 18 nt, Mycobacterium bovis subsp bovis AF2122/97
gcccucgaucgccacgac

SEQ ID NO: 1208127 - RNA, 16 nt, Mycobacterium bovis subsp bovis AF2122/97
gcccucgaugccgcgu

SEQ ID NO: 1208128 - RNA, 13 nt, Mycobacterium bovis subsp bovis AF2122/97
gcccucggccgcc

SEQ ID NO: 1208129 - RNA, 14 nt, Mycobacterium bovis subsp bovis AF2122/97
gcccucgacgccgc

SEQ ID NO: 1208130 - RNA, 19 nt, Mycobacterium bovis subsp bovis AF2122/97
gcccucgaauucggccggc

SEQ ID NO: 1208131 - RNA, 21 nt, Mycobacterium bovis subsp bovis AF2122/97
gcccucgacgccgcgcagccg

SEQ ID NO: 1208132 - RNA, 14 nt, Mycobacterium bovis subsp bovis AF2122/97
gcccucgacgcgcu

SEQ ID NO: 1208133 - RNA, 12 nt, Mycobacterium bovis subsp bovis AF2122/97
gcccucgacggc

SEQ ID NO: 1208134 - RNA, 21 nt, Mycobacterium bovis subsp bovis AF2122/97
gcccucgacguccaucccggc

SEQ ID NO: 1208135 - RNA, 15 nt, Mycobacterium bovis subsp bovis AF2122/97
gcccuccggcgcagc

SEQ ID NO: 1208136 - RNA, 12 nt, Mycobacterium bovis subsp bovis AF2122/97
gcccuccgacgg

SEQ ID NO: 1208137 - RNA, 15 nt, Mycobacterium bovis subsp bovis AF2122/97
gcccuccgagcacag

SEQ ID NO: 1208138 - RNA, 19 nt, Mycobacterium bovis subsp bovis AF2122/97
gcccuccggguauggcggc

SEQ ID NO: 1208139 - RNA, 22 nt, Mycobacterium bovis subsp bovis AF2122/97
gcccgucguagguggccggcuu

SEQ ID NO: 1208140 - RNA, 20 nt, Mycobacterium bovis subsp bovis AF2122/97
gcccguccggcccccgaggc

SEQ ID NO: 1208141 - RNA, 17 nt, Mycobacterium bovis subsp bovis AF2122/97
gcccguccucgucggug

SEQ ID NO: 1208142 - RNA, 14 nt, Mycobacterium bovis subsp bovis AF2122/97
gcccgucgcggccg

SEQ ID NO: 1208143 - RNA, 16 nt, Mycobacterium bovis subsp bovis AF2122/97
gcccgucuccagcacc

SEQ ID NO: 1208144 - RNA, 13 nt, Mycobacterium bovis subsp bovis AF2122/97
gcccgucuuccag

SEQ ID NO: 1208145 - RNA, 15 nt, Mycobacterium bovis subsp bovis AF2122/97
gcccgucuuccagcc

SEQ ID NO: 1208146 - RNA, 14 nt, Mycobacterium bovis subsp bovis AF2122/97
gcccgugcgaugca

SEQ ID NO: 1208147 - RNA, 15 nt, Mycobacterium bovis subsp bovis AF2122/97
gcccgugccgcccuc

SEQ ID NO: 1208148 - RNA, 14 nt, Mycobacterium bovis subsp bovis AF2122/97
gcccgugccacagc

SEQ ID NO: 1208149 - RNA, 17 nt, Mycobacterium bovis subsp bovis AF2122/97
gcccgugcggcucgccg

SEQ ID NO: 1208150 - RNA, 19 nt, Mycobacterium bovis subsp bovis AF2122/97
gcccgugcggcucgccggc

SEQ ID NO: 1208151 - RNA, 19 nt, Mycobacterium bovis subsp bovis AF2122/97
gcccgugggugcgucuggg

SEQ ID NO: 1208152 - RNA, 21 nt, Mycobacterium bovis subsp bovis AF2122/97
gcccguggucgaucaugacga

SEQ ID NO: 1208153 - RNA, 18 nt, Mycobacterium bovis subsp bovis AF2122/97
gcccguguugaagaagcc

SEQ ID NO: 1208154 - RNA, 16 nt, Mycobacterium bovis subsp bovis AF2122/97
gcccguguugaagaag

SEQ ID NO: 1208155 - RNA, 16 nt, Mycobacterium bovis subsp bovis AF2122/97
gcccguugaccugcgc

SEQ ID NO: 1208156 - RNA, 15 nt, Mycobacterium bovis subsp bovis AF2122/97
gcccguugcagguga

SEQ ID NO: 1208157 - RNA, 22 nt, Mycobacterium bovis subsp bovis AF2122/97
gcccguucauaaagguccaacc

SEQ ID NO: 1208158 - RNA, 19 nt, Mycobacterium bovis subsp bovis AF2122/97
gcccguucaugcggcggcg

SEQ ID NO: 1208159 - RNA, 20 nt, Mycobacterium bovis subsp bovis AF2122/97
gcccguuggccaagaaugug

SEQ ID NO: 1208160 - RNA, 19 nt, Mycobacterium bovis subsp bovis AF2122/97
gcccguugcgaauccccaa

SEQ ID NO: 1208161 - RNA, 17 nt, Mycobacterium bovis subsp bovis AF2122/97
gcccuaacccugcccua

SEQ ID NO: 1208162 - RNA, 14 nt, Mycobacterium bovis subsp bovis AF2122/97
gcccuuccggccga

SEQ ID NO: 1208163 - RNA, 20 nt, Mycobacterium bovis subsp bovis AF2122/97
gcccuucagcguccugguga

SEQ ID NO: 1208164 - RNA, 18 nt, Mycobacterium bovis subsp bovis AF2122/97
gcccuucaguucgacggu

SEQ ID NO: 1208165 - RNA, 13 nt, Mycobacterium bovis subsp bovis AF2122/97
gcccuggccgcgc

SEQ ID NO: 1208166 - RNA, 19 nt, Mycobacterium bovis subsp bovis AF2122/97
gcccuggccgcccuggccg

SEQ ID NO: 1208167 - RNA, 14 nt, Mycobacterium bovis subsp bovis AF2122/97
gcccuuaagccggc

SEQ ID NO: 1208168 - RNA, 15 nt, Mycobacterium bovis subsp bovis AF2122/97
gcccugcacagcagc

SEQ ID NO: 1208169 - RNA, 14 nt, Mycobacterium bovis subsp bovis AF2122/97
gcccugauugaagc

SEQ ID NO: 1208170 - RNA, 17 nt, Mycobacterium bovis subsp bovis AF2122/97
gcccugauugaagcccc

SEQ ID NO: 1208171 - RNA, 20 nt, Mycobacterium bovis subsp bovis AF2122/97
gcccugacgccccgccacaa

SEQ ID NO: 1208172 - RNA, 14 nt, Mycobacterium bovis subsp bovis AF2122/97
gcccugagccaccc

SEQ ID NO: 1208173 - RNA, 14 nt, Mycobacterium bovis subsp bovis AF2122/97
gcccuggccgccgg

SEQ ID NO: 1208174 - RNA, 15 nt, Mycobacterium bovis subsp bovis AF2122/97
gcccuggccgcccug

SEQ ID NO: 1208175 - RNA, 14 nt, Mycobacterium bovis subsp bovis AF2122/97
gcccuggcccaucu

SEQ ID NO: 1208176 - RNA, 14 nt, Mycobacterium bovis subsp bovis AF2122/97
gcccuggccagccc

SEQ ID NO: 1208177 - RNA, 17 nt, Mycobacterium bovis subsp bovis AF2122/97
gcccugcccgaaggugg

SEQ ID NO: 1208178 - RNA, 21 nt, Mycobacterium bovis subsp bovis AF2122/97
gcccucguuaucgaccgccgc

SEQ ID NO: 1208179 - RNA, 17 nt, Mycobacterium bovis subsp bovis AF2122/97
gcccucgucgaucgccg

SEQ ID NO: 1208180 - RNA, 19 nt, Mycobacterium bovis subsp bovis AF2122/97
gcccucgucgggaucggcg

SEQ ID NO: 1208181 - RNA, 19 nt, Mycobacterium bovis subsp bovis AF2122/97
gcccucgucgcgggccacc

SEQ ID NO: 1208182 - RNA, 14 nt, Mycobacterium bovis subsp bovis AF2122/97
gcccucgggacugc

SEQ ID NO: 1208183 - RNA, 20 nt, Mycobacterium bovis subsp bovis AF2122/97
gcccucgggguagccaaccu

SEQ ID NO: 1208184 - RNA, 22 nt, Mycobacterium bovis subsp bovis AF2122/97
gcccucguaauccacgccgacc

SEQ ID NO: 1208185 - RNA, 19 nt, Mycobacterium bovis subsp bovis AF2122/97
gcccugacacaacaccggc

SEQ ID NO: 1208186 - RNA, 22 nt, Mycobacterium bovis subsp bovis AF2122/97
gcccugacccggagccgccagg

SEQ ID NO: 1208187 - RNA, 21 nt, Mycobacterium bovis subsp bovis AF2122/97
gcccucgucgcgggccaccgc

SEQ ID NO: 1208188 - RNA, 13 nt, Mycobacterium bovis subsp bovis AF2122/97
gccgaagccgcgc

SEQ ID NO: 1208189 - RNA, 15 nt, Mycobacterium bovis subsp bovis AF2122/97
gccgaagaggagaac

SEQ ID NO: 1208190 - RNA, 16 nt, Mycobacterium bovis subsp bovis AF2122/97
gccgaagccgaagggg

SEQ ID NO: 1208191 - RNA, 13 nt, Mycobacterium bovis subsp bovis AF2122/97
gccgaagcccggc

SEQ ID NO: 1208192 - RNA, 21 nt, Mycobacterium bovis subsp bovis AF2122/97
gccgaagccuugcagcgcccc

SEQ ID NO: 1208193 - RNA, 21 nt, Mycobacterium bovis subsp bovis AF2122/97
gccgaagcggccaccgccgcc

SEQ ID NO: 1208194 - RNA, 16 nt, Mycobacterium bovis subsp bovis AF2122/97
gccgaagcugcccaac

SEQ ID NO: 1208195 - RNA, 18 nt, Mycobacterium bovis subsp bovis AF2122/97
gccgaagacgugccggcu

SEQ ID NO: 1208196 - RNA, 21 nt, Mycobacterium bovis subsp bovis AF2122/97
gccgaagaaccggucgcagug

SEQ ID NO: 1208197 - RNA, 23 nt, Mycobacterium bovis subsp bovis AF2122/97
gccgaaaaugccgcccagcgacc

SEQ ID NO: 1208198 - RNA, 19 nt, Mycobacterium bovis subsp bovis AF2122/97
gccgacgacaacagccagc

SEQ ID NO: 1208199 - RNA, 21 nt, Mycobacterium bovis subsp bovis AF2122/97
gccgacgaacgaaccgccgcc

SEQ ID NO: 1208200 - RNA, 23 nt, Mycobacterium bovis subsp bovis AF2122/97
gccgacgaacgaaccgccgccgc

SEQ ID NO: 1208201 - RNA, 18 nt, Mycobacterium bovis subsp bovis AF2122/97
gccgacgaucgacgccgc

SEQ ID NO: 1208202 - RNA, 17 nt, Mycobacterium bovis subsp bovis AF2122/97
gccgacgaccagcagau

SEQ ID NO: 1208203 - RNA, 19 nt, Mycobacterium bovis subsp bovis AF2122/97
gccgacgauguuccaggcu

SEQ ID NO: 1208204 - RNA, 22 nt, Mycobacterium bovis subsp bovis AF2122/97
gccgacgauguuccaggcuacc

SEQ ID NO: 1208205 - RNA, 22 nt, Mycobacterium bovis subsp bovis AF2122/97
gccgacauugcugcucgugagc

SEQ ID NO: 1208206 - RNA, 21 nt, Mycobacterium bovis subsp bovis AF2122/97
gccgaccucaucggcaccguc

SEQ ID NO: 1208207 - RNA, 21 nt, Mycobacterium bovis subsp bovis AF2122/97
gccgaccugcgcgacggcgcu

SEQ ID NO: 1208208 - RNA, 14 nt, Mycobacterium bovis subsp bovis AF2122/97
gccgaccuagucac

SEQ ID NO: 1208209 - RNA, 18 nt, Mycobacterium bovis subsp bovis AF2122/97
gccgacaggccggccacc

SEQ ID NO: 1208210 - RNA, 21 nt, Mycobacterium bovis subsp bovis AF2122/97
gccgacaucgauguggaugga

SEQ ID NO: 1208211 - RNA, 16 nt, Mycobacterium bovis subsp bovis AF2122/97
gccgacaucggcggcc

SEQ ID NO: 1208212 - RNA, 14 nt, Mycobacterium bovis subsp bovis AF2122/97
gccgacagccaccg

SEQ ID NO: 1208213 - RNA, 13 nt, Mycobacterium bovis subsp bovis AF2122/97
gccgaaucgcggg

SEQ ID NO: 1208214 - RNA, 13 nt, Mycobacterium bovis subsp bovis AF2122/97
gccgaaucggcag

SEQ ID NO: 1208215 - RNA, 21 nt, Mycobacterium bovis subsp bovis AF2122/97
gccgaaguuuuggaagcccga

SEQ ID NO: 1208216 - RNA, 17 nt, Mycobacterium bovis subsp bovis AF2122/97
gccgaauaacagcaggc

SEQ ID NO: 1208217 - RNA, 14 nt, Mycobacterium bovis subsp bovis AF2122/97
gccgcaaggcgccg

SEQ ID NO: 1208218 - RNA, 22 nt, Mycobacterium bovis subsp bovis AF2122/97
gccgcagcuuuaaucguggcac

SEQ ID NO: 1208219 - RNA, 23 nt, Mycobacterium bovis subsp bovis AF2122/97
gccgcaccgcuguugcaucgccg

SEQ ID NO: 1208220 - RNA, 22 nt, Mycobacterium bovis subsp bovis AF2122/97
gccgcagcuccccgaccgaacc

SEQ ID NO: 1208221 - RNA, 14 nt, Mycobacterium bovis subsp bovis AF2122/97
gccgcagcucgccg

SEQ ID NO: 1208222 - RNA, 18 nt, Mycobacterium bovis subsp bovis AF2122/97
gccgcagcucgccgagug

SEQ ID NO: 1208223 - RNA, 15 nt, Mycobacterium bovis subsp bovis AF2122/97
gccgcacccggucga

SEQ ID NO: 1208224 - RNA, 23 nt, Mycobacterium bovis subsp bovis AF2122/97
gccgcacccguugcucccacggc

SEQ ID NO: 1208225 - RNA, 18 nt, Mycobacterium bovis subsp bovis AF2122/97
gccgcaccaagcagcgac

SEQ ID NO: 1208226 - RNA, 18 nt, Mycobacterium bovis subsp bovis AF2122/97
gccgcaccaucggcgagg

SEQ ID NO: 1208227 - RNA, 19 nt, Mycobacterium bovis subsp bovis AF2122/97
gccgcaccaucggcgaggc

SEQ ID NO: 1208228 - RNA, 17 nt, Mycobacterium bovis subsp bovis AF2122/97
gccgcaggcuugccgau

SEQ ID NO: 1208229 - RNA, 17 nt, Mycobacterium bovis subsp bovis AF2122/97
gccgcagggccgcgcgc

SEQ ID NO: 1208230 - RNA, 22 nt, Mycobacterium bovis subsp bovis AF2122/97
gccgccaaccgcaggccgaaga

SEQ ID NO: 1208231 - RNA, 17 nt, Mycobacterium bovis subsp bovis AF2122/97
gccgccaacuccagcac

SEQ ID NO: 1208232 - RNA, 20 nt, Mycobacterium bovis subsp bovis AF2122/97
gccgccaacuucaccacccu

SEQ ID NO: 1208233 - RNA, 18 nt, Mycobacterium bovis subsp bovis AF2122/97
gccgccacccggcgggcg

SEQ ID NO: 1208234 - RNA, 12 nt, Mycobacterium bovis subsp bovis AF2122/97
gccgccaccagc

SEQ ID NO: 1208235 - RNA, 19 nt, Mycobacterium bovis subsp bovis AF2122/97
gccgccaccagcgcgagcc

SEQ ID NO: 1208236 - RNA, 13 nt, Mycobacterium bovis subsp bovis AF2122/97
gccgccaccgcga

SEQ ID NO: 1208237 - RNA, 18 nt, Mycobacterium bovis subsp bovis AF2122/97
gccgccaccagggcggcc

SEQ ID NO: 1208238 - RNA, 13 nt, Mycobacterium bovis subsp bovis AF2122/97
gccgccagccggc

SEQ ID NO: 1208239 - RNA, 15 nt, Mycobacterium bovis subsp bovis AF2122/97
gccgccagcccagcc

SEQ ID NO: 1208240 - RNA, 22 nt, Mycobacterium bovis subsp bovis AF2122/97
gccgccagcgccgccggcgccg

SEQ ID NO: 1208241 - RNA, 17 nt, Mycobacterium bovis subsp bovis AF2122/97
gccgccagcgccgccgg

SEQ ID NO: 1208242 - RNA, 18 nt, Mycobacterium bovis subsp bovis AF2122/97
gccgccagcgccgccggc

SEQ ID NO: 1208243 - RNA, 17 nt, Mycobacterium bovis subsp bovis AF2122/97
gccgccagcugcgcagc

SEQ ID NO: 1208244 - RNA, 17 nt, Mycobacterium bovis subsp bovis AF2122/97
gccgccaucgccgccgg

SEQ ID NO: 1208245 - RNA, 19 nt, Mycobacterium bovis subsp bovis AF2122/97
gccgccauguacaggcccc

SEQ ID NO: 1208246 - RNA, 20 nt, Mycobacterium bovis subsp bovis AF2122/97
gccgccauccccuggccagc

SEQ ID NO: 1208247 - RNA, 17 nt, Mycobacterium bovis subsp bovis AF2122/97
gccgccaucagcccuuc

SEQ ID NO: 1208248 - RNA, 23 nt, Mycobacterium bovis subsp bovis AF2122/97
gccgccauccccuggccagcaga

SEQ ID NO: 1208249 - RNA, 14 nt, Mycobacterium bovis subsp bovis AF2122/97
gccgacgccaacgc

SEQ ID NO: 1208250 - RNA, 12 nt, Mycobacterium bovis subsp bovis AF2122/97
gccgacgccgcc

SEQ ID NO: 1208251 - RNA, 14 nt, Mycobacterium bovis subsp bovis AF2122/97
gccgacgcggcggg

SEQ ID NO: 1208252 - RNA, 16 nt, Mycobacterium bovis subsp bovis AF2122/97
gccgacgccuuccagc

SEQ ID NO: 1208253 - RNA, 18 nt, Mycobacterium bovis subsp bovis AF2122/97
gccgacgccgccggcccc

SEQ ID NO: 1208254 - RNA, 19 nt, Mycobacterium bovis subsp bovis AF2122/97
gccgacgccgccggccccg

SEQ ID NO: 1208255 - RNA, 16 nt, Mycobacterium bovis subsp bovis AF2122/97
gccgacgcgaacccau

SEQ ID NO: 1208256 - RNA, 16 nt, Mycobacterium bovis subsp bovis AF2122/97
gccgacggccagcagg

SEQ ID NO: 1208257 - RNA, 18 nt, Mycobacterium bovis subsp bovis AF2122/97
gccgacggccagcaggau

SEQ ID NO: 1208258 - RNA, 17 nt, Mycobacterium bovis subsp bovis AF2122/97
gccgacggccagcagga

SEQ ID NO: 1208259 - RNA, 21 nt, Mycobacterium bovis subsp bovis AF2122/97
gccgaggcggucuuguccagg

SEQ ID NO: 1208260 - RNA, 16 nt, Mycobacterium bovis subsp bovis AF2122/97
gccgaucaauggcaac

SEQ ID NO: 1208261 - RNA, 21 nt, Mycobacterium bovis subsp bovis AF2122/97
gccgaguggccgcauuagccu

SEQ ID NO: 1208262 - RNA, 22 nt, Mycobacterium bovis subsp bovis AF2122/97
gccgaucaccgccggggcuggu

SEQ ID NO: 1208263 - RNA, 14 nt, Mycobacterium bovis subsp bovis AF2122/97
gccgaucagcgaac

SEQ ID NO: 1208264 - RNA, 22 nt, Mycobacterium bovis subsp bovis AF2122/97
gccgaggguagacggggcgagc

SEQ ID NO: 1208265 - RNA, 20 nt, Mycobacterium bovis subsp bovis AF2122/97
gccgaggucgaaccgccggc

SEQ ID NO: 1208266 - RNA, 22 nt, Mycobacterium bovis subsp bovis AF2122/97
gccgaggucuccggugcgcagc

SEQ ID NO: 1208267 - RNA, 20 nt, Mycobacterium bovis subsp bovis AF2122/97
gccgaguaccggccagccgc

SEQ ID NO: 1208268 - RNA, 23 nt, Mycobacterium bovis subsp bovis AF2122/97
gccgaguaccggccagccgcggc

SEQ ID NO: 1208269 - RNA, 21 nt, Mycobacterium bovis subsp bovis AF2122/97
gccgaggucgaaccgccggcu

SEQ ID NO: 1208270 - RNA, 18 nt, Mycobacterium bovis subsp bovis AF2122/97
gccgaugccggcgagggc

SEQ ID NO: 1208271 - RNA, 22 nt, Mycobacterium bovis subsp bovis AF2122/97
gccgaugaugcggcgcagcgac

SEQ ID NO: 1208272 - RNA, 16 nt, Mycobacterium bovis subsp bovis AF2122/97
gccgaugaugcggcgc

SEQ ID NO: 1208273 - RNA, 19 nt, Mycobacterium bovis subsp bovis AF2122/97
gccgaugaugcggcgcagc

SEQ ID NO: 1208274 - RNA, 15 nt, Mycobacterium bovis subsp bovis AF2122/97
gccgaucccguggug

SEQ ID NO: 1208275 - RNA, 14 nt, Mycobacterium bovis subsp bovis AF2122/97
gccgauccagcagg

SEQ ID NO: 1208276 - RNA, 16 nt, Mycobacterium bovis subsp bovis AF2122/97
gccgaucccggcgagc

SEQ ID NO: 1208277 - RNA, 20 nt, Mycobacterium bovis subsp bovis AF2122/97
gccgaucccggcgagcaccc

SEQ ID NO: 1208278 - RNA, 16 nt, Mycobacterium bovis subsp bovis AF2122/97
gccgaucaugaccauc

SEQ ID NO: 1208279 - RNA, 16 nt, Mycobacterium bovis subsp bovis AF2122/97
gccgaucagcugcgca

SEQ ID NO: 1208280 - RNA, 20 nt, Mycobacterium bovis subsp bovis AF2122/97
gccgaugggcaucaagaaac

SEQ ID NO: 1208281 - RNA, 17 nt, Mycobacterium bovis subsp bovis AF2122/97
gccgauggcgucaagca

SEQ ID NO: 1208282 - RNA, 15 nt, Mycobacterium bovis subsp bovis AF2122/97
gccgauggugauggg

SEQ ID NO: 1208283 - RNA, 19 nt, Mycobacterium bovis subsp bovis AF2122/97
gccgaugucgaugccgcgc

SEQ ID NO: 1208284 - RNA, 17 nt, Mycobacterium bovis subsp bovis AF2122/97
gccgaugucgcgcgcua

SEQ ID NO: 1208285 - RNA, 16 nt, Mycobacterium bovis subsp bovis AF2122/97
gccgauuggccugcca

SEQ ID NO: 1208286 - RNA, 22 nt, Mycobacterium bovis subsp bovis AF2122/97
gccgauuacggugaucgccggc

SEQ ID NO: 1208287 - RNA, 21 nt, Mycobacterium bovis subsp bovis AF2122/97
gccgauugcucggggaggaaa

SEQ ID NO: 1208288 - RNA, 23 nt, Mycobacterium bovis subsp bovis AF2122/97
gccgauugcuucuucgggccgcu

SEQ ID NO: 1208289 - RNA, 14 nt, Mycobacterium bovis subsp bovis AF2122/97
gccgauuggccugc

SEQ ID NO: 1208290 - RNA, 16 nt, Mycobacterium bovis subsp bovis AF2122/97
gccgcccuggccgccg

SEQ ID NO: 1208291 - RNA, 19 nt, Mycobacterium bovis subsp bovis AF2122/97
gccgcccuggccgccggcc

SEQ ID NO: 1208292 - RNA, 20 nt, Mycobacterium bovis subsp bovis AF2122/97
gccgcccuggccgccggccc

SEQ ID NO: 1208293 - RNA, 22 nt, Mycobacterium bovis subsp bovis AF2122/97
gccgcccuucaucuugccgcga

SEQ ID NO: 1208294 - RNA, 17 nt, Mycobacterium bovis subsp bovis AF2122/97
gccgcccuugccgccgg

SEQ ID NO: 1208295 - RNA, 20 nt, Mycobacterium bovis subsp bovis AF2122/97
gccgcccuugccgccggccc

SEQ ID NO: 1208296 - RNA, 18 nt, Mycobacterium bovis subsp bovis AF2122/97
gccgcccuugccgcccgc

SEQ ID NO: 1208297 - RNA, 21 nt, Mycobacterium bovis subsp bovis AF2122/97
gccgcccuugccgccggcccc

SEQ ID NO: 1208298 - RNA, 17 nt, Mycobacterium bovis subsp bovis AF2122/97
gccgccgaagccgcgca

SEQ ID NO: 1208299 - RNA, 16 nt, Mycobacterium bovis subsp bovis AF2122/97
gccgccgacaaccccg

SEQ ID NO: 1208300 - RNA, 22 nt, Mycobacterium bovis subsp bovis AF2122/97
gccgccgacaaccccgccagga

SEQ ID NO: 1208301 - RNA, 17 nt, Mycobacterium bovis subsp bovis AF2122/97
gccgccgacgccgccgg

SEQ ID NO: 1208302 - RNA, 22 nt, Mycobacterium bovis subsp bovis AF2122/97
gccgccgacggaucgcccugac

SEQ ID NO: 1208303 - RNA, 18 nt, Mycobacterium bovis subsp bovis AF2122/97
gccgccgacgccgccggc

SEQ ID NO: 1208304 - RNA, 15 nt, Mycobacterium bovis subsp bovis AF2122/97
gccgccgacaacccc

SEQ ID NO: 1208305 - RNA, 15 nt, Mycobacterium bovis subsp bovis AF2122/97
gccgccggcacccgc

SEQ ID NO: 1208306 - RNA, 17 nt, Mycobacterium bovis subsp bovis AF2122/97
gccgccggaaucgagac

SEQ ID NO: 1208307 - RNA, 15 nt, Mycobacterium bovis subsp bovis AF2122/97
gccgccggcaccgcc

SEQ ID NO: 1208308 - RNA, 18 nt, Mycobacterium bovis subsp bovis AF2122/97
gccgccgcuucaccccac

SEQ ID NO: 1208309 - RNA, 19 nt, Mycobacterium bovis subsp bovis AF2122/97
gccgccgcuuucgccggcg

SEQ ID NO: 1208310 - RNA, 18 nt, Mycobacterium bovis subsp bovis AF2122/97
gccgccggaagcgccggc

SEQ ID NO: 1208311 - RNA, 21 nt, Mycobacterium bovis subsp bovis AF2122/97
gccgccggacccgucgagcag

SEQ ID NO: 1208312 - RNA, 13 nt, Mycobacterium bovis subsp bovis AF2122/97
gccgccgcuggug

SEQ ID NO: 1208313 - RNA, 13 nt, Mycobacterium bovis subsp bovis AF2122/97
gccgccgcugccg

SEQ ID NO: 1208314 - RNA, 15 nt, Mycobacterium bovis subsp bovis AF2122/97
gccgccgaugccacc

SEQ ID NO: 1208315 - RNA, 17 nt, Mycobacterium bovis subsp bovis AF2122/97
gccgccgagggcgccgg

SEQ ID NO: 1208316 - RNA, 21 nt, Mycobacterium bovis subsp bovis AF2122/97
gccgccgauaccgccggcccc

SEQ ID NO: 1208317 - RNA, 19 nt, Mycobacterium bovis subsp bovis AF2122/97
gccgccgaucugcugcagc

SEQ ID NO: 1208318 - RNA, 18 nt, Mycobacterium bovis subsp bovis AF2122/97
gccgccgacguuggggau

SEQ ID NO: 1208319 - RNA, 23 nt, Mycobacterium bovis subsp bovis AF2122/97
gccgccgagaugaugcugccggc

SEQ ID NO: 1208320 - RNA, 17 nt, Mycobacterium bovis subsp bovis AF2122/97
gccgccgagcuggcgcg

SEQ ID NO: 1208321 - RNA, 21 nt, Mycobacterium bovis subsp bovis AF2122/97
gccgcccagcugucauccccg

SEQ ID NO: 1208322 - RNA, 22 nt, Mycobacterium bovis subsp bovis AF2122/97
gccgcccagcugucauccccgg

SEQ ID NO: 1208323 - RNA, 11 nt, Mycobacterium bovis subsp bovis AF2122/97
gccgcccagcg

SEQ ID NO: 1208324 - RNA, 17 nt, Mycobacterium bovis subsp bovis AF2122/97
gccgcccagaccgccga

SEQ ID NO: 1208325 - RNA, 17 nt, Mycobacterium bovis subsp bovis AF2122/97
gccgcccaagccgccgg

SEQ ID NO: 1208326 - RNA, 14 nt, Mycobacterium bovis subsp bovis AF2122/97
gccgcccaaagaaa

SEQ ID NO: 1208327 - RNA, 18 nt, Mycobacterium bovis subsp bovis AF2122/97
gccgccaucgccgccaac

SEQ ID NO: 1208328 - RNA, 13 nt, Mycobacterium bovis subsp bovis AF2122/97
gccgccauugcca

SEQ ID NO: 1208329 - RNA, 14 nt, Mycobacterium bovis subsp bovis AF2122/97
gccgccauuggaca

SEQ ID NO: 1208330 - RNA, 17 nt, Mycobacterium bovis subsp bovis AF2122/97
gccgccauugccgccgg

SEQ ID NO: 1208331 - RNA, 15 nt, Mycobacterium bovis subsp bovis AF2122/97
gccgcccggucgggc

SEQ ID NO: 1208332 - RNA, 18 nt, Mycobacterium bovis subsp bovis AF2122/97
gccgcccggucgggcgcg

SEQ ID NO: 1208333 - RNA, 16 nt, Mycobacterium bovis subsp bovis AF2122/97
gccgcccgggcgagaa

SEQ ID NO: 1208334 - RNA, 14 nt, Mycobacterium bovis subsp bovis AF2122/97
gccgcccccgccgg

SEQ ID NO: 1208335 - RNA, 15 nt, Mycobacterium bovis subsp bovis AF2122/97
gccgcccccgccggc

SEQ ID NO: 1208336 - RNA, 16 nt, Mycobacterium bovis subsp bovis AF2122/97
gccgcccccgccggcc

SEQ ID NO: 1208337 - RNA, 19 nt, Mycobacterium bovis subsp bovis AF2122/97
gccgcccucccuggggccg

SEQ ID NO: 1208338 - RNA, 16 nt, Mycobacterium bovis subsp bovis AF2122/97
gccgcccgugccgccc

SEQ ID NO: 1208339 - RNA, 14 nt, Mycobacterium bovis subsp bovis AF2122/97
gccgcgcgccggcc

SEQ ID NO: 1208340 - RNA, 14 nt, Mycobacterium bovis subsp bovis AF2122/97
gccgcgcgccgguu

SEQ ID NO: 1208341 - RNA, 13 nt, Mycobacterium bovis subsp bovis AF2122/97
gccgcgcgcgccg

SEQ ID NO: 1208342 - RNA, 13 nt, Mycobacterium bovis subsp bovis AF2122/97
gccgcgcgcccgc

SEQ ID NO: 1208343 - RNA, 24 nt, Mycobacterium bovis subsp bovis AF2122/97
gccgcgccguaguucuccgccaac

SEQ ID NO: 1208344 - RNA, 15 nt, Mycobacterium bovis subsp bovis AF2122/97
gccgcgccggugugc

SEQ ID NO: 1208345 - RNA, 22 nt, Mycobacterium bovis subsp bovis AF2122/97
gccgcgcccaaugcgggcuggg

SEQ ID NO: 1208346 - RNA, 12 nt, Mycobacterium bovis subsp bovis AF2122/97
gccgcgcagcug

SEQ ID NO: 1208347 - RNA, 16 nt, Mycobacterium bovis subsp bovis AF2122/97
gccgcgcagcugccgc

SEQ ID NO: 1208348 - RNA, 21 nt, Mycobacterium bovis subsp bovis AF2122/97
gccgcgagcacgucggggugc

SEQ ID NO: 1208349 - RNA, 22 nt, Mycobacterium bovis subsp bovis AF2122/97
gccgcgcaucugucgcgcggca

SEQ ID NO: 1208350 - RNA, 17 nt, Mycobacterium bovis subsp bovis AF2122/97
gccgcgcaucgcggccg

SEQ ID NO: 1208351 - RNA, 14 nt, Mycobacterium bovis subsp bovis AF2122/97
gccgcgcauccgca

SEQ ID NO: 1208352 - RNA, 15 nt, Mycobacterium bovis subsp bovis AF2122/97
gccgcgagcgccggc

SEQ ID NO: 1208353 - RNA, 23 nt, Mycobacterium bovis subsp bovis AF2122/97
gccgcgagacgcaugucgggcca

SEQ ID NO: 1208354 - RNA, 23 nt, Mycobacterium bovis subsp bovis AF2122/97
gccgcgacgaugccucggcggcc

SEQ ID NO: 1208355 - RNA, 18 nt, Mycobacterium bovis subsp bovis AF2122/97
gccgccggcaccgccggc

SEQ ID NO: 1208356 - RNA, 16 nt, Mycobacterium bovis subsp bovis AF2122/97
gccgccggcaccgggg

SEQ ID NO: 1208357 - RNA, 14 nt, Mycobacterium bovis subsp bovis AF2122/97
gccgccggccccgc

SEQ ID NO: 1208358 - RNA, 13 nt, Mycobacterium bovis subsp bovis AF2122/97
gccgccggccgcg

SEQ ID NO: 1208359 - RNA, 12 nt, Mycobacterium bovis subsp bovis AF2122/97
gccgccggccgc

SEQ ID NO: 1208360 - RNA, 14 nt, Mycobacterium bovis subsp bovis AF2122/97
gccgccggccgcca

SEQ ID NO: 1208361 - RNA, 15 nt, Mycobacterium bovis subsp bovis AF2122/97
gccgccgggggacga

SEQ ID NO: 1208362 - RNA, 15 nt, Mycobacterium bovis subsp bovis AF2122/97
gccgccgguccccuc

SEQ ID NO: 1208363 - RNA, 16 nt, Mycobacterium bovis subsp bovis AF2122/97
gccgccgggugcgccg

SEQ ID NO: 1208364 - RNA, 19 nt, Mycobacterium bovis subsp bovis AF2122/97
gccgccggucaucccaagc

SEQ ID NO: 1208365 - RNA, 23 nt, Mycobacterium bovis subsp bovis AF2122/97
gccgccgguggugccggcgccgc

SEQ ID NO: 1208366 - RNA, 21 nt, Mycobacterium bovis subsp bovis AF2122/97
gccgccgucaccgcccuugcc

SEQ ID NO: 1208367 - RNA, 16 nt, Mycobacterium bovis subsp bovis AF2122/97
gccgccggugccaccg

SEQ ID NO: 1208368 - RNA, 16 nt, Mycobacterium bovis subsp bovis AF2122/97
gccgccggugccgccc

SEQ ID NO: 1208369 - RNA, 17 nt, Mycobacterium bovis subsp bovis AF2122/97
gccgccggugccgccgg

SEQ ID NO: 1208370 - RNA, 16 nt, Mycobacterium bovis subsp bovis AF2122/97
gccgccggugccgccu

SEQ ID NO: 1208371 - RNA, 19 nt, Mycobacterium bovis subsp bovis AF2122/97
gccgccugcccggcccgcu

SEQ ID NO: 1208372 - RNA, 16 nt, Mycobacterium bovis subsp bovis AF2122/97
gccgccugcgccgcca

SEQ ID NO: 1208373 - RNA, 15 nt, Mycobacterium bovis subsp bovis AF2122/97
gccgcgaccgcgagc

SEQ ID NO: 1208374 - RNA, 16 nt, Mycobacterium bovis subsp bovis AF2122/97
gccgcgaccgcgagca

SEQ ID NO: 1208375 - RNA, 15 nt, Mycobacterium bovis subsp bovis AF2122/97
gccgcgacccgcgca

SEQ ID NO: 1208376 - RNA, 21 nt, Mycobacterium bovis subsp bovis AF2122/97
gccgccugcuccucggccagc

SEQ ID NO: 1208377 - RNA, 18 nt, Mycobacterium bovis subsp bovis AF2122/97
gccgcgaccgccucgccg

SEQ ID NO: 1208378 - RNA, 14 nt, Mycobacterium bovis subsp bovis AF2122/97
gccgcgacccgcgc

SEQ ID NO: 1208379 - RNA, 14 nt, Mycobacterium bovis subsp bovis AF2122/97
gccgccuccgccug

SEQ ID NO: 1208380 - RNA, 22 nt, Mycobacterium bovis subsp bovis AF2122/97
gccgccuccgccgaggccgccg

SEQ ID NO: 1208381 - RNA, 14 nt, Mycobacterium bovis subsp bovis AF2122/97
gccgccucgggcac

SEQ ID NO: 1208382 - RNA, 18 nt, Mycobacterium bovis subsp bovis AF2122/97
gccgccguccagcgccgc

SEQ ID NO: 1208383 - RNA, 16 nt, Mycobacterium bovis subsp bovis AF2122/97
gccgccguccagcgcc

SEQ ID NO: 1208384 - RNA, 15 nt, Mycobacterium bovis subsp bovis AF2122/97
gccggucgugccggg

SEQ ID NO: 1208385 - RNA, 22 nt, Mycobacterium bovis subsp bovis AF2122/97
gccggucgugccggggcugccg

SEQ ID NO: 1208386 - RNA, 14 nt, Mycobacterium bovis subsp bovis AF2122/97
gccggucggcgucg

SEQ ID NO: 1208387 - RNA, 22 nt, Mycobacterium bovis subsp bovis AF2122/97
gccggucuugcaucgccaaugc

SEQ ID NO: 1208388 - RNA, 15 nt, Mycobacterium bovis subsp bovis AF2122/97
gccggugacguggug

SEQ ID NO: 1208389 - RNA, 18 nt, Mycobacterium bovis subsp bovis AF2122/97
gccggugacguggugggc

SEQ ID NO: 1208390 - RNA, 22 nt, Mycobacterium bovis subsp bovis AF2122/97
gccggugauggccgaccagccg

SEQ ID NO: 1208391 - RNA, 18 nt, Mycobacterium bovis subsp bovis AF2122/97
gccggugaggcgaccgga

SEQ ID NO: 1208392 - RNA, 19 nt, Mycobacterium bovis subsp bovis AF2122/97
gccggugccacugccguug

SEQ ID NO: 1208393 - RNA, 15 nt, Mycobacterium bovis subsp bovis AF2122/97
gccggugccaccggc

SEQ ID NO: 1208394 - RNA, 19 nt, Mycobacterium bovis subsp bovis AF2122/97
gccggugccaccggcuggu

SEQ ID NO: 1208395 - RNA, 15 nt, Mycobacterium bovis subsp bovis AF2122/97
gccggugccgccauu

SEQ ID NO: 1208396 - RNA, 17 nt, Mycobacterium bovis subsp bovis AF2122/97
gccggugccgccgccug

SEQ ID NO: 1208397 - RNA, 16 nt, Mycobacterium bovis subsp bovis AF2122/97
gccggugccgccgucg

SEQ ID NO: 1208398 - RNA, 17 nt, Mycobacterium bovis subsp bovis AF2122/97
gccggugccgccgucgc

SEQ ID NO: 1208399 - RNA, 17 nt, Mycobacterium bovis subsp bovis AF2122/97
gccggugccgccguucc

SEQ ID NO: 1208400 - RNA, 21 nt, Mycobacterium bovis subsp bovis AF2122/97
gccggugccggcguugccgcc

SEQ ID NO: 1208401 - RNA, 22 nt, Mycobacterium bovis subsp bovis AF2122/97
gccggugccgccuccgccugcc

SEQ ID NO: 1208402 - RNA, 17 nt, Mycobacterium bovis subsp bovis AF2122/97
gccggugccgccugcgc

SEQ ID NO: 1208403 - RNA, 20 nt, Mycobacterium bovis subsp bovis AF2122/97
gccggugccgccugcgccgc

SEQ ID NO: 1208404 - RNA, 13 nt, Mycobacterium bovis subsp bovis AF2122/97
gccggugcuccuc

SEQ ID NO: 1208405 - RNA, 16 nt, Mycobacterium bovis subsp bovis AF2122/97
gccggugcgguggugc

SEQ ID NO: 1208406 - RNA, 20 nt, Mycobacterium bovis subsp bovis AF2122/97
gccggugcgucacagccggg

SEQ ID NO: 1208407 - RNA, 15 nt, Mycobacterium bovis subsp bovis AF2122/97
gccggugcgcugguu

SEQ ID NO: 1208408 - RNA, 15 nt, Mycobacterium bovis subsp bovis AF2122/97
gccggugcgcccugc

SEQ ID NO: 1208409 - RNA, 15 nt, Mycobacterium bovis subsp bovis AF2122/97
gccgguggcggcggc

SEQ ID NO: 1208410 - RNA, 19 nt, Mycobacterium bovis subsp bovis AF2122/97
gccgguggcggcggcggca

SEQ ID NO: 1208411 - RNA, 20 nt, Mycobacterium bovis subsp bovis AF2122/97
gccgguguaggccucggcag

SEQ ID NO: 1208412 - RNA, 14 nt, Mycobacterium bovis subsp bovis AF2122/97
gccggugucggcug

SEQ ID NO: 1208413 - RNA, 23 nt, Mycobacterium bovis subsp bovis AF2122/97
gccggugggcgguccgcgucugg

SEQ ID NO: 1208414 - RNA, 13 nt, Mycobacterium bovis subsp bovis AF2122/97
gccgguggcccgc

SEQ ID NO: 1208415 - RNA, 22 nt, Mycobacterium bovis subsp bovis AF2122/97
gccgguggcccgccggcaguga

SEQ ID NO: 1208416 - RNA, 14 nt, Mycobacterium bovis subsp bovis AF2122/97
gccgguggccgcgc

SEQ ID NO: 1208417 - RNA, 23 nt, Mycobacterium bovis subsp bovis AF2122/97
gccgguaggcggccagcgcgcgc

SEQ ID NO: 1208418 - RNA, 18 nt, Mycobacterium bovis subsp bovis AF2122/97
gccgguauacccggcccc

SEQ ID NO: 1208419 - RNA, 15 nt, Mycobacterium bovis subsp bovis AF2122/97
gccggucaccucgcc

SEQ ID NO: 1208420 - RNA, 18 nt, Mycobacterium bovis subsp bovis AF2122/97
gccggucaccucgccggc

SEQ ID NO: 1208421 - RNA, 20 nt, Mycobacterium bovis subsp bovis AF2122/97
gccggucaccucgccggcgg

SEQ ID NO: 1208422 - RNA, 15 nt, Mycobacterium bovis subsp bovis AF2122/97
gccggucacgacguc

SEQ ID NO: 1208423 - RNA, 21 nt, Mycobacterium bovis subsp bovis AF2122/97
gccggucaacccucgccacgc

SEQ ID NO: 1208424 - RNA, 14 nt, Mycobacterium bovis subsp bovis AF2122/97
gccgguccggggca

SEQ ID NO: 1208425 - RNA, 17 nt, Mycobacterium bovis subsp bovis AF2122/97
gccggucaguauggcga

SEQ ID NO: 1208426 - RNA, 21 nt, Mycobacterium bovis subsp bovis AF2122/97
gccgguccccccguugccgcc

SEQ ID NO: 1208427 - RNA, 18 nt, Mycobacterium bovis subsp bovis AF2122/97
gccgguccagacccagcu

SEQ ID NO: 1208428 - RNA, 19 nt, Mycobacterium bovis subsp bovis AF2122/97
gccgguccagacccagcuc

SEQ ID NO: 1208429 - RNA, 16 nt, Mycobacterium bovis subsp bovis AF2122/97
gccgggugggagcagc

SEQ ID NO: 1208430 - RNA, 17 nt, Mycobacterium bovis subsp bovis AF2122/97
gccgggugggagcagcc

SEQ ID NO: 1208431 - RNA, 18 nt, Mycobacterium bovis subsp bovis AF2122/97
gccgggugcgugcgcguc

SEQ ID NO: 1208432 - RNA, 13 nt, Mycobacterium bovis subsp bovis AF2122/97
gccggguguuggg

SEQ ID NO: 1208433 - RNA, 16 nt, Mycobacterium bovis subsp bovis AF2122/97
gccggguuaucggcag

SEQ ID NO: 1208434 - RNA, 12 nt, Mycobacterium bovis subsp bovis AF2122/97
gccggguuccag

SEQ ID NO: 1208435 - RNA, 16 nt, Mycobacterium bovis subsp bovis AF2122/97
gccggguugguaccca

SEQ ID NO: 1208436 - RNA, 20 nt, Mycobacterium bovis subsp bovis AF2122/97
gccggguuggccggcgcugc

SEQ ID NO: 1208437 - RNA, 16 nt, Mycobacterium bovis subsp bovis AF2122/97
gccgguagcacagcag

SEQ ID NO: 1208438 - RNA, 18 nt, Mycobacterium bovis subsp bovis AF2122/97
gccgguagcacagcagca

SEQ ID NO: 1208439 - RNA, 16 nt, Mycobacterium bovis subsp bovis AF2122/97
gccgguagcgcgggug

SEQ ID NO: 1208440 - RNA, 16 nt, Mycobacterium bovis subsp bovis AF2122/97
gccgggcgaugcuggg

SEQ ID NO: 1208441 - RNA, 14 nt, Mycobacterium bovis subsp bovis AF2122/97
gccgggcgccgugc

SEQ ID NO: 1208442 - RNA, 21 nt, Mycobacterium bovis subsp bovis AF2122/97
gccgggcgcccuuaagccggc

SEQ ID NO: 1208443 - RNA, 13 nt, Mycobacterium bovis subsp bovis AF2122/97
gccgggcgcacgc

SEQ ID NO: 1208444 - RNA, 19 nt, Mycobacterium bovis subsp bovis AF2122/97
gccgggcgcgccggccaug

SEQ ID NO: 1208445 - RNA, 17 nt, Mycobacterium bovis subsp bovis AF2122/97
gccgggcgucgcuggug

SEQ ID NO: 1208446 - RNA, 14 nt, Mycobacterium bovis subsp bovis AF2122/97
gccgggcggcagcg

SEQ ID NO: 1208447 - RNA, 13 nt, Mycobacterium bovis subsp bovis AF2122/97
gccgggccgccga

SEQ ID NO: 1208448 - RNA, 13 nt, Mycobacterium bovis subsp bovis AF2122/97
gccgggcccagca

SEQ ID NO: 1208449 - RNA, 15 nt, Mycobacterium bovis subsp bovis AF2122/97
gccgggccccacauc

SEQ ID NO: 1208450 - RNA, 13 nt, Mycobacterium bovis subsp bovis AF2122/97
gccgggccggcca

SEQ ID NO: 1208451 - RNA, 16 nt, Mycobacterium bovis subsp bovis AF2122/97
gccgggccggccacgu

SEQ ID NO: 1208452 - RNA, 20 nt, Mycobacterium bovis subsp bovis AF2122/97
gccgggcgaguacaggcgca

SEQ ID NO: 1208453 - RNA, 15 nt, Mycobacterium bovis subsp bovis AF2122/97
gccgggccaaccggu

SEQ ID NO: 1208454 - RNA, 15 nt, Mycobacterium bovis subsp bovis AF2122/97
gccgggcagucaggc

SEQ ID NO: 1208455 - RNA, 16 nt, Mycobacterium bovis subsp bovis AF2122/97
gccgggcaccacccuu

SEQ ID NO: 1208456 - RNA, 20 nt, Mycobacterium bovis subsp bovis AF2122/97
gccgggcacgcgaggcgcuc

SEQ ID NO: 1208457 - RNA, 20 nt, Mycobacterium bovis subsp bovis AF2122/97
gccggggcgaugucggcugg

SEQ ID NO: 1208458 - RNA, 17 nt, Mycobacterium bovis subsp bovis AF2122/97
gccggggcgcagguugg

SEQ ID NO: 1208459 - RNA, 16 nt, Mycobacterium bovis subsp bovis AF2122/97
gccggggccgccgaug

SEQ ID NO: 1208460 - RNA, 13 nt, Mycobacterium bovis subsp bovis AF2122/97
gccgggggcaccg

SEQ ID NO: 1208461 - RNA, 16 nt, Mycobacterium bovis subsp bovis AF2122/97
gccggggcggaaccug

SEQ ID NO: 1208462 - RNA, 19 nt, Mycobacterium bovis subsp bovis AF2122/97
gccgggcuguucggccaug

SEQ ID NO: 1208463 - RNA, 23 nt, Mycobacterium bovis subsp bovis AF2122/97
gccgggcuccucugguugggagc

SEQ ID NO: 1208464 - RNA, 15 nt, Mycobacterium bovis subsp bovis AF2122/97
gccggggaguggaaa

SEQ ID NO: 1208465 - RNA, 16 nt, Mycobacterium bovis subsp bovis AF2122/97
gccggggacgccgcgg

SEQ ID NO: 1208466 - RNA, 13 nt, Mycobacterium bovis subsp bovis AF2122/97
gccggggccccau

SEQ ID NO: 1208467 - RNA, 16 nt, Mycobacterium bovis subsp bovis AF2122/97
gccgggggcgccgccg

SEQ ID NO: 1208468 - RNA, 16 nt, Mycobacterium bovis subsp bovis AF2122/97
gccggggucggcccgc

SEQ ID NO: 1208469 - RNA, 16 nt, Mycobacterium bovis subsp bovis AF2122/97
gccggguccgccgggc

SEQ ID NO: 1208470 - RNA, 21 nt, Mycobacterium bovis subsp bovis AF2122/97
gccggguauugauugacugcu

SEQ ID NO: 1208471 - RNA, 14 nt, Mycobacterium bovis subsp bovis AF2122/97
gccgggucgcgcug

SEQ ID NO: 1208472 - RNA, 22 nt, Mycobacterium bovis subsp bovis AF2122/97
gccgggucgcgcuggcgccggc

SEQ ID NO: 1208473 - RNA, 21 nt, Mycobacterium bovis subsp bovis AF2122/97
gccgggugccacaacccgcuu

SEQ ID NO: 1208474 - RNA, 22 nt, Mycobacterium bovis subsp bovis AF2122/97
gccgggucguacaacacgggca

SEQ ID NO: 1208475 - RNA, 20 nt, Mycobacterium bovis subsp bovis AF2122/97
gccgugccagcaggggacgg

SEQ ID NO: 1208476 - RNA, 13 nt, Mycobacterium bovis subsp bovis AF2122/97
gccgugccagccc

SEQ ID NO: 1208477 - RNA, 20 nt, Mycobacterium bovis subsp bovis AF2122/97
gccgugcccggugcggugca

SEQ ID NO: 1208478 - RNA, 17 nt, Mycobacterium bovis subsp bovis AF2122/97
gccgugccgaaguggag

SEQ ID NO: 1208479 - RNA, 16 nt, Mycobacterium bovis subsp bovis AF2122/97
gccgugccguggugaa

SEQ ID NO: 1208480 - RNA, 21 nt, Mycobacterium bovis subsp bovis AF2122/97
gccgugccgccgacaccaccg

SEQ ID NO: 1208481 - RNA, 14 nt, Mycobacterium bovis subsp bovis AF2122/97
gccgucucgcggug

SEQ ID NO: 1208482 - RNA, 15 nt, Mycobacterium bovis subsp bovis AF2122/97
gccguggcgucggcg

SEQ ID NO: 1208483 - RNA, 19 nt, Mycobacterium bovis subsp bovis AF2122/97
gccguggcgucgguggcaa

SEQ ID NO: 1208484 - RNA, 15 nt, Mycobacterium bovis subsp bovis AF2122/97
gccguggcggacggc

SEQ ID NO: 1208485 - RNA, 20 nt, Mycobacterium bovis subsp bovis AF2122/97
gccgugcgaucaccuccgcg

SEQ ID NO: 1208486 - RNA, 22 nt, Mycobacterium bovis subsp bovis AF2122/97
gccguggguguugaugggcagc

SEQ ID NO: 1208487 - RNA, 17 nt, Mycobacterium bovis subsp bovis AF2122/97
gccguguacgugcucgu

SEQ ID NO: 1208488 - RNA, 20 nt, Mycobacterium bovis subsp bovis AF2122/97
gccguguucagcacccaccg

SEQ ID NO: 1208489 - RNA, 17 nt, Mycobacterium bovis subsp bovis AF2122/97
gccguucgcucccccgc

SEQ ID NO: 1208490 - RNA, 17 nt, Mycobacterium bovis subsp bovis AF2122/97
gccguucggcaucuggu

SEQ ID NO: 1208491 - RNA, 15 nt, Mycobacterium bovis subsp bovis AF2122/97
gccguucggggcgcg

SEQ ID NO: 1208492 - RNA, 17 nt, Mycobacterium bovis subsp bovis AF2122/97
gccguggugcgcauggc

SEQ ID NO: 1208493 - RNA, 18 nt, Mycobacterium bovis subsp bovis AF2122/97
gccgugugugcgauccag

SEQ ID NO: 1208494 - RNA, 20 nt, Mycobacterium bovis subsp bovis AF2122/97
gccgugugugcgauccaggg

SEQ ID NO: 1208495 - RNA, 18 nt, Mycobacterium bovis subsp bovis AF2122/97
gccuaccaggcgcggccc

SEQ ID NO: 1208496 - RNA, 14 nt, Mycobacterium bovis subsp bovis AF2122/97
gccuaccaggcgcg

SEQ ID NO: 1208497 - RNA, 23 nt, Mycobacterium bovis subsp bovis AF2122/97
gccuacccuucgguaggcaggcc

SEQ ID NO: 1208498 - RNA, 12 nt, Mycobacterium bovis subsp bovis AF2122/97
gccuaccggccu

SEQ ID NO: 1208499 - RNA, 22 nt, Mycobacterium bovis subsp bovis AF2122/97
gccuaccggccuuuccagcacc

SEQ ID NO: 1208500 - RNA, 15 nt, Mycobacterium bovis subsp bovis AF2122/97
gccguugccgccggc

SEQ ID NO: 1208501 - RNA, 17 nt, Mycobacterium bovis subsp bovis AF2122/97
gccguugccgccgucgc

SEQ ID NO: 1208502 - RNA, 15 nt, Mycobacterium bovis subsp bovis AF2122/97
gccguugccgccgcc

SEQ ID NO: 1208503 - RNA, 17 nt, Mycobacterium bovis subsp bovis AF2122/97
gccguugccgccgacgc

SEQ ID NO: 1208504 - RNA, 22 nt, Mycobacterium bovis subsp bovis AF2122/97
gccguugccguacagcccggcc

SEQ ID NO: 1208505 - RNA, 20 nt, Mycobacterium bovis subsp bovis AF2122/97
gccguugccgccgucgccgc

SEQ ID NO: 1208506 - RNA, 17 nt, Mycobacterium bovis subsp bovis AF2122/97
gccguugaucgcaaacc

SEQ ID NO: 1208507 - RNA, 13 nt, Mycobacterium bovis subsp bovis AF2122/97
gccguugccaccg

SEQ ID NO: 1208508 - RNA, 19 nt, Mycobacterium bovis subsp bovis AF2122/97
gccguugccgauccccagg

SEQ ID NO: 1208509 - RNA, 12 nt, Mycobacterium bovis subsp bovis AF2122/97
gccguugccgcc

SEQ ID NO: 1208510 - RNA, 15 nt, Mycobacterium bovis subsp bovis AF2122/97
gccguugccgccauc

SEQ ID NO: 1208511 - RNA, 15 nt, Mycobacterium bovis subsp bovis AF2122/97
gccguugccgccauu

SEQ ID NO: 1208512 - RNA, 19 nt, Mycobacterium bovis subsp bovis AF2122/97
gccguugccgccauuggca

SEQ ID NO: 1208513 - RNA, 15 nt, Mycobacterium bovis subsp bovis AF2122/97
gccguucucgcccac

SEQ ID NO: 1208514 - RNA, 15 nt, Mycobacterium bovis subsp bovis AF2122/97
gccgucgaccggcgg

SEQ ID NO: 1208515 - RNA, 12 nt, Mycobacterium bovis subsp bovis AF2122/97
gccgucgagcaa

SEQ ID NO: 1208516 - RNA, 16 nt, Mycobacterium bovis subsp bovis AF2122/97
gccgucgacgcggccg

SEQ ID NO: 1208517 - RNA, 20 nt, Mycobacterium bovis subsp bovis AF2122/97
gccgucgaucccggucggug

SEQ ID NO: 1208518 - RNA, 18 nt, Mycobacterium bovis subsp bovis AF2122/97
gccgucgagcacggugag

SEQ ID NO: 1208519 - RNA, 17 nt, Mycobacterium bovis subsp bovis AF2122/97
gccgucgagcacgguga

SEQ ID NO: 1208520 - RNA, 16 nt, Mycobacterium bovis subsp bovis AF2122/97
gccgucgagcauccac

SEQ ID NO: 1208521 - RNA, 22 nt, Mycobacterium bovis subsp bovis AF2122/97
gccgucggugccggggcugccg

SEQ ID NO: 1208522 - RNA, 23 nt, Mycobacterium bovis subsp bovis AF2122/97
gccgucggugggugccagccggu

SEQ ID NO: 1208523 - RNA, 21 nt, Mycobacterium bovis subsp bovis AF2122/97
gccgucggugccgccgccggc

SEQ ID NO: 1208524 - RNA, 17 nt, Mycobacterium bovis subsp bovis AF2122/97
gccgucggugccgcgga

SEQ ID NO: 1208525 - RNA, 20 nt, Mycobacterium bovis subsp bovis AF2122/97
gccgucggguaggccgccgu

SEQ ID NO: 1208526 - RNA, 18 nt, Mycobacterium bovis subsp bovis AF2122/97
gccgucgauguggcgcuc

SEQ ID NO: 1208527 - RNA, 22 nt, Mycobacterium bovis subsp bovis AF2122/97
gccgucgaugaucugcuugcca

SEQ ID NO: 1208528 - RNA, 15 nt, Mycobacterium bovis subsp bovis AF2122/97
gccgucgcagccagc

SEQ ID NO: 1208529 - RNA, 22 nt, Mycobacterium bovis subsp bovis AF2122/97
gccguccaccgauacccccggc

SEQ ID NO: 1208530 - RNA, 21 nt, Mycobacterium bovis subsp bovis AF2122/97
gccgucgaaccaguccucggg

SEQ ID NO: 1208531 - RNA, 17 nt, Mycobacterium bovis subsp bovis AF2122/97
gccgucaucuggaagua

SEQ ID NO: 1208532 - RNA, 20 nt, Mycobacterium bovis subsp bovis AF2122/97
gccgucaugcccaucuccaa

SEQ ID NO: 1208533 - RNA, 18 nt, Mycobacterium bovis subsp bovis AF2122/97
gccguccaauuccgcaga

SEQ ID NO: 1208534 - RNA, 23 nt, Mycobacterium bovis subsp bovis AF2122/97
gccguagguugcgccccgacugc

SEQ ID NO: 1208535 - RNA, 19 nt, Mycobacterium bovis subsp bovis AF2122/97
gccguaggcggcgacccgc

SEQ ID NO: 1208536 - RNA, 14 nt, Mycobacterium bovis subsp bovis AF2122/97
gccgucagccaggu

SEQ ID NO: 1208537 - RNA, 20 nt, Mycobacterium bovis subsp bovis AF2122/97
gccgucagggucagcuggga

SEQ ID NO: 1208538 - RNA, 13 nt, Mycobacterium bovis subsp bovis AF2122/97
gccgucagggugu

SEQ ID NO: 1208539 - RNA, 22 nt, Mycobacterium bovis subsp bovis AF2122/97
gccgucagcucaccacccagau

SEQ ID NO: 1208540 - RNA, 16 nt, Mycobacterium bovis subsp bovis AF2122/97
gccgucagcccaggug

SEQ ID NO: 1208541 - RNA, 19 nt, Mycobacterium bovis subsp bovis AF2122/97
gccgucauagcaggccucc

SEQ ID NO: 1208542 - RNA, 19 nt, Mycobacterium bovis subsp bovis AF2122/97
gccguaagcaccagccagc

SEQ ID NO: 1208543 - RNA, 15 nt, Mycobacterium bovis subsp bovis AF2122/97
gccguacagcccggc

SEQ ID NO: 1208544 - RNA, 13 nt, Mycobacterium bovis subsp bovis AF2122/97
gccguacagcggc

SEQ ID NO: 1208545 - RNA, 14 nt, Mycobacterium bovis subsp bovis AF2122/97
gccguacaaccacc

SEQ ID NO: 1208546 - RNA, 17 nt, Mycobacterium bovis subsp bovis AF2122/97
gccguacaaccacccac

SEQ ID NO: 1208547 - RNA, 14 nt, Mycobacterium bovis subsp bovis AF2122/97
gccguagccgccgu

SEQ ID NO: 1208548 - RNA, 15 nt, Mycobacterium bovis subsp bovis AF2122/97
gccguagcgcagcgc

SEQ ID NO: 1208549 - RNA, 22 nt, Mycobacterium bovis subsp bovis AF2122/97
gccguacguucaccaccgcaca

SEQ ID NO: 1208550 - RNA, 19 nt, Mycobacterium bovis subsp bovis AF2122/97
gccguagaccaggcccagg

SEQ ID NO: 1208551 - RNA, 21 nt, Mycobacterium bovis subsp bovis AF2122/97
gccgguguugauuccggcgug

SEQ ID NO: 1208552 - RNA, 19 nt, Mycobacterium bovis subsp bovis AF2122/97
gccgguguugccgccggug

SEQ ID NO: 1208553 - RNA, 21 nt, Mycobacterium bovis subsp bovis AF2122/97
gccgguguuuccgaaacccgc

SEQ ID NO: 1208554 - RNA, 19 nt, Mycobacterium bovis subsp bovis AF2122/97
gccgguggugccggcgccg

SEQ ID NO: 1208555 - RNA, 16 nt, Mycobacterium bovis subsp bovis AF2122/97
gccggugucggcuggu

SEQ ID NO: 1208556 - RNA, 15 nt, Mycobacterium bovis subsp bovis AF2122/97
gccggugucgggcug

SEQ ID NO: 1208557 - RNA, 18 nt, Mycobacterium bovis subsp bovis AF2122/97
gccggugucucccuugcc

SEQ ID NO: 1208558 - RNA, 15 nt, Mycobacterium bovis subsp bovis AF2122/97
gccgguuccgcaaug

SEQ ID NO: 1208559 - RNA, 19 nt, Mycobacterium bovis subsp bovis AF2122/97
gccgguguuagugaggccc

SEQ ID NO: 1208560 - RNA, 15 nt, Mycobacterium bovis subsp bovis AF2122/97
gccgguuggcugccg

SEQ ID NO: 1208561 - RNA, 17 nt, Mycobacterium bovis subsp bovis AF2122/97
gccgguugucgcagcgc

SEQ ID NO: 1208562 - RNA, 23 nt, Mycobacterium bovis subsp bovis AF2122/97
gccgguuugucgugucaugcuca

SEQ ID NO: 1208563 - RNA, 17 nt, Mycobacterium bovis subsp bovis AF2122/97
gccggcgcugccaaacu

SEQ ID NO: 1208564 - RNA, 12 nt, Mycobacterium bovis subsp bovis AF2122/97
gccggcgcuggc

SEQ ID NO: 1208565 - RNA, 15 nt, Mycobacterium bovis subsp bovis AF2122/97
gccggcggccaccuc

SEQ ID NO: 1208566 - RNA, 15 nt, Mycobacterium bovis subsp bovis AF2122/97
gccggcggcccgcuc

SEQ ID NO: 1208567 - RNA, 20 nt, Mycobacterium bovis subsp bovis AF2122/97
gccggcggccuugcgggcuc

SEQ ID NO: 1208568 - RNA, 15 nt, Mycobacterium bovis subsp bovis AF2122/97
gccggcggcgguggu

SEQ ID NO: 1208569 - RNA, 12 nt, Mycobacterium bovis subsp bovis AF2122/97
gccggcggcugu

SEQ ID NO: 1208570 - RNA, 14 nt, Mycobacterium bovis subsp bovis AF2122/97
gccggcggcggccg

SEQ ID NO: 1208571 - RNA, 15 nt, Mycobacterium bovis subsp bovis AF2122/97
gccggcggcggccgc

SEQ ID NO: 1208572 - RNA, 12 nt, Mycobacterium bovis subsp bovis AF2122/97
gccggcggcggc

SEQ ID NO: 1208573 - RNA, 15 nt, Mycobacterium bovis subsp bovis AF2122/97
gccggcggcggcgcu

SEQ ID NO: 1208574 - RNA, 19 nt, Mycobacterium bovis subsp bovis AF2122/97
gccggcggguggcccccgc

SEQ ID NO: 1208575 - RNA, 18 nt, Mycobacterium bovis subsp bovis AF2122/97
gccggcgggcucgcccgc

SEQ ID NO: 1208576 - RNA, 15 nt, Mycobacterium bovis subsp bovis AF2122/97
gccggcgucagcccc

SEQ ID NO: 1208577 - RNA, 20 nt, Mycobacterium bovis subsp bovis AF2122/97
gccggcgguagucggccagc

SEQ ID NO: 1208578 - RNA, 21 nt, Mycobacterium bovis subsp bovis AF2122/97
gccggcggucgggcccggcga

SEQ ID NO: 1208579 - RNA, 23 nt, Mycobacterium bovis subsp bovis AF2122/97
gccggcggucgggcccggcgagc

SEQ ID NO: 1208580 - RNA, 15 nt, Mycobacterium bovis subsp bovis AF2122/97
gccggcggucgccag

SEQ ID NO: 1208581 - RNA, 22 nt, Mycobacterium bovis subsp bovis AF2122/97
gccggcguagaucaucagcgac

SEQ ID NO: 1208582 - RNA, 21 nt, Mycobacterium bovis subsp bovis AF2122/97
gccggcgucggcgcccagcuc

SEQ ID NO: 1208583 - RNA, 14 nt, Mycobacterium bovis subsp bovis AF2122/97
gccggcuccgccgu

SEQ ID NO: 1208584 - RNA, 21 nt, Mycobacterium bovis subsp bovis AF2122/97
gccggcuccgccguugccgcc

SEQ ID NO: 1208585 - RNA, 16 nt, Mycobacterium bovis subsp bovis AF2122/97
gccggcuccggcggug

SEQ ID NO: 1208586 - RNA, 14 nt, Mycobacterium bovis subsp bovis AF2122/97
gccggcuccacccu

SEQ ID NO: 1208587 - RNA, 17 nt, Mycobacterium bovis subsp bovis AF2122/97
gccggcugcauccuccu

SEQ ID NO: 1208588 - RNA, 16 nt, Mycobacterium bovis subsp bovis AF2122/97
gccggcugcggaggcg

SEQ ID NO: 1208589 - RNA, 23 nt, Mycobacterium bovis subsp bovis AF2122/97
gccggcguuagcguagcccgagu

SEQ ID NO: 1208590 - RNA, 17 nt, Mycobacterium bovis subsp bovis AF2122/97
gccggcguugccgccgu

SEQ ID NO: 1208591 - RNA, 20 nt, Mycobacterium bovis subsp bovis AF2122/97
gccggcguugccgccguucc

SEQ ID NO: 1208592 - RNA, 23 nt, Mycobacterium bovis subsp bovis AF2122/97
gccggcuagauaacccaaccgcg

SEQ ID NO: 1208593 - RNA, 19 nt, Mycobacterium bovis subsp bovis AF2122/97
gccggcuagcucggcggcu

SEQ ID NO: 1208594 - RNA, 16 nt, Mycobacterium bovis subsp bovis AF2122/97
gccggcuagggcagca

SEQ ID NO: 1208595 - RNA, 18 nt, Mycobacterium bovis subsp bovis AF2122/97
gccggcuagggcagcagc

SEQ ID NO: 1208596 - RNA, 15 nt, Mycobacterium bovis subsp bovis AF2122/97
gccggcucgccggcg

SEQ ID NO: 1208597 - RNA, 16 nt, Mycobacterium bovis subsp bovis AF2122/97
gccggcuucgcccaga

SEQ ID NO: 1208598 - RNA, 17 nt, Mycobacterium bovis subsp bovis AF2122/97
gccggcuucgcccagag

SEQ ID NO: 1208599 - RNA, 16 nt, Mycobacterium bovis subsp bovis AF2122/97
gccggcuugggcggua

SEQ ID NO: 1208600 - RNA, 22 nt, Mycobacterium bovis subsp bovis AF2122/97
gccggcuuggccuuugccgucg

SEQ ID NO: 1208601 - RNA, 17 nt, Mycobacterium bovis subsp bovis AF2122/97
gccggcuucggcgagcg

SEQ ID NO: 1208602 - RNA, 17 nt, Mycobacterium bovis subsp bovis AF2122/97
gccgggaacaucccagc

SEQ ID NO: 1208603 - RNA, 19 nt, Mycobacterium bovis subsp bovis AF2122/97
gccggcuuugagccgcucg

SEQ ID NO: 1208604 - RNA, 14 nt, Mycobacterium bovis subsp bovis AF2122/97
gccgggcaaccagc

SEQ ID NO: 1208605 - RNA, 16 nt, Mycobacterium bovis subsp bovis AF2122/97
gccgggauugccgucg

SEQ ID NO: 1208606 - RNA, 16 nt, Mycobacterium bovis subsp bovis AF2122/97
gccgggaugccgccgc

SEQ ID NO: 1208607 - RNA, 19 nt, Mycobacterium bovis subsp bovis AF2122/97
gccgggaugccgccgcuga

SEQ ID NO: 1208608 - RNA, 17 nt, Mycobacterium bovis subsp bovis AF2122/97
gccgggagacgcugcgc

SEQ ID NO: 1208609 - RNA, 16 nt, Mycobacterium bovis subsp bovis AF2122/97
gccgggauaacccagc

SEQ ID NO: 1208610 - RNA, 14 nt, Mycobacterium bovis subsp bovis AF2122/97
gccggccccgccga

SEQ ID NO: 1208611 - RNA, 13 nt, Mycobacterium bovis subsp bovis AF2122/97
gccggcccgcggg

SEQ ID NO: 1208612 - RNA, 15 nt, Mycobacterium bovis subsp bovis AF2122/97
gccggcccgcgggcg

SEQ ID NO: 1208613 - RNA, 18 nt, Mycobacterium bovis subsp bovis AF2122/97
gccggcccugcucgccgu

SEQ ID NO: 1208614 - RNA, 23 nt, Mycobacterium bovis subsp bovis AF2122/97
gccggccgagcgcacuggggagg

SEQ ID NO: 1208615 - RNA, 17 nt, Mycobacterium bovis subsp bovis AF2122/97
gccggccgaucggccgg

SEQ ID NO: 1208616 - RNA, 21 nt, Mycobacterium bovis subsp bovis AF2122/97
gccggccgcacgccggccagc

SEQ ID NO: 1208617 - RNA, 13 nt, Mycobacterium bovis subsp bovis AF2122/97
gccggccgcccgc

SEQ ID NO: 1208618 - RNA, 14 nt, Mycobacterium bovis subsp bovis AF2122/97
gccggccccgccgu

SEQ ID NO: 1208619 - RNA, 14 nt, Mycobacterium bovis subsp bovis AF2122/97
gccggccgcgaccg

SEQ ID NO: 1208620 - RNA, 15 nt, Mycobacterium bovis subsp bovis AF2122/97
gccggccgcgaccgc

SEQ ID NO: 1208621 - RNA, 15 nt, Mycobacterium bovis subsp bovis AF2122/97
gccggccgcgccggc

SEQ ID NO: 1208622 - RNA, 13 nt, Mycobacterium bovis subsp bovis AF2122/97
gccggccgcgggc

SEQ ID NO: 1208623 - RNA, 14 nt, Mycobacterium bovis subsp bovis AF2122/97
gccggccgcgggcg

SEQ ID NO: 1208624 - RNA, 20 nt, Mycobacterium bovis subsp bovis AF2122/97
gccggccgcucaccccgcgc

SEQ ID NO: 1208625 - RNA, 20 nt, Mycobacterium bovis subsp bovis AF2122/97
gccggccgcuuggccgcugc

SEQ ID NO: 1208626 - RNA, 15 nt, Mycobacterium bovis subsp bovis AF2122/97
gccggccggcccggg

SEQ ID NO: 1208627 - RNA, 13 nt, Mycobacterium bovis subsp bovis AF2122/97
gccggccggcggg

SEQ ID NO: 1208628 - RNA, 12 nt, Mycobacterium bovis subsp bovis AF2122/97
gccggccggcag

SEQ ID NO: 1208629 - RNA, 17 nt, Mycobacterium bovis subsp bovis AF2122/97
gccggccgcggggcauc

SEQ ID NO: 1208630 - RNA, 21 nt, Mycobacterium bovis subsp bovis AF2122/97
gccggccucgccgaagcgggc

SEQ ID NO: 1208631 - RNA, 13 nt, Mycobacterium bovis subsp bovis AF2122/97
gccggccuggccg

SEQ ID NO: 1208632 - RNA, 19 nt, Mycobacterium bovis subsp bovis AF2122/97
gccggcgaaccccagcgca

SEQ ID NO: 1208633 - RNA, 21 nt, Mycobacterium bovis subsp bovis AF2122/97
gccggcgaccgggaucggcuc

SEQ ID NO: 1208634 - RNA, 14 nt, Mycobacterium bovis subsp bovis AF2122/97
gccggcgaccagga

SEQ ID NO: 1208635 - RNA, 16 nt, Mycobacterium bovis subsp bovis AF2122/97
gccggccgucggccgg

SEQ ID NO: 1208636 - RNA, 21 nt, Mycobacterium bovis subsp bovis AF2122/97
gccggcgaauccgcacagguc

SEQ ID NO: 1208637 - RNA, 15 nt, Mycobacterium bovis subsp bovis AF2122/97
gccggcgagcaggcc

SEQ ID NO: 1208638 - RNA, 16 nt, Mycobacterium bovis subsp bovis AF2122/97
gccggcgagggccacg

SEQ ID NO: 1208639 - RNA, 16 nt, Mycobacterium bovis subsp bovis AF2122/97
gccggcgagggugagc

SEQ ID NO: 1208640 - RNA, 13 nt, Mycobacterium bovis subsp bovis AF2122/97
gccggcgccaagu

SEQ ID NO: 1208641 - RNA, 13 nt, Mycobacterium bovis subsp bovis AF2122/97
gccggcgccgcac

SEQ ID NO: 1208642 - RNA, 15 nt, Mycobacterium bovis subsp bovis AF2122/97
gccggcgcccggggc

SEQ ID NO: 1208643 - RNA, 17 nt, Mycobacterium bovis subsp bovis AF2122/97
gccggcgcccggggcgg

SEQ ID NO: 1208644 - RNA, 15 nt, Mycobacterium bovis subsp bovis AF2122/97
gccggcgccacccgc

SEQ ID NO: 1208645 - RNA, 15 nt, Mycobacterium bovis subsp bovis AF2122/97
gccggcgccgccagc

SEQ ID NO: 1208646 - RNA, 15 nt, Mycobacterium bovis subsp bovis AF2122/97
gccggcgccgccauu

SEQ ID NO: 1208647 - RNA, 17 nt, Mycobacterium bovis subsp bovis AF2122/97
gccggcgccgcccgcgc

SEQ ID NO: 1208648 - RNA, 19 nt, Mycobacterium bovis subsp bovis AF2122/97
gccggcgccggcgcugcug

SEQ ID NO: 1208649 - RNA, 12 nt, Mycobacterium bovis subsp bovis AF2122/97
gccggcgccggc

SEQ ID NO: 1208650 - RNA, 16 nt, Mycobacterium bovis subsp bovis AF2122/97
gccggcgccgccggug

SEQ ID NO: 1208651 - RNA, 15 nt, Mycobacterium bovis subsp bovis AF2122/97
gccggcgcgcagccg

SEQ ID NO: 1208652 - RNA, 16 nt, Mycobacterium bovis subsp bovis AF2122/97
gccggcgcgcaccccg

SEQ ID NO: 1208653 - RNA, 16 nt, Mycobacterium bovis subsp bovis AF2122/97
gccggcgcgccgggcg

SEQ ID NO: 1208654 - RNA, 14 nt, Mycobacterium bovis subsp bovis AF2122/97
gccggcgcggcggc

SEQ ID NO: 1208655 - RNA, 12 nt, Mycobacterium bovis subsp bovis AF2122/97
gccggcgcggcg

SEQ ID NO: 1208656 - RNA, 13 nt, Mycobacterium bovis subsp bovis AF2122/97
gccggcgcgcccc

SEQ ID NO: 1208657 - RNA, 19 nt, Mycobacterium bovis subsp bovis AF2122/97
gccggccagacggugcagc

SEQ ID NO: 1208658 - RNA, 14 nt, Mycobacterium bovis subsp bovis AF2122/97
gccggccagccagc

SEQ ID NO: 1208659 - RNA, 22 nt, Mycobacterium bovis subsp bovis AF2122/97
gccggccccaccggugccgccg

SEQ ID NO: 1208660 - RNA, 22 nt, Mycobacterium bovis subsp bovis AF2122/97
gccggcccaccaggcccaucuc

SEQ ID NO: 1208661 - RNA, 17 nt, Mycobacterium bovis subsp bovis AF2122/97
gccggcccaccaggccc

SEQ ID NO: 1208662 - RNA, 14 nt, Mycobacterium bovis subsp bovis AF2122/97
gccggccccgccgc

SEQ ID NO: 1208663 - RNA, 13 nt, Mycobacterium bovis subsp bovis AF2122/97
gccggccccgccg

SEQ ID NO: 1208664 - RNA, 15 nt, Mycobacterium bovis subsp bovis AF2122/97
gccggccccgcccgc

SEQ ID NO: 1208665 - RNA, 15 nt, Mycobacterium bovis subsp bovis AF2122/97
gccggcauggcggca

SEQ ID NO: 1208666 - RNA, 18 nt, Mycobacterium bovis subsp bovis AF2122/97
gccggcaucgcgcgcggc

SEQ ID NO: 1208667 - RNA, 14 nt, Mycobacterium bovis subsp bovis AF2122/97
gccggccaacuggg

SEQ ID NO: 1208668 - RNA, 15 nt, Mycobacterium bovis subsp bovis AF2122/97
gccggccaacugggc

SEQ ID NO: 1208669 - RNA, 19 nt, Mycobacterium bovis subsp bovis AF2122/97
gccggccaacugggccgag

SEQ ID NO: 1208670 - RNA, 13 nt, Mycobacterium bovis subsp bovis AF2122/97
gccggccaacuuc

SEQ ID NO: 1208671 - RNA, 17 nt, Mycobacterium bovis subsp bovis AF2122/97
gccggccaccaccgcgc

SEQ ID NO: 1208672 - RNA, 19 nt, Mycobacterium bovis subsp bovis AF2122/97
gccggccaccaccgcgccg

SEQ ID NO: 1208673 - RNA, 17 nt, Mycobacterium bovis subsp bovis AF2122/97
gccggccaccucggugc

SEQ ID NO: 1208674 - RNA, 19 nt, Mycobacterium bovis subsp bovis AF2122/97
gccggccacgcauuccagc

SEQ ID NO: 1208675 - RNA, 12 nt, Mycobacterium bovis subsp bovis AF2122/97
gccggccaccuc

SEQ ID NO: 1208676 - RNA, 15 nt, Mycobacterium bovis subsp bovis AF2122/97
gccggccacccgcgc

SEQ ID NO: 1208677 - RNA, 21 nt, Mycobacterium bovis subsp bovis AF2122/97
gccggcauaaaccgcguccgc

SEQ ID NO: 1208678 - RNA, 23 nt, Mycobacterium bovis subsp bovis AF2122/97
gccggcauaaaccgcguccgcgc

SEQ ID NO: 1208679 - RNA, 22 nt, Mycobacterium bovis subsp bovis AF2122/97
gccggcauccgguucgccgccg

SEQ ID NO: 1208680 - RNA, 14 nt, Mycobacterium bovis subsp bovis AF2122/97
gccggcaugccagc

SEQ ID NO: 1208681 - RNA, 15 nt, Mycobacterium bovis subsp bovis AF2122/97
gccggcaugccagcc

SEQ ID NO: 1208682 - RNA, 13 nt, Mycobacterium bovis subsp bovis AF2122/97
gccggcacgccga

SEQ ID NO: 1208683 - RNA, 20 nt, Mycobacterium bovis subsp bovis AF2122/97
gccggcacgccgaccggugg

SEQ ID NO: 1208684 - RNA, 16 nt, Mycobacterium bovis subsp bovis AF2122/97
gccggcaccgccggcg

SEQ ID NO: 1208685 - RNA, 12 nt, Mycobacterium bovis subsp bovis AF2122/97
gccggcaccggg

SEQ ID NO: 1208686 - RNA, 17 nt, Mycobacterium bovis subsp bovis AF2122/97
gccggcacccgccgugc

SEQ ID NO: 1208687 - RNA, 15 nt, Mycobacterium bovis subsp bovis AF2122/97
gccggcaccgccgcc

SEQ ID NO: 1208688 - RNA, 17 nt, Mycobacterium bovis subsp bovis AF2122/97
gccggcacugccgagca

SEQ ID NO: 1208689 - RNA, 14 nt, Mycobacterium bovis subsp bovis AF2122/97
gccggcacgcgcgc

SEQ ID NO: 1208690 - RNA, 13 nt, Mycobacterium bovis subsp bovis AF2122/97
gccggcagcagcg

SEQ ID NO: 1208691 - RNA, 16 nt, Mycobacterium bovis subsp bovis AF2122/97
gccggcagcagcgggc

SEQ ID NO: 1208692 - RNA, 16 nt, Mycobacterium bovis subsp bovis AF2122/97
gccggcagcggcgcgc

SEQ ID NO: 1208693 - RNA, 15 nt, Mycobacterium bovis subsp bovis AF2122/97
gccggcagcgccccc

SEQ ID NO: 1208694 - RNA, 14 nt, Mycobacterium bovis subsp bovis AF2122/97
gccggcagugaguc

SEQ ID NO: 1208695 - RNA, 16 nt, Mycobacterium bovis subsp bovis AF2122/97
gccggcaacggcgcgc

SEQ ID NO: 1208696 - RNA, 19 nt, Mycobacterium bovis subsp bovis AF2122/97
gccggcaaugccgcggcca

SEQ ID NO: 1208697 - RNA, 21 nt, Mycobacterium bovis subsp bovis AF2122/97
gccggcaauaccgccagcgcc

SEQ ID NO: 1208698 - RNA, 13 nt, Mycobacterium bovis subsp bovis AF2122/97
gccggaugaaaug

SEQ ID NO: 1208699 - RNA, 13 nt, Mycobacterium bovis subsp bovis AF2122/97
gccggaucccagu

SEQ ID NO: 1208700 - RNA, 16 nt, Mycobacterium bovis subsp bovis AF2122/97
gccggauaggucgggc

SEQ ID NO: 1208701 - RNA, 17 nt, Mycobacterium bovis subsp bovis AF2122/97
gccggauagcaccggca

SEQ ID NO: 1208702 - RNA, 19 nt, Mycobacterium bovis subsp bovis AF2122/97
gccggaggcaagcaaccgg

SEQ ID NO: 1208703 - RNA, 17 nt, Mycobacterium bovis subsp bovis AF2122/97
gccggaguuccgccauu

SEQ ID NO: 1208704 - RNA, 18 nt, Mycobacterium bovis subsp bovis AF2122/97
gccggaguugaagaagcc

SEQ ID NO: 1208705 - RNA, 17 nt, Mycobacterium bovis subsp bovis AF2122/97
gccggagucgacccugc

SEQ ID NO: 1208706 - RNA, 19 nt, Mycobacterium bovis subsp bovis AF2122/97
gccggagccggugccgacg

SEQ ID NO: 1208707 - RNA, 18 nt, Mycobacterium bovis subsp bovis AF2122/97
gccggagccgccggcccc

SEQ ID NO: 1208708 - RNA, 20 nt, Mycobacterium bovis subsp bovis AF2122/97
gccggagccgccggccccgc

SEQ ID NO: 1208709 - RNA, 15 nt, Mycobacterium bovis subsp bovis AF2122/97
gccggagccgccggc

SEQ ID NO: 1208710 - RNA, 20 nt, Mycobacterium bovis subsp bovis AF2122/97
gccggagacgucgccgcagu

SEQ ID NO: 1208711 - RNA, 14 nt, Mycobacterium bovis subsp bovis AF2122/97
gccgcggccaccac

SEQ ID NO: 1208712 - RNA, 13 nt, Mycobacterium bovis subsp bovis AF2122/97
gccgcggccaccg

SEQ ID NO: 1208713 - RNA, 18 nt, Mycobacterium bovis subsp bovis AF2122/97
gccgcggccaccgccgcc

SEQ ID NO: 1208714 - RNA, 16 nt, Mycobacterium bovis subsp bovis AF2122/97
gccgcggcccgcgugc

SEQ ID NO: 1208715 - RNA, 18 nt, Mycobacterium bovis subsp bovis AF2122/97
gccgcggaggcggccagc

SEQ ID NO: 1208716 - RNA, 21 nt, Mycobacterium bovis subsp bovis AF2122/97
gccgcggagaaggcgcgggcg

SEQ ID NO: 1208717 - RNA, 22 nt, Mycobacterium bovis subsp bovis AF2122/97
gccgcggagaaggcgcgggcga

SEQ ID NO: 1208718 - RNA, 18 nt, Mycobacterium bovis subsp bovis AF2122/97
gccgcggcaccgccccgc

SEQ ID NO: 1208719 - RNA, 19 nt, Mycobacterium bovis subsp bovis AF2122/97
gccgcggcaccgccgagca

SEQ ID NO: 1208720 - RNA, 14 nt, Mycobacterium bovis subsp bovis AF2122/97
gccgcggcagggcg

SEQ ID NO: 1208721 - RNA, 18 nt, Mycobacterium bovis subsp bovis AF2122/97
gccggaauacccgcuggc

SEQ ID NO: 1208722 - RNA, 17 nt, Mycobacterium bovis subsp bovis AF2122/97
gccggaccagcuccugc

SEQ ID NO: 1208723 - RNA, 16 nt, Mycobacterium bovis subsp bovis AF2122/97
gccggacaaccugggg

SEQ ID NO: 1208724 - RNA, 18 nt, Mycobacterium bovis subsp bovis AF2122/97
gccggaccagcuccugca

SEQ ID NO: 1208725 - RNA, 14 nt, Mycobacterium bovis subsp bovis AF2122/97
gccggaccaucagc

SEQ ID NO: 1208726 - RNA, 13 nt, Mycobacterium bovis subsp bovis AF2122/97
gccggacccgccg

SEQ ID NO: 1208727 - RNA, 15 nt, Mycobacterium bovis subsp bovis AF2122/97
gccggaccgccgcaa

SEQ ID NO: 1208728 - RNA, 20 nt, Mycobacterium bovis subsp bovis AF2122/97
gccggacguucuggaucgug

SEQ ID NO: 1208729 - RNA, 21 nt, Mycobacterium bovis subsp bovis AF2122/97
gccggacuaccgccggcggcg

SEQ ID NO: 1208730 - RNA, 22 nt, Mycobacterium bovis subsp bovis AF2122/97
gcgacaggagacgguacgccag

SEQ ID NO: 1208731 - RNA, 11 nt, Mycobacterium bovis subsp bovis AF2122/97
gcgacagcgcu

SEQ ID NO: 1208732 - RNA, 16 nt, Mycobacterium bovis subsp bovis AF2122/97
gcgacagcgcggcggu

SEQ ID NO: 1208733 - RNA, 15 nt, Mycobacterium bovis subsp bovis AF2122/97
gcgacagcgcggcgg

SEQ ID NO: 1208734 - RNA, 21 nt, Mycobacterium bovis subsp bovis AF2122/97
gcgacagcggcgacaugaucu

SEQ ID NO: 1208735 - RNA, 15 nt, Mycobacterium bovis subsp bovis AF2122/97
gcgacagccguggcg

SEQ ID NO: 1208736 - RNA, 14 nt, Mycobacterium bovis subsp bovis AF2122/97
gcgacacgccggcg

SEQ ID NO: 1208737 - RNA, 12 nt, Mycobacterium bovis subsp bovis AF2122/97
gcgacacgccag

SEQ ID NO: 1208738 - RNA, 20 nt, Mycobacterium bovis subsp bovis AF2122/97
gcgacagacagcaccgccgg

SEQ ID NO: 1208739 - RNA, 14 nt, Mycobacterium bovis subsp bovis AF2122/97
gcgacacgccaggu

SEQ ID NO: 1208740 - RNA, 19 nt, Mycobacterium bovis subsp bovis AF2122/97
gcgacaauggugcccagga

SEQ ID NO: 1208741 - RNA, 23 nt, Mycobacterium bovis subsp bovis AF2122/97
gcgacacccugggugccggcagc

SEQ ID NO: 1208742 - RNA, 22 nt, Mycobacterium bovis subsp bovis AF2122/97
gcgaaacaccggccagcggccc

SEQ ID NO: 1208743 - RNA, 12 nt, Mycobacterium bovis subsp bovis AF2122/97
gcgaaucacccg

SEQ ID NO: 1208744 - RNA, 23 nt, Mycobacterium bovis subsp bovis AF2122/97
gcgaauccagccgcgcgccggcc

SEQ ID NO: 1208745 - RNA, 19 nt, Mycobacterium bovis subsp bovis AF2122/97
gcgaaucaacaggaccggg

SEQ ID NO: 1208746 - RNA, 23 nt, Mycobacterium bovis subsp bovis AF2122/97
gcgaaucgcgucgagcgccggcc

SEQ ID NO: 1208747 - RNA, 22 nt, Mycobacterium bovis subsp bovis AF2122/97
gcgaaugaucuugccacuccag

SEQ ID NO: 1208748 - RNA, 17 nt, Mycobacterium bovis subsp bovis AF2122/97
gcgaaugcgggccuccu

SEQ ID NO: 1208749 - RNA, 20 nt, Mycobacterium bovis subsp bovis AF2122/97
gcgaccaccguuugagcggc

SEQ ID NO: 1208750 - RNA, 17 nt, Mycobacterium bovis subsp bovis AF2122/97
gcgaccaccgcggcugc

SEQ ID NO: 1208751 - RNA, 19 nt, Mycobacterium bovis subsp bovis AF2122/97
gcgaccaccgcggcugcuc

SEQ ID NO: 1208752 - RNA, 18 nt, Mycobacterium bovis subsp bovis AF2122/97
gcgaccaccgcgucgggc

SEQ ID NO: 1208753 - RNA, 19 nt, Mycobacterium bovis subsp bovis AF2122/97
gcgaccaccgcgucgggcc

SEQ ID NO: 1208754 - RNA, 12 nt, Mycobacterium bovis subsp bovis AF2122/97
gcgaccaccagc

SEQ ID NO: 1208755 - RNA, 22 nt, Mycobacterium bovis subsp bovis AF2122/97
gcgaccacaucaugccagccgu

SEQ ID NO: 1208756 - RNA, 21 nt, Mycobacterium bovis subsp bovis AF2122/97
gcgaccaacacgucgagcagc

SEQ ID NO: 1208757 - RNA, 22 nt, Mycobacterium bovis subsp bovis AF2122/97
gcgaccaacacgucgagcagcc

SEQ ID NO: 1208758 - RNA, 20 nt, Mycobacterium bovis subsp bovis AF2122/97
gcgaccaacacgguacugug

SEQ ID NO: 1208759 - RNA, 15 nt, Mycobacterium bovis subsp bovis AF2122/97
gcgaccagccgagcg

SEQ ID NO: 1208760 - RNA, 16 nt, Mycobacterium bovis subsp bovis AF2122/97
gcgaccaggucgccag

SEQ ID NO: 1208761 - RNA, 18 nt, Mycobacterium bovis subsp bovis AF2122/97
gcgaccaggucgccagcu

SEQ ID NO: 1208762 - RNA, 13 nt, Mycobacterium bovis subsp bovis AF2122/97
gcgaccaugcucc

SEQ ID NO: 1208763 - RNA, 15 nt, Mycobacterium bovis subsp bovis AF2122/97
gcgaccccaggcgcu

SEQ ID NO: 1208764 - RNA, 21 nt, Mycobacterium bovis subsp bovis AF2122/97
gcgaccccaggcgcucaucac

SEQ ID NO: 1208765 - RNA, 17 nt, Mycobacterium bovis subsp bovis AF2122/97
gcgacccggccagcggc

SEQ ID NO: 1208766 - RNA, 18 nt, Mycobacterium bovis subsp bovis AF2122/97
gcgacccggcccagcgcc

SEQ ID NO: 1208767 - RNA, 17 nt, Mycobacterium bovis subsp bovis AF2122/97
gcgacccgggccgcggc

SEQ ID NO: 1208768 - RNA, 17 nt, Mycobacterium bovis subsp bovis AF2122/97
gcgaccgucccggccuc

SEQ ID NO: 1208769 - RNA, 16 nt, Mycobacterium bovis subsp bovis AF2122/97
gcgaccgucccagcgc

SEQ ID NO: 1208770 - RNA, 15 nt, Mycobacterium bovis subsp bovis AF2122/97
gcgaccgucccggcc

SEQ ID NO: 1208771 - RNA, 14 nt, Mycobacterium bovis subsp bovis AF2122/97
gcgaccgucccagc

SEQ ID NO: 1208772 - RNA, 19 nt, Mycobacterium bovis subsp bovis AF2122/97
gcgaccggugccugcaacg

SEQ ID NO: 1208773 - RNA, 16 nt, Mycobacterium bovis subsp bovis AF2122/97
gcgaccucgccggacg

SEQ ID NO: 1208774 - RNA, 17 nt, Mycobacterium bovis subsp bovis AF2122/97
gcgaccucggcggcggc

SEQ ID NO: 1208775 - RNA, 20 nt, Mycobacterium bovis subsp bovis AF2122/97
gcgaccuccggaaucgcccg

SEQ ID NO: 1208776 - RNA, 15 nt, Mycobacterium bovis subsp bovis AF2122/97
gcgaccgccugcgcg

SEQ ID NO: 1208777 - RNA, 15 nt, Mycobacterium bovis subsp bovis AF2122/97
gcgaccgcagcuggg

SEQ ID NO: 1208778 - RNA, 20 nt, Mycobacterium bovis subsp bovis AF2122/97
gcgaccgccugcgcggcugc

SEQ ID NO: 1208779 - RNA, 18 nt, Mycobacterium bovis subsp bovis AF2122/97
gcgaccggcaacgcggcc

SEQ ID NO: 1208780 - RNA, 22 nt, Mycobacterium bovis subsp bovis AF2122/97
gcgaccggcaacgcggccuugc

SEQ ID NO: 1208781 - RNA, 13 nt, Mycobacterium bovis subsp bovis AF2122/97
gcgaccggccggc

SEQ ID NO: 1208782 - RNA, 13 nt, Mycobacterium bovis subsp bovis AF2122/97
gcgaccgcggccc

SEQ ID NO: 1208783 - RNA, 19 nt, Mycobacterium bovis subsp bovis AF2122/97
gcgacgacccgggucggca

SEQ ID NO: 1208784 - RNA, 19 nt, Mycobacterium bovis subsp bovis AF2122/97
gcgaccuggucgcuggugc

SEQ ID NO: 1208785 - RNA, 19 nt, Mycobacterium bovis subsp bovis AF2122/97
gcgaccuugacccgcaagu

SEQ ID NO: 1208786 - RNA, 15 nt, Mycobacterium bovis subsp bovis AF2122/97
gcgagcagcccggcg

SEQ ID NO: 1208787 - RNA, 22 nt, Mycobacterium bovis subsp bovis AF2122/97
gcgagcagacgcaaaagccacc

SEQ ID NO: 1208788 - RNA, 21 nt, Mycobacterium bovis subsp bovis AF2122/97
gcgagcacccgcuggucgagc

SEQ ID NO: 1208789 - RNA, 15 nt, Mycobacterium bovis subsp bovis AF2122/97
gcgagcaacacgagc

SEQ ID NO: 1208790 - RNA, 18 nt, Mycobacterium bovis subsp bovis AF2122/97
gcgagcaacucguccagc

SEQ ID NO: 1208791 - RNA, 17 nt, Mycobacterium bovis subsp bovis AF2122/97
gcgagcacccgcugguc

SEQ ID NO: 1208792 - RNA, 18 nt, Mycobacterium bovis subsp bovis AF2122/97
gcgagcaauuccucagcc

SEQ ID NO: 1208793 - RNA, 19 nt, Mycobacterium bovis subsp bovis AF2122/97
gcgacuuggcaucgcgagc

SEQ ID NO: 1208794 - RNA, 19 nt, Mycobacterium bovis subsp bovis AF2122/97
gcgacuggugccugccgca

SEQ ID NO: 1208795 - RNA, 17 nt, Mycobacterium bovis subsp bovis AF2122/97
gcgacugcagcggcgca

SEQ ID NO: 1208796 - RNA, 20 nt, Mycobacterium bovis subsp bovis AF2122/97
gcgacgucgcuagaucccag

SEQ ID NO: 1208797 - RNA, 16 nt, Mycobacterium bovis subsp bovis AF2122/97
gcgacgucggcgguga

SEQ ID NO: 1208798 - RNA, 17 nt, Mycobacterium bovis subsp bovis AF2122/97
gcgacgucaggguaucc

SEQ ID NO: 1208799 - RNA, 21 nt, Mycobacterium bovis subsp bovis AF2122/97
gcgacgucugccaggcgcagc

SEQ ID NO: 1208800 - RNA, 23 nt, Mycobacterium bovis subsp bovis AF2122/97
gcgacgauaucgggagcggcugc

SEQ ID NO: 1208801 - RNA, 13 nt, Mycobacterium bovis subsp bovis AF2122/97
gcgacgauccgca

SEQ ID NO: 1208802 - RNA, 17 nt, Mycobacterium bovis subsp bovis AF2122/97
gcgacgaucucggcggc

SEQ ID NO: 1208803 - RNA, 22 nt, Mycobacterium bovis subsp bovis AF2122/97
gcgacgaugaucucgcccaccu

SEQ ID NO: 1208804 - RNA, 22 nt, Mycobacterium bovis subsp bovis AF2122/97
gcgacgauaucgggagcggcug

SEQ ID NO: 1208805 - RNA, 12 nt, Mycobacterium bovis subsp bovis AF2122/97
gcgacgccgcgg

SEQ ID NO: 1208806 - RNA, 16 nt, Mycobacterium bovis subsp bovis AF2122/97
gcgacgaugcagguga

SEQ ID NO: 1208807 - RNA, 19 nt, Mycobacterium bovis subsp bovis AF2122/97
gcgacgaugucgagcgcga

SEQ ID NO: 1208808 - RNA, 16 nt, Mycobacterium bovis subsp bovis AF2122/97
gcgacgaugccgccug

SEQ ID NO: 1208809 - RNA, 18 nt, Mycobacterium bovis subsp bovis AF2122/97
gcgacgcucgcugcagca

SEQ ID NO: 1208810 - RNA, 17 nt, Mycobacterium bovis subsp bovis AF2122/97
gcgacgccggccuuggc

SEQ ID NO: 1208811 - RNA, 22 nt, Mycobacterium bovis subsp bovis AF2122/97
gcgacgcgacacacgccgccgg

SEQ ID NO: 1208812 - RNA, 15 nt, Mycobacterium bovis subsp bovis AF2122/97
gcgacgcgaccgcga

SEQ ID NO: 1208813 - RNA, 20 nt, Mycobacterium bovis subsp bovis AF2122/97
gcgacgggucgggcaaccug

SEQ ID NO: 1208814 - RNA, 22 nt, Mycobacterium bovis subsp bovis AF2122/97
gcgacggugccaccgcgacggc

SEQ ID NO: 1208815 - RNA, 19 nt, Mycobacterium bovis subsp bovis AF2122/97
gcgacggucgugaucggcg

SEQ ID NO: 1208816 - RNA, 19 nt, Mycobacterium bovis subsp bovis AF2122/97
gcgacgguucccagcuucc

SEQ ID NO: 1208817 - RNA, 22 nt, Mycobacterium bovis subsp bovis AF2122/97
gcgacguaguggaagccgacca

SEQ ID NO: 1208818 - RNA, 20 nt, Mycobacterium bovis subsp bovis AF2122/97
gcgaggcguaaucaagcagc

SEQ ID NO: 1208819 - RNA, 18 nt, Mycobacterium bovis subsp bovis AF2122/97
gcgagguaagcgagucga

SEQ ID NO: 1208820 - RNA, 14 nt, Mycobacterium bovis subsp bovis AF2122/97
gcgaggggccggcu

SEQ ID NO: 1208821 - RNA, 17 nt, Mycobacterium bovis subsp bovis AF2122/97
gcgaggcucgcguggcc

SEQ ID NO: 1208822 - RNA, 17 nt, Mycobacterium bovis subsp bovis AF2122/97
gcgagggcacggcggug

SEQ ID NO: 1208823 - RNA, 17 nt, Mycobacterium bovis subsp bovis AF2122/97
gcgagggcauccgagcg

SEQ ID NO: 1208824 - RNA, 20 nt, Mycobacterium bovis subsp bovis AF2122/97
gcgagggcuaccggcgccgc

SEQ ID NO: 1208825 - RNA, 12 nt, Mycobacterium bovis subsp bovis AF2122/97
gcgagcgcgccg

SEQ ID NO: 1208826 - RNA, 14 nt, Mycobacterium bovis subsp bovis AF2122/97
gcgagcgcgccggc

SEQ ID NO: 1208827 - RNA, 22 nt, Mycobacterium bovis subsp bovis AF2122/97
gcgagcgcggcggagccgggug

SEQ ID NO: 1208828 - RNA, 14 nt, Mycobacterium bovis subsp bovis AF2122/97
gcgagcgccuuucg

SEQ ID NO: 1208829 - RNA, 13 nt, Mycobacterium bovis subsp bovis AF2122/97
gcgagcgcagcgc

SEQ ID NO: 1208830 - RNA, 12 nt, Mycobacterium bovis subsp bovis AF2122/97
gcgagcgccggc

SEQ ID NO: 1208831 - RNA, 16 nt, Mycobacterium bovis subsp bovis AF2122/97
gcgagcggccuccagc

SEQ ID NO: 1208832 - RNA, 18 nt, Mycobacterium bovis subsp bovis AF2122/97
gcgagcggccuccagcac

SEQ ID NO: 1208833 - RNA, 22 nt, Mycobacterium bovis subsp bovis AF2122/97
gcgagcggaauggaggccgccg

SEQ ID NO: 1208834 - RNA, 16 nt, Mycobacterium bovis subsp bovis AF2122/97
gcgaggaugcugagcg

SEQ ID NO: 1208835 - RNA, 20 nt, Mycobacterium bovis subsp bovis AF2122/97
gcgagcguuucaccagucca

SEQ ID NO: 1208836 - RNA, 21 nt, Mycobacterium bovis subsp bovis AF2122/97
gcgaggauccauuggaaccug

SEQ ID NO: 1208837 - RNA, 16 nt, Mycobacterium bovis subsp bovis AF2122/97
gcgagucggcggggcg

SEQ ID NO: 1208838 - RNA, 13 nt, Mycobacterium bovis subsp bovis AF2122/97
gcgagucgggggc

SEQ ID NO: 1208839 - RNA, 22 nt, Mycobacterium bovis subsp bovis AF2122/97
gcgagucgggguacaggcugcu

SEQ ID NO: 1208840 - RNA, 23 nt, Mycobacterium bovis subsp bovis AF2122/97
gcgagucgggguacaggcugcug

SEQ ID NO: 1208841 - RNA, 20 nt, Mycobacterium bovis subsp bovis AF2122/97
gcgaguacggccugccgcuc

SEQ ID NO: 1208842 - RNA, 15 nt, Mycobacterium bovis subsp bovis AF2122/97
gcgagguccagcaug

SEQ ID NO: 1208843 - RNA, 13 nt, Mycobacterium bovis subsp bovis AF2122/97
gcgaggugccggg

SEQ ID NO: 1208844 - RNA, 19 nt, Mycobacterium bovis subsp bovis AF2122/97
gcgaguaacccguccggug

SEQ ID NO: 1208845 - RNA, 20 nt, Mycobacterium bovis subsp bovis AF2122/97
gcgagguuggcguugguggu

SEQ ID NO: 1208846 - RNA, 19 nt, Mycobacterium bovis subsp bovis AF2122/97
gcgagguucagccugagca

SEQ ID NO: 1208847 - RNA, 21 nt, Mycobacterium bovis subsp bovis AF2122/97
gcgagguugaccaccagcgug

SEQ ID NO: 1208848 - RNA, 16 nt, Mycobacterium bovis subsp bovis AF2122/97
gcgauacacggcggcg

SEQ ID NO: 1208849 - RNA, 21 nt, Mycobacterium bovis subsp bovis AF2122/97
gcgaucagcagccgccgauga

SEQ ID NO: 1208850 - RNA, 15 nt, Mycobacterium bovis subsp bovis AF2122/97
gcgagugucagcaga

SEQ ID NO: 1208851 - RNA, 16 nt, Mycobacterium bovis subsp bovis AF2122/97
gcgagugaacucgucc

SEQ ID NO: 1208852 - RNA, 21 nt, Mycobacterium bovis subsp bovis AF2122/97
gccugagcacguucaccgcgc

SEQ ID NO: 1208853 - RNA, 13 nt, Mycobacterium bovis subsp bovis AF2122/97
gccugagccacca

SEQ ID NO: 1208854 - RNA, 23 nt, Mycobacterium bovis subsp bovis AF2122/97
gccugagcggggauguccgcggc

SEQ ID NO: 1208855 - RNA, 14 nt, Mycobacterium bovis subsp bovis AF2122/97
gccugagcggccuc

SEQ ID NO: 1208856 - RNA, 16 nt, Mycobacterium bovis subsp bovis AF2122/97
gccugagcgccgcggc

SEQ ID NO: 1208857 - RNA, 18 nt, Mycobacterium bovis subsp bovis AF2122/97
gccugagcgccgcggcgg

SEQ ID NO: 1208858 - RNA, 17 nt, Mycobacterium bovis subsp bovis AF2122/97
gccugauaaagcccggc

SEQ ID NO: 1208859 - RNA, 21 nt, Mycobacterium bovis subsp bovis AF2122/97
gccugauaaagcccggcggca

SEQ ID NO: 1208860 - RNA, 19 nt, Mycobacterium bovis subsp bovis AF2122/97
gccugauaaagcccggcgg

SEQ ID NO: 1208861 - RNA, 16 nt, Mycobacterium bovis subsp bovis AF2122/97
gccuaugcugcccggc

SEQ ID NO: 1208862 - RNA, 13 nt, Mycobacterium bovis subsp bovis AF2122/97
gccucaacacccg

SEQ ID NO: 1208863 - RNA, 19 nt, Mycobacterium bovis subsp bovis AF2122/97
gccugaagcuuguccagau

SEQ ID NO: 1208864 - RNA, 18 nt, Mycobacterium bovis subsp bovis AF2122/97
gccugaccgaagucugca

SEQ ID NO: 1208865 - RNA, 23 nt, Mycobacterium bovis subsp bovis AF2122/97
gccugaccgaagucugcagacgg

SEQ ID NO: 1208866 - RNA, 16 nt, Mycobacterium bovis subsp bovis AF2122/97
gccugaaacgauugcu

SEQ ID NO: 1208867 - RNA, 21 nt, Mycobacterium bovis subsp bovis AF2122/97
gccugaaacggcugcagaggc

SEQ ID NO: 1208868 - RNA, 19 nt, Mycobacterium bovis subsp bovis AF2122/97
gccugcgccggcgcugcca

SEQ ID NO: 1208869 - RNA, 15 nt, Mycobacterium bovis subsp bovis AF2122/97
gccugcgccgcccgc

SEQ ID NO: 1208870 - RNA, 22 nt, Mycobacterium bovis subsp bovis AF2122/97
gccugcgccuugaagcggugga

SEQ ID NO: 1208871 - RNA, 21 nt, Mycobacterium bovis subsp bovis AF2122/97
gccugcgccuuggucgccggc

SEQ ID NO: 1208872 - RNA, 22 nt, Mycobacterium bovis subsp bovis AF2122/97
gccugcgccuuggucgccggcg

SEQ ID NO: 1208873 - RNA, 19 nt, Mycobacterium bovis subsp bovis AF2122/97
gccugcgcgaccgaccagc

SEQ ID NO: 1208874 - RNA, 16 nt, Mycobacterium bovis subsp bovis AF2122/97
gccugcggucagggcu

SEQ ID NO: 1208875 - RNA, 17 nt, Mycobacterium bovis subsp bovis AF2122/97
gccugcgucucgaugag

SEQ ID NO: 1208876 - RNA, 17 nt, Mycobacterium bovis subsp bovis AF2122/97
gccugcucaaccagcag

SEQ ID NO: 1208877 - RNA, 21 nt, Mycobacterium bovis subsp bovis AF2122/97
gccugcccggcccgcucagcc

SEQ ID NO: 1208878 - RNA, 20 nt, Mycobacterium bovis subsp bovis AF2122/97
gccugcccccggcgcggcgg

SEQ ID NO: 1208879 - RNA, 12 nt, Mycobacterium bovis subsp bovis AF2122/97
gccugccccaga

SEQ ID NO: 1208880 - RNA, 13 nt, Mycobacterium bovis subsp bovis AF2122/97
gccugccccagau

SEQ ID NO: 1208881 - RNA, 22 nt, Mycobacterium bovis subsp bovis AF2122/97
gccugccccacccgcggcgccg

SEQ ID NO: 1208882 - RNA, 12 nt, Mycobacterium bovis subsp bovis AF2122/97
gccugcccagca

SEQ ID NO: 1208883 - RNA, 14 nt, Mycobacterium bovis subsp bovis AF2122/97
gccugcccagcacc

SEQ ID NO: 1208884 - RNA, 13 nt, Mycobacterium bovis subsp bovis AF2122/97
gccugcgacagca

SEQ ID NO: 1208885 - RNA, 13 nt, Mycobacterium bovis subsp bovis AF2122/97
gccugcgccgagu

SEQ ID NO: 1208886 - RNA, 18 nt, Mycobacterium bovis subsp bovis AF2122/97
gccugcgccgccagcgcc

SEQ ID NO: 1208887 - RNA, 15 nt, Mycobacterium bovis subsp bovis AF2122/97
gccugcagcgcgacc

SEQ ID NO: 1208888 - RNA, 20 nt, Mycobacterium bovis subsp bovis AF2122/97
gccugcaagcuaagcgccug

SEQ ID NO: 1208889 - RNA, 16 nt, Mycobacterium bovis subsp bovis AF2122/97
gccugcaccagcgagu

SEQ ID NO: 1208890 - RNA, 14 nt, Mycobacterium bovis subsp bovis AF2122/97
gccugcacggcgcu

SEQ ID NO: 1208891 - RNA, 15 nt, Mycobacterium bovis subsp bovis AF2122/97
gccugcaggccgccg

SEQ ID NO: 1208892 - RNA, 17 nt, Mycobacterium bovis subsp bovis AF2122/97
gccugcaggccgccggc

SEQ ID NO: 1208893 - RNA, 20 nt, Mycobacterium bovis subsp bovis AF2122/97
gccugcaguucggcguacgg

SEQ ID NO: 1208894 - RNA, 14 nt, Mycobacterium bovis subsp bovis AF2122/97
gccugcccaccuuc

SEQ ID NO: 1208895 - RNA, 11 nt, Mycobacterium bovis subsp bovis AF2122/97
gccugccaccc

SEQ ID NO: 1208896 - RNA, 14 nt, Mycobacterium bovis subsp bovis AF2122/97
gccugccacccggc

SEQ ID NO: 1208897 - RNA, 16 nt, Mycobacterium bovis subsp bovis AF2122/97
gccugccacccggcca

SEQ ID NO: 1208898 - RNA, 22 nt, Mycobacterium bovis subsp bovis AF2122/97
gccuggaaucgcggagccagga

SEQ ID NO: 1208899 - RNA, 19 nt, Mycobacterium bovis subsp bovis AF2122/97
gccuggaagacggugcggg

SEQ ID NO: 1208900 - RNA, 14 nt, Mycobacterium bovis subsp bovis AF2122/97
gccuggcacccggg

SEQ ID NO: 1208901 - RNA, 15 nt, Mycobacterium bovis subsp bovis AF2122/97
gccuggccacacuca

SEQ ID NO: 1208902 - RNA, 16 nt, Mycobacterium bovis subsp bovis AF2122/97
gccuggacgccgccgg

SEQ ID NO: 1208903 - RNA, 23 nt, Mycobacterium bovis subsp bovis AF2122/97
gccuggugcucaacggcgacauc

SEQ ID NO: 1208904 - RNA, 16 nt, Mycobacterium bovis subsp bovis AF2122/97
gccuguacggcggcua

SEQ ID NO: 1208905 - RNA, 23 nt, Mycobacterium bovis subsp bovis AF2122/97
gccugugcgcggugacgagccac

SEQ ID NO: 1208906 - RNA, 14 nt, Mycobacterium bovis subsp bovis AF2122/97
gccugugccgccgg

SEQ ID NO: 1208907 - RNA, 20 nt, Mycobacterium bovis subsp bovis AF2122/97
gccuuaggugaccaggguga

SEQ ID NO: 1208908 - RNA, 21 nt, Mycobacterium bovis subsp bovis AF2122/97
gccuuacacgccuggcuacgc

SEQ ID NO: 1208909 - RNA, 16 nt, Mycobacterium bovis subsp bovis AF2122/97
gccuuccuggcgggcg

SEQ ID NO: 1208910 - RNA, 15 nt, Mycobacterium bovis subsp bovis AF2122/97
gccuucccagccgac

SEQ ID NO: 1208911 - RNA, 16 nt, Mycobacterium bovis subsp bovis AF2122/97
gccuucuuggcgggag

SEQ ID NO: 1208912 - RNA, 21 nt, Mycobacterium bovis subsp bovis AF2122/97
gccuucuuggcaggugccuuc

SEQ ID NO: 1208913 - RNA, 21 nt, Mycobacterium bovis subsp bovis AF2122/97
gccuucuucgcuaccuucuug

SEQ ID NO: 1208914 - RNA, 17 nt, Mycobacterium bovis subsp bovis AF2122/97
gccuugccgccggcccc

SEQ ID NO: 1208915 - RNA, 22 nt, Mycobacterium bovis subsp bovis AF2122/97
gccuugccgccggccccgccag

SEQ ID NO: 1208916 - RNA, 17 nt, Mycobacterium bovis subsp bovis AF2122/97
gccuugcgucaucggcu

SEQ ID NO: 1208917 - RNA, 15 nt, Mycobacterium bovis subsp bovis AF2122/97
gccuugcgcacaggc

SEQ ID NO: 1208918 - RNA, 15 nt, Mycobacterium bovis subsp bovis AF2122/97
gccuugcgcgcgcag

SEQ ID NO: 1208919 - RNA, 12 nt, Mycobacterium bovis subsp bovis AF2122/97
gccuugucuagu

SEQ ID NO: 1208920 - RNA, 13 nt, Mycobacterium bovis subsp bovis AF2122/97
gccuugugcucga

SEQ ID NO: 1208921 - RNA, 24 nt, Mycobacterium bovis subsp bovis AF2122/97
gccuugucggcgugucgcgucgca

SEQ ID NO: 1208922 - RNA, 16 nt, Mycobacterium bovis subsp bovis AF2122/97
gccuuguugccgccgg

SEQ ID NO: 1208923 - RNA, 19 nt, Mycobacterium bovis subsp bovis AF2122/97
gccuuguuggcgaagucgu

SEQ ID NO: 1208924 - RNA, 18 nt, Mycobacterium bovis subsp bovis AF2122/97
gccuuguuguccuucagc

SEQ ID NO: 1208925 - RNA, 23 nt, Mycobacterium bovis subsp bovis AF2122/97
gccuuguggaaccaucccugaaa

SEQ ID NO: 1208926 - RNA, 12 nt, Mycobacterium bovis subsp bovis AF2122/97
gcgcgcucgccc

SEQ ID NO: 1208927 - RNA, 22 nt, Mycobacterium bovis subsp bovis AF2122/97
gcgcgcucaucgaccgcggccg

SEQ ID NO: 1208928 - RNA, 20 nt, Mycobacterium bovis subsp bovis AF2122/97
gcgcgcuaccagcucacggc

SEQ ID NO: 1208929 - RNA, 19 nt, Mycobacterium bovis subsp bovis AF2122/97
gcgcggagagccugcucgc

SEQ ID NO: 1208930 - RNA, 17 nt, Mycobacterium bovis subsp bovis AF2122/97
gcgcggacccagcaccc

SEQ ID NO: 1208931 - RNA, 15 nt, Mycobacterium bovis subsp bovis AF2122/97
gcgcggacccgccgu

SEQ ID NO: 1208932 - RNA, 14 nt, Mycobacterium bovis subsp bovis AF2122/97
gcgcggacccagca

SEQ ID NO: 1208933 - RNA, 17 nt, Mycobacterium bovis subsp bovis AF2122/97
gcgcggaucggcggccg

SEQ ID NO: 1208934 - RNA, 13 nt, Mycobacterium bovis subsp bovis AF2122/97
gcgcggcccgccg

SEQ ID NO: 1208935 - RNA, 13 nt, Mycobacterium bovis subsp bovis AF2122/97
gcgcggccagccc

SEQ ID NO: 1208936 - RNA, 12 nt, Mycobacterium bovis subsp bovis AF2122/97
gcgcggcccgcc

SEQ ID NO: 1208937 - RNA, 18 nt, Mycobacterium bovis subsp bovis AF2122/97
gcgcggaucggcggccgc

SEQ ID NO: 1208938 - RNA, 22 nt, Mycobacterium bovis subsp bovis AF2122/97
gcgcggauucgguuagcgcggc

SEQ ID NO: 1208939 - RNA, 15 nt, Mycobacterium bovis subsp bovis AF2122/97
gcgcgcccgcggccg

SEQ ID NO: 1208940 - RNA, 21 nt, Mycobacterium bovis subsp bovis AF2122/97
gcgcgccguagaccagcaggc

SEQ ID NO: 1208941 - RNA, 20 nt, Mycobacterium bovis subsp bovis AF2122/97
gcgcgcccaccgggcggcgg

SEQ ID NO: 1208942 - RNA, 12 nt, Mycobacterium bovis subsp bovis AF2122/97
gcgcgcccgcgg

SEQ ID NO: 1208943 - RNA, 13 nt, Mycobacterium bovis subsp bovis AF2122/97
gcgcgcccgggcg

SEQ ID NO: 1208944 - RNA, 21 nt, Mycobacterium bovis subsp bovis AF2122/97
gcgcgcggccgcgcugcagca

SEQ ID NO: 1208945 - RNA, 13 nt, Mycobacterium bovis subsp bovis AF2122/97
gcgcgcggccgcg

SEQ ID NO: 1208946 - RNA, 17 nt, Mycobacterium bovis subsp bovis AF2122/97
gcgcgcgggguggcggc

SEQ ID NO: 1208947 - RNA, 19 nt, Mycobacterium bovis subsp bovis AF2122/97
gcgcgcggcgaccauaagc

SEQ ID NO: 1208948 - RNA, 23 nt, Mycobacterium bovis subsp bovis AF2122/97
gcgcgcggucgagguggcgggcg

SEQ ID NO: 1208949 - RNA, 22 nt, Mycobacterium bovis subsp bovis AF2122/97
gcgcgccggucgccgacggcga

SEQ ID NO: 1208950 - RNA, 18 nt, Mycobacterium bovis subsp bovis AF2122/97
gcgcgccuaugggccugc

SEQ ID NO: 1208951 - RNA, 12 nt, Mycobacterium bovis subsp bovis AF2122/97
gcgcgccguuca

SEQ ID NO: 1208952 - RNA, 17 nt, Mycobacterium bovis subsp bovis AF2122/97
gcgcgccuucacgcugg

SEQ ID NO: 1208953 - RNA, 19 nt, Mycobacterium bovis subsp bovis AF2122/97
gcgcgccuucacgcuggcc

SEQ ID NO: 1208954 - RNA, 13 nt, Mycobacterium bovis subsp bovis AF2122/97
gcgaucagcuggg

SEQ ID NO: 1208955 - RNA, 15 nt, Mycobacterium bovis subsp bovis AF2122/97
gcgaucagcgcgcac

SEQ ID NO: 1208956 - RNA, 14 nt, Mycobacterium bovis subsp bovis AF2122/97
gcgaucaggcgcuc

SEQ ID NO: 1208957 - RNA, 22 nt, Mycobacterium bovis subsp bovis AF2122/97
gcgaucaggcugccgcugcgcc

SEQ ID NO: 1208958 - RNA, 22 nt, Mycobacterium bovis subsp bovis AF2122/97
gcgaucaucaggugcgccuggc

SEQ ID NO: 1208959 - RNA, 20 nt, Mycobacterium bovis subsp bovis AF2122/97
gcgauccggucggccaggcc

SEQ ID NO: 1208960 - RNA, 15 nt, Mycobacterium bovis subsp bovis AF2122/97
gcgauccccagcacc

SEQ ID NO: 1208961 - RNA, 20 nt, Mycobacterium bovis subsp bovis AF2122/97
gcgaucccgaucgcgcuggg

SEQ ID NO: 1208962 - RNA, 17 nt, Mycobacterium bovis subsp bovis AF2122/97
gcgaucccgccggggcc

SEQ ID NO: 1208963 - RNA, 20 nt, Mycobacterium bovis subsp bovis AF2122/97
gcgauccgagaccgcgugcu

SEQ ID NO: 1208964 - RNA, 14 nt, Mycobacterium bovis subsp bovis AF2122/97
gcgauccagggccg

SEQ ID NO: 1208965 - RNA, 19 nt, Mycobacterium bovis subsp bovis AF2122/97
gcgauccaccaagcucgca

SEQ ID NO: 1208966 - RNA, 16 nt, Mycobacterium bovis subsp bovis AF2122/97
gcgaucgcaacaccgg

SEQ ID NO: 1208967 - RNA, 22 nt, Mycobacterium bovis subsp bovis AF2122/97
gcgaucgcagugagcagccgga

SEQ ID NO: 1208968 - RNA, 14 nt, Mycobacterium bovis subsp bovis AF2122/97
gcgaucgccggccg

SEQ ID NO: 1208969 - RNA, 14 nt, Mycobacterium bovis subsp bovis AF2122/97
gcgaucgcgagcga

SEQ ID NO: 1208970 - RNA, 16 nt, Mycobacterium bovis subsp bovis AF2122/97
gcgaucgacgauccac

SEQ ID NO: 1208971 - RNA, 20 nt, Mycobacterium bovis subsp bovis AF2122/97
gcgaucccaacgcccgggcg

SEQ ID NO: 1208972 - RNA, 23 nt, Mycobacterium bovis subsp bovis AF2122/97
gcgauccggcugcgggaagacgu

SEQ ID NO: 1208973 - RNA, 15 nt, Mycobacterium bovis subsp bovis AF2122/97
gcgauccggucgggg

SEQ ID NO: 1208974 - RNA, 24 nt, Mycobacterium bovis subsp bovis AF2122/97
gcgcgaagucuugaccgcaccggc

SEQ ID NO: 1208975 - RNA, 14 nt, Mycobacterium bovis subsp bovis AF2122/97
gcgcgaaggggacg

SEQ ID NO: 1208976 - RNA, 21 nt, Mycobacterium bovis subsp bovis AF2122/97
gcgcgaaccugcucggcgcgc

SEQ ID NO: 1208977 - RNA, 15 nt, Mycobacterium bovis subsp bovis AF2122/97
gcgcgaacgccugcu

SEQ ID NO: 1208978 - RNA, 16 nt, Mycobacterium bovis subsp bovis AF2122/97
gcgcgaacgucaaccg

SEQ ID NO: 1208979 - RNA, 20 nt, Mycobacterium bovis subsp bovis AF2122/97
gcgcgaacgucaaccgggcg

SEQ ID NO: 1208980 - RNA, 22 nt, Mycobacterium bovis subsp bovis AF2122/97
gcgcgaacgucaaccgggcggc

SEQ ID NO: 1208981 - RNA, 23 nt, Mycobacterium bovis subsp bovis AF2122/97
gcgcgaacgucaaccgggcggcg

SEQ ID NO: 1208982 - RNA, 22 nt, Mycobacterium bovis subsp bovis AF2122/97
gcgcgaauuccucuguacccca

SEQ ID NO: 1208983 - RNA, 15 nt, Mycobacterium bovis subsp bovis AF2122/97
gcgcgagccgcucca

SEQ ID NO: 1208984 - RNA, 17 nt, Mycobacterium bovis subsp bovis AF2122/97
gcgcgagaucagccggc

SEQ ID NO: 1208985 - RNA, 22 nt, Mycobacterium bovis subsp bovis AF2122/97
gcgcgaggcucguggcgacggc

SEQ ID NO: 1208986 - RNA, 14 nt, Mycobacterium bovis subsp bovis AF2122/97
gcgcgaggggccgg

SEQ ID NO: 1208987 - RNA, 22 nt, Mycobacterium bovis subsp bovis AF2122/97
gcgcgaucaccgagucgacggc

SEQ ID NO: 1208988 - RNA, 21 nt, Mycobacterium bovis subsp bovis AF2122/97
gcgcgauagauacccgcggca

SEQ ID NO: 1208989 - RNA, 14 nt, Mycobacterium bovis subsp bovis AF2122/97
gcgcgaucgcgccc

SEQ ID NO: 1208990 - RNA, 13 nt, Mycobacterium bovis subsp bovis AF2122/97
gcgcgcacacggc

SEQ ID NO: 1208991 - RNA, 22 nt, Mycobacterium bovis subsp bovis AF2122/97
gcgcgcaccggguugagccgcc

SEQ ID NO: 1208992 - RNA, 15 nt, Mycobacterium bovis subsp bovis AF2122/97
gcgcgcacggcgucg

SEQ ID NO: 1208993 - RNA, 17 nt, Mycobacterium bovis subsp bovis AF2122/97
gcgcgcacggcgucggc

SEQ ID NO: 1208994 - RNA, 19 nt, Mycobacterium bovis subsp bovis AF2122/97
gcgcgaucgacgcucggcu

SEQ ID NO: 1208995 - RNA, 19 nt, Mycobacterium bovis subsp bovis AF2122/97
gcgcgcagaugagcgcggc

SEQ ID NO: 1208996 - RNA, 20 nt, Mycobacterium bovis subsp bovis AF2122/97
gcgcggucggagucgagcac

SEQ ID NO: 1208997 - RNA, 22 nt, Mycobacterium bovis subsp bovis AF2122/97
gcgcgguccuuguuagccucca

SEQ ID NO: 1208998 - RNA, 17 nt, Mycobacterium bovis subsp bovis AF2122/97
gcgcgguacugcgcagc

SEQ ID NO: 1208999 - RNA, 18 nt, Mycobacterium bovis subsp bovis AF2122/97
gcgcggguggcagcggcg

SEQ ID NO: 1209000 - RNA, 15 nt, Mycobacterium bovis subsp bovis AF2122/97
gcgcggugccggccg

SEQ ID NO: 1209001 - RNA, 14 nt, Mycobacterium bovis subsp bovis AF2122/97
gcgcggugcccugc

SEQ ID NO: 1209002 - RNA, 15 nt, Mycobacterium bovis subsp bovis AF2122/97
gcgcggugcgcguga

SEQ ID NO: 1209003 - RNA, 16 nt, Mycobacterium bovis subsp bovis AF2122/97
gcgcgguggucagcac

SEQ ID NO: 1209004 - RNA, 18 nt, Mycobacterium bovis subsp bovis AF2122/97
gcgcgguuucggcgauga

SEQ ID NO: 1209005 - RNA, 21 nt, Mycobacterium bovis subsp bovis AF2122/97
gcgcguaauccgagcgcggcg

SEQ ID NO: 1209006 - RNA, 14 nt, Mycobacterium bovis subsp bovis AF2122/97
gcgcguagcgggcg

SEQ ID NO: 1209007 - RNA, 21 nt, Mycobacterium bovis subsp bovis AF2122/97
gcgcguaggcccaacgacggc

SEQ ID NO: 1209008 - RNA, 14 nt, Mycobacterium bovis subsp bovis AF2122/97
gcgcguccccagcg

SEQ ID NO: 1209009 - RNA, 15 nt, Mycobacterium bovis subsp bovis AF2122/97
gcgcguccgucggcg

SEQ ID NO: 1209010 - RNA, 21 nt, Mycobacterium bovis subsp bovis AF2122/97
gcgcgucacauccgacagcag

SEQ ID NO: 1209011 - RNA, 19 nt, Mycobacterium bovis subsp bovis AF2122/97
gcgcgucagccgcaccccg

SEQ ID NO: 1209012 - RNA, 14 nt, Mycobacterium bovis subsp bovis AF2122/97
gcgcguccaaccaa

SEQ ID NO: 1209013 - RNA, 15 nt, Mycobacterium bovis subsp bovis AF2122/97
gcgcggcuggggccc

SEQ ID NO: 1209014 - RNA, 22 nt, Mycobacterium bovis subsp bovis AF2122/97
gcgcggcuggggccccgcgccg

SEQ ID NO: 1209015 - RNA, 12 nt, Mycobacterium bovis subsp bovis AF2122/97
gcgcgggccugg

SEQ ID NO: 1209016 - RNA, 13 nt, Mycobacterium bovis subsp bovis AF2122/97
gcgcgggccuggc

SEQ ID NO: 1209017 - RNA, 16 nt, Mycobacterium bovis subsp bovis AF2122/97
gcgcgggccuggccca

SEQ ID NO: 1209018 - RNA, 12 nt, Mycobacterium bovis subsp bovis AF2122/97
gcgcggcugccg

SEQ ID NO: 1209019 - RNA, 17 nt, Mycobacterium bovis subsp bovis AF2122/97
gcgcggcggagugcaug

SEQ ID NO: 1209020 - RNA, 13 nt, Mycobacterium bovis subsp bovis AF2122/97
gcgcggccgggcg

SEQ ID NO: 1209021 - RNA, 13 nt, Mycobacterium bovis subsp bovis AF2122/97
gcgcggggcggcc

SEQ ID NO: 1209022 - RNA, 20 nt, Mycobacterium bovis subsp bovis AF2122/97
gcgcggggccgccgcggccg

SEQ ID NO: 1209023 - RNA, 18 nt, Mycobacterium bovis subsp bovis AF2122/97
gcgcgggguggcggcgcu

SEQ ID NO: 1209024 - RNA, 19 nt, Mycobacterium bovis subsp bovis AF2122/97
gcgcgggguggcggcgcug

SEQ ID NO: 1209025 - RNA, 15 nt, Mycobacterium bovis subsp bovis AF2122/97
gcgcggggugcgcgc

SEQ ID NO: 1209026 - RNA, 19 nt, Mycobacterium bovis subsp bovis AF2122/97
gcgcggggugcgcgcgacc

SEQ ID NO: 1209027 - RNA, 17 nt, Mycobacterium bovis subsp bovis AF2122/97
gcgcggggcggccugcc

SEQ ID NO: 1209028 - RNA, 16 nt, Mycobacterium bovis subsp bovis AF2122/97
gcgcggguccagccac

SEQ ID NO: 1209029 - RNA, 22 nt, Mycobacterium bovis subsp bovis AF2122/97
gcgcgggauguaccccggcccg

SEQ ID NO: 1209030 - RNA, 17 nt, Mycobacterium bovis subsp bovis AF2122/97
gcgcgggcucgguggcg

SEQ ID NO: 1209031 - RNA, 23 nt, Mycobacterium bovis subsp bovis AF2122/97
gcgcgggcucgguggcggacggc

SEQ ID NO: 1209032 - RNA, 17 nt, Mycobacterium bovis subsp bovis AF2122/97
gcgcuagccgggcgcgc

SEQ ID NO: 1209033 - RNA, 21 nt, Mycobacterium bovis subsp bovis AF2122/97
gcgcuagccgggcgcgccggc

SEQ ID NO: 1209034 - RNA, 18 nt, Mycobacterium bovis subsp bovis AF2122/97
gcgcuagccgggcgcgcc

SEQ ID NO: 1209035 - RNA, 17 nt, Mycobacterium bovis subsp bovis AF2122/97
gcgcuagcgccgcgcuu

SEQ ID NO: 1209036 - RNA, 20 nt, Mycobacterium bovis subsp bovis AF2122/97
gcgcucaaugaucgcggcgg

SEQ ID NO: 1209037 - RNA, 21 nt, Mycobacterium bovis subsp bovis AF2122/97
gcgcucaaugaucgcggcggc

SEQ ID NO: 1209038 - RNA, 13 nt, Mycobacterium bovis subsp bovis AF2122/97
gcgcucagccggg

SEQ ID NO: 1209039 - RNA, 17 nt, Mycobacterium bovis subsp bovis AF2122/97
gcgcucaucgaccgggg

SEQ ID NO: 1209040 - RNA, 22 nt, Mycobacterium bovis subsp bovis AF2122/97
gcgcucaggucaucggcggcgg

SEQ ID NO: 1209041 - RNA, 18 nt, Mycobacterium bovis subsp bovis AF2122/97
gcgcucaucacccagcgc

SEQ ID NO: 1209042 - RNA, 20 nt, Mycobacterium bovis subsp bovis AF2122/97
gcgcucaggucaucggcggc

SEQ ID NO: 1209043 - RNA, 15 nt, Mycobacterium bovis subsp bovis AF2122/97
gcgcuccagccgcgc

SEQ ID NO: 1209044 - RNA, 22 nt, Mycobacterium bovis subsp bovis AF2122/97
gcgcuccagcugagcggccggc

SEQ ID NO: 1209045 - RNA, 19 nt, Mycobacterium bovis subsp bovis AF2122/97
gcgcgucgcgcgcggcaug

SEQ ID NO: 1209046 - RNA, 14 nt, Mycobacterium bovis subsp bovis AF2122/97
gcgcgucgagcagc

SEQ ID NO: 1209047 - RNA, 12 nt, Mycobacterium bovis subsp bovis AF2122/97
gcgcgucggcac

SEQ ID NO: 1209048 - RNA, 22 nt, Mycobacterium bovis subsp bovis AF2122/97
gcgcgucgcgggauugcgcgcu

SEQ ID NO: 1209049 - RNA, 15 nt, Mycobacterium bovis subsp bovis AF2122/97
gcgcgucggucaccg

SEQ ID NO: 1209050 - RNA, 16 nt, Mycobacterium bovis subsp bovis AF2122/97
gcgcguggaaaccggu

SEQ ID NO: 1209051 - RNA, 14 nt, Mycobacterium bovis subsp bovis AF2122/97
gcgcgugcucgacg

SEQ ID NO: 1209052 - RNA, 18 nt, Mycobacterium bovis subsp bovis AF2122/97
gcgcgugggcgugcaggc

SEQ ID NO: 1209053 - RNA, 16 nt, Mycobacterium bovis subsp bovis AF2122/97
gcgcgugacagugacc

SEQ ID NO: 1209054 - RNA, 14 nt, Mycobacterium bovis subsp bovis AF2122/97
gcgcuacccagcgc

SEQ ID NO: 1209055 - RNA, 13 nt, Mycobacterium bovis subsp bovis AF2122/97
gcgcguugcuggu

SEQ ID NO: 1209056 - RNA, 17 nt, Mycobacterium bovis subsp bovis AF2122/97
gcgcguugaagucgccg

SEQ ID NO: 1209057 - RNA, 18 nt, Mycobacterium bovis subsp bovis AF2122/97
gcggccaucccgcguucg

SEQ ID NO: 1209058 - RNA, 16 nt, Mycobacterium bovis subsp bovis AF2122/97
gcggccauccggcggc

SEQ ID NO: 1209059 - RNA, 17 nt, Mycobacterium bovis subsp bovis AF2122/97
gcggccauccggcggcg

SEQ ID NO: 1209060 - RNA, 15 nt, Mycobacterium bovis subsp bovis AF2122/97
gcggccaggucgguc

SEQ ID NO: 1209061 - RNA, 17 nt, Mycobacterium bovis subsp bovis AF2122/97
gcggccauaucgcccac

SEQ ID NO: 1209062 - RNA, 18 nt, Mycobacterium bovis subsp bovis AF2122/97
gcggccauaucgcccacc

SEQ ID NO: 1209063 - RNA, 13 nt, Mycobacterium bovis subsp bovis AF2122/97
gcggccauggcac

SEQ ID NO: 1209064 - RNA, 18 nt, Mycobacterium bovis subsp bovis AF2122/97
gcggccauggcagcgcgc

SEQ ID NO: 1209065 - RNA, 14 nt, Mycobacterium bovis subsp bovis AF2122/97
gcggccgcgcgcuc

SEQ ID NO: 1209066 - RNA, 15 nt, Mycobacterium bovis subsp bovis AF2122/97
gcggccgcggaugcu

SEQ ID NO: 1209067 - RNA, 15 nt, Mycobacterium bovis subsp bovis AF2122/97
gcggccgcgcugcag

SEQ ID NO: 1209068 - RNA, 23 nt, Mycobacterium bovis subsp bovis AF2122/97
gcggccgccuacccguucuucgc

SEQ ID NO: 1209069 - RNA, 18 nt, Mycobacterium bovis subsp bovis AF2122/97
gcggccgcggugacggcg

SEQ ID NO: 1209070 - RNA, 15 nt, Mycobacterium bovis subsp bovis AF2122/97
gcggccgcuccaccu

SEQ ID NO: 1209071 - RNA, 15 nt, Mycobacterium bovis subsp bovis AF2122/97
gcggccggcaugcug

SEQ ID NO: 1209072 - RNA, 18 nt, Mycobacterium bovis subsp bovis AF2122/97
gcggccggcacgaccgcu

SEQ ID NO: 1209073 - RNA, 16 nt, Mycobacterium bovis subsp bovis AF2122/97
gcggccggcacgggcg

SEQ ID NO: 1209074 - RNA, 14 nt, Mycobacterium bovis subsp bovis AF2122/97
gcggccggccgccc

SEQ ID NO: 1209075 - RNA, 14 nt, Mycobacterium bovis subsp bovis AF2122/97
gcggccgggcgccc

SEQ ID NO: 1209076 - RNA, 15 nt, Mycobacterium bovis subsp bovis AF2122/97
gcggccggcgucggc

SEQ ID NO: 1209077 - RNA, 18 nt, Mycobacterium bovis subsp bovis AF2122/97
gcggccgggcuccccaag

SEQ ID NO: 1209078 - RNA, 19 nt, Mycobacterium bovis subsp bovis AF2122/97
gcggcauagcucagaccgg

SEQ ID NO: 1209079 - RNA, 18 nt, Mycobacterium bovis subsp bovis AF2122/97
gcggcaguuguggcgcug

SEQ ID NO: 1209080 - RNA, 22 nt, Mycobacterium bovis subsp bovis AF2122/97
gcggcagucauuauucgcgcaa

SEQ ID NO: 1209081 - RNA, 23 nt, Mycobacterium bovis subsp bovis AF2122/97
gcggcagguugcguugcaggaaa

SEQ ID NO: 1209082 - RNA, 21 nt, Mycobacterium bovis subsp bovis AF2122/97
gcggcaggucgaugcugccag

SEQ ID NO: 1209083 - RNA, 19 nt, Mycobacterium bovis subsp bovis AF2122/97
gcggcaggugcggcggcau

SEQ ID NO: 1209084 - RNA, 15 nt, Mycobacterium bovis subsp bovis AF2122/97
gcggcagccuggccu

SEQ ID NO: 1209085 - RNA, 15 nt, Mycobacterium bovis subsp bovis AF2122/97
gcggccagccguuug

SEQ ID NO: 1209086 - RNA, 18 nt, Mycobacterium bovis subsp bovis AF2122/97
gcggccagcccagccggg

SEQ ID NO: 1209087 - RNA, 20 nt, Mycobacterium bovis subsp bovis AF2122/97
gcggccagcgcgcgcgggug

SEQ ID NO: 1209088 - RNA, 15 nt, Mycobacterium bovis subsp bovis AF2122/97
gcggccagugcucgc

SEQ ID NO: 1209089 - RNA, 21 nt, Mycobacterium bovis subsp bovis AF2122/97
gcggccaguucggcggccgcc

SEQ ID NO: 1209090 - RNA, 16 nt, Mycobacterium bovis subsp bovis AF2122/97
gcggccaggucgccuu

SEQ ID NO: 1209091 - RNA, 16 nt, Mycobacterium bovis subsp bovis AF2122/97
gcggccguagugcacg

SEQ ID NO: 1209092 - RNA, 22 nt, Mycobacterium bovis subsp bovis AF2122/97
gcggccgugaacggcgcgggcc

SEQ ID NO: 1209093 - RNA, 15 nt, Mycobacterium bovis subsp bovis AF2122/97
gcggccgggucgcgc

SEQ ID NO: 1209094 - RNA, 14 nt, Mycobacterium bovis subsp bovis AF2122/97
gcggccgugguggu

SEQ ID NO: 1209095 - RNA, 21 nt, Mycobacterium bovis subsp bovis AF2122/97
gcggccuaggacgccgcccuc

SEQ ID NO: 1209096 - RNA, 15 nt, Mycobacterium bovis subsp bovis AF2122/97
gcggccuccccgacc

SEQ ID NO: 1209097 - RNA, 13 nt, Mycobacterium bovis subsp bovis AF2122/97
gcggccucccgca

SEQ ID NO: 1209098 - RNA, 23 nt, Mycobacterium bovis subsp bovis AF2122/97
gcggccucccgcaaugcgagcgc

SEQ ID NO: 1209099 - RNA, 19 nt, Mycobacterium bovis subsp bovis AF2122/97
gcggccuagcgccacuuga

SEQ ID NO: 1209100 - RNA, 13 nt, Mycobacterium bovis subsp bovis AF2122/97
gcggccucgccgg

SEQ ID NO: 1209101 - RNA, 17 nt, Mycobacterium bovis subsp bovis AF2122/97
gcggccucggucuggug

SEQ ID NO: 1209102 - RNA, 12 nt, Mycobacterium bovis subsp bovis AF2122/97
gcggccugaccg

SEQ ID NO: 1209103 - RNA, 16 nt, Mycobacterium bovis subsp bovis AF2122/97
gcggccugcccgccgu

SEQ ID NO: 1209104 - RNA, 20 nt, Mycobacterium bovis subsp bovis AF2122/97
gcggccugcccgccguuacg

SEQ ID NO: 1209105 - RNA, 23 nt, Mycobacterium bovis subsp bovis AF2122/97
gcggcgaacucuacgguggugcg

SEQ ID NO: 1209106 - RNA, 15 nt, Mycobacterium bovis subsp bovis AF2122/97
gcggccuuggugggc

SEQ ID NO: 1209107 - RNA, 17 nt, Mycobacterium bovis subsp bovis AF2122/97
gcggccuuugucgccuu

SEQ ID NO: 1209108 - RNA, 17 nt, Mycobacterium bovis subsp bovis AF2122/97
gcggccuucggccggcg

SEQ ID NO: 1209109 - RNA, 16 nt, Mycobacterium bovis subsp bovis AF2122/97
gcggccugggccagcc

SEQ ID NO: 1209110 - RNA, 16 nt, Mycobacterium bovis subsp bovis AF2122/97
gcggccuggcacccgg

SEQ ID NO: 1209111 - RNA, 15 nt, Mycobacterium bovis subsp bovis AF2122/97
gcggcgaucgcuccg

SEQ ID NO: 1209112 - RNA, 20 nt, Mycobacterium bovis subsp bovis AF2122/97
gcggcgaugauggcgcgauc

SEQ ID NO: 1209113 - RNA, 17 nt, Mycobacterium bovis subsp bovis AF2122/97
gcggcgcccggucgagc

SEQ ID NO: 1209114 - RNA, 18 nt, Mycobacterium bovis subsp bovis AF2122/97
gcggcgauccggucgggg

SEQ ID NO: 1209115 - RNA, 20 nt, Mycobacterium bovis subsp bovis AF2122/97
gcggcgaucaacucgggcag

SEQ ID NO: 1209116 - RNA, 23 nt, Mycobacterium bovis subsp bovis AF2122/97
gcggcgaccgucgauuucgacga

SEQ ID NO: 1209117 - RNA, 19 nt, Mycobacterium bovis subsp bovis AF2122/97
gcggcgaaccagcgcgucu

SEQ ID NO: 1209118 - RNA, 16 nt, Mycobacterium bovis subsp bovis AF2122/97
gcggcgaagaagccgg

SEQ ID NO: 1209119 - RNA, 17 nt, Mycobacterium bovis subsp bovis AF2122/97
gcggcgacgagcgcagc

SEQ ID NO: 1209120 - RNA, 16 nt, Mycobacterium bovis subsp bovis AF2122/97
gcggcgacgacggccu

SEQ ID NO: 1209121 - RNA, 17 nt, Mycobacterium bovis subsp bovis AF2122/97
gcggcgacgacggccug

SEQ ID NO: 1209122 - RNA, 20 nt, Mycobacterium bovis subsp bovis AF2122/97
gcggcgaccgccagcgugga

SEQ ID NO: 1209123 - RNA, 21 nt, Mycobacterium bovis subsp bovis AF2122/97
gcggcgacggugccaccgcga

SEQ ID NO: 1209124 - RNA, 17 nt, Mycobacterium bovis subsp bovis AF2122/97
gcggcgagcaccacccc

SEQ ID NO: 1209125 - RNA, 17 nt, Mycobacterium bovis subsp bovis AF2122/97
gcggcgacggccgcucg

SEQ ID NO: 1209126 - RNA, 21 nt, Mycobacterium bovis subsp bovis AF2122/97
gcggagccaggacgacgccga

SEQ ID NO: 1209127 - RNA, 13 nt, Mycobacterium bovis subsp bovis AF2122/97
gcggagccgauga

SEQ ID NO: 1209128 - RNA, 12 nt, Mycobacterium bovis subsp bovis AF2122/97
gcggagccggcg

SEQ ID NO: 1209129 - RNA, 22 nt, Mycobacterium bovis subsp bovis AF2122/97
gcggaggcgaccccggccccga

SEQ ID NO: 1209130 - RNA, 17 nt, Mycobacterium bovis subsp bovis AF2122/97
gcggagccgggugaggc

SEQ ID NO: 1209131 - RNA, 21 nt, Mycobacterium bovis subsp bovis AF2122/97
gcggagucgcgcagggcgaca

SEQ ID NO: 1209132 - RNA, 17 nt, Mycobacterium bovis subsp bovis AF2122/97
gcggaguucgcugacgg

SEQ ID NO: 1209133 - RNA, 20 nt, Mycobacterium bovis subsp bovis AF2122/97
gcggaguuuuucgggguggc

SEQ ID NO: 1209134 - RNA, 16 nt, Mycobacterium bovis subsp bovis AF2122/97
gcggauaaccggcaug

SEQ ID NO: 1209135 - RNA, 17 nt, Mycobacterium bovis subsp bovis AF2122/97
gcggaggcugggcugag

SEQ ID NO: 1209136 - RNA, 14 nt, Mycobacterium bovis subsp bovis AF2122/97
gcggaucaacaggc

SEQ ID NO: 1209137 - RNA, 10 nt, Mycobacterium bovis subsp bovis AF2122/97
gcggaucugu

SEQ ID NO: 1209138 - RNA, 21 nt, Mycobacterium bovis subsp bovis AF2122/97
gcggauccagaaacugcucgg

SEQ ID NO: 1209139 - RNA, 16 nt, Mycobacterium bovis subsp bovis AF2122/97
gcggaucugguccagu

SEQ ID NO: 1209140 - RNA, 15 nt, Mycobacterium bovis subsp bovis AF2122/97
gcggauacagccgcc

SEQ ID NO: 1209141 - RNA, 20 nt, Mycobacterium bovis subsp bovis AF2122/97
gcggauagcggcaaagccgg

SEQ ID NO: 1209142 - RNA, 19 nt, Mycobacterium bovis subsp bovis AF2122/97
gcggauagugguugcggcc

SEQ ID NO: 1209143 - RNA, 13 nt, Mycobacterium bovis subsp bovis AF2122/97
gcggcaccagcac

SEQ ID NO: 1209144 - RNA, 14 nt, Mycobacterium bovis subsp bovis AF2122/97
gcggcagcacccac

SEQ ID NO: 1209145 - RNA, 20 nt, Mycobacterium bovis subsp bovis AF2122/97
gcggcagcacccacaucagc

SEQ ID NO: 1209146 - RNA, 14 nt, Mycobacterium bovis subsp bovis AF2122/97
gcggcaagggcuuc

SEQ ID NO: 1209147 - RNA, 19 nt, Mycobacterium bovis subsp bovis AF2122/97
gcgcuccggcgcgacgccc

SEQ ID NO: 1209148 - RNA, 16 nt, Mycobacterium bovis subsp bovis AF2122/97
gcgcucccggagcaca

SEQ ID NO: 1209149 - RNA, 17 nt, Mycobacterium bovis subsp bovis AF2122/97
gcgcucccggagcacaa

SEQ ID NO: 1209150 - RNA, 21 nt, Mycobacterium bovis subsp bovis AF2122/97
gcgcugaaucaccccggcggc

SEQ ID NO: 1209151 - RNA, 17 nt, Mycobacterium bovis subsp bovis AF2122/97
gcgcugaagcccauggc

SEQ ID NO: 1209152 - RNA, 22 nt, Mycobacterium bovis subsp bovis AF2122/97
gcgcugaaucaccccggcggcc

SEQ ID NO: 1209153 - RNA, 21 nt, Mycobacterium bovis subsp bovis AF2122/97
gcgcugagcgacugcagcggc

SEQ ID NO: 1209154 - RNA, 22 nt, Mycobacterium bovis subsp bovis AF2122/97
gcgcugagcgacugcagcggcg

SEQ ID NO: 1209155 - RNA, 13 nt, Mycobacterium bovis subsp bovis AF2122/97
gcgcuugcggccg

SEQ ID NO: 1209156 - RNA, 20 nt, Mycobacterium bovis subsp bovis AF2122/97
gcgcuugcgccgcccaugcc

SEQ ID NO: 1209157 - RNA, 19 nt, Mycobacterium bovis subsp bovis AF2122/97
gcgcuugacccgcggaccg

SEQ ID NO: 1209158 - RNA, 14 nt, Mycobacterium bovis subsp bovis AF2122/97
gcgcuucgccacac

SEQ ID NO: 1209159 - RNA, 22 nt, Mycobacterium bovis subsp bovis AF2122/97
gcggacaggcccgguggcggcu

SEQ ID NO: 1209160 - RNA, 14 nt, Mycobacterium bovis subsp bovis AF2122/97
gcggacaccgcggc

SEQ ID NO: 1209161 - RNA, 18 nt, Mycobacterium bovis subsp bovis AF2122/97
gcggacaccucgggcgcc

SEQ ID NO: 1209162 - RNA, 20 nt, Mycobacterium bovis subsp bovis AF2122/97
gcggacacgaucgcgucggc

SEQ ID NO: 1209163 - RNA, 13 nt, Mycobacterium bovis subsp bovis AF2122/97
gcggacaguuccc

SEQ ID NO: 1209164 - RNA, 20 nt, Mycobacterium bovis subsp bovis AF2122/97
gcggacauccgggccgagcg

SEQ ID NO: 1209165 - RNA, 17 nt, Mycobacterium bovis subsp bovis AF2122/97
gcggacuggcauccgcc

SEQ ID NO: 1209166 - RNA, 22 nt, Mycobacterium bovis subsp bovis AF2122/97
gcggacuggcauccgccccgcc

SEQ ID NO: 1209167 - RNA, 22 nt, Mycobacterium bovis subsp bovis AF2122/97
gcggacugagagauggucgggc

SEQ ID NO: 1209168 - RNA, 20 nt, Mycobacterium bovis subsp bovis AF2122/97
gcggacuucgaugucgaggu

SEQ ID NO: 1209169 - RNA, 18 nt, Mycobacterium bovis subsp bovis AF2122/97
gcggagaccccgcgcgcu

SEQ ID NO: 1209170 - RNA, 18 nt, Mycobacterium bovis subsp bovis AF2122/97
gcggagacgaucgccagg

SEQ ID NO: 1209171 - RNA, 13 nt, Mycobacterium bovis subsp bovis AF2122/97
gcggaauggcgcc

SEQ ID NO: 1209172 - RNA, 13 nt, Mycobacterium bovis subsp bovis AF2122/97
gcguccagcagcg

SEQ ID NO: 1209173 - RNA, 21 nt, Mycobacterium bovis subsp bovis AF2122/97
gcgucauucaccgcguugaug

SEQ ID NO: 1209174 - RNA, 15 nt, Mycobacterium bovis subsp bovis AF2122/97
gcguccagcgcggcc

SEQ ID NO: 1209175 - RNA, 20 nt, Mycobacterium bovis subsp bovis AF2122/97
gcguccagcaaaugcggcgc

SEQ ID NO: 1209176 - RNA, 22 nt, Mycobacterium bovis subsp bovis AF2122/97
gcguccacccacgaucagcagc

SEQ ID NO: 1209177 - RNA, 22 nt, Mycobacterium bovis subsp bovis AF2122/97
gcguccaggccagggcgguggc

SEQ ID NO: 1209178 - RNA, 16 nt, Mycobacterium bovis subsp bovis AF2122/97
gcguccgcccagcacc

SEQ ID NO: 1209179 - RNA, 16 nt, Mycobacterium bovis subsp bovis AF2122/97
gcguccauccgcagca

SEQ ID NO: 1209180 - RNA, 17 nt, Mycobacterium bovis subsp bovis AF2122/97
gcgucccgccgcaccgc

SEQ ID NO: 1209181 - RNA, 19 nt, Mycobacterium bovis subsp bovis AF2122/97
gcgucgacgucgacggcga

SEQ ID NO: 1209182 - RNA, 22 nt, Mycobacterium bovis subsp bovis AF2122/97
gcgucgagccggauucggcugc

SEQ ID NO: 1209183 - RNA, 17 nt, Mycobacterium bovis subsp bovis AF2122/97
gcgucgagcgccggccg

SEQ ID NO: 1209184 - RNA, 18 nt, Mycobacterium bovis subsp bovis AF2122/97
gcgucgaugcgcugcuca

SEQ ID NO: 1209185 - RNA, 12 nt, Mycobacterium bovis subsp bovis AF2122/97
gcgucgaugccg

SEQ ID NO: 1209186 - RNA, 22 nt, Mycobacterium bovis subsp bovis AF2122/97
gcgucgaugagguucaucgccg

SEQ ID NO: 1209187 - RNA, 15 nt, Mycobacterium bovis subsp bovis AF2122/97
gcgucgagcagcacc

SEQ ID NO: 1209188 - RNA, 19 nt, Mycobacterium bovis subsp bovis AF2122/97
gcgucgcacgcgcgcaggc

SEQ ID NO: 1209189 - RNA, 21 nt, Mycobacterium bovis subsp bovis AF2122/97
gcgucgcaaggcccgcaccgc

SEQ ID NO: 1209190 - RNA, 12 nt, Mycobacterium bovis subsp bovis AF2122/97
gcgucgccgccg

SEQ ID NO: 1209191 - RNA, 14 nt, Mycobacterium bovis subsp bovis AF2122/97
gcgucgacacaccc

SEQ ID NO: 1209192 - RNA, 15 nt, Mycobacterium bovis subsp bovis AF2122/97
gcgucgaccgcggcc

SEQ ID NO: 1209193 - RNA, 15 nt, Mycobacterium bovis subsp bovis AF2122/97
gcgucgaagccgggg

SEQ ID NO: 1209194 - RNA, 16 nt, Mycobacterium bovis subsp bovis AF2122/97
gcguccucgcccuggc

SEQ ID NO: 1209195 - RNA, 17 nt, Mycobacterium bovis subsp bovis AF2122/97
gcguccgucucgcaggc

SEQ ID NO: 1209196 - RNA, 19 nt, Mycobacterium bovis subsp bovis AF2122/97
gcguccguagcgauucugg

SEQ ID NO: 1209197 - RNA, 19 nt, Mycobacterium bovis subsp bovis AF2122/97
gcguccgcccagccgcagc

SEQ ID NO: 1209198 - RNA, 15 nt, Mycobacterium bovis subsp bovis AF2122/97
gcguccgggcagccg

SEQ ID NO: 1209199 - RNA, 14 nt, Mycobacterium bovis subsp bovis AF2122/97
gcgucacagccggg

SEQ ID NO: 1209200 - RNA, 16 nt, Mycobacterium bovis subsp bovis AF2122/97
gcgucaagggcugggu

SEQ ID NO: 1209201 - RNA, 21 nt, Mycobacterium bovis subsp bovis AF2122/97
gcgucaccccggucccgccga

SEQ ID NO: 1209202 - RNA, 15 nt, Mycobacterium bovis subsp bovis AF2122/97
gcgucaggccagcgc

SEQ ID NO: 1209203 - RNA, 17 nt, Mycobacterium bovis subsp bovis AF2122/97
gcgucaggugcgcgacc

SEQ ID NO: 1209204 - RNA, 19 nt, Mycobacterium bovis subsp bovis AF2122/97
gcgucaguccucaucgagc

SEQ ID NO: 1209205 - RNA, 23 nt, Mycobacterium bovis subsp bovis AF2122/97
gcgucaguccucaucgagcgcgc

SEQ ID NO: 1209206 - RNA, 20 nt, Mycobacterium bovis subsp bovis AF2122/97
gcguacuucgcuggaaaccu

SEQ ID NO: 1209207 - RNA, 21 nt, Mycobacterium bovis subsp bovis AF2122/97
gcguagaagaaguacaucugc

SEQ ID NO: 1209208 - RNA, 15 nt, Mycobacterium bovis subsp bovis AF2122/97
gcguagcaacccagg

SEQ ID NO: 1209209 - RNA, 21 nt, Mycobacterium bovis subsp bovis AF2122/97
gcguagcccacccgggugggc

SEQ ID NO: 1209210 - RNA, 13 nt, Mycobacterium bovis subsp bovis AF2122/97
gcguagcggggga

SEQ ID NO: 1209211 - RNA, 22 nt, Mycobacterium bovis subsp bovis AF2122/97
gcguagcgggggagcgaacggc

SEQ ID NO: 1209212 - RNA, 20 nt, Mycobacterium bovis subsp bovis AF2122/97
gcguaggccuugcucagccg

SEQ ID NO: 1209213 - RNA, 16 nt, Mycobacterium bovis subsp bovis AF2122/97
gcguagcuggccaggu

SEQ ID NO: 1209214 - RNA, 20 nt, Mycobacterium bovis subsp bovis AF2122/97
gcguagaucaucuggcuggu

SEQ ID NO: 1209215 - RNA, 17 nt, Mycobacterium bovis subsp bovis AF2122/97
gcguauugcaccgccag

SEQ ID NO: 1209216 - RNA, 17 nt, Mycobacterium bovis subsp bovis AF2122/97
gcguaugcccacgaacc

SEQ ID NO: 1209217 - RNA, 21 nt, Mycobacterium bovis subsp bovis AF2122/97
gcguagugcggcguggaucag

SEQ ID NO: 1209218 - RNA, 22 nt, Mycobacterium bovis subsp bovis AF2122/97
gcguauagcaugccgcggcgga

SEQ ID NO: 1209219 - RNA, 16 nt, Mycobacterium bovis subsp bovis AF2122/97
gcgugcugcggcuggu

SEQ ID NO: 1209220 - RNA, 18 nt, Mycobacterium bovis subsp bovis AF2122/97
gcgugcucgacgcgcauc

SEQ ID NO: 1209221 - RNA, 23 nt, Mycobacterium bovis subsp bovis AF2122/97
gcgugcucgccguaagcaccagc

SEQ ID NO: 1209222 - RNA, 17 nt, Mycobacterium bovis subsp bovis AF2122/97
gcgugcuugaccgccug

SEQ ID NO: 1209223 - RNA, 13 nt, Mycobacterium bovis subsp bovis AF2122/97
gcgugcuugagca

SEQ ID NO: 1209224 - RNA, 14 nt, Mycobacterium bovis subsp bovis AF2122/97
gcgugcugugcuca

SEQ ID NO: 1209225 - RNA, 15 nt, Mycobacterium bovis subsp bovis AF2122/97
gcguggaaaccggug

SEQ ID NO: 1209226 - RNA, 20 nt, Mycobacterium bovis subsp bovis AF2122/97
gcguggccaauccggcggcg

SEQ ID NO: 1209227 - RNA, 17 nt, Mycobacterium bovis subsp bovis AF2122/97
gcguggacgcccgcccg

SEQ ID NO: 1209228 - RNA, 20 nt, Mycobacterium bovis subsp bovis AF2122/97
gcguggaauggcgccggccg

SEQ ID NO: 1209229 - RNA, 19 nt, Mycobacterium bovis subsp bovis AF2122/97
gcgugccggcagcgguggc

SEQ ID NO: 1209230 - RNA, 15 nt, Mycobacterium bovis subsp bovis AF2122/97
gcgugccgccgcaga

SEQ ID NO: 1209231 - RNA, 15 nt, Mycobacterium bovis subsp bovis AF2122/97
gcgugccgcagcggc

SEQ ID NO: 1209232 - RNA, 14 nt, Mycobacterium bovis subsp bovis AF2122/97
gcgugcggcugcca

SEQ ID NO: 1209233 - RNA, 13 nt, Mycobacterium bovis subsp bovis AF2122/97
gcgugcgccgggg

SEQ ID NO: 1209234 - RNA, 23 nt, Mycobacterium bovis subsp bovis AF2122/97
gcgugcaucgcgauuccggcggc

SEQ ID NO: 1209235 - RNA, 16 nt, Mycobacterium bovis subsp bovis AF2122/97
gcgugccacucgaugc

SEQ ID NO: 1209236 - RNA, 12 nt, Mycobacterium bovis subsp bovis AF2122/97
gcgugccagcac

SEQ ID NO: 1209237 - RNA, 15 nt, Mycobacterium bovis subsp bovis AF2122/97
gcgugcagcggcggg

SEQ ID NO: 1209238 - RNA, 21 nt, Mycobacterium bovis subsp bovis AF2122/97
gcgugcagaucacgggugugc

SEQ ID NO: 1209239 - RNA, 15 nt, Mycobacterium bovis subsp bovis AF2122/97
gcgugccagcgcccc

SEQ ID NO: 1209240 - RNA, 21 nt, Mycobacterium bovis subsp bovis AF2122/97
gcgugaucuggccgaagcccg

SEQ ID NO: 1209241 - RNA, 17 nt, Mycobacterium bovis subsp bovis AF2122/97
gcgugagcugcucgagc

SEQ ID NO: 1209242 - RNA, 18 nt, Mycobacterium bovis subsp bovis AF2122/97
gcgugaucuggccacggc

SEQ ID NO: 1209243 - RNA, 15 nt, Mycobacterium bovis subsp bovis AF2122/97
gcgugacccgccggc

SEQ ID NO: 1209244 - RNA, 18 nt, Mycobacterium bovis subsp bovis AF2122/97
gcgugaccgacugcgggu

SEQ ID NO: 1209245 - RNA, 17 nt, Mycobacterium bovis subsp bovis AF2122/97
gcgugacgaccagcccc

SEQ ID NO: 1209246 - RNA, 22 nt, Mycobacterium bovis subsp bovis AF2122/97
gcgucuuggaaggcgcgcgccc

SEQ ID NO: 1209247 - RNA, 15 nt, Mycobacterium bovis subsp bovis AF2122/97
gcgucggcggcuucc

SEQ ID NO: 1209248 - RNA, 22 nt, Mycobacterium bovis subsp bovis AF2122/97
gcgucguaaacgucggucgggg

SEQ ID NO: 1209249 - RNA, 16 nt, Mycobacterium bovis subsp bovis AF2122/97
gcgucgugccacuucc

SEQ ID NO: 1209250 - RNA, 17 nt, Mycobacterium bovis subsp bovis AF2122/97
gcgucguagcgcucgug

SEQ ID NO: 1209251 - RNA, 21 nt, Mycobacterium bovis subsp bovis AF2122/97
gcgucguagcgcucgugaccg

SEQ ID NO: 1209252 - RNA, 13 nt, Mycobacterium bovis subsp bovis AF2122/97
gcgucggccaccc

SEQ ID NO: 1209253 - RNA, 16 nt, Mycobacterium bovis subsp bovis AF2122/97
gcgucggcccggugcu

SEQ ID NO: 1209254 - RNA, 13 nt, Mycobacterium bovis subsp bovis AF2122/97
gcgucggcgauga

SEQ ID NO: 1209255 - RNA, 16 nt, Mycobacterium bovis subsp bovis AF2122/97
gcgucggagccgggca

SEQ ID NO: 1209256 - RNA, 19 nt, Mycobacterium bovis subsp bovis AF2122/97
gcgucggaauacaacagcu

SEQ ID NO: 1209257 - RNA, 15 nt, Mycobacterium bovis subsp bovis AF2122/97
gcgucgcuacgcaac

SEQ ID NO: 1209258 - RNA, 20 nt, Mycobacterium bovis subsp bovis AF2122/97
gcgucgccggccuugagcac

SEQ ID NO: 1209259 - RNA, 23 nt, Mycobacterium bovis subsp bovis AF2122/97
gcgucgcuaucgugcgccgacgg

SEQ ID NO: 1209260 - RNA, 18 nt, Mycobacterium bovis subsp bovis AF2122/97
gcgucgcggacggugcgg

SEQ ID NO: 1209261 - RNA, 21 nt, Mycobacterium bovis subsp bovis AF2122/97
gcgucgcgccugcccggguga

SEQ ID NO: 1209262 - RNA, 16 nt, Mycobacterium bovis subsp bovis AF2122/97
gcgucugcucgcgccc

SEQ ID NO: 1209263 - RNA, 18 nt, Mycobacterium bovis subsp bovis AF2122/97
gcgucugcucggcgcagc

SEQ ID NO: 1209264 - RNA, 17 nt, Mycobacterium bovis subsp bovis AF2122/97
gcgucugcucggcggcc

SEQ ID NO: 1209265 - RNA, 20 nt, Mycobacterium bovis subsp bovis AF2122/97
gcgucugcucggcggugccg

SEQ ID NO: 1209266 - RNA, 18 nt, Mycobacterium bovis subsp bovis AF2122/97
gcgucugcugaccggagu

SEQ ID NO: 1209267 - RNA, 15 nt, Mycobacterium bovis subsp bovis AF2122/97
gcgucugcucgccgg

SEQ ID NO: 1209268 - RNA, 17 nt, Mycobacterium bovis subsp bovis AF2122/97
gcgucugcucgccaggc

SEQ ID NO: 1209269 - RNA, 18 nt, Mycobacterium bovis subsp bovis AF2122/97
gcgucugcucgccaggca

SEQ ID NO: 1209270 - RNA, 18 nt, Mycobacterium bovis subsp bovis AF2122/97
gcgucugcucgccaggcc

SEQ ID NO: 1209271 - RNA, 16 nt, Mycobacterium bovis subsp bovis AF2122/97
gcgucugcucgccagc

SEQ ID NO: 1209272 - RNA, 13 nt, Mycobacterium bovis subsp bovis AF2122/97
gcgucugcggcgg

SEQ ID NO: 1209273 - RNA, 19 nt, Mycobacterium bovis subsp bovis AF2122/97
gcgucugcgguggccuguc

SEQ ID NO: 1209274 - RNA, 14 nt, Mycobacterium bovis subsp bovis AF2122/97
gcgucugcucgcca

SEQ ID NO: 1209275 - RNA, 22 nt, Mycobacterium bovis subsp bovis AF2122/97
gcgucugcgaucccgaucgcgc

SEQ ID NO: 1209276 - RNA, 18 nt, Mycobacterium bovis subsp bovis AF2122/97
gcgucugcccgcccagcc

SEQ ID NO: 1209277 - RNA, 16 nt, Mycobacterium bovis subsp bovis AF2122/97
gcgucugggugcaggu

SEQ ID NO: 1209278 - RNA, 16 nt, Mycobacterium bovis subsp bovis AF2122/97
gcgucuggucagccgc

SEQ ID NO: 1209279 - RNA, 19 nt, Mycobacterium bovis subsp bovis AF2122/97
gcgucuuccucggccaccc

SEQ ID NO: 1209280 - RNA, 14 nt, Mycobacterium bovis subsp bovis AF2122/97
gcgucuugcagccu

SEQ ID NO: 1209281 - RNA, 21 nt, Mycobacterium bovis subsp bovis AF2122/97
gcgucuuccucggccacccgc

SEQ ID NO: 1209282 - RNA, 13 nt, Mycobacterium bovis subsp bovis AF2122/97
gcgucugagcgcc

SEQ ID NO: 1209283 - RNA, 17 nt, Mycobacterium bovis subsp bovis AF2122/97
gcgucucgcgcagccgg

SEQ ID NO: 1209284 - RNA, 12 nt, Mycobacterium bovis subsp bovis AF2122/97
gcgucucggugg

SEQ ID NO: 1209285 - RNA, 18 nt, Mycobacterium bovis subsp bovis AF2122/97
gcgucuccagcuggguga

SEQ ID NO: 1209286 - RNA, 23 nt, Mycobacterium bovis subsp bovis AF2122/97
gcgucucgaucaccucgcgggug

SEQ ID NO: 1209287 - RNA, 14 nt, Mycobacterium bovis subsp bovis AF2122/97
gcgucuccuugagc

SEQ ID NO: 1209288 - RNA, 20 nt, Mycobacterium bovis subsp bovis AF2122/97
gcgucguugucgucgccggc

SEQ ID NO: 1209289 - RNA, 16 nt, Mycobacterium bovis subsp bovis AF2122/97
gcgucguuugggugcg

SEQ ID NO: 1209290 - RNA, 16 nt, Mycobacterium bovis subsp bovis AF2122/97
gcgucguucgcgggug

SEQ ID NO: 1209291 - RNA, 16 nt, Mycobacterium bovis subsp bovis AF2122/97
gcgucuccagcugggu

SEQ ID NO: 1209292 - RNA, 17 nt, Mycobacterium bovis subsp bovis AF2122/97
gcgucuccacuuucugc

SEQ ID NO: 1209293 - RNA, 19 nt, Mycobacterium bovis subsp bovis AF2122/97
gcgggccugcacgccggcg

SEQ ID NO: 1209294 - RNA, 21 nt, Mycobacterium bovis subsp bovis AF2122/97
gcgggccugcacgccggcgcu

SEQ ID NO: 1209295 - RNA, 16 nt, Mycobacterium bovis subsp bovis AF2122/97
gcgggccugcgcgauc

SEQ ID NO: 1209296 - RNA, 14 nt, Mycobacterium bovis subsp bovis AF2122/97
gcgggccuggccca

SEQ ID NO: 1209297 - RNA, 15 nt, Mycobacterium bovis subsp bovis AF2122/97
gcgggccgcgcggcg

SEQ ID NO: 1209298 - RNA, 22 nt, Mycobacterium bovis subsp bovis AF2122/97
gcgggcccucuaugcgggcagc

SEQ ID NO: 1209299 - RNA, 19 nt, Mycobacterium bovis subsp bovis AF2122/97
gcgggccgcguccagaccg

SEQ ID NO: 1209300 - RNA, 17 nt, Mycobacterium bovis subsp bovis AF2122/97
gcgggccgacgcaggug

SEQ ID NO: 1209301 - RNA, 11 nt, Mycobacterium bovis subsp bovis AF2122/97
gcgggcagcag

SEQ ID NO: 1209302 - RNA, 14 nt, Mycobacterium bovis subsp bovis AF2122/97
gcgggcacgccgcc

SEQ ID NO: 1209303 - RNA, 18 nt, Mycobacterium bovis subsp bovis AF2122/97
gcgggcagcguguaaccg

SEQ ID NO: 1209304 - RNA, 19 nt, Mycobacterium bovis subsp bovis AF2122/97
gcgggcagccgcccgccag

SEQ ID NO: 1209305 - RNA, 18 nt, Mycobacterium bovis subsp bovis AF2122/97
gcgggcaguagcuguggc

SEQ ID NO: 1209306 - RNA, 18 nt, Mycobacterium bovis subsp bovis AF2122/97
gcgggcacgcacaaguuc

SEQ ID NO: 1209307 - RNA, 21 nt, Mycobacterium bovis subsp bovis AF2122/97
gcgggcaagccggacagauca

SEQ ID NO: 1209308 - RNA, 16 nt, Mycobacterium bovis subsp bovis AF2122/97
gcgggcaaucaccgcc

SEQ ID NO: 1209309 - RNA, 20 nt, Mycobacterium bovis subsp bovis AF2122/97
gcgggcaacugcagcauggc

SEQ ID NO: 1209310 - RNA, 15 nt, Mycobacterium bovis subsp bovis AF2122/97
gcgggauugcgcgcu

SEQ ID NO: 1209311 - RNA, 12 nt, Mycobacterium bovis subsp bovis AF2122/97
gcggcgccgcaa

SEQ ID NO: 1209312 - RNA, 15 nt, Mycobacterium bovis subsp bovis AF2122/97
gcggcgcccuggccg

SEQ ID NO: 1209313 - RNA, 20 nt, Mycobacterium bovis subsp bovis AF2122/97
gcggcgccggaggcggcgcu

SEQ ID NO: 1209314 - RNA, 13 nt, Mycobacterium bovis subsp bovis AF2122/97
gcggcgccggccu

SEQ ID NO: 1209315 - RNA, 21 nt, Mycobacterium bovis subsp bovis AF2122/97
gcggcgccggccucgccgggg

SEQ ID NO: 1209316 - RNA, 17 nt, Mycobacterium bovis subsp bovis AF2122/97
gcggcgccggugggcgg

SEQ ID NO: 1209317 - RNA, 15 nt, Mycobacterium bovis subsp bovis AF2122/97
gcggcgccggggggc

SEQ ID NO: 1209318 - RNA, 12 nt, Mycobacterium bovis subsp bovis AF2122/97
gcggcgccgggg

SEQ ID NO: 1209319 - RNA, 15 nt, Mycobacterium bovis subsp bovis AF2122/97
gcggcgccggugggc

SEQ ID NO: 1209320 - RNA, 17 nt, Mycobacterium bovis subsp bovis AF2122/97
gcggcgcgaccgucugg

SEQ ID NO: 1209321 - RNA, 18 nt, Mycobacterium bovis subsp bovis AF2122/97
gcggcgcgaagucuugac

SEQ ID NO: 1209322 - RNA, 14 nt, Mycobacterium bovis subsp bovis AF2122/97
gcgggaugcgcgcc

SEQ ID NO: 1209323 - RNA, 17 nt, Mycobacterium bovis subsp bovis AF2122/97
gcgggaugcgcgcccga

SEQ ID NO: 1209324 - RNA, 14 nt, Mycobacterium bovis subsp bovis AF2122/97
gcgggauggggccc

SEQ ID NO: 1209325 - RNA, 18 nt, Mycobacterium bovis subsp bovis AF2122/97
gcgggauggggcccgcau

SEQ ID NO: 1209326 - RNA, 17 nt, Mycobacterium bovis subsp bovis AF2122/97
gcggcugguguccagcc

SEQ ID NO: 1209327 - RNA, 17 nt, Mycobacterium bovis subsp bovis AF2122/97
gcggcugucggccgggu

SEQ ID NO: 1209328 - RNA, 16 nt, Mycobacterium bovis subsp bovis AF2122/97
gcggcuguugcggcgg

SEQ ID NO: 1209329 - RNA, 19 nt, Mycobacterium bovis subsp bovis AF2122/97
gcggcuguugcggcggcgc

SEQ ID NO: 1209330 - RNA, 17 nt, Mycobacterium bovis subsp bovis AF2122/97
gcggcuguugcggcggc

SEQ ID NO: 1209331 - RNA, 17 nt, Mycobacterium bovis subsp bovis AF2122/97
gcggggauuggugccca

SEQ ID NO: 1209332 - RNA, 22 nt, Mycobacterium bovis subsp bovis AF2122/97
gcgggcgguccaaaacaccgcc

SEQ ID NO: 1209333 - RNA, 13 nt, Mycobacterium bovis subsp bovis AF2122/97
gcggggccggccg

SEQ ID NO: 1209334 - RNA, 17 nt, Mycobacterium bovis subsp bovis AF2122/97
gcggggcggcggugggc

SEQ ID NO: 1209335 - RNA, 12 nt, Mycobacterium bovis subsp bovis AF2122/97
gcgggcggcgcu

SEQ ID NO: 1209336 - RNA, 16 nt, Mycobacterium bovis subsp bovis AF2122/97
gcgggcgggucugggu

SEQ ID NO: 1209337 - RNA, 21 nt, Mycobacterium bovis subsp bovis AF2122/97
gcgggcgggucugggugguga

SEQ ID NO: 1209338 - RNA, 18 nt, Mycobacterium bovis subsp bovis AF2122/97
gcggggguucgcucuggu

SEQ ID NO: 1209339 - RNA, 14 nt, Mycobacterium bovis subsp bovis AF2122/97
gcgggguaggccca

SEQ ID NO: 1209340 - RNA, 21 nt, Mycobacterium bovis subsp bovis AF2122/97
gcgggguaggcccagcaaccg

SEQ ID NO: 1209341 - RNA, 17 nt, Mycobacterium bovis subsp bovis AF2122/97
gcgggggcgucgccgcc

SEQ ID NO: 1209342 - RNA, 16 nt, Mycobacterium bovis subsp bovis AF2122/97
gcgggggcgaccuggu

SEQ ID NO: 1209343 - RNA, 12 nt, Mycobacterium bovis subsp bovis AF2122/97
gcgggggcggcc

SEQ ID NO: 1209344 - RNA, 12 nt, Mycobacterium bovis subsp bovis AF2122/97
gcgggggcagcg

SEQ ID NO: 1209345 - RNA, 18 nt, Mycobacterium bovis subsp bovis AF2122/97
gcggggugugcgguugcu

SEQ ID NO: 1209346 - RNA, 20 nt, Mycobacterium bovis subsp bovis AF2122/97
gcggguaagacgucggacgg

SEQ ID NO: 1209347 - RNA, 24 nt, Mycobacterium bovis subsp bovis AF2122/97
gcgggguuggccguggucgaggug

SEQ ID NO: 1209348 - RNA, 19 nt, Mycobacterium bovis subsp bovis AF2122/97
gcgguaccgccgcggucgg

SEQ ID NO: 1209349 - RNA, 21 nt, Mycobacterium bovis subsp bovis AF2122/97
gcgguaccgccgcggucggac

SEQ ID NO: 1209350 - RNA, 23 nt, Mycobacterium bovis subsp bovis AF2122/97
gcgguaccggaaucggcggcgga

SEQ ID NO: 1209351 - RNA, 17 nt, Mycobacterium bovis subsp bovis AF2122/97
gcggguucaacgcgcgc

SEQ ID NO: 1209352 - RNA, 15 nt, Mycobacterium bovis subsp bovis AF2122/97
gcgggugguccagcc

SEQ ID NO: 1209353 - RNA, 13 nt, Mycobacterium bovis subsp bovis AF2122/97
gcgggugugagug

SEQ ID NO: 1209354 - RNA, 20 nt, Mycobacterium bovis subsp bovis AF2122/97
gcggguguuccacaccaggc

SEQ ID NO: 1209355 - RNA, 16 nt, Mycobacterium bovis subsp bovis AF2122/97
gcggguggcccccgcc

SEQ ID NO: 1209356 - RNA, 14 nt, Mycobacterium bovis subsp bovis AF2122/97
gcggguggcggcgu

SEQ ID NO: 1209357 - RNA, 18 nt, Mycobacterium bovis subsp bovis AF2122/97
gcggguggcgccggugcg

SEQ ID NO: 1209358 - RNA, 18 nt, Mycobacterium bovis subsp bovis AF2122/97
gcggucaucgcguccaug

SEQ ID NO: 1209359 - RNA, 16 nt, Mycobacterium bovis subsp bovis AF2122/97
gcgguagucgccgagg

SEQ ID NO: 1209360 - RNA, 20 nt, Mycobacterium bovis subsp bovis AF2122/97
gcggucagcggauccaggcc

SEQ ID NO: 1209361 - RNA, 21 nt, Mycobacterium bovis subsp bovis AF2122/97
gcgguagucggccagcucgcg

SEQ ID NO: 1209362 - RNA, 17 nt, Mycobacterium bovis subsp bovis AF2122/97
gcgguagucgucgacag

SEQ ID NO: 1209363 - RNA, 15 nt, Mycobacterium bovis subsp bovis AF2122/97
gcggucagcggcugg

SEQ ID NO: 1209364 - RNA, 16 nt, Mycobacterium bovis subsp bovis AF2122/97
gcgguagagcucuggu

SEQ ID NO: 1209365 - RNA, 20 nt, Mycobacterium bovis subsp bovis AF2122/97
gcgguagcagccgcugagcg

SEQ ID NO: 1209366 - RNA, 14 nt, Mycobacterium bovis subsp bovis AF2122/97
gcgguagccgagcu

SEQ ID NO: 1209367 - RNA, 23 nt, Mycobacterium bovis subsp bovis AF2122/97
gcgguagcggaccugcgagaucg

SEQ ID NO: 1209368 - RNA, 19 nt, Mycobacterium bovis subsp bovis AF2122/97
gcgguagcggaccugcgag

SEQ ID NO: 1209369 - RNA, 18 nt, Mycobacterium bovis subsp bovis AF2122/97
gcgguaggagcggguggc

SEQ ID NO: 1209370 - RNA, 16 nt, Mycobacterium bovis subsp bovis AF2122/97
gcgguagcugcccagc

SEQ ID NO: 1209371 - RNA, 17 nt, Mycobacterium bovis subsp bovis AF2122/97
gcgguagcugcccagcg

SEQ ID NO: 1209372 - RNA, 14 nt, Mycobacterium bovis subsp bovis AF2122/97
gcggucggcggccg

SEQ ID NO: 1209373 - RNA, 13 nt, Mycobacterium bovis subsp bovis AF2122/97
gcggucgggcccg

SEQ ID NO: 1209374 - RNA, 19 nt, Mycobacterium bovis subsp bovis AF2122/97
gcggucgcagcagaccaca

SEQ ID NO: 1209375 - RNA, 18 nt, Mycobacterium bovis subsp bovis AF2122/97
gcggucggaaugccgucg

SEQ ID NO: 1209376 - RNA, 15 nt, Mycobacterium bovis subsp bovis AF2122/97
gcggucggcagaccg

SEQ ID NO: 1209377 - RNA, 22 nt, Mycobacterium bovis subsp bovis AF2122/97
gcggucggcagcgacgccggcc

SEQ ID NO: 1209378 - RNA, 23 nt, Mycobacterium bovis subsp bovis AF2122/97
gcggucgcgguagcagccgcuga

SEQ ID NO: 1209379 - RNA, 15 nt, Mycobacterium bovis subsp bovis AF2122/97
gcggucgugaucagc

SEQ ID NO: 1209380 - RNA, 22 nt, Mycobacterium bovis subsp bovis AF2122/97
gcggucguccccgucgcuggcc

SEQ ID NO: 1209381 - RNA, 16 nt, Mycobacterium bovis subsp bovis AF2122/97
gcggucuugccgcagg

SEQ ID NO: 1209382 - RNA, 18 nt, Mycobacterium bovis subsp bovis AF2122/97
gcggucuugccgcaggcc

SEQ ID NO: 1209383 - RNA, 17 nt, Mycobacterium bovis subsp bovis AF2122/97
gcggucuuggcgcgccc

SEQ ID NO: 1209384 - RNA, 18 nt, Mycobacterium bovis subsp bovis AF2122/97
gcggucugcgccuucgcc

SEQ ID NO: 1209385 - RNA, 17 nt, Mycobacterium bovis subsp bovis AF2122/97
gcggucguugccgaccg

SEQ ID NO: 1209386 - RNA, 19 nt, Mycobacterium bovis subsp bovis AF2122/97
gcggucugcgcgucgcgug

SEQ ID NO: 1209387 - RNA, 17 nt, Mycobacterium bovis subsp bovis AF2122/97
gcggucugcuccaggcg

SEQ ID NO: 1209388 - RNA, 22 nt, Mycobacterium bovis subsp bovis AF2122/97
gcgguccagaaugucgcgggug

SEQ ID NO: 1209389 - RNA, 18 nt, Mycobacterium bovis subsp bovis AF2122/97
gcgguccaggccggcacc

SEQ ID NO: 1209390 - RNA, 13 nt, Mycobacterium bovis subsp bovis AF2122/97
gcgguccgagcgg

SEQ ID NO: 1209391 - RNA, 16 nt, Mycobacterium bovis subsp bovis AF2122/97
gcggucccgcggaccg

SEQ ID NO: 1209392 - RNA, 20 nt, Mycobacterium bovis subsp bovis AF2122/97
gcgguccaccggcccucgcc

SEQ ID NO: 1209393 - RNA, 23 nt, Mycobacterium bovis subsp bovis AF2122/97
gcgguccgcugccaucggcacca

SEQ ID NO: 1209394 - RNA, 19 nt, Mycobacterium bovis subsp bovis AF2122/97
gcggucgauguccgcagca

SEQ ID NO: 1209395 - RNA, 18 nt, Mycobacterium bovis subsp bovis AF2122/97
gcggucgccacacccgcg

SEQ ID NO: 1209396 - RNA, 19 nt, Mycobacterium bovis subsp bovis AF2122/97
gcggucgccacacccgcga

SEQ ID NO: 1209397 - RNA, 19 nt, Mycobacterium bovis subsp bovis AF2122/97
gcggucgaagaccaagagc

SEQ ID NO: 1209398 - RNA, 16 nt, Mycobacterium bovis subsp bovis AF2122/97
gcggucgagccaccca

SEQ ID NO: 1209399 - RNA, 19 nt, Mycobacterium bovis subsp bovis AF2122/97
gcggugccgucagcggcgg

SEQ ID NO: 1209400 - RNA, 15 nt, Mycobacterium bovis subsp bovis AF2122/97
gcggugccgugcuca

SEQ ID NO: 1209401 - RNA, 16 nt, Mycobacterium bovis subsp bovis AF2122/97
gcggugccgugcucac

SEQ ID NO: 1209402 - RNA, 22 nt, Mycobacterium bovis subsp bovis AF2122/97
gcggugccgugcucacggcagg

SEQ ID NO: 1209403 - RNA, 14 nt, Mycobacterium bovis subsp bovis AF2122/97
gcggugccguggug

SEQ ID NO: 1209404 - RNA, 18 nt, Mycobacterium bovis subsp bovis AF2122/97
gcggugccggcggaucug

SEQ ID NO: 1209405 - RNA, 16 nt, Mycobacterium bovis subsp bovis AF2122/97
gcggugccggcggcgc

SEQ ID NO: 1209406 - RNA, 15 nt, Mycobacterium bovis subsp bovis AF2122/97
gcggugcccagcagc

SEQ ID NO: 1209407 - RNA, 15 nt, Mycobacterium bovis subsp bovis AF2122/97
gcggugccugcagcu

SEQ ID NO: 1209408 - RNA, 19 nt, Mycobacterium bovis subsp bovis AF2122/97
gcggugcgcaccaccgagc

SEQ ID NO: 1209409 - RNA, 19 nt, Mycobacterium bovis subsp bovis AF2122/97
gcggugcugguggcggcac

SEQ ID NO: 1209410 - RNA, 15 nt, Mycobacterium bovis subsp bovis AF2122/97
gcggugaggucggug

SEQ ID NO: 1209411 - RNA, 16 nt, Mycobacterium bovis subsp bovis AF2122/97
gcggugcacacugacc

SEQ ID NO: 1209412 - RNA, 18 nt, Mycobacterium bovis subsp bovis AF2122/97
gcggugcaucgccaccac

SEQ ID NO: 1209413 - RNA, 23 nt, Mycobacterium bovis subsp bovis AF2122/97
gcggugcagugccucggcggcgu

SEQ ID NO: 1209414 - RNA, 23 nt, Mycobacterium bovis subsp bovis AF2122/97
gcggugccacggugacccuggug

SEQ ID NO: 1209415 - RNA, 20 nt, Mycobacterium bovis subsp bovis AF2122/97
gcggugacgagccaccaccg

SEQ ID NO: 1209416 - RNA, 18 nt, Mycobacterium bovis subsp bovis AF2122/97
gcggugacgccagccugg

SEQ ID NO: 1209417 - RNA, 14 nt, Mycobacterium bovis subsp bovis AF2122/97
gcggugaccggguu

SEQ ID NO: 1209418 - RNA, 20 nt, Mycobacterium bovis subsp bovis AF2122/97
gcggugacucggccuccgcc

SEQ ID NO: 1209419 - RNA, 15 nt, Mycobacterium bovis subsp bovis AF2122/97
gcggugacggcggca

SEQ ID NO: 1209420 - RNA, 22 nt, Mycobacterium bovis subsp bovis AF2122/97
gcggugacccguucagcgacgg

SEQ ID NO: 1209421 - RNA, 19 nt, Mycobacterium bovis subsp bovis AF2122/97
gcgguuggaucggcggccg

SEQ ID NO: 1209422 - RNA, 14 nt, Mycobacterium bovis subsp bovis AF2122/97
gcgguuggcggcga

SEQ ID NO: 1209423 - RNA, 19 nt, Mycobacterium bovis subsp bovis AF2122/97
gcgguugcccgagcggcug

SEQ ID NO: 1209424 - RNA, 17 nt, Mycobacterium bovis subsp bovis AF2122/97
gcgguucgcugcggcgg

SEQ ID NO: 1209425 - RNA, 16 nt, Mycobacterium bovis subsp bovis AF2122/97
gcgguucgcauugggg

SEQ ID NO: 1209426 - RNA, 21 nt, Mycobacterium bovis subsp bovis AF2122/97
gcgguuagaucacccgcagcc

SEQ ID NO: 1209427 - RNA, 16 nt, Mycobacterium bovis subsp bovis AF2122/97
gcgguuagcagccgcu

SEQ ID NO: 1209428 - RNA, 21 nt, Mycobacterium bovis subsp bovis AF2122/97
gcgguggccgucgggugcagc

SEQ ID NO: 1209429 - RNA, 19 nt, Mycobacterium bovis subsp bovis AF2122/97
gcgguggcggugucggcgc

SEQ ID NO: 1209430 - RNA, 21 nt, Mycobacterium bovis subsp bovis AF2122/97
gcgguggcgucgucggcgggc

SEQ ID NO: 1209431 - RNA, 12 nt, Mycobacterium bovis subsp bovis AF2122/97
gcgguggcggcg

SEQ ID NO: 1209432 - RNA, 15 nt, Mycobacterium bovis subsp bovis AF2122/97
gcggugggcagcagc

SEQ ID NO: 1209433 - RNA, 23 nt, Mycobacterium bovis subsp bovis AF2122/97
gcgguggugccgcggccaccgcc

SEQ ID NO: 1209434 - RNA, 16 nt, Mycobacterium bovis subsp bovis AF2122/97
gcgguggucggcgcgc

SEQ ID NO: 1209435 - RNA, 18 nt, Mycobacterium bovis subsp bovis AF2122/97
gcgguggggcgcgccggc

SEQ ID NO: 1209436 - RNA, 18 nt, Mycobacterium bovis subsp bovis AF2122/97
gcgguguagaagcgggcg

SEQ ID NO: 1209437 - RNA, 22 nt, Mycobacterium bovis subsp bovis AF2122/97
gcgguguagaagcgggcgucgc

SEQ ID NO: 1209438 - RNA, 22 nt, Mycobacterium bovis subsp bovis AF2122/97
gcgguggugguguaggaguaca

SEQ ID NO: 1209439 - RNA, 19 nt, Mycobacterium bovis subsp bovis AF2122/97
gcgguguagccggcgccgc

SEQ ID NO: 1209440 - RNA, 17 nt, Mycobacterium bovis subsp bovis AF2122/97
gcgguguagggcggcgu

SEQ ID NO: 1209441 - RNA, 18 nt, Mycobacterium bovis subsp bovis AF2122/97
gcggugucgucgagguca

SEQ ID NO: 1209442 - RNA, 15 nt, Mycobacterium bovis subsp bovis AF2122/97
gcgguguugccggag

SEQ ID NO: 1209443 - RNA, 19 nt, Mycobacterium bovis subsp bovis AF2122/97
gcguacugguccgcacggu

SEQ ID NO: 1209444 - RNA, 18 nt, Mycobacterium bovis subsp bovis AF2122/97
gcguacucggcauccagg

SEQ ID NO: 1209445 - RNA, 16 nt, Mycobacterium bovis subsp bovis AF2122/97
gcguacucgugaugaa

SEQ ID NO: 1209446 - RNA, 20 nt, Mycobacterium bovis subsp bovis AF2122/97
gcguacaggccggccaccac

SEQ ID NO: 1209447 - RNA, 17 nt, Mycobacterium bovis subsp bovis AF2122/97
gcguaauccgagcgcgg

SEQ ID NO: 1209448 - RNA, 23 nt, Mycobacterium bovis subsp bovis AF2122/97
gcgguuuggaucacccgccgcgu

SEQ ID NO: 1209449 - RNA, 17 nt, Mycobacterium bovis subsp bovis AF2122/97
gcgguuuucggcugccg

SEQ ID NO: 1209450 - RNA, 21 nt, Mycobacterium bovis subsp bovis AF2122/97
gcguaaaggccuugggcggca

SEQ ID NO: 1209451 - RNA, 16 nt, Mycobacterium bovis subsp bovis AF2122/97
gcuaauaccugcggau

SEQ ID NO: 1209452 - RNA, 21 nt, Mycobacterium bovis subsp bovis AF2122/97
gcuaacgcaccugcgcgcggc

SEQ ID NO: 1209453 - RNA, 17 nt, Mycobacterium bovis subsp bovis AF2122/97
gcuaaccgacgcugaag

SEQ ID NO: 1209454 - RNA, 20 nt, Mycobacterium bovis subsp bovis AF2122/97
gcuaacuccccagacaucca

SEQ ID NO: 1209455 - RNA, 15 nt, Mycobacterium bovis subsp bovis AF2122/97
gcuaacuggcccgga

SEQ ID NO: 1209456 - RNA, 21 nt, Mycobacterium bovis subsp bovis AF2122/97
gcuaaccacggugugcuacca

SEQ ID NO: 1209457 - RNA, 15 nt, Mycobacterium bovis subsp bovis AF2122/97
gcuacgccuccuucg

SEQ ID NO: 1209458 - RNA, 13 nt, Mycobacterium bovis subsp bovis AF2122/97
gcuacgccccacu

SEQ ID NO: 1209459 - RNA, 13 nt, Mycobacterium bovis subsp bovis AF2122/97
gcuaccuuggacu

SEQ ID NO: 1209460 - RNA, 15 nt, Mycobacterium bovis subsp bovis AF2122/97
gcuaccuccgccacc

SEQ ID NO: 1209461 - RNA, 16 nt, Mycobacterium bovis subsp bovis AF2122/97
gcuaccuccgccacca

SEQ ID NO: 1209462 - RNA, 20 nt, Mycobacterium bovis subsp bovis AF2122/97
gcuacccggacagggcggcg

SEQ ID NO: 1209463 - RNA, 16 nt, Mycobacterium bovis subsp bovis AF2122/97
gcuacccgggccaggc

SEQ ID NO: 1209464 - RNA, 13 nt, Mycobacterium bovis subsp bovis AF2122/97
gcuaccgccgacc

SEQ ID NO: 1209465 - RNA, 23 nt, Mycobacterium bovis subsp bovis AF2122/97
gcuaccgaacaguaggccuccgc

SEQ ID NO: 1209466 - RNA, 16 nt, Mycobacterium bovis subsp bovis AF2122/97
gcuaccggcagcugcu

SEQ ID NO: 1209467 - RNA, 17 nt, Mycobacterium bovis subsp bovis AF2122/97
gcuaccgcgcucccggc

SEQ ID NO: 1209468 - RNA, 12 nt, Mycobacterium bovis subsp bovis AF2122/97
gcuaccgcccgc

SEQ ID NO: 1209469 - RNA, 19 nt, Mycobacterium bovis subsp bovis AF2122/97
gcuaccgcgcucccggcgu

SEQ ID NO: 1209470 - RNA, 20 nt, Mycobacterium bovis subsp bovis AF2122/97
gcuacgcgaucagcugggca

SEQ ID NO: 1209471 - RNA, 13 nt, Mycobacterium bovis subsp bovis AF2122/97
gcuacgcgcgccc

SEQ ID NO: 1209472 - RNA, 13 nt, Mycobacterium bovis subsp bovis AF2122/97
gcuacgcgcgcuc

SEQ ID NO: 1209473 - RNA, 22 nt, Mycobacterium bovis subsp bovis AF2122/97
gcuacgggccgcgguacccacc

SEQ ID NO: 1209474 - RNA, 20 nt, Mycobacterium bovis subsp bovis AF2122/97
gcuacggcgacacgccagcc

SEQ ID NO: 1209475 - RNA, 13 nt, Mycobacterium bovis subsp bovis AF2122/97
gcuaauugcggcc

SEQ ID NO: 1209476 - RNA, 13 nt, Mycobacterium bovis subsp bovis AF2122/97
gcuacccauggcc

SEQ ID NO: 1209477 - RNA, 18 nt, Mycobacterium bovis subsp bovis AF2122/97
gcuacccauucggcggcg

SEQ ID NO: 1209478 - RNA, 17 nt, Mycobacterium bovis subsp bovis AF2122/97
gcuaccccagccggcag

SEQ ID NO: 1209479 - RNA, 20 nt, Mycobacterium bovis subsp bovis AF2122/97
gcuacccaccggccggugcc

SEQ ID NO: 1209480 - RNA, 23 nt, Mycobacterium bovis subsp bovis AF2122/97
gcuaccagccauagugcggcagc

SEQ ID NO: 1209481 - RNA, 15 nt, Mycobacterium bovis subsp bovis AF2122/97
gcguuggaucccagc

SEQ ID NO: 1209482 - RNA, 18 nt, Mycobacterium bovis subsp bovis AF2122/97
gcguuggaucccagcccg

SEQ ID NO: 1209483 - RNA, 22 nt, Mycobacterium bovis subsp bovis AF2122/97
gcguugcggaaucagcacccca

SEQ ID NO: 1209484 - RNA, 14 nt, Mycobacterium bovis subsp bovis AF2122/97
gcguugccgccggc

SEQ ID NO: 1209485 - RNA, 21 nt, Mycobacterium bovis subsp bovis AF2122/97
gcguugccgccguccccgccg

SEQ ID NO: 1209486 - RNA, 17 nt, Mycobacterium bovis subsp bovis AF2122/97
gcguugccgaaacccga

SEQ ID NO: 1209487 - RNA, 20 nt, Mycobacterium bovis subsp bovis AF2122/97
gcguugucgcccacccacug

SEQ ID NO: 1209488 - RNA, 20 nt, Mycobacterium bovis subsp bovis AF2122/97
gcguugguggucggcccucc

SEQ ID NO: 1209489 - RNA, 20 nt, Mycobacterium bovis subsp bovis AF2122/97
gcguuggcgaucucgacggc

SEQ ID NO: 1209490 - RNA, 12 nt, Mycobacterium bovis subsp bovis AF2122/97
gcguuggcuggu

SEQ ID NO: 1209491 - RNA, 19 nt, Mycobacterium bovis subsp bovis AF2122/97
gcguugggcagcuccacca

SEQ ID NO: 1209492 - RNA, 16 nt, Mycobacterium bovis subsp bovis AF2122/97
gcguugguagccaggg

SEQ ID NO: 1209493 - RNA, 20 nt, Mycobacterium bovis subsp bovis AF2122/97
gcguugaugaccgccgccgg

SEQ ID NO: 1209494 - RNA, 18 nt, Mycobacterium bovis subsp bovis AF2122/97
gcguugacggcggggcgg

SEQ ID NO: 1209495 - RNA, 16 nt, Mycobacterium bovis subsp bovis AF2122/97
gcguugcccuccuucu

SEQ ID NO: 1209496 - RNA, 19 nt, Mycobacterium bovis subsp bovis AF2122/97
gcguugccaggugcuguuu

SEQ ID NO: 1209497 - RNA, 22 nt, Mycobacterium bovis subsp bovis AF2122/97
gcguugcaccauucgcaccggc

SEQ ID NO: 1209498 - RNA, 14 nt, Mycobacterium bovis subsp bovis AF2122/97
gcguugcacagcag

SEQ ID NO: 1209499 - RNA, 18 nt, Mycobacterium bovis subsp bovis AF2122/97
gcguucggucagugggac

SEQ ID NO: 1209500 - RNA, 15 nt, Mycobacterium bovis subsp bovis AF2122/97
gcguuugaggcagcg

SEQ ID NO: 1209501 - RNA, 14 nt, Mycobacterium bovis subsp bovis AF2122/97
gcguuugccggccg

SEQ ID NO: 1209502 - RNA, 19 nt, Mycobacterium bovis subsp bovis AF2122/97
gcguugucggguggcugcu

SEQ ID NO: 1209503 - RNA, 13 nt, Mycobacterium bovis subsp bovis AF2122/97
gcguuguggcuga

SEQ ID NO: 1209504 - RNA, 13 nt, Mycobacterium bovis subsp bovis AF2122/97
gcguggcgccggc

SEQ ID NO: 1209505 - RNA, 22 nt, Mycobacterium bovis subsp bovis AF2122/97
gcguggcgcccgugccgcccgc

SEQ ID NO: 1209506 - RNA, 22 nt, Mycobacterium bovis subsp bovis AF2122/97
gcguggcgcaccaccgccccgc

SEQ ID NO: 1209507 - RNA, 15 nt, Mycobacterium bovis subsp bovis AF2122/97
gcguggcugccuucg

SEQ ID NO: 1209508 - RNA, 23 nt, Mycobacterium bovis subsp bovis AF2122/97
gcguggcuggcaccucccgggcg

SEQ ID NO: 1209509 - RNA, 15 nt, Mycobacterium bovis subsp bovis AF2122/97
gcguggcuggcggcg

SEQ ID NO: 1209510 - RNA, 20 nt, Mycobacterium bovis subsp bovis AF2122/97
gcguggcuucacccaacccc

SEQ ID NO: 1209511 - RNA, 17 nt, Mycobacterium bovis subsp bovis AF2122/97
gcgugguaaccagggca

SEQ ID NO: 1209512 - RNA, 13 nt, Mycobacterium bovis subsp bovis AF2122/97
gcgugggcacuug

SEQ ID NO: 1209513 - RNA, 15 nt, Mycobacterium bovis subsp bovis AF2122/97
gcgugggcgcggcgc

SEQ ID NO: 1209514 - RNA, 17 nt, Mycobacterium bovis subsp bovis AF2122/97
gcguggugaagucggug

SEQ ID NO: 1209515 - RNA, 19 nt, Mycobacterium bovis subsp bovis AF2122/97
gcguguagccugcggcggu

SEQ ID NO: 1209516 - RNA, 16 nt, Mycobacterium bovis subsp bovis AF2122/97
gcgugucugcccgagg

SEQ ID NO: 1209517 - RNA, 18 nt, Mycobacterium bovis subsp bovis AF2122/97
gcguggugcugaccgcgc

SEQ ID NO: 1209518 - RNA, 18 nt, Mycobacterium bovis subsp bovis AF2122/97
gcguggugaagucggugc

SEQ ID NO: 1209519 - RNA, 15 nt, Mycobacterium bovis subsp bovis AF2122/97
gcguguaaccccagg

SEQ ID NO: 1209520 - RNA, 22 nt, Mycobacterium bovis subsp bovis AF2122/97
gcguguggcuuugacugcuggg

SEQ ID NO: 1209521 - RNA, 15 nt, Mycobacterium bovis subsp bovis AF2122/97
gcgugugcgcgugcu

SEQ ID NO: 1209522 - RNA, 22 nt, Mycobacterium bovis subsp bovis AF2122/97
gcguuccugaucgagcgccagc

SEQ ID NO: 1209523 - RNA, 14 nt, Mycobacterium bovis subsp bovis AF2122/97
gcguucccccacuc

SEQ ID NO: 1209524 - RNA, 23 nt, Mycobacterium bovis subsp bovis AF2122/97
gcguucccccacucggacccgca

SEQ ID NO: 1209525 - RNA, 17 nt, Mycobacterium bovis subsp bovis AF2122/97
gcguuccagcacaccca

SEQ ID NO: 1209526 - RNA, 14 nt, Mycobacterium bovis subsp bovis AF2122/97
gcguuccaucgccg

SEQ ID NO: 1209527 - RNA, 16 nt, Mycobacterium bovis subsp bovis AF2122/97
gcguucggcaccuggu

SEQ ID NO: 1209528 - RNA, 17 nt, Mycobacterium bovis subsp bovis AF2122/97
gcguucgccgcccggcg

SEQ ID NO: 1209529 - RNA, 19 nt, Mycobacterium bovis subsp bovis AF2122/97
gcguucagcggccagcagu

SEQ ID NO: 1209530 - RNA, 14 nt, Mycobacterium bovis subsp bovis AF2122/97
gcguuacgccgcga

SEQ ID NO: 1209531 - RNA, 17 nt, Mycobacterium bovis subsp bovis AF2122/97
gcguuagggccgccauc

SEQ ID NO: 1209532 - RNA, 13 nt, Mycobacterium bovis subsp bovis AF2122/97
gcucaccggcgcc

SEQ ID NO: 1209533 - RNA, 14 nt, Mycobacterium bovis subsp bovis AF2122/97
gcucaccggcuggu

SEQ ID NO: 1209534 - RNA, 20 nt, Mycobacterium bovis subsp bovis AF2122/97
gcucaccgcgcaucaucgcc

SEQ ID NO: 1209535 - RNA, 18 nt, Mycobacterium bovis subsp bovis AF2122/97
gcucaccggcuggugcca

SEQ ID NO: 1209536 - RNA, 20 nt, Mycobacterium bovis subsp bovis AF2122/97
gcucaccggcuggugccaac

SEQ ID NO: 1209537 - RNA, 18 nt, Mycobacterium bovis subsp bovis AF2122/97
gcucaccgacgcugacca

SEQ ID NO: 1209538 - RNA, 16 nt, Mycobacterium bovis subsp bovis AF2122/97
gcucacgcuccgccgg

SEQ ID NO: 1209539 - RNA, 13 nt, Mycobacterium bovis subsp bovis AF2122/97
gcucacgguggcc

SEQ ID NO: 1209540 - RNA, 18 nt, Mycobacterium bovis subsp bovis AF2122/97
gcucacggcggaagaagu

SEQ ID NO: 1209541 - RNA, 19 nt, Mycobacterium bovis subsp bovis AF2122/97
gcucaaugaucgcggcggc

SEQ ID NO: 1209542 - RNA, 19 nt, Mycobacterium bovis subsp bovis AF2122/97
gcucaccaaucugcgggcc

SEQ ID NO: 1209543 - RNA, 16 nt, Mycobacterium bovis subsp bovis AF2122/97
gcucacccggagcacc

SEQ ID NO: 1209544 - RNA, 13 nt, Mycobacterium bovis subsp bovis AF2122/97
gcucacccggcgu

SEQ ID NO: 1209545 - RNA, 17 nt, Mycobacterium bovis subsp bovis AF2122/97
gcucacauccggucaga

SEQ ID NO: 1209546 - RNA, 21 nt, Mycobacterium bovis subsp bovis AF2122/97
gcucacauucaacagauccga

SEQ ID NO: 1209547 - RNA, 15 nt, Mycobacterium bovis subsp bovis AF2122/97
gcucaccagcuccuc

SEQ ID NO: 1209548 - RNA, 15 nt, Mycobacterium bovis subsp bovis AF2122/97
gcucacccaggcgcc

SEQ ID NO: 1209549 - RNA, 13 nt, Mycobacterium bovis subsp bovis AF2122/97
gcucagcgcggcc

SEQ ID NO: 1209550 - RNA, 15 nt, Mycobacterium bovis subsp bovis AF2122/97
gcucagcgcgcgccg

SEQ ID NO: 1209551 - RNA, 20 nt, Mycobacterium bovis subsp bovis AF2122/97
gcucagcgugcgcuggcuga

SEQ ID NO: 1209552 - RNA, 22 nt, Mycobacterium bovis subsp bovis AF2122/97
gcucagcuaaaaaccgcugccg

SEQ ID NO: 1209553 - RNA, 17 nt, Mycobacterium bovis subsp bovis AF2122/97
gcucagcuccggcgacu

SEQ ID NO: 1209554 - RNA, 20 nt, Mycobacterium bovis subsp bovis AF2122/97
gcucagcugguggcggcggu

SEQ ID NO: 1209555 - RNA, 20 nt, Mycobacterium bovis subsp bovis AF2122/97
gcucagccggcccugcggcc

SEQ ID NO: 1209556 - RNA, 18 nt, Mycobacterium bovis subsp bovis AF2122/97
gcucacuucacgccgccc

SEQ ID NO: 1209557 - RNA, 15 nt, Mycobacterium bovis subsp bovis AF2122/97
gcucagaccggcgcc

SEQ ID NO: 1209558 - RNA, 20 nt, Mycobacterium bovis subsp bovis AF2122/97
gcucaugcgagucgucccag

SEQ ID NO: 1209559 - RNA, 14 nt, Mycobacterium bovis subsp bovis AF2122/97
gcuccaccaggacg

SEQ ID NO: 1209560 - RNA, 22 nt, Mycobacterium bovis subsp bovis AF2122/97
gcuccaccgggcccgccggccc

SEQ ID NO: 1209561 - RNA, 17 nt, Mycobacterium bovis subsp bovis AF2122/97
gcucauuagcccccgcg

SEQ ID NO: 1209562 - RNA, 17 nt, Mycobacterium bovis subsp bovis AF2122/97
gcucauucgugcccggg

SEQ ID NO: 1209563 - RNA, 14 nt, Mycobacterium bovis subsp bovis AF2122/97
gcucagguucagcu

SEQ ID NO: 1209564 - RNA, 22 nt, Mycobacterium bovis subsp bovis AF2122/97
gcucagguucagcuugaugucu

SEQ ID NO: 1209565 - RNA, 14 nt, Mycobacterium bovis subsp bovis AF2122/97
gcucagugaccugu

SEQ ID NO: 1209566 - RNA, 17 nt, Mycobacterium bovis subsp bovis AF2122/97
gcucagugaugcgcccc

SEQ ID NO: 1209567 - RNA, 16 nt, Mycobacterium bovis subsp bovis AF2122/97
gcucagggugcgccgc

SEQ ID NO: 1209568 - RNA, 23 nt, Mycobacterium bovis subsp bovis AF2122/97
gcucaggggcuacuaggcccagc

SEQ ID NO: 1209569 - RNA, 17 nt, Mycobacterium bovis subsp bovis AF2122/97
gcucagggugcgccgca

SEQ ID NO: 1209570 - RNA, 19 nt, Mycobacterium bovis subsp bovis AF2122/97
gcucagggugcgccgcagc

SEQ ID NO: 1209571 - RNA, 19 nt, Mycobacterium bovis subsp bovis AF2122/97
gcucaggucaccggccgcc

SEQ ID NO: 1209572 - RNA, 20 nt, Mycobacterium bovis subsp bovis AF2122/97
gcucaggucaccggccgccg

SEQ ID NO: 1209573 - RNA, 12 nt, Mycobacterium bovis subsp bovis AF2122/97
gcucagggcagu

SEQ ID NO: 1209574 - RNA, 19 nt, Mycobacterium bovis subsp bovis AF2122/97
gcuccacguacgcggcugc

SEQ ID NO: 1209575 - RNA, 14 nt, Mycobacterium bovis subsp bovis AF2122/97
gcuccaccgggccc

SEQ ID NO: 1209576 - RNA, 21 nt, Mycobacterium bovis subsp bovis AF2122/97
gcuccacuuggggcgccaggg

SEQ ID NO: 1209577 - RNA, 21 nt, Mycobacterium bovis subsp bovis AF2122/97
gcuccagcugagcggccggca

SEQ ID NO: 1209578 - RNA, 16 nt, Mycobacterium bovis subsp bovis AF2122/97
gcuccccgucggggaa

SEQ ID NO: 1209579 - RNA, 17 nt, Mycobacterium bovis subsp bovis AF2122/97
gcuccagguagagucca

SEQ ID NO: 1209580 - RNA, 21 nt, Mycobacterium bovis subsp bovis AF2122/97
gcucaaaucaugcgauucugc

SEQ ID NO: 1209581 - RNA, 22 nt, Mycobacterium bovis subsp bovis AF2122/97
gcucaacaccgaguuccucugc

SEQ ID NO: 1209582 - RNA, 21 nt, Mycobacterium bovis subsp bovis AF2122/97
gcucaacggcgaaaguccugc

SEQ ID NO: 1209583 - RNA, 20 nt, Mycobacterium bovis subsp bovis AF2122/97
gcucaacggcgacaucggcc

SEQ ID NO: 1209584 - RNA, 20 nt, Mycobacterium bovis subsp bovis AF2122/97
gcucaaccucuggcggcggg

SEQ ID NO: 1209585 - RNA, 15 nt, Mycobacterium bovis subsp bovis AF2122/97
gcucaagcgcgucgu

SEQ ID NO: 1209586 - RNA, 18 nt, Mycobacterium bovis subsp bovis AF2122/97
gcucaaggcuucggcggc

SEQ ID NO: 1209587 - RNA, 15 nt, Mycobacterium bovis subsp bovis AF2122/97
gcuauucgccagcgc

SEQ ID NO: 1209588 - RNA, 16 nt, Mycobacterium bovis subsp bovis AF2122/97
gcuauucgccagcgcc

SEQ ID NO: 1209589 - RNA, 16 nt, Mycobacterium bovis subsp bovis AF2122/97
gcuaugaugccgccgg

SEQ ID NO: 1209590 - RNA, 23 nt, Mycobacterium bovis subsp bovis AF2122/97
gcuaugcgccgcaugccaccgag

SEQ ID NO: 1209591 - RNA, 16 nt, Mycobacterium bovis subsp bovis AF2122/97
gcuauccggcggccag

SEQ ID NO: 1209592 - RNA, 22 nt, Mycobacterium bovis subsp bovis AF2122/97
gcuaucgugcgccgacggugca

SEQ ID NO: 1209593 - RNA, 12 nt, Mycobacterium bovis subsp bovis AF2122/97
gcuaucgcagaa

SEQ ID NO: 1209594 - RNA, 14 nt, Mycobacterium bovis subsp bovis AF2122/97
gcuaucaugaccac

SEQ ID NO: 1209595 - RNA, 15 nt, Mycobacterium bovis subsp bovis AF2122/97
gcuagcuuggcggcc

SEQ ID NO: 1209596 - RNA, 20 nt, Mycobacterium bovis subsp bovis AF2122/97
gcuagccgggcgcgccggcc

SEQ ID NO: 1209597 - RNA, 18 nt, Mycobacterium bovis subsp bovis AF2122/97
gcuaggaccgcgguggcc

SEQ ID NO: 1209598 - RNA, 18 nt, Mycobacterium bovis subsp bovis AF2122/97
gcuagguauugccgcaga

SEQ ID NO: 1209599 - RNA, 17 nt, Mycobacterium bovis subsp bovis AF2122/97
gcuaggucaguucccag

SEQ ID NO: 1209600 - RNA, 21 nt, Mycobacterium bovis subsp bovis AF2122/97
gcuaggucaguucccagacca

SEQ ID NO: 1209601 - RNA, 16 nt, Mycobacterium bovis subsp bovis AF2122/97
gcuaggugacgccgcc

SEQ ID NO: 1209602 - RNA, 20 nt, Mycobacterium bovis subsp bovis AF2122/97
gcuagucggggugggacagg

SEQ ID NO: 1209603 - RNA, 20 nt, Mycobacterium bovis subsp bovis AF2122/97
gcuagugcgggccgugaccc

SEQ ID NO: 1209604 - RNA, 16 nt, Mycobacterium bovis subsp bovis AF2122/97
gcuagcgccgcgcuug

SEQ ID NO: 1209605 - RNA, 14 nt, Mycobacterium bovis subsp bovis AF2122/97
gcucgcgcgcuggg

SEQ ID NO: 1209606 - RNA, 16 nt, Mycobacterium bovis subsp bovis AF2122/97
gcucgcgcgcugggcg

SEQ ID NO: 1209607 - RNA, 14 nt, Mycobacterium bovis subsp bovis AF2122/97
gcucgcggcgcagg

SEQ ID NO: 1209608 - RNA, 16 nt, Mycobacterium bovis subsp bovis AF2122/97
gcucgcggcggcgcug

SEQ ID NO: 1209609 - RNA, 13 nt, Mycobacterium bovis subsp bovis AF2122/97
gcucggcccagcg

SEQ ID NO: 1209610 - RNA, 19 nt, Mycobacterium bovis subsp bovis AF2122/97
gcucggccgaugcgcagug

SEQ ID NO: 1209611 - RNA, 14 nt, Mycobacterium bovis subsp bovis AF2122/97
gcucggccgcagcc

SEQ ID NO: 1209612 - RNA, 20 nt, Mycobacterium bovis subsp bovis AF2122/97
gcucggccuguucggcggcu

SEQ ID NO: 1209613 - RNA, 14 nt, Mycobacterium bovis subsp bovis AF2122/97
gcucggcgcagcua

SEQ ID NO: 1209614 - RNA, 12 nt, Mycobacterium bovis subsp bovis AF2122/97
gcucggcgcagc

SEQ ID NO: 1209615 - RNA, 18 nt, Mycobacterium bovis subsp bovis AF2122/97
gcucggcgcagcacaucc

SEQ ID NO: 1209616 - RNA, 20 nt, Mycobacterium bovis subsp bovis AF2122/97
gcucggcgaucugcguuugg

SEQ ID NO: 1209617 - RNA, 12 nt, Mycobacterium bovis subsp bovis AF2122/97
gcucggcaggcc

SEQ ID NO: 1209618 - RNA, 14 nt, Mycobacterium bovis subsp bovis AF2122/97
gcucggauccggcc

SEQ ID NO: 1209619 - RNA, 15 nt, Mycobacterium bovis subsp bovis AF2122/97
gcucggccaggcugg

SEQ ID NO: 1209620 - RNA, 22 nt, Mycobacterium bovis subsp bovis AF2122/97
gcucggccauagcgccgcgccc

SEQ ID NO: 1209621 - RNA, 21 nt, Mycobacterium bovis subsp bovis AF2122/97
gcucgcggcuucaguccggcc

SEQ ID NO: 1209622 - RNA, 21 nt, Mycobacterium bovis subsp bovis AF2122/97
gcucggaguugagcugucgca

SEQ ID NO: 1209623 - RNA, 19 nt, Mycobacterium bovis subsp bovis AF2122/97
gcucggcgucgccgccauu

SEQ ID NO: 1209624 - RNA, 16 nt, Mycobacterium bovis subsp bovis AF2122/97
gcucggcggugcagug

SEQ ID NO: 1209625 - RNA, 15 nt, Mycobacterium bovis subsp bovis AF2122/97
gcucggcggcccggc

SEQ ID NO: 1209626 - RNA, 15 nt, Mycobacterium bovis subsp bovis AF2122/97
gcucgggcgcacggu

SEQ ID NO: 1209627 - RNA, 18 nt, Mycobacterium bovis subsp bovis AF2122/97
gcucgguuugcguccugg

SEQ ID NO: 1209628 - RNA, 20 nt, Mycobacterium bovis subsp bovis AF2122/97
gcucgguuugcguccuggug

SEQ ID NO: 1209629 - RNA, 14 nt, Mycobacterium bovis subsp bovis AF2122/97
gcucguagcccagg

SEQ ID NO: 1209630 - RNA, 17 nt, Mycobacterium bovis subsp bovis AF2122/97
gcucguagcggcggcgc

SEQ ID NO: 1209631 - RNA, 17 nt, Mycobacterium bovis subsp bovis AF2122/97
gcucguagacuugcugc

SEQ ID NO: 1209632 - RNA, 14 nt, Mycobacterium bovis subsp bovis AF2122/97
gcucguagcuggug

SEQ ID NO: 1209633 - RNA, 16 nt, Mycobacterium bovis subsp bovis AF2122/97
gcucguuccggcgguc

SEQ ID NO: 1209634 - RNA, 17 nt, Mycobacterium bovis subsp bovis AF2122/97
gcucgucauccauccgg

SEQ ID NO: 1209635 - RNA, 23 nt, Mycobacterium bovis subsp bovis AF2122/97
gcucgucacgugucccgcaugca

SEQ ID NO: 1209636 - RNA, 20 nt, Mycobacterium bovis subsp bovis AF2122/97
gcucguccaagccggccacg

SEQ ID NO: 1209637 - RNA, 23 nt, Mycobacterium bovis subsp bovis AF2122/97
gcucguccaccccgauccgccac

SEQ ID NO: 1209638 - RNA, 12 nt, Mycobacterium bovis subsp bovis AF2122/97
gcucguugcguu

SEQ ID NO: 1209639 - RNA, 17 nt, Mycobacterium bovis subsp bovis AF2122/97
gcucguucgugcagccc

SEQ ID NO: 1209640 - RNA, 22 nt, Mycobacterium bovis subsp bovis AF2122/97
gcucugcgaccucgccggacgg

SEQ ID NO: 1209641 - RNA, 18 nt, Mycobacterium bovis subsp bovis AF2122/97
gcucugcgccacagcagc

SEQ ID NO: 1209642 - RNA, 20 nt, Mycobacterium bovis subsp bovis AF2122/97
gcucugagcuuggucgccgg

SEQ ID NO: 1209643 - RNA, 16 nt, Mycobacterium bovis subsp bovis AF2122/97
gcucucacgagcggcg

SEQ ID NO: 1209644 - RNA, 17 nt, Mycobacterium bovis subsp bovis AF2122/97
gcucucauagcgacggc

SEQ ID NO: 1209645 - RNA, 19 nt, Mycobacterium bovis subsp bovis AF2122/97
gcucucuucgcgcgcuggg

SEQ ID NO: 1209646 - RNA, 22 nt, Mycobacterium bovis subsp bovis AF2122/97
gcucuguagcgucgcacccagg

SEQ ID NO: 1209647 - RNA, 22 nt, Mycobacterium bovis subsp bovis AF2122/97
gcucuugcgggcagccgcccgc

SEQ ID NO: 1209648 - RNA, 15 nt, Mycobacterium bovis subsp bovis AF2122/97
gcugacuccugcggc

SEQ ID NO: 1209649 - RNA, 16 nt, Mycobacterium bovis subsp bovis AF2122/97
gcugacgugucggcug

SEQ ID NO: 1209650 - RNA, 14 nt, Mycobacterium bovis subsp bovis AF2122/97
gcugacggugggga

SEQ ID NO: 1209651 - RNA, 16 nt, Mycobacterium bovis subsp bovis AF2122/97
gcugagcggccggcau

SEQ ID NO: 1209652 - RNA, 18 nt, Mycobacterium bovis subsp bovis AF2122/97
gcugaggaagcggcggca

SEQ ID NO: 1209653 - RNA, 16 nt, Mycobacterium bovis subsp bovis AF2122/97
gcugaggaacgccggc

SEQ ID NO: 1209654 - RNA, 21 nt, Mycobacterium bovis subsp bovis AF2122/97
gcugagcucgaugucagcggc

SEQ ID NO: 1209655 - RNA, 16 nt, Mycobacterium bovis subsp bovis AF2122/97
gcugagcugcucgccg

SEQ ID NO: 1209656 - RNA, 18 nt, Mycobacterium bovis subsp bovis AF2122/97
gcugagcugcucgccggc

SEQ ID NO: 1209657 - RNA, 19 nt, Mycobacterium bovis subsp bovis AF2122/97
gcugagcugcucgccggcc

SEQ ID NO: 1209658 - RNA, 18 nt, Mycobacterium bovis subsp bovis AF2122/97
gcugagcuggcagcuccu

SEQ ID NO: 1209659 - RNA, 12 nt, Mycobacterium bovis subsp bovis AF2122/97
gcugagggugga

SEQ ID NO: 1209660 - RNA, 21 nt, Mycobacterium bovis subsp bovis AF2122/97
gcugaguccccaggugggcag

SEQ ID NO: 1209661 - RNA, 22 nt, Mycobacterium bovis subsp bovis AF2122/97
gcugaguccccaggugggcagc

SEQ ID NO: 1209662 - RNA, 24 nt, Mycobacterium bovis subsp bovis AF2122/97
gcugagucgguucagccacgcagc

SEQ ID NO: 1209663 - RNA, 14 nt, Mycobacterium bovis subsp bovis AF2122/97
gcugagucgugaca

SEQ ID NO: 1209664 - RNA, 19 nt, Mycobacterium bovis subsp bovis AF2122/97
gcugagucgugacaaccau

SEQ ID NO: 1209665 - RNA, 21 nt, Mycobacterium bovis subsp bovis AF2122/97
gcugaccgcgccggacagcgc

SEQ ID NO: 1209666 - RNA, 22 nt, Mycobacterium bovis subsp bovis AF2122/97
gcugaccgcuaccagcugggcg

SEQ ID NO: 1209667 - RNA, 19 nt, Mycobacterium bovis subsp bovis AF2122/97
gcugaccggggcgcccggc

SEQ ID NO: 1209668 - RNA, 16 nt, Mycobacterium bovis subsp bovis AF2122/97
gcugaccggggucggc

SEQ ID NO: 1209669 - RNA, 23 nt, Mycobacterium bovis subsp bovis AF2122/97
gcugaccggcuauuagcggcuug

SEQ ID NO: 1209670 - RNA, 17 nt, Mycobacterium bovis subsp bovis AF2122/97
gcugacgggccgcugug

SEQ ID NO: 1209671 - RNA, 14 nt, Mycobacterium bovis subsp bovis AF2122/97
gcugaccgaagagc

SEQ ID NO: 1209672 - RNA, 21 nt, Mycobacterium bovis subsp bovis AF2122/97
gcugaccgccagcggccgcuc

SEQ ID NO: 1209673 - RNA, 14 nt, Mycobacterium bovis subsp bovis AF2122/97
gcugaccaucacac

SEQ ID NO: 1209674 - RNA, 22 nt, Mycobacterium bovis subsp bovis AF2122/97
gcugaccaucacacccaucacc

SEQ ID NO: 1209675 - RNA, 22 nt, Mycobacterium bovis subsp bovis AF2122/97
gcugaccaugaccgggcuggcc

SEQ ID NO: 1209676 - RNA, 14 nt, Mycobacterium bovis subsp bovis AF2122/97
gcugaccccgccgg

SEQ ID NO: 1209677 - RNA, 21 nt, Mycobacterium bovis subsp bovis AF2122/97
gcugaccccgccggcugcgga

SEQ ID NO: 1209678 - RNA, 18 nt, Mycobacterium bovis subsp bovis AF2122/97
gcugacccgggccgggcc

SEQ ID NO: 1209679 - RNA, 17 nt, Mycobacterium bovis subsp bovis AF2122/97
gcugaaaauaggccggg

SEQ ID NO: 1209680 - RNA, 14 nt, Mycobacterium bovis subsp bovis AF2122/97
gcucuuugagugcc

SEQ ID NO: 1209681 - RNA, 14 nt, Mycobacterium bovis subsp bovis AF2122/97
gcugccccgccacc

SEQ ID NO: 1209682 - RNA, 16 nt, Mycobacterium bovis subsp bovis AF2122/97
gcugccccgccaccuc

SEQ ID NO: 1209683 - RNA, 13 nt, Mycobacterium bovis subsp bovis AF2122/97
gcugcccgccagc

SEQ ID NO: 1209684 - RNA, 16 nt, Mycobacterium bovis subsp bovis AF2122/97
gcugcccgccagcgcc

SEQ ID NO: 1209685 - RNA, 12 nt, Mycobacterium bovis subsp bovis AF2122/97
gcugcccgccgc

SEQ ID NO: 1209686 - RNA, 16 nt, Mycobacterium bovis subsp bovis AF2122/97
gcugcccgggcugccg

SEQ ID NO: 1209687 - RNA, 19 nt, Mycobacterium bovis subsp bovis AF2122/97
gcugcccgggcugccgccc

SEQ ID NO: 1209688 - RNA, 18 nt, Mycobacterium bovis subsp bovis AF2122/97
gcugcccaaaagcgcggc

SEQ ID NO: 1209689 - RNA, 20 nt, Mycobacterium bovis subsp bovis AF2122/97
gcugcccaaaaggaagaccu

SEQ ID NO: 1209690 - RNA, 14 nt, Mycobacterium bovis subsp bovis AF2122/97
gcugcccaaaagcg

SEQ ID NO: 1209691 - RNA, 17 nt, Mycobacterium bovis subsp bovis AF2122/97
gcugcccacgggccggc

SEQ ID NO: 1209692 - RNA, 15 nt, Mycobacterium bovis subsp bovis AF2122/97
gcugcccaucccggc

SEQ ID NO: 1209693 - RNA, 13 nt, Mycobacterium bovis subsp bovis AF2122/97
gcugcccaugcgg

SEQ ID NO: 1209694 - RNA, 22 nt, Mycobacterium bovis subsp bovis AF2122/97
gcugcccaugguggcgaucugg

SEQ ID NO: 1209695 - RNA, 19 nt, Mycobacterium bovis subsp bovis AF2122/97
gcugcauccgcagcaccaa

SEQ ID NO: 1209696 - RNA, 22 nt, Mycobacterium bovis subsp bovis AF2122/97
gcugccagugccgcccaccaca

SEQ ID NO: 1209697 - RNA, 17 nt, Mycobacterium bovis subsp bovis AF2122/97
gcugccagggugcgccg

SEQ ID NO: 1209698 - RNA, 16 nt, Mycobacterium bovis subsp bovis AF2122/97
gcugcauguuaugggu

SEQ ID NO: 1209699 - RNA, 13 nt, Mycobacterium bovis subsp bovis AF2122/97
gcugccauugccg

SEQ ID NO: 1209700 - RNA, 12 nt, Mycobacterium bovis subsp bovis AF2122/97
gcugcccaaaag

SEQ ID NO: 1209701 - RNA, 12 nt, Mycobacterium bovis subsp bovis AF2122/97
gcugccaugcgg

SEQ ID NO: 1209702 - RNA, 18 nt, Mycobacterium bovis subsp bovis AF2122/97
gcugccaucggcaccagc

SEQ ID NO: 1209703 - RNA, 20 nt, Mycobacterium bovis subsp bovis AF2122/97
gcugccaucggcaccagcgc

SEQ ID NO: 1209704 - RNA, 22 nt, Mycobacterium bovis subsp bovis AF2122/97
gcugcaccguuuccggcgcucc

SEQ ID NO: 1209705 - RNA, 22 nt, Mycobacterium bovis subsp bovis AF2122/97
gcugcaccuccgacggccgcgg

SEQ ID NO: 1209706 - RNA, 14 nt, Mycobacterium bovis subsp bovis AF2122/97
gcugcaccagcugc

SEQ ID NO: 1209707 - RNA, 21 nt, Mycobacterium bovis subsp bovis AF2122/97
gcugcaccggcuugggccagg

SEQ ID NO: 1209708 - RNA, 22 nt, Mycobacterium bovis subsp bovis AF2122/97
gcugcacccggagaaucggucc

SEQ ID NO: 1209709 - RNA, 21 nt, Mycobacterium bovis subsp bovis AF2122/97
gcugcagugacucgaucacca

SEQ ID NO: 1209710 - RNA, 13 nt, Mycobacterium bovis subsp bovis AF2122/97
gcugcagggccug

SEQ ID NO: 1209711 - RNA, 15 nt, Mycobacterium bovis subsp bovis AF2122/97
gcugcagggccuggc

SEQ ID NO: 1209712 - RNA, 16 nt, Mycobacterium bovis subsp bovis AF2122/97
gcugcagguccagggu

SEQ ID NO: 1209713 - RNA, 20 nt, Mycobacterium bovis subsp bovis AF2122/97
gcugauggacggugcgcagg

SEQ ID NO: 1209714 - RNA, 14 nt, Mycobacterium bovis subsp bovis AF2122/97
gcugaugcgcuggg

SEQ ID NO: 1209715 - RNA, 19 nt, Mycobacterium bovis subsp bovis AF2122/97
gcugaugcgcugggccagg

SEQ ID NO: 1209716 - RNA, 22 nt, Mycobacterium bovis subsp bovis AF2122/97
gcugaucuuggcaagccaagcg

SEQ ID NO: 1209717 - RNA, 19 nt, Mycobacterium bovis subsp bovis AF2122/97
gcugaugaaacgccgucgc

SEQ ID NO: 1209718 - RNA, 17 nt, Mycobacterium bovis subsp bovis AF2122/97
gcuggugggaggggacc

SEQ ID NO: 1209719 - RNA, 15 nt, Mycobacterium bovis subsp bovis AF2122/97
gcuggugggccggac

SEQ ID NO: 1209720 - RNA, 15 nt, Mycobacterium bovis subsp bovis AF2122/97
gcuggugugcgggug

SEQ ID NO: 1209721 - RNA, 18 nt, Mycobacterium bovis subsp bovis AF2122/97
gcugguguccagccaggc

SEQ ID NO: 1209722 - RNA, 14 nt, Mycobacterium bovis subsp bovis AF2122/97
gcugguugugcugg

SEQ ID NO: 1209723 - RNA, 20 nt, Mycobacterium bovis subsp bovis AF2122/97
gcugguugccuuugcggcgg

SEQ ID NO: 1209724 - RNA, 13 nt, Mycobacterium bovis subsp bovis AF2122/97
gcugguucaacac

SEQ ID NO: 1209725 - RNA, 17 nt, Mycobacterium bovis subsp bovis AF2122/97
gcugguugaacaugucc

SEQ ID NO: 1209726 - RNA, 16 nt, Mycobacterium bovis subsp bovis AF2122/97
gcuguaacacccggcc

SEQ ID NO: 1209727 - RNA, 18 nt, Mycobacterium bovis subsp bovis AF2122/97
gcugguggcgccaucccc

SEQ ID NO: 1209728 - RNA, 19 nt, Mycobacterium bovis subsp bovis AF2122/97
aaagcuugggcgaucguca

SEQ ID NO: 1209729 - RNA, 15 nt, Mycobacterium bovis subsp bovis AF2122/97
gcugucgaaguuggu

SEQ ID NO: 1209730 - RNA, 20 nt, Mycobacterium bovis subsp bovis AF2122/97
gcugucgacgucggcaaucu

SEQ ID NO: 1209731 - RNA, 21 nt, Mycobacterium bovis subsp bovis AF2122/97
gcuguacucgcggcgcggccg

SEQ ID NO: 1209732 - RNA, 19 nt, Mycobacterium bovis subsp bovis AF2122/97
gcuguacugccccagcaca

SEQ ID NO: 1209733 - RNA, 17 nt, Mycobacterium bovis subsp bovis AF2122/97
gcuguacugcggugcca

SEQ ID NO: 1209734 - RNA, 17 nt, Mycobacterium bovis subsp bovis AF2122/97
gcuguccgcgggccgcg

SEQ ID NO: 1209735 - RNA, 14 nt, Mycobacterium bovis subsp bovis AF2122/97
gcugucggcuuccu

SEQ ID NO: 1209736 - RNA, 14 nt, Mycobacterium bovis subsp bovis AF2122/97
gcuggcggcgcagc

SEQ ID NO: 1209737 - RNA, 14 nt, Mycobacterium bovis subsp bovis AF2122/97
gcuggcuacccacc

SEQ ID NO: 1209738 - RNA, 24 nt, Mycobacterium bovis subsp bovis AF2122/97
gcuggcuagcagguacucgcccca

SEQ ID NO: 1209739 - RNA, 23 nt, Mycobacterium bovis subsp bovis AF2122/97
gcuggcugccacgaacgcuucca

SEQ ID NO: 1209740 - RNA, 17 nt, Mycobacterium bovis subsp bovis AF2122/97
gcuggcggguugguccc

SEQ ID NO: 1209741 - RNA, 21 nt, Mycobacterium bovis subsp bovis AF2122/97
gcugggcccgagcgcgcgcug

SEQ ID NO: 1209742 - RNA, 21 nt, Mycobacterium bovis subsp bovis AF2122/97
gcugggcaucaucagcggcgc

SEQ ID NO: 1209743 - RNA, 13 nt, Mycobacterium bovis subsp bovis AF2122/97
gcugggaggcgcg

SEQ ID NO: 1209744 - RNA, 22 nt, Mycobacterium bovis subsp bovis AF2122/97
gcugggaucggauuuuccgccu

SEQ ID NO: 1209745 - RNA, 17 nt, Mycobacterium bovis subsp bovis AF2122/97
gcugggacgggcgcguc

SEQ ID NO: 1209746 - RNA, 13 nt, Mycobacterium bovis subsp bovis AF2122/97
gcugggaaagcau

SEQ ID NO: 1209747 - RNA, 15 nt, Mycobacterium bovis subsp bovis AF2122/97
gcuggcuucucgcag

SEQ ID NO: 1209748 - RNA, 14 nt, Mycobacterium bovis subsp bovis AF2122/97
gcuggcuguggcug

SEQ ID NO: 1209749 - RNA, 16 nt, Mycobacterium bovis subsp bovis AF2122/97
gcuggcuguggcugaa

SEQ ID NO: 1209750 - RNA, 21 nt, Mycobacterium bovis subsp bovis AF2122/97
gcuggcugaccgaauggccgc

SEQ ID NO: 1209751 - RNA, 16 nt, Mycobacterium bovis subsp bovis AF2122/97
gcugggcgccaccauc

SEQ ID NO: 1209752 - RNA, 21 nt, Mycobacterium bovis subsp bovis AF2122/97
gcugggccggggaggcuaggc

SEQ ID NO: 1209753 - RNA, 15 nt, Mycobacterium bovis subsp bovis AF2122/97
gcuggggccccgcgc

SEQ ID NO: 1209754 - RNA, 14 nt, Mycobacterium bovis subsp bovis AF2122/97
gcuggggcgcccga

SEQ ID NO: 1209755 - RNA, 15 nt, Mycobacterium bovis subsp bovis AF2122/97
gcugggugaccagga

SEQ ID NO: 1209756 - RNA, 16 nt, Mycobacterium bovis subsp bovis AF2122/97
gcugcggugccggccc

SEQ ID NO: 1209757 - RNA, 17 nt, Mycobacterium bovis subsp bovis AF2122/97
gcugcggugggccaggu

SEQ ID NO: 1209758 - RNA, 23 nt, Mycobacterium bovis subsp bovis AF2122/97
gcugcggggcgauccccagcacc

SEQ ID NO: 1209759 - RNA, 20 nt, Mycobacterium bovis subsp bovis AF2122/97
gcugcgucgucugcagaccu

SEQ ID NO: 1209760 - RNA, 14 nt, Mycobacterium bovis subsp bovis AF2122/97
gcugcucgccggcc

SEQ ID NO: 1209761 - RNA, 20 nt, Mycobacterium bovis subsp bovis AF2122/97
gcugcucgagcagaucagca

SEQ ID NO: 1209762 - RNA, 14 nt, Mycobacterium bovis subsp bovis AF2122/97
gcugcguccggaac

SEQ ID NO: 1209763 - RNA, 23 nt, Mycobacterium bovis subsp bovis AF2122/97
gcugccgaacaguucggcgagca

SEQ ID NO: 1209764 - RNA, 19 nt, Mycobacterium bovis subsp bovis AF2122/97
gcugcggauacagccgccg

SEQ ID NO: 1209765 - RNA, 20 nt, Mycobacterium bovis subsp bovis AF2122/97
gcugcggauacagccgccgc

SEQ ID NO: 1209766 - RNA, 21 nt, Mycobacterium bovis subsp bovis AF2122/97
gcugcggauacagccgccgcc

SEQ ID NO: 1209767 - RNA, 18 nt, Mycobacterium bovis subsp bovis AF2122/97
gcugcggaucacagugau

SEQ ID NO: 1209768 - RNA, 22 nt, Mycobacterium bovis subsp bovis AF2122/97
gcugcggauuaagucggcggcc

SEQ ID NO: 1209769 - RNA, 21 nt, Mycobacterium bovis subsp bovis AF2122/97
gcugcggccagcgcggcgcgc

SEQ ID NO: 1209770 - RNA, 23 nt, Mycobacterium bovis subsp bovis AF2122/97
gcugcggcccacaccagcgcagc

SEQ ID NO: 1209771 - RNA, 18 nt, Mycobacterium bovis subsp bovis AF2122/97
gcugcggcgcuggccagc

SEQ ID NO: 1209772 - RNA, 19 nt, Mycobacterium bovis subsp bovis AF2122/97
gcugcggcuuggccaucac

SEQ ID NO: 1209773 - RNA, 13 nt, Mycobacterium bovis subsp bovis AF2122/97
gcugcggcggcuu

SEQ ID NO: 1209774 - RNA, 16 nt, Mycobacterium bovis subsp bovis AF2122/97
gcugcuuauuggucuc

SEQ ID NO: 1209775 - RNA, 19 nt, Mycobacterium bovis subsp bovis AF2122/97
gcugcugccgcaccggugc

SEQ ID NO: 1209776 - RNA, 20 nt, Mycobacterium bovis subsp bovis AF2122/97
gcugcucggucaggcggcug

SEQ ID NO: 1209777 - RNA, 21 nt, Mycobacterium bovis subsp bovis AF2122/97
gcugcucuccgucgcgcacgg

SEQ ID NO: 1209778 - RNA, 21 nt, Mycobacterium bovis subsp bovis AF2122/97
gcugcucgucuuggcggcggu

SEQ ID NO: 1209779 - RNA, 22 nt, Mycobacterium bovis subsp bovis AF2122/97
gcugcucgugagccccagcgac

SEQ ID NO: 1209780 - RNA, 21 nt, Mycobacterium bovis subsp bovis AF2122/97
gcugcucuggacggucauccg

SEQ ID NO: 1209781 - RNA, 21 nt, Mycobacterium bovis subsp bovis AF2122/97
gcugcuucuucggacagcagc

SEQ ID NO: 1209782 - RNA, 19 nt, Mycobacterium bovis subsp bovis AF2122/97
gcugcuugcgcccggccug

SEQ ID NO: 1209783 - RNA, 22 nt, Mycobacterium bovis subsp bovis AF2122/97
gcugcuuggucgcccagccacu

SEQ ID NO: 1209784 - RNA, 21 nt, Mycobacterium bovis subsp bovis AF2122/97
gcuggacuaucgccgcgcguc

SEQ ID NO: 1209785 - RNA, 14 nt, Mycobacterium bovis subsp bovis AF2122/97
gcuggacggcgggc

SEQ ID NO: 1209786 - RNA, 22 nt, Mycobacterium bovis subsp bovis AF2122/97
gcuggacggcgggccgcgcggc

SEQ ID NO: 1209787 - RNA, 16 nt, Mycobacterium bovis subsp bovis AF2122/97
gcuggcgccggccagc

SEQ ID NO: 1209788 - RNA, 21 nt, Mycobacterium bovis subsp bovis AF2122/97
gcuggcgccccaggugguuca

SEQ ID NO: 1209789 - RNA, 22 nt, Mycobacterium bovis subsp bovis AF2122/97
gcuggcggaacuugccggugcg

SEQ ID NO: 1209790 - RNA, 22 nt, Mycobacterium bovis subsp bovis AF2122/97
gcuggcgaacucgaggucgagc

SEQ ID NO: 1209791 - RNA, 21 nt, Mycobacterium bovis subsp bovis AF2122/97
gcuggcgaaggacaacagccg

SEQ ID NO: 1209792 - RNA, 22 nt, Mycobacterium bovis subsp bovis AF2122/97
gcuggcgaccuggucgcuggug

SEQ ID NO: 1209793 - RNA, 14 nt, Mycobacterium bovis subsp bovis AF2122/97
gcuggcgcaaccaa

SEQ ID NO: 1209794 - RNA, 15 nt, Mycobacterium bovis subsp bovis AF2122/97
gcuggccggcaccgu

SEQ ID NO: 1209795 - RNA, 17 nt, Mycobacterium bovis subsp bovis AF2122/97
gcuggcccgcaugccgg

SEQ ID NO: 1209796 - RNA, 22 nt, Mycobacterium bovis subsp bovis AF2122/97
gcuggccaccuuagcgcuugcc

SEQ ID NO: 1209797 - RNA, 14 nt, Mycobacterium bovis subsp bovis AF2122/97
gcuggccacgaucc

SEQ ID NO: 1209798 - RNA, 19 nt, Mycobacterium bovis subsp bovis AF2122/97
gcuggccaugguggcgccg

SEQ ID NO: 1209799 - RNA, 18 nt, Mycobacterium bovis subsp bovis AF2122/97
gcuggcccagcgaccagu

SEQ ID NO: 1209800 - RNA, 18 nt, Mycobacterium bovis subsp bovis AF2122/97
gcuggccagcugcggcuc

SEQ ID NO: 1209801 - RNA, 14 nt, Mycobacterium bovis subsp bovis AF2122/97
gcuggccagcgcgc

SEQ ID NO: 1209802 - RNA, 13 nt, Mycobacterium bovis subsp bovis AF2122/97
gcuggcaggccgg

SEQ ID NO: 1209803 - RNA, 15 nt, Mycobacterium bovis subsp bovis AF2122/97
gcuggcaggccgggc

SEQ ID NO: 1209804 - RNA, 19 nt, Mycobacterium bovis subsp bovis AF2122/97
gcuggcaggccgggcacca

SEQ ID NO: 1209805 - RNA, 13 nt, Mycobacterium bovis subsp bovis AF2122/97
gcuggcagcgacu

SEQ ID NO: 1209806 - RNA, 16 nt, Mycobacterium bovis subsp bovis AF2122/97
gcuggcagcuccucgc

SEQ ID NO: 1209807 - RNA, 12 nt, Mycobacterium bovis subsp bovis AF2122/97
gcuggcagacuc

SEQ ID NO: 1209808 - RNA, 12 nt, Mycobacterium bovis subsp bovis AF2122/97
gcuggaggccac

SEQ ID NO: 1209809 - RNA, 17 nt, Mycobacterium bovis subsp bovis AF2122/97
gcuggaggcggcgccug

SEQ ID NO: 1209810 - RNA, 21 nt, Mycobacterium bovis subsp bovis AF2122/97
gcuggaucaacccggccuucu

SEQ ID NO: 1209811 - RNA, 17 nt, Mycobacterium bovis subsp bovis AF2122/97
gcuuuuacgucugcucg

SEQ ID NO: 1209812 - RNA, 22 nt, Mycobacterium bovis subsp bovis AF2122/97
gcuuugucaccggcuucggcca

SEQ ID NO: 1209813 - RNA, 20 nt, Mycobacterium bovis subsp bovis AF2122/97
gcuuucgcgugcggcugcca

SEQ ID NO: 1209814 - RNA, 18 nt, Mycobacterium bovis subsp bovis AF2122/97
gcugugguaggccggugc

SEQ ID NO: 1209815 - RNA, 13 nt, Mycobacterium bovis subsp bovis AF2122/97
gcuguggccgcgu

SEQ ID NO: 1209816 - RNA, 12 nt, Mycobacterium bovis subsp bovis AF2122/97
gcuguggcucga

SEQ ID NO: 1209817 - RNA, 19 nt, Mycobacterium bovis subsp bovis AF2122/97
gcuguggccagcaucauca

SEQ ID NO: 1209818 - RNA, 17 nt, Mycobacterium bovis subsp bovis AF2122/97
gcugugccccagggcag

SEQ ID NO: 1209819 - RNA, 13 nt, Mycobacterium bovis subsp bovis AF2122/97
gcugugauagcgc

SEQ ID NO: 1209820 - RNA, 19 nt, Mycobacterium bovis subsp bovis AF2122/97
gcugugccccagggcagug

SEQ ID NO: 1209821 - RNA, 20 nt, Mycobacterium bovis subsp bovis AF2122/97
gcuuucuuggcgggcgccuu

SEQ ID NO: 1209822 - RNA, 14 nt, Mycobacterium bovis subsp bovis AF2122/97
ggaaacaagcaagc

SEQ ID NO: 1209823 - RNA, 13 nt, Mycobacterium bovis subsp bovis AF2122/97
ggaaaagcccgga

SEQ ID NO: 1209824 - RNA, 22 nt, Mycobacterium bovis subsp bovis AF2122/97
ggaaaccgccccgugggccucg

SEQ ID NO: 1209825 - RNA, 22 nt, Mycobacterium bovis subsp bovis AF2122/97
ggaaaccucuucgggugcagcc

SEQ ID NO: 1209826 - RNA, 16 nt, Mycobacterium bovis subsp bovis AF2122/97
ggaaacccggccagcu

SEQ ID NO: 1209827 - RNA, 19 nt, Mycobacterium bovis subsp bovis AF2122/97
ggaaacccggccagcugcg

SEQ ID NO: 1209828 - RNA, 16 nt, Mycobacterium bovis subsp bovis AF2122/97
ggaaacggagccgagc

SEQ ID NO: 1209829 - RNA, 11 nt, Mycobacterium bovis subsp bovis AF2122/97
ggaaagcucuc

SEQ ID NO: 1209830 - RNA, 22 nt, Mycobacterium bovis subsp bovis AF2122/97
ggaaauacuuuggaugcccgua

SEQ ID NO: 1209831 - RNA, 14 nt, Mycobacterium bovis subsp bovis AF2122/97
ggaaaugaaguggc

SEQ ID NO: 1209832 - RNA, 19 nt, Mycobacterium bovis subsp bovis AF2122/97
ggaaauggcgucgccggca

SEQ ID NO: 1209833 - RNA, 13 nt, Mycobacterium bovis subsp bovis AF2122/97
ggaaaugucuccu

SEQ ID NO: 1209834 - RNA, 20 nt, Mycobacterium bovis subsp bovis AF2122/97
ggaaggggcucagcgguggc

SEQ ID NO: 1209835 - RNA, 19 nt, Mycobacterium bovis subsp bovis AF2122/97
ggaaggcccaccauggcug

SEQ ID NO: 1209836 - RNA, 14 nt, Mycobacterium bovis subsp bovis AF2122/97
ggaaggcggccagg

SEQ ID NO: 1209837 - RNA, 18 nt, Mycobacterium bovis subsp bovis AF2122/97
ggaagaucucggccagga

SEQ ID NO: 1209838 - RNA, 22 nt, Mycobacterium bovis subsp bovis AF2122/97
ggaagauuucugggccgcucca

SEQ ID NO: 1209839 - RNA, 16 nt, Mycobacterium bovis subsp bovis AF2122/97
ggaacuggaccacagc

SEQ ID NO: 1209840 - RNA, 12 nt, Mycobacterium bovis subsp bovis AF2122/97
ggaacgccggca

SEQ ID NO: 1209841 - RNA, 14 nt, Mycobacterium bovis subsp bovis AF2122/97
ggaacgccucaggg

SEQ ID NO: 1209842 - RNA, 20 nt, Mycobacterium bovis subsp bovis AF2122/97
ggaacuguaggucacagcug

SEQ ID NO: 1209843 - RNA, 21 nt, Mycobacterium bovis subsp bovis AF2122/97
ggaaccuugaccgaccagcug

SEQ ID NO: 1209844 - RNA, 16 nt, Mycobacterium bovis subsp bovis AF2122/97
ggaaccggcgugcagc

SEQ ID NO: 1209845 - RNA, 16 nt, Mycobacterium bovis subsp bovis AF2122/97
ggaaccgggcaaauca

SEQ ID NO: 1209846 - RNA, 18 nt, Mycobacterium bovis subsp bovis AF2122/97
ggaaccgggcaaaucaag

SEQ ID NO: 1209847 - RNA, 18 nt, Mycobacterium bovis subsp bovis AF2122/97
ggaacccccagcugcagg

SEQ ID NO: 1209848 - RNA, 23 nt, Mycobacterium bovis subsp bovis AF2122/97
ggaacccgaaucccacagcagga

SEQ ID NO: 1209849 - RNA, 14 nt, Mycobacterium bovis subsp bovis AF2122/97
ggaaauuccaagcg

SEQ ID NO: 1209850 - RNA, 17 nt, Mycobacterium bovis subsp bovis AF2122/97
ggaagaagagguuggcg

SEQ ID NO: 1209851 - RNA, 21 nt, Mycobacterium bovis subsp bovis AF2122/97
ggaagaacucguugagcagcu

SEQ ID NO: 1209852 - RNA, 18 nt, Mycobacterium bovis subsp bovis AF2122/97
ggaagaaaccgcagucgc

SEQ ID NO: 1209853 - RNA, 16 nt, Mycobacterium bovis subsp bovis AF2122/97
ggaacuugccggugcg

SEQ ID NO: 1209854 - RNA, 17 nt, Mycobacterium bovis subsp bovis AF2122/97
ggaacuugugccgggcg

SEQ ID NO: 1209855 - RNA, 18 nt, Mycobacterium bovis subsp bovis AF2122/97
ggaagaccucgaccugga

SEQ ID NO: 1209856 - RNA, 14 nt, Mycobacterium bovis subsp bovis AF2122/97
ggaagacggugcgg

SEQ ID NO: 1209857 - RNA, 19 nt, Mycobacterium bovis subsp bovis AF2122/97
ggaagacuuagcgggugcc

SEQ ID NO: 1209858 - RNA, 22 nt, Mycobacterium bovis subsp bovis AF2122/97
ggaccagugcgguggcagguga

SEQ ID NO: 1209859 - RNA, 11 nt, Mycobacterium bovis subsp bovis AF2122/97
ggaccagcgcc

SEQ ID NO: 1209860 - RNA, 16 nt, Mycobacterium bovis subsp bovis AF2122/97
ggaccaucgccaggcc

SEQ ID NO: 1209861 - RNA, 19 nt, Mycobacterium bovis subsp bovis AF2122/97
ggacccaccgucacccccg

SEQ ID NO: 1209862 - RNA, 17 nt, Mycobacterium bovis subsp bovis AF2122/97
ggacccagccagcugga

SEQ ID NO: 1209863 - RNA, 20 nt, Mycobacterium bovis subsp bovis AF2122/97
ggaccaccgcauaacgccag

SEQ ID NO: 1209864 - RNA, 16 nt, Mycobacterium bovis subsp bovis AF2122/97
ggaccacagccgcgcc

SEQ ID NO: 1209865 - RNA, 21 nt, Mycobacterium bovis subsp bovis AF2122/97
ggaccaccacuaggucgccgg

SEQ ID NO: 1209866 - RNA, 14 nt, Mycobacterium bovis subsp bovis AF2122/97
ggaccaccagcgcu

SEQ ID NO: 1209867 - RNA, 17 nt, Mycobacterium bovis subsp bovis AF2122/97
ggaccaccagcgcucca

SEQ ID NO: 1209868 - RNA, 12 nt, Mycobacterium bovis subsp bovis AF2122/97
ggaccacggcgu

SEQ ID NO: 1209869 - RNA, 23 nt, Mycobacterium bovis subsp bovis AF2122/97
ggaccacuaguucgagcugccag

SEQ ID NO: 1209870 - RNA, 14 nt, Mycobacterium bovis subsp bovis AF2122/97
ggaccagaggcgcu

SEQ ID NO: 1209871 - RNA, 16 nt, Mycobacterium bovis subsp bovis AF2122/97
ggaccagcgccccggc

SEQ ID NO: 1209872 - RNA, 14 nt, Mycobacterium bovis subsp bovis AF2122/97
ggacccgcccaggc

SEQ ID NO: 1209873 - RNA, 12 nt, Mycobacterium bovis subsp bovis AF2122/97
ggacccgcagcu

SEQ ID NO: 1209874 - RNA, 14 nt, Mycobacterium bovis subsp bovis AF2122/97
ggacccaucgccag

SEQ ID NO: 1209875 - RNA, 18 nt, Mycobacterium bovis subsp bovis AF2122/97
ggacccaugagcccguga

SEQ ID NO: 1209876 - RNA, 13 nt, Mycobacterium bovis subsp bovis AF2122/97
ggaccccgccagc

SEQ ID NO: 1209877 - RNA, 20 nt, Mycobacterium bovis subsp bovis AF2122/97
ggaccucggcgaccugcucg

SEQ ID NO: 1209878 - RNA, 20 nt, Mycobacterium bovis subsp bovis AF2122/97
ggaccucgaagcccagcacc

SEQ ID NO: 1209879 - RNA, 18 nt, Mycobacterium bovis subsp bovis AF2122/97
ggaaucgcggagccagga

SEQ ID NO: 1209880 - RNA, 15 nt, Mycobacterium bovis subsp bovis AF2122/97
ggaauccuggccgcc

SEQ ID NO: 1209881 - RNA, 16 nt, Mycobacterium bovis subsp bovis AF2122/97
ggacagggugcgcuug

SEQ ID NO: 1209882 - RNA, 15 nt, Mycobacterium bovis subsp bovis AF2122/97
ggaaucgguuucgac

SEQ ID NO: 1209883 - RNA, 22 nt, Mycobacterium bovis subsp bovis AF2122/97
ggacagggugggggcaucaggg

SEQ ID NO: 1209884 - RNA, 16 nt, Mycobacterium bovis subsp bovis AF2122/97
ggacagguagucgccg

SEQ ID NO: 1209885 - RNA, 18 nt, Mycobacterium bovis subsp bovis AF2122/97
ggacaggucgcccaacac

SEQ ID NO: 1209886 - RNA, 20 nt, Mycobacterium bovis subsp bovis AF2122/97
ggacaguuccccgggcucgg

SEQ ID NO: 1209887 - RNA, 23 nt, Mycobacterium bovis subsp bovis AF2122/97
ggaccaacgccaacgccacggca

SEQ ID NO: 1209888 - RNA, 20 nt, Mycobacterium bovis subsp bovis AF2122/97
ggacauccgcuuacgggugu

SEQ ID NO: 1209889 - RNA, 20 nt, Mycobacterium bovis subsp bovis AF2122/97
ggacauccgggccgagcgca

SEQ ID NO: 1209890 - RNA, 23 nt, Mycobacterium bovis subsp bovis AF2122/97
ggacaucugacgcuuggccaggu

SEQ ID NO: 1209891 - RNA, 16 nt, Mycobacterium bovis subsp bovis AF2122/97
ggacggccaacagggc

SEQ ID NO: 1209892 - RNA, 16 nt, Mycobacterium bovis subsp bovis AF2122/97
ggacgcgagugcguga

SEQ ID NO: 1209893 - RNA, 21 nt, Mycobacterium bovis subsp bovis AF2122/97
ggacgccuugcacaagcugaa

SEQ ID NO: 1209894 - RNA, 17 nt, Mycobacterium bovis subsp bovis AF2122/97
ggacgcgaaauccccug

SEQ ID NO: 1209895 - RNA, 17 nt, Mycobacterium bovis subsp bovis AF2122/97
ggacgccgcgccgcaga

SEQ ID NO: 1209896 - RNA, 13 nt, Mycobacterium bovis subsp bovis AF2122/97
ggacgccagcaau

SEQ ID NO: 1209897 - RNA, 21 nt, Mycobacterium bovis subsp bovis AF2122/97
ggacgccagcucaaccacaug

SEQ ID NO: 1209898 - RNA, 22 nt, Mycobacterium bovis subsp bovis AF2122/97
ggaccugcgucaucgcggguga

SEQ ID NO: 1209899 - RNA, 23 nt, Mycobacterium bovis subsp bovis AF2122/97
ggacgauggcgucggccaggauc

SEQ ID NO: 1209900 - RNA, 12 nt, Mycobacterium bovis subsp bovis AF2122/97
ggacggccucca

SEQ ID NO: 1209901 - RNA, 21 nt, Mycobacterium bovis subsp bovis AF2122/97
ggacgggaugcuuggucucga

SEQ ID NO: 1209902 - RNA, 20 nt, Mycobacterium bovis subsp bovis AF2122/97
ggacgggguacugcggcucg

SEQ ID NO: 1209903 - RNA, 16 nt, Mycobacterium bovis subsp bovis AF2122/97
ggacggugcgcagggc

SEQ ID NO: 1209904 - RNA, 18 nt, Mycobacterium bovis subsp bovis AF2122/97
ggacgggaucgcccaggc

SEQ ID NO: 1209905 - RNA, 12 nt, Mycobacterium bovis subsp bovis AF2122/97
ggacgggcggcc

SEQ ID NO: 1209906 - RNA, 22 nt, Mycobacterium bovis subsp bovis AF2122/97
ggacgugcccgguguucaucac

SEQ ID NO: 1209907 - RNA, 19 nt, Mycobacterium bovis subsp bovis AF2122/97
ggacguuugagaccccaac

SEQ ID NO: 1209908 - RNA, 14 nt, Mycobacterium bovis subsp bovis AF2122/97
ggacguucuggauc

SEQ ID NO: 1209909 - RNA, 14 nt, Mycobacterium bovis subsp bovis AF2122/97
ggacucacgcagcg

SEQ ID NO: 1209910 - RNA, 17 nt, Mycobacterium bovis subsp bovis AF2122/97
ggagaacgcccgcagga

SEQ ID NO: 1209911 - RNA, 23 nt, Mycobacterium bovis subsp bovis AF2122/97
ggagaauuaguuucguccccaga

SEQ ID NO: 1209912 - RNA, 12 nt, Mycobacterium bovis subsp bovis AF2122/97
ggaggcugggcu

SEQ ID NO: 1209913 - RNA, 13 nt, Mycobacterium bovis subsp bovis AF2122/97
ggaggcagcgcga

SEQ ID NO: 1209914 - RNA, 17 nt, Mycobacterium bovis subsp bovis AF2122/97
ggaggggacccagcggc

SEQ ID NO: 1209915 - RNA, 12 nt, Mycobacterium bovis subsp bovis AF2122/97
ggagggcgagca

SEQ ID NO: 1209916 - RNA, 18 nt, Mycobacterium bovis subsp bovis AF2122/97
ggagggcccggccggacg

SEQ ID NO: 1209917 - RNA, 17 nt, Mycobacterium bovis subsp bovis AF2122/97
ggagggccgcgaucgac

SEQ ID NO: 1209918 - RNA, 12 nt, Mycobacterium bovis subsp bovis AF2122/97
ggaggcaagcaa

SEQ ID NO: 1209919 - RNA, 14 nt, Mycobacterium bovis subsp bovis AF2122/97
ggaggccgccgcgc

SEQ ID NO: 1209920 - RNA, 20 nt, Mycobacterium bovis subsp bovis AF2122/97
ggaggccaacccugcggcgu

SEQ ID NO: 1209921 - RNA, 14 nt, Mycobacterium bovis subsp bovis AF2122/97
ggaggcaagcaacc

SEQ ID NO: 1209922 - RNA, 14 nt, Mycobacterium bovis subsp bovis AF2122/97
ggagcgggccagca

SEQ ID NO: 1209923 - RNA, 16 nt, Mycobacterium bovis subsp bovis AF2122/97
ggagcggguggccggg

SEQ ID NO: 1209924 - RNA, 20 nt, Mycobacterium bovis subsp bovis AF2122/97
ggagcucacgccgggugugg

SEQ ID NO: 1209925 - RNA, 21 nt, Mycobacterium bovis subsp bovis AF2122/97
ggagcgugucggccggccagg

SEQ ID NO: 1209926 - RNA, 16 nt, Mycobacterium bovis subsp bovis AF2122/97
ggagcucuugcgggca

SEQ ID NO: 1209927 - RNA, 19 nt, Mycobacterium bovis subsp bovis AF2122/97
ggagcucuugcgggcagcc

SEQ ID NO: 1209928 - RNA, 14 nt, Mycobacterium bovis subsp bovis AF2122/97
ggagcugcggcggc

SEQ ID NO: 1209929 - RNA, 19 nt, Mycobacterium bovis subsp bovis AF2122/97
ggagcugggcugauggacg

SEQ ID NO: 1209930 - RNA, 15 nt, Mycobacterium bovis subsp bovis AF2122/97
ggagcucgcggcgca

SEQ ID NO: 1209931 - RNA, 17 nt, Mycobacterium bovis subsp bovis AF2122/97
ggaggacaccagcugga

SEQ ID NO: 1209932 - RNA, 15 nt, Mycobacterium bovis subsp bovis AF2122/97
ggaggaaccccgcgc

SEQ ID NO: 1209933 - RNA, 15 nt, Mycobacterium bovis subsp bovis AF2122/97
ggagaugucgaucag

SEQ ID NO: 1209934 - RNA, 22 nt, Mycobacterium bovis subsp bovis AF2122/97
ggagccgugcggucgcgcccuc

SEQ ID NO: 1209935 - RNA, 23 nt, Mycobacterium bovis subsp bovis AF2122/97
ggagcgcaaguugagcagcuugg

SEQ ID NO: 1209936 - RNA, 18 nt, Mycobacterium bovis subsp bovis AF2122/97
ggagcgcaggaccugacg

SEQ ID NO: 1209937 - RNA, 15 nt, Mycobacterium bovis subsp bovis AF2122/97
ggagcgccagccgcu

SEQ ID NO: 1209938 - RNA, 15 nt, Mycobacterium bovis subsp bovis AF2122/97
ggagcggcugcggca

SEQ ID NO: 1209939 - RNA, 17 nt, Mycobacterium bovis subsp bovis AF2122/97
ggagcggcugcacgccu

SEQ ID NO: 1209940 - RNA, 21 nt, Mycobacterium bovis subsp bovis AF2122/97
ggagcggaauggcgccggccg

SEQ ID NO: 1209941 - RNA, 24 nt, Mycobacterium bovis subsp bovis AF2122/97
ggagcggaauggcgccggccggcg

SEQ ID NO: 1209942 - RNA, 20 nt, Mycobacterium bovis subsp bovis AF2122/97
ggagccgugcggucgcgccc

SEQ ID NO: 1209943 - RNA, 18 nt, Mycobacterium bovis subsp bovis AF2122/97
ggagauccaccgguccag

SEQ ID NO: 1209944 - RNA, 13 nt, Mycobacterium bovis subsp bovis AF2122/97
ggagauccagggc

SEQ ID NO: 1209945 - RNA, 21 nt, Mycobacterium bovis subsp bovis AF2122/97
ggagauccaccgguccagggc

SEQ ID NO: 1209946 - RNA, 19 nt, Mycobacterium bovis subsp bovis AF2122/97
ggagacacccgccaggccg

SEQ ID NO: 1209947 - RNA, 15 nt, Mycobacterium bovis subsp bovis AF2122/97
ggauccgcugcggcc

SEQ ID NO: 1209948 - RNA, 15 nt, Mycobacterium bovis subsp bovis AF2122/97
ggauccggaagcccu

SEQ ID NO: 1209949 - RNA, 16 nt, Mycobacterium bovis subsp bovis AF2122/97
ggauccgauccgcaca

SEQ ID NO: 1209950 - RNA, 17 nt, Mycobacterium bovis subsp bovis AF2122/97
ggauccgaccccgcgcc

SEQ ID NO: 1209951 - RNA, 17 nt, Mycobacterium bovis subsp bovis AF2122/97
ggauccgaagagccagc

SEQ ID NO: 1209952 - RNA, 18 nt, Mycobacterium bovis subsp bovis AF2122/97
ggauccgaagagccagca

SEQ ID NO: 1209953 - RNA, 15 nt, Mycobacterium bovis subsp bovis AF2122/97
ggauccgggagucga

SEQ ID NO: 1209954 - RNA, 17 nt, Mycobacterium bovis subsp bovis AF2122/97
ggauccggcagcagccg

SEQ ID NO: 1209955 - RNA, 20 nt, Mycobacterium bovis subsp bovis AF2122/97
ggaucagcgaguggucccgu

SEQ ID NO: 1209956 - RNA, 19 nt, Mycobacterium bovis subsp bovis AF2122/97
ggaucccagugccagugcc

SEQ ID NO: 1209957 - RNA, 15 nt, Mycobacterium bovis subsp bovis AF2122/97
ggaucccgcugcacg

SEQ ID NO: 1209958 - RNA, 14 nt, Mycobacterium bovis subsp bovis AF2122/97
ggaucaccaucgcc

SEQ ID NO: 1209959 - RNA, 19 nt, Mycobacterium bovis subsp bovis AF2122/97
ggaucacaccccaggcacc

SEQ ID NO: 1209960 - RNA, 19 nt, Mycobacterium bovis subsp bovis AF2122/97
ggauaucagcaacagcagg

SEQ ID NO: 1209961 - RNA, 23 nt, Mycobacterium bovis subsp bovis AF2122/97
ggauagguggucuuggcgguggc

SEQ ID NO: 1209962 - RNA, 23 nt, Mycobacterium bovis subsp bovis AF2122/97
ggaggguucgccgaagccggacc

SEQ ID NO: 1209963 - RNA, 13 nt, Mycobacterium bovis subsp bovis AF2122/97
ggaggugccggcg

SEQ ID NO: 1209964 - RNA, 14 nt, Mycobacterium bovis subsp bovis AF2122/97
ggagguggcgcggg

SEQ ID NO: 1209965 - RNA, 21 nt, Mycobacterium bovis subsp bovis AF2122/97
ggaguagccgcagcugagccg

SEQ ID NO: 1209966 - RNA, 15 nt, Mycobacterium bovis subsp bovis AF2122/97
ggagucaccagcaac

SEQ ID NO: 1209967 - RNA, 18 nt, Mycobacterium bovis subsp bovis AF2122/97
ggagucaccagcaacagc

SEQ ID NO: 1209968 - RNA, 20 nt, Mycobacterium bovis subsp bovis AF2122/97
ggagucgacccugcccagca

SEQ ID NO: 1209969 - RNA, 17 nt, Mycobacterium bovis subsp bovis AF2122/97
ggagucgguaucggcag

SEQ ID NO: 1209970 - RNA, 15 nt, Mycobacterium bovis subsp bovis AF2122/97
ggagucgucgagcug

SEQ ID NO: 1209971 - RNA, 23 nt, Mycobacterium bovis subsp bovis AF2122/97
ggagucgucggcaugggccggcg

SEQ ID NO: 1209972 - RNA, 21 nt, Mycobacterium bovis subsp bovis AF2122/97
ggagucuucggcgacaggccg

SEQ ID NO: 1209973 - RNA, 15 nt, Mycobacterium bovis subsp bovis AF2122/97
ggagugaggcugugc

SEQ ID NO: 1209974 - RNA, 17 nt, Mycobacterium bovis subsp bovis AF2122/97
ggagugaggcugugccc

SEQ ID NO: 1209975 - RNA, 21 nt, Mycobacterium bovis subsp bovis AF2122/97
ggagugaggcugugccccagg

SEQ ID NO: 1209976 - RNA, 22 nt, Mycobacterium bovis subsp bovis AF2122/97
ggagugcgccggcuggcggccu

SEQ ID NO: 1209977 - RNA, 17 nt, Mycobacterium bovis subsp bovis AF2122/97
ggauaguucaccacaug

SEQ ID NO: 1209978 - RNA, 18 nt, Mycobacterium bovis subsp bovis AF2122/97
ggauaguuuucggccgcc

SEQ ID NO: 1209979 - RNA, 14 nt, Mycobacterium bovis subsp bovis AF2122/97
ggauagcagugcag

SEQ ID NO: 1209980 - RNA, 16 nt, Mycobacterium bovis subsp bovis AF2122/97
ggauagccucggcggc

SEQ ID NO: 1209981 - RNA, 18 nt, Mycobacterium bovis subsp bovis AF2122/97
ggccagcgcgccacgagc

SEQ ID NO: 1209982 - RNA, 11 nt, Mycobacterium bovis subsp bovis AF2122/97
ggccagcgcau

SEQ ID NO: 1209983 - RNA, 22 nt, Mycobacterium bovis subsp bovis AF2122/97
ggccagcgaugugaaccgggca

SEQ ID NO: 1209984 - RNA, 23 nt, Mycobacterium bovis subsp bovis AF2122/97
ggccagcgcaucuuugaacgcca

SEQ ID NO: 1209985 - RNA, 17 nt, Mycobacterium bovis subsp bovis AF2122/97
ggccagcgagaucagca

SEQ ID NO: 1209986 - RNA, 15 nt, Mycobacterium bovis subsp bovis AF2122/97
ggccagccuaccggc

SEQ ID NO: 1209987 - RNA, 14 nt, Mycobacterium bovis subsp bovis AF2122/97
ggccagcccgagcu

SEQ ID NO: 1209988 - RNA, 13 nt, Mycobacterium bovis subsp bovis AF2122/97
ggccagccgcggc

SEQ ID NO: 1209989 - RNA, 15 nt, Mycobacterium bovis subsp bovis AF2122/97
ggccagccgcacggu

SEQ ID NO: 1209990 - RNA, 17 nt, Mycobacterium bovis subsp bovis AF2122/97
ggccagccgacgcggcg

SEQ ID NO: 1209991 - RNA, 19 nt, Mycobacterium bovis subsp bovis AF2122/97
ggccagccgacgcggcggg

SEQ ID NO: 1209992 - RNA, 14 nt, Mycobacterium bovis subsp bovis AF2122/97
ggccagccagcggg

SEQ ID NO: 1209993 - RNA, 20 nt, Mycobacterium bovis subsp bovis AF2122/97
ggccagcaugucgggccgcu

SEQ ID NO: 1209994 - RNA, 16 nt, Mycobacterium bovis subsp bovis AF2122/97
ggccagcaucgggugg

SEQ ID NO: 1209995 - RNA, 18 nt, Mycobacterium bovis subsp bovis AF2122/97
ggccagccacuccucggu

SEQ ID NO: 1209996 - RNA, 23 nt, Mycobacterium bovis subsp bovis AF2122/97
ggccacugagucugauggccucg

SEQ ID NO: 1209997 - RNA, 13 nt, Mycobacterium bovis subsp bovis AF2122/97
ggccagcagcagc

SEQ ID NO: 1209998 - RNA, 15 nt, Mycobacterium bovis subsp bovis AF2122/97
ggccagcagccgcga

SEQ ID NO: 1209999 - RNA, 14 nt, Mycobacterium bovis subsp bovis AF2122/97
ggccagcagccgcg

SEQ ID NO: 1210000 - RNA, 15 nt, Mycobacterium bovis subsp bovis AF2122/97
ggccagcagcgcggg

SEQ ID NO: 1210001 - RNA, 20 nt, Mycobacterium bovis subsp bovis AF2122/97
ggccagcagggccaccacca

SEQ ID NO: 1210002 - RNA, 14 nt, Mycobacterium bovis subsp bovis AF2122/97
ggccagcaucauca

SEQ ID NO: 1210003 - RNA, 21 nt, Mycobacterium bovis subsp bovis AF2122/97
ggccacucacauuggccaggu

SEQ ID NO: 1210004 - RNA, 14 nt, Mycobacterium bovis subsp bovis AF2122/97
ggccacucccagcc

SEQ ID NO: 1210005 - RNA, 20 nt, Mycobacterium bovis subsp bovis AF2122/97
ggccacggcgucggccaccc

SEQ ID NO: 1210006 - RNA, 16 nt, Mycobacterium bovis subsp bovis AF2122/97
ggccacguccugcccg

SEQ ID NO: 1210007 - RNA, 17 nt, Mycobacterium bovis subsp bovis AF2122/97
ggccacggucagccagg

SEQ ID NO: 1210008 - RNA, 22 nt, Mycobacterium bovis subsp bovis AF2122/97
ggccacguagcagcagacgacg

SEQ ID NO: 1210009 - RNA, 16 nt, Mycobacterium bovis subsp bovis AF2122/97
ggccacgguccggccc

SEQ ID NO: 1210010 - RNA, 19 nt, Mycobacterium bovis subsp bovis AF2122/97
ggccacgguccggcccacc

SEQ ID NO: 1210011 - RNA, 14 nt, Mycobacterium bovis subsp bovis AF2122/97
ggccaccccgaccu

SEQ ID NO: 1210012 - RNA, 16 nt, Mycobacterium bovis subsp bovis AF2122/97
ggccaccaguccgaug

SEQ ID NO: 1210013 - RNA, 17 nt, Mycobacterium bovis subsp bovis AF2122/97
ggccaccgaacgcggcc

SEQ ID NO: 1210014 - RNA, 17 nt, Mycobacterium bovis subsp bovis AF2122/97
ggccaccgcaucgccga

SEQ ID NO: 1210015 - RNA, 15 nt, Mycobacterium bovis subsp bovis AF2122/97
ggccacggcgucggc

SEQ ID NO: 1210016 - RNA, 19 nt, Mycobacterium bovis subsp bovis AF2122/97
ggccacggcgucggccacc

SEQ ID NO: 1210017 - RNA, 24 nt, Mycobacterium bovis subsp bovis AF2122/97
ggccagugaaaccaccggccgucc

SEQ ID NO: 1210018 - RNA, 19 nt, Mycobacterium bovis subsp bovis AF2122/97
ggccaucagaaccuccucg

SEQ ID NO: 1210019 - RNA, 17 nt, Mycobacterium bovis subsp bovis AF2122/97
ggccagguguugacgau

SEQ ID NO: 1210020 - RNA, 22 nt, Mycobacterium bovis subsp bovis AF2122/97
ggccauguagccguugccgccg

SEQ ID NO: 1210021 - RNA, 16 nt, Mycobacterium bovis subsp bovis AF2122/97
ggccaugucagcggcc

SEQ ID NO: 1210022 - RNA, 15 nt, Mycobacterium bovis subsp bovis AF2122/97
ggccaucgacgacac

SEQ ID NO: 1210023 - RNA, 17 nt, Mycobacterium bovis subsp bovis AF2122/97
ggccaucgaguccacca

SEQ ID NO: 1210024 - RNA, 13 nt, Mycobacterium bovis subsp bovis AF2122/97
ggccaucccggcc

SEQ ID NO: 1210025 - RNA, 18 nt, Mycobacterium bovis subsp bovis AF2122/97
ggccaucgggauggacac

SEQ ID NO: 1210026 - RNA, 23 nt, Mycobacterium bovis subsp bovis AF2122/97
ggccaucgggauggacaccaccu

SEQ ID NO: 1210027 - RNA, 22 nt, Mycobacterium bovis subsp bovis AF2122/97
ggccaucgccgacacccucggg

SEQ ID NO: 1210028 - RNA, 20 nt, Mycobacterium bovis subsp bovis AF2122/97
ggccaucgcauccccagcac

SEQ ID NO: 1210029 - RNA, 22 nt, Mycobacterium bovis subsp bovis AF2122/97
ggccaucgcauccccagcacaa

SEQ ID NO: 1210030 - RNA, 12 nt, Mycobacterium bovis subsp bovis AF2122/97
ggccagcgcggc

SEQ ID NO: 1210031 - RNA, 15 nt, Mycobacterium bovis subsp bovis AF2122/97
ggccagcgcucaccg

SEQ ID NO: 1210032 - RNA, 17 nt, Mycobacterium bovis subsp bovis AF2122/97
ggccagcgcucaccggc

SEQ ID NO: 1210033 - RNA, 14 nt, Mycobacterium bovis subsp bovis AF2122/97
ggccagcgcugcug

SEQ ID NO: 1210034 - RNA, 19 nt, Mycobacterium bovis subsp bovis AF2122/97
ggccagcgcuucgucggcc

SEQ ID NO: 1210035 - RNA, 22 nt, Mycobacterium bovis subsp bovis AF2122/97
ggccagcgcggcgcgcggggcc

SEQ ID NO: 1210036 - RNA, 18 nt, Mycobacterium bovis subsp bovis AF2122/97
ggccagcggcagccuggc

SEQ ID NO: 1210037 - RNA, 21 nt, Mycobacterium bovis subsp bovis AF2122/97
ggccagcggccauccggcggc

SEQ ID NO: 1210038 - RNA, 16 nt, Mycobacterium bovis subsp bovis AF2122/97
ggccaggccgucggcg

SEQ ID NO: 1210039 - RNA, 16 nt, Mycobacterium bovis subsp bovis AF2122/97
ggccaggccggcggcg

SEQ ID NO: 1210040 - RNA, 12 nt, Mycobacterium bovis subsp bovis AF2122/97
ggccagcucccg

SEQ ID NO: 1210041 - RNA, 22 nt, Mycobacterium bovis subsp bovis AF2122/97
ggccagcucccgggcggcggcc

SEQ ID NO: 1210042 - RNA, 19 nt, Mycobacterium bovis subsp bovis AF2122/97
ggccaggaagucccgggca

SEQ ID NO: 1210043 - RNA, 14 nt, Mycobacterium bovis subsp bovis AF2122/97
ggccaccagccugg

SEQ ID NO: 1210044 - RNA, 11 nt, Mycobacterium bovis subsp bovis AF2122/97
ggccaccagcg

SEQ ID NO: 1210045 - RNA, 14 nt, Mycobacterium bovis subsp bovis AF2122/97
ggccaccagcaugc

SEQ ID NO: 1210046 - RNA, 23 nt, Mycobacterium bovis subsp bovis AF2122/97
ggccaccaccgugaagcccuggc

SEQ ID NO: 1210047 - RNA, 17 nt, Mycobacterium bovis subsp bovis AF2122/97
ggccaccagaaccacuu

SEQ ID NO: 1210048 - RNA, 14 nt, Mycobacterium bovis subsp bovis AF2122/97
ggccaccagcuggc

SEQ ID NO: 1210049 - RNA, 12 nt, Mycobacterium bovis subsp bovis AF2122/97
ggccaccagucc

SEQ ID NO: 1210050 - RNA, 17 nt, Mycobacterium bovis subsp bovis AF2122/97
ggccaccaccgccgccg

SEQ ID NO: 1210051 - RNA, 17 nt, Mycobacterium bovis subsp bovis AF2122/97
ggccaccaccacggcca

SEQ ID NO: 1210052 - RNA, 18 nt, Mycobacterium bovis subsp bovis AF2122/97
ggccaccaacucggcgac

SEQ ID NO: 1210053 - RNA, 18 nt, Mycobacterium bovis subsp bovis AF2122/97
ggccacaugaucgagcag

SEQ ID NO: 1210054 - RNA, 13 nt, Mycobacterium bovis subsp bovis AF2122/97
ggccacagugcau

SEQ ID NO: 1210055 - RNA, 16 nt, Mycobacterium bovis subsp bovis AF2122/97
ggccacauccagcgcu

SEQ ID NO: 1210056 - RNA, 18 nt, Mycobacterium bovis subsp bovis AF2122/97
ggccaacccugcggcguc

SEQ ID NO: 1210057 - RNA, 22 nt, Mycobacterium bovis subsp bovis AF2122/97
ggccaaccccauggccagcgcu

SEQ ID NO: 1210058 - RNA, 14 nt, Mycobacterium bovis subsp bovis AF2122/97
ggccaacgacggcc

SEQ ID NO: 1210059 - RNA, 17 nt, Mycobacterium bovis subsp bovis AF2122/97
ggccaacugggccgagc

SEQ ID NO: 1210060 - RNA, 23 nt, Mycobacterium bovis subsp bovis AF2122/97
ggccaacuuggcggccagccgcu

SEQ ID NO: 1210061 - RNA, 22 nt, Mycobacterium bovis subsp bovis AF2122/97
ggccaagaaugugggcgacggc

SEQ ID NO: 1210062 - RNA, 23 nt, Mycobacterium bovis subsp bovis AF2122/97
ggccaagaaugugggcgacggcc

SEQ ID NO: 1210063 - RNA, 14 nt, Mycobacterium bovis subsp bovis AF2122/97
ggccaagaucggcg

SEQ ID NO: 1210064 - RNA, 14 nt, Mycobacterium bovis subsp bovis AF2122/97
ggccaacugggcgg

SEQ ID NO: 1210065 - RNA, 16 nt, Mycobacterium bovis subsp bovis AF2122/97
ggccaacuucugcacg

SEQ ID NO: 1210066 - RNA, 19 nt, Mycobacterium bovis subsp bovis AF2122/97
ggccaacuuggcggccagc

SEQ ID NO: 1210067 - RNA, 14 nt, Mycobacterium bovis subsp bovis AF2122/97
ggcauggucgccgg

SEQ ID NO: 1210068 - RNA, 13 nt, Mycobacterium bovis subsp bovis AF2122/97
ggcaugguggugg

SEQ ID NO: 1210069 - RNA, 16 nt, Mycobacterium bovis subsp bovis AF2122/97
ggcauguaccgaccgc

SEQ ID NO: 1210070 - RNA, 17 nt, Mycobacterium bovis subsp bovis AF2122/97
ggcauggucaggcggcc

SEQ ID NO: 1210071 - RNA, 15 nt, Mycobacterium bovis subsp bovis AF2122/97
ggcaugggccggcgc

SEQ ID NO: 1210072 - RNA, 17 nt, Mycobacterium bovis subsp bovis AF2122/97
ggcaugggcccugcaca

SEQ ID NO: 1210073 - RNA, 23 nt, Mycobacterium bovis subsp bovis AF2122/97
ggcaugauccccguugacccaga

SEQ ID NO: 1210074 - RNA, 16 nt, Mycobacterium bovis subsp bovis AF2122/97
ggcaugacgaauuggu

SEQ ID NO: 1210075 - RNA, 14 nt, Mycobacterium bovis subsp bovis AF2122/97
ggcaugccgcccgc

SEQ ID NO: 1210076 - RNA, 21 nt, Mycobacterium bovis subsp bovis AF2122/97
ggcaugcagaucucacggagg

SEQ ID NO: 1210077 - RNA, 17 nt, Mycobacterium bovis subsp bovis AF2122/97
ggcaugcagccccacuu

SEQ ID NO: 1210078 - RNA, 14 nt, Mycobacterium bovis subsp bovis AF2122/97
ggcaugccacacac

SEQ ID NO: 1210079 - RNA, 15 nt, Mycobacterium bovis subsp bovis AF2122/97
ggccaacagguccac

SEQ ID NO: 1210080 - RNA, 22 nt, Mycobacterium bovis subsp bovis AF2122/97
ggccaaagccgucagcucacca

SEQ ID NO: 1210081 - RNA, 21 nt, Mycobacterium bovis subsp bovis AF2122/97
ggcauguugcggaccaguucg

SEQ ID NO: 1210082 - RNA, 14 nt, Mycobacterium bovis subsp bovis AF2122/97
ggcagugcgcggcg

SEQ ID NO: 1210083 - RNA, 20 nt, Mycobacterium bovis subsp bovis AF2122/97
ggcagugguuacagaugaag

SEQ ID NO: 1210084 - RNA, 23 nt, Mycobacterium bovis subsp bovis AF2122/97
ggcagucgcgguaccaucaccgc

SEQ ID NO: 1210085 - RNA, 19 nt, Mycobacterium bovis subsp bovis AF2122/97
ggcagugaaauugccgccg

SEQ ID NO: 1210086 - RNA, 14 nt, Mycobacterium bovis subsp bovis AF2122/97
ggcaguucgcggcc

SEQ ID NO: 1210087 - RNA, 18 nt, Mycobacterium bovis subsp bovis AF2122/97
ggcaguugaacucgacca

SEQ ID NO: 1210088 - RNA, 18 nt, Mycobacterium bovis subsp bovis AF2122/97
ggcaguugacccaugccg

SEQ ID NO: 1210089 - RNA, 14 nt, Mycobacterium bovis subsp bovis AF2122/97
ggcagcgguggcaa

SEQ ID NO: 1210090 - RNA, 14 nt, Mycobacterium bovis subsp bovis AF2122/97
ggcagcgguggcuu

SEQ ID NO: 1210091 - RNA, 15 nt, Mycobacterium bovis subsp bovis AF2122/97
ggcagcgguggcuug

SEQ ID NO: 1210092 - RNA, 16 nt, Mycobacterium bovis subsp bovis AF2122/97
ggcagcgguggcuugc

SEQ ID NO: 1210093 - RNA, 20 nt, Mycobacterium bovis subsp bovis AF2122/97
ggcagcgguguagccggcgc

SEQ ID NO: 1210094 - RNA, 21 nt, Mycobacterium bovis subsp bovis AF2122/97
ggcagcgguguagccggcgcc

SEQ ID NO: 1210095 - RNA, 15 nt, Mycobacterium bovis subsp bovis AF2122/97
ggcagcgggccgccc

SEQ ID NO: 1210096 - RNA, 16 nt, Mycobacterium bovis subsp bovis AF2122/97
ggcagcgggcuccccg

SEQ ID NO: 1210097 - RNA, 22 nt, Mycobacterium bovis subsp bovis AF2122/97
ggcagcgguuuuaggcagccca

SEQ ID NO: 1210098 - RNA, 17 nt, Mycobacterium bovis subsp bovis AF2122/97
ggcagucaggccuagcg

SEQ ID NO: 1210099 - RNA, 19 nt, Mycobacterium bovis subsp bovis AF2122/97
ggcaguccaccgcgcggcg

SEQ ID NO: 1210100 - RNA, 14 nt, Mycobacterium bovis subsp bovis AF2122/97
ggcaguccagccgg

SEQ ID NO: 1210101 - RNA, 18 nt, Mycobacterium bovis subsp bovis AF2122/97
ggcaguccagccgggugc

SEQ ID NO: 1210102 - RNA, 14 nt, Mycobacterium bovis subsp bovis AF2122/97
ggcagcguguaacc

SEQ ID NO: 1210103 - RNA, 17 nt, Mycobacterium bovis subsp bovis AF2122/97
ggcagcguugacgguca

SEQ ID NO: 1210104 - RNA, 14 nt, Mycobacterium bovis subsp bovis AF2122/97
ggcaucgacugcca

SEQ ID NO: 1210105 - RNA, 20 nt, Mycobacterium bovis subsp bovis AF2122/97
ggcaucgauaauggccgagu

SEQ ID NO: 1210106 - RNA, 18 nt, Mycobacterium bovis subsp bovis AF2122/97
ggcauccgagcgggaacg

SEQ ID NO: 1210107 - RNA, 22 nt, Mycobacterium bovis subsp bovis AF2122/97
ggcaucccgggcaguccaggca

SEQ ID NO: 1210108 - RNA, 13 nt, Mycobacterium bovis subsp bovis AF2122/97
ggcauccugcacg

SEQ ID NO: 1210109 - RNA, 18 nt, Mycobacterium bovis subsp bovis AF2122/97
ggcauccucugaaccagc

SEQ ID NO: 1210110 - RNA, 22 nt, Mycobacterium bovis subsp bovis AF2122/97
ggcauccucugaaccagcugag

SEQ ID NO: 1210111 - RNA, 19 nt, Mycobacterium bovis subsp bovis AF2122/97
ggcaucgccgcgggugauc

SEQ ID NO: 1210112 - RNA, 14 nt, Mycobacterium bovis subsp bovis AF2122/97
ggcaucgccgagcu

SEQ ID NO: 1210113 - RNA, 21 nt, Mycobacterium bovis subsp bovis AF2122/97
ggcaucucggcuacgccucgg

SEQ ID NO: 1210114 - RNA, 23 nt, Mycobacterium bovis subsp bovis AF2122/97
ggcauacaucgccuugcccagcg

SEQ ID NO: 1210115 - RNA, 17 nt, Mycobacterium bovis subsp bovis AF2122/97
ggcauacccaucaacau

SEQ ID NO: 1210116 - RNA, 18 nt, Mycobacterium bovis subsp bovis AF2122/97
ggcauagccgaacagcgg

SEQ ID NO: 1210117 - RNA, 13 nt, Mycobacterium bovis subsp bovis AF2122/97
ggcauacauccag

SEQ ID NO: 1210118 - RNA, 14 nt, Mycobacterium bovis subsp bovis AF2122/97
ggcauacaacuggu

SEQ ID NO: 1210119 - RNA, 16 nt, Mycobacterium bovis subsp bovis AF2122/97
ggcacccgccgugccc

SEQ ID NO: 1210120 - RNA, 22 nt, Mycobacterium bovis subsp bovis AF2122/97
ggcacccgccgugcccccggcu

SEQ ID NO: 1210121 - RNA, 22 nt, Mycobacterium bovis subsp bovis AF2122/97
ggcaccccuuugacgccgagca

SEQ ID NO: 1210122 - RNA, 22 nt, Mycobacterium bovis subsp bovis AF2122/97
ggcacccgcggcgaaccgucuc

SEQ ID NO: 1210123 - RNA, 19 nt, Mycobacterium bovis subsp bovis AF2122/97
ggcacccgagccgcacagc

SEQ ID NO: 1210124 - RNA, 17 nt, Mycobacterium bovis subsp bovis AF2122/97
ggcacccgcacggccuc

SEQ ID NO: 1210125 - RNA, 13 nt, Mycobacterium bovis subsp bovis AF2122/97
ggcacccuccgcc

SEQ ID NO: 1210126 - RNA, 21 nt, Mycobacterium bovis subsp bovis AF2122/97
ggcacccggugagaagaagcc

SEQ ID NO: 1210127 - RNA, 23 nt, Mycobacterium bovis subsp bovis AF2122/97
ggcacccggugagaagaagccca

SEQ ID NO: 1210128 - RNA, 18 nt, Mycobacterium bovis subsp bovis AF2122/97
ggcaccagcggcaccgcg

SEQ ID NO: 1210129 - RNA, 21 nt, Mycobacterium bovis subsp bovis AF2122/97
ggcaccagcggcaccgcggcc

SEQ ID NO: 1210130 - RNA, 19 nt, Mycobacterium bovis subsp bovis AF2122/97
ggcaccagguugccgaggu

SEQ ID NO: 1210131 - RNA, 14 nt, Mycobacterium bovis subsp bovis AF2122/97
ggcacccccgucgc

SEQ ID NO: 1210132 - RNA, 14 nt, Mycobacterium bovis subsp bovis AF2122/97
ggcaccauaucgug

SEQ ID NO: 1210133 - RNA, 18 nt, Mycobacterium bovis subsp bovis AF2122/97
ggcaccauguacaggcug

SEQ ID NO: 1210134 - RNA, 19 nt, Mycobacterium bovis subsp bovis AF2122/97
ggcaccgccgcccccgccg

SEQ ID NO: 1210135 - RNA, 15 nt, Mycobacterium bovis subsp bovis AF2122/97
ggcaccgcgccggcg

SEQ ID NO: 1210136 - RNA, 16 nt, Mycobacterium bovis subsp bovis AF2122/97
ggcaccgcggccagcg

SEQ ID NO: 1210137 - RNA, 18 nt, Mycobacterium bovis subsp bovis AF2122/97
ggcaccgcggccagcggg

SEQ ID NO: 1210138 - RNA, 16 nt, Mycobacterium bovis subsp bovis AF2122/97
ggcaccgcggccgcgg

SEQ ID NO: 1210139 - RNA, 16 nt, Mycobacterium bovis subsp bovis AF2122/97
ggcaccgugcgggggg

SEQ ID NO: 1210140 - RNA, 19 nt, Mycobacterium bovis subsp bovis AF2122/97
ggcaccguggaucugaaga

SEQ ID NO: 1210141 - RNA, 15 nt, Mycobacterium bovis subsp bovis AF2122/97
ggcaccggcggucug

SEQ ID NO: 1210142 - RNA, 20 nt, Mycobacterium bovis subsp bovis AF2122/97
ggcaccggcggucugcagug

SEQ ID NO: 1210143 - RNA, 17 nt, Mycobacterium bovis subsp bovis AF2122/97
ggcaccggugcccacca

SEQ ID NO: 1210144 - RNA, 16 nt, Mycobacterium bovis subsp bovis AF2122/97
ggcaccgagcugagcg

SEQ ID NO: 1210145 - RNA, 15 nt, Mycobacterium bovis subsp bovis AF2122/97
ggcaccgauccugga

SEQ ID NO: 1210146 - RNA, 19 nt, Mycobacterium bovis subsp bovis AF2122/97
ggcaccgaucggugccggc

SEQ ID NO: 1210147 - RNA, 14 nt, Mycobacterium bovis subsp bovis AF2122/97
ggcaccgaugcacu

SEQ ID NO: 1210148 - RNA, 19 nt, Mycobacterium bovis subsp bovis AF2122/97
ggcaccgcccccgucggcc

SEQ ID NO: 1210149 - RNA, 14 nt, Mycobacterium bovis subsp bovis AF2122/97
ggcaccgccgagca

SEQ ID NO: 1210150 - RNA, 16 nt, Mycobacterium bovis subsp bovis AF2122/97
ggcaccgccagccacc

SEQ ID NO: 1210151 - RNA, 18 nt, Mycobacterium bovis subsp bovis AF2122/97
ggcaccgccgcccccgcc

SEQ ID NO: 1210152 - RNA, 22 nt, Mycobacterium bovis subsp bovis AF2122/97
ggcacgccauaccggcuggcca

SEQ ID NO: 1210153 - RNA, 22 nt, Mycobacterium bovis subsp bovis AF2122/97
ggcacgcuccagcucggccagu

SEQ ID NO: 1210154 - RNA, 15 nt, Mycobacterium bovis subsp bovis AF2122/97
ggcacgcgaggcgcu

SEQ ID NO: 1210155 - RNA, 14 nt, Mycobacterium bovis subsp bovis AF2122/97
ggcacgcccucguc

SEQ ID NO: 1210156 - RNA, 15 nt, Mycobacterium bovis subsp bovis AF2122/97
ggcacgccggcggcg

SEQ ID NO: 1210157 - RNA, 16 nt, Mycobacterium bovis subsp bovis AF2122/97
ggcacgccggcggcgg

SEQ ID NO: 1210158 - RNA, 15 nt, Mycobacterium bovis subsp bovis AF2122/97
ggcacgggcggccau

SEQ ID NO: 1210159 - RNA, 18 nt, Mycobacterium bovis subsp bovis AF2122/97
ggcacgacccgggaagga

SEQ ID NO: 1210160 - RNA, 19 nt, Mycobacterium bovis subsp bovis AF2122/97
ggcacgacccgggaaggaa

SEQ ID NO: 1210161 - RNA, 18 nt, Mycobacterium bovis subsp bovis AF2122/97
ggcacgaucgucgcggcc

SEQ ID NO: 1210162 - RNA, 14 nt, Mycobacterium bovis subsp bovis AF2122/97
ggcacgacccggga

SEQ ID NO: 1210163 - RNA, 13 nt, Mycobacterium bovis subsp bovis AF2122/97
ggcaccuccagca

SEQ ID NO: 1210164 - RNA, 15 nt, Mycobacterium bovis subsp bovis AF2122/97
ggcaccucgcccucc

SEQ ID NO: 1210165 - RNA, 15 nt, Mycobacterium bovis subsp bovis AF2122/97
ggcaccuauagggac

SEQ ID NO: 1210166 - RNA, 21 nt, Mycobacterium bovis subsp bovis AF2122/97
ggcaccguuaccgccgucgcc

SEQ ID NO: 1210167 - RNA, 22 nt, Mycobacterium bovis subsp bovis AF2122/97
ggcaccguagagcaugccgccc

SEQ ID NO: 1210168 - RNA, 20 nt, Mycobacterium bovis subsp bovis AF2122/97
ggcaccgguuugacguccag

SEQ ID NO: 1210169 - RNA, 12 nt, Mycobacterium bovis subsp bovis AF2122/97
ggcaccgugucg

SEQ ID NO: 1210170 - RNA, 16 nt, Mycobacterium bovis subsp bovis AF2122/97
ggcacuccagcggcgg

SEQ ID NO: 1210171 - RNA, 17 nt, Mycobacterium bovis subsp bovis AF2122/97
ggcacuccagcggcggg

SEQ ID NO: 1210172 - RNA, 12 nt, Mycobacterium bovis subsp bovis AF2122/97
ggcacucccgga

SEQ ID NO: 1210173 - RNA, 19 nt, Mycobacterium bovis subsp bovis AF2122/97
ggcacguccgaucggcgcg

SEQ ID NO: 1210174 - RNA, 16 nt, Mycobacterium bovis subsp bovis AF2122/97
ggcacguucagccagg

SEQ ID NO: 1210175 - RNA, 17 nt, Mycobacterium bovis subsp bovis AF2122/97
ggcacguucagccaggc

SEQ ID NO: 1210176 - RNA, 16 nt, Mycobacterium bovis subsp bovis AF2122/97
ggcacuggauccggga

SEQ ID NO: 1210177 - RNA, 17 nt, Mycobacterium bovis subsp bovis AF2122/97
ggcacugcccagcagac

SEQ ID NO: 1210178 - RNA, 14 nt, Mycobacterium bovis subsp bovis AF2122/97
ggcacugccgagca

SEQ ID NO: 1210179 - RNA, 15 nt, Mycobacterium bovis subsp bovis AF2122/97
ggcacugcggccagu

SEQ ID NO: 1210180 - RNA, 16 nt, Mycobacterium bovis subsp bovis AF2122/97
ggcagcacccgcacgg

SEQ ID NO: 1210181 - RNA, 22 nt, Mycobacterium bovis subsp bovis AF2122/97
ggcacugugcguccgcaacagg

SEQ ID NO: 1210182 - RNA, 23 nt, Mycobacterium bovis subsp bovis AF2122/97
ggcacuuaccgagccgucagcgu

SEQ ID NO: 1210183 - RNA, 19 nt, Mycobacterium bovis subsp bovis AF2122/97
ggcacuugcccgucggcgc

SEQ ID NO: 1210184 - RNA, 16 nt, Mycobacterium bovis subsp bovis AF2122/97
ggcagcagccggcggg

SEQ ID NO: 1210185 - RNA, 22 nt, Mycobacterium bovis subsp bovis AF2122/97
ggcagcagcgcgcggguuaccc

SEQ ID NO: 1210186 - RNA, 17 nt, Mycobacterium bovis subsp bovis AF2122/97
ggcagcagccggcgggc

SEQ ID NO: 1210187 - RNA, 14 nt, Mycobacterium bovis subsp bovis AF2122/97
ggcagcagcgccgu

SEQ ID NO: 1210188 - RNA, 19 nt, Mycobacterium bovis subsp bovis AF2122/97
ggcagcaucuccgucggcc

SEQ ID NO: 1210189 - RNA, 13 nt, Mycobacterium bovis subsp bovis AF2122/97
ggcagcauggcca

SEQ ID NO: 1210190 - RNA, 13 nt, Mycobacterium bovis subsp bovis AF2122/97
ggcagccaccagc

SEQ ID NO: 1210191 - RNA, 18 nt, Mycobacterium bovis subsp bovis AF2122/97
ggcagccaccagcgacga

SEQ ID NO: 1210192 - RNA, 13 nt, Mycobacterium bovis subsp bovis AF2122/97
ggcagcauauccg

SEQ ID NO: 1210193 - RNA, 12 nt, Mycobacterium bovis subsp bovis AF2122/97
ggcagcagcggu

SEQ ID NO: 1210194 - RNA, 22 nt, Mycobacterium bovis subsp bovis AF2122/97
ggcagccaccgucaugccgacg

SEQ ID NO: 1210195 - RNA, 21 nt, Mycobacterium bovis subsp bovis AF2122/97
ggcagccacggguagcugccg

SEQ ID NO: 1210196 - RNA, 12 nt, Mycobacterium bovis subsp bovis AF2122/97
ggcagcgcuggc

SEQ ID NO: 1210197 - RNA, 15 nt, Mycobacterium bovis subsp bovis AF2122/97
ggcagcgcggccaau

SEQ ID NO: 1210198 - RNA, 12 nt, Mycobacterium bovis subsp bovis AF2122/97
ggcagcgcggcc

SEQ ID NO: 1210199 - RNA, 16 nt, Mycobacterium bovis subsp bovis AF2122/97
ggcagcgcgcccgaca

SEQ ID NO: 1210200 - RNA, 20 nt, Mycobacterium bovis subsp bovis AF2122/97
ggcagccaaaaacgcugccg

SEQ ID NO: 1210201 - RNA, 20 nt, Mycobacterium bovis subsp bovis AF2122/97
ggcagcggcgcgcugcacgg

SEQ ID NO: 1210202 - RNA, 23 nt, Mycobacterium bovis subsp bovis AF2122/97
ggcacacuguuacuccgacggcc

SEQ ID NO: 1210203 - RNA, 18 nt, Mycobacterium bovis subsp bovis AF2122/97
ggcacagccaguaaaaag

SEQ ID NO: 1210204 - RNA, 22 nt, Mycobacterium bovis subsp bovis AF2122/97
ggcacaaucggauagccgugcu

SEQ ID NO: 1210205 - RNA, 21 nt, Mycobacterium bovis subsp bovis AF2122/97
ggcacacccaucaccgccagc

SEQ ID NO: 1210206 - RNA, 15 nt, Mycobacterium bovis subsp bovis AF2122/97
ggcacacccuccaca

SEQ ID NO: 1210207 - RNA, 20 nt, Mycobacterium bovis subsp bovis AF2122/97
ggcaccacuacaucgaucag

SEQ ID NO: 1210208 - RNA, 21 nt, Mycobacterium bovis subsp bovis AF2122/97
ggcaccagccggugagcgagc

SEQ ID NO: 1210209 - RNA, 20 nt, Mycobacterium bovis subsp bovis AF2122/97
ggcaccaccaagcucggcca

SEQ ID NO: 1210210 - RNA, 23 nt, Mycobacterium bovis subsp bovis AF2122/97
ggcacauugaucgacggccagcc

SEQ ID NO: 1210211 - RNA, 14 nt, Mycobacterium bovis subsp bovis AF2122/97
ggcaccacgccagc

SEQ ID NO: 1210212 - RNA, 19 nt, Mycobacterium bovis subsp bovis AF2122/97
ggcaccacccgauuggcca

SEQ ID NO: 1210213 - RNA, 15 nt, Mycobacterium bovis subsp bovis AF2122/97
ggcacaugcgcgucc

SEQ ID NO: 1210214 - RNA, 16 nt, Mycobacterium bovis subsp bovis AF2122/97
ggcacaggcggccagc

SEQ ID NO: 1210215 - RNA, 19 nt, Mycobacterium bovis subsp bovis AF2122/97
ggcaauacguagucgccga

SEQ ID NO: 1210216 - RNA, 15 nt, Mycobacterium bovis subsp bovis AF2122/97
ggcaauacccgccgc

SEQ ID NO: 1210217 - RNA, 15 nt, Mycobacterium bovis subsp bovis AF2122/97
ggcaauaccgccagc

SEQ ID NO: 1210218 - RNA, 13 nt, Mycobacterium bovis subsp bovis AF2122/97
ggcaauggccagc

SEQ ID NO: 1210219 - RNA, 21 nt, Mycobacterium bovis subsp bovis AF2122/97
ggaucgccuuggcgcccgcga

SEQ ID NO: 1210220 - RNA, 21 nt, Mycobacterium bovis subsp bovis AF2122/97
ggauugacgcgacgagccgca

SEQ ID NO: 1210221 - RNA, 13 nt, Mycobacterium bovis subsp bovis AF2122/97
ggaucgcggcgcc

SEQ ID NO: 1210222 - RNA, 22 nt, Mycobacterium bovis subsp bovis AF2122/97
ggaucgcggcgccgucgucagc

SEQ ID NO: 1210223 - RNA, 13 nt, Mycobacterium bovis subsp bovis AF2122/97
ggaucgcggcggc

SEQ ID NO: 1210224 - RNA, 23 nt, Mycobacterium bovis subsp bovis AF2122/97
ggaucgcguggcgcaccaccgcc

SEQ ID NO: 1210225 - RNA, 18 nt, Mycobacterium bovis subsp bovis AF2122/97
ggaucgcguccgccucgg

SEQ ID NO: 1210226 - RNA, 16 nt, Mycobacterium bovis subsp bovis AF2122/97
ggaucgccggggacgc

SEQ ID NO: 1210227 - RNA, 20 nt, Mycobacterium bovis subsp bovis AF2122/97
ggaucgacaguugcgccagc

SEQ ID NO: 1210228 - RNA, 17 nt, Mycobacterium bovis subsp bovis AF2122/97
ggaucgccugagcgccg

SEQ ID NO: 1210229 - RNA, 22 nt, Mycobacterium bovis subsp bovis AF2122/97
ggaucgccugagcgccgcggcg

SEQ ID NO: 1210230 - RNA, 14 nt, Mycobacterium bovis subsp bovis AF2122/97
ggaucgaccgccag

SEQ ID NO: 1210231 - RNA, 13 nt, Mycobacterium bovis subsp bovis AF2122/97
ggaucgcagcgcc

SEQ ID NO: 1210232 - RNA, 23 nt, Mycobacterium bovis subsp bovis AF2122/97
ggcaaaccgaucaauccgcccuu

SEQ ID NO: 1210233 - RNA, 16 nt, Mycobacterium bovis subsp bovis AF2122/97
ggauuggcgucagcag

SEQ ID NO: 1210234 - RNA, 18 nt, Mycobacterium bovis subsp bovis AF2122/97
ggcaacggaggugccggc

SEQ ID NO: 1210235 - RNA, 13 nt, Mycobacterium bovis subsp bovis AF2122/97
ggcaacggccgcu

SEQ ID NO: 1210236 - RNA, 17 nt, Mycobacterium bovis subsp bovis AF2122/97
ggcaacgaggucugcgg

SEQ ID NO: 1210237 - RNA, 14 nt, Mycobacterium bovis subsp bovis AF2122/97
ggcaacgaucaggu

SEQ ID NO: 1210238 - RNA, 14 nt, Mycobacterium bovis subsp bovis AF2122/97
ggcaacgcggucug

SEQ ID NO: 1210239 - RNA, 19 nt, Mycobacterium bovis subsp bovis AF2122/97
ggcaacaacguucggcaca

SEQ ID NO: 1210240 - RNA, 20 nt, Mycobacterium bovis subsp bovis AF2122/97
ggcaaaucggugcgauccug

SEQ ID NO: 1210241 - RNA, 13 nt, Mycobacterium bovis subsp bovis AF2122/97
ggcaaaucaagca

SEQ ID NO: 1210242 - RNA, 15 nt, Mycobacterium bovis subsp bovis AF2122/97
ggcaaacuccugcag

SEQ ID NO: 1210243 - RNA, 13 nt, Mycobacterium bovis subsp bovis AF2122/97
ggcaaacugggca

SEQ ID NO: 1210244 - RNA, 12 nt, Mycobacterium bovis subsp bovis AF2122/97
ggccggccgccg

SEQ ID NO: 1210245 - RNA, 14 nt, Mycobacterium bovis subsp bovis AF2122/97
ggccggcgccgcac

SEQ ID NO: 1210246 - RNA, 14 nt, Mycobacterium bovis subsp bovis AF2122/97
ggccggcgccggcg

SEQ ID NO: 1210247 - RNA, 13 nt, Mycobacterium bovis subsp bovis AF2122/97
ggccggcgcucgc

SEQ ID NO: 1210248 - RNA, 16 nt, Mycobacterium bovis subsp bovis AF2122/97
ggccggcgggccugcc

SEQ ID NO: 1210249 - RNA, 13 nt, Mycobacterium bovis subsp bovis AF2122/97
ggccggcggcggu

SEQ ID NO: 1210250 - RNA, 22 nt, Mycobacterium bovis subsp bovis AF2122/97
ggccggcggcucgggugcgccc

SEQ ID NO: 1210251 - RNA, 19 nt, Mycobacterium bovis subsp bovis AF2122/97
ggccgggcagugcgcggcg

SEQ ID NO: 1210252 - RNA, 20 nt, Mycobacterium bovis subsp bovis AF2122/97
ggccggcggucgggcccggc

SEQ ID NO: 1210253 - RNA, 14 nt, Mycobacterium bovis subsp bovis AF2122/97
ggccgggccgagug

SEQ ID NO: 1210254 - RNA, 14 nt, Mycobacterium bovis subsp bovis AF2122/97
ggccgggcucccca

SEQ ID NO: 1210255 - RNA, 16 nt, Mycobacterium bovis subsp bovis AF2122/97
ggccgggcuccucugg

SEQ ID NO: 1210256 - RNA, 16 nt, Mycobacterium bovis subsp bovis AF2122/97
ggccggcgucagcccc

SEQ ID NO: 1210257 - RNA, 18 nt, Mycobacterium bovis subsp bovis AF2122/97
ggccggcgggccugcccg

SEQ ID NO: 1210258 - RNA, 18 nt, Mycobacterium bovis subsp bovis AF2122/97
ggccggcucguccgggca

SEQ ID NO: 1210259 - RNA, 19 nt, Mycobacterium bovis subsp bovis AF2122/97
ggccggcucguccgggcag

SEQ ID NO: 1210260 - RNA, 20 nt, Mycobacterium bovis subsp bovis AF2122/97
ggccggcuagggcagcagcc

SEQ ID NO: 1210261 - RNA, 11 nt, Mycobacterium bovis subsp bovis AF2122/97
ggccgggaacc

SEQ ID NO: 1210262 - RNA, 22 nt, Mycobacterium bovis subsp bovis AF2122/97
ggccgggaucucgaaggccgcc

SEQ ID NO: 1210263 - RNA, 20 nt, Mycobacterium bovis subsp bovis AF2122/97
ggccggcauccgguucgccg

SEQ ID NO: 1210264 - RNA, 18 nt, Mycobacterium bovis subsp bovis AF2122/97
ggccggcacugccgagca

SEQ ID NO: 1210265 - RNA, 13 nt, Mycobacterium bovis subsp bovis AF2122/97
ggccggcaagcag

SEQ ID NO: 1210266 - RNA, 22 nt, Mycobacterium bovis subsp bovis AF2122/97
ggccggcaaugccgcggccagu

SEQ ID NO: 1210267 - RNA, 15 nt, Mycobacterium bovis subsp bovis AF2122/97
ggccggcaccgcagc

SEQ ID NO: 1210268 - RNA, 22 nt, Mycobacterium bovis subsp bovis AF2122/97
ggccggaucgaagaccagcaac

SEQ ID NO: 1210269 - RNA, 22 nt, Mycobacterium bovis subsp bovis AF2122/97
ggccggaugacgcccagggcgu

SEQ ID NO: 1210270 - RNA, 20 nt, Mycobacterium bovis subsp bovis AF2122/97
ggccggaugagcgaacgcca

SEQ ID NO: 1210271 - RNA, 21 nt, Mycobacterium bovis subsp bovis AF2122/97
ggccgcuugccccgccuuggc

SEQ ID NO: 1210272 - RNA, 19 nt, Mycobacterium bovis subsp bovis AF2122/97
ggccgcuggaggcggcgcc

SEQ ID NO: 1210273 - RNA, 13 nt, Mycobacterium bovis subsp bovis AF2122/97
ggccgcugaucaa

SEQ ID NO: 1210274 - RNA, 21 nt, Mycobacterium bovis subsp bovis AF2122/97
ggccgcugugggcgagucggg

SEQ ID NO: 1210275 - RNA, 17 nt, Mycobacterium bovis subsp bovis AF2122/97
ggccggagccgccggcc

SEQ ID NO: 1210276 - RNA, 15 nt, Mycobacterium bovis subsp bovis AF2122/97
ggccggagccgccgg

SEQ ID NO: 1210277 - RNA, 16 nt, Mycobacterium bovis subsp bovis AF2122/97
ggccggagccgccggc

SEQ ID NO: 1210278 - RNA, 19 nt, Mycobacterium bovis subsp bovis AF2122/97
ggccggacgggugcgggcc

SEQ ID NO: 1210279 - RNA, 15 nt, Mycobacterium bovis subsp bovis AF2122/97
ggccggaccaucagc

SEQ ID NO: 1210280 - RNA, 20 nt, Mycobacterium bovis subsp bovis AF2122/97
ggccggaccuuguuggccau

SEQ ID NO: 1210281 - RNA, 16 nt, Mycobacterium bovis subsp bovis AF2122/97
ggccggaacgcccggc

SEQ ID NO: 1210282 - RNA, 19 nt, Mycobacterium bovis subsp bovis AF2122/97
ggccgcuuggccgcugccu

SEQ ID NO: 1210283 - RNA, 16 nt, Mycobacterium bovis subsp bovis AF2122/97
ggccgcgggcgcggcc

SEQ ID NO: 1210284 - RNA, 19 nt, Mycobacterium bovis subsp bovis AF2122/97
ggccgcggcggccccgcgc

SEQ ID NO: 1210285 - RNA, 17 nt, Mycobacterium bovis subsp bovis AF2122/97
ggccgcgggucgcugcg

SEQ ID NO: 1210286 - RNA, 18 nt, Mycobacterium bovis subsp bovis AF2122/97
ggccgcggucggccacca

SEQ ID NO: 1210287 - RNA, 20 nt, Mycobacterium bovis subsp bovis AF2122/97
ggccgcgucacggaccugga

SEQ ID NO: 1210288 - RNA, 20 nt, Mycobacterium bovis subsp bovis AF2122/97
ggccgcuauggcccgggccg

SEQ ID NO: 1210289 - RNA, 19 nt, Mycobacterium bovis subsp bovis AF2122/97
ggccgcguugggguuggca

SEQ ID NO: 1210290 - RNA, 12 nt, Mycobacterium bovis subsp bovis AF2122/97
ggccgcucgccu

SEQ ID NO: 1210291 - RNA, 13 nt, Mycobacterium bovis subsp bovis AF2122/97
ggccgcggcggcc

SEQ ID NO: 1210292 - RNA, 16 nt, Mycobacterium bovis subsp bovis AF2122/97
ggccgcggccucccgc

SEQ ID NO: 1210293 - RNA, 18 nt, Mycobacterium bovis subsp bovis AF2122/97
ggccgcggccucccgcaa

SEQ ID NO: 1210294 - RNA, 12 nt, Mycobacterium bovis subsp bovis AF2122/97
ggccgcggcggu

SEQ ID NO: 1210295 - RNA, 16 nt, Mycobacterium bovis subsp bovis AF2122/97
ggccgcggcggccagc

SEQ ID NO: 1210296 - RNA, 14 nt, Mycobacterium bovis subsp bovis AF2122/97
ggccgcggcggccc

SEQ ID NO: 1210297 - RNA, 15 nt, Mycobacterium bovis subsp bovis AF2122/97
ggccgcgagguaccc

SEQ ID NO: 1210298 - RNA, 19 nt, Mycobacterium bovis subsp bovis AF2122/97
ggccgcgaccagcgccgca

SEQ ID NO: 1210299 - RNA, 16 nt, Mycobacterium bovis subsp bovis AF2122/97
ggccgcgauccagcgc

SEQ ID NO: 1210300 - RNA, 14 nt, Mycobacterium bovis subsp bovis AF2122/97
ggccgcgagacgca

SEQ ID NO: 1210301 - RNA, 15 nt, Mycobacterium bovis subsp bovis AF2122/97
ggccgcgcagauucc

SEQ ID NO: 1210302 - RNA, 15 nt, Mycobacterium bovis subsp bovis AF2122/97
ggccgcgccggcccc

SEQ ID NO: 1210303 - RNA, 11 nt, Mycobacterium bovis subsp bovis AF2122/97
ggccgcgcagg

SEQ ID NO: 1210304 - RNA, 12 nt, Mycobacterium bovis subsp bovis AF2122/97
ggccgcgcaggc

SEQ ID NO: 1210305 - RNA, 15 nt, Mycobacterium bovis subsp bovis AF2122/97
ggccgcgcgcaccgg

SEQ ID NO: 1210306 - RNA, 16 nt, Mycobacterium bovis subsp bovis AF2122/97
ggccgcgccggccccg

SEQ ID NO: 1210307 - RNA, 18 nt, Mycobacterium bovis subsp bovis AF2122/97
ggccgcgcgcagggcguc

SEQ ID NO: 1210308 - RNA, 16 nt, Mycobacterium bovis subsp bovis AF2122/97
ggccgcgcggggugcg

SEQ ID NO: 1210309 - RNA, 14 nt, Mycobacterium bovis subsp bovis AF2122/97
ggccgcgcgcucga

SEQ ID NO: 1210310 - RNA, 22 nt, Mycobacterium bovis subsp bovis AF2122/97
ggccgcgcgcucgagcaggcug

SEQ ID NO: 1210311 - RNA, 20 nt, Mycobacterium bovis subsp bovis AF2122/97
ggccgaguucgucagcggcc

SEQ ID NO: 1210312 - RNA, 17 nt, Mycobacterium bovis subsp bovis AF2122/97
ggccgaucagcgcggcg

SEQ ID NO: 1210313 - RNA, 20 nt, Mycobacterium bovis subsp bovis AF2122/97
ggccgaucucuccggcggcg

SEQ ID NO: 1210314 - RNA, 16 nt, Mycobacterium bovis subsp bovis AF2122/97
ggccgaugagcccagc

SEQ ID NO: 1210315 - RNA, 19 nt, Mycobacterium bovis subsp bovis AF2122/97
ggccgaugagcccagccgc

SEQ ID NO: 1210316 - RNA, 19 nt, Mycobacterium bovis subsp bovis AF2122/97
ggccgaucucuccggcggc

SEQ ID NO: 1210317 - RNA, 16 nt, Mycobacterium bovis subsp bovis AF2122/97
ggccgaugccgaccuu

SEQ ID NO: 1210318 - RNA, 22 nt, Mycobacterium bovis subsp bovis AF2122/97
ggccgagcucguugcuggcggc

SEQ ID NO: 1210319 - RNA, 14 nt, Mycobacterium bovis subsp bovis AF2122/97
ggccgagcgcgccg

SEQ ID NO: 1210320 - RNA, 18 nt, Mycobacterium bovis subsp bovis AF2122/97
ggccgagcgcaccacggc

SEQ ID NO: 1210321 - RNA, 12 nt, Mycobacterium bovis subsp bovis AF2122/97
ggccgagcgcga

SEQ ID NO: 1210322 - RNA, 15 nt, Mycobacterium bovis subsp bovis AF2122/97
ggccgagccgcccgc

SEQ ID NO: 1210323 - RNA, 17 nt, Mycobacterium bovis subsp bovis AF2122/97
ggccgcagcggccagcc

SEQ ID NO: 1210324 - RNA, 15 nt, Mycobacterium bovis subsp bovis AF2122/97
ggccgcacugggugc

SEQ ID NO: 1210325 - RNA, 20 nt, Mycobacterium bovis subsp bovis AF2122/97
ggccgcacuuucuuccucgg

SEQ ID NO: 1210326 - RNA, 15 nt, Mycobacterium bovis subsp bovis AF2122/97
ggccgcaccagcauu

SEQ ID NO: 1210327 - RNA, 18 nt, Mycobacterium bovis subsp bovis AF2122/97
ggccgcacgccggccagc

SEQ ID NO: 1210328 - RNA, 16 nt, Mycobacterium bovis subsp bovis AF2122/97
ggccgcaauccagcug

SEQ ID NO: 1210329 - RNA, 19 nt, Mycobacterium bovis subsp bovis AF2122/97
ggccgauggugugcacggc

SEQ ID NO: 1210330 - RNA, 21 nt, Mycobacterium bovis subsp bovis AF2122/97
ggccgauguacugugccgccc

SEQ ID NO: 1210331 - RNA, 23 nt, Mycobacterium bovis subsp bovis AF2122/97
ggccgauguacugugccgccccc

SEQ ID NO: 1210332 - RNA, 23 nt, Mycobacterium bovis subsp bovis AF2122/97
ggccgccgaggacacauugacca

SEQ ID NO: 1210333 - RNA, 12 nt, Mycobacterium bovis subsp bovis AF2122/97
ggccgccgcagc

SEQ ID NO: 1210334 - RNA, 20 nt, Mycobacterium bovis subsp bovis AF2122/97
ggccgccgcgauggccccug

SEQ ID NO: 1210335 - RNA, 13 nt, Mycobacterium bovis subsp bovis AF2122/97
ggccgccgcggcg

SEQ ID NO: 1210336 - RNA, 17 nt, Mycobacterium bovis subsp bovis AF2122/97
ggccgccgcggcuuguc

SEQ ID NO: 1210337 - RNA, 13 nt, Mycobacterium bovis subsp bovis AF2122/97
ggccgccggcccc

SEQ ID NO: 1210338 - RNA, 17 nt, Mycobacterium bovis subsp bovis AF2122/97
ggccgccggccccgccg

SEQ ID NO: 1210339 - RNA, 15 nt, Mycobacterium bovis subsp bovis AF2122/97
ggccgccggacccgu

SEQ ID NO: 1210340 - RNA, 16 nt, Mycobacterium bovis subsp bovis AF2122/97
ggccgccggguccgga

SEQ ID NO: 1210341 - RNA, 23 nt, Mycobacterium bovis subsp bovis AF2122/97
ggccgccuugaggcccugcggcc

SEQ ID NO: 1210342 - RNA, 16 nt, Mycobacterium bovis subsp bovis AF2122/97
ggccgccuugaggccc

SEQ ID NO: 1210343 - RNA, 17 nt, Mycobacterium bovis subsp bovis AF2122/97
ggccgccguccccgccg

SEQ ID NO: 1210344 - RNA, 18 nt, Mycobacterium bovis subsp bovis AF2122/97
ggccgccggacccgucga

SEQ ID NO: 1210345 - RNA, 16 nt, Mycobacterium bovis subsp bovis AF2122/97
ggccgccccaggcugg

SEQ ID NO: 1210346 - RNA, 16 nt, Mycobacterium bovis subsp bovis AF2122/97
ggccgcccgcucgaug

SEQ ID NO: 1210347 - RNA, 15 nt, Mycobacterium bovis subsp bovis AF2122/97
ggccgcccgcugcgg

SEQ ID NO: 1210348 - RNA, 17 nt, Mycobacterium bovis subsp bovis AF2122/97
ggccgcccgcugcggcg

SEQ ID NO: 1210349 - RNA, 18 nt, Mycobacterium bovis subsp bovis AF2122/97
ggccgcccggcgagcagg

SEQ ID NO: 1210350 - RNA, 14 nt, Mycobacterium bovis subsp bovis AF2122/97
ggccgcccggcgag

SEQ ID NO: 1210351 - RNA, 16 nt, Mycobacterium bovis subsp bovis AF2122/97
ggccgcccggcgagca

SEQ ID NO: 1210352 - RNA, 16 nt, Mycobacterium bovis subsp bovis AF2122/97
ggccgcaugccacggc

SEQ ID NO: 1210353 - RNA, 18 nt, Mycobacterium bovis subsp bovis AF2122/97
ggccgcauuagccugcgu

SEQ ID NO: 1210354 - RNA, 14 nt, Mycobacterium bovis subsp bovis AF2122/97
ggccgccacccgca

SEQ ID NO: 1210355 - RNA, 13 nt, Mycobacterium bovis subsp bovis AF2122/97
ggccgccaccgca

SEQ ID NO: 1210356 - RNA, 13 nt, Mycobacterium bovis subsp bovis AF2122/97
ggccgccaccucc

SEQ ID NO: 1210357 - RNA, 19 nt, Mycobacterium bovis subsp bovis AF2122/97
ggccgccaacuucaccacc

SEQ ID NO: 1210358 - RNA, 13 nt, Mycobacterium bovis subsp bovis AF2122/97
ggccgccaccagc

SEQ ID NO: 1210359 - RNA, 14 nt, Mycobacterium bovis subsp bovis AF2122/97
ggccgccaccagcg

SEQ ID NO: 1210360 - RNA, 18 nt, Mycobacterium bovis subsp bovis AF2122/97
ggccgccacucgcccgcu

SEQ ID NO: 1210361 - RNA, 13 nt, Mycobacterium bovis subsp bovis AF2122/97
ggccgccagcagc

SEQ ID NO: 1210362 - RNA, 13 nt, Mycobacterium bovis subsp bovis AF2122/97
ggccgccagcgca

SEQ ID NO: 1210363 - RNA, 17 nt, Mycobacterium bovis subsp bovis AF2122/97
ggccgccaggaaucccu

SEQ ID NO: 1210364 - RNA, 15 nt, Mycobacterium bovis subsp bovis AF2122/97
ggccgccaggcggcc

SEQ ID NO: 1210365 - RNA, 18 nt, Mycobacterium bovis subsp bovis AF2122/97
ggccgccaggcggccggg

SEQ ID NO: 1210366 - RNA, 20 nt, Mycobacterium bovis subsp bovis AF2122/97
ggccugaccggcucgccggc

SEQ ID NO: 1210367 - RNA, 12 nt, Mycobacterium bovis subsp bovis AF2122/97
ggccucguccag

SEQ ID NO: 1210368 - RNA, 14 nt, Mycobacterium bovis subsp bovis AF2122/97
ggccucgggacucc

SEQ ID NO: 1210369 - RNA, 21 nt, Mycobacterium bovis subsp bovis AF2122/97
ggccucgucgugcaccucguc

SEQ ID NO: 1210370 - RNA, 23 nt, Mycobacterium bovis subsp bovis AF2122/97
ggccucgucgugcaccucguccc

SEQ ID NO: 1210371 - RNA, 17 nt, Mycobacterium bovis subsp bovis AF2122/97
ggccucguuguagccga

SEQ ID NO: 1210372 - RNA, 11 nt, Mycobacterium bovis subsp bovis AF2122/97
ggccuccucgu

SEQ ID NO: 1210373 - RNA, 15 nt, Mycobacterium bovis subsp bovis AF2122/97
ggccuccgcugccgc

SEQ ID NO: 1210374 - RNA, 17 nt, Mycobacterium bovis subsp bovis AF2122/97
ggccucgaccucuucgg

SEQ ID NO: 1210375 - RNA, 20 nt, Mycobacterium bovis subsp bovis AF2122/97
ggccuccugcuggcccugcu

SEQ ID NO: 1210376 - RNA, 21 nt, Mycobacterium bovis subsp bovis AF2122/97
ggccuccugcuggcccugcuc

SEQ ID NO: 1210377 - RNA, 13 nt, Mycobacterium bovis subsp bovis AF2122/97
ggccucggcagca

SEQ ID NO: 1210378 - RNA, 13 nt, Mycobacterium bovis subsp bovis AF2122/97
ggccucgcgagaa

SEQ ID NO: 1210379 - RNA, 23 nt, Mycobacterium bovis subsp bovis AF2122/97
ggccuaucccgaaucucacccac

SEQ ID NO: 1210380 - RNA, 14 nt, Mycobacterium bovis subsp bovis AF2122/97
ggccuagccgcggc

SEQ ID NO: 1210381 - RNA, 17 nt, Mycobacterium bovis subsp bovis AF2122/97
ggccuaccaggcgcggc

SEQ ID NO: 1210382 - RNA, 13 nt, Mycobacterium bovis subsp bovis AF2122/97
ggccucccacggc

SEQ ID NO: 1210383 - RNA, 18 nt, Mycobacterium bovis subsp bovis AF2122/97
ggccucccacucacccag

SEQ ID NO: 1210384 - RNA, 14 nt, Mycobacterium bovis subsp bovis AF2122/97
ggccucccgggccg

SEQ ID NO: 1210385 - RNA, 19 nt, Mycobacterium bovis subsp bovis AF2122/97
ggccuccccgaccugcaag

SEQ ID NO: 1210386 - RNA, 15 nt, Mycobacterium bovis subsp bovis AF2122/97
ggccucagcuacccc

SEQ ID NO: 1210387 - RNA, 21 nt, Mycobacterium bovis subsp bovis AF2122/97
ggccucagcuaccccggcggu

SEQ ID NO: 1210388 - RNA, 18 nt, Mycobacterium bovis subsp bovis AF2122/97
ggccucagcccggccagc

SEQ ID NO: 1210389 - RNA, 19 nt, Mycobacterium bovis subsp bovis AF2122/97
ggccucagcccggccagcc

SEQ ID NO: 1210390 - RNA, 20 nt, Mycobacterium bovis subsp bovis AF2122/97
ggccguuccacaucaaaacg

SEQ ID NO: 1210391 - RNA, 22 nt, Mycobacterium bovis subsp bovis AF2122/97
ggccguugacggugucuugcca

SEQ ID NO: 1210392 - RNA, 23 nt, Mycobacterium bovis subsp bovis AF2122/97
ggccguugcuauucgccagcgcc

SEQ ID NO: 1210393 - RNA, 15 nt, Mycobacterium bovis subsp bovis AF2122/97
ggccguuucggcgcc

SEQ ID NO: 1210394 - RNA, 14 nt, Mycobacterium bovis subsp bovis AF2122/97
ggccgguccgggaa

SEQ ID NO: 1210395 - RNA, 15 nt, Mycobacterium bovis subsp bovis AF2122/97
ggccgguccggggca

SEQ ID NO: 1210396 - RNA, 13 nt, Mycobacterium bovis subsp bovis AF2122/97
ggccggucgggca

SEQ ID NO: 1210397 - RNA, 23 nt, Mycobacterium bovis subsp bovis AF2122/97
ggccgguacacguccaguggcag

SEQ ID NO: 1210398 - RNA, 16 nt, Mycobacterium bovis subsp bovis AF2122/97
ggccgguaccgggacg

SEQ ID NO: 1210399 - RNA, 23 nt, Mycobacterium bovis subsp bovis AF2122/97
ggccgguagaucuucggccgcac

SEQ ID NO: 1210400 - RNA, 16 nt, Mycobacterium bovis subsp bovis AF2122/97
ggccgguaguagcuga

SEQ ID NO: 1210401 - RNA, 18 nt, Mycobacterium bovis subsp bovis AF2122/97
ggccgggucgucuuccag

SEQ ID NO: 1210402 - RNA, 16 nt, Mycobacterium bovis subsp bovis AF2122/97
ggccggguggcccggc

SEQ ID NO: 1210403 - RNA, 21 nt, Mycobacterium bovis subsp bovis AF2122/97
ggccgggucgaacuugaucac

SEQ ID NO: 1210404 - RNA, 14 nt, Mycobacterium bovis subsp bovis AF2122/97
ggccguacggcgcg

SEQ ID NO: 1210405 - RNA, 21 nt, Mycobacterium bovis subsp bovis AF2122/97
ggccgguggaaaagccacggc

SEQ ID NO: 1210406 - RNA, 13 nt, Mycobacterium bovis subsp bovis AF2122/97
ggccggugggccg

SEQ ID NO: 1210407 - RNA, 17 nt, Mycobacterium bovis subsp bovis AF2122/97
ggccgguucaggggugg

SEQ ID NO: 1210408 - RNA, 14 nt, Mycobacterium bovis subsp bovis AF2122/97
ggccgucagggugu

SEQ ID NO: 1210409 - RNA, 23 nt, Mycobacterium bovis subsp bovis AF2122/97
ggccgucagccaggugcccaagc

SEQ ID NO: 1210410 - RNA, 19 nt, Mycobacterium bovis subsp bovis AF2122/97
ggccgucaccgacgcacag

SEQ ID NO: 1210411 - RNA, 18 nt, Mycobacterium bovis subsp bovis AF2122/97
ggccgucaccggucggcc

SEQ ID NO: 1210412 - RNA, 22 nt, Mycobacterium bovis subsp bovis AF2122/97
ggccguauaggcccgggcggcc

SEQ ID NO: 1210413 - RNA, 22 nt, Mycobacterium bovis subsp bovis AF2122/97
ggccguaguugguucuccccgc

SEQ ID NO: 1210414 - RNA, 13 nt, Mycobacterium bovis subsp bovis AF2122/97
ggccguccucggu

SEQ ID NO: 1210415 - RNA, 18 nt, Mycobacterium bovis subsp bovis AF2122/97
ggccgucccgcgagcagc

SEQ ID NO: 1210416 - RNA, 22 nt, Mycobacterium bovis subsp bovis AF2122/97
ggccgucccgcgagcagcccgg

SEQ ID NO: 1210417 - RNA, 18 nt, Mycobacterium bovis subsp bovis AF2122/97
ggccgucgaacgguagca

SEQ ID NO: 1210418 - RNA, 21 nt, Mycobacterium bovis subsp bovis AF2122/97
ggccgucgacgaucagcgagu

SEQ ID NO: 1210419 - RNA, 14 nt, Mycobacterium bovis subsp bovis AF2122/97
ggccgucggcgggc

SEQ ID NO: 1210420 - RNA, 16 nt, Mycobacterium bovis subsp bovis AF2122/97
ggccgucgggcagcag

SEQ ID NO: 1210421 - RNA, 15 nt, Mycobacterium bovis subsp bovis AF2122/97
ggccgucgggugugc

SEQ ID NO: 1210422 - RNA, 14 nt, Mycobacterium bovis subsp bovis AF2122/97
ggccgucgaucaag

SEQ ID NO: 1210423 - RNA, 12 nt, Mycobacterium bovis subsp bovis AF2122/97
ggccgucgccga

SEQ ID NO: 1210424 - RNA, 19 nt, Mycobacterium bovis subsp bovis AF2122/97
ggccgucgucggucaccga

SEQ ID NO: 1210425 - RNA, 14 nt, Mycobacterium bovis subsp bovis AF2122/97
ggccgugaccgagc

SEQ ID NO: 1210426 - RNA, 16 nt, Mycobacterium bovis subsp bovis AF2122/97
ggccgugaccgagccg

SEQ ID NO: 1210427 - RNA, 21 nt, Mycobacterium bovis subsp bovis AF2122/97
ggccgugaugccacggcgucg

SEQ ID NO: 1210428 - RNA, 18 nt, Mycobacterium bovis subsp bovis AF2122/97
ggccgugaccgagccgcg

SEQ ID NO: 1210429 - RNA, 12 nt, Mycobacterium bovis subsp bovis AF2122/97
ggcgaaguuggu

SEQ ID NO: 1210430 - RNA, 17 nt, Mycobacterium bovis subsp bovis AF2122/97
ggcgaauccgcacaggu

SEQ ID NO: 1210431 - RNA, 20 nt, Mycobacterium bovis subsp bovis AF2122/97
ggcgaagcgggcgugcucgg

SEQ ID NO: 1210432 - RNA, 20 nt, Mycobacterium bovis subsp bovis AF2122/97
ggcgaaggccgcgcgcaggg

SEQ ID NO: 1210433 - RNA, 12 nt, Mycobacterium bovis subsp bovis AF2122/97
ggcgaagcccga

SEQ ID NO: 1210434 - RNA, 16 nt, Mycobacterium bovis subsp bovis AF2122/97
ggccuucggccggcgu

SEQ ID NO: 1210435 - RNA, 22 nt, Mycobacterium bovis subsp bovis AF2122/97
ggccuugacgcacgacugugcg

SEQ ID NO: 1210436 - RNA, 20 nt, Mycobacterium bovis subsp bovis AF2122/97
ggcgaacucgaggucgagcg

SEQ ID NO: 1210437 - RNA, 19 nt, Mycobacterium bovis subsp bovis AF2122/97
ggcgaacucgcgccgagcc

SEQ ID NO: 1210438 - RNA, 15 nt, Mycobacterium bovis subsp bovis AF2122/97
ggcgaacugggugcg

SEQ ID NO: 1210439 - RNA, 20 nt, Mycobacterium bovis subsp bovis AF2122/97
ggcgaacgcguccagcgcgg

SEQ ID NO: 1210440 - RNA, 18 nt, Mycobacterium bovis subsp bovis AF2122/97
ggccuucuccccgaucag

SEQ ID NO: 1210441 - RNA, 22 nt, Mycobacterium bovis subsp bovis AF2122/97
ggccuugcucagcacgccgggu

SEQ ID NO: 1210442 - RNA, 16 nt, Mycobacterium bovis subsp bovis AF2122/97
ggccuucagcucacca

SEQ ID NO: 1210443 - RNA, 13 nt, Mycobacterium bovis subsp bovis AF2122/97
ggccuguuccauu

SEQ ID NO: 1210444 - RNA, 22 nt, Mycobacterium bovis subsp bovis AF2122/97
ggccugucgaagauccagcgca

SEQ ID NO: 1210445 - RNA, 18 nt, Mycobacterium bovis subsp bovis AF2122/97
ggccugucaggcggcgga

SEQ ID NO: 1210446 - RNA, 17 nt, Mycobacterium bovis subsp bovis AF2122/97
ggccugucaggcggcgg

SEQ ID NO: 1210447 - RNA, 14 nt, Mycobacterium bovis subsp bovis AF2122/97
ggccugcucgacca

SEQ ID NO: 1210448 - RNA, 15 nt, Mycobacterium bovis subsp bovis AF2122/97
ggccugccguuccag

SEQ ID NO: 1210449 - RNA, 13 nt, Mycobacterium bovis subsp bovis AF2122/97
ggccugcgcgacc

SEQ ID NO: 1210450 - RNA, 19 nt, Mycobacterium bovis subsp bovis AF2122/97
ggccugcgcgaccgaccag

SEQ ID NO: 1210451 - RNA, 13 nt, Mycobacterium bovis subsp bovis AF2122/97
ggccugcgccggc

SEQ ID NO: 1210452 - RNA, 15 nt, Mycobacterium bovis subsp bovis AF2122/97
ggccugcgcgauccg

SEQ ID NO: 1210453 - RNA, 18 nt, Mycobacterium bovis subsp bovis AF2122/97
ggccugcggucagggcuu

SEQ ID NO: 1210454 - RNA, 18 nt, Mycobacterium bovis subsp bovis AF2122/97
ggccugcgcuucguccag

SEQ ID NO: 1210455 - RNA, 15 nt, Mycobacterium bovis subsp bovis AF2122/97
ggccugcacgccggc

SEQ ID NO: 1210456 - RNA, 22 nt, Mycobacterium bovis subsp bovis AF2122/97
ggccugcaacgucacucccugg

SEQ ID NO: 1210457 - RNA, 16 nt, Mycobacterium bovis subsp bovis AF2122/97
ggccugccgcacuggg

SEQ ID NO: 1210458 - RNA, 12 nt, Mycobacterium bovis subsp bovis AF2122/97
ggccugcccggc

SEQ ID NO: 1210459 - RNA, 23 nt, Mycobacterium bovis subsp bovis AF2122/97
ggccugcccccggcgcggcggac

SEQ ID NO: 1210460 - RNA, 13 nt, Mycobacterium bovis subsp bovis AF2122/97
ggccugcagccga

SEQ ID NO: 1210461 - RNA, 17 nt, Mycobacterium bovis subsp bovis AF2122/97
ggccuggaucgugccga

SEQ ID NO: 1210462 - RNA, 13 nt, Mycobacterium bovis subsp bovis AF2122/97
ggccuggcagggu

SEQ ID NO: 1210463 - RNA, 14 nt, Mycobacterium bovis subsp bovis AF2122/97
ggccuggccccggc

SEQ ID NO: 1210464 - RNA, 17 nt, Mycobacterium bovis subsp bovis AF2122/97
ggccugggacggcggca

SEQ ID NO: 1210465 - RNA, 13 nt, Mycobacterium bovis subsp bovis AF2122/97
ggcgcgcagccgg

SEQ ID NO: 1210466 - RNA, 16 nt, Mycobacterium bovis subsp bovis AF2122/97
ggcgcgcagccgggcc

SEQ ID NO: 1210467 - RNA, 16 nt, Mycobacterium bovis subsp bovis AF2122/97
ggcgcgcagcuuggac

SEQ ID NO: 1210468 - RNA, 15 nt, Mycobacterium bovis subsp bovis AF2122/97
ggcgcgccggccaug

SEQ ID NO: 1210469 - RNA, 16 nt, Mycobacterium bovis subsp bovis AF2122/97
ggcgcgccgggcggcg

SEQ ID NO: 1210470 - RNA, 19 nt, Mycobacterium bovis subsp bovis AF2122/97
ggcgcgcaagugcuggccg

SEQ ID NO: 1210471 - RNA, 21 nt, Mycobacterium bovis subsp bovis AF2122/97
ggcgcgcaccaccgcggcggc

SEQ ID NO: 1210472 - RNA, 22 nt, Mycobacterium bovis subsp bovis AF2122/97
ggcgcgcaccaccgcggcggcg

SEQ ID NO: 1210473 - RNA, 20 nt, Mycobacterium bovis subsp bovis AF2122/97
ggcgcgauccccgcgcugag

SEQ ID NO: 1210474 - RNA, 19 nt, Mycobacterium bovis subsp bovis AF2122/97
ggcgccgucggccgagucg

SEQ ID NO: 1210475 - RNA, 15 nt, Mycobacterium bovis subsp bovis AF2122/97
ggcgccgucgucagc

SEQ ID NO: 1210476 - RNA, 18 nt, Mycobacterium bovis subsp bovis AF2122/97
ggcgccgucgucagcggg

SEQ ID NO: 1210477 - RNA, 20 nt, Mycobacterium bovis subsp bovis AF2122/97
ggcgccgugaucagcucgcg

SEQ ID NO: 1210478 - RNA, 19 nt, Mycobacterium bovis subsp bovis AF2122/97
ggcgccguugucggcggug

SEQ ID NO: 1210479 - RNA, 21 nt, Mycobacterium bovis subsp bovis AF2122/97
ggcgcgaggaacgccggggcg

SEQ ID NO: 1210480 - RNA, 14 nt, Mycobacterium bovis subsp bovis AF2122/97
ggcgccggagccgc

SEQ ID NO: 1210481 - RNA, 15 nt, Mycobacterium bovis subsp bovis AF2122/97
ggcgccggagccgcc

SEQ ID NO: 1210482 - RNA, 19 nt, Mycobacterium bovis subsp bovis AF2122/97
ggcgccggaacgagcggcc

SEQ ID NO: 1210483 - RNA, 20 nt, Mycobacterium bovis subsp bovis AF2122/97
ggcgccgcccuugccgccgg

SEQ ID NO: 1210484 - RNA, 14 nt, Mycobacterium bovis subsp bovis AF2122/97
ggcgccgcccgcgc

SEQ ID NO: 1210485 - RNA, 17 nt, Mycobacterium bovis subsp bovis AF2122/97
ggcgccgccaagggccc

SEQ ID NO: 1210486 - RNA, 14 nt, Mycobacterium bovis subsp bovis AF2122/97
ggcgccggccagcc

SEQ ID NO: 1210487 - RNA, 18 nt, Mycobacterium bovis subsp bovis AF2122/97
ggcgccggccagccagcg

SEQ ID NO: 1210488 - RNA, 14 nt, Mycobacterium bovis subsp bovis AF2122/97
ggcgccggccggcg

SEQ ID NO: 1210489 - RNA, 18 nt, Mycobacterium bovis subsp bovis AF2122/97
ggcgccggccggcgcggu

SEQ ID NO: 1210490 - RNA, 16 nt, Mycobacterium bovis subsp bovis AF2122/97
ggcgccggccucgccg

SEQ ID NO: 1210491 - RNA, 12 nt, Mycobacterium bovis subsp bovis AF2122/97
ggcgcccugcgc

SEQ ID NO: 1210492 - RNA, 18 nt, Mycobacterium bovis subsp bovis AF2122/97
ggcgcccuugagccgccg

SEQ ID NO: 1210493 - RNA, 14 nt, Mycobacterium bovis subsp bovis AF2122/97
ggcgcccugcgcca

SEQ ID NO: 1210494 - RNA, 20 nt, Mycobacterium bovis subsp bovis AF2122/97
ggcgcccuuaagccggcgcg

SEQ ID NO: 1210495 - RNA, 18 nt, Mycobacterium bovis subsp bovis AF2122/97
ggcgccgaacaccggcuc

SEQ ID NO: 1210496 - RNA, 15 nt, Mycobacterium bovis subsp bovis AF2122/97
ggcgccgaaccagcg

SEQ ID NO: 1210497 - RNA, 19 nt, Mycobacterium bovis subsp bovis AF2122/97
ggcgccgaugccggccaag

SEQ ID NO: 1210498 - RNA, 13 nt, Mycobacterium bovis subsp bovis AF2122/97
ggcgccgcagggc

SEQ ID NO: 1210499 - RNA, 21 nt, Mycobacterium bovis subsp bovis AF2122/97
ggcgccgauuuugggaucgug

SEQ ID NO: 1210500 - RNA, 18 nt, Mycobacterium bovis subsp bovis AF2122/97
ggcgccgauaccggcggc

SEQ ID NO: 1210501 - RNA, 16 nt, Mycobacterium bovis subsp bovis AF2122/97
ggcgccgagcagcccg

SEQ ID NO: 1210502 - RNA, 19 nt, Mycobacterium bovis subsp bovis AF2122/97
ggcgccgagcagcccgcgg

SEQ ID NO: 1210503 - RNA, 15 nt, Mycobacterium bovis subsp bovis AF2122/97
ggcgcuaggaacgcc

SEQ ID NO: 1210504 - RNA, 16 nt, Mycobacterium bovis subsp bovis AF2122/97
ggcgcuaggaacgcca

SEQ ID NO: 1210505 - RNA, 19 nt, Mycobacterium bovis subsp bovis AF2122/97
ggcgcucacaauggcucug

SEQ ID NO: 1210506 - RNA, 16 nt, Mycobacterium bovis subsp bovis AF2122/97
ggcgcggucgaagcug

SEQ ID NO: 1210507 - RNA, 18 nt, Mycobacterium bovis subsp bovis AF2122/97
ggcgcgugcagcggcgcc

SEQ ID NO: 1210508 - RNA, 21 nt, Mycobacterium bovis subsp bovis AF2122/97
ggcgcgggugaccaggcggcg

SEQ ID NO: 1210509 - RNA, 16 nt, Mycobacterium bovis subsp bovis AF2122/97
ggcgcgggugcgccgg

SEQ ID NO: 1210510 - RNA, 20 nt, Mycobacterium bovis subsp bovis AF2122/97
ggcgcugaacgcgagcaaca

SEQ ID NO: 1210511 - RNA, 15 nt, Mycobacterium bovis subsp bovis AF2122/97
ggcgcucccggagca

SEQ ID NO: 1210512 - RNA, 13 nt, Mycobacterium bovis subsp bovis AF2122/97
ggcgcuccuucag

SEQ ID NO: 1210513 - RNA, 13 nt, Mycobacterium bovis subsp bovis AF2122/97
ggcgcucgcgcgc

SEQ ID NO: 1210514 - RNA, 17 nt, Mycobacterium bovis subsp bovis AF2122/97
ggcgcucgcgcgcuggg

SEQ ID NO: 1210515 - RNA, 18 nt, Mycobacterium bovis subsp bovis AF2122/97
ggcgcucgcgcgcugggc

SEQ ID NO: 1210516 - RNA, 22 nt, Mycobacterium bovis subsp bovis AF2122/97
ggcgcgggucggcgaccgcgcu

SEQ ID NO: 1210517 - RNA, 17 nt, Mycobacterium bovis subsp bovis AF2122/97
ggcgcgggugaccaggc

SEQ ID NO: 1210518 - RNA, 15 nt, Mycobacterium bovis subsp bovis AF2122/97
ggcgcggggccgccg

SEQ ID NO: 1210519 - RNA, 15 nt, Mycobacterium bovis subsp bovis AF2122/97
ggcgcgggcgccggg

SEQ ID NO: 1210520 - RNA, 14 nt, Mycobacterium bovis subsp bovis AF2122/97
ggcgcgggcgccgg

SEQ ID NO: 1210521 - RNA, 13 nt, Mycobacterium bovis subsp bovis AF2122/97
ggcgcggcggcgu

SEQ ID NO: 1210522 - RNA, 19 nt, Mycobacterium bovis subsp bovis AF2122/97
ggcgcgccggucgccgacg

SEQ ID NO: 1210523 - RNA, 14 nt, Mycobacterium bovis subsp bovis AF2122/97
ggcgcgcgcgccgg

SEQ ID NO: 1210524 - RNA, 19 nt, Mycobacterium bovis subsp bovis AF2122/97
ggcgcgcgcgccggcugcc

SEQ ID NO: 1210525 - RNA, 13 nt, Mycobacterium bovis subsp bovis AF2122/97
ggcgcgcggcgcc

SEQ ID NO: 1210526 - RNA, 14 nt, Mycobacterium bovis subsp bovis AF2122/97
ggcgcgcggcgccg

SEQ ID NO: 1210527 - RNA, 22 nt, Mycobacterium bovis subsp bovis AF2122/97
ggcgaucugcgacaagaccggc

SEQ ID NO: 1210528 - RNA, 18 nt, Mycobacterium bovis subsp bovis AF2122/97
ggcgaugcguccgcccag

SEQ ID NO: 1210529 - RNA, 19 nt, Mycobacterium bovis subsp bovis AF2122/97
ggcgaugcguccgcccagc

SEQ ID NO: 1210530 - RNA, 19 nt, Mycobacterium bovis subsp bovis AF2122/97
ggcgauccggucggccagg

SEQ ID NO: 1210531 - RNA, 15 nt, Mycobacterium bovis subsp bovis AF2122/97
ggcgauccgauacag

SEQ ID NO: 1210532 - RNA, 20 nt, Mycobacterium bovis subsp bovis AF2122/97
ggcgaucgucaagccgggca

SEQ ID NO: 1210533 - RNA, 14 nt, Mycobacterium bovis subsp bovis AF2122/97
ggcgaucgccuggg

SEQ ID NO: 1210534 - RNA, 19 nt, Mycobacterium bovis subsp bovis AF2122/97
ggcgaugucggcugguggg

SEQ ID NO: 1210535 - RNA, 15 nt, Mycobacterium bovis subsp bovis AF2122/97
ggcgcaacucgacca

SEQ ID NO: 1210536 - RNA, 20 nt, Mycobacterium bovis subsp bovis AF2122/97
ggcgcaacgagagcggcucc

SEQ ID NO: 1210537 - RNA, 13 nt, Mycobacterium bovis subsp bovis AF2122/97
ggcgcaaucaacg

SEQ ID NO: 1210538 - RNA, 18 nt, Mycobacterium bovis subsp bovis AF2122/97
ggcgcaagaaugccgccg

SEQ ID NO: 1210539 - RNA, 23 nt, Mycobacterium bovis subsp bovis AF2122/97
ggcgaguuaggccgccagccggc

SEQ ID NO: 1210540 - RNA, 20 nt, Mycobacterium bovis subsp bovis AF2122/97
ggcgagggcggucagcggcc

SEQ ID NO: 1210541 - RNA, 15 nt, Mycobacterium bovis subsp bovis AF2122/97
ggcgauccaggccag

SEQ ID NO: 1210542 - RNA, 19 nt, Mycobacterium bovis subsp bovis AF2122/97
ggcgauaaggaccgcgccc

SEQ ID NO: 1210543 - RNA, 21 nt, Mycobacterium bovis subsp bovis AF2122/97
ggcgagugucuuagccagcag

SEQ ID NO: 1210544 - RNA, 19 nt, Mycobacterium bovis subsp bovis AF2122/97
ggcgagggccacggcugcg

SEQ ID NO: 1210545 - RNA, 15 nt, Mycobacterium bovis subsp bovis AF2122/97
ggcgagggcgcgccg

SEQ ID NO: 1210546 - RNA, 17 nt, Mycobacterium bovis subsp bovis AF2122/97
ggcgaggcggucgccga

SEQ ID NO: 1210547 - RNA, 15 nt, Mycobacterium bovis subsp bovis AF2122/97
ggcgaggcagcaccc

SEQ ID NO: 1210548 - RNA, 15 nt, Mycobacterium bovis subsp bovis AF2122/97
ggcgaaugcgggccu

SEQ ID NO: 1210549 - RNA, 22 nt, Mycobacterium bovis subsp bovis AF2122/97
ggcgaauugcaggacgcgggcu

SEQ ID NO: 1210550 - RNA, 16 nt, Mycobacterium bovis subsp bovis AF2122/97
ggcgaaugacggccag

SEQ ID NO: 1210551 - RNA, 17 nt, Mycobacterium bovis subsp bovis AF2122/97
ggcgaaugcgggccucc

SEQ ID NO: 1210552 - RNA, 19 nt, Mycobacterium bovis subsp bovis AF2122/97
ggcgcccacaucgucggcg

SEQ ID NO: 1210553 - RNA, 13 nt, Mycobacterium bovis subsp bovis AF2122/97
ggcgcccccgcca

SEQ ID NO: 1210554 - RNA, 22 nt, Mycobacterium bovis subsp bovis AF2122/97
ggcgcccccgccauugccgccg

SEQ ID NO: 1210555 - RNA, 23 nt, Mycobacterium bovis subsp bovis AF2122/97
ggcgcccccgccauugccgccgg

SEQ ID NO: 1210556 - RNA, 21 nt, Mycobacterium bovis subsp bovis AF2122/97
ggcgcccgcucggccgcagcc

SEQ ID NO: 1210557 - RNA, 20 nt, Mycobacterium bovis subsp bovis AF2122/97
ggcgcccgggucccggcagc

SEQ ID NO: 1210558 - RNA, 21 nt, Mycobacterium bovis subsp bovis AF2122/97
ggcgcccggucgagccagcgg

SEQ ID NO: 1210559 - RNA, 12 nt, Mycobacterium bovis subsp bovis AF2122/97
ggcgcccgccgc

SEQ ID NO: 1210560 - RNA, 16 nt, Mycobacterium bovis subsp bovis AF2122/97
ggcgcccgaagccggg

SEQ ID NO: 1210561 - RNA, 19 nt, Mycobacterium bovis subsp bovis AF2122/97
ggcgcccgcccgagccgcu

SEQ ID NO: 1210562 - RNA, 18 nt, Mycobacterium bovis subsp bovis AF2122/97
ggcgcccgccaccggagg

SEQ ID NO: 1210563 - RNA, 22 nt, Mycobacterium bovis subsp bovis AF2122/97
ggcgccacccgcgccgcccgcu

SEQ ID NO: 1210564 - RNA, 23 nt, Mycobacterium bovis subsp bovis AF2122/97
ggcgccacccgcgccgcccgcuc

SEQ ID NO: 1210565 - RNA, 21 nt, Mycobacterium bovis subsp bovis AF2122/97
ggcgcauuccggcgccaggau

SEQ ID NO: 1210566 - RNA, 19 nt, Mycobacterium bovis subsp bovis AF2122/97
ggcgcauuccggcgccagg

SEQ ID NO: 1210567 - RNA, 19 nt, Mycobacterium bovis subsp bovis AF2122/97
ggcgccauggucgcugcgu

SEQ ID NO: 1210568 - RNA, 16 nt, Mycobacterium bovis subsp bovis AF2122/97
ggcgcaguagccgacc

SEQ ID NO: 1210569 - RNA, 19 nt, Mycobacterium bovis subsp bovis AF2122/97
ggcgcaggucgcgcaguug

SEQ ID NO: 1210570 - RNA, 21 nt, Mycobacterium bovis subsp bovis AF2122/97
ggcgcaguuggcaccagccgg

SEQ ID NO: 1210571 - RNA, 15 nt, Mycobacterium bovis subsp bovis AF2122/97
ggcgcauaggcggcc

SEQ ID NO: 1210572 - RNA, 13 nt, Mycobacterium bovis subsp bovis AF2122/97
ggcgcaucaccac

SEQ ID NO: 1210573 - RNA, 16 nt, Mycobacterium bovis subsp bovis AF2122/97
ggcgcauuccggcgcc

SEQ ID NO: 1210574 - RNA, 16 nt, Mycobacterium bovis subsp bovis AF2122/97
ggcgcagaucgugcac

SEQ ID NO: 1210575 - RNA, 11 nt, Mycobacterium bovis subsp bovis AF2122/97
ggcgcagccgg

SEQ ID NO: 1210576 - RNA, 14 nt, Mycobacterium bovis subsp bovis AF2122/97
ggcgcagcgccagc

SEQ ID NO: 1210577 - RNA, 12 nt, Mycobacterium bovis subsp bovis AF2122/97
ggcgcagguaua

SEQ ID NO: 1210578 - RNA, 24 nt, Mycobacterium bovis subsp bovis AF2122/97
ggcguuccccgagaacggcgggcg

SEQ ID NO: 1210579 - RNA, 18 nt, Mycobacterium bovis subsp bovis AF2122/97
ggcguucagcggccagca

SEQ ID NO: 1210580 - RNA, 13 nt, Mycobacterium bovis subsp bovis AF2122/97
ggcguucaccugc

SEQ ID NO: 1210581 - RNA, 18 nt, Mycobacterium bovis subsp bovis AF2122/97
ggcguguagccugcggcg

SEQ ID NO: 1210582 - RNA, 16 nt, Mycobacterium bovis subsp bovis AF2122/97
ggcgugucgccgccac

SEQ ID NO: 1210583 - RNA, 12 nt, Mycobacterium bovis subsp bovis AF2122/97
ggcguggucucg

SEQ ID NO: 1210584 - RNA, 12 nt, Mycobacterium bovis subsp bovis AF2122/97
ggcguggcuggu

SEQ ID NO: 1210585 - RNA, 24 nt, Mycobacterium bovis subsp bovis AF2122/97
ggcgugcuugaccgccuggaagga

SEQ ID NO: 1210586 - RNA, 18 nt, Mycobacterium bovis subsp bovis AF2122/97
ggcgugcacaggucagcg

SEQ ID NO: 1210587 - RNA, 14 nt, Mycobacterium bovis subsp bovis AF2122/97
ggcgugcaguacac

SEQ ID NO: 1210588 - RNA, 21 nt, Mycobacterium bovis subsp bovis AF2122/97
ggcgugcucgccgggucagcc

SEQ ID NO: 1210589 - RNA, 16 nt, Mycobacterium bovis subsp bovis AF2122/97
ggcgugcucggaggcg

SEQ ID NO: 1210590 - RNA, 11 nt, Mycobacterium bovis subsp bovis AF2122/97
ggcgugcuggc

SEQ ID NO: 1210591 - RNA, 16 nt, Mycobacterium bovis subsp bovis AF2122/97
ggcgugccgaccagca

SEQ ID NO: 1210592 - RNA, 20 nt, Mycobacterium bovis subsp bovis AF2122/97
ggcgucgcggaucuguuccu

SEQ ID NO: 1210593 - RNA, 16 nt, Mycobacterium bovis subsp bovis AF2122/97
ggcgucggccaccgcc

SEQ ID NO: 1210594 - RNA, 14 nt, Mycobacterium bovis subsp bovis AF2122/97
ggcgucgcuggcca

SEQ ID NO: 1210595 - RNA, 22 nt, Mycobacterium bovis subsp bovis AF2122/97
ggcgucggccaccgccugagcg

SEQ ID NO: 1210596 - RNA, 15 nt, Mycobacterium bovis subsp bovis AF2122/97
ggcgucggcgcggcc

SEQ ID NO: 1210597 - RNA, 20 nt, Mycobacterium bovis subsp bovis AF2122/97
ggcgucgacugcgugccgca

SEQ ID NO: 1210598 - RNA, 16 nt, Mycobacterium bovis subsp bovis AF2122/97
ggcgucgaugcgggcc

SEQ ID NO: 1210599 - RNA, 19 nt, Mycobacterium bovis subsp bovis AF2122/97
ggcgucgccggccccgccg

SEQ ID NO: 1210600 - RNA, 22 nt, Mycobacterium bovis subsp bovis AF2122/97
ggcgucgccggccccgccggcg

SEQ ID NO: 1210601 - RNA, 19 nt, Mycobacterium bovis subsp bovis AF2122/97
ggcgucgaugccggcugcc

SEQ ID NO: 1210602 - RNA, 16 nt, Mycobacterium bovis subsp bovis AF2122/97
ggcgucgaccgcggcc

SEQ ID NO: 1210603 - RNA, 23 nt, Mycobacterium bovis subsp bovis AF2122/97
ggcgucgacgauucccgcggaca

SEQ ID NO: 1210604 - RNA, 14 nt, Mycobacterium bovis subsp bovis AF2122/97
ggcgucgaacucau

SEQ ID NO: 1210605 - RNA, 22 nt, Mycobacterium bovis subsp bovis AF2122/97
ggcgucgucgacggcugcgccg

SEQ ID NO: 1210606 - RNA, 16 nt, Mycobacterium bovis subsp bovis AF2122/97
ggcgucgugcgcggcc

SEQ ID NO: 1210607 - RNA, 22 nt, Mycobacterium bovis subsp bovis AF2122/97
ggcgucgugcgcggccggcacg

SEQ ID NO: 1210608 - RNA, 18 nt, Mycobacterium bovis subsp bovis AF2122/97
ggcgucguucgcgggugc

SEQ ID NO: 1210609 - RNA, 11 nt, Mycobacterium bovis subsp bovis AF2122/97
ggcgucugcgg

SEQ ID NO: 1210610 - RNA, 23 nt, Mycobacterium bovis subsp bovis AF2122/97
ggcgucucgcagcaacggcggcg

SEQ ID NO: 1210611 - RNA, 15 nt, Mycobacterium bovis subsp bovis AF2122/97
ggcgugacgggcagg

SEQ ID NO: 1210612 - RNA, 20 nt, Mycobacterium bovis subsp bovis AF2122/97
ggcgugaccuaccuccucgg

SEQ ID NO: 1210613 - RNA, 14 nt, Mycobacterium bovis subsp bovis AF2122/97
ggcgugaguggcuc

SEQ ID NO: 1210614 - RNA, 22 nt, Mycobacterium bovis subsp bovis AF2122/97
ggcgugagcuaugcuggcagcu

SEQ ID NO: 1210615 - RNA, 21 nt, Mycobacterium bovis subsp bovis AF2122/97
ggcgugacagggcggcaaccu

SEQ ID NO: 1210616 - RNA, 14 nt, Mycobacterium bovis subsp bovis AF2122/97
ggcucagcgguggc

SEQ ID NO: 1210617 - RNA, 14 nt, Mycobacterium bovis subsp bovis AF2122/97
ggcucagcggcgac

SEQ ID NO: 1210618 - RNA, 15 nt, Mycobacterium bovis subsp bovis AF2122/97
ggcucagcggcgacc

SEQ ID NO: 1210619 - RNA, 21 nt, Mycobacterium bovis subsp bovis AF2122/97
ggcucagcagcgccgcgcggg

SEQ ID NO: 1210620 - RNA, 16 nt, Mycobacterium bovis subsp bovis AF2122/97
ggcucacgcuccgccg

SEQ ID NO: 1210621 - RNA, 14 nt, Mycobacterium bovis subsp bovis AF2122/97
ggcucacccuugga

SEQ ID NO: 1210622 - RNA, 15 nt, Mycobacterium bovis subsp bovis AF2122/97
ggcucaccagcuccu

SEQ ID NO: 1210623 - RNA, 12 nt, Mycobacterium bovis subsp bovis AF2122/97
ggcucacccagg

SEQ ID NO: 1210624 - RNA, 21 nt, Mycobacterium bovis subsp bovis AF2122/97
ggcucacccaggcgccgaugu

SEQ ID NO: 1210625 - RNA, 22 nt, Mycobacterium bovis subsp bovis AF2122/97
ggcucaacaccgaguuccucug

SEQ ID NO: 1210626 - RNA, 14 nt, Mycobacterium bovis subsp bovis AF2122/97
ggcuaggccagcac

SEQ ID NO: 1210627 - RNA, 22 nt, Mycobacterium bovis subsp bovis AF2122/97
ggcuaguugggugggugcagca

SEQ ID NO: 1210628 - RNA, 22 nt, Mycobacterium bovis subsp bovis AF2122/97
ggcuacucgaaacccauguuug

SEQ ID NO: 1210629 - RNA, 20 nt, Mycobacterium bovis subsp bovis AF2122/97
ggcuacggcugcccguucug

SEQ ID NO: 1210630 - RNA, 17 nt, Mycobacterium bovis subsp bovis AF2122/97
ggcuauggcgcagcugg

SEQ ID NO: 1210631 - RNA, 14 nt, Mycobacterium bovis subsp bovis AF2122/97
ggcguugccgccug

SEQ ID NO: 1210632 - RNA, 16 nt, Mycobacterium bovis subsp bovis AF2122/97
ggcguugaucgacauc

SEQ ID NO: 1210633 - RNA, 14 nt, Mycobacterium bovis subsp bovis AF2122/97
ggcguuggccagca

SEQ ID NO: 1210634 - RNA, 18 nt, Mycobacterium bovis subsp bovis AF2122/97
ggcguugccaagauccuu

SEQ ID NO: 1210635 - RNA, 18 nt, Mycobacterium bovis subsp bovis AF2122/97
ggcuacccaauaggcgaa

SEQ ID NO: 1210636 - RNA, 15 nt, Mycobacterium bovis subsp bovis AF2122/97
ggcuaccccagggag

SEQ ID NO: 1210637 - RNA, 22 nt, Mycobacterium bovis subsp bovis AF2122/97
ggcuaccuaacccgcgccggcc

SEQ ID NO: 1210638 - RNA, 13 nt, Mycobacterium bovis subsp bovis AF2122/97
ggcuaccuuggac

SEQ ID NO: 1210639 - RNA, 14 nt, Mycobacterium bovis subsp bovis AF2122/97
ggcuaccggcagcu

SEQ ID NO: 1210640 - RNA, 13 nt, Mycobacterium bovis subsp bovis AF2122/97
ggcuaccuaaccc

SEQ ID NO: 1210641 - RNA, 18 nt, Mycobacterium bovis subsp bovis AF2122/97
ggcuaccuaacccgcgcc

SEQ ID NO: 1210642 - RNA, 15 nt, Mycobacterium bovis subsp bovis AF2122/97
ggcuacgacggcgcc

SEQ ID NO: 1210643 - RNA, 15 nt, Mycobacterium bovis subsp bovis AF2122/97
ggcuacgccccacug

SEQ ID NO: 1210644 - RNA, 18 nt, Mycobacterium bovis subsp bovis AF2122/97
ggcuacgccccacugccg

SEQ ID NO: 1210645 - RNA, 14 nt, Mycobacterium bovis subsp bovis AF2122/97
ggcuacgcgcgccc

SEQ ID NO: 1210646 - RNA, 20 nt, Mycobacterium bovis subsp bovis AF2122/97
ggcuaacaccgcaggcacau

SEQ ID NO: 1210647 - RNA, 22 nt, Mycobacterium bovis subsp bovis AF2122/97
ggcggcgagcgcgaugcagugc

SEQ ID NO: 1210648 - RNA, 20 nt, Mycobacterium bovis subsp bovis AF2122/97
ggcggcgaucaacucgggca

SEQ ID NO: 1210649 - RNA, 16 nt, Mycobacterium bovis subsp bovis AF2122/97
ggcggcgccggaggcg

SEQ ID NO: 1210650 - RNA, 14 nt, Mycobacterium bovis subsp bovis AF2122/97
ggcggcccgcucgg

SEQ ID NO: 1210651 - RNA, 23 nt, Mycobacterium bovis subsp bovis AF2122/97
ggcggccgcgaccagcgccgcac

SEQ ID NO: 1210652 - RNA, 20 nt, Mycobacterium bovis subsp bovis AF2122/97
ggcggcgaccagcucagcug

SEQ ID NO: 1210653 - RNA, 15 nt, Mycobacterium bovis subsp bovis AF2122/97
ggcggcggugggcgc

SEQ ID NO: 1210654 - RNA, 17 nt, Mycobacterium bovis subsp bovis AF2122/97
ggcggcgugaagugagc

SEQ ID NO: 1210655 - RNA, 19 nt, Mycobacterium bovis subsp bovis AF2122/97
ggcggcgucgagcaccucc

SEQ ID NO: 1210656 - RNA, 12 nt, Mycobacterium bovis subsp bovis AF2122/97
ggcggcgcgccg

SEQ ID NO: 1210657 - RNA, 15 nt, Mycobacterium bovis subsp bovis AF2122/97
ggcggcggugcagca

SEQ ID NO: 1210658 - RNA, 13 nt, Mycobacterium bovis subsp bovis AF2122/97
ggcggcgguggcg

SEQ ID NO: 1210659 - RNA, 22 nt, Mycobacterium bovis subsp bovis AF2122/97
ggcggcuccaccgggcccgccg

SEQ ID NO: 1210660 - RNA, 20 nt, Mycobacterium bovis subsp bovis AF2122/97
ggcggcguugagcuggcggu

SEQ ID NO: 1210661 - RNA, 17 nt, Mycobacterium bovis subsp bovis AF2122/97
ggcggcuacuccaacug

SEQ ID NO: 1210662 - RNA, 22 nt, Mycobacterium bovis subsp bovis AF2122/97
ggcggcgucgagggagcgccgc

SEQ ID NO: 1210663 - RNA, 17 nt, Mycobacterium bovis subsp bovis AF2122/97
ggcggcggucggcuggg

SEQ ID NO: 1210664 - RNA, 12 nt, Mycobacterium bovis subsp bovis AF2122/97
ggcggcccgcuc

SEQ ID NO: 1210665 - RNA, 12 nt, Mycobacterium bovis subsp bovis AF2122/97
ggcggccgagcg

SEQ ID NO: 1210666 - RNA, 14 nt, Mycobacterium bovis subsp bovis AF2122/97
ggcggccgagcgca

SEQ ID NO: 1210667 - RNA, 23 nt, Mycobacterium bovis subsp bovis AF2122/97
ggcggaacagcuucgcgcagccg

SEQ ID NO: 1210668 - RNA, 21 nt, Mycobacterium bovis subsp bovis AF2122/97
ggcggccccgcgccaccuccc

SEQ ID NO: 1210669 - RNA, 17 nt, Mycobacterium bovis subsp bovis AF2122/97
ggcggcccccggcagcg

SEQ ID NO: 1210670 - RNA, 19 nt, Mycobacterium bovis subsp bovis AF2122/97
ggcggaacaccgacgacac

SEQ ID NO: 1210671 - RNA, 22 nt, Mycobacterium bovis subsp bovis AF2122/97
ggcggaaaaucggcuggcccga

SEQ ID NO: 1210672 - RNA, 17 nt, Mycobacterium bovis subsp bovis AF2122/97
ggcgcuuugggcugccg

SEQ ID NO: 1210673 - RNA, 14 nt, Mycobacterium bovis subsp bovis AF2122/97
ggcgcuugccgggg

SEQ ID NO: 1210674 - RNA, 15 nt, Mycobacterium bovis subsp bovis AF2122/97
ggcgcuggugcgcca

SEQ ID NO: 1210675 - RNA, 12 nt, Mycobacterium bovis subsp bovis AF2122/97
ggcgcuggcccg

SEQ ID NO: 1210676 - RNA, 22 nt, Mycobacterium bovis subsp bovis AF2122/97
ggcgcuggaccgggucgggcac

SEQ ID NO: 1210677 - RNA, 16 nt, Mycobacterium bovis subsp bovis AF2122/97
ggcgcuggacggcggg

SEQ ID NO: 1210678 - RNA, 17 nt, Mycobacterium bovis subsp bovis AF2122/97
ggcggcugaacggcagc

SEQ ID NO: 1210679 - RNA, 18 nt, Mycobacterium bovis subsp bovis AF2122/97
ggcggcugcagccgaccg

SEQ ID NO: 1210680 - RNA, 15 nt, Mycobacterium bovis subsp bovis AF2122/97
ggcggcucgggugcg

SEQ ID NO: 1210681 - RNA, 18 nt, Mycobacterium bovis subsp bovis AF2122/97
ggcggcucuagaucgccg

SEQ ID NO: 1210682 - RNA, 22 nt, Mycobacterium bovis subsp bovis AF2122/97
ggcggcucuagaucgccgagcg

SEQ ID NO: 1210683 - RNA, 12 nt, Mycobacterium bovis subsp bovis AF2122/97
ggcggcugucgg

SEQ ID NO: 1210684 - RNA, 15 nt, Mycobacterium bovis subsp bovis AF2122/97
ggcggcuuccucgag

SEQ ID NO: 1210685 - RNA, 19 nt, Mycobacterium bovis subsp bovis AF2122/97
ggcggcuucgacgucggcg

SEQ ID NO: 1210686 - RNA, 19 nt, Mycobacterium bovis subsp bovis AF2122/97
ggcggcuucgcuaauacac

SEQ ID NO: 1210687 - RNA, 23 nt, Mycobacterium bovis subsp bovis AF2122/97
ggcggucagcagcgccgucagca

SEQ ID NO: 1210688 - RNA, 14 nt, Mycobacterium bovis subsp bovis AF2122/97
ggcggucagcggcu

SEQ ID NO: 1210689 - RNA, 15 nt, Mycobacterium bovis subsp bovis AF2122/97
ggcggucagcggcuc

SEQ ID NO: 1210690 - RNA, 18 nt, Mycobacterium bovis subsp bovis AF2122/97
ggcggucuguaagacagc

SEQ ID NO: 1210691 - RNA, 20 nt, Mycobacterium bovis subsp bovis AF2122/97
ggcggucugcagugcagcga

SEQ ID NO: 1210692 - RNA, 18 nt, Mycobacterium bovis subsp bovis AF2122/97
ggcggucugcagugcagc

SEQ ID NO: 1210693 - RNA, 13 nt, Mycobacterium bovis subsp bovis AF2122/97
ggcggucggcugg

SEQ ID NO: 1210694 - RNA, 17 nt, Mycobacterium bovis subsp bovis AF2122/97
ggcggugcaguggcuac

SEQ ID NO: 1210695 - RNA, 21 nt, Mycobacterium bovis subsp bovis AF2122/97
ggcggugccaucgggcgcggu

SEQ ID NO: 1210696 - RNA, 13 nt, Mycobacterium bovis subsp bovis AF2122/97
ggcggugccgccg

SEQ ID NO: 1210697 - RNA, 15 nt, Mycobacterium bovis subsp bovis AF2122/97
ggcggugcgcaccac

SEQ ID NO: 1210698 - RNA, 19 nt, Mycobacterium bovis subsp bovis AF2122/97
ggcggucuuuuugggcuug

SEQ ID NO: 1210699 - RNA, 13 nt, Mycobacterium bovis subsp bovis AF2122/97
ggcggugaacacc

SEQ ID NO: 1210700 - RNA, 14 nt, Mycobacterium bovis subsp bovis AF2122/97
ggcggugaaggccc

SEQ ID NO: 1210701 - RNA, 16 nt, Mycobacterium bovis subsp bovis AF2122/97
ggcggugacggcggca

SEQ ID NO: 1210702 - RNA, 22 nt, Mycobacterium bovis subsp bovis AF2122/97
ggcggugcggguggugccggcg

SEQ ID NO: 1210703 - RNA, 14 nt, Mycobacterium bovis subsp bovis AF2122/97
ggcgguggcgaggu

SEQ ID NO: 1210704 - RNA, 22 nt, Mycobacterium bovis subsp bovis AF2122/97
ggcgguugaucgccggccugcu

SEQ ID NO: 1210705 - RNA, 23 nt, Mycobacterium bovis subsp bovis AF2122/97
ggcguacccguuaugcgccgccc

SEQ ID NO: 1210706 - RNA, 15 nt, Mycobacterium bovis subsp bovis AF2122/97
ggcguaccagcuggc

SEQ ID NO: 1210707 - RNA, 16 nt, Mycobacterium bovis subsp bovis AF2122/97
ggcgucccagggcaca

SEQ ID NO: 1210708 - RNA, 15 nt, Mycobacterium bovis subsp bovis AF2122/97
ggcguccgcccagca

SEQ ID NO: 1210709 - RNA, 23 nt, Mycobacterium bovis subsp bovis AF2122/97
ggcgucagugcagaagacaagug

SEQ ID NO: 1210710 - RNA, 12 nt, Mycobacterium bovis subsp bovis AF2122/97
ggcguccagcag

SEQ ID NO: 1210711 - RNA, 13 nt, Mycobacterium bovis subsp bovis AF2122/97
ggcgucagcagca

SEQ ID NO: 1210712 - RNA, 13 nt, Mycobacterium bovis subsp bovis AF2122/97
gaagagcaccgcg

SEQ ID NO: 1210713 - RNA, 14 nt, Mycobacterium bovis subsp bovis AF2122/97
gaagagcaggccca

SEQ ID NO: 1210714 - RNA, 23 nt, Mycobacterium bovis subsp bovis AF2122/97
gaagaccucgucgcgucgccaga

SEQ ID NO: 1210715 - RNA, 18 nt, Mycobacterium bovis subsp bovis AF2122/97
gaagaccuggccugcggc

SEQ ID NO: 1210716 - RNA, 17 nt, Mycobacterium bovis subsp bovis AF2122/97
gaagaccaggccgguga

SEQ ID NO: 1210717 - RNA, 15 nt, Mycobacterium bovis subsp bovis AF2122/97
gaagaucaccucccg

SEQ ID NO: 1210718 - RNA, 19 nt, Mycobacterium bovis subsp bovis AF2122/97
gaagaucaccucccgcggc

SEQ ID NO: 1210719 - RNA, 18 nt, Mycobacterium bovis subsp bovis AF2122/97
gaagagcggagccggcgc

SEQ ID NO: 1210720 - RNA, 22 nt, Mycobacterium bovis subsp bovis AF2122/97
gaagaucggcgcuagccaggga

SEQ ID NO: 1210721 - RNA, 19 nt, Mycobacterium bovis subsp bovis AF2122/97
gaagaucgcgugccacagc

SEQ ID NO: 1210722 - RNA, 16 nt, Mycobacterium bovis subsp bovis AF2122/97
gaagaacuggcugcug

SEQ ID NO: 1210723 - RNA, 14 nt, Mycobacterium bovis subsp bovis AF2122/97
gaagacaccaggcc

SEQ ID NO: 1210724 - RNA, 15 nt, Mycobacterium bovis subsp bovis AF2122/97
gaagaagugcucaca

SEQ ID NO: 1210725 - RNA, 20 nt, Mycobacterium bovis subsp bovis AF2122/97
gaagcucaauuccaugcagu

SEQ ID NO: 1210726 - RNA, 20 nt, Mycobacterium bovis subsp bovis AF2122/97
gaagcgaugccgugcugggc

SEQ ID NO: 1210727 - RNA, 18 nt, Mycobacterium bovis subsp bovis AF2122/97
gaagccuguagucccuca

SEQ ID NO: 1210728 - RNA, 19 nt, Mycobacterium bovis subsp bovis AF2122/97
gaagccgacguugaagccg

SEQ ID NO: 1210729 - RNA, 22 nt, Mycobacterium bovis subsp bovis AF2122/97
gaagccgacguugaagccgccg

SEQ ID NO: 1210730 - RNA, 20 nt, Mycobacterium bovis subsp bovis AF2122/97
gaagccgacgauccacggcg

SEQ ID NO: 1210731 - RNA, 22 nt, Mycobacterium bovis subsp bovis AF2122/97
gaagccgcaccgcuguugcauc

SEQ ID NO: 1210732 - RNA, 14 nt, Mycobacterium bovis subsp bovis AF2122/97
gaagccgccgggca

SEQ ID NO: 1210733 - RNA, 15 nt, Mycobacterium bovis subsp bovis AF2122/97
gaagccgccgggcau

SEQ ID NO: 1210734 - RNA, 17 nt, Mycobacterium bovis subsp bovis AF2122/97
gaagccgcgcaucuguc

SEQ ID NO: 1210735 - RNA, 15 nt, Mycobacterium bovis subsp bovis AF2122/97
gaagccgagcaucag

SEQ ID NO: 1210736 - RNA, 19 nt, Mycobacterium bovis subsp bovis AF2122/97
gaagccggccacuacggcc

SEQ ID NO: 1210737 - RNA, 14 nt, Mycobacterium bovis subsp bovis AF2122/97
gaagccggcgccgg

SEQ ID NO: 1210738 - RNA, 17 nt, Mycobacterium bovis subsp bovis AF2122/97
gaagccggcgccggcuu

SEQ ID NO: 1210739 - RNA, 17 nt, Mycobacterium bovis subsp bovis AF2122/97
gaagauggcaccgcccc

SEQ ID NO: 1210740 - RNA, 22 nt, Mycobacterium bovis subsp bovis AF2122/97
gaagaugccugcuagcagcagc

SEQ ID NO: 1210741 - RNA, 13 nt, Mycobacterium bovis subsp bovis AF2122/97
gaagaugccugcu

SEQ ID NO: 1210742 - RNA, 17 nt, Mycobacterium bovis subsp bovis AF2122/97
gaagcccuuguagcaca

SEQ ID NO: 1210743 - RNA, 19 nt, Mycobacterium bovis subsp bovis AF2122/97
gaagccgacgaccagcaga

SEQ ID NO: 1210744 - RNA, 17 nt, Mycobacterium bovis subsp bovis AF2122/97
gaagccagaucagccgc

SEQ ID NO: 1210745 - RNA, 18 nt, Mycobacterium bovis subsp bovis AF2122/97
gaagccagaucgcuagga

SEQ ID NO: 1210746 - RNA, 17 nt, Mycobacterium bovis subsp bovis AF2122/97
gaagccagcgcagcacc

SEQ ID NO: 1210747 - RNA, 23 nt, Mycobacterium bovis subsp bovis AF2122/97
gaagcaucgcguuguaggcuucc

SEQ ID NO: 1210748 - RNA, 16 nt, Mycobacterium bovis subsp bovis AF2122/97
gaagcugcugcugcuu

SEQ ID NO: 1210749 - RNA, 19 nt, Mycobacterium bovis subsp bovis AF2122/97
gaagcuggcgugcagcagg

SEQ ID NO: 1210750 - RNA, 14 nt, Mycobacterium bovis subsp bovis AF2122/97
gaagcuggccaccg

SEQ ID NO: 1210751 - RNA, 23 nt, Mycobacterium bovis subsp bovis AF2122/97
gaagcuggcacgcagagccaaca

SEQ ID NO: 1210752 - RNA, 20 nt, Mycobacterium bovis subsp bovis AF2122/97
gaaggcuucggugacccggg

SEQ ID NO: 1210753 - RNA, 13 nt, Mycobacterium bovis subsp bovis AF2122/97
gaaggcugucagu

SEQ ID NO: 1210754 - RNA, 17 nt, Mycobacterium bovis subsp bovis AF2122/97
gaagugcuugggccgcu

SEQ ID NO: 1210755 - RNA, 15 nt, Mycobacterium bovis subsp bovis AF2122/97
gaaguccagcuggcc

SEQ ID NO: 1210756 - RNA, 21 nt, Mycobacterium bovis subsp bovis AF2122/97
gaaggugggauugaagcuggc

SEQ ID NO: 1210757 - RNA, 18 nt, Mycobacterium bovis subsp bovis AF2122/97
gaagguguuggugcgggg

SEQ ID NO: 1210758 - RNA, 16 nt, Mycobacterium bovis subsp bovis AF2122/97
gaaggugaaucgacug

SEQ ID NO: 1210759 - RNA, 14 nt, Mycobacterium bovis subsp bovis AF2122/97
gaaggugacgacga

SEQ ID NO: 1210760 - RNA, 12 nt, Mycobacterium bovis subsp bovis AF2122/97
gaaggugcuggu

SEQ ID NO: 1210761 - RNA, 18 nt, Mycobacterium bovis subsp bovis AF2122/97
gaaguagugcucgcagcc

SEQ ID NO: 1210762 - RNA, 14 nt, Mycobacterium bovis subsp bovis AF2122/97
gaaguuggcguggu

SEQ ID NO: 1210763 - RNA, 14 nt, Mycobacterium bovis subsp bovis AF2122/97
gaaguuggcugagc

SEQ ID NO: 1210764 - RNA, 22 nt, Mycobacterium bovis subsp bovis AF2122/97
gaaguugugcgcacucuuuccu

SEQ ID NO: 1210765 - RNA, 17 nt, Mycobacterium bovis subsp bovis AF2122/97
gaagugucgcugcaacc

SEQ ID NO: 1210766 - RNA, 17 nt, Mycobacterium bovis subsp bovis AF2122/97
gaauacgaggacgacga

SEQ ID NO: 1210767 - RNA, 15 nt, Mycobacterium bovis subsp bovis AF2122/97
gaauacgcgccgccg

SEQ ID NO: 1210768 - RNA, 16 nt, Mycobacterium bovis subsp bovis AF2122/97
gaauacaccugcugga

SEQ ID NO: 1210769 - RNA, 13 nt, Mycobacterium bovis subsp bovis AF2122/97
gaauacaacagcu

SEQ ID NO: 1210770 - RNA, 22 nt, Mycobacterium bovis subsp bovis AF2122/97
gaauacagcuugaucgccgagg

SEQ ID NO: 1210771 - RNA, 15 nt, Mycobacterium bovis subsp bovis AF2122/97
gaauccgggaagccg

SEQ ID NO: 1210772 - RNA, 20 nt, Mycobacterium bovis subsp bovis AF2122/97
gaauccggcccacuucccag

SEQ ID NO: 1210773 - RNA, 20 nt, Mycobacterium bovis subsp bovis AF2122/97
gaauccggcaaccaccggcc

SEQ ID NO: 1210774 - RNA, 16 nt, Mycobacterium bovis subsp bovis AF2122/97
gaauccccgcggcggu

SEQ ID NO: 1210775 - RNA, 17 nt, Mycobacterium bovis subsp bovis AF2122/97
gaaucccgcgcccggcc

SEQ ID NO: 1210776 - RNA, 23 nt, Mycobacterium bovis subsp bovis AF2122/97
gaaucccguauugauacugcccg

SEQ ID NO: 1210777 - RNA, 13 nt, Mycobacterium bovis subsp bovis AF2122/97
gaaucggcggcgg

SEQ ID NO: 1210778 - RNA, 17 nt, Mycobacterium bovis subsp bovis AF2122/97
gaaucgguuucgaccug

SEQ ID NO: 1210779 - RNA, 14 nt, Mycobacterium bovis subsp bovis AF2122/97
gaaucgggucagca

SEQ ID NO: 1210780 - RNA, 13 nt, Mycobacterium bovis subsp bovis AF2122/97
gaaucgcugguga

SEQ ID NO: 1210781 - RNA, 17 nt, Mycobacterium bovis subsp bovis AF2122/97
gaaucgcggagccagga

SEQ ID NO: 1210782 - RNA, 14 nt, Mycobacterium bovis subsp bovis AF2122/97
gaaugcugggcccg

SEQ ID NO: 1210783 - RNA, 18 nt, Mycobacterium bovis subsp bovis AF2122/97
gaaugcugggcccgccag

SEQ ID NO: 1210784 - RNA, 20 nt, Mycobacterium bovis subsp bovis AF2122/97
gaaugcugggcccgccagcc

SEQ ID NO: 1210785 - RNA, 16 nt, Mycobacterium bovis subsp bovis AF2122/97
gaaugcuggggccugg

SEQ ID NO: 1210786 - RNA, 17 nt, Mycobacterium bovis subsp bovis AF2122/97
gaaugcuggggccuggu

SEQ ID NO: 1210787 - RNA, 13 nt, Mycobacterium bovis subsp bovis AF2122/97
gaaucuccgcgcg

SEQ ID NO: 1210788 - RNA, 22 nt, Mycobacterium bovis subsp bovis AF2122/97
gaaucugaagggcaagaacccg

SEQ ID NO: 1210789 - RNA, 17 nt, Mycobacterium bovis subsp bovis AF2122/97
gaaucugccggccggcg

SEQ ID NO: 1210790 - RNA, 13 nt, Mycobacterium bovis subsp bovis AF2122/97
gaaucugccucuc

SEQ ID NO: 1210791 - RNA, 15 nt, Mycobacterium bovis subsp bovis AF2122/97
gaaucaccccggcgg

SEQ ID NO: 1210792 - RNA, 14 nt, Mycobacterium bovis subsp bovis AF2122/97
gacaacagcuugga

SEQ ID NO: 1210793 - RNA, 19 nt, Mycobacterium bovis subsp bovis AF2122/97
gacacagcaccguccucgg

SEQ ID NO: 1210794 - RNA, 16 nt, Mycobacterium bovis subsp bovis AF2122/97
gacaaagccacgcaga

SEQ ID NO: 1210795 - RNA, 20 nt, Mycobacterium bovis subsp bovis AF2122/97
gacaaagccgaacgacagca

SEQ ID NO: 1210796 - RNA, 23 nt, Mycobacterium bovis subsp bovis AF2122/97
gacaaagcgcgcuggcuacccac

SEQ ID NO: 1210797 - RNA, 14 nt, Mycobacterium bovis subsp bovis AF2122/97
gacaaagcggcugc

SEQ ID NO: 1210798 - RNA, 13 nt, Mycobacterium bovis subsp bovis AF2122/97
gacaacaccacgg

SEQ ID NO: 1210799 - RNA, 19 nt, Mycobacterium bovis subsp bovis AF2122/97
gaauggcccuugcucgucc

SEQ ID NO: 1210800 - RNA, 15 nt, Mycobacterium bovis subsp bovis AF2122/97
gaauggccgccgcag

SEQ ID NO: 1210801 - RNA, 17 nt, Mycobacterium bovis subsp bovis AF2122/97
gaauggccgccgcagcu

SEQ ID NO: 1210802 - RNA, 13 nt, Mycobacterium bovis subsp bovis AF2122/97
gaauggccgccuu

SEQ ID NO: 1210803 - RNA, 19 nt, Mycobacterium bovis subsp bovis AF2122/97
gaauucauccgggcucgca

SEQ ID NO: 1210804 - RNA, 15 nt, Mycobacterium bovis subsp bovis AF2122/97
gaauuccgccugcuc

SEQ ID NO: 1210805 - RNA, 19 nt, Mycobacterium bovis subsp bovis AF2122/97
gaauucccaugcugcgcaa

SEQ ID NO: 1210806 - RNA, 14 nt, Mycobacterium bovis subsp bovis AF2122/97
gaauuccggcugcu

SEQ ID NO: 1210807 - RNA, 19 nt, Mycobacterium bovis subsp bovis AF2122/97
gaauucgaccacucgccgc

SEQ ID NO: 1210808 - RNA, 14 nt, Mycobacterium bovis subsp bovis AF2122/97
gaauuccuuccugg

SEQ ID NO: 1210809 - RNA, 14 nt, Mycobacterium bovis subsp bovis AF2122/97
gaccagggcagcgg

SEQ ID NO: 1210810 - RNA, 16 nt, Mycobacterium bovis subsp bovis AF2122/97
gaccagggcagcggcc

SEQ ID NO: 1210811 - RNA, 23 nt, Mycobacterium bovis subsp bovis AF2122/97
gaccagggcagcggccagggcac

SEQ ID NO: 1210812 - RNA, 14 nt, Mycobacterium bovis subsp bovis AF2122/97
gaccagggccgccg

SEQ ID NO: 1210813 - RNA, 17 nt, Mycobacterium bovis subsp bovis AF2122/97
gaccaggcggcgcgggu

SEQ ID NO: 1210814 - RNA, 14 nt, Mycobacterium bovis subsp bovis AF2122/97
gaccaggucugcgg

SEQ ID NO: 1210815 - RNA, 18 nt, Mycobacterium bovis subsp bovis AF2122/97
gaccagugaccgcagucc

SEQ ID NO: 1210816 - RNA, 23 nt, Mycobacterium bovis subsp bovis AF2122/97
gaccagugaucagcgcaucgccg

SEQ ID NO: 1210817 - RNA, 16 nt, Mycobacterium bovis subsp bovis AF2122/97
gaccagggucugcuca

SEQ ID NO: 1210818 - RNA, 14 nt, Mycobacterium bovis subsp bovis AF2122/97
gacccacugcaggc

SEQ ID NO: 1210819 - RNA, 15 nt, Mycobacterium bovis subsp bovis AF2122/97
gacccaacgcagauc

SEQ ID NO: 1210820 - RNA, 17 nt, Mycobacterium bovis subsp bovis AF2122/97
gacccaagucgccgagg

SEQ ID NO: 1210821 - RNA, 20 nt, Mycobacterium bovis subsp bovis AF2122/97
gacccacucaucagagcgcu

SEQ ID NO: 1210822 - RNA, 18 nt, Mycobacterium bovis subsp bovis AF2122/97
gacccaccgucacccccg

SEQ ID NO: 1210823 - RNA, 16 nt, Mycobacterium bovis subsp bovis AF2122/97
gacccacagucgccgg

SEQ ID NO: 1210824 - RNA, 23 nt, Mycobacterium bovis subsp bovis AF2122/97
gacccacagucgccggccggccc

SEQ ID NO: 1210825 - RNA, 18 nt, Mycobacterium bovis subsp bovis AF2122/97
gacccacaucaggucggc

SEQ ID NO: 1210826 - RNA, 20 nt, Mycobacterium bovis subsp bovis AF2122/97
gacccaccaauccacagauu

SEQ ID NO: 1210827 - RNA, 18 nt, Mycobacterium bovis subsp bovis AF2122/97
gacccaccgccccggcgg

SEQ ID NO: 1210828 - RNA, 13 nt, Mycobacterium bovis subsp bovis AF2122/97
gacccgccgcgcc

SEQ ID NO: 1210829 - RNA, 19 nt, Mycobacterium bovis subsp bovis AF2122/97
gacccgcccuugccgccga

SEQ ID NO: 1210830 - RNA, 19 nt, Mycobacterium bovis subsp bovis AF2122/97
gacccgcuauucggcggca

SEQ ID NO: 1210831 - RNA, 21 nt, Mycobacterium bovis subsp bovis AF2122/97
gacccgcgcgucgcccagugc

SEQ ID NO: 1210832 - RNA, 14 nt, Mycobacterium bovis subsp bovis AF2122/97
gacccgcucgcggc

SEQ ID NO: 1210833 - RNA, 14 nt, Mycobacterium bovis subsp bovis AF2122/97
gacccgcugggccg

SEQ ID NO: 1210834 - RNA, 22 nt, Mycobacterium bovis subsp bovis AF2122/97
gacccgcuggucgaugccuucg

SEQ ID NO: 1210835 - RNA, 19 nt, Mycobacterium bovis subsp bovis AF2122/97
gacccgggccgcggcggcc

SEQ ID NO: 1210836 - RNA, 21 nt, Mycobacterium bovis subsp bovis AF2122/97
gacccgggccgcggcggccag

SEQ ID NO: 1210837 - RNA, 12 nt, Mycobacterium bovis subsp bovis AF2122/97
gacccgggccgg

SEQ ID NO: 1210838 - RNA, 14 nt, Mycobacterium bovis subsp bovis AF2122/97
gacccgggucggca

SEQ ID NO: 1210839 - RNA, 23 nt, Mycobacterium bovis subsp bovis AF2122/97
gacccggcccagcgcccccagca

SEQ ID NO: 1210840 - RNA, 15 nt, Mycobacterium bovis subsp bovis AF2122/97
gacccggccagcggc

SEQ ID NO: 1210841 - RNA, 16 nt, Mycobacterium bovis subsp bovis AF2122/97
gacccggcccagcgcc

SEQ ID NO: 1210842 - RNA, 20 nt, Mycobacterium bovis subsp bovis AF2122/97
gacccggcagcccggcggcc

SEQ ID NO: 1210843 - RNA, 17 nt, Mycobacterium bovis subsp bovis AF2122/97
gacccggccaagggugc

SEQ ID NO: 1210844 - RNA, 21 nt, Mycobacterium bovis subsp bovis AF2122/97
gacccggaccuucggcggugc

SEQ ID NO: 1210845 - RNA, 16 nt, Mycobacterium bovis subsp bovis AF2122/97
gacccgcugggccgca

SEQ ID NO: 1210846 - RNA, 14 nt, Mycobacterium bovis subsp bovis AF2122/97
gacccguaccagcc

SEQ ID NO: 1210847 - RNA, 24 nt, Mycobacterium bovis subsp bovis AF2122/97
gacccguccaacuacgccagccgc

SEQ ID NO: 1210848 - RNA, 15 nt, Mycobacterium bovis subsp bovis AF2122/97
gacccggcgccgucg

SEQ ID NO: 1210849 - RNA, 16 nt, Mycobacterium bovis subsp bovis AF2122/97
gacccuccagcacgcc

SEQ ID NO: 1210850 - RNA, 17 nt, Mycobacterium bovis subsp bovis AF2122/97
gacccucagcaccgcug

SEQ ID NO: 1210851 - RNA, 21 nt, Mycobacterium bovis subsp bovis AF2122/97
gacccguugaacucgaagacc

SEQ ID NO: 1210852 - RNA, 20 nt, Mycobacterium bovis subsp bovis AF2122/97
gacccugcugcagggccugg

SEQ ID NO: 1210853 - RNA, 20 nt, Mycobacterium bovis subsp bovis AF2122/97
gacccugggguugcaucaug

SEQ ID NO: 1210854 - RNA, 19 nt, Mycobacterium bovis subsp bovis AF2122/97
gacccuggccgucccacca

SEQ ID NO: 1210855 - RNA, 23 nt, Mycobacterium bovis subsp bovis AF2122/97
gacccguucagcgacggccgcca

SEQ ID NO: 1210856 - RNA, 16 nt, Mycobacterium bovis subsp bovis AF2122/97
gacccugcgccgccac

SEQ ID NO: 1210857 - RNA, 19 nt, Mycobacterium bovis subsp bovis AF2122/97
gacccugcccagcaccccc

SEQ ID NO: 1210858 - RNA, 21 nt, Mycobacterium bovis subsp bovis AF2122/97
gaccagcaaccaccccagggc

SEQ ID NO: 1210859 - RNA, 13 nt, Mycobacterium bovis subsp bovis AF2122/97
gaccagcaccgcc

SEQ ID NO: 1210860 - RNA, 14 nt, Mycobacterium bovis subsp bovis AF2122/97
gaccagcagaucca

SEQ ID NO: 1210861 - RNA, 19 nt, Mycobacterium bovis subsp bovis AF2122/97
gaccagcagauccaggcgu

SEQ ID NO: 1210862 - RNA, 21 nt, Mycobacterium bovis subsp bovis AF2122/97
gaccagcaggcccuggccacc

SEQ ID NO: 1210863 - RNA, 18 nt, Mycobacterium bovis subsp bovis AF2122/97
gaccagccgaucaucacc

SEQ ID NO: 1210864 - RNA, 23 nt, Mycobacterium bovis subsp bovis AF2122/97
gaccagcgccccggcgcguucca

SEQ ID NO: 1210865 - RNA, 20 nt, Mycobacterium bovis subsp bovis AF2122/97
gaccaggaacggcucggccg

SEQ ID NO: 1210866 - RNA, 14 nt, Mycobacterium bovis subsp bovis AF2122/97
gaccaggcgcggcg

SEQ ID NO: 1210867 - RNA, 19 nt, Mycobacterium bovis subsp bovis AF2122/97
gaccacgucgagguccacc

SEQ ID NO: 1210868 - RNA, 20 nt, Mycobacterium bovis subsp bovis AF2122/97
gaccacgucgagguccacca

SEQ ID NO: 1210869 - RNA, 13 nt, Mycobacterium bovis subsp bovis AF2122/97
gaccacggcaccg

SEQ ID NO: 1210870 - RNA, 17 nt, Mycobacterium bovis subsp bovis AF2122/97
gaccacucgagcgcuca

SEQ ID NO: 1210871 - RNA, 15 nt, Mycobacterium bovis subsp bovis AF2122/97
gaccacugaucggca

SEQ ID NO: 1210872 - RNA, 21 nt, Mycobacterium bovis subsp bovis AF2122/97
gaccacugcccgggguccauc

SEQ ID NO: 1210873 - RNA, 14 nt, Mycobacterium bovis subsp bovis AF2122/97
gaccagagccgcga

SEQ ID NO: 1210874 - RNA, 14 nt, Mycobacterium bovis subsp bovis AF2122/97
gaccagagcuucgc

SEQ ID NO: 1210875 - RNA, 16 nt, Mycobacterium bovis subsp bovis AF2122/97
gaccagagcuucgccg

SEQ ID NO: 1210876 - RNA, 16 nt, Mycobacterium bovis subsp bovis AF2122/97
gaccagaaucucgccg

SEQ ID NO: 1210877 - RNA, 23 nt, Mycobacterium bovis subsp bovis AF2122/97
gaccacuguuggugccgccacca

SEQ ID NO: 1210878 - RNA, 16 nt, Mycobacterium bovis subsp bovis AF2122/97
gaccagaaccuggagc

SEQ ID NO: 1210879 - RNA, 21 nt, Mycobacterium bovis subsp bovis AF2122/97
gaccacuuagcuggcgggggu

SEQ ID NO: 1210880 - RNA, 15 nt, Mycobacterium bovis subsp bovis AF2122/97
gacauugccacggcg

SEQ ID NO: 1210881 - RNA, 23 nt, Mycobacterium bovis subsp bovis AF2122/97
gaccaacacccccccccccaccc

SEQ ID NO: 1210882 - RNA, 15 nt, Mycobacterium bovis subsp bovis AF2122/97
gaccaagguguccag

SEQ ID NO: 1210883 - RNA, 20 nt, Mycobacterium bovis subsp bovis AF2122/97
gaccaagguguccagcaccu

SEQ ID NO: 1210884 - RNA, 14 nt, Mycobacterium bovis subsp bovis AF2122/97
gacagcagccgccg

SEQ ID NO: 1210885 - RNA, 12 nt, Mycobacterium bovis subsp bovis AF2122/97
gacagcgagcga

SEQ ID NO: 1210886 - RNA, 21 nt, Mycobacterium bovis subsp bovis AF2122/97
gacagcgagcgacguuaauga

SEQ ID NO: 1210887 - RNA, 12 nt, Mycobacterium bovis subsp bovis AF2122/97
gacagacacagc

SEQ ID NO: 1210888 - RNA, 23 nt, Mycobacterium bovis subsp bovis AF2122/97
gacacugcgaaggaccagagcuc

SEQ ID NO: 1210889 - RNA, 14 nt, Mycobacterium bovis subsp bovis AF2122/97
gacacugugcgccu

SEQ ID NO: 1210890 - RNA, 14 nt, Mycobacterium bovis subsp bovis AF2122/97
gacacugcagugau

SEQ ID NO: 1210891 - RNA, 15 nt, Mycobacterium bovis subsp bovis AF2122/97
gacacgacgugcagg

SEQ ID NO: 1210892 - RNA, 17 nt, Mycobacterium bovis subsp bovis AF2122/97
gacaccgugaccgccgc

SEQ ID NO: 1210893 - RNA, 15 nt, Mycobacterium bovis subsp bovis AF2122/97
gacacauugaccagg

SEQ ID NO: 1210894 - RNA, 16 nt, Mycobacterium bovis subsp bovis AF2122/97
gacacauugaccaggu

SEQ ID NO: 1210895 - RNA, 22 nt, Mycobacterium bovis subsp bovis AF2122/97
gacacgaucgcgucggcuaccu

SEQ ID NO: 1210896 - RNA, 21 nt, Mycobacterium bovis subsp bovis AF2122/97
gacacguugcagcucgauccg

SEQ ID NO: 1210897 - RNA, 19 nt, Mycobacterium bovis subsp bovis AF2122/97
gacacguuguucaccgacg

SEQ ID NO: 1210898 - RNA, 22 nt, Mycobacterium bovis subsp bovis AF2122/97
gacaucggcccgaucaccaucc

SEQ ID NO: 1210899 - RNA, 21 nt, Mycobacterium bovis subsp bovis AF2122/97
gacaucggucagcauggggua

SEQ ID NO: 1210900 - RNA, 21 nt, Mycobacterium bovis subsp bovis AF2122/97
gacaucggucagcgggcacgc

SEQ ID NO: 1210901 - RNA, 16 nt, Mycobacterium bovis subsp bovis AF2122/97
gacaucgguggcggcc

SEQ ID NO: 1210902 - RNA, 19 nt, Mycobacterium bovis subsp bovis AF2122/97
gacaucgggccgccgagcu

SEQ ID NO: 1210903 - RNA, 23 nt, Mycobacterium bovis subsp bovis AF2122/97
gacaucgguggcggccuccgagg

SEQ ID NO: 1210904 - RNA, 15 nt, Mycobacterium bovis subsp bovis AF2122/97
gacaucaccaccgcc

SEQ ID NO: 1210905 - RNA, 17 nt, Mycobacterium bovis subsp bovis AF2122/97
gacaucguaggccggca

SEQ ID NO: 1210906 - RNA, 15 nt, Mycobacterium bovis subsp bovis AF2122/97
gacaucgucgccagg

SEQ ID NO: 1210907 - RNA, 19 nt, Mycobacterium bovis subsp bovis AF2122/97
gacagcgcgggacacgucg

SEQ ID NO: 1210908 - RNA, 20 nt, Mycobacterium bovis subsp bovis AF2122/97
gacagcgccaugcccucggc

SEQ ID NO: 1210909 - RNA, 13 nt, Mycobacterium bovis subsp bovis AF2122/97
gacagcgcugggc

SEQ ID NO: 1210910 - RNA, 17 nt, Mycobacterium bovis subsp bovis AF2122/97
gacagcgccuuguuggc

SEQ ID NO: 1210911 - RNA, 15 nt, Mycobacterium bovis subsp bovis AF2122/97
gacaggaccgguggg

SEQ ID NO: 1210912 - RNA, 17 nt, Mycobacterium bovis subsp bovis AF2122/97
gacagcugguugugcug

SEQ ID NO: 1210913 - RNA, 19 nt, Mycobacterium bovis subsp bovis AF2122/97
gacagcugguugugcuggg

SEQ ID NO: 1210914 - RNA, 16 nt, Mycobacterium bovis subsp bovis AF2122/97
gacagcgugccgaaca

SEQ ID NO: 1210915 - RNA, 22 nt, Mycobacterium bovis subsp bovis AF2122/97
gacagcucacgcugaagccgcu

SEQ ID NO: 1210916 - RNA, 18 nt, Mycobacterium bovis subsp bovis AF2122/97
gacauacgagcagugacc

SEQ ID NO: 1210917 - RNA, 17 nt, Mycobacterium bovis subsp bovis AF2122/97
gacgggauagccguucg

SEQ ID NO: 1210918 - RNA, 22 nt, Mycobacterium bovis subsp bovis AF2122/97
gacgggcgcguccucgccgcac

SEQ ID NO: 1210919 - RNA, 22 nt, Mycobacterium bovis subsp bovis AF2122/97
gacgggccacgaugcgcacacc

SEQ ID NO: 1210920 - RNA, 21 nt, Mycobacterium bovis subsp bovis AF2122/97
gacgggcacccgagccgcaca

SEQ ID NO: 1210921 - RNA, 21 nt, Mycobacterium bovis subsp bovis AF2122/97
gacggggcgagcaugccguug

SEQ ID NO: 1210922 - RNA, 17 nt, Mycobacterium bovis subsp bovis AF2122/97
gacggggugagccgacc

SEQ ID NO: 1210923 - RNA, 15 nt, Mycobacterium bovis subsp bovis AF2122/97
gacgggucggcgccg

SEQ ID NO: 1210924 - RNA, 14 nt, Mycobacterium bovis subsp bovis AF2122/97
gacgggucgccgcc

SEQ ID NO: 1210925 - RNA, 23 nt, Mycobacterium bovis subsp bovis AF2122/97
gacgggguuguggucgaguugaa

SEQ ID NO: 1210926 - RNA, 22 nt, Mycobacterium bovis subsp bovis AF2122/97
gacggguagcguacucccccga

SEQ ID NO: 1210927 - RNA, 19 nt, Mycobacterium bovis subsp bovis AF2122/97
gacggggucgcccggggcg

SEQ ID NO: 1210928 - RNA, 20 nt, Mycobacterium bovis subsp bovis AF2122/97
gacgggaaacuccgcggcgc

SEQ ID NO: 1210929 - RNA, 15 nt, Mycobacterium bovis subsp bovis AF2122/97
gacggcaggaaugau

SEQ ID NO: 1210930 - RNA, 21 nt, Mycobacterium bovis subsp bovis AF2122/97
gacggcaggcucgggcaaggc

SEQ ID NO: 1210931 - RNA, 13 nt, Mycobacterium bovis subsp bovis AF2122/97
gacggcagugcug

SEQ ID NO: 1210932 - RNA, 22 nt, Mycobacterium bovis subsp bovis AF2122/97
gacggcuuccaacucggcggcc

SEQ ID NO: 1210933 - RNA, 21 nt, Mycobacterium bovis subsp bovis AF2122/97
gacggcuucggcagccgcaua

SEQ ID NO: 1210934 - RNA, 11 nt, Mycobacterium bovis subsp bovis AF2122/97
gacggaucugg

SEQ ID NO: 1210935 - RNA, 14 nt, Mycobacterium bovis subsp bovis AF2122/97
gacggcaagggcau

SEQ ID NO: 1210936 - RNA, 18 nt, Mycobacterium bovis subsp bovis AF2122/97
gacggcagccaccagcga

SEQ ID NO: 1210937 - RNA, 19 nt, Mycobacterium bovis subsp bovis AF2122/97
gacggcagccaccagcgac

SEQ ID NO: 1210938 - RNA, 17 nt, Mycobacterium bovis subsp bovis AF2122/97
gacggcaccggcccaga

SEQ ID NO: 1210939 - RNA, 22 nt, Mycobacterium bovis subsp bovis AF2122/97
gacggaucgucgugcacggcgg

SEQ ID NO: 1210940 - RNA, 18 nt, Mycobacterium bovis subsp bovis AF2122/97
gacgucucuggugcaggu

SEQ ID NO: 1210941 - RNA, 19 nt, Mycobacterium bovis subsp bovis AF2122/97
gacgucgggcauggcggcg

SEQ ID NO: 1210942 - RNA, 19 nt, Mycobacterium bovis subsp bovis AF2122/97
gacgucgucgucgacggcc

SEQ ID NO: 1210943 - RNA, 20 nt, Mycobacterium bovis subsp bovis AF2122/97
gacgucguuacuggagauac

SEQ ID NO: 1210944 - RNA, 17 nt, Mycobacterium bovis subsp bovis AF2122/97
gacgugaagaugcccuu

SEQ ID NO: 1210945 - RNA, 23 nt, Mycobacterium bovis subsp bovis AF2122/97
gacgucuuugacgaacuggucuc

SEQ ID NO: 1210946 - RNA, 15 nt, Mycobacterium bovis subsp bovis AF2122/97
gacgugaaugguggu

SEQ ID NO: 1210947 - RNA, 22 nt, Mycobacterium bovis subsp bovis AF2122/97
gacgugagggucaugucgauca

SEQ ID NO: 1210948 - RNA, 18 nt, Mycobacterium bovis subsp bovis AF2122/97
gacgugaguuucaccacu

SEQ ID NO: 1210949 - RNA, 19 nt, Mycobacterium bovis subsp bovis AF2122/97
gacgucgcggauugccgcg

SEQ ID NO: 1210950 - RNA, 23 nt, Mycobacterium bovis subsp bovis AF2122/97
gacgucgauggugcggcccaacc

SEQ ID NO: 1210951 - RNA, 20 nt, Mycobacterium bovis subsp bovis AF2122/97
gacgucgccaagaccagaag

SEQ ID NO: 1210952 - RNA, 15 nt, Mycobacterium bovis subsp bovis AF2122/97
gacgucgagcagcgc

SEQ ID NO: 1210953 - RNA, 14 nt, Mycobacterium bovis subsp bovis AF2122/97
gacguccaacagcg

SEQ ID NO: 1210954 - RNA, 17 nt, Mycobacterium bovis subsp bovis AF2122/97
gacguccaccagccggu

SEQ ID NO: 1210955 - RNA, 18 nt, Mycobacterium bovis subsp bovis AF2122/97
gacguccaccagccgguu

SEQ ID NO: 1210956 - RNA, 22 nt, Mycobacterium bovis subsp bovis AF2122/97
gacguccgcggucgcagcagac

SEQ ID NO: 1210957 - RNA, 19 nt, Mycobacterium bovis subsp bovis AF2122/97
gacgguggggucgccgucg

SEQ ID NO: 1210958 - RNA, 17 nt, Mycobacterium bovis subsp bovis AF2122/97
gacgguggugaucacgu

SEQ ID NO: 1210959 - RNA, 14 nt, Mycobacterium bovis subsp bovis AF2122/97
gacggugguccuga

SEQ ID NO: 1210960 - RNA, 20 nt, Mycobacterium bovis subsp bovis AF2122/97
gacgguguugguggcggggu

SEQ ID NO: 1210961 - RNA, 18 nt, Mycobacterium bovis subsp bovis AF2122/97
gacgguggggauggcgcc

SEQ ID NO: 1210962 - RNA, 16 nt, Mycobacterium bovis subsp bovis AF2122/97
gacggguggcccgacc

SEQ ID NO: 1210963 - RNA, 16 nt, Mycobacterium bovis subsp bovis AF2122/97
gacgcucgcugcagca

SEQ ID NO: 1210964 - RNA, 22 nt, Mycobacterium bovis subsp bovis AF2122/97
gacgcguucaacaccgccgacc

SEQ ID NO: 1210965 - RNA, 16 nt, Mycobacterium bovis subsp bovis AF2122/97
gacgcgugucugggac

SEQ ID NO: 1210966 - RNA, 18 nt, Mycobacterium bovis subsp bovis AF2122/97
gacgcggucggcggccgc

SEQ ID NO: 1210967 - RNA, 15 nt, Mycobacterium bovis subsp bovis AF2122/97
gacgcgucggcgacg

SEQ ID NO: 1210968 - RNA, 15 nt, Mycobacterium bovis subsp bovis AF2122/97
gacgcgucagcggcg

SEQ ID NO: 1210969 - RNA, 17 nt, Mycobacterium bovis subsp bovis AF2122/97
gacgcuggucggcggcu

SEQ ID NO: 1210970 - RNA, 14 nt, Mycobacterium bovis subsp bovis AF2122/97
gacgcugcgcgcca

SEQ ID NO: 1210971 - RNA, 22 nt, Mycobacterium bovis subsp bovis AF2122/97
gacgcggcgccgccaucaacaa

SEQ ID NO: 1210972 - RNA, 15 nt, Mycobacterium bovis subsp bovis AF2122/97
gacgcgcgcgaugga

SEQ ID NO: 1210973 - RNA, 20 nt, Mycobacterium bovis subsp bovis AF2122/97
gacgcgaucuguccgcgaac

SEQ ID NO: 1210974 - RNA, 23 nt, Mycobacterium bovis subsp bovis AF2122/97
gacgcgcaucgcacgggccacca

SEQ ID NO: 1210975 - RNA, 20 nt, Mycobacterium bovis subsp bovis AF2122/97
gacgcgcaugccccgaccgc

SEQ ID NO: 1210976 - RNA, 13 nt, Mycobacterium bovis subsp bovis AF2122/97
gacgcagaagccc

SEQ ID NO: 1210977 - RNA, 15 nt, Mycobacterium bovis subsp bovis AF2122/97
gacgcacgauccgca

SEQ ID NO: 1210978 - RNA, 16 nt, Mycobacterium bovis subsp bovis AF2122/97
gacgcgaacgcggcca

SEQ ID NO: 1210979 - RNA, 18 nt, Mycobacterium bovis subsp bovis AF2122/97
gacgcaaaauccccucgc

SEQ ID NO: 1210980 - RNA, 19 nt, Mycobacterium bovis subsp bovis AF2122/97
gacgcacgacugugcgccg

SEQ ID NO: 1210981 - RNA, 12 nt, Mycobacterium bovis subsp bovis AF2122/97
gacgaccgcgcg

SEQ ID NO: 1210982 - RNA, 14 nt, Mycobacterium bovis subsp bovis AF2122/97
gacgaccgcgcggc

SEQ ID NO: 1210983 - RNA, 11 nt, Mycobacterium bovis subsp bovis AF2122/97
gacgacccggg

SEQ ID NO: 1210984 - RNA, 18 nt, Mycobacterium bovis subsp bovis AF2122/97
gacgagaucugcgauggg

SEQ ID NO: 1210985 - RNA, 16 nt, Mycobacterium bovis subsp bovis AF2122/97
gacgagacgaaccgcc

SEQ ID NO: 1210986 - RNA, 12 nt, Mycobacterium bovis subsp bovis AF2122/97
gacgagccacca

SEQ ID NO: 1210987 - RNA, 14 nt, Mycobacterium bovis subsp bovis AF2122/97
gacgagcaccgcgc

SEQ ID NO: 1210988 - RNA, 17 nt, Mycobacterium bovis subsp bovis AF2122/97
gacgagccagaggugga

SEQ ID NO: 1210989 - RNA, 14 nt, Mycobacterium bovis subsp bovis AF2122/97
gacgagcgauacgu

SEQ ID NO: 1210990 - RNA, 15 nt, Mycobacterium bovis subsp bovis AF2122/97
gacgaucgccaggcc

SEQ ID NO: 1210991 - RNA, 15 nt, Mycobacterium bovis subsp bovis AF2122/97
gacgaucgcggcggg

SEQ ID NO: 1210992 - RNA, 15 nt, Mycobacterium bovis subsp bovis AF2122/97
gacgaucggcggcgc

SEQ ID NO: 1210993 - RNA, 16 nt, Mycobacterium bovis subsp bovis AF2122/97
gacgaugcuggcggcc

SEQ ID NO: 1210994 - RNA, 16 nt, Mycobacterium bovis subsp bovis AF2122/97
gacgaugccgccuggu

SEQ ID NO: 1210995 - RNA, 18 nt, Mycobacterium bovis subsp bovis AF2122/97
gacgaugccucggcggcc

SEQ ID NO: 1210996 - RNA, 16 nt, Mycobacterium bovis subsp bovis AF2122/97
gacgaugucggucgga

SEQ ID NO: 1210997 - RNA, 22 nt, Mycobacterium bovis subsp bovis AF2122/97
gacgauuaccagcggcaccgcg

SEQ ID NO: 1210998 - RNA, 13 nt, Mycobacterium bovis subsp bovis AF2122/97
gacgauucucgag

SEQ ID NO: 1210999 - RNA, 19 nt, Mycobacterium bovis subsp bovis AF2122/97
gaccuucucgaugcugacg

SEQ ID NO: 1211000 - RNA, 22 nt, Mycobacterium bovis subsp bovis AF2122/97
gaccuucucgaugcugacgaac

SEQ ID NO: 1211001 - RNA, 19 nt, Mycobacterium bovis subsp bovis AF2122/97
gaccuucucgucggccagu

SEQ ID NO: 1211002 - RNA, 15 nt, Mycobacterium bovis subsp bovis AF2122/97
gaccuucgagccgca

SEQ ID NO: 1211003 - RNA, 15 nt, Mycobacterium bovis subsp bovis AF2122/97
gacgaauuggcccga

SEQ ID NO: 1211004 - RNA, 22 nt, Mycobacterium bovis subsp bovis AF2122/97
gaccucgccgcgcgugacagug

SEQ ID NO: 1211005 - RNA, 17 nt, Mycobacterium bovis subsp bovis AF2122/97
gaccucggcggcggcac

SEQ ID NO: 1211006 - RNA, 15 nt, Mycobacterium bovis subsp bovis AF2122/97
gaccuccucgaccag

SEQ ID NO: 1211007 - RNA, 19 nt, Mycobacterium bovis subsp bovis AF2122/97
gaccucggcgugucugccc

SEQ ID NO: 1211008 - RNA, 20 nt, Mycobacterium bovis subsp bovis AF2122/97
gaccucgugguucugcaggu

SEQ ID NO: 1211009 - RNA, 16 nt, Mycobacterium bovis subsp bovis AF2122/97
gaccucgucgaccggg

SEQ ID NO: 1211010 - RNA, 16 nt, Mycobacterium bovis subsp bovis AF2122/97
gaccucucugcgccag

SEQ ID NO: 1211011 - RNA, 20 nt, Mycobacterium bovis subsp bovis AF2122/97
gaccucucugcgccaggcgg

SEQ ID NO: 1211012 - RNA, 20 nt, Mycobacterium bovis subsp bovis AF2122/97
gaccuguuuggggcugugca

SEQ ID NO: 1211013 - RNA, 23 nt, Mycobacterium bovis subsp bovis AF2122/97
gaccuguuuggggcugugcaggc

SEQ ID NO: 1211014 - RNA, 21 nt, Mycobacterium bovis subsp bovis AF2122/97
gaccgaugacgaucggcggcg

SEQ ID NO: 1211015 - RNA, 15 nt, Mycobacterium bovis subsp bovis AF2122/97
gaccgauagcuggcc

SEQ ID NO: 1211016 - RNA, 18 nt, Mycobacterium bovis subsp bovis AF2122/97
gaccgaucggcaggccgc

SEQ ID NO: 1211017 - RNA, 20 nt, Mycobacterium bovis subsp bovis AF2122/97
gaccgaucggcaggccgcuu

SEQ ID NO: 1211018 - RNA, 12 nt, Mycobacterium bovis subsp bovis AF2122/97
gaccgaaagccg

SEQ ID NO: 1211019 - RNA, 16 nt, Mycobacterium bovis subsp bovis AF2122/97
gaccgcaccggccgcu

SEQ ID NO: 1211020 - RNA, 16 nt, Mycobacterium bovis subsp bovis AF2122/97
gaccgcacgaccagcu

SEQ ID NO: 1211021 - RNA, 15 nt, Mycobacterium bovis subsp bovis AF2122/97
gaccgcagcuggggc

SEQ ID NO: 1211022 - RNA, 21 nt, Mycobacterium bovis subsp bovis AF2122/97
gaccggcgggcagauggugaa

SEQ ID NO: 1211023 - RNA, 21 nt, Mycobacterium bovis subsp bovis AF2122/97
gaccggcggcuacggcugccc

SEQ ID NO: 1211024 - RNA, 16 nt, Mycobacterium bovis subsp bovis AF2122/97
gaccgggcucuggcca

SEQ ID NO: 1211025 - RNA, 19 nt, Mycobacterium bovis subsp bovis AF2122/97
gaccggggacagcccuucg

SEQ ID NO: 1211026 - RNA, 14 nt, Mycobacterium bovis subsp bovis AF2122/97
gaccgggcuggcca

SEQ ID NO: 1211027 - RNA, 19 nt, Mycobacterium bovis subsp bovis AF2122/97
gaccgggcuggccagcgcg

SEQ ID NO: 1211028 - RNA, 15 nt, Mycobacterium bovis subsp bovis AF2122/97
gaccgggaggcggcg

SEQ ID NO: 1211029 - RNA, 17 nt, Mycobacterium bovis subsp bovis AF2122/97
gaccgggaacagggugg

SEQ ID NO: 1211030 - RNA, 20 nt, Mycobacterium bovis subsp bovis AF2122/97
gaccgggaacaggguggugg

SEQ ID NO: 1211031 - RNA, 17 nt, Mycobacterium bovis subsp bovis AF2122/97
gaccggcucggcggugc

SEQ ID NO: 1211032 - RNA, 16 nt, Mycobacterium bovis subsp bovis AF2122/97
gaccggggcuuggguu

SEQ ID NO: 1211033 - RNA, 17 nt, Mycobacterium bovis subsp bovis AF2122/97
gaccgggucgaugacgc

SEQ ID NO: 1211034 - RNA, 17 nt, Mycobacterium bovis subsp bovis AF2122/97
gaccgguacccguagca

SEQ ID NO: 1211035 - RNA, 23 nt, Mycobacterium bovis subsp bovis AF2122/97
gaccggucgacagcgaaggcgcc

SEQ ID NO: 1211036 - RNA, 20 nt, Mycobacterium bovis subsp bovis AF2122/97
gaccggucggugaugguuuc

SEQ ID NO: 1211037 - RNA, 15 nt, Mycobacterium bovis subsp bovis AF2122/97
gaccggugccagcag

SEQ ID NO: 1211038 - RNA, 17 nt, Mycobacterium bovis subsp bovis AF2122/97
gaccggugccugcaacg

SEQ ID NO: 1211039 - RNA, 20 nt, Mycobacterium bovis subsp bovis AF2122/97
gaccgguggcaccggcggcg

SEQ ID NO: 1211040 - RNA, 19 nt, Mycobacterium bovis subsp bovis AF2122/97
gaccgguguuccgcccagc

SEQ ID NO: 1211041 - RNA, 17 nt, Mycobacterium bovis subsp bovis AF2122/97
gaccucgaagcccagca

SEQ ID NO: 1211042 - RNA, 14 nt, Mycobacterium bovis subsp bovis AF2122/97
gaccuccaccaaug

SEQ ID NO: 1211043 - RNA, 18 nt, Mycobacterium bovis subsp bovis AF2122/97
gaccuccagugcggccuu

SEQ ID NO: 1211044 - RNA, 15 nt, Mycobacterium bovis subsp bovis AF2122/97
gaccuagucaccuug

SEQ ID NO: 1211045 - RNA, 15 nt, Mycobacterium bovis subsp bovis AF2122/97
gaccuaucagaacuu

SEQ ID NO: 1211046 - RNA, 21 nt, Mycobacterium bovis subsp bovis AF2122/97
gaccguauugaccagcggggu

SEQ ID NO: 1211047 - RNA, 23 nt, Mycobacterium bovis subsp bovis AF2122/97
gaccgucacaagucgacacgccg

SEQ ID NO: 1211048 - RNA, 18 nt, Mycobacterium bovis subsp bovis AF2122/97
gaccgguucccgggcagc

SEQ ID NO: 1211049 - RNA, 20 nt, Mycobacterium bovis subsp bovis AF2122/97
gaccgguuucuucggccagc

SEQ ID NO: 1211050 - RNA, 21 nt, Mycobacterium bovis subsp bovis AF2122/97
gaccgguuucuucggccagcu

SEQ ID NO: 1211051 - RNA, 16 nt, Mycobacterium bovis subsp bovis AF2122/97
gaccguaccgauccag

SEQ ID NO: 1211052 - RNA, 18 nt, Mycobacterium bovis subsp bovis AF2122/97
gaccgucccagcgccgca

SEQ ID NO: 1211053 - RNA, 21 nt, Mycobacterium bovis subsp bovis AF2122/97
gaccguggucggagguggggu

SEQ ID NO: 1211054 - RNA, 17 nt, Mycobacterium bovis subsp bovis AF2122/97
gaccgugaucagcgcgu

SEQ ID NO: 1211055 - RNA, 19 nt, Mycobacterium bovis subsp bovis AF2122/97
gaccgugcgucgauggcgu

SEQ ID NO: 1211056 - RNA, 22 nt, Mycobacterium bovis subsp bovis AF2122/97
gaccgugccgucggcgugcagc

SEQ ID NO: 1211057 - RNA, 15 nt, Mycobacterium bovis subsp bovis AF2122/97
gaccguggcggccuc

SEQ ID NO: 1211058 - RNA, 17 nt, Mycobacterium bovis subsp bovis AF2122/97
gacugcgucggcggcuu

SEQ ID NO: 1211059 - RNA, 13 nt, Mycobacterium bovis subsp bovis AF2122/97
gacugcggaagcc

SEQ ID NO: 1211060 - RNA, 14 nt, Mycobacterium bovis subsp bovis AF2122/97
gacugcggaagcca

SEQ ID NO: 1211061 - RNA, 14 nt, Mycobacterium bovis subsp bovis AF2122/97
gacugcggucugga

SEQ ID NO: 1211062 - RNA, 20 nt, Mycobacterium bovis subsp bovis AF2122/97
gacuggaccgcggugacccg

SEQ ID NO: 1211063 - RNA, 18 nt, Mycobacterium bovis subsp bovis AF2122/97
gacuggggcgccaccacc

SEQ ID NO: 1211064 - RNA, 16 nt, Mycobacterium bovis subsp bovis AF2122/97
gacuggucacugcccu

SEQ ID NO: 1211065 - RNA, 16 nt, Mycobacterium bovis subsp bovis AF2122/97
gacugucccaccaggu

SEQ ID NO: 1211066 - RNA, 14 nt, Mycobacterium bovis subsp bovis AF2122/97
gacugcgccaccgg

SEQ ID NO: 1211067 - RNA, 15 nt, Mycobacterium bovis subsp bovis AF2122/97
gacugcgcggcacuu

SEQ ID NO: 1211068 - RNA, 17 nt, Mycobacterium bovis subsp bovis AF2122/97
gacugcgaaugcugggc

SEQ ID NO: 1211069 - RNA, 16 nt, Mycobacterium bovis subsp bovis AF2122/97
gacugcagcggcgcau

SEQ ID NO: 1211070 - RNA, 18 nt, Mycobacterium bovis subsp bovis AF2122/97
gacugcaacucuucccau

SEQ ID NO: 1211071 - RNA, 17 nt, Mycobacterium bovis subsp bovis AF2122/97
gacugcacaccaccgcc

SEQ ID NO: 1211072 - RNA, 17 nt, Mycobacterium bovis subsp bovis AF2122/97
gacugaucugugggugg

SEQ ID NO: 1211073 - RNA, 18 nt, Mycobacterium bovis subsp bovis AF2122/97
gacugaucuguggguggu

SEQ ID NO: 1211074 - RNA, 21 nt, Mycobacterium bovis subsp bovis AF2122/97
gacugaucaagugccagcgug

SEQ ID NO: 1211075 - RNA, 14 nt, Mycobacterium bovis subsp bovis AF2122/97
gacugaacaccaaa

SEQ ID NO: 1211076 - RNA, 18 nt, Mycobacterium bovis subsp bovis AF2122/97
gacgugcaggaacaccca

SEQ ID NO: 1211077 - RNA, 20 nt, Mycobacterium bovis subsp bovis AF2122/97
gacgugaucgcgguccaaca

SEQ ID NO: 1211078 - RNA, 17 nt, Mycobacterium bovis subsp bovis AF2122/97
gacgugcaggaacaccc

SEQ ID NO: 1211079 - RNA, 15 nt, Mycobacterium bovis subsp bovis AF2122/97
gacguugcagccggc

SEQ ID NO: 1211080 - RNA, 17 nt, Mycobacterium bovis subsp bovis AF2122/97
gacguugcagccggcau

SEQ ID NO: 1211081 - RNA, 14 nt, Mycobacterium bovis subsp bovis AF2122/97
gacgugcggcggcc

SEQ ID NO: 1211082 - RNA, 15 nt, Mycobacterium bovis subsp bovis AF2122/97
gacguggaugguggu

SEQ ID NO: 1211083 - RNA, 23 nt, Mycobacterium bovis subsp bovis AF2122/97
gacguugagguucuucugcgcca

SEQ ID NO: 1211084 - RNA, 13 nt, Mycobacterium bovis subsp bovis AF2122/97
gacuccggcaggc

SEQ ID NO: 1211085 - RNA, 16 nt, Mycobacterium bovis subsp bovis AF2122/97
gacuccggcaagcaca

SEQ ID NO: 1211086 - RNA, 15 nt, Mycobacterium bovis subsp bovis AF2122/97
gacguuucagccggg

SEQ ID NO: 1211087 - RNA, 16 nt, Mycobacterium bovis subsp bovis AF2122/97
gacucuucagcuaccu

SEQ ID NO: 1211088 - RNA, 19 nt, Mycobacterium bovis subsp bovis AF2122/97
gacucugcguccaccacgc

SEQ ID NO: 1211089 - RNA, 22 nt, Mycobacterium bovis subsp bovis AF2122/97
gacucugcgucugcucaccagc

SEQ ID NO: 1211090 - RNA, 16 nt, Mycobacterium bovis subsp bovis AF2122/97
gacuccucucucuugg

SEQ ID NO: 1211091 - RNA, 18 nt, Mycobacterium bovis subsp bovis AF2122/97
gacuccugcggcaccgcu

SEQ ID NO: 1211092 - RNA, 21 nt, Mycobacterium bovis subsp bovis AF2122/97
gacuccugugcggagccgcca

SEQ ID NO: 1211093 - RNA, 23 nt, Mycobacterium bovis subsp bovis AF2122/97
gacucgacguaagugugcccugc

SEQ ID NO: 1211094 - RNA, 13 nt, Mycobacterium bovis subsp bovis AF2122/97
gacucgccaccgc

SEQ ID NO: 1211095 - RNA, 20 nt, Mycobacterium bovis subsp bovis AF2122/97
gacucgccacauuucaccac

SEQ ID NO: 1211096 - RNA, 18 nt, Mycobacterium bovis subsp bovis AF2122/97
gacucgggcaggccccac

SEQ ID NO: 1211097 - RNA, 21 nt, Mycobacterium bovis subsp bovis AF2122/97
gacucggcaccuggauccacc

SEQ ID NO: 1211098 - RNA, 16 nt, Mycobacterium bovis subsp bovis AF2122/97
gacucggccgacgaga

SEQ ID NO: 1211099 - RNA, 19 nt, Mycobacterium bovis subsp bovis AF2122/97
gacucggaauucggcgucg

SEQ ID NO: 1211100 - RNA, 20 nt, Mycobacterium bovis subsp bovis AF2122/97
gacucgucgcaucaccaggg

SEQ ID NO: 1211101 - RNA, 17 nt, Mycobacterium bovis subsp bovis AF2122/97
gacuucagcauggugga

SEQ ID NO: 1211102 - RNA, 21 nt, Mycobacterium bovis subsp bovis AF2122/97
gacuucagcaggcccagcgga

SEQ ID NO: 1211103 - RNA, 14 nt, Mycobacterium bovis subsp bovis AF2122/97
gacuucagcaggcc

SEQ ID NO: 1211104 - RNA, 15 nt, Mycobacterium bovis subsp bovis AF2122/97
gacuugcgcgcggca

SEQ ID NO: 1211105 - RNA, 16 nt, Mycobacterium bovis subsp bovis AF2122/97
gacuuggccaugcugg

SEQ ID NO: 1211106 - RNA, 17 nt, Mycobacterium bovis subsp bovis AF2122/97
gacuuggccaugcuggu

SEQ ID NO: 1211107 - RNA, 18 nt, Mycobacterium bovis subsp bovis AF2122/97
gacuuguccaucacaucc

SEQ ID NO: 1211108 - RNA, 18 nt, Mycobacterium bovis subsp bovis AF2122/97
gagaaacccgaaguagaa

SEQ ID NO: 1211109 - RNA, 13 nt, Mycobacterium bovis subsp bovis AF2122/97
gagaaagugcagu

SEQ ID NO: 1211110 - RNA, 17 nt, Mycobacterium bovis subsp bovis AF2122/97
gagaaaacggcggcgcc

SEQ ID NO: 1211111 - RNA, 22 nt, Mycobacterium bovis subsp bovis AF2122/97
gagaaaccgcgaacaaccugcc

SEQ ID NO: 1211112 - RNA, 16 nt, Mycobacterium bovis subsp bovis AF2122/97
gagaacacccgugccu

SEQ ID NO: 1211113 - RNA, 14 nt, Mycobacterium bovis subsp bovis AF2122/97
gagaccggccgggu

SEQ ID NO: 1211114 - RNA, 23 nt, Mycobacterium bovis subsp bovis AF2122/97
gagaccgccgcugccgccgagcu

SEQ ID NO: 1211115 - RNA, 19 nt, Mycobacterium bovis subsp bovis AF2122/97
gagacaugucgcugccgcc

SEQ ID NO: 1211116 - RNA, 12 nt, Mycobacterium bovis subsp bovis AF2122/97
gagacgaucauc

SEQ ID NO: 1211117 - RNA, 20 nt, Mycobacterium bovis subsp bovis AF2122/97
gagacgcuccaguggcgcca

SEQ ID NO: 1211118 - RNA, 14 nt, Mycobacterium bovis subsp bovis AF2122/97
gagacgaucgccag

SEQ ID NO: 1211119 - RNA, 15 nt, Mycobacterium bovis subsp bovis AF2122/97
gagacgaucgccagg

SEQ ID NO: 1211120 - RNA, 22 nt, Mycobacterium bovis subsp bovis AF2122/97
gagacgcaugucgggccaggcg

SEQ ID NO: 1211121 - RNA, 14 nt, Mycobacterium bovis subsp bovis AF2122/97
gagaauuccccagc

SEQ ID NO: 1211122 - RNA, 18 nt, Mycobacterium bovis subsp bovis AF2122/97
gagaauuccccagccgca

SEQ ID NO: 1211123 - RNA, 19 nt, Mycobacterium bovis subsp bovis AF2122/97
gagaaggugcugcgcgggu

SEQ ID NO: 1211124 - RNA, 20 nt, Mycobacterium bovis subsp bovis AF2122/97
gagaagcaugauuggcucgg

SEQ ID NO: 1211125 - RNA, 15 nt, Mycobacterium bovis subsp bovis AF2122/97
gagaagaagcccagg

SEQ ID NO: 1211126 - RNA, 12 nt, Mycobacterium bovis subsp bovis AF2122/97
gagaagacaccg

SEQ ID NO: 1211127 - RNA, 23 nt, Mycobacterium bovis subsp bovis AF2122/97
gagaaguuagccaccuuggacac

SEQ ID NO: 1211128 - RNA, 17 nt, Mycobacterium bovis subsp bovis AF2122/97
gagaagucgcagcgagg

SEQ ID NO: 1211129 - RNA, 18 nt, Mycobacterium bovis subsp bovis AF2122/97
gagaagucgcagcgagga

SEQ ID NO: 1211130 - RNA, 24 nt, Mycobacterium bovis subsp bovis AF2122/97
gagacgucuucgggcucguccagc

SEQ ID NO: 1211131 - RNA, 22 nt, Mycobacterium bovis subsp bovis AF2122/97
gagagccugcucgcagcgggcg

SEQ ID NO: 1211132 - RNA, 18 nt, Mycobacterium bovis subsp bovis AF2122/97
gagagccccgaccagcag

SEQ ID NO: 1211133 - RNA, 20 nt, Mycobacterium bovis subsp bovis AF2122/97
gagagccccgaccagcagac

SEQ ID NO: 1211134 - RNA, 17 nt, Mycobacterium bovis subsp bovis AF2122/97
gagagccaaaggcggcu

SEQ ID NO: 1211135 - RNA, 14 nt, Mycobacterium bovis subsp bovis AF2122/97
gagagcagccagcc

SEQ ID NO: 1211136 - RNA, 21 nt, Mycobacterium bovis subsp bovis AF2122/97
gagagcaguacgucugcgucc

SEQ ID NO: 1211137 - RNA, 21 nt, Mycobacterium bovis subsp bovis AF2122/97
gagagaguaucgacccgauga

SEQ ID NO: 1211138 - RNA, 16 nt, Mycobacterium bovis subsp bovis AF2122/97
gagaucagucugggcg

SEQ ID NO: 1211139 - RNA, 15 nt, Mycobacterium bovis subsp bovis AF2122/97
gagauccagggccuu

SEQ ID NO: 1211140 - RNA, 14 nt, Mycobacterium bovis subsp bovis AF2122/97
gagauccagggccu

SEQ ID NO: 1211141 - RNA, 22 nt, Mycobacterium bovis subsp bovis AF2122/97
gagaucauggcgagcguuugga

SEQ ID NO: 1211142 - RNA, 20 nt, Mycobacterium bovis subsp bovis AF2122/97
gagauccagcgccuugucua

SEQ ID NO: 1211143 - RNA, 24 nt, Mycobacterium bovis subsp bovis AF2122/97
gagaucaccuugccuagccgcagc

SEQ ID NO: 1211144 - RNA, 20 nt, Mycobacterium bovis subsp bovis AF2122/97
gagaucaccuuggcaagcac

SEQ ID NO: 1211145 - RNA, 15 nt, Mycobacterium bovis subsp bovis AF2122/97
gagaucaccgccacc

SEQ ID NO: 1211146 - RNA, 17 nt, Mycobacterium bovis subsp bovis AF2122/97
gagaucaccgccaccac

SEQ ID NO: 1211147 - RNA, 13 nt, Mycobacterium bovis subsp bovis AF2122/97
gagaguggccucg

SEQ ID NO: 1211148 - RNA, 22 nt, Mycobacterium bovis subsp bovis AF2122/97
gagauagucggccggcggucgc

SEQ ID NO: 1211149 - RNA, 20 nt, Mycobacterium bovis subsp bovis AF2122/97
gagcaccgcucgguccagcc

SEQ ID NO: 1211150 - RNA, 15 nt, Mycobacterium bovis subsp bovis AF2122/97
gagcaccgcgcccuu

SEQ ID NO: 1211151 - RNA, 22 nt, Mycobacterium bovis subsp bovis AF2122/97
gagcaccgcgaacagcacauau

SEQ ID NO: 1211152 - RNA, 11 nt, Mycobacterium bovis subsp bovis AF2122/97
gagcaccugac

SEQ ID NO: 1211153 - RNA, 15 nt, Mycobacterium bovis subsp bovis AF2122/97
gagcaccugggcgcg

SEQ ID NO: 1211154 - RNA, 16 nt, Mycobacterium bovis subsp bovis AF2122/97
gagcaccugggcgcgc

SEQ ID NO: 1211155 - RNA, 14 nt, Mycobacterium bovis subsp bovis AF2122/97
gagcaccagcagca

SEQ ID NO: 1211156 - RNA, 18 nt, Mycobacterium bovis subsp bovis AF2122/97
gagcacccggggggccuc

SEQ ID NO: 1211157 - RNA, 12 nt, Mycobacterium bovis subsp bovis AF2122/97
gagcaccagcag

SEQ ID NO: 1211158 - RNA, 22 nt, Mycobacterium bovis subsp bovis AF2122/97
gagcacaugcucgacgcccgcc

SEQ ID NO: 1211159 - RNA, 20 nt, Mycobacterium bovis subsp bovis AF2122/97
gagcaccaccccagcggcca

SEQ ID NO: 1211160 - RNA, 21 nt, Mycobacterium bovis subsp bovis AF2122/97
gagcaccacccgggccucggc

SEQ ID NO: 1211161 - RNA, 22 nt, Mycobacterium bovis subsp bovis AF2122/97
gagaugccgcgaucgugcaggu

SEQ ID NO: 1211162 - RNA, 16 nt, Mycobacterium bovis subsp bovis AF2122/97
gagaugccaucgguga

SEQ ID NO: 1211163 - RNA, 21 nt, Mycobacterium bovis subsp bovis AF2122/97
gagaugccaucggugaugagu

SEQ ID NO: 1211164 - RNA, 20 nt, Mycobacterium bovis subsp bovis AF2122/97
gagaugccgcgaucgugcag

SEQ ID NO: 1211165 - RNA, 21 nt, Mycobacterium bovis subsp bovis AF2122/97
gagaugccgcgaucgugcagg

SEQ ID NO: 1211166 - RNA, 19 nt, Mycobacterium bovis subsp bovis AF2122/97
gagcacacuccuagccaac

SEQ ID NO: 1211167 - RNA, 14 nt, Mycobacterium bovis subsp bovis AF2122/97
gagcacgccgagcc

SEQ ID NO: 1211168 - RNA, 20 nt, Mycobacterium bovis subsp bovis AF2122/97
gagcacggguagcguccagg

SEQ ID NO: 1211169 - RNA, 21 nt, Mycobacterium bovis subsp bovis AF2122/97
gagcacggcgcggcggagugc

SEQ ID NO: 1211170 - RNA, 21 nt, Mycobacterium bovis subsp bovis AF2122/97
gagcacgucggggugccggcu

SEQ ID NO: 1211171 - RNA, 23 nt, Mycobacterium bovis subsp bovis AF2122/97
gagcacguucaccgcgcgcucgc

SEQ ID NO: 1211172 - RNA, 19 nt, Mycobacterium bovis subsp bovis AF2122/97
gagcacugggcuggccagc

SEQ ID NO: 1211173 - RNA, 17 nt, Mycobacterium bovis subsp bovis AF2122/97
gagcagacgcauaagcc

SEQ ID NO: 1211174 - RNA, 14 nt, Mycobacterium bovis subsp bovis AF2122/97
gagcagaaggccag

SEQ ID NO: 1211175 - RNA, 14 nt, Mycobacterium bovis subsp bovis AF2122/97
gagcagacguaaaa

SEQ ID NO: 1211176 - RNA, 14 nt, Mycobacterium bovis subsp bovis AF2122/97
gagcagacugcccu

SEQ ID NO: 1211177 - RNA, 17 nt, Mycobacterium bovis subsp bovis AF2122/97
gagcagucgcaaaagcc

SEQ ID NO: 1211178 - RNA, 21 nt, Mycobacterium bovis subsp bovis AF2122/97
gagcagggcucguccaucagc

SEQ ID NO: 1211179 - RNA, 23 nt, Mycobacterium bovis subsp bovis AF2122/97
gagcaggggaguugcuugcaggg

SEQ ID NO: 1211180 - RNA, 17 nt, Mycobacterium bovis subsp bovis AF2122/97
gagcagggcucguccau

SEQ ID NO: 1211181 - RNA, 16 nt, Mycobacterium bovis subsp bovis AF2122/97
gagcccgcugcgccgg

SEQ ID NO: 1211182 - RNA, 20 nt, Mycobacterium bovis subsp bovis AF2122/97
gagcccgagcucaccgcaca

SEQ ID NO: 1211183 - RNA, 22 nt, Mycobacterium bovis subsp bovis AF2122/97
gagcccggucccuuuguggggc

SEQ ID NO: 1211184 - RNA, 12 nt, Mycobacterium bovis subsp bovis AF2122/97
gagcccggugcu

SEQ ID NO: 1211185 - RNA, 14 nt, Mycobacterium bovis subsp bovis AF2122/97
gagcccggcggccc

SEQ ID NO: 1211186 - RNA, 20 nt, Mycobacterium bovis subsp bovis AF2122/97
gagcccgaucgcggcccggc

SEQ ID NO: 1211187 - RNA, 19 nt, Mycobacterium bovis subsp bovis AF2122/97
gagcccgucagcuccccgu

SEQ ID NO: 1211188 - RNA, 18 nt, Mycobacterium bovis subsp bovis AF2122/97
gagccccgaccagcagac

SEQ ID NO: 1211189 - RNA, 16 nt, Mycobacterium bovis subsp bovis AF2122/97
gagcccgaaggcggcu

SEQ ID NO: 1211190 - RNA, 16 nt, Mycobacterium bovis subsp bovis AF2122/97
gagccauguccuugga

SEQ ID NO: 1211191 - RNA, 15 nt, Mycobacterium bovis subsp bovis AF2122/97
gagcccaauccgcaa

SEQ ID NO: 1211192 - RNA, 20 nt, Mycobacterium bovis subsp bovis AF2122/97
gagcccagccgcgggccgcg

SEQ ID NO: 1211193 - RNA, 19 nt, Mycobacterium bovis subsp bovis AF2122/97
gagcccagccgggcacccu

SEQ ID NO: 1211194 - RNA, 12 nt, Mycobacterium bovis subsp bovis AF2122/97
gagcccagcgcc

SEQ ID NO: 1211195 - RNA, 21 nt, Mycobacterium bovis subsp bovis AF2122/97
gagccgcggucggcgugcagg

SEQ ID NO: 1211196 - RNA, 18 nt, Mycobacterium bovis subsp bovis AF2122/97
gagccgcgauguggugga

SEQ ID NO: 1211197 - RNA, 24 nt, Mycobacterium bovis subsp bovis AF2122/97
gagccggcacgcgcgcuucaugag

SEQ ID NO: 1211198 - RNA, 14 nt, Mycobacterium bovis subsp bovis AF2122/97
gagccgggcaacca

SEQ ID NO: 1211199 - RNA, 17 nt, Mycobacterium bovis subsp bovis AF2122/97
gagccgggcaaccagca

SEQ ID NO: 1211200 - RNA, 17 nt, Mycobacterium bovis subsp bovis AF2122/97
gagccgggccguccggg

SEQ ID NO: 1211201 - RNA, 18 nt, Mycobacterium bovis subsp bovis AF2122/97
gagccgggcaaccagcag

SEQ ID NO: 1211202 - RNA, 19 nt, Mycobacterium bovis subsp bovis AF2122/97
gagccgggcaaccagcagc

SEQ ID NO: 1211203 - RNA, 14 nt, Mycobacterium bovis subsp bovis AF2122/97
gagccggugccacu

SEQ ID NO: 1211204 - RNA, 10 nt, Mycobacterium bovis subsp bovis AF2122/97
gagccuuggu

SEQ ID NO: 1211205 - RNA, 20 nt, Mycobacterium bovis subsp bovis AF2122/97
gagcaucucgacaucggcca

SEQ ID NO: 1211206 - RNA, 18 nt, Mycobacterium bovis subsp bovis AF2122/97
gagcaguuccagcucgcg

SEQ ID NO: 1211207 - RNA, 17 nt, Mycobacterium bovis subsp bovis AF2122/97
gagccagggaggggccg

SEQ ID NO: 1211208 - RNA, 18 nt, Mycobacterium bovis subsp bovis AF2122/97
gagcaugguccagcacau

SEQ ID NO: 1211209 - RNA, 14 nt, Mycobacterium bovis subsp bovis AF2122/97
gagcccaaggggca

SEQ ID NO: 1211210 - RNA, 17 nt, Mycobacterium bovis subsp bovis AF2122/97
gagcccaaggggcagcg

SEQ ID NO: 1211211 - RNA, 23 nt, Mycobacterium bovis subsp bovis AF2122/97
gagcaugccgcccgcgccgccgg

SEQ ID NO: 1211212 - RNA, 16 nt, Mycobacterium bovis subsp bovis AF2122/97
gagcaugccguugaca

SEQ ID NO: 1211213 - RNA, 14 nt, Mycobacterium bovis subsp bovis AF2122/97
gagcaugauguccu

SEQ ID NO: 1211214 - RNA, 18 nt, Mycobacterium bovis subsp bovis AF2122/97
gagggccgcgguuuggcg

SEQ ID NO: 1211215 - RNA, 13 nt, Mycobacterium bovis subsp bovis AF2122/97
gagggcagccgcc

SEQ ID NO: 1211216 - RNA, 23 nt, Mycobacterium bovis subsp bovis AF2122/97
gagggauguagugcugcucgaca

SEQ ID NO: 1211217 - RNA, 16 nt, Mycobacterium bovis subsp bovis AF2122/97
gagggauguagugcug

SEQ ID NO: 1211218 - RNA, 15 nt, Mycobacterium bovis subsp bovis AF2122/97
gagggcaucgggccu

SEQ ID NO: 1211219 - RNA, 19 nt, Mycobacterium bovis subsp bovis AF2122/97
gagggcgucgccgccguug

SEQ ID NO: 1211220 - RNA, 14 nt, Mycobacterium bovis subsp bovis AF2122/97
gaggucacccggua

SEQ ID NO: 1211221 - RNA, 17 nt, Mycobacterium bovis subsp bovis AF2122/97
gagggcgccgggggcgc

SEQ ID NO: 1211222 - RNA, 20 nt, Mycobacterium bovis subsp bovis AF2122/97
gagggccugccgcacugggc

SEQ ID NO: 1211223 - RNA, 22 nt, Mycobacterium bovis subsp bovis AF2122/97
gaggugauguuggccgccacac

SEQ ID NO: 1211224 - RNA, 18 nt, Mycobacterium bovis subsp bovis AF2122/97
gaggugacucggcaccug

SEQ ID NO: 1211225 - RNA, 14 nt, Mycobacterium bovis subsp bovis AF2122/97
gaggugcugcaccu

SEQ ID NO: 1211226 - RNA, 23 nt, Mycobacterium bovis subsp bovis AF2122/97
gagguccgguggacgaucuggca

SEQ ID NO: 1211227 - RNA, 20 nt, Mycobacterium bovis subsp bovis AF2122/97
gaggucggccagcagcagug

SEQ ID NO: 1211228 - RNA, 22 nt, Mycobacterium bovis subsp bovis AF2122/97
gaggucgaaccgccggcugcgc

SEQ ID NO: 1211229 - RNA, 14 nt, Mycobacterium bovis subsp bovis AF2122/97
gagguccaccaccc

SEQ ID NO: 1211230 - RNA, 22 nt, Mycobacterium bovis subsp bovis AF2122/97
gaggucgagcgccuuugcccga

SEQ ID NO: 1211231 - RNA, 14 nt, Mycobacterium bovis subsp bovis AF2122/97
gaggucgaucaggg

SEQ ID NO: 1211232 - RNA, 17 nt, Mycobacterium bovis subsp bovis AF2122/97
gaggucggccagcagca

SEQ ID NO: 1211233 - RNA, 13 nt, Mycobacterium bovis subsp bovis AF2122/97
gaggucuacuucg

SEQ ID NO: 1211234 - RNA, 21 nt, Mycobacterium bovis subsp bovis AF2122/97
gaggucugguagagguugucg

SEQ ID NO: 1211235 - RNA, 13 nt, Mycobacterium bovis subsp bovis AF2122/97
gaggcaacaagca

SEQ ID NO: 1211236 - RNA, 17 nt, Mycobacterium bovis subsp bovis AF2122/97
gaggcacaaucaccgcc

SEQ ID NO: 1211237 - RNA, 20 nt, Mycobacterium bovis subsp bovis AF2122/97
gaggcaggccucggcgccgc

SEQ ID NO: 1211238 - RNA, 20 nt, Mycobacterium bovis subsp bovis AF2122/97
gaggcuaggcguuuggugug

SEQ ID NO: 1211239 - RNA, 17 nt, Mycobacterium bovis subsp bovis AF2122/97
gaggcuuacaugcccug

SEQ ID NO: 1211240 - RNA, 19 nt, Mycobacterium bovis subsp bovis AF2122/97
gaggcugggcugagggugg

SEQ ID NO: 1211241 - RNA, 19 nt, Mycobacterium bovis subsp bovis AF2122/97
gaggcuggucugcaggcgg

SEQ ID NO: 1211242 - RNA, 21 nt, Mycobacterium bovis subsp bovis AF2122/97
gaggcuaggcguuugguguga

SEQ ID NO: 1211243 - RNA, 17 nt, Mycobacterium bovis subsp bovis AF2122/97
gaggcucguggcgacgg

SEQ ID NO: 1211244 - RNA, 21 nt, Mycobacterium bovis subsp bovis AF2122/97
gagggaacccacaguggcucg

SEQ ID NO: 1211245 - RNA, 19 nt, Mycobacterium bovis subsp bovis AF2122/97
gagggagcgccgcaggguc

SEQ ID NO: 1211246 - RNA, 18 nt, Mycobacterium bovis subsp bovis AF2122/97
gaggaugcugagcgccag

SEQ ID NO: 1211247 - RNA, 19 nt, Mycobacterium bovis subsp bovis AF2122/97
gaggauccgcaccacgccc

SEQ ID NO: 1211248 - RNA, 14 nt, Mycobacterium bovis subsp bovis AF2122/97
gaggaccugcucgg

SEQ ID NO: 1211249 - RNA, 23 nt, Mycobacterium bovis subsp bovis AF2122/97
gaggaaggugugcgucuccagcu

SEQ ID NO: 1211250 - RNA, 22 nt, Mycobacterium bovis subsp bovis AF2122/97
gagcuggcgaccuggucgcugg

SEQ ID NO: 1211251 - RNA, 15 nt, Mycobacterium bovis subsp bovis AF2122/97
gagcugcucgccggc

SEQ ID NO: 1211252 - RNA, 11 nt, Mycobacterium bovis subsp bovis AF2122/97
gagcugcucgc

SEQ ID NO: 1211253 - RNA, 13 nt, Mycobacterium bovis subsp bovis AF2122/97
gagcugcucgccg

SEQ ID NO: 1211254 - RNA, 16 nt, Mycobacterium bovis subsp bovis AF2122/97
gagcugcuggcgcgcc

SEQ ID NO: 1211255 - RNA, 14 nt, Mycobacterium bovis subsp bovis AF2122/97
gagcgaacccccgc

SEQ ID NO: 1211256 - RNA, 14 nt, Mycobacterium bovis subsp bovis AF2122/97
gagcgacccccagc

SEQ ID NO: 1211257 - RNA, 17 nt, Mycobacterium bovis subsp bovis AF2122/97
gagcgacccccagcgcc

SEQ ID NO: 1211258 - RNA, 20 nt, Mycobacterium bovis subsp bovis AF2122/97
gagcgaccgcgagggccagc

SEQ ID NO: 1211259 - RNA, 14 nt, Mycobacterium bovis subsp bovis AF2122/97
gagcugugcgcaga

SEQ ID NO: 1211260 - RNA, 16 nt, Mycobacterium bovis subsp bovis AF2122/97
gagcugguaaacgggu

SEQ ID NO: 1211261 - RNA, 17 nt, Mycobacterium bovis subsp bovis AF2122/97
gagcuuggccagcagca

SEQ ID NO: 1211262 - RNA, 16 nt, Mycobacterium bovis subsp bovis AF2122/97
gaggugguucacgggg

SEQ ID NO: 1211263 - RNA, 16 nt, Mycobacterium bovis subsp bovis AF2122/97
gagguggcggugcggc

SEQ ID NO: 1211264 - RNA, 15 nt, Mycobacterium bovis subsp bovis AF2122/97
gaggugggguggugg

SEQ ID NO: 1211265 - RNA, 15 nt, Mycobacterium bovis subsp bovis AF2122/97
gagguguagcccucc

SEQ ID NO: 1211266 - RNA, 17 nt, Mycobacterium bovis subsp bovis AF2122/97
gagguucagccugagca

SEQ ID NO: 1211267 - RNA, 15 nt, Mycobacterium bovis subsp bovis AF2122/97
gagguugggaacagc

SEQ ID NO: 1211268 - RNA, 18 nt, Mycobacterium bovis subsp bovis AF2122/97
gagguuggagcgccagcc

SEQ ID NO: 1211269 - RNA, 13 nt, Mycobacterium bovis subsp bovis AF2122/97
gagguuggcggcc

SEQ ID NO: 1211270 - RNA, 22 nt, Mycobacterium bovis subsp bovis AF2122/97
gaguagccgcuaggaucggaug

SEQ ID NO: 1211271 - RNA, 13 nt, Mycobacterium bovis subsp bovis AF2122/97
gaguagugguggg

SEQ ID NO: 1211272 - RNA, 16 nt, Mycobacterium bovis subsp bovis AF2122/97
gagugcggacuucgcc

SEQ ID NO: 1211273 - RNA, 21 nt, Mycobacterium bovis subsp bovis AF2122/97
gagucugcugaucgagcgggu

SEQ ID NO: 1211274 - RNA, 21 nt, Mycobacterium bovis subsp bovis AF2122/97
gagucuucggcgacaggccga

SEQ ID NO: 1211275 - RNA, 19 nt, Mycobacterium bovis subsp bovis AF2122/97
gagucugauggccucgcga

SEQ ID NO: 1211276 - RNA, 19 nt, Mycobacterium bovis subsp bovis AF2122/97
gaguccgcugagcgggcaa

SEQ ID NO: 1211277 - RNA, 16 nt, Mycobacterium bovis subsp bovis AF2122/97
gagucgucccaguccc

SEQ ID NO: 1211278 - RNA, 19 nt, Mycobacterium bovis subsp bovis AF2122/97
gagucguuggacggcaccg

SEQ ID NO: 1211279 - RNA, 21 nt, Mycobacterium bovis subsp bovis AF2122/97
gaguccccaggugggcagcag

SEQ ID NO: 1211280 - RNA, 23 nt, Mycobacterium bovis subsp bovis AF2122/97
gaguccccaggugggcagcaggc

SEQ ID NO: 1211281 - RNA, 17 nt, Mycobacterium bovis subsp bovis AF2122/97
gaguccagccggcgcgc

SEQ ID NO: 1211282 - RNA, 16 nt, Mycobacterium bovis subsp bovis AF2122/97
gaguccaggccggcag

SEQ ID NO: 1211283 - RNA, 18 nt, Mycobacterium bovis subsp bovis AF2122/97
gaguucccgaaacccgau

SEQ ID NO: 1211284 - RNA, 12 nt, Mycobacterium bovis subsp bovis AF2122/97
gaguugaagaag

SEQ ID NO: 1211285 - RNA, 15 nt, Mycobacterium bovis subsp bovis AF2122/97
gaguugaagaagccc

SEQ ID NO: 1211286 - RNA, 22 nt, Mycobacterium bovis subsp bovis AF2122/97
gaguugaucuccacggcggugc

SEQ ID NO: 1211287 - RNA, 13 nt, Mycobacterium bovis subsp bovis AF2122/97
gaguugcagaccg

SEQ ID NO: 1211288 - RNA, 22 nt, Mycobacterium bovis subsp bovis AF2122/97
gagugcggcguauugcggccug

SEQ ID NO: 1211289 - RNA, 17 nt, Mycobacterium bovis subsp bovis AF2122/97
gagugcggguggugagc

SEQ ID NO: 1211290 - RNA, 19 nt, Mycobacterium bovis subsp bovis AF2122/97
gagugcggguggugagcug

SEQ ID NO: 1211291 - RNA, 22 nt, Mycobacterium bovis subsp bovis AF2122/97
gagugcgucucgguggcugcgc

SEQ ID NO: 1211292 - RNA, 13 nt, Mycobacterium bovis subsp bovis AF2122/97
gaguggaugcgcc

SEQ ID NO: 1211293 - RNA, 12 nt, Mycobacterium bovis subsp bovis AF2122/97
gaguuuuucggg

SEQ ID NO: 1211294 - RNA, 18 nt, Mycobacterium bovis subsp bovis AF2122/97
gauaaaaaccacccccac

SEQ ID NO: 1211295 - RNA, 23 nt, Mycobacterium bovis subsp bovis AF2122/97
gauaaauggccgaugagcccagc

SEQ ID NO: 1211296 - RNA, 13 nt, Mycobacterium bovis subsp bovis AF2122/97
gauacccagcgcc

SEQ ID NO: 1211297 - RNA, 14 nt, Mycobacterium bovis subsp bovis AF2122/97
gauaccgccggccc

SEQ ID NO: 1211298 - RNA, 18 nt, Mycobacterium bovis subsp bovis AF2122/97
gauacagcacauccagcc

SEQ ID NO: 1211299 - RNA, 16 nt, Mycobacterium bovis subsp bovis AF2122/97
gauacagcgccagggg

SEQ ID NO: 1211300 - RNA, 14 nt, Mycobacterium bovis subsp bovis AF2122/97
gauacacggcggcg

SEQ ID NO: 1211301 - RNA, 19 nt, Mycobacterium bovis subsp bovis AF2122/97
gauacagcgccaggggugu

SEQ ID NO: 1211302 - RNA, 23 nt, Mycobacterium bovis subsp bovis AF2122/97
gauaauccaugacacuggggugc

SEQ ID NO: 1211303 - RNA, 16 nt, Mycobacterium bovis subsp bovis AF2122/97
gauaaucguuuucggc

SEQ ID NO: 1211304 - RNA, 14 nt, Mycobacterium bovis subsp bovis AF2122/97
gauaaccaccaucu

SEQ ID NO: 1211305 - RNA, 15 nt, Mycobacterium bovis subsp bovis AF2122/97
gauaaccaccaucug

SEQ ID NO: 1211306 - RNA, 15 nt, Mycobacterium bovis subsp bovis AF2122/97
gauaccgucagcgcc

SEQ ID NO: 1211307 - RNA, 15 nt, Mycobacterium bovis subsp bovis AF2122/97
gauaccuagccccug

SEQ ID NO: 1211308 - RNA, 16 nt, Mycobacterium bovis subsp bovis AF2122/97
gauaccggcgugcagu

SEQ ID NO: 1211309 - RNA, 18 nt, Mycobacterium bovis subsp bovis AF2122/97
gauagccgaccagguaga

SEQ ID NO: 1211310 - RNA, 12 nt, Mycobacterium bovis subsp bovis AF2122/97
gauagccgacca

SEQ ID NO: 1211311 - RNA, 19 nt, Mycobacterium bovis subsp bovis AF2122/97
gauagcaccggcacccgca

SEQ ID NO: 1211312 - RNA, 13 nt, Mycobacterium bovis subsp bovis AF2122/97
gauaguucaccac

SEQ ID NO: 1211313 - RNA, 17 nt, Mycobacterium bovis subsp bovis AF2122/97
gauagccucggcggcgc

SEQ ID NO: 1211314 - RNA, 22 nt, Mycobacterium bovis subsp bovis AF2122/97
gauauuggacgcgcaugccccg

SEQ ID NO: 1211315 - RNA, 20 nt, Mycobacterium bovis subsp bovis AF2122/97
gaucaaugcugcguccugga

SEQ ID NO: 1211316 - RNA, 14 nt, Mycobacterium bovis subsp bovis AF2122/97
gauaucggcggcuu

SEQ ID NO: 1211317 - RNA, 19 nt, Mycobacterium bovis subsp bovis AF2122/97
gauaucggcggcuuggccg

SEQ ID NO: 1211318 - RNA, 16 nt, Mycobacterium bovis subsp bovis AF2122/97
gauauccuuugccgcc

SEQ ID NO: 1211319 - RNA, 15 nt, Mycobacterium bovis subsp bovis AF2122/97
gaaaugccggugccg

SEQ ID NO: 1211320 - RNA, 19 nt, Mycobacterium bovis subsp bovis AF2122/97
gaaaucgguggccaccacc

SEQ ID NO: 1211321 - RNA, 18 nt, Mycobacterium bovis subsp bovis AF2122/97
gaaauugggcgauucugc

SEQ ID NO: 1211322 - RNA, 22 nt, Mycobacterium bovis subsp bovis AF2122/97
gaacagcgacgccauggucaga

SEQ ID NO: 1211323 - RNA, 19 nt, Mycobacterium bovis subsp bovis AF2122/97
gaacagcgaaccgccggca

SEQ ID NO: 1211324 - RNA, 18 nt, Mycobacterium bovis subsp bovis AF2122/97
gaacagcgaaccggcugg

SEQ ID NO: 1211325 - RNA, 21 nt, Mycobacterium bovis subsp bovis AF2122/97
gaacagcaccgaacccgccac

SEQ ID NO: 1211326 - RNA, 19 nt, Mycobacterium bovis subsp bovis AF2122/97
gaacagacggggucgcccg

SEQ ID NO: 1211327 - RNA, 14 nt, Mycobacterium bovis subsp bovis AF2122/97
gaacaggguggugg

SEQ ID NO: 1211328 - RNA, 21 nt, Mycobacterium bovis subsp bovis AF2122/97
gaacagcgcgucggagccggg

SEQ ID NO: 1211329 - RNA, 21 nt, Mycobacterium bovis subsp bovis AF2122/97
gaacaguucggcgagcacaug

SEQ ID NO: 1211330 - RNA, 21 nt, Mycobacterium bovis subsp bovis AF2122/97
gaacaacggcguaaucgggaa

SEQ ID NO: 1211331 - RNA, 22 nt, Mycobacterium bovis subsp bovis AF2122/97
gaacaacggcgcggcaagggcu

SEQ ID NO: 1211332 - RNA, 16 nt, Mycobacterium bovis subsp bovis AF2122/97
gaacacaccgggcggg

SEQ ID NO: 1211333 - RNA, 23 nt, Mycobacterium bovis subsp bovis AF2122/97
gaacaccacaccgagcaccugac

SEQ ID NO: 1211334 - RNA, 13 nt, Mycobacterium bovis subsp bovis AF2122/97
gaacaccaccgcc

SEQ ID NO: 1211335 - RNA, 20 nt, Mycobacterium bovis subsp bovis AF2122/97
gaacaauuucugcagcccau

SEQ ID NO: 1211336 - RNA, 18 nt, Mycobacterium bovis subsp bovis AF2122/97
gaacaccagcaggaagaa

SEQ ID NO: 1211337 - RNA, 23 nt, Mycobacterium bovis subsp bovis AF2122/97
gaacaccagcaggaagaagccga

SEQ ID NO: 1211338 - RNA, 13 nt, Mycobacterium bovis subsp bovis AF2122/97
gaacaccagcagg

SEQ ID NO: 1211339 - RNA, 15 nt, Mycobacterium bovis subsp bovis AF2122/97
gaacaccgaggcgac

SEQ ID NO: 1211340 - RNA, 17 nt, Mycobacterium bovis subsp bovis AF2122/97
gaaagugccagugcgca

SEQ ID NO: 1211341 - RNA, 21 nt, Mycobacterium bovis subsp bovis AF2122/97
gaaauccagauaauccuggua

SEQ ID NO: 1211342 - RNA, 15 nt, Mycobacterium bovis subsp bovis AF2122/97
gaaauccgagccgcg

SEQ ID NO: 1211343 - RNA, 22 nt, Mycobacterium bovis subsp bovis AF2122/97
gaaaucggcggcguccagcagc

SEQ ID NO: 1211344 - RNA, 18 nt, Mycobacterium bovis subsp bovis AF2122/97
gaaauccccugcgcugca

SEQ ID NO: 1211345 - RNA, 21 nt, Mycobacterium bovis subsp bovis AF2122/97
gaaauccccugcgcugcagcu

SEQ ID NO: 1211346 - RNA, 22 nt, Mycobacterium bovis subsp bovis AF2122/97
gaaagaucgguugaucugucag

SEQ ID NO: 1211347 - RNA, 21 nt, Mycobacterium bovis subsp bovis AF2122/97
gaaagccgcagccgcaggcca

SEQ ID NO: 1211348 - RNA, 23 nt, Mycobacterium bovis subsp bovis AF2122/97
gaaagccuaguccuggcucggca

SEQ ID NO: 1211349 - RNA, 15 nt, Mycobacterium bovis subsp bovis AF2122/97
gaaagacaacccgcu

SEQ ID NO: 1211350 - RNA, 16 nt, Mycobacterium bovis subsp bovis AF2122/97
gaaagacgcuguccag

SEQ ID NO: 1211351 - RNA, 14 nt, Mycobacterium bovis subsp bovis AF2122/97
gaaacggccgggca

SEQ ID NO: 1211352 - RNA, 20 nt, Mycobacterium bovis subsp bovis AF2122/97
gaaacggauuggucgaccga

SEQ ID NO: 1211353 - RNA, 23 nt, Mycobacterium bovis subsp bovis AF2122/97
gaaacgcguaucccagauacauc

SEQ ID NO: 1211354 - RNA, 17 nt, Mycobacterium bovis subsp bovis AF2122/97
gaaacgcgaugguggcc

SEQ ID NO: 1211355 - RNA, 16 nt, Mycobacterium bovis subsp bovis AF2122/97
gaaaauugcuccacca

SEQ ID NO: 1211356 - RNA, 15 nt, Mycobacterium bovis subsp bovis AF2122/97
gaaacaccggccagc

SEQ ID NO: 1211357 - RNA, 14 nt, Mycobacterium bovis subsp bovis AF2122/97
gaaacacgacagcc

SEQ ID NO: 1211358 - RNA, 22 nt, Mycobacterium bovis subsp bovis AF2122/97
gaaacaagcaagcguguuguuu

SEQ ID NO: 1211359 - RNA, 21 nt, Mycobacterium bovis subsp bovis AF2122/97
gaaacaucucggcgcagccgg

SEQ ID NO: 1211360 - RNA, 23 nt, Mycobacterium bovis subsp bovis AF2122/97
gaaacaucucggcgcagccggug

SEQ ID NO: 1211361 - RNA, 13 nt, Mycobacterium bovis subsp bovis AF2122/97
gaaacauccccga

SEQ ID NO: 1211362 - RNA, 17 nt, Mycobacterium bovis subsp bovis AF2122/97
gaaacagccgcagcggc

SEQ ID NO: 1211363 - RNA, 17 nt, Mycobacterium bovis subsp bovis AF2122/97
gaaacacgacagccagu

SEQ ID NO: 1211364 - RNA, 16 nt, Mycobacterium bovis subsp bovis AF2122/97
gaaacagccgcagcgg

SEQ ID NO: 1211365 - RNA, 19 nt, Mycobacterium bovis subsp bovis AF2122/97
gaaaccgcugggggcgguc

SEQ ID NO: 1211366 - RNA, 21 nt, Mycobacterium bovis subsp bovis AF2122/97
gaaaccaugccgccgaagccg

SEQ ID NO: 1211367 - RNA, 14 nt, Mycobacterium bovis subsp bovis AF2122/97
gaaaccaucgccag

SEQ ID NO: 1211368 - RNA, 14 nt, Mycobacterium bovis subsp bovis AF2122/97
gaaaccacagcgcc

SEQ ID NO: 1211369 - RNA, 22 nt, Mycobacterium bovis subsp bovis AF2122/97
gaaacagguaagcagccagcaa

SEQ ID NO: 1211370 - RNA, 14 nt, Mycobacterium bovis subsp bovis AF2122/97
gaaaaagaccgaca

SEQ ID NO: 1211371 - RNA, 15 nt, Mycobacterium bovis subsp bovis AF2122/97
gaaaaacaccagcga

SEQ ID NO: 1211372 - RNA, 22 nt, Mycobacterium bovis subsp bovis AF2122/97
cuuuuucccggcggcgcgcccg

SEQ ID NO: 1211373 - RNA, 15 nt, Mycobacterium bovis subsp bovis AF2122/97
cuuuugauugaccaa

SEQ ID NO: 1211374 - RNA, 15 nt, Mycobacterium bovis subsp bovis AF2122/97
cuuguugaccaccac

SEQ ID NO: 1211375 - RNA, 16 nt, Mycobacterium bovis subsp bovis AF2122/97
cuuguucggacucacu

SEQ ID NO: 1211376 - RNA, 14 nt, Mycobacterium bovis subsp bovis AF2122/97
cuuguuguggugga

SEQ ID NO: 1211377 - RNA, 19 nt, Mycobacterium bovis subsp bovis AF2122/97
cuuuaaaccgaacccaccc

SEQ ID NO: 1211378 - RNA, 22 nt, Mycobacterium bovis subsp bovis AF2122/97
cuugugcugcaaggaauuccgg

SEQ ID NO: 1211379 - RNA, 15 nt, Mycobacterium bovis subsp bovis AF2122/97
cuugugccccgagcu

SEQ ID NO: 1211380 - RNA, 17 nt, Mycobacterium bovis subsp bovis AF2122/97
cuugugccccgagcugc

SEQ ID NO: 1211381 - RNA, 16 nt, Mycobacterium bovis subsp bovis AF2122/97
cuuguucaucaucugg

SEQ ID NO: 1211382 - RNA, 18 nt, Mycobacterium bovis subsp bovis AF2122/97
cuuguucaucaucugguc

SEQ ID NO: 1211383 - RNA, 20 nt, Mycobacterium bovis subsp bovis AF2122/97
cuuguuagccuccagauucg

SEQ ID NO: 1211384 - RNA, 14 nt, Mycobacterium bovis subsp bovis AF2122/97
cuugucggccccgg

SEQ ID NO: 1211385 - RNA, 23 nt, Mycobacterium bovis subsp bovis AF2122/97
cuugucgcggugcggcagauacu

SEQ ID NO: 1211386 - RNA, 15 nt, Mycobacterium bovis subsp bovis AF2122/97
cuugucgcguucggc

SEQ ID NO: 1211387 - RNA, 22 nt, Mycobacterium bovis subsp bovis AF2122/97
cuuguccggugguggcgacccc

SEQ ID NO: 1211388 - RNA, 24 nt, Mycobacterium bovis subsp bovis AF2122/97
cuuguccuuauuggacugcagcgu

SEQ ID NO: 1211389 - RNA, 14 nt, Mycobacterium bovis subsp bovis AF2122/97
cuuguccuccgcgg

SEQ ID NO: 1211390 - RNA, 15 nt, Mycobacterium bovis subsp bovis AF2122/97
cuugucgaccacgac

SEQ ID NO: 1211391 - RNA, 20 nt, Mycobacterium bovis subsp bovis AF2122/97
cuugucgaggcgcaggucaa

SEQ ID NO: 1211392 - RNA, 16 nt, Mycobacterium bovis subsp bovis AF2122/97
cuugucgccccaugcg

SEQ ID NO: 1211393 - RNA, 14 nt, Mycobacterium bovis subsp bovis AF2122/97
cuugucgccggcau

SEQ ID NO: 1211394 - RNA, 23 nt, Mycobacterium bovis subsp bovis AF2122/97
cuugucgccggcauacaccguga

SEQ ID NO: 1211395 - RNA, 22 nt, Mycobacterium bovis subsp bovis AF2122/97
cuuggucaaaaagcucggcccu

SEQ ID NO: 1211396 - RNA, 23 nt, Mycobacterium bovis subsp bovis AF2122/97
cuuggucaggcuggaggugaacu

SEQ ID NO: 1211397 - RNA, 17 nt, Mycobacterium bovis subsp bovis AF2122/97
cuugggcuugcgccgga

SEQ ID NO: 1211398 - RNA, 17 nt, Mycobacterium bovis subsp bovis AF2122/97
cuugguagccggccgcu

SEQ ID NO: 1211399 - RNA, 13 nt, Mycobacterium bovis subsp bovis AF2122/97
cuuggucgccggc

SEQ ID NO: 1211400 - RNA, 15 nt, Mycobacterium bovis subsp bovis AF2122/97
cuuggucgcccagcc

SEQ ID NO: 1211401 - RNA, 17 nt, Mycobacterium bovis subsp bovis AF2122/97
cuuggucgccgccuucu

SEQ ID NO: 1211402 - RNA, 17 nt, Mycobacterium bovis subsp bovis AF2122/97
cuuggucuugaacccga

SEQ ID NO: 1211403 - RNA, 19 nt, Mycobacterium bovis subsp bovis AF2122/97
cuuggugaaccgcgcggcg

SEQ ID NO: 1211404 - RNA, 21 nt, Mycobacterium bovis subsp bovis AF2122/97
cuuggugcccaaggcagaccc

SEQ ID NO: 1211405 - RNA, 14 nt, Mycobacterium bovis subsp bovis AF2122/97
cuuguccaccgugc

SEQ ID NO: 1211406 - RNA, 16 nt, Mycobacterium bovis subsp bovis AF2122/97
cuugucaaaggugcac

SEQ ID NO: 1211407 - RNA, 18 nt, Mycobacterium bovis subsp bovis AF2122/97
cuugucaaaggugcacug

SEQ ID NO: 1211408 - RNA, 19 nt, Mycobacterium bovis subsp bovis AF2122/97
cuuguagcgcaucgccaau

SEQ ID NO: 1211409 - RNA, 18 nt, Mycobacterium bovis subsp bovis AF2122/97
cuuggccgcugccuucuu

SEQ ID NO: 1211410 - RNA, 23 nt, Mycobacterium bovis subsp bovis AF2122/97
cuuggcggccaacggcuccgggc

SEQ ID NO: 1211411 - RNA, 17 nt, Mycobacterium bovis subsp bovis AF2122/97
cuuggcgauccaggcca

SEQ ID NO: 1211412 - RNA, 20 nt, Mycobacterium bovis subsp bovis AF2122/97
cuuggcgaucucaccuggag

SEQ ID NO: 1211413 - RNA, 18 nt, Mycobacterium bovis subsp bovis AF2122/97
cuuggcggccuuugucgc

SEQ ID NO: 1211414 - RNA, 12 nt, Mycobacterium bovis subsp bovis AF2122/97
cuuggcggccuu

SEQ ID NO: 1211415 - RNA, 17 nt, Mycobacterium bovis subsp bovis AF2122/97
cuuggcgggagccuugg

SEQ ID NO: 1211416 - RNA, 21 nt, Mycobacterium bovis subsp bovis AF2122/97
cuuggcgggagccuugguagc

SEQ ID NO: 1211417 - RNA, 17 nt, Mycobacterium bovis subsp bovis AF2122/97
cuuggcgguggcccgau

SEQ ID NO: 1211418 - RNA, 17 nt, Mycobacterium bovis subsp bovis AF2122/97
cuuggcuaacaccgcag

SEQ ID NO: 1211419 - RNA, 15 nt, Mycobacterium bovis subsp bovis AF2122/97
cuuggcguugaccag

SEQ ID NO: 1211420 - RNA, 23 nt, Mycobacterium bovis subsp bovis AF2122/97
cuuggcuucgacgcuuccugggu

SEQ ID NO: 1211421 - RNA, 14 nt, Mycobacterium bovis subsp bovis AF2122/97
cuugggaaacccgg

SEQ ID NO: 1211422 - RNA, 12 nt, Mycobacterium bovis subsp bovis AF2122/97
cuuggcgggcgc

SEQ ID NO: 1211423 - RNA, 12 nt, Mycobacterium bovis subsp bovis AF2122/97
cuugggccaggc

SEQ ID NO: 1211424 - RNA, 15 nt, Mycobacterium bovis subsp bovis AF2122/97
cuugggccaggccca

SEQ ID NO: 1211425 - RNA, 16 nt, Mycobacterium bovis subsp bovis AF2122/97
cuugggcagcagcgcg

SEQ ID NO: 1211426 - RNA, 17 nt, Mycobacterium bovis subsp bovis AF2122/97
cuugggccaggcccagc

SEQ ID NO: 1211427 - RNA, 13 nt, Mycobacterium bovis subsp bovis AF2122/97
cuugggcccgcug

SEQ ID NO: 1211428 - RNA, 16 nt, Mycobacterium bovis subsp bovis AF2122/97
cuugggccugggccgc

SEQ ID NO: 1211429 - RNA, 20 nt, Mycobacterium bovis subsp bovis AF2122/97
cuugggcgacgcggcgccgc

SEQ ID NO: 1211430 - RNA, 21 nt, Mycobacterium bovis subsp bovis AF2122/97
cuugggcgacgcggcgccgcc

SEQ ID NO: 1211431 - RNA, 17 nt, Mycobacterium bovis subsp bovis AF2122/97
cuugggaccgacuugcc

SEQ ID NO: 1211432 - RNA, 16 nt, Mycobacterium bovis subsp bovis AF2122/97
cuugggauuugggcga

SEQ ID NO: 1211433 - RNA, 18 nt, Mycobacterium bovis subsp bovis AF2122/97
cuuggccagacccaccac

SEQ ID NO: 1211434 - RNA, 19 nt, Mycobacterium bovis subsp bovis AF2122/97
cuuggccaggaagucccgg

SEQ ID NO: 1211435 - RNA, 11 nt, Mycobacterium bovis subsp bovis AF2122/97
cuuggccggca

SEQ ID NO: 1211436 - RNA, 14 nt, Mycobacterium bovis subsp bovis AF2122/97
cuuggccgcugccu

SEQ ID NO: 1211437 - RNA, 12 nt, Mycobacterium bovis subsp bovis AF2122/97
cuuggccgcgca

SEQ ID NO: 1211438 - RNA, 15 nt, Mycobacterium bovis subsp bovis AF2122/97
cuuggccgccgccac

SEQ ID NO: 1211439 - RNA, 17 nt, Mycobacterium bovis subsp bovis AF2122/97
cuuggccaccaucgccg

SEQ ID NO: 1211440 - RNA, 18 nt, Mycobacterium bovis subsp bovis AF2122/97
cuuggcaggugccuucuu

SEQ ID NO: 1211441 - RNA, 16 nt, Mycobacterium bovis subsp bovis AF2122/97
cuuggauccggccgcc

SEQ ID NO: 1211442 - RNA, 22 nt, Mycobacterium bovis subsp bovis AF2122/97
cuuggagaagguuucccgcuua

SEQ ID NO: 1211443 - RNA, 20 nt, Mycobacterium bovis subsp bovis AF2122/97
cuuggcaaucaucucccgac

SEQ ID NO: 1211444 - RNA, 12 nt, Mycobacterium bovis subsp bovis AF2122/97
cuuggacagcag

SEQ ID NO: 1211445 - RNA, 19 nt, Mycobacterium bovis subsp bovis AF2122/97
cuuggacaccaguaaugcc

SEQ ID NO: 1211446 - RNA, 14 nt, Mycobacterium bovis subsp bovis AF2122/97
cuuggaaggcgcgc

SEQ ID NO: 1211447 - RNA, 19 nt, Mycobacterium bovis subsp bovis AF2122/97
cuuggacgacccgggccgg

SEQ ID NO: 1211448 - RNA, 12 nt, Mycobacterium bovis subsp bovis AF2122/97
cuuggaccagcg

SEQ ID NO: 1211449 - RNA, 22 nt, Mycobacterium bovis subsp bovis AF2122/97
cuuggaccagcguggggccgcc

SEQ ID NO: 1211450 - RNA, 22 nt, Mycobacterium bovis subsp bovis AF2122/97
cuuugguuguuggugccagccg

SEQ ID NO: 1211451 - RNA, 23 nt, Mycobacterium bovis subsp bovis AF2122/97
cuuugguuguuggugccagccgg

SEQ ID NO: 1211452 - RNA, 22 nt, Mycobacterium bovis subsp bovis AF2122/97
cuuuggcggugaugguggcaac

SEQ ID NO: 1211453 - RNA, 22 nt, Mycobacterium bovis subsp bovis AF2122/97
cuuugcgaaucggcccgugcca

SEQ ID NO: 1211454 - RNA, 18 nt, Mycobacterium bovis subsp bovis AF2122/97
cuuugagcgcggccacca

SEQ ID NO: 1211455 - RNA, 14 nt, Mycobacterium bovis subsp bovis AF2122/97
cuuugaucgcccgg

SEQ ID NO: 1211456 - RNA, 19 nt, Mycobacterium bovis subsp bovis AF2122/97
cuuucgcgugcggcugcca

SEQ ID NO: 1211457 - RNA, 20 nt, Mycobacterium bovis subsp bovis AF2122/97
cuuucgcgccgcgaggcacc

SEQ ID NO: 1211458 - RNA, 24 nt, Mycobacterium bovis subsp bovis AF2122/97
cuuucgcgccgcgaggcaccgaca

SEQ ID NO: 1211459 - RNA, 14 nt, Mycobacterium bovis subsp bovis AF2122/97
cuuucgaugauggg

SEQ ID NO: 1211460 - RNA, 22 nt, Mycobacterium bovis subsp bovis AF2122/97
cuuucggaaaaccgcaccgucc

SEQ ID NO: 1211461 - RNA, 17 nt, Mycobacterium bovis subsp bovis AF2122/97
cuuuagugucugcucgc

SEQ ID NO: 1211462 - RNA, 15 nt, Mycobacterium bovis subsp bovis AF2122/97
aaagacagcgcggga

SEQ ID NO: 1211463 - RNA, 18 nt, Mycobacterium bovis subsp bovis AF2122/97
cuucugccuuggccggcu

SEQ ID NO: 1211464 - RNA, 13 nt, Mycobacterium bovis subsp bovis AF2122/97
cuucugcuacccg

SEQ ID NO: 1211465 - RNA, 15 nt, Mycobacterium bovis subsp bovis AF2122/97
cuucugacgcggccg

SEQ ID NO: 1211466 - RNA, 14 nt, Mycobacterium bovis subsp bovis AF2122/97
cuucucucgggcca

SEQ ID NO: 1211467 - RNA, 14 nt, Mycobacterium bovis subsp bovis AF2122/97
cuucucgagccgcc

SEQ ID NO: 1211468 - RNA, 14 nt, Mycobacterium bovis subsp bovis AF2122/97
cuucuccuccagag

SEQ ID NO: 1211469 - RNA, 23 nt, Mycobacterium bovis subsp bovis AF2122/97
cuucuccguccccgcagcgccua

SEQ ID NO: 1211470 - RNA, 18 nt, Mycobacterium bovis subsp bovis AF2122/97
cuucucggcgggucaggc

SEQ ID NO: 1211471 - RNA, 14 nt, Mycobacterium bovis subsp bovis AF2122/97
cuucuccaccaccg

SEQ ID NO: 1211472 - RNA, 12 nt, Mycobacterium bovis subsp bovis AF2122/97
cuucggugaucu

SEQ ID NO: 1211473 - RNA, 17 nt, Mycobacterium bovis subsp bovis AF2122/97
cuucgucauggccggcc

SEQ ID NO: 1211474 - RNA, 18 nt, Mycobacterium bovis subsp bovis AF2122/97
cuucgucaaccaccagga

SEQ ID NO: 1211475 - RNA, 21 nt, Mycobacterium bovis subsp bovis AF2122/97
cuucgucggccggcaccccac

SEQ ID NO: 1211476 - RNA, 12 nt, Mycobacterium bovis subsp bovis AF2122/97
cuucgucggccg

SEQ ID NO: 1211477 - RNA, 16 nt, Mycobacterium bovis subsp bovis AF2122/97
cuucgucggccggcac

SEQ ID NO: 1211478 - RNA, 15 nt, Mycobacterium bovis subsp bovis AF2122/97
cuucguggccuugac

SEQ ID NO: 1211479 - RNA, 18 nt, Mycobacterium bovis subsp bovis AF2122/97
cuucuuaccgcgggccgc

SEQ ID NO: 1211480 - RNA, 20 nt, Mycobacterium bovis subsp bovis AF2122/97
cuucuuggcugcacuggccc

SEQ ID NO: 1211481 - RNA, 21 nt, Mycobacterium bovis subsp bovis AF2122/97
cuucuuggcaggugccuucuu

SEQ ID NO: 1211482 - RNA, 14 nt, Mycobacterium bovis subsp bovis AF2122/97
cuucuugaccacga

SEQ ID NO: 1211483 - RNA, 13 nt, Mycobacterium bovis subsp bovis AF2122/97
cuucuucuugacc

SEQ ID NO: 1211484 - RNA, 13 nt, Mycobacterium bovis subsp bovis AF2122/97
cuugaaacccagg

SEQ ID NO: 1211485 - RNA, 14 nt, Mycobacterium bovis subsp bovis AF2122/97
cuucuuugccggcg

SEQ ID NO: 1211486 - RNA, 16 nt, Mycobacterium bovis subsp bovis AF2122/97
cuugagccgccccggc

SEQ ID NO: 1211487 - RNA, 24 nt, Mycobacterium bovis subsp bovis AF2122/97
cuugagccggacguucuggaucgu

SEQ ID NO: 1211488 - RNA, 19 nt, Mycobacterium bovis subsp bovis AF2122/97
cuugagccgggcaaccagc

SEQ ID NO: 1211489 - RNA, 15 nt, Mycobacterium bovis subsp bovis AF2122/97
cuugacugcacacca

SEQ ID NO: 1211490 - RNA, 23 nt, Mycobacterium bovis subsp bovis AF2122/97
cuugaccgcggucuucuucaccg

SEQ ID NO: 1211491 - RNA, 20 nt, Mycobacterium bovis subsp bovis AF2122/97
cuugacuccgcgcgcugggc

SEQ ID NO: 1211492 - RNA, 22 nt, Mycobacterium bovis subsp bovis AF2122/97
cuugacgcggccacauaccacc

SEQ ID NO: 1211493 - RNA, 20 nt, Mycobacterium bovis subsp bovis AF2122/97
cuugauggucuccaccaggu

SEQ ID NO: 1211494 - RNA, 23 nt, Mycobacterium bovis subsp bovis AF2122/97
cuugccaaucgccgucagcaccg

SEQ ID NO: 1211495 - RNA, 15 nt, Mycobacterium bovis subsp bovis AF2122/97
cuugccacuccagga

SEQ ID NO: 1211496 - RNA, 16 nt, Mycobacterium bovis subsp bovis AF2122/97
cuugccacuccaggag

SEQ ID NO: 1211497 - RNA, 23 nt, Mycobacterium bovis subsp bovis AF2122/97
cuugcccaagaucucgcgggccc

SEQ ID NO: 1211498 - RNA, 21 nt, Mycobacterium bovis subsp bovis AF2122/97
cuugcaccggccgaaggcgcu

SEQ ID NO: 1211499 - RNA, 12 nt, Mycobacterium bovis subsp bovis AF2122/97
cuugcacaagcu

SEQ ID NO: 1211500 - RNA, 23 nt, Mycobacterium bovis subsp bovis AF2122/97
cuugccguagaagcgcuccagcu

SEQ ID NO: 1211501 - RNA, 17 nt, Mycobacterium bovis subsp bovis AF2122/97
cuugccugcgccgaguu

SEQ ID NO: 1211502 - RNA, 16 nt, Mycobacterium bovis subsp bovis AF2122/97
cuugccguugggaacc

SEQ ID NO: 1211503 - RNA, 15 nt, Mycobacterium bovis subsp bovis AF2122/97
cuugccuagccgcag

SEQ ID NO: 1211504 - RNA, 18 nt, Mycobacterium bovis subsp bovis AF2122/97
cuugccgcccgcuccgcc

SEQ ID NO: 1211505 - RNA, 15 nt, Mycobacterium bovis subsp bovis AF2122/97
cuugccgccggcccc

SEQ ID NO: 1211506 - RNA, 16 nt, Mycobacterium bovis subsp bovis AF2122/97
cuugccgccggcgccg

SEQ ID NO: 1211507 - RNA, 18 nt, Mycobacterium bovis subsp bovis AF2122/97
cuugccgccauuccagcc

SEQ ID NO: 1211508 - RNA, 13 nt, Mycobacterium bovis subsp bovis AF2122/97
cuugccgaucagc

SEQ ID NO: 1211509 - RNA, 17 nt, Mycobacterium bovis subsp bovis AF2122/97
cuugccgcugagcccug

SEQ ID NO: 1211510 - RNA, 16 nt, Mycobacterium bovis subsp bovis AF2122/97
cuugccgccuuggccc

SEQ ID NO: 1211511 - RNA, 17 nt, Mycobacterium bovis subsp bovis AF2122/97
cuugccgccuuggcccc

SEQ ID NO: 1211512 - RNA, 17 nt, Mycobacterium bovis subsp bovis AF2122/97
cuugccgccguugauga

SEQ ID NO: 1211513 - RNA, 14 nt, Mycobacterium bovis subsp bovis AF2122/97
cuugcccagcgaca

SEQ ID NO: 1211514 - RNA, 12 nt, Mycobacterium bovis subsp bovis AF2122/97
cuugccccgccg

SEQ ID NO: 1211515 - RNA, 17 nt, Mycobacterium bovis subsp bovis AF2122/97
cuugcccgagcccagcc

SEQ ID NO: 1211516 - RNA, 21 nt, Mycobacterium bovis subsp bovis AF2122/97
cuugcgcccggccugcugguc

SEQ ID NO: 1211517 - RNA, 19 nt, Mycobacterium bovis subsp bovis AF2122/97
cuugcgccgcccaugccuc

SEQ ID NO: 1211518 - RNA, 14 nt, Mycobacterium bovis subsp bovis AF2122/97
cuugcgcagcagcg

SEQ ID NO: 1211519 - RNA, 18 nt, Mycobacterium bovis subsp bovis AF2122/97
cuugcgcaucgccgacag

SEQ ID NO: 1211520 - RNA, 21 nt, Mycobacterium bovis subsp bovis AF2122/97
cuugcgaucggcacuuagccc

SEQ ID NO: 1211521 - RNA, 22 nt, Mycobacterium bovis subsp bovis AF2122/97
cuugcggccgcugaucaacaga

SEQ ID NO: 1211522 - RNA, 20 nt, Mycobacterium bovis subsp bovis AF2122/97
cuugcguccauccgcagcag

SEQ ID NO: 1211523 - RNA, 18 nt, Mycobacterium bovis subsp bovis AF2122/97
cuugcggaagaagugcuc

SEQ ID NO: 1211524 - RNA, 15 nt, Mycobacterium bovis subsp bovis AF2122/97
cuugcggagccgccg

SEQ ID NO: 1211525 - RNA, 16 nt, Mycobacterium bovis subsp bovis AF2122/97
cuugcucucgcagcau

SEQ ID NO: 1211526 - RNA, 21 nt, Mycobacterium bovis subsp bovis AF2122/97
cuugcuagcgcaucuuggugc

SEQ ID NO: 1211527 - RNA, 16 nt, Mycobacterium bovis subsp bovis AF2122/97
cuugcucggcgugcuc

SEQ ID NO: 1211528 - RNA, 14 nt, Mycobacterium bovis subsp bovis AF2122/97
cuggccgacucgag

SEQ ID NO: 1211529 - RNA, 14 nt, Mycobacterium bovis subsp bovis AF2122/97
cuggccgaagaacu

SEQ ID NO: 1211530 - RNA, 14 nt, Mycobacterium bovis subsp bovis AF2122/97
cuggccgaagcccg

SEQ ID NO: 1211531 - RNA, 23 nt, Mycobacterium bovis subsp bovis AF2122/97
cuggccgaacgacggguccgggc

SEQ ID NO: 1211532 - RNA, 15 nt, Mycobacterium bovis subsp bovis AF2122/97
cuggcccugcuccuc

SEQ ID NO: 1211533 - RNA, 15 nt, Mycobacterium bovis subsp bovis AF2122/97
cuggcccgucggcgu

SEQ ID NO: 1211534 - RNA, 20 nt, Mycobacterium bovis subsp bovis AF2122/97
cuggcccggcuacgacggcg

SEQ ID NO: 1211535 - RNA, 22 nt, Mycobacterium bovis subsp bovis AF2122/97
cuggcccuuguuggccugcaac

SEQ ID NO: 1211536 - RNA, 18 nt, Mycobacterium bovis subsp bovis AF2122/97
cuggcccgauaaaugccg

SEQ ID NO: 1211537 - RNA, 15 nt, Mycobacterium bovis subsp bovis AF2122/97
cuggccccgguggug

SEQ ID NO: 1211538 - RNA, 23 nt, Mycobacterium bovis subsp bovis AF2122/97
cuggccccgguggugcugccgau

SEQ ID NO: 1211539 - RNA, 17 nt, Mycobacterium bovis subsp bovis AF2122/97
cuggcccgcuguaccuc

SEQ ID NO: 1211540 - RNA, 23 nt, Mycobacterium bovis subsp bovis AF2122/97
cuggcccgcgacaucgggaaugu

SEQ ID NO: 1211541 - RNA, 19 nt, Mycobacterium bovis subsp bovis AF2122/97
cuguuacuccgacggcccg

SEQ ID NO: 1211542 - RNA, 16 nt, Mycobacterium bovis subsp bovis AF2122/97
cuguucggccauggcg

SEQ ID NO: 1211543 - RNA, 16 nt, Mycobacterium bovis subsp bovis AF2122/97
cuguucggucuugccg

SEQ ID NO: 1211544 - RNA, 21 nt, Mycobacterium bovis subsp bovis AF2122/97
cuguugugagauuggcagacc

SEQ ID NO: 1211545 - RNA, 14 nt, Mycobacterium bovis subsp bovis AF2122/97
cuguuucugagcgc

SEQ ID NO: 1211546 - RNA, 19 nt, Mycobacterium bovis subsp bovis AF2122/97
cuuaaccgagccgaccggc

SEQ ID NO: 1211547 - RNA, 12 nt, Mycobacterium bovis subsp bovis AF2122/97
cuuaugcgcggu

SEQ ID NO: 1211548 - RNA, 18 nt, Mycobacterium bovis subsp bovis AF2122/97
cuuagggcgcccgccccg

SEQ ID NO: 1211549 - RNA, 20 nt, Mycobacterium bovis subsp bovis AF2122/97
cuuagcgccguugccgccac

SEQ ID NO: 1211550 - RNA, 19 nt, Mycobacterium bovis subsp bovis AF2122/97
cuuagcgcgggccuggccc

SEQ ID NO: 1211551 - RNA, 23 nt, Mycobacterium bovis subsp bovis AF2122/97
cuucccuccagauaccaccgccg

SEQ ID NO: 1211552 - RNA, 19 nt, Mycobacterium bovis subsp bovis AF2122/97
cuuccggaacaaaggcuug

SEQ ID NO: 1211553 - RNA, 16 nt, Mycobacterium bovis subsp bovis AF2122/97
cuucccggaagcgccg

SEQ ID NO: 1211554 - RNA, 16 nt, Mycobacterium bovis subsp bovis AF2122/97
cuuccggauucggacu

SEQ ID NO: 1211555 - RNA, 21 nt, Mycobacterium bovis subsp bovis AF2122/97
cuuccacugacgucucaucaa

SEQ ID NO: 1211556 - RNA, 14 nt, Mycobacterium bovis subsp bovis AF2122/97
cuuccaacaggccg

SEQ ID NO: 1211557 - RNA, 16 nt, Mycobacterium bovis subsp bovis AF2122/97
cuucgagccggcggcc

SEQ ID NO: 1211558 - RNA, 17 nt, Mycobacterium bovis subsp bovis AF2122/97
cuucgacgcggcgaccg

SEQ ID NO: 1211559 - RNA, 21 nt, Mycobacterium bovis subsp bovis AF2122/97
cuucgacgcuuccuggguugg

SEQ ID NO: 1211560 - RNA, 20 nt, Mycobacterium bovis subsp bovis AF2122/97
cuucgccgcgcagccuucuc

SEQ ID NO: 1211561 - RNA, 22 nt, Mycobacterium bovis subsp bovis AF2122/97
cuucgccggcgccagcagaucu

SEQ ID NO: 1211562 - RNA, 22 nt, Mycobacterium bovis subsp bovis AF2122/97
cuucgcgaagaacgacgccacc

SEQ ID NO: 1211563 - RNA, 18 nt, Mycobacterium bovis subsp bovis AF2122/97
cuucggggugcacgcgga

SEQ ID NO: 1211564 - RNA, 20 nt, Mycobacterium bovis subsp bovis AF2122/97
cuucgguaggcaggccggcu

SEQ ID NO: 1211565 - RNA, 13 nt, Mycobacterium bovis subsp bovis AF2122/97
cuucgggaacgcu

SEQ ID NO: 1211566 - RNA, 17 nt, Mycobacterium bovis subsp bovis AF2122/97
cuucggucaccucgaug

SEQ ID NO: 1211567 - RNA, 14 nt, Mycobacterium bovis subsp bovis AF2122/97
cuucggucagggug

SEQ ID NO: 1211568 - RNA, 19 nt, Mycobacterium bovis subsp bovis AF2122/97
cuucggcggugcccagcag

SEQ ID NO: 1211569 - RNA, 14 nt, Mycobacterium bovis subsp bovis AF2122/97
cuucggcuagguca

SEQ ID NO: 1211570 - RNA, 13 nt, Mycobacterium bovis subsp bovis AF2122/97
cuucgcgcagccg

SEQ ID NO: 1211571 - RNA, 16 nt, Mycobacterium bovis subsp bovis AF2122/97
cuucgcgcagccgccg

SEQ ID NO: 1211572 - RNA, 18 nt, Mycobacterium bovis subsp bovis AF2122/97
cuucgcgcaaccagccca

SEQ ID NO: 1211573 - RNA, 17 nt, Mycobacterium bovis subsp bovis AF2122/97
cuuccgggacuaccacc

SEQ ID NO: 1211574 - RNA, 19 nt, Mycobacterium bovis subsp bovis AF2122/97
cuuccgggacuaccacccg

SEQ ID NO: 1211575 - RNA, 13 nt, Mycobacterium bovis subsp bovis AF2122/97
cuuccgguccagc

SEQ ID NO: 1211576 - RNA, 13 nt, Mycobacterium bovis subsp bovis AF2122/97
cuucgaccgccgu

SEQ ID NO: 1211577 - RNA, 14 nt, Mycobacterium bovis subsp bovis AF2122/97
cuucgacagcggcg

SEQ ID NO: 1211578 - RNA, 17 nt, Mycobacterium bovis subsp bovis AF2122/97
cuucaucaacgacacca

SEQ ID NO: 1211579 - RNA, 19 nt, Mycobacterium bovis subsp bovis AF2122/97
cuucaucaacgacaccaga

SEQ ID NO: 1211580 - RNA, 17 nt, Mycobacterium bovis subsp bovis AF2122/97
cuucaguccggcccccg

SEQ ID NO: 1211581 - RNA, 14 nt, Mycobacterium bovis subsp bovis AF2122/97
cuucagcagcggcg

SEQ ID NO: 1211582 - RNA, 24 nt, Mycobacterium bovis subsp bovis AF2122/97
cuucagcacgguguacgcccgcuc

SEQ ID NO: 1211583 - RNA, 22 nt, Mycobacterium bovis subsp bovis AF2122/97
cuucaggcaccggaugaugugg

SEQ ID NO: 1211584 - RNA, 17 nt, Mycobacterium bovis subsp bovis AF2122/97
cuucagcuaccuccgcc

SEQ ID NO: 1211585 - RNA, 20 nt, Mycobacterium bovis subsp bovis AF2122/97
cuucagcuaccuccgccacc

SEQ ID NO: 1211586 - RNA, 17 nt, Mycobacterium bovis subsp bovis AF2122/97
cuucaggcaucaccgga

SEQ ID NO: 1211587 - RNA, 19 nt, Mycobacterium bovis subsp bovis AF2122/97
cuucacgggccguccagga

SEQ ID NO: 1211588 - RNA, 20 nt, Mycobacterium bovis subsp bovis AF2122/97
cuucacgcuggccuccagcu

SEQ ID NO: 1211589 - RNA, 21 nt, Mycobacterium bovis subsp bovis AF2122/97
cuucacgcuggccuccagcuu

SEQ ID NO: 1211590 - RNA, 14 nt, Mycobacterium bovis subsp bovis AF2122/97
cuucaccgccuugg

SEQ ID NO: 1211591 - RNA, 13 nt, Mycobacterium bovis subsp bovis AF2122/97
cuucaccacccug

SEQ ID NO: 1211592 - RNA, 15 nt, Mycobacterium bovis subsp bovis AF2122/97
cuucaccacccuguu

SEQ ID NO: 1211593 - RNA, 15 nt, Mycobacterium bovis subsp bovis AF2122/97
cuucaccagccaccc

SEQ ID NO: 1211594 - RNA, 18 nt, Mycobacterium bovis subsp bovis AF2122/97
cggcucggaaaccgcccc

SEQ ID NO: 1211595 - RNA, 19 nt, Mycobacterium bovis subsp bovis AF2122/97
cggcucggaaaccgccccg

SEQ ID NO: 1211596 - RNA, 20 nt, Mycobacterium bovis subsp bovis AF2122/97
cggcucgccggcgaccggga

SEQ ID NO: 1211597 - RNA, 19 nt, Mycobacterium bovis subsp bovis AF2122/97
cggcucgccggcggcccgc

SEQ ID NO: 1211598 - RNA, 20 nt, Mycobacterium bovis subsp bovis AF2122/97
cggcucgccggcggcccgcu

SEQ ID NO: 1211599 - RNA, 23 nt, Mycobacterium bovis subsp bovis AF2122/97
cggcucgccggcggcccgcucga

SEQ ID NO: 1211600 - RNA, 22 nt, Mycobacterium bovis subsp bovis AF2122/97
cggcucggcgggggaccccgcc

SEQ ID NO: 1211601 - RNA, 14 nt, Mycobacterium bovis subsp bovis AF2122/97
cggcucggccaccg

SEQ ID NO: 1211602 - RNA, 15 nt, Mycobacterium bovis subsp bovis AF2122/97
cggcucggcccccga

SEQ ID NO: 1211603 - RNA, 15 nt, Mycobacterium bovis subsp bovis AF2122/97
cggcucgggugcgcc

SEQ ID NO: 1211604 - RNA, 18 nt, Mycobacterium bovis subsp bovis AF2122/97
cggcucguugcgggcggg

SEQ ID NO: 1211605 - RNA, 16 nt, Mycobacterium bovis subsp bovis AF2122/97
cggcucguuggcaaag

SEQ ID NO: 1211606 - RNA, 17 nt, Mycobacterium bovis subsp bovis AF2122/97
cggcucuauccggcgca

SEQ ID NO: 1211607 - RNA, 16 nt, Mycobacterium bovis subsp bovis AF2122/97
cggcugcauccuccuc

SEQ ID NO: 1211608 - RNA, 20 nt, Mycobacterium bovis subsp bovis AF2122/97
cggcugcaaccagcggcaca

SEQ ID NO: 1211609 - RNA, 20 nt, Mycobacterium bovis subsp bovis AF2122/97
cggcugagacagaccgggcc

SEQ ID NO: 1211610 - RNA, 21 nt, Mycobacterium bovis subsp bovis AF2122/97
cggcugaccucccacccccgg

SEQ ID NO: 1211611 - RNA, 22 nt, Mycobacterium bovis subsp bovis AF2122/97
cggcucucuucgcgcgcugggc

SEQ ID NO: 1211612 - RNA, 19 nt, Mycobacterium bovis subsp bovis AF2122/97
cggcugccagcgccgccgc

SEQ ID NO: 1211613 - RNA, 14 nt, Mycobacterium bovis subsp bovis AF2122/97
cggcugccacacag

SEQ ID NO: 1211614 - RNA, 17 nt, Mycobacterium bovis subsp bovis AF2122/97
cggcugccacgcgucgg

SEQ ID NO: 1211615 - RNA, 14 nt, Mycobacterium bovis subsp bovis AF2122/97
cggcugccgcggcu

SEQ ID NO: 1211616 - RNA, 16 nt, Mycobacterium bovis subsp bovis AF2122/97
cggcugccgcucgacc

SEQ ID NO: 1211617 - RNA, 15 nt, Mycobacterium bovis subsp bovis AF2122/97
cggcugccuccauga

SEQ ID NO: 1211618 - RNA, 17 nt, Mycobacterium bovis subsp bovis AF2122/97
cggcugcgcgcucggcc

SEQ ID NO: 1211619 - RNA, 22 nt, Mycobacterium bovis subsp bovis AF2122/97
cggcugcgguaaucgccaccgc

SEQ ID NO: 1211620 - RNA, 20 nt, Mycobacterium bovis subsp bovis AF2122/97
cggcugcgacaggacgucgg

SEQ ID NO: 1211621 - RNA, 15 nt, Mycobacterium bovis subsp bovis AF2122/97
cggcugccgcgcgcu

SEQ ID NO: 1211622 - RNA, 17 nt, Mycobacterium bovis subsp bovis AF2122/97
cggcugcugcgcggugc

SEQ ID NO: 1211623 - RNA, 19 nt, Mycobacterium bovis subsp bovis AF2122/97
cggcugcuuggucgcccag

SEQ ID NO: 1211624 - RNA, 20 nt, Mycobacterium bovis subsp bovis AF2122/97
cggcugcuuggucgcccagc

SEQ ID NO: 1211625 - RNA, 14 nt, Mycobacterium bovis subsp bovis AF2122/97
cggcuggcccaccu

SEQ ID NO: 1211626 - RNA, 20 nt, Mycobacterium bovis subsp bovis AF2122/97
cggcugcgcuuugcacagcg

SEQ ID NO: 1211627 - RNA, 23 nt, Mycobacterium bovis subsp bovis AF2122/97
cggcugcuuggucgcccagccac

SEQ ID NO: 1211628 - RNA, 13 nt, Mycobacterium bovis subsp bovis AF2122/97
cggcuggcggccu

SEQ ID NO: 1211629 - RNA, 18 nt, Mycobacterium bovis subsp bovis AF2122/97
cggcuggccgcgccucgg

SEQ ID NO: 1211630 - RNA, 18 nt, Mycobacterium bovis subsp bovis AF2122/97
cggcuggugccaacugcg

SEQ ID NO: 1211631 - RNA, 22 nt, Mycobacterium bovis subsp bovis AF2122/97
cggcuggugccaacugcgccgu

SEQ ID NO: 1211632 - RNA, 14 nt, Mycobacterium bovis subsp bovis AF2122/97
cggcugguggggga

SEQ ID NO: 1211633 - RNA, 14 nt, Mycobacterium bovis subsp bovis AF2122/97
cggcuggggccgcu

SEQ ID NO: 1211634 - RNA, 15 nt, Mycobacterium bovis subsp bovis AF2122/97
cggcugggcggucgg

SEQ ID NO: 1211635 - RNA, 18 nt, Mycobacterium bovis subsp bovis AF2122/97
cggcuucaguccggcccc

SEQ ID NO: 1211636 - RNA, 19 nt, Mycobacterium bovis subsp bovis AF2122/97
cggcugucgugccucucgg

SEQ ID NO: 1211637 - RNA, 18 nt, Mycobacterium bovis subsp bovis AF2122/97
cggcuguugcggcggcgc

SEQ ID NO: 1211638 - RNA, 21 nt, Mycobacterium bovis subsp bovis AF2122/97
cggcuucguggcggcgcgcgc

SEQ ID NO: 1211639 - RNA, 16 nt, Mycobacterium bovis subsp bovis AF2122/97
cggcuugcccaggcgc

SEQ ID NO: 1211640 - RNA, 17 nt, Mycobacterium bovis subsp bovis AF2122/97
cggcuugagccgcagca

SEQ ID NO: 1211641 - RNA, 23 nt, Mycobacterium bovis subsp bovis AF2122/97
cggcuugcagugaggucaucguc

SEQ ID NO: 1211642 - RNA, 15 nt, Mycobacterium bovis subsp bovis AF2122/97
cggcuucgacgucgg

SEQ ID NO: 1211643 - RNA, 14 nt, Mycobacterium bovis subsp bovis AF2122/97
cggcuuccuccucg

SEQ ID NO: 1211644 - RNA, 18 nt, Mycobacterium bovis subsp bovis AF2122/97
cggcuucgucggccagca

SEQ ID NO: 1211645 - RNA, 16 nt, Mycobacterium bovis subsp bovis AF2122/97
cggcuucguccaccgc

SEQ ID NO: 1211646 - RNA, 17 nt, Mycobacterium bovis subsp bovis AF2122/97
cggcuucgucggccagc

SEQ ID NO: 1211647 - RNA, 14 nt, Mycobacterium bovis subsp bovis AF2122/97
cggcuucggcagcc

SEQ ID NO: 1211648 - RNA, 16 nt, Mycobacterium bovis subsp bovis AF2122/97
cggcuucggguguucg

SEQ ID NO: 1211649 - RNA, 21 nt, Mycobacterium bovis subsp bovis AF2122/97
cggcuucggguguucgcgcgc

SEQ ID NO: 1211650 - RNA, 13 nt, Mycobacterium bovis subsp bovis AF2122/97
cggcuugggccag

SEQ ID NO: 1211651 - RNA, 16 nt, Mycobacterium bovis subsp bovis AF2122/97
cggcuuggcugccucc

SEQ ID NO: 1211652 - RNA, 19 nt, Mycobacterium bovis subsp bovis AF2122/97
cggcuugggaaacccggcc

SEQ ID NO: 1211653 - RNA, 18 nt, Mycobacterium bovis subsp bovis AF2122/97
cggcuugggccaggccca

SEQ ID NO: 1211654 - RNA, 23 nt, Mycobacterium bovis subsp bovis AF2122/97
cggcuuguccucacaugcccgga

SEQ ID NO: 1211655 - RNA, 23 nt, Mycobacterium bovis subsp bovis AF2122/97
cgggaaggaaccgggcaaaucaa

SEQ ID NO: 1211656 - RNA, 19 nt, Mycobacterium bovis subsp bovis AF2122/97
cgggaaggaaccgggcaaa

SEQ ID NO: 1211657 - RNA, 12 nt, Mycobacterium bovis subsp bovis AF2122/97
cgggaaggaacc

SEQ ID NO: 1211658 - RNA, 16 nt, Mycobacterium bovis subsp bovis AF2122/97
cgggaaccaacaccag

SEQ ID NO: 1211659 - RNA, 13 nt, Mycobacterium bovis subsp bovis AF2122/97
cgggaaccccagc

SEQ ID NO: 1211660 - RNA, 22 nt, Mycobacterium bovis subsp bovis AF2122/97
cgggaacgagccacgccagcgu

SEQ ID NO: 1211661 - RNA, 22 nt, Mycobacterium bovis subsp bovis AF2122/97
cgggaaaguuguaucgcagcau

SEQ ID NO: 1211662 - RNA, 23 nt, Mycobacterium bovis subsp bovis AF2122/97
cgggaaacacguucucaccacca

SEQ ID NO: 1211663 - RNA, 21 nt, Mycobacterium bovis subsp bovis AF2122/97
cggcguccuugcgcagcacca

SEQ ID NO: 1211664 - RNA, 21 nt, Mycobacterium bovis subsp bovis AF2122/97
cggcgucgaaggugaccaggc

SEQ ID NO: 1211665 - RNA, 15 nt, Mycobacterium bovis subsp bovis AF2122/97
cggcgucggccaccc

SEQ ID NO: 1211666 - RNA, 17 nt, Mycobacterium bovis subsp bovis AF2122/97
cggcgucgcuggccagg

SEQ ID NO: 1211667 - RNA, 18 nt, Mycobacterium bovis subsp bovis AF2122/97
cggcgucgcuggccaggc

SEQ ID NO: 1211668 - RNA, 15 nt, Mycobacterium bovis subsp bovis AF2122/97
cggcguccgcccagc

SEQ ID NO: 1211669 - RNA, 13 nt, Mycobacterium bovis subsp bovis AF2122/97
cggcguccgaccg

SEQ ID NO: 1211670 - RNA, 16 nt, Mycobacterium bovis subsp bovis AF2122/97
cggcguccuugcgcag

SEQ ID NO: 1211671 - RNA, 19 nt, Mycobacterium bovis subsp bovis AF2122/97
cggcgccgccggcgccgcc

SEQ ID NO: 1211672 - RNA, 20 nt, Mycobacterium bovis subsp bovis AF2122/97
cggcgccgccguccagcgcc

SEQ ID NO: 1211673 - RNA, 15 nt, Mycobacterium bovis subsp bovis AF2122/97
cggcgccgccgugcg

SEQ ID NO: 1211674 - RNA, 17 nt, Mycobacterium bovis subsp bovis AF2122/97
cggcgccgcccuugccg

SEQ ID NO: 1211675 - RNA, 14 nt, Mycobacterium bovis subsp bovis AF2122/97
cggcgccgcccagc

SEQ ID NO: 1211676 - RNA, 13 nt, Mycobacterium bovis subsp bovis AF2122/97
cggcgccgcccgc

SEQ ID NO: 1211677 - RNA, 18 nt, Mycobacterium bovis subsp bovis AF2122/97
cggcgccgcccgcgccgc

SEQ ID NO: 1211678 - RNA, 14 nt, Mycobacterium bovis subsp bovis AF2122/97
cggcguagacgucc

SEQ ID NO: 1211679 - RNA, 20 nt, Mycobacterium bovis subsp bovis AF2122/97
cggcguagaugcgcccggcg

SEQ ID NO: 1211680 - RNA, 22 nt, Mycobacterium bovis subsp bovis AF2122/97
cggcguagaugcgcccggcgug

SEQ ID NO: 1211681 - RNA, 21 nt, Mycobacterium bovis subsp bovis AF2122/97
cggcguaggcgauggcggcgc

SEQ ID NO: 1211682 - RNA, 19 nt, Mycobacterium bovis subsp bovis AF2122/97
cggcgucacggcgugacca

SEQ ID NO: 1211683 - RNA, 16 nt, Mycobacterium bovis subsp bovis AF2122/97
cggcgucaggcacaac

SEQ ID NO: 1211684 - RNA, 17 nt, Mycobacterium bovis subsp bovis AF2122/97
cggcgucggcgcccagc

SEQ ID NO: 1211685 - RNA, 14 nt, Mycobacterium bovis subsp bovis AF2122/97
cggcgucggcgccc

SEQ ID NO: 1211686 - RNA, 19 nt, Mycobacterium bovis subsp bovis AF2122/97
cggcgucgugguggccacg

SEQ ID NO: 1211687 - RNA, 20 nt, Mycobacterium bovis subsp bovis AF2122/97
cggcgucguucgagaccccg

SEQ ID NO: 1211688 - RNA, 16 nt, Mycobacterium bovis subsp bovis AF2122/97
cggcgucucgcagcaa

SEQ ID NO: 1211689 - RNA, 21 nt, Mycobacterium bovis subsp bovis AF2122/97
cggcgucuucgucggagucuu

SEQ ID NO: 1211690 - RNA, 23 nt, Mycobacterium bovis subsp bovis AF2122/97
cggcgucuuccucggccacccgc

SEQ ID NO: 1211691 - RNA, 15 nt, Mycobacterium bovis subsp bovis AF2122/97
cggcgugcagcaccc

SEQ ID NO: 1211692 - RNA, 14 nt, Mycobacterium bovis subsp bovis AF2122/97
cggcgugcggacug

SEQ ID NO: 1211693 - RNA, 16 nt, Mycobacterium bovis subsp bovis AF2122/97
cggcgugcggacugac

SEQ ID NO: 1211694 - RNA, 21 nt, Mycobacterium bovis subsp bovis AF2122/97
cggcgugaaaaacgcccgcgc

SEQ ID NO: 1211695 - RNA, 13 nt, Mycobacterium bovis subsp bovis AF2122/97
cggcgugcucggc

SEQ ID NO: 1211696 - RNA, 23 nt, Mycobacterium bovis subsp bovis AF2122/97
cggcguggcaguacaccggcgug

SEQ ID NO: 1211697 - RNA, 23 nt, Mycobacterium bovis subsp bovis AF2122/97
cggcgugggagguggcgcggggc

SEQ ID NO: 1211698 - RNA, 14 nt, Mycobacterium bovis subsp bovis AF2122/97
cggcgugggcaccu

SEQ ID NO: 1211699 - RNA, 15 nt, Mycobacterium bovis subsp bovis AF2122/97
cggcguguccgccga

SEQ ID NO: 1211700 - RNA, 16 nt, Mycobacterium bovis subsp bovis AF2122/97
cggcgugucgccgcca

SEQ ID NO: 1211701 - RNA, 13 nt, Mycobacterium bovis subsp bovis AF2122/97
cggcgugucgggg

SEQ ID NO: 1211702 - RNA, 16 nt, Mycobacterium bovis subsp bovis AF2122/97
cggcgugucgggggcu

SEQ ID NO: 1211703 - RNA, 21 nt, Mycobacterium bovis subsp bovis AF2122/97
cggcguggucgcgcggcaccg

SEQ ID NO: 1211704 - RNA, 16 nt, Mycobacterium bovis subsp bovis AF2122/97
cggcguugagcuggcg

SEQ ID NO: 1211705 - RNA, 23 nt, Mycobacterium bovis subsp bovis AF2122/97
cggcguugaucagugccaggugg

SEQ ID NO: 1211706 - RNA, 18 nt, Mycobacterium bovis subsp bovis AF2122/97
cggcguugugaccgccga

SEQ ID NO: 1211707 - RNA, 22 nt, Mycobacterium bovis subsp bovis AF2122/97
cggcguugugcaaugugggcgc

SEQ ID NO: 1211708 - RNA, 16 nt, Mycobacterium bovis subsp bovis AF2122/97
cggcguugucccccag

SEQ ID NO: 1211709 - RNA, 23 nt, Mycobacterium bovis subsp bovis AF2122/97
cggcguuccccgagaacggcggg

SEQ ID NO: 1211710 - RNA, 23 nt, Mycobacterium bovis subsp bovis AF2122/97
cggcguuaccaccgucaccgccg

SEQ ID NO: 1211711 - RNA, 17 nt, Mycobacterium bovis subsp bovis AF2122/97
cggcguuacguggugga

SEQ ID NO: 1211712 - RNA, 21 nt, Mycobacterium bovis subsp bovis AF2122/97
cggcuagcugaugccuggucg

SEQ ID NO: 1211713 - RNA, 19 nt, Mycobacterium bovis subsp bovis AF2122/97
cggcuaggccaagccgcgg

SEQ ID NO: 1211714 - RNA, 15 nt, Mycobacterium bovis subsp bovis AF2122/97
cggcuaggccggccg

SEQ ID NO: 1211715 - RNA, 20 nt, Mycobacterium bovis subsp bovis AF2122/97
cggcuagggcagcagcccgg

SEQ ID NO: 1211716 - RNA, 21 nt, Mycobacterium bovis subsp bovis AF2122/97
cggcuagggcagcagcccggg

SEQ ID NO: 1211717 - RNA, 19 nt, Mycobacterium bovis subsp bovis AF2122/97
cggcuaggucagcgggcuu

SEQ ID NO: 1211718 - RNA, 22 nt, Mycobacterium bovis subsp bovis AF2122/97
cggcuaccgcgcucccggcguc

SEQ ID NO: 1211719 - RNA, 19 nt, Mycobacterium bovis subsp bovis AF2122/97
cggcuaccuaacccgcacc

SEQ ID NO: 1211720 - RNA, 19 nt, Mycobacterium bovis subsp bovis AF2122/97
cggcuaccuaacccgcgcc

SEQ ID NO: 1211721 - RNA, 17 nt, Mycobacterium bovis subsp bovis AF2122/97
cggcuacgccucggcgu

SEQ ID NO: 1211722 - RNA, 13 nt, Mycobacterium bovis subsp bovis AF2122/97
cggcuaccgccga

SEQ ID NO: 1211723 - RNA, 15 nt, Mycobacterium bovis subsp bovis AF2122/97
cggcuaccgccuugu

SEQ ID NO: 1211724 - RNA, 21 nt, Mycobacterium bovis subsp bovis AF2122/97
cggcuaacgaagccagaucag

SEQ ID NO: 1211725 - RNA, 22 nt, Mycobacterium bovis subsp bovis AF2122/97
cggcuccggacaccccgcacgg

SEQ ID NO: 1211726 - RNA, 16 nt, Mycobacterium bovis subsp bovis AF2122/97
cggcuccgcccggcgu

SEQ ID NO: 1211727 - RNA, 13 nt, Mycobacterium bovis subsp bovis AF2122/97
cggcuccgaugca

SEQ ID NO: 1211728 - RNA, 13 nt, Mycobacterium bovis subsp bovis AF2122/97
cggcuccgcaacc

SEQ ID NO: 1211729 - RNA, 13 nt, Mycobacterium bovis subsp bovis AF2122/97
cggcuccgcagcg

SEQ ID NO: 1211730 - RNA, 15 nt, Mycobacterium bovis subsp bovis AF2122/97
cggcucgccaccucg

SEQ ID NO: 1211731 - RNA, 17 nt, Mycobacterium bovis subsp bovis AF2122/97
cggcucgccgacccgcc

SEQ ID NO: 1211732 - RNA, 19 nt, Mycobacterium bovis subsp bovis AF2122/97
cggcucgccgacccgccgc

SEQ ID NO: 1211733 - RNA, 16 nt, Mycobacterium bovis subsp bovis AF2122/97
cggcuccggcggcagc

SEQ ID NO: 1211734 - RNA, 14 nt, Mycobacterium bovis subsp bovis AF2122/97
cggcuccuccccgg

SEQ ID NO: 1211735 - RNA, 21 nt, Mycobacterium bovis subsp bovis AF2122/97
cggcuccaccgggcccgccgg

SEQ ID NO: 1211736 - RNA, 15 nt, Mycobacterium bovis subsp bovis AF2122/97
cggcuccaccgggcc

SEQ ID NO: 1211737 - RNA, 20 nt, Mycobacterium bovis subsp bovis AF2122/97
cggcucagaccaaggcgaag

SEQ ID NO: 1211738 - RNA, 22 nt, Mycobacterium bovis subsp bovis AF2122/97
cggcucaacaccgaguuccucu

SEQ ID NO: 1211739 - RNA, 15 nt, Mycobacterium bovis subsp bovis AF2122/97
cggcucaaucuccuc

SEQ ID NO: 1211740 - RNA, 16 nt, Mycobacterium bovis subsp bovis AF2122/97
cggcuaggccggccgg

SEQ ID NO: 1211741 - RNA, 15 nt, Mycobacterium bovis subsp bovis AF2122/97
cggcucacagcacag

SEQ ID NO: 1211742 - RNA, 21 nt, Mycobacterium bovis subsp bovis AF2122/97
cggcucacagcacagcgcagc

SEQ ID NO: 1211743 - RNA, 18 nt, Mycobacterium bovis subsp bovis AF2122/97
cggcucacgaccggccaa

SEQ ID NO: 1211744 - RNA, 21 nt, Mycobacterium bovis subsp bovis AF2122/97
cggcucacguaaccagugacc

SEQ ID NO: 1211745 - RNA, 16 nt, Mycobacterium bovis subsp bovis AF2122/97
cgggccgccagggccc

SEQ ID NO: 1211746 - RNA, 15 nt, Mycobacterium bovis subsp bovis AF2122/97
cgggccgaucacccc

SEQ ID NO: 1211747 - RNA, 21 nt, Mycobacterium bovis subsp bovis AF2122/97
cgggcccccagguagugcaca

SEQ ID NO: 1211748 - RNA, 12 nt, Mycobacterium bovis subsp bovis AF2122/97
cgggcccgaugu

SEQ ID NO: 1211749 - RNA, 18 nt, Mycobacterium bovis subsp bovis AF2122/97
cgggcccgccggccccgc

SEQ ID NO: 1211750 - RNA, 20 nt, Mycobacterium bovis subsp bovis AF2122/97
cgggcccguagccgagcuug

SEQ ID NO: 1211751 - RNA, 21 nt, Mycobacterium bovis subsp bovis AF2122/97
cgggcccgcugggcuuggggc

SEQ ID NO: 1211752 - RNA, 17 nt, Mycobacterium bovis subsp bovis AF2122/97
cgggccgaagccccgau

SEQ ID NO: 1211753 - RNA, 23 nt, Mycobacterium bovis subsp bovis AF2122/97
cgggccgaacacaccgggcgggc

SEQ ID NO: 1211754 - RNA, 17 nt, Mycobacterium bovis subsp bovis AF2122/97
cgggccgaagcgcgcgc

SEQ ID NO: 1211755 - RNA, 18 nt, Mycobacterium bovis subsp bovis AF2122/97
cgggcccuccggcgcagc

SEQ ID NO: 1211756 - RNA, 20 nt, Mycobacterium bovis subsp bovis AF2122/97
cgggccauggguagccgccc

SEQ ID NO: 1211757 - RNA, 18 nt, Mycobacterium bovis subsp bovis AF2122/97
cgggcccacguuggcccc

SEQ ID NO: 1211758 - RNA, 13 nt, Mycobacterium bovis subsp bovis AF2122/97
cgggcccagccgg

SEQ ID NO: 1211759 - RNA, 19 nt, Mycobacterium bovis subsp bovis AF2122/97
cgggcccacguuggccccg

SEQ ID NO: 1211760 - RNA, 20 nt, Mycobacterium bovis subsp bovis AF2122/97
cgggcccacguuggccccgc

SEQ ID NO: 1211761 - RNA, 19 nt, Mycobacterium bovis subsp bovis AF2122/97
cgggccccggggugccccc

SEQ ID NO: 1211762 - RNA, 15 nt, Mycobacterium bovis subsp bovis AF2122/97
cgggccagcacccgc

SEQ ID NO: 1211763 - RNA, 21 nt, Mycobacterium bovis subsp bovis AF2122/97
cgggccagaucgaagcgcagc

SEQ ID NO: 1211764 - RNA, 20 nt, Mycobacterium bovis subsp bovis AF2122/97
cgggccgaucucuccggcgg

SEQ ID NO: 1211765 - RNA, 19 nt, Mycobacterium bovis subsp bovis AF2122/97
cgggccgcgcgcagagcgu

SEQ ID NO: 1211766 - RNA, 19 nt, Mycobacterium bovis subsp bovis AF2122/97
cgggccggcgacuguccca

SEQ ID NO: 1211767 - RNA, 15 nt, Mycobacterium bovis subsp bovis AF2122/97
cgggccggccgccgc

SEQ ID NO: 1211768 - RNA, 16 nt, Mycobacterium bovis subsp bovis AF2122/97
cgggccggccgccgcg

SEQ ID NO: 1211769 - RNA, 23 nt, Mycobacterium bovis subsp bovis AF2122/97
cgggccgguggaaaagccacggc

SEQ ID NO: 1211770 - RNA, 14 nt, Mycobacterium bovis subsp bovis AF2122/97
cgggccguacggcg

SEQ ID NO: 1211771 - RNA, 18 nt, Mycobacterium bovis subsp bovis AF2122/97
cgggccugcaccacggcg

SEQ ID NO: 1211772 - RNA, 18 nt, Mycobacterium bovis subsp bovis AF2122/97
cgggccuugcgcgcgcag

SEQ ID NO: 1211773 - RNA, 16 nt, Mycobacterium bovis subsp bovis AF2122/97
cgggccuucagcucac

SEQ ID NO: 1211774 - RNA, 15 nt, Mycobacterium bovis subsp bovis AF2122/97
cgggccuggccugcc

SEQ ID NO: 1211775 - RNA, 22 nt, Mycobacterium bovis subsp bovis AF2122/97
cgggccuggccugcccagcacc

SEQ ID NO: 1211776 - RNA, 15 nt, Mycobacterium bovis subsp bovis AF2122/97
cgggccuucgccacu

SEQ ID NO: 1211777 - RNA, 17 nt, Mycobacterium bovis subsp bovis AF2122/97
cgggccguguccgccgg

SEQ ID NO: 1211778 - RNA, 18 nt, Mycobacterium bovis subsp bovis AF2122/97
cgggccucggcgccgucg

SEQ ID NO: 1211779 - RNA, 21 nt, Mycobacterium bovis subsp bovis AF2122/97
cgggccucaugcuaggccacc

SEQ ID NO: 1211780 - RNA, 14 nt, Mycobacterium bovis subsp bovis AF2122/97
cgggccuccugcug

SEQ ID NO: 1211781 - RNA, 21 nt, Mycobacterium bovis subsp bovis AF2122/97
cgggcggcauccugcacgacc

SEQ ID NO: 1211782 - RNA, 21 nt, Mycobacterium bovis subsp bovis AF2122/97
cgggcggccauggcacugccg

SEQ ID NO: 1211783 - RNA, 22 nt, Mycobacterium bovis subsp bovis AF2122/97
cgggcgcugaugcgcugggcca

SEQ ID NO: 1211784 - RNA, 20 nt, Mycobacterium bovis subsp bovis AF2122/97
cgggcgcuguagucgcgccu

SEQ ID NO: 1211785 - RNA, 22 nt, Mycobacterium bovis subsp bovis AF2122/97
cgggcguuguuaucgaagcccg

SEQ ID NO: 1211786 - RNA, 14 nt, Mycobacterium bovis subsp bovis AF2122/97
cgggcgugguaacc

SEQ ID NO: 1211787 - RNA, 13 nt, Mycobacterium bovis subsp bovis AF2122/97
cgggcgugucggg

SEQ ID NO: 1211788 - RNA, 16 nt, Mycobacterium bovis subsp bovis AF2122/97
cgggcggucgagaugu

SEQ ID NO: 1211789 - RNA, 22 nt, Mycobacterium bovis subsp bovis AF2122/97
cgggcgggcguccacgcugacc

SEQ ID NO: 1211790 - RNA, 18 nt, Mycobacterium bovis subsp bovis AF2122/97
cgggcggugggcagcagc

SEQ ID NO: 1211791 - RNA, 19 nt, Mycobacterium bovis subsp bovis AF2122/97
cgggcguccacgcugacca

SEQ ID NO: 1211792 - RNA, 21 nt, Mycobacterium bovis subsp bovis AF2122/97
cgggcguccacgcugaccaac

SEQ ID NO: 1211793 - RNA, 20 nt, Mycobacterium bovis subsp bovis AF2122/97
cgggcgucacggugcguucg

SEQ ID NO: 1211794 - RNA, 19 nt, Mycobacterium bovis subsp bovis AF2122/97
cgggcguacauucgggcgu

SEQ ID NO: 1211795 - RNA, 13 nt, Mycobacterium bovis subsp bovis AF2122/97
cgggcgccgcagc

SEQ ID NO: 1211796 - RNA, 16 nt, Mycobacterium bovis subsp bovis AF2122/97
cgggcgccccaccggc

SEQ ID NO: 1211797 - RNA, 19 nt, Mycobacterium bovis subsp bovis AF2122/97
cgggcgccccaccggcccg

SEQ ID NO: 1211798 - RNA, 22 nt, Mycobacterium bovis subsp bovis AF2122/97
cgggcgccggaacgagcggccg

SEQ ID NO: 1211799 - RNA, 22 nt, Mycobacterium bovis subsp bovis AF2122/97
cgggcgcgaggacgcugaucca

SEQ ID NO: 1211800 - RNA, 15 nt, Mycobacterium bovis subsp bovis AF2122/97
cgggcgcgccggcca

SEQ ID NO: 1211801 - RNA, 15 nt, Mycobacterium bovis subsp bovis AF2122/97
cgggcgcgucggcgu

SEQ ID NO: 1211802 - RNA, 12 nt, Mycobacterium bovis subsp bovis AF2122/97
cgggcgagaucu

SEQ ID NO: 1211803 - RNA, 20 nt, Mycobacterium bovis subsp bovis AF2122/97
cgggcgagaacccacgcaug

SEQ ID NO: 1211804 - RNA, 20 nt, Mycobacterium bovis subsp bovis AF2122/97
cgggcgaguacaggcgcagc

SEQ ID NO: 1211805 - RNA, 20 nt, Mycobacterium bovis subsp bovis AF2122/97
cgggcgaccuccggaaucgc

SEQ ID NO: 1211806 - RNA, 15 nt, Mycobacterium bovis subsp bovis AF2122/97
cgggcgaccaacacg

SEQ ID NO: 1211807 - RNA, 14 nt, Mycobacterium bovis subsp bovis AF2122/97
cgggcgaccaccac

SEQ ID NO: 1211808 - RNA, 18 nt, Mycobacterium bovis subsp bovis AF2122/97
cgggcgaccaccaccgcc

SEQ ID NO: 1211809 - RNA, 21 nt, Mycobacterium bovis subsp bovis AF2122/97
cgggcgcaccaagacgccacc

SEQ ID NO: 1211810 - RNA, 14 nt, Mycobacterium bovis subsp bovis AF2122/97
cgggcgaugcuggg

SEQ ID NO: 1211811 - RNA, 18 nt, Mycobacterium bovis subsp bovis AF2122/97
cgggcgaucgccugggcu

SEQ ID NO: 1211812 - RNA, 22 nt, Mycobacterium bovis subsp bovis AF2122/97
cgggcgaucucgauguacagcg

SEQ ID NO: 1211813 - RNA, 21 nt, Mycobacterium bovis subsp bovis AF2122/97
cgggcgaguacaggcgcagcg

SEQ ID NO: 1211814 - RNA, 21 nt, Mycobacterium bovis subsp bovis AF2122/97
cgggcgaucaaagccagcacc

SEQ ID NO: 1211815 - RNA, 15 nt, Mycobacterium bovis subsp bovis AF2122/97
cgggaucgacccgcc

SEQ ID NO: 1211816 - RNA, 13 nt, Mycobacterium bovis subsp bovis AF2122/97
cgggaucgccaug

SEQ ID NO: 1211817 - RNA, 14 nt, Mycobacterium bovis subsp bovis AF2122/97
cgggaucgccaugu

SEQ ID NO: 1211818 - RNA, 21 nt, Mycobacterium bovis subsp bovis AF2122/97
cgggaucgucaggcccauggc

SEQ ID NO: 1211819 - RNA, 19 nt, Mycobacterium bovis subsp bovis AF2122/97
cgggaucugcuccgcagca

SEQ ID NO: 1211820 - RNA, 14 nt, Mycobacterium bovis subsp bovis AF2122/97
cgggauggccgccg

SEQ ID NO: 1211821 - RNA, 13 nt, Mycobacterium bovis subsp bovis AF2122/97
cgggauggacagc

SEQ ID NO: 1211822 - RNA, 14 nt, Mycobacterium bovis subsp bovis AF2122/97
cgggauggacacca

SEQ ID NO: 1211823 - RNA, 20 nt, Mycobacterium bovis subsp bovis AF2122/97
cgggaugcucgauccacugc

SEQ ID NO: 1211824 - RNA, 17 nt, Mycobacterium bovis subsp bovis AF2122/97
cgggagucgucgagcug

SEQ ID NO: 1211825 - RNA, 13 nt, Mycobacterium bovis subsp bovis AF2122/97
cgggaggccaccg

SEQ ID NO: 1211826 - RNA, 14 nt, Mycobacterium bovis subsp bovis AF2122/97
cgggagcugaucac

SEQ ID NO: 1211827 - RNA, 15 nt, Mycobacterium bovis subsp bovis AF2122/97
cgggaggacaccagc

SEQ ID NO: 1211828 - RNA, 22 nt, Mycobacterium bovis subsp bovis AF2122/97
cgggaggacaccagcuggaaga

SEQ ID NO: 1211829 - RNA, 18 nt, Mycobacterium bovis subsp bovis AF2122/97
cgggauaacccagcacca

SEQ ID NO: 1211830 - RNA, 17 nt, Mycobacterium bovis subsp bovis AF2122/97
cgggauaacccagcacc

SEQ ID NO: 1211831 - RNA, 14 nt, Mycobacterium bovis subsp bovis AF2122/97
cgggauccaggccc

SEQ ID NO: 1211832 - RNA, 19 nt, Mycobacterium bovis subsp bovis AF2122/97
cgggauccacccagugcca

SEQ ID NO: 1211833 - RNA, 16 nt, Mycobacterium bovis subsp bovis AF2122/97
cgggauagccguucgg

SEQ ID NO: 1211834 - RNA, 19 nt, Mycobacterium bovis subsp bovis AF2122/97
cgggaccggggacgcgccc

SEQ ID NO: 1211835 - RNA, 15 nt, Mycobacterium bovis subsp bovis AF2122/97
cgggacagcgccggg

SEQ ID NO: 1211836 - RNA, 19 nt, Mycobacterium bovis subsp bovis AF2122/97
cgggacgaaucccgcgccc

SEQ ID NO: 1211837 - RNA, 21 nt, Mycobacterium bovis subsp bovis AF2122/97
cgggacgccccgucuggcaug

SEQ ID NO: 1211838 - RNA, 15 nt, Mycobacterium bovis subsp bovis AF2122/97
cgggacugcagcgcg

SEQ ID NO: 1211839 - RNA, 16 nt, Mycobacterium bovis subsp bovis AF2122/97
cgggacuggcugaucg

SEQ ID NO: 1211840 - RNA, 21 nt, Mycobacterium bovis subsp bovis AF2122/97
cgggacuuccggggagcagag

SEQ ID NO: 1211841 - RNA, 20 nt, Mycobacterium bovis subsp bovis AF2122/97
cgggacguuguccaccgcca

SEQ ID NO: 1211842 - RNA, 15 nt, Mycobacterium bovis subsp bovis AF2122/97
cgggacuucccgcga

SEQ ID NO: 1211843 - RNA, 22 nt, Mycobacterium bovis subsp bovis AF2122/97
cgggagcaccgaccagggccgc

SEQ ID NO: 1211844 - RNA, 18 nt, Mycobacterium bovis subsp bovis AF2122/97
cgggagcggaauggcgcc

SEQ ID NO: 1211845 - RNA, 16 nt, Mycobacterium bovis subsp bovis AF2122/97
cgggagcccgagcuca

SEQ ID NO: 1211846 - RNA, 14 nt, Mycobacterium bovis subsp bovis AF2122/97
cgggagcggcugcg

SEQ ID NO: 1211847 - RNA, 15 nt, Mycobacterium bovis subsp bovis AF2122/97
cgggacaaccgggcg

SEQ ID NO: 1211848 - RNA, 13 nt, Mycobacterium bovis subsp bovis AF2122/97
cgggacaccaccg

SEQ ID NO: 1211849 - RNA, 22 nt, Mycobacterium bovis subsp bovis AF2122/97
cgggaccgaucuuggccaccgc

SEQ ID NO: 1211850 - RNA, 13 nt, Mycobacterium bovis subsp bovis AF2122/97
cgggaauccggug

SEQ ID NO: 1211851 - RNA, 15 nt, Mycobacterium bovis subsp bovis AF2122/97
cgggaauggacaggu

SEQ ID NO: 1211852 - RNA, 15 nt, Mycobacterium bovis subsp bovis AF2122/97
cgggaauggcgacca

SEQ ID NO: 1211853 - RNA, 14 nt, Mycobacterium bovis subsp bovis AF2122/97
cgggaaugaccuug

SEQ ID NO: 1211854 - RNA, 21 nt, Mycobacterium bovis subsp bovis AF2122/97
cgggaauuucgucggccaugg

SEQ ID NO: 1211855 - RNA, 19 nt, Mycobacterium bovis subsp bovis AF2122/97
cgggacaaaaucagcagcc

SEQ ID NO: 1211856 - RNA, 24 nt, Mycobacterium bovis subsp bovis AF2122/97
cgggacaaagccgaacgacagcag

SEQ ID NO: 1211857 - RNA, 16 nt, Mycobacterium bovis subsp bovis AF2122/97
cgggaagucgggccgg

SEQ ID NO: 1211858 - RNA, 13 nt, Mycobacterium bovis subsp bovis AF2122/97
cgggaaggugacg

SEQ ID NO: 1211859 - RNA, 21 nt, Mycobacterium bovis subsp bovis AF2122/97
cgggaaucgcucgcgccaggu

SEQ ID NO: 1211860 - RNA, 21 nt, Mycobacterium bovis subsp bovis AF2122/97
cgggcaguggcagcccgucgg

SEQ ID NO: 1211861 - RNA, 23 nt, Mycobacterium bovis subsp bovis AF2122/97
cgggcaguucaacgaggccgacg

SEQ ID NO: 1211862 - RNA, 15 nt, Mycobacterium bovis subsp bovis AF2122/97
cgggcaguugaccca

SEQ ID NO: 1211863 - RNA, 20 nt, Mycobacterium bovis subsp bovis AF2122/97
cgggcaguuuguucgcgaag

SEQ ID NO: 1211864 - RNA, 21 nt, Mycobacterium bovis subsp bovis AF2122/97
cgggcaguuuguucgcgaagc

SEQ ID NO: 1211865 - RNA, 15 nt, Mycobacterium bovis subsp bovis AF2122/97
cgggcaugauccccg

SEQ ID NO: 1211866 - RNA, 19 nt, Mycobacterium bovis subsp bovis AF2122/97
cgggcaugcucuggcaaug

SEQ ID NO: 1211867 - RNA, 16 nt, Mycobacterium bovis subsp bovis AF2122/97
cgggcauggucgccgg

SEQ ID NO: 1211868 - RNA, 14 nt, Mycobacterium bovis subsp bovis AF2122/97
cgggcaugccggcg

SEQ ID NO: 1211869 - RNA, 19 nt, Mycobacterium bovis subsp bovis AF2122/97
cgggcauggucgccggaga

SEQ ID NO: 1211870 - RNA, 20 nt, Mycobacterium bovis subsp bovis AF2122/97
cgggccacgucgagcacccg

SEQ ID NO: 1211871 - RNA, 17 nt, Mycobacterium bovis subsp bovis AF2122/97
cgggcacugugagguca

SEQ ID NO: 1211872 - RNA, 22 nt, Mycobacterium bovis subsp bovis AF2122/97
cgggcagaggcuggcgcagauc

SEQ ID NO: 1211873 - RNA, 21 nt, Mycobacterium bovis subsp bovis AF2122/97
cgggcagauaugacggcagac

SEQ ID NO: 1211874 - RNA, 13 nt, Mycobacterium bovis subsp bovis AF2122/97
cgggcagccccuc

SEQ ID NO: 1211875 - RNA, 16 nt, Mycobacterium bovis subsp bovis AF2122/97
cgggcagccccuccgc

SEQ ID NO: 1211876 - RNA, 17 nt, Mycobacterium bovis subsp bovis AF2122/97
cgggcagcacgccagcc

SEQ ID NO: 1211877 - RNA, 11 nt, Mycobacterium bovis subsp bovis AF2122/97
cgggcagcacu

SEQ ID NO: 1211878 - RNA, 16 nt, Mycobacterium bovis subsp bovis AF2122/97
cgggcagauucuucac

SEQ ID NO: 1211879 - RNA, 11 nt, Mycobacterium bovis subsp bovis AF2122/97
cgggcagcgcg

SEQ ID NO: 1211880 - RNA, 17 nt, Mycobacterium bovis subsp bovis AF2122/97
cgggcagccugcugcau

SEQ ID NO: 1211881 - RNA, 20 nt, Mycobacterium bovis subsp bovis AF2122/97
cgggcaggagcagcacgucg

SEQ ID NO: 1211882 - RNA, 14 nt, Mycobacterium bovis subsp bovis AF2122/97
cgggcaguccaggc

SEQ ID NO: 1211883 - RNA, 14 nt, Mycobacterium bovis subsp bovis AF2122/97
cgggcaggccgucg

SEQ ID NO: 1211884 - RNA, 19 nt, Mycobacterium bovis subsp bovis AF2122/97
cgggcaaaucaagcacagc

SEQ ID NO: 1211885 - RNA, 15 nt, Mycobacterium bovis subsp bovis AF2122/97
cgggcaacggcagcc

SEQ ID NO: 1211886 - RNA, 17 nt, Mycobacterium bovis subsp bovis AF2122/97
cgggcaacucggugacg

SEQ ID NO: 1211887 - RNA, 15 nt, Mycobacterium bovis subsp bovis AF2122/97
cgggcaacugcagca

SEQ ID NO: 1211888 - RNA, 14 nt, Mycobacterium bovis subsp bovis AF2122/97
cgggaugccgccgc

SEQ ID NO: 1211889 - RNA, 19 nt, Mycobacterium bovis subsp bovis AF2122/97
cgggauguaccccggcccg

SEQ ID NO: 1211890 - RNA, 17 nt, Mycobacterium bovis subsp bovis AF2122/97
cgggaugugcggcugca

SEQ ID NO: 1211891 - RNA, 22 nt, Mycobacterium bovis subsp bovis AF2122/97
cgggcaagucgcccagccgagc

SEQ ID NO: 1211892 - RNA, 20 nt, Mycobacterium bovis subsp bovis AF2122/97
cgggcaaucaccgccggcgg

SEQ ID NO: 1211893 - RNA, 15 nt, Mycobacterium bovis subsp bovis AF2122/97
cgggcaaucgcucug

SEQ ID NO: 1211894 - RNA, 16 nt, Mycobacterium bovis subsp bovis AF2122/97
cgggcaaggcccgguc

SEQ ID NO: 1211895 - RNA, 16 nt, Mycobacterium bovis subsp bovis AF2122/97
cgggcaagucgcccag

SEQ ID NO: 1211896 - RNA, 17 nt, Mycobacterium bovis subsp bovis AF2122/97
cgggcaagucgcccagc

SEQ ID NO: 1211897 - RNA, 14 nt, Mycobacterium bovis subsp bovis AF2122/97
cgggcacgcggcga

SEQ ID NO: 1211898 - RNA, 23 nt, Mycobacterium bovis subsp bovis AF2122/97
cgggcacguuuacauagaccacc

SEQ ID NO: 1211899 - RNA, 15 nt, Mycobacterium bovis subsp bovis AF2122/97
cgggcacucagcagg

SEQ ID NO: 1211900 - RNA, 14 nt, Mycobacterium bovis subsp bovis AF2122/97
cgggcaccuggucg

SEQ ID NO: 1211901 - RNA, 14 nt, Mycobacterium bovis subsp bovis AF2122/97
cgggcacgccgccg

SEQ ID NO: 1211902 - RNA, 16 nt, Mycobacterium bovis subsp bovis AF2122/97
cggucggcggaaacaa

SEQ ID NO: 1211903 - RNA, 23 nt, Mycobacterium bovis subsp bovis AF2122/97
cggucggccauugcccgggcggg

SEQ ID NO: 1211904 - RNA, 18 nt, Mycobacterium bovis subsp bovis AF2122/97
cggucggggauccgaccu

SEQ ID NO: 1211905 - RNA, 17 nt, Mycobacterium bovis subsp bovis AF2122/97
cggucgguguagcaacg

SEQ ID NO: 1211906 - RNA, 16 nt, Mycobacterium bovis subsp bovis AF2122/97
cggucgugaucagcag

SEQ ID NO: 1211907 - RNA, 18 nt, Mycobacterium bovis subsp bovis AF2122/97
cggucggcgacguagacg

SEQ ID NO: 1211908 - RNA, 16 nt, Mycobacterium bovis subsp bovis AF2122/97
cggucguuggucgggg

SEQ ID NO: 1211909 - RNA, 16 nt, Mycobacterium bovis subsp bovis AF2122/97
cggucuugccgcaggc

SEQ ID NO: 1211910 - RNA, 17 nt, Mycobacterium bovis subsp bovis AF2122/97
cggucuugccgcaggcc

SEQ ID NO: 1211911 - RNA, 19 nt, Mycobacterium bovis subsp bovis AF2122/97
cggucuugccgcaggccug

SEQ ID NO: 1211912 - RNA, 15 nt, Mycobacterium bovis subsp bovis AF2122/97
cggucuuuggcauug

SEQ ID NO: 1211913 - RNA, 23 nt, Mycobacterium bovis subsp bovis AF2122/97
cggucucggaaacggaccuccuc

SEQ ID NO: 1211914 - RNA, 22 nt, Mycobacterium bovis subsp bovis AF2122/97
cggucucgucgcggguccaggc

SEQ ID NO: 1211915 - RNA, 18 nt, Mycobacterium bovis subsp bovis AF2122/97
cggucucaugcacccggu

SEQ ID NO: 1211916 - RNA, 22 nt, Mycobacterium bovis subsp bovis AF2122/97
cggucuccaccaccgacgagga

SEQ ID NO: 1211917 - RNA, 15 nt, Mycobacterium bovis subsp bovis AF2122/97
cggucucgaccgcgc

SEQ ID NO: 1211918 - RNA, 17 nt, Mycobacterium bovis subsp bovis AF2122/97
cggucucgaccgcgccu

SEQ ID NO: 1211919 - RNA, 23 nt, Mycobacterium bovis subsp bovis AF2122/97
cggucugcgccuucgccagcggc

SEQ ID NO: 1211920 - RNA, 21 nt, Mycobacterium bovis subsp bovis AF2122/97
cggucuggacaucggccggcg

SEQ ID NO: 1211921 - RNA, 19 nt, Mycobacterium bovis subsp bovis AF2122/97
cggugacguuggcaggcag

SEQ ID NO: 1211922 - RNA, 19 nt, Mycobacterium bovis subsp bovis AF2122/97
cggugagcaacuggcauuu

SEQ ID NO: 1211923 - RNA, 16 nt, Mycobacterium bovis subsp bovis AF2122/97
cggugagaagaagccc

SEQ ID NO: 1211924 - RNA, 17 nt, Mycobacterium bovis subsp bovis AF2122/97
cggugagaagaagccca

SEQ ID NO: 1211925 - RNA, 14 nt, Mycobacterium bovis subsp bovis AF2122/97
cggugagccgggcg

SEQ ID NO: 1211926 - RNA, 16 nt, Mycobacterium bovis subsp bovis AF2122/97
cggugaggucgaugcc

SEQ ID NO: 1211927 - RNA, 15 nt, Mycobacterium bovis subsp bovis AF2122/97
cggugaggaagcggc

SEQ ID NO: 1211928 - RNA, 21 nt, Mycobacterium bovis subsp bovis AF2122/97
cggugacgagccaccaccgcc

SEQ ID NO: 1211929 - RNA, 17 nt, Mycobacterium bovis subsp bovis AF2122/97
cggugacgaucaggccg

SEQ ID NO: 1211930 - RNA, 19 nt, Mycobacterium bovis subsp bovis AF2122/97
cggugacgaaacagagcgu

SEQ ID NO: 1211931 - RNA, 17 nt, Mycobacterium bovis subsp bovis AF2122/97
cggugacgcacagcagc

SEQ ID NO: 1211932 - RNA, 19 nt, Mycobacterium bovis subsp bovis AF2122/97
cggugacucggccuccgcc

SEQ ID NO: 1211933 - RNA, 17 nt, Mycobacterium bovis subsp bovis AF2122/97
cggugacggggcugacc

SEQ ID NO: 1211934 - RNA, 20 nt, Mycobacterium bovis subsp bovis AF2122/97
cggugacaagcggcccgcug

SEQ ID NO: 1211935 - RNA, 18 nt, Mycobacterium bovis subsp bovis AF2122/97
cggugacaccaacaccgg

SEQ ID NO: 1211936 - RNA, 15 nt, Mycobacterium bovis subsp bovis AF2122/97
cggugacccccgaga

SEQ ID NO: 1211937 - RNA, 17 nt, Mycobacterium bovis subsp bovis AF2122/97
cggugaacgguagcacu

SEQ ID NO: 1211938 - RNA, 17 nt, Mycobacterium bovis subsp bovis AF2122/97
cggugaaucgaagcccg

SEQ ID NO: 1211939 - RNA, 17 nt, Mycobacterium bovis subsp bovis AF2122/97
cggugaaucgucugacg

SEQ ID NO: 1211940 - RNA, 14 nt, Mycobacterium bovis subsp bovis AF2122/97
cggugaauucacga

SEQ ID NO: 1211941 - RNA, 21 nt, Mycobacterium bovis subsp bovis AF2122/97
cggugaacuucuccaccagcg

SEQ ID NO: 1211942 - RNA, 15 nt, Mycobacterium bovis subsp bovis AF2122/97
cggugaacgccgccc

SEQ ID NO: 1211943 - RNA, 17 nt, Mycobacterium bovis subsp bovis AF2122/97
cggugaacgccgccccg

SEQ ID NO: 1211944 - RNA, 16 nt, Mycobacterium bovis subsp bovis AF2122/97
cggugaacggcaaggu

SEQ ID NO: 1211945 - RNA, 18 nt, Mycobacterium bovis subsp bovis AF2122/97
cggugaaauucgcggcgg

SEQ ID NO: 1211946 - RNA, 13 nt, Mycobacterium bovis subsp bovis AF2122/97
cggucgacuccag

SEQ ID NO: 1211947 - RNA, 23 nt, Mycobacterium bovis subsp bovis AF2122/97
cggucgacccacucaucagagcg

SEQ ID NO: 1211948 - RNA, 22 nt, Mycobacterium bovis subsp bovis AF2122/97
cggucgacuccagcaccagcac

SEQ ID NO: 1211949 - RNA, 20 nt, Mycobacterium bovis subsp bovis AF2122/97
cggucgagccagcggagcag

SEQ ID NO: 1211950 - RNA, 19 nt, Mycobacterium bovis subsp bovis AF2122/97
cggucgacuccagcaccag

SEQ ID NO: 1211951 - RNA, 20 nt, Mycobacterium bovis subsp bovis AF2122/97
cggucgacuccagcaccagc

SEQ ID NO: 1211952 - RNA, 19 nt, Mycobacterium bovis subsp bovis AF2122/97
cggucgauguccgcagcac

SEQ ID NO: 1211953 - RNA, 21 nt, Mycobacterium bovis subsp bovis AF2122/97
cggucgauguccgcagcaccg

SEQ ID NO: 1211954 - RNA, 22 nt, Mycobacterium bovis subsp bovis AF2122/97
cggucgaugcucagugccaaag

SEQ ID NO: 1211955 - RNA, 16 nt, Mycobacterium bovis subsp bovis AF2122/97
cgguccggcccaccag

SEQ ID NO: 1211956 - RNA, 17 nt, Mycobacterium bovis subsp bovis AF2122/97
cgguccggcccaccagc

SEQ ID NO: 1211957 - RNA, 16 nt, Mycobacterium bovis subsp bovis AF2122/97
cgguccugccaaugcu

SEQ ID NO: 1211958 - RNA, 15 nt, Mycobacterium bovis subsp bovis AF2122/97
cgguccggcccgggg

SEQ ID NO: 1211959 - RNA, 22 nt, Mycobacterium bovis subsp bovis AF2122/97
cggucgccucgcuaacucccca

SEQ ID NO: 1211960 - RNA, 20 nt, Mycobacterium bovis subsp bovis AF2122/97
cggucggaccacccggcgcg

SEQ ID NO: 1211961 - RNA, 17 nt, Mycobacterium bovis subsp bovis AF2122/97
cggucggcagaccgacc

SEQ ID NO: 1211962 - RNA, 13 nt, Mycobacterium bovis subsp bovis AF2122/97
cggucgccgcgcg

SEQ ID NO: 1211963 - RNA, 22 nt, Mycobacterium bovis subsp bovis AF2122/97
cggucgccucaccggcgcgagc

SEQ ID NO: 1211964 - RNA, 15 nt, Mycobacterium bovis subsp bovis AF2122/97
cggucgccaccgccg

SEQ ID NO: 1211965 - RNA, 20 nt, Mycobacterium bovis subsp bovis AF2122/97
cggucgccaccgccggcagc

SEQ ID NO: 1211966 - RNA, 20 nt, Mycobacterium bovis subsp bovis AF2122/97
cggucgcacuuggcccccga

SEQ ID NO: 1211967 - RNA, 15 nt, Mycobacterium bovis subsp bovis AF2122/97
cggucgcagcagacc

SEQ ID NO: 1211968 - RNA, 13 nt, Mycobacterium bovis subsp bovis AF2122/97
cgguccagggccu

SEQ ID NO: 1211969 - RNA, 19 nt, Mycobacterium bovis subsp bovis AF2122/97
cgguccauucguccgcggu

SEQ ID NO: 1211970 - RNA, 16 nt, Mycobacterium bovis subsp bovis AF2122/97
cgguccaucccgagcu

SEQ ID NO: 1211971 - RNA, 16 nt, Mycobacterium bovis subsp bovis AF2122/97
cgguccagcggccgcc

SEQ ID NO: 1211972 - RNA, 18 nt, Mycobacterium bovis subsp bovis AF2122/97
cgguccgaugcgcgcggc

SEQ ID NO: 1211973 - RNA, 15 nt, Mycobacterium bovis subsp bovis AF2122/97
cgguccgccacggcg

SEQ ID NO: 1211974 - RNA, 22 nt, Mycobacterium bovis subsp bovis AF2122/97
cggucccagguuggagcccgag

SEQ ID NO: 1211975 - RNA, 14 nt, Mycobacterium bovis subsp bovis AF2122/97
cgguccaccggccc

SEQ ID NO: 1211976 - RNA, 23 nt, Mycobacterium bovis subsp bovis AF2122/97
cggucagugggacgggcgcgucc

SEQ ID NO: 1211977 - RNA, 22 nt, Mycobacterium bovis subsp bovis AF2122/97
cggucauagucgaauggcaaca

SEQ ID NO: 1211978 - RNA, 17 nt, Mycobacterium bovis subsp bovis AF2122/97
cggucauccggccgucg

SEQ ID NO: 1211979 - RNA, 15 nt, Mycobacterium bovis subsp bovis AF2122/97
cggucauccgggcga

SEQ ID NO: 1211980 - RNA, 20 nt, Mycobacterium bovis subsp bovis AF2122/97
cggucaggccgccgcggcga

SEQ ID NO: 1211981 - RNA, 17 nt, Mycobacterium bovis subsp bovis AF2122/97
cggucaguauggcgacg

SEQ ID NO: 1211982 - RNA, 17 nt, Mycobacterium bovis subsp bovis AF2122/97
cggucagcucgcugacg

SEQ ID NO: 1211983 - RNA, 22 nt, Mycobacterium bovis subsp bovis AF2122/97
cggucagcucggcagcaucucc

SEQ ID NO: 1211984 - RNA, 17 nt, Mycobacterium bovis subsp bovis AF2122/97
cgguaacuguccgcccg

SEQ ID NO: 1211985 - RNA, 19 nt, Mycobacterium bovis subsp bovis AF2122/97
cgguaacggcgguaagggc

SEQ ID NO: 1211986 - RNA, 19 nt, Mycobacterium bovis subsp bovis AF2122/97
cgguaaccgcgucgaccgg

SEQ ID NO: 1211987 - RNA, 15 nt, Mycobacterium bovis subsp bovis AF2122/97
cgguaaccacgcgga

SEQ ID NO: 1211988 - RNA, 17 nt, Mycobacterium bovis subsp bovis AF2122/97
cgguaauacaggugcag

SEQ ID NO: 1211989 - RNA, 21 nt, Mycobacterium bovis subsp bovis AF2122/97
cgguaccaucaccgcgccagc

SEQ ID NO: 1211990 - RNA, 20 nt, Mycobacterium bovis subsp bovis AF2122/97
cgguacccaccucccgcagc

SEQ ID NO: 1211991 - RNA, 16 nt, Mycobacterium bovis subsp bovis AF2122/97
cgguacccguagcacc

SEQ ID NO: 1211992 - RNA, 21 nt, Mycobacterium bovis subsp bovis AF2122/97
cgguacccaccucccgcagcc

SEQ ID NO: 1211993 - RNA, 15 nt, Mycobacterium bovis subsp bovis AF2122/97
cgguaccgccggcuc

SEQ ID NO: 1211994 - RNA, 13 nt, Mycobacterium bovis subsp bovis AF2122/97
cgguaccgggauc

SEQ ID NO: 1211995 - RNA, 13 nt, Mycobacterium bovis subsp bovis AF2122/97
cgguacgccgccg

SEQ ID NO: 1211996 - RNA, 20 nt, Mycobacterium bovis subsp bovis AF2122/97
cgguagaucuucggccgcac

SEQ ID NO: 1211997 - RNA, 18 nt, Mycobacterium bovis subsp bovis AF2122/97
cgguagcacagcagcaac

SEQ ID NO: 1211998 - RNA, 18 nt, Mycobacterium bovis subsp bovis AF2122/97
cgguagacaagucggcgc

SEQ ID NO: 1211999 - RNA, 17 nt, Mycobacterium bovis subsp bovis AF2122/97
cgguagcucgucgagga

SEQ ID NO: 1212000 - RNA, 23 nt, Mycobacterium bovis subsp bovis AF2122/97
cgguagccaggcgcgcuaccagc

SEQ ID NO: 1212001 - RNA, 16 nt, Mycobacterium bovis subsp bovis AF2122/97
cgguagccgaccagcg

SEQ ID NO: 1212002 - RNA, 14 nt, Mycobacterium bovis subsp bovis AF2122/97
cgguagcauccagc

SEQ ID NO: 1212003 - RNA, 23 nt, Mycobacterium bovis subsp bovis AF2122/97
cgguagucgaugcugacgguggg

SEQ ID NO: 1212004 - RNA, 13 nt, Mycobacterium bovis subsp bovis AF2122/97
cgguaggcgagac

SEQ ID NO: 1212005 - RNA, 21 nt, Mycobacterium bovis subsp bovis AF2122/97
cgguaugcgcguccccagcgc

SEQ ID NO: 1212006 - RNA, 17 nt, Mycobacterium bovis subsp bovis AF2122/97
cgguaucggcagauggu

SEQ ID NO: 1212007 - RNA, 15 nt, Mycobacterium bovis subsp bovis AF2122/97
cgguaucccucaagg

SEQ ID NO: 1212008 - RNA, 17 nt, Mycobacterium bovis subsp bovis AF2122/97
cgguauacccggccccg

SEQ ID NO: 1212009 - RNA, 14 nt, Mycobacterium bovis subsp bovis AF2122/97
cggucacccgugcu

SEQ ID NO: 1212010 - RNA, 12 nt, Mycobacterium bovis subsp bovis AF2122/97
cggucaccaccg

SEQ ID NO: 1212011 - RNA, 15 nt, Mycobacterium bovis subsp bovis AF2122/97
cggucacacgccagc

SEQ ID NO: 1212012 - RNA, 16 nt, Mycobacterium bovis subsp bovis AF2122/97
cggucacacgccagcc

SEQ ID NO: 1212013 - RNA, 19 nt, Mycobacterium bovis subsp bovis AF2122/97
cggucacacgccagccggu

SEQ ID NO: 1212014 - RNA, 24 nt, Mycobacterium bovis subsp bovis AF2122/97
cggucaagccggcgcccgccgcga

SEQ ID NO: 1212015 - RNA, 18 nt, Mycobacterium bovis subsp bovis AF2122/97
cggucaaggugcgccgcc

SEQ ID NO: 1212016 - RNA, 20 nt, Mycobacterium bovis subsp bovis AF2122/97
cggucaaggugcgccgccau

SEQ ID NO: 1212017 - RNA, 21 nt, Mycobacterium bovis subsp bovis AF2122/97
cggucaaucccggccaggggc

SEQ ID NO: 1212018 - RNA, 23 nt, Mycobacterium bovis subsp bovis AF2122/97
cggucaaugccacuaggaaggug

SEQ ID NO: 1212019 - RNA, 15 nt, Mycobacterium bovis subsp bovis AF2122/97
cggucaaacgcgcgc

SEQ ID NO: 1212020 - RNA, 17 nt, Mycobacterium bovis subsp bovis AF2122/97
cggucaaacgcgcgcgc

SEQ ID NO: 1212021 - RNA, 19 nt, Mycobacterium bovis subsp bovis AF2122/97
cggucaaacgcgcgcgcca

SEQ ID NO: 1212022 - RNA, 20 nt, Mycobacterium bovis subsp bovis AF2122/97
cggucaacacccgcccgggc

SEQ ID NO: 1212023 - RNA, 15 nt, Mycobacterium bovis subsp bovis AF2122/97
cggucaccgcggcau

SEQ ID NO: 1212024 - RNA, 15 nt, Mycobacterium bovis subsp bovis AF2122/97
cggucaccgcgcagc

SEQ ID NO: 1212025 - RNA, 18 nt, Mycobacterium bovis subsp bovis AF2122/97
cggucaccgacgcagaac

SEQ ID NO: 1212026 - RNA, 13 nt, Mycobacterium bovis subsp bovis AF2122/97
cggucacgcugug

SEQ ID NO: 1212027 - RNA, 17 nt, Mycobacterium bovis subsp bovis AF2122/97
cggucagcggccaaccc

SEQ ID NO: 1212028 - RNA, 14 nt, Mycobacterium bovis subsp bovis AF2122/97
cggucagccgcggg

SEQ ID NO: 1212029 - RNA, 22 nt, Mycobacterium bovis subsp bovis AF2122/97
cggucagcgcggcgcacaaccc

SEQ ID NO: 1212030 - RNA, 22 nt, Mycobacterium bovis subsp bovis AF2122/97
cggucagcacgcugaccacaac

SEQ ID NO: 1212031 - RNA, 19 nt, Mycobacterium bovis subsp bovis AF2122/97
cggucagccagcccagggu

SEQ ID NO: 1212032 - RNA, 12 nt, Mycobacterium bovis subsp bovis AF2122/97
cggucagccagg

SEQ ID NO: 1212033 - RNA, 13 nt, Mycobacterium bovis subsp bovis AF2122/97
aaacuaccgaaca

SEQ ID NO: 1212034 - RNA, 18 nt, Mycobacterium bovis subsp bovis AF2122/97
cggguccuauccgggccc

SEQ ID NO: 1212035 - RNA, 16 nt, Mycobacterium bovis subsp bovis AF2122/97
cggguccucgcggagc

SEQ ID NO: 1212036 - RNA, 14 nt, Mycobacterium bovis subsp bovis AF2122/97
cggguccagcccgg

SEQ ID NO: 1212037 - RNA, 14 nt, Mycobacterium bovis subsp bovis AF2122/97
cggguccgccgggc

SEQ ID NO: 1212038 - RNA, 15 nt, Mycobacterium bovis subsp bovis AF2122/97
cggguccgccgggcc

SEQ ID NO: 1212039 - RNA, 21 nt, Mycobacterium bovis subsp bovis AF2122/97
cgggucccuuguggucugcca

SEQ ID NO: 1212040 - RNA, 15 nt, Mycobacterium bovis subsp bovis AF2122/97
cgggucagcaccacc

SEQ ID NO: 1212041 - RNA, 18 nt, Mycobacterium bovis subsp bovis AF2122/97
cgggucagcaccaccagc

SEQ ID NO: 1212042 - RNA, 20 nt, Mycobacterium bovis subsp bovis AF2122/97
cgggucagcaccaccagcag

SEQ ID NO: 1212043 - RNA, 17 nt, Mycobacterium bovis subsp bovis AF2122/97
cgggucacuccggcggc

SEQ ID NO: 1212044 - RNA, 21 nt, Mycobacterium bovis subsp bovis AF2122/97
cgggucacuccggcggcuucg

SEQ ID NO: 1212045 - RNA, 18 nt, Mycobacterium bovis subsp bovis AF2122/97
cgggucagcucgaccuga

SEQ ID NO: 1212046 - RNA, 15 nt, Mycobacterium bovis subsp bovis AF2122/97
cggguacgccgggca

SEQ ID NO: 1212047 - RNA, 19 nt, Mycobacterium bovis subsp bovis AF2122/97
cggguagaaccagcccggc

SEQ ID NO: 1212048 - RNA, 19 nt, Mycobacterium bovis subsp bovis AF2122/97
cggguacacccgcucgccc

SEQ ID NO: 1212049 - RNA, 19 nt, Mycobacterium bovis subsp bovis AF2122/97
cggguagaccaccugcaug

SEQ ID NO: 1212050 - RNA, 18 nt, Mycobacterium bovis subsp bovis AF2122/97
cggguagcggcgccgccc

SEQ ID NO: 1212051 - RNA, 22 nt, Mycobacterium bovis subsp bovis AF2122/97
cggguagauguucacgccgccg

SEQ ID NO: 1212052 - RNA, 21 nt, Mycobacterium bovis subsp bovis AF2122/97
cgggucaccgauucggccagc

SEQ ID NO: 1212053 - RNA, 18 nt, Mycobacterium bovis subsp bovis AF2122/97
cggguagugcacggacag

SEQ ID NO: 1212054 - RNA, 22 nt, Mycobacterium bovis subsp bovis AF2122/97
cggguaugggagucccaccauc

SEQ ID NO: 1212055 - RNA, 23 nt, Mycobacterium bovis subsp bovis AF2122/97
cgggugcagcacggcgccgccac

SEQ ID NO: 1212056 - RNA, 18 nt, Mycobacterium bovis subsp bovis AF2122/97
cgggugaucuuggcgccc

SEQ ID NO: 1212057 - RNA, 22 nt, Mycobacterium bovis subsp bovis AF2122/97
cgggugaugacgccgucggcgc

SEQ ID NO: 1212058 - RNA, 15 nt, Mycobacterium bovis subsp bovis AF2122/97
cgggugaugcaguga

SEQ ID NO: 1212059 - RNA, 13 nt, Mycobacterium bovis subsp bovis AF2122/97
cgggugcagcgca

SEQ ID NO: 1212060 - RNA, 20 nt, Mycobacterium bovis subsp bovis AF2122/97
cgggugccaucggugguggc

SEQ ID NO: 1212061 - RNA, 15 nt, Mycobacterium bovis subsp bovis AF2122/97
cgggugccgagcugg

SEQ ID NO: 1212062 - RNA, 16 nt, Mycobacterium bovis subsp bovis AF2122/97
cgggugaucuccaccg

SEQ ID NO: 1212063 - RNA, 21 nt, Mycobacterium bovis subsp bovis AF2122/97
cgggugaguaacacgugggug

SEQ ID NO: 1212064 - RNA, 16 nt, Mycobacterium bovis subsp bovis AF2122/97
cgggucgucauacagc

SEQ ID NO: 1212065 - RNA, 22 nt, Mycobacterium bovis subsp bovis AF2122/97
cgggucgguuuccuccggcagc

SEQ ID NO: 1212066 - RNA, 23 nt, Mycobacterium bovis subsp bovis AF2122/97
cgggucguccgccugcaccgccg

SEQ ID NO: 1212067 - RNA, 21 nt, Mycobacterium bovis subsp bovis AF2122/97
cgggucgucauacagcgcccu

SEQ ID NO: 1212068 - RNA, 22 nt, Mycobacterium bovis subsp bovis AF2122/97
cgggucguacaacacgggcagc

SEQ ID NO: 1212069 - RNA, 16 nt, Mycobacterium bovis subsp bovis AF2122/97
cgggucgugccagcag

SEQ ID NO: 1212070 - RNA, 22 nt, Mycobacterium bovis subsp bovis AF2122/97
cgggucuacagcguugccaggu

SEQ ID NO: 1212071 - RNA, 20 nt, Mycobacterium bovis subsp bovis AF2122/97
cgggucgcugccggcugacg

SEQ ID NO: 1212072 - RNA, 16 nt, Mycobacterium bovis subsp bovis AF2122/97
cgggucggcacgaccc

SEQ ID NO: 1212073 - RNA, 15 nt, Mycobacterium bovis subsp bovis AF2122/97
cgggucgaugacgcc

SEQ ID NO: 1212074 - RNA, 22 nt, Mycobacterium bovis subsp bovis AF2122/97
cgggucgcgggguaggcccagc

SEQ ID NO: 1212075 - RNA, 22 nt, Mycobacterium bovis subsp bovis AF2122/97
cgggucggcacgacccgggaag

SEQ ID NO: 1212076 - RNA, 17 nt, Mycobacterium bovis subsp bovis AF2122/97
cgggucggcgaccgcgc

SEQ ID NO: 1212077 - RNA, 20 nt, Mycobacterium bovis subsp bovis AF2122/97
cgggucgggcaccgcgcgcu

SEQ ID NO: 1212078 - RNA, 20 nt, Mycobacterium bovis subsp bovis AF2122/97
cgggucggcggugccgugug

SEQ ID NO: 1212079 - RNA, 19 nt, Mycobacterium bovis subsp bovis AF2122/97
cgggugggagcagccgaac

SEQ ID NO: 1212080 - RNA, 15 nt, Mycobacterium bovis subsp bovis AF2122/97
cggguggugagcuga

SEQ ID NO: 1212081 - RNA, 19 nt, Mycobacterium bovis subsp bovis AF2122/97
cggguggccacgcccaggc

SEQ ID NO: 1212082 - RNA, 19 nt, Mycobacterium bovis subsp bovis AF2122/97
cggguggaguuggcugccg

SEQ ID NO: 1212083 - RNA, 14 nt, Mycobacterium bovis subsp bovis AF2122/97
cgggugcgucgaug

SEQ ID NO: 1212084 - RNA, 17 nt, Mycobacterium bovis subsp bovis AF2122/97
cgggugcgugcgcgucg

SEQ ID NO: 1212085 - RNA, 18 nt, Mycobacterium bovis subsp bovis AF2122/97
cgggugcuacuggguggg

SEQ ID NO: 1212086 - RNA, 19 nt, Mycobacterium bovis subsp bovis AF2122/97
cgggugcuacugggugggu

SEQ ID NO: 1212087 - RNA, 22 nt, Mycobacterium bovis subsp bovis AF2122/97
cgggugcugaugggucaggccg

SEQ ID NO: 1212088 - RNA, 17 nt, Mycobacterium bovis subsp bovis AF2122/97
cgggugcuggucaacag

SEQ ID NO: 1212089 - RNA, 15 nt, Mycobacterium bovis subsp bovis AF2122/97
cgggugcgcccggcc

SEQ ID NO: 1212090 - RNA, 20 nt, Mycobacterium bovis subsp bovis AF2122/97
cggguucacuuccgggcagc

SEQ ID NO: 1212091 - RNA, 22 nt, Mycobacterium bovis subsp bovis AF2122/97
cggguucaacgcgcgcacgcca

SEQ ID NO: 1212092 - RNA, 16 nt, Mycobacterium bovis subsp bovis AF2122/97
cggguuaucggcagca

SEQ ID NO: 1212093 - RNA, 23 nt, Mycobacterium bovis subsp bovis AF2122/97
cggguuacccgcagcgugcccag

SEQ ID NO: 1212094 - RNA, 20 nt, Mycobacterium bovis subsp bovis AF2122/97
cggguuccgaucucaagggc

SEQ ID NO: 1212095 - RNA, 16 nt, Mycobacterium bovis subsp bovis AF2122/97
cgggugucgggcagca

SEQ ID NO: 1212096 - RNA, 18 nt, Mycobacterium bovis subsp bovis AF2122/97
cggguggugcggccgugg

SEQ ID NO: 1212097 - RNA, 18 nt, Mycobacterium bovis subsp bovis AF2122/97
cgggugucgggcagcaac

SEQ ID NO: 1212098 - RNA, 13 nt, Mycobacterium bovis subsp bovis AF2122/97
cgggugucgggcg

SEQ ID NO: 1212099 - RNA, 15 nt, Mycobacterium bovis subsp bovis AF2122/97
cgggugucgggcgcg

SEQ ID NO: 1212100 - RNA, 17 nt, Mycobacterium bovis subsp bovis AF2122/97
cggguguuccacaccag

SEQ ID NO: 1212101 - RNA, 21 nt, Mycobacterium bovis subsp bovis AF2122/97
cggguguuccacaccaggccg

SEQ ID NO: 1212102 - RNA, 17 nt, Mycobacterium bovis subsp bovis AF2122/97
cggguuggaagccgcac

SEQ ID NO: 1212103 - RNA, 18 nt, Mycobacterium bovis subsp bovis AF2122/97
cggguuggaagccgcacc

SEQ ID NO: 1212104 - RNA, 21 nt, Mycobacterium bovis subsp bovis AF2122/97
cggguugggcaucaggccgcg

SEQ ID NO: 1212105 - RNA, 14 nt, Mycobacterium bovis subsp bovis AF2122/97
cggguuggccaccu

SEQ ID NO: 1212106 - RNA, 15 nt, Mycobacterium bovis subsp bovis AF2122/97
cggguuggcgacgau

SEQ ID NO: 1212107 - RNA, 18 nt, Mycobacterium bovis subsp bovis AF2122/97
cggguuugaucuccaccu

SEQ ID NO: 1212108 - RNA, 23 nt, Mycobacterium bovis subsp bovis AF2122/97
cggggugugcgggcggugcacac

SEQ ID NO: 1212109 - RNA, 15 nt, Mycobacterium bovis subsp bovis AF2122/97
cgggguugacuggcc

SEQ ID NO: 1212110 - RNA, 19 nt, Mycobacterium bovis subsp bovis AF2122/97
cgggguugacuggccgccc

SEQ ID NO: 1212111 - RNA, 14 nt, Mycobacterium bovis subsp bovis AF2122/97
cgggguugggcgga

SEQ ID NO: 1212112 - RNA, 22 nt, Mycobacterium bovis subsp bovis AF2122/97
cgggguuguccucggcgaucac

SEQ ID NO: 1212113 - RNA, 18 nt, Mycobacterium bovis subsp bovis AF2122/97
cggguaaugcgacgccgg

SEQ ID NO: 1212114 - RNA, 14 nt, Mycobacterium bovis subsp bovis AF2122/97
cggguaaccggcuc

SEQ ID NO: 1212115 - RNA, 17 nt, Mycobacterium bovis subsp bovis AF2122/97
cggguaaccggcuccgg

SEQ ID NO: 1212116 - RNA, 16 nt, Mycobacterium bovis subsp bovis AF2122/97
cggggugcgcgcgacc

SEQ ID NO: 1212117 - RNA, 12 nt, Mycobacterium bovis subsp bovis AF2122/97
cgggguggugga

SEQ ID NO: 1212118 - RNA, 15 nt, Mycobacterium bovis subsp bovis AF2122/97
cgggguggcggcgcu

SEQ ID NO: 1212119 - RNA, 23 nt, Mycobacterium bovis subsp bovis AF2122/97
cggggucgaacaugauccgccgg

SEQ ID NO: 1212120 - RNA, 14 nt, Mycobacterium bovis subsp bovis AF2122/97
cggggugagccgac

SEQ ID NO: 1212121 - RNA, 22 nt, Mycobacterium bovis subsp bovis AF2122/97
cggggugaaugcaacuccucga

SEQ ID NO: 1212122 - RNA, 15 nt, Mycobacterium bovis subsp bovis AF2122/97
cggggugcacaccgu

SEQ ID NO: 1212123 - RNA, 18 nt, Mycobacterium bovis subsp bovis AF2122/97
cggggucagauccaggac

SEQ ID NO: 1212124 - RNA, 16 nt, Mycobacterium bovis subsp bovis AF2122/97
cggggucguugaggcc

SEQ ID NO: 1212125 - RNA, 23 nt, Mycobacterium bovis subsp bovis AF2122/97
cggggcucaagucucccggccgc

SEQ ID NO: 1212126 - RNA, 22 nt, Mycobacterium bovis subsp bovis AF2122/97
cggggcucucgaguccaggcag

SEQ ID NO: 1212127 - RNA, 11 nt, Mycobacterium bovis subsp bovis AF2122/97
cggggcugccc

SEQ ID NO: 1212128 - RNA, 17 nt, Mycobacterium bovis subsp bovis AF2122/97
cggggcugccgaacagc

SEQ ID NO: 1212129 - RNA, 19 nt, Mycobacterium bovis subsp bovis AF2122/97
cgggggagcgaacggcgca

SEQ ID NO: 1212130 - RNA, 12 nt, Mycobacterium bovis subsp bovis AF2122/97
cgggggaagcgc

SEQ ID NO: 1212131 - RNA, 15 nt, Mycobacterium bovis subsp bovis AF2122/97
cggggcgcucgcgcg

SEQ ID NO: 1212132 - RNA, 19 nt, Mycobacterium bovis subsp bovis AF2122/97
cggggcgauccccagcacc

SEQ ID NO: 1212133 - RNA, 20 nt, Mycobacterium bovis subsp bovis AF2122/97
cggggguuccacuccccagc

SEQ ID NO: 1212134 - RNA, 17 nt, Mycobacterium bovis subsp bovis AF2122/97
cggggguugcggcagcu

SEQ ID NO: 1212135 - RNA, 12 nt, Mycobacterium bovis subsp bovis AF2122/97
cgggggucgggc

SEQ ID NO: 1212136 - RNA, 18 nt, Mycobacterium bovis subsp bovis AF2122/97
cgggggaucucgagccgc

SEQ ID NO: 1212137 - RNA, 17 nt, Mycobacterium bovis subsp bovis AF2122/97
cgggggcgccggcgccc

SEQ ID NO: 1212138 - RNA, 21 nt, Mycobacterium bovis subsp bovis AF2122/97
cgggggcuuauguguccgcuc

SEQ ID NO: 1212139 - RNA, 20 nt, Mycobacterium bovis subsp bovis AF2122/97
cggggggauccagcaggccg

SEQ ID NO: 1212140 - RNA, 20 nt, Mycobacterium bovis subsp bovis AF2122/97
cgggggcuguccaccgaggc

SEQ ID NO: 1212141 - RNA, 22 nt, Mycobacterium bovis subsp bovis AF2122/97
cgggggcggccggcggccaugg

SEQ ID NO: 1212142 - RNA, 20 nt, Mycobacterium bovis subsp bovis AF2122/97
cggggauggagccggugacg

SEQ ID NO: 1212143 - RNA, 18 nt, Mycobacterium bovis subsp bovis AF2122/97
cggggaguucgcgcagca

SEQ ID NO: 1212144 - RNA, 20 nt, Mycobacterium bovis subsp bovis AF2122/97
cggggauaccggucagcacc

SEQ ID NO: 1212145 - RNA, 16 nt, Mycobacterium bovis subsp bovis AF2122/97
cggggcacaaggguca

SEQ ID NO: 1212146 - RNA, 17 nt, Mycobacterium bovis subsp bovis AF2122/97
cggggcaaaggagccgu

SEQ ID NO: 1212147 - RNA, 23 nt, Mycobacterium bovis subsp bovis AF2122/97
cggggauucgucgugcgggcggg

SEQ ID NO: 1212148 - RNA, 17 nt, Mycobacterium bovis subsp bovis AF2122/97
cggggauuggcgacguc

SEQ ID NO: 1212149 - RNA, 18 nt, Mycobacterium bovis subsp bovis AF2122/97
cggggacggcggcaaggg

SEQ ID NO: 1212150 - RNA, 19 nt, Mycobacterium bovis subsp bovis AF2122/97
cggggagcugcggcggcca

SEQ ID NO: 1212151 - RNA, 19 nt, Mycobacterium bovis subsp bovis AF2122/97
cggggccgucggcaauacu

SEQ ID NO: 1212152 - RNA, 20 nt, Mycobacterium bovis subsp bovis AF2122/97
cggggccgccgcggccggcg

SEQ ID NO: 1212153 - RNA, 15 nt, Mycobacterium bovis subsp bovis AF2122/97
cggggccggaugacg

SEQ ID NO: 1212154 - RNA, 13 nt, Mycobacterium bovis subsp bovis AF2122/97
cggggccacccgc

SEQ ID NO: 1212155 - RNA, 15 nt, Mycobacterium bovis subsp bovis AF2122/97
cggggccacccgcag

SEQ ID NO: 1212156 - RNA, 22 nt, Mycobacterium bovis subsp bovis AF2122/97
cggggcacuggggucugauggc

SEQ ID NO: 1212157 - RNA, 18 nt, Mycobacterium bovis subsp bovis AF2122/97
cgggcucguguccgccgu

SEQ ID NO: 1212158 - RNA, 15 nt, Mycobacterium bovis subsp bovis AF2122/97
cgggcugcggcagua

SEQ ID NO: 1212159 - RNA, 19 nt, Mycobacterium bovis subsp bovis AF2122/97
cgggcugcuugcgcccggc

SEQ ID NO: 1212160 - RNA, 15 nt, Mycobacterium bovis subsp bovis AF2122/97
cgggcucaacaccag

SEQ ID NO: 1212161 - RNA, 19 nt, Mycobacterium bovis subsp bovis AF2122/97
cgggcucggcgaaacccgg

SEQ ID NO: 1212162 - RNA, 16 nt, Mycobacterium bovis subsp bovis AF2122/97
cgggcucgcugcacca

SEQ ID NO: 1212163 - RNA, 15 nt, Mycobacterium bovis subsp bovis AF2122/97
cgggcucgcuucagg

SEQ ID NO: 1212164 - RNA, 17 nt, Mycobacterium bovis subsp bovis AF2122/97
cgggcucgcauguucuc

SEQ ID NO: 1212165 - RNA, 21 nt, Mycobacterium bovis subsp bovis AF2122/97
cgggcucagacuuucgcccag

SEQ ID NO: 1212166 - RNA, 16 nt, Mycobacterium bovis subsp bovis AF2122/97
cgggcuucagcacgcg

SEQ ID NO: 1212167 - RNA, 18 nt, Mycobacterium bovis subsp bovis AF2122/97
cgggcuguucggccaugg

SEQ ID NO: 1212168 - RNA, 16 nt, Mycobacterium bovis subsp bovis AF2122/97
cgggcuuaggccgcgg

SEQ ID NO: 1212169 - RNA, 15 nt, Mycobacterium bovis subsp bovis AF2122/97
cgggcuucaacacac

SEQ ID NO: 1212170 - RNA, 11 nt, Mycobacterium bovis subsp bovis AF2122/97
cggggaacacc

SEQ ID NO: 1212171 - RNA, 16 nt, Mycobacterium bovis subsp bovis AF2122/97
cggggaagccugcggg

SEQ ID NO: 1212172 - RNA, 19 nt, Mycobacterium bovis subsp bovis AF2122/97
cggggaagccugcgggccg

SEQ ID NO: 1212173 - RNA, 20 nt, Mycobacterium bovis subsp bovis AF2122/97
cggggaacguccgcgccgag

SEQ ID NO: 1212174 - RNA, 19 nt, Mycobacterium bovis subsp bovis AF2122/97
cgggcuugagcgccgaugu

SEQ ID NO: 1212175 - RNA, 15 nt, Mycobacterium bovis subsp bovis AF2122/97
cgggcuugccguugg

SEQ ID NO: 1212176 - RNA, 15 nt, Mycobacterium bovis subsp bovis AF2122/97
cgggcuugcgcagca

SEQ ID NO: 1212177 - RNA, 16 nt, Mycobacterium bovis subsp bovis AF2122/97
cgucgagcgcgccacu

SEQ ID NO: 1212178 - RNA, 14 nt, Mycobacterium bovis subsp bovis AF2122/97
cgucgagcgcgucg

SEQ ID NO: 1212179 - RNA, 19 nt, Mycobacterium bovis subsp bovis AF2122/97
cgucgagcgcgucggucac

SEQ ID NO: 1212180 - RNA, 14 nt, Mycobacterium bovis subsp bovis AF2122/97
cgucgagcgcuccc

SEQ ID NO: 1212181 - RNA, 22 nt, Mycobacterium bovis subsp bovis AF2122/97
cgucgagcgccuugucgaucuc

SEQ ID NO: 1212182 - RNA, 12 nt, Mycobacterium bovis subsp bovis AF2122/97
cgucgagcgcgc

SEQ ID NO: 1212183 - RNA, 14 nt, Mycobacterium bovis subsp bovis AF2122/97
cgucgagcaccucc

SEQ ID NO: 1212184 - RNA, 13 nt, Mycobacterium bovis subsp bovis AF2122/97
cgucgagcagccg

SEQ ID NO: 1212185 - RNA, 14 nt, Mycobacterium bovis subsp bovis AF2122/97
cgucgagcagcgcc

SEQ ID NO: 1212186 - RNA, 16 nt, Mycobacterium bovis subsp bovis AF2122/97
cgucgagcauccaccc

SEQ ID NO: 1212187 - RNA, 16 nt, Mycobacterium bovis subsp bovis AF2122/97
cgucgacggucuggcc

SEQ ID NO: 1212188 - RNA, 22 nt, Mycobacterium bovis subsp bovis AF2122/97
cgucgaccuguugucguggcgg

SEQ ID NO: 1212189 - RNA, 21 nt, Mycobacterium bovis subsp bovis AF2122/97
cgucgacggccuggggcagcc

SEQ ID NO: 1212190 - RNA, 14 nt, Mycobacterium bovis subsp bovis AF2122/97
cgucgacgagcgcc

SEQ ID NO: 1212191 - RNA, 18 nt, Mycobacterium bovis subsp bovis AF2122/97
cgucgagaaauggcccga

SEQ ID NO: 1212192 - RNA, 17 nt, Mycobacterium bovis subsp bovis AF2122/97
cgucgacggcugcgccg

SEQ ID NO: 1212193 - RNA, 19 nt, Mycobacterium bovis subsp bovis AF2122/97
cgucgacuugcaggcgucc

SEQ ID NO: 1212194 - RNA, 16 nt, Mycobacterium bovis subsp bovis AF2122/97
cgucgacgucggcccc

SEQ ID NO: 1212195 - RNA, 15 nt, Mycobacterium bovis subsp bovis AF2122/97
cgucgacgucggcga

SEQ ID NO: 1212196 - RNA, 17 nt, Mycobacterium bovis subsp bovis AF2122/97
cgucgacgucguagacc

SEQ ID NO: 1212197 - RNA, 13 nt, Mycobacterium bovis subsp bovis AF2122/97
cgucgacucggcg

SEQ ID NO: 1212198 - RNA, 13 nt, Mycobacterium bovis subsp bovis AF2122/97
cgucgaggcggca

SEQ ID NO: 1212199 - RNA, 21 nt, Mycobacterium bovis subsp bovis AF2122/97
cgucgaggcugaccguggcgc

SEQ ID NO: 1212200 - RNA, 20 nt, Mycobacterium bovis subsp bovis AF2122/97
cgucgaggaagaucaccucc

SEQ ID NO: 1212201 - RNA, 21 nt, Mycobacterium bovis subsp bovis AF2122/97
cgucgaggaagaucaccuccc

SEQ ID NO: 1212202 - RNA, 17 nt, Mycobacterium bovis subsp bovis AF2122/97
cgucgagggagcgccgc

SEQ ID NO: 1212203 - RNA, 18 nt, Mycobacterium bovis subsp bovis AF2122/97
cgucgagggagcgccgca

SEQ ID NO: 1212204 - RNA, 16 nt, Mycobacterium bovis subsp bovis AF2122/97
cgucgagguccaccac

SEQ ID NO: 1212205 - RNA, 18 nt, Mycobacterium bovis subsp bovis AF2122/97
cgucgagguccaccaccc

SEQ ID NO: 1212206 - RNA, 18 nt, Mycobacterium bovis subsp bovis AF2122/97
cgucgaucagcggcagca

SEQ ID NO: 1212207 - RNA, 17 nt, Mycobacterium bovis subsp bovis AF2122/97
cgucgaguuccggccgg

SEQ ID NO: 1212208 - RNA, 18 nt, Mycobacterium bovis subsp bovis AF2122/97
cgucgauccgucggcgga

SEQ ID NO: 1212209 - RNA, 23 nt, Mycobacterium bovis subsp bovis AF2122/97
cgucgagucgccgaggacgccgg

SEQ ID NO: 1212210 - RNA, 19 nt, Mycobacterium bovis subsp bovis AF2122/97
cgucgagugccgccaccgc

SEQ ID NO: 1212211 - RNA, 15 nt, Mycobacterium bovis subsp bovis AF2122/97
cgucgaugcgcugcu

SEQ ID NO: 1212212 - RNA, 21 nt, Mycobacterium bovis subsp bovis AF2122/97
cgucgaugccggcugccgcac

SEQ ID NO: 1212213 - RNA, 16 nt, Mycobacterium bovis subsp bovis AF2122/97
cgucgaucucggcgca

SEQ ID NO: 1212214 - RNA, 15 nt, Mycobacterium bovis subsp bovis AF2122/97
cguccuucgcuggua

SEQ ID NO: 1212215 - RNA, 14 nt, Mycobacterium bovis subsp bovis AF2122/97
cguccuuuccagga

SEQ ID NO: 1212216 - RNA, 20 nt, Mycobacterium bovis subsp bovis AF2122/97
cgucgaaaagccgugcacca

SEQ ID NO: 1212217 - RNA, 17 nt, Mycobacterium bovis subsp bovis AF2122/97
cgucgaacgguagcacg

SEQ ID NO: 1212218 - RNA, 20 nt, Mycobacterium bovis subsp bovis AF2122/97
cgucgaacacgucgggaugc

SEQ ID NO: 1212219 - RNA, 20 nt, Mycobacterium bovis subsp bovis AF2122/97
cguccugcccgucgucggca

SEQ ID NO: 1212220 - RNA, 14 nt, Mycobacterium bovis subsp bovis AF2122/97
cgucgacacaccca

SEQ ID NO: 1212221 - RNA, 21 nt, Mycobacterium bovis subsp bovis AF2122/97
cgucgacaguucaacgggccu

SEQ ID NO: 1212222 - RNA, 16 nt, Mycobacterium bovis subsp bovis AF2122/97
cgucgacacacccacc

SEQ ID NO: 1212223 - RNA, 11 nt, Mycobacterium bovis subsp bovis AF2122/97
cgucgaccagg

SEQ ID NO: 1212224 - RNA, 21 nt, Mycobacterium bovis subsp bovis AF2122/97
cgucgacccccugccacagcg

SEQ ID NO: 1212225 - RNA, 21 nt, Mycobacterium bovis subsp bovis AF2122/97
cgucgaccgugucaccgccgg

SEQ ID NO: 1212226 - RNA, 17 nt, Mycobacterium bovis subsp bovis AF2122/97
cgucgaacugggcgccc

SEQ ID NO: 1212227 - RNA, 22 nt, Mycobacterium bovis subsp bovis AF2122/97
cgucgaagaccgccuccaccgc

SEQ ID NO: 1212228 - RNA, 22 nt, Mycobacterium bovis subsp bovis AF2122/97
cgucgaagaccucaacccccuu

SEQ ID NO: 1212229 - RNA, 21 nt, Mycobacterium bovis subsp bovis AF2122/97
cgucgaaguagccgacgucgc

SEQ ID NO: 1212230 - RNA, 15 nt, Mycobacterium bovis subsp bovis AF2122/97
cgucgaauccugccg

SEQ ID NO: 1212231 - RNA, 16 nt, Mycobacterium bovis subsp bovis AF2122/97
cgucgacaacacgccg

SEQ ID NO: 1212232 - RNA, 18 nt, Mycobacterium bovis subsp bovis AF2122/97
cgucgacaacgaucgcgc

SEQ ID NO: 1212233 - RNA, 22 nt, Mycobacterium bovis subsp bovis AF2122/97
cgucgaacuuugucgcgcugcu

SEQ ID NO: 1212234 - RNA, 21 nt, Mycobacterium bovis subsp bovis AF2122/97
cgucgaaguuggcgaagcccg

SEQ ID NO: 1212235 - RNA, 18 nt, Mycobacterium bovis subsp bovis AF2122/97
cguccagcgcggccuugg

SEQ ID NO: 1212236 - RNA, 17 nt, Mycobacterium bovis subsp bovis AF2122/97
cguccagccguggcggc

SEQ ID NO: 1212237 - RNA, 16 nt, Mycobacterium bovis subsp bovis AF2122/97
cguccagcgccgcggc

SEQ ID NO: 1212238 - RNA, 13 nt, Mycobacterium bovis subsp bovis AF2122/97
cguccagggcgcc

SEQ ID NO: 1212239 - RNA, 18 nt, Mycobacterium bovis subsp bovis AF2122/97
cguccaggcgcugcagca

SEQ ID NO: 1212240 - RNA, 18 nt, Mycobacterium bovis subsp bovis AF2122/97
cguccaguggcagccagc

SEQ ID NO: 1212241 - RNA, 22 nt, Mycobacterium bovis subsp bovis AF2122/97
cguccaguggcagccagcggcg

SEQ ID NO: 1212242 - RNA, 22 nt, Mycobacterium bovis subsp bovis AF2122/97
cguccaucgcgucgucuucuuc

SEQ ID NO: 1212243 - RNA, 16 nt, Mycobacterium bovis subsp bovis AF2122/97
cguccaucgccaccgc

SEQ ID NO: 1212244 - RNA, 18 nt, Mycobacterium bovis subsp bovis AF2122/97
cguccaucaccagcagug

SEQ ID NO: 1212245 - RNA, 23 nt, Mycobacterium bovis subsp bovis AF2122/97
cguccggucgccucaccggcgcg

SEQ ID NO: 1212246 - RNA, 20 nt, Mycobacterium bovis subsp bovis AF2122/97
cguccgggcggccucccggg

SEQ ID NO: 1212247 - RNA, 16 nt, Mycobacterium bovis subsp bovis AF2122/97
cguccgggaucucccc

SEQ ID NO: 1212248 - RNA, 13 nt, Mycobacterium bovis subsp bovis AF2122/97
cguccggcuuggc

SEQ ID NO: 1212249 - RNA, 18 nt, Mycobacterium bovis subsp bovis AF2122/97
cguccggaucggucggca

SEQ ID NO: 1212250 - RNA, 14 nt, Mycobacterium bovis subsp bovis AF2122/97
cgucccagagaauc

SEQ ID NO: 1212251 - RNA, 19 nt, Mycobacterium bovis subsp bovis AF2122/97
cgucccagagaaucagcgu

SEQ ID NO: 1212252 - RNA, 21 nt, Mycobacterium bovis subsp bovis AF2122/97
cgucccaggacuccggccgca

SEQ ID NO: 1212253 - RNA, 21 nt, Mycobacterium bovis subsp bovis AF2122/97
cgucccacagguuugcgccgc

SEQ ID NO: 1212254 - RNA, 12 nt, Mycobacterium bovis subsp bovis AF2122/97
cgucccagaagu

SEQ ID NO: 1212255 - RNA, 13 nt, Mycobacterium bovis subsp bovis AF2122/97
cgucccagaaguc

SEQ ID NO: 1212256 - RNA, 21 nt, Mycobacterium bovis subsp bovis AF2122/97
cguccgcgggggaccgcccga

SEQ ID NO: 1212257 - RNA, 18 nt, Mycobacterium bovis subsp bovis AF2122/97
cguccgcggucgcagcag

SEQ ID NO: 1212258 - RNA, 18 nt, Mycobacterium bovis subsp bovis AF2122/97
cguccccgccgacgccga

SEQ ID NO: 1212259 - RNA, 23 nt, Mycobacterium bovis subsp bovis AF2122/97
cguccccgccgucgccaccaucg

SEQ ID NO: 1212260 - RNA, 14 nt, Mycobacterium bovis subsp bovis AF2122/97
cgucagcgcgccgu

SEQ ID NO: 1212261 - RNA, 18 nt, Mycobacterium bovis subsp bovis AF2122/97
cgucagcgccgcgcgcgc

SEQ ID NO: 1212262 - RNA, 14 nt, Mycobacterium bovis subsp bovis AF2122/97
cgucagcgccgcug

SEQ ID NO: 1212263 - RNA, 18 nt, Mycobacterium bovis subsp bovis AF2122/97
cgucagcggcgagcagag

SEQ ID NO: 1212264 - RNA, 14 nt, Mycobacterium bovis subsp bovis AF2122/97
cgucagcggcggcc

SEQ ID NO: 1212265 - RNA, 14 nt, Mycobacterium bovis subsp bovis AF2122/97
cgucagcgccgccg

SEQ ID NO: 1212266 - RNA, 13 nt, Mycobacterium bovis subsp bovis AF2122/97
cgucagcgccgcc

SEQ ID NO: 1212267 - RNA, 22 nt, Mycobacterium bovis subsp bovis AF2122/97
cgucaguucggugugcggcgca

SEQ ID NO: 1212268 - RNA, 18 nt, Mycobacterium bovis subsp bovis AF2122/97
cgucaguaccgcacgcaa

SEQ ID NO: 1212269 - RNA, 18 nt, Mycobacterium bovis subsp bovis AF2122/97
cgucacggaccuggaacu

SEQ ID NO: 1212270 - RNA, 17 nt, Mycobacterium bovis subsp bovis AF2122/97
cgucacgcgcggcggcg

SEQ ID NO: 1212271 - RNA, 23 nt, Mycobacterium bovis subsp bovis AF2122/97
cgucacgcggaaaccaucgccag

SEQ ID NO: 1212272 - RNA, 20 nt, Mycobacterium bovis subsp bovis AF2122/97
cgucacguggucggccaccc

SEQ ID NO: 1212273 - RNA, 17 nt, Mycobacterium bovis subsp bovis AF2122/97
cgucacgugucccgcau

SEQ ID NO: 1212274 - RNA, 16 nt, Mycobacterium bovis subsp bovis AF2122/97
cgucacguucggcgca

SEQ ID NO: 1212275 - RNA, 20 nt, Mycobacterium bovis subsp bovis AF2122/97
cgucacaagucgacacgccg

SEQ ID NO: 1212276 - RNA, 16 nt, Mycobacterium bovis subsp bovis AF2122/97
cgucacgcaaccggcg

SEQ ID NO: 1212277 - RNA, 18 nt, Mycobacterium bovis subsp bovis AF2122/97
cgucacgcaaccggcgga

SEQ ID NO: 1212278 - RNA, 12 nt, Mycobacterium bovis subsp bovis AF2122/97
cgucacccccga

SEQ ID NO: 1212279 - RNA, 20 nt, Mycobacterium bovis subsp bovis AF2122/97
cgucaacgccucugcucagc

SEQ ID NO: 1212280 - RNA, 23 nt, Mycobacterium bovis subsp bovis AF2122/97
cgucaaccugcgcaucaccacug

SEQ ID NO: 1212281 - RNA, 15 nt, Mycobacterium bovis subsp bovis AF2122/97
cgucaaccugcugca

SEQ ID NO: 1212282 - RNA, 21 nt, Mycobacterium bovis subsp bovis AF2122/97
cgucaagagugcucagcgcgc

SEQ ID NO: 1212283 - RNA, 19 nt, Mycobacterium bovis subsp bovis AF2122/97
cgucaagccacacccggcg

SEQ ID NO: 1212284 - RNA, 15 nt, Mycobacterium bovis subsp bovis AF2122/97
cgucaaggaaggcgu

SEQ ID NO: 1212285 - RNA, 16 nt, Mycobacterium bovis subsp bovis AF2122/97
cguaguggaagccgac

SEQ ID NO: 1212286 - RNA, 16 nt, Mycobacterium bovis subsp bovis AF2122/97
cguagugcucgccggc

SEQ ID NO: 1212287 - RNA, 18 nt, Mycobacterium bovis subsp bovis AF2122/97
cguaguaguggccgccac

SEQ ID NO: 1212288 - RNA, 21 nt, Mycobacterium bovis subsp bovis AF2122/97
cguagucgucuucgucauggc

SEQ ID NO: 1212289 - RNA, 14 nt, Mycobacterium bovis subsp bovis AF2122/97
cguagugcgcgcca

SEQ ID NO: 1212290 - RNA, 19 nt, Mycobacterium bovis subsp bovis AF2122/97
cguaugccguggccgccau

SEQ ID NO: 1212291 - RNA, 17 nt, Mycobacterium bovis subsp bovis AF2122/97
cguaugccgccaaccgc

SEQ ID NO: 1212292 - RNA, 22 nt, Mycobacterium bovis subsp bovis AF2122/97
cgucaaacgcaaagacagcgcg

SEQ ID NO: 1212293 - RNA, 21 nt, Mycobacterium bovis subsp bovis AF2122/97
cgucaaacccagcgacgcggc

SEQ ID NO: 1212294 - RNA, 17 nt, Mycobacterium bovis subsp bovis AF2122/97
cgucaaacgacagcccu

SEQ ID NO: 1212295 - RNA, 22 nt, Mycobacterium bovis subsp bovis AF2122/97
cguagcgggggagcgaacggcg

SEQ ID NO: 1212296 - RNA, 12 nt, Mycobacterium bovis subsp bovis AF2122/97
cguaauccacgc

SEQ ID NO: 1212297 - RNA, 18 nt, Mycobacterium bovis subsp bovis AF2122/97
cgguggcccgccggcagu

SEQ ID NO: 1212298 - RNA, 16 nt, Mycobacterium bovis subsp bovis AF2122/97
cgguggccaucgcgcg

SEQ ID NO: 1212299 - RNA, 20 nt, Mycobacterium bovis subsp bovis AF2122/97
cgguggccaucgcgcggacc

SEQ ID NO: 1212300 - RNA, 21 nt, Mycobacterium bovis subsp bovis AF2122/97
cgguggccaucgcgcggacca

SEQ ID NO: 1212301 - RNA, 23 nt, Mycobacterium bovis subsp bovis AF2122/97
cgguggccaucgcgcggaccaga

SEQ ID NO: 1212302 - RNA, 16 nt, Mycobacterium bovis subsp bovis AF2122/97
cgguggccaacaccgc

SEQ ID NO: 1212303 - RNA, 21 nt, Mycobacterium bovis subsp bovis AF2122/97
cgguggccaacaccgccagca

SEQ ID NO: 1212304 - RNA, 16 nt, Mycobacterium bovis subsp bovis AF2122/97
cgguggccacccggcc

SEQ ID NO: 1212305 - RNA, 19 nt, Mycobacterium bovis subsp bovis AF2122/97
cgguggcaccggcggcgac

SEQ ID NO: 1212306 - RNA, 14 nt, Mycobacterium bovis subsp bovis AF2122/97
cgguggcacgcuga

SEQ ID NO: 1212307 - RNA, 16 nt, Mycobacterium bovis subsp bovis AF2122/97
cgguggcagagccgcc

SEQ ID NO: 1212308 - RNA, 14 nt, Mycobacterium bovis subsp bovis AF2122/97
cgguggcagccugc

SEQ ID NO: 1212309 - RNA, 19 nt, Mycobacterium bovis subsp bovis AF2122/97
cgguggaauccaccagccg

SEQ ID NO: 1212310 - RNA, 19 nt, Mycobacterium bovis subsp bovis AF2122/97
cgguggcaacgggucggca

SEQ ID NO: 1212311 - RNA, 15 nt, Mycobacterium bovis subsp bovis AF2122/97
cgguggaaaaagccc

SEQ ID NO: 1212312 - RNA, 15 nt, Mycobacterium bovis subsp bovis AF2122/97
cggugcugguccagc

SEQ ID NO: 1212313 - RNA, 18 nt, Mycobacterium bovis subsp bovis AF2122/97
cggugcugguccagccgg

SEQ ID NO: 1212314 - RNA, 16 nt, Mycobacterium bovis subsp bovis AF2122/97
cggugcugaccccgcc

SEQ ID NO: 1212315 - RNA, 14 nt, Mycobacterium bovis subsp bovis AF2122/97
cgguggccgucggg

SEQ ID NO: 1212316 - RNA, 21 nt, Mycobacterium bovis subsp bovis AF2122/97
cgguggccgucgggugcagca

SEQ ID NO: 1212317 - RNA, 15 nt, Mycobacterium bovis subsp bovis AF2122/97
cgguggccgcggcgg

SEQ ID NO: 1212318 - RNA, 18 nt, Mycobacterium bovis subsp bovis AF2122/97
cgguggccggcagccaga

SEQ ID NO: 1212319 - RNA, 15 nt, Mycobacterium bovis subsp bovis AF2122/97
cgguggcgccgucgg

SEQ ID NO: 1212320 - RNA, 18 nt, Mycobacterium bovis subsp bovis AF2122/97
cgguggcgccggggccgc

SEQ ID NO: 1212321 - RNA, 21 nt, Mycobacterium bovis subsp bovis AF2122/97
cgguggcgccgaacgccagca

SEQ ID NO: 1212322 - RNA, 17 nt, Mycobacterium bovis subsp bovis AF2122/97
cgguggcggcgagcagc

SEQ ID NO: 1212323 - RNA, 17 nt, Mycobacterium bovis subsp bovis AF2122/97
cgguggcuugccccgcc

SEQ ID NO: 1212324 - RNA, 19 nt, Mycobacterium bovis subsp bovis AF2122/97
cgguggcgucgucggcggg

SEQ ID NO: 1212325 - RNA, 15 nt, Mycobacterium bovis subsp bovis AF2122/97
cgguggcggcucacg

SEQ ID NO: 1212326 - RNA, 14 nt, Mycobacterium bovis subsp bovis AF2122/97
cggugguaacgggg

SEQ ID NO: 1212327 - RNA, 22 nt, Mycobacterium bovis subsp bovis AF2122/97
cgguggcuggccgccaccgcac

SEQ ID NO: 1212328 - RNA, 17 nt, Mycobacterium bovis subsp bovis AF2122/97
cggugggcacagccagu

SEQ ID NO: 1212329 - RNA, 19 nt, Mycobacterium bovis subsp bovis AF2122/97
cggugucgggcuggguggc

SEQ ID NO: 1212330 - RNA, 22 nt, Mycobacterium bovis subsp bovis AF2122/97
cggugugcagggacccggcgcc

SEQ ID NO: 1212331 - RNA, 20 nt, Mycobacterium bovis subsp bovis AF2122/97
cggugucgucaucggggccu

SEQ ID NO: 1212332 - RNA, 14 nt, Mycobacterium bovis subsp bovis AF2122/97
cggugucggcgccg

SEQ ID NO: 1212333 - RNA, 15 nt, Mycobacterium bovis subsp bovis AF2122/97
cgguguccagugcau

SEQ ID NO: 1212334 - RNA, 15 nt, Mycobacterium bovis subsp bovis AF2122/97
cggugucgccacccg

SEQ ID NO: 1212335 - RNA, 18 nt, Mycobacterium bovis subsp bovis AF2122/97
cggugucgaugcgcagcc

SEQ ID NO: 1212336 - RNA, 13 nt, Mycobacterium bovis subsp bovis AF2122/97
cggugucgaugcu

SEQ ID NO: 1212337 - RNA, 18 nt, Mycobacterium bovis subsp bovis AF2122/97
cggugugcggcgcaugca

SEQ ID NO: 1212338 - RNA, 14 nt, Mycobacterium bovis subsp bovis AF2122/97
cggugugcuaccaa

SEQ ID NO: 1212339 - RNA, 17 nt, Mycobacterium bovis subsp bovis AF2122/97
cgguguggccgugggug

SEQ ID NO: 1212340 - RNA, 14 nt, Mycobacterium bovis subsp bovis AF2122/97
cggugugcggcgca

SEQ ID NO: 1212341 - RNA, 13 nt, Mycobacterium bovis subsp bovis AF2122/97
cgguguugcuccc

SEQ ID NO: 1212342 - RNA, 14 nt, Mycobacterium bovis subsp bovis AF2122/97
cgguguugcgcacc

SEQ ID NO: 1212343 - RNA, 18 nt, Mycobacterium bovis subsp bovis AF2122/97
cgguguuuccgaaacccg

SEQ ID NO: 1212344 - RNA, 22 nt, Mycobacterium bovis subsp bovis AF2122/97
cggugguagcggacagcucgcg

SEQ ID NO: 1212345 - RNA, 23 nt, Mycobacterium bovis subsp bovis AF2122/97
cgguggucucgacggcgccgccc

SEQ ID NO: 1212346 - RNA, 16 nt, Mycobacterium bovis subsp bovis AF2122/97
cggugguaccggcggc

SEQ ID NO: 1212347 - RNA, 17 nt, Mycobacterium bovis subsp bovis AF2122/97
cgguggucccccgcagc

SEQ ID NO: 1212348 - RNA, 13 nt, Mycobacterium bovis subsp bovis AF2122/97
cgguggugcugcc

SEQ ID NO: 1212349 - RNA, 14 nt, Mycobacterium bovis subsp bovis AF2122/97
cgguggugcggccc

SEQ ID NO: 1212350 - RNA, 19 nt, Mycobacterium bovis subsp bovis AF2122/97
cgguggugaccgcgggcgc

SEQ ID NO: 1212351 - RNA, 23 nt, Mycobacterium bovis subsp bovis AF2122/97
cgguggugccggcgccgccagca

SEQ ID NO: 1212352 - RNA, 17 nt, Mycobacterium bovis subsp bovis AF2122/97
cgguggugccgcggcca

SEQ ID NO: 1212353 - RNA, 20 nt, Mycobacterium bovis subsp bovis AF2122/97
cgguguaggccucggcagca

SEQ ID NO: 1212354 - RNA, 21 nt, Mycobacterium bovis subsp bovis AF2122/97
cgguguauccgacuggccccg

SEQ ID NO: 1212355 - RNA, 19 nt, Mycobacterium bovis subsp bovis AF2122/97
cgguguagcagcgccagca

SEQ ID NO: 1212356 - RNA, 17 nt, Mycobacterium bovis subsp bovis AF2122/97
cggugguguuccagguc

SEQ ID NO: 1212357 - RNA, 16 nt, Mycobacterium bovis subsp bovis AF2122/97
cgguguaacccuggcg

SEQ ID NO: 1212358 - RNA, 23 nt, Mycobacterium bovis subsp bovis AF2122/97
cggugccgcagcaggggacgacc

SEQ ID NO: 1212359 - RNA, 16 nt, Mycobacterium bovis subsp bovis AF2122/97
cggugccgccaccggc

SEQ ID NO: 1212360 - RNA, 13 nt, Mycobacterium bovis subsp bovis AF2122/97
cggugccgcccga

SEQ ID NO: 1212361 - RNA, 20 nt, Mycobacterium bovis subsp bovis AF2122/97
cggugccgcccgcgccuccg

SEQ ID NO: 1212362 - RNA, 23 nt, Mycobacterium bovis subsp bovis AF2122/97
cggugccgccguucccaccacca

SEQ ID NO: 1212363 - RNA, 23 nt, Mycobacterium bovis subsp bovis AF2122/97
cggugccgccuccgccugcccca

SEQ ID NO: 1212364 - RNA, 16 nt, Mycobacterium bovis subsp bovis AF2122/97
cggugccgccugcgcc

SEQ ID NO: 1212365 - RNA, 22 nt, Mycobacterium bovis subsp bovis AF2122/97
cggugccgccgccggcgccgga

SEQ ID NO: 1212366 - RNA, 19 nt, Mycobacterium bovis subsp bovis AF2122/97
cggugccgccgcggccacc

SEQ ID NO: 1212367 - RNA, 23 nt, Mycobacterium bovis subsp bovis AF2122/97
cggugccgccgcggccaccaccg

SEQ ID NO: 1212368 - RNA, 21 nt, Mycobacterium bovis subsp bovis AF2122/97
cggugccgccggugccgccug

SEQ ID NO: 1212369 - RNA, 15 nt, Mycobacterium bovis subsp bovis AF2122/97
cggugcgcagggccu

SEQ ID NO: 1212370 - RNA, 12 nt, Mycobacterium bovis subsp bovis AF2122/97
cggugccgugcu

SEQ ID NO: 1212371 - RNA, 16 nt, Mycobacterium bovis subsp bovis AF2122/97
cggugccgguggugac

SEQ ID NO: 1212372 - RNA, 19 nt, Mycobacterium bovis subsp bovis AF2122/97
cggugccgucagcggcggc

SEQ ID NO: 1212373 - RNA, 15 nt, Mycobacterium bovis subsp bovis AF2122/97
cggugccggccaucg

SEQ ID NO: 1212374 - RNA, 15 nt, Mycobacterium bovis subsp bovis AF2122/97
cggugcgcaccagag

SEQ ID NO: 1212375 - RNA, 14 nt, Mycobacterium bovis subsp bovis AF2122/97
cggugcgcgcagac

SEQ ID NO: 1212376 - RNA, 12 nt, Mycobacterium bovis subsp bovis AF2122/97
cggugcgcugga

SEQ ID NO: 1212377 - RNA, 21 nt, Mycobacterium bovis subsp bovis AF2122/97
cggugcgcuggaggcuccugg

SEQ ID NO: 1212378 - RNA, 15 nt, Mycobacterium bovis subsp bovis AF2122/97
cggugcgcuggaugu

SEQ ID NO: 1212379 - RNA, 20 nt, Mycobacterium bovis subsp bovis AF2122/97
cggugcggaacaccgcccgg

SEQ ID NO: 1212380 - RNA, 17 nt, Mycobacterium bovis subsp bovis AF2122/97
cggugcgguggugcgca

SEQ ID NO: 1212381 - RNA, 17 nt, Mycobacterium bovis subsp bovis AF2122/97
cggugcuaaccgacgcu

SEQ ID NO: 1212382 - RNA, 18 nt, Mycobacterium bovis subsp bovis AF2122/97
cggugcucuucggcacca

SEQ ID NO: 1212383 - RNA, 18 nt, Mycobacterium bovis subsp bovis AF2122/97
cggugaucaccgcggcgg

SEQ ID NO: 1212384 - RNA, 15 nt, Mycobacterium bovis subsp bovis AF2122/97
cggugaucagcagca

SEQ ID NO: 1212385 - RNA, 17 nt, Mycobacterium bovis subsp bovis AF2122/97
cggugauccaacuggcc

SEQ ID NO: 1212386 - RNA, 14 nt, Mycobacterium bovis subsp bovis AF2122/97
cggugaucagccac

SEQ ID NO: 1212387 - RNA, 15 nt, Mycobacterium bovis subsp bovis AF2122/97
cggugaucagccacc

SEQ ID NO: 1212388 - RNA, 22 nt, Mycobacterium bovis subsp bovis AF2122/97
cggugaucagguaagcgaacgg

SEQ ID NO: 1212389 - RNA, 19 nt, Mycobacterium bovis subsp bovis AF2122/97
cggugaucaaaccggcggc

SEQ ID NO: 1212390 - RNA, 17 nt, Mycobacterium bovis subsp bovis AF2122/97
cggugaucaccaugauc

SEQ ID NO: 1212391 - RNA, 16 nt, Mycobacterium bovis subsp bovis AF2122/97
cggugaucgcgguggc

SEQ ID NO: 1212392 - RNA, 16 nt, Mycobacterium bovis subsp bovis AF2122/97
cggugaugggggagcc

SEQ ID NO: 1212393 - RNA, 17 nt, Mycobacterium bovis subsp bovis AF2122/97
cggugaugguggcaacg

SEQ ID NO: 1212394 - RNA, 20 nt, Mycobacterium bovis subsp bovis AF2122/97
cggugauggugugcagcagc

SEQ ID NO: 1212395 - RNA, 18 nt, Mycobacterium bovis subsp bovis AF2122/97
cggugauggccgaccagc

SEQ ID NO: 1212396 - RNA, 18 nt, Mycobacterium bovis subsp bovis AF2122/97
cggugcacgagcggacag

SEQ ID NO: 1212397 - RNA, 21 nt, Mycobacterium bovis subsp bovis AF2122/97
cggugcacaacgcccaccacg

SEQ ID NO: 1212398 - RNA, 20 nt, Mycobacterium bovis subsp bovis AF2122/97
cggugcacacugaccccgcc

SEQ ID NO: 1212399 - RNA, 21 nt, Mycobacterium bovis subsp bovis AF2122/97
cggugcacggcgcuaccagcc

SEQ ID NO: 1212400 - RNA, 15 nt, Mycobacterium bovis subsp bovis AF2122/97
cggugccgacgguga

SEQ ID NO: 1212401 - RNA, 18 nt, Mycobacterium bovis subsp bovis AF2122/97
cggugcccugccggcagc

SEQ ID NO: 1212402 - RNA, 14 nt, Mycobacterium bovis subsp bovis AF2122/97
cggugccgaacagc

SEQ ID NO: 1212403 - RNA, 22 nt, Mycobacterium bovis subsp bovis AF2122/97
cggugccaucgggcgcgguaac

SEQ ID NO: 1212404 - RNA, 18 nt, Mycobacterium bovis subsp bovis AF2122/97
cggugcccaacccacucg

SEQ ID NO: 1212405 - RNA, 12 nt, Mycobacterium bovis subsp bovis AF2122/97
cggugccaccag

SEQ ID NO: 1212406 - RNA, 17 nt, Mycobacterium bovis subsp bovis AF2122/97
cggugccaccagugagc

SEQ ID NO: 1212407 - RNA, 17 nt, Mycobacterium bovis subsp bovis AF2122/97
cggugccagcacuccac

SEQ ID NO: 1212408 - RNA, 12 nt, Mycobacterium bovis subsp bovis AF2122/97
cggugcagcgca

SEQ ID NO: 1212409 - RNA, 17 nt, Mycobacterium bovis subsp bovis AF2122/97
cggugcagcuccccgcc

SEQ ID NO: 1212410 - RNA, 19 nt, Mycobacterium bovis subsp bovis AF2122/97
cggugcagcgcacgcagcc

SEQ ID NO: 1212411 - RNA, 21 nt, Mycobacterium bovis subsp bovis AF2122/97
cggugcagugccucggcggcg

SEQ ID NO: 1212412 - RNA, 22 nt, Mycobacterium bovis subsp bovis AF2122/97
cggugccaagggccggaugggc

SEQ ID NO: 1212413 - RNA, 15 nt, Mycobacterium bovis subsp bovis AF2122/97
cggugccaccacgcu

SEQ ID NO: 1212414 - RNA, 23 nt, Mycobacterium bovis subsp bovis AF2122/97
cggugccacggugacccuggugg

SEQ ID NO: 1212415 - RNA, 18 nt, Mycobacterium bovis subsp bovis AF2122/97
cggugccacugccggugg

SEQ ID NO: 1212416 - RNA, 14 nt, Mycobacterium bovis subsp bovis AF2122/97
cgguugccggcggc

SEQ ID NO: 1212417 - RNA, 16 nt, Mycobacterium bovis subsp bovis AF2122/97
cgguugccuucuuggc

SEQ ID NO: 1212418 - RNA, 15 nt, Mycobacterium bovis subsp bovis AF2122/97
cgguugccccgaccg

SEQ ID NO: 1212419 - RNA, 22 nt, Mycobacterium bovis subsp bovis AF2122/97
cgguugcauccauccugccuua

SEQ ID NO: 1212420 - RNA, 22 nt, Mycobacterium bovis subsp bovis AF2122/97
cgguuggccagccacagccgac

SEQ ID NO: 1212421 - RNA, 18 nt, Mycobacterium bovis subsp bovis AF2122/97
cgguuggccagugacuca

SEQ ID NO: 1212422 - RNA, 13 nt, Mycobacterium bovis subsp bovis AF2122/97
cgguuggccacca

SEQ ID NO: 1212423 - RNA, 17 nt, Mycobacterium bovis subsp bovis AF2122/97
cgguuggcugccggcaa

SEQ ID NO: 1212424 - RNA, 19 nt, Mycobacterium bovis subsp bovis AF2122/97
cgguuggcucgggccagau

SEQ ID NO: 1212425 - RNA, 17 nt, Mycobacterium bovis subsp bovis AF2122/97
cgguugugcgcgcgccc

SEQ ID NO: 1212426 - RNA, 16 nt, Mycobacterium bovis subsp bovis AF2122/97
cgguuucggugguaac

SEQ ID NO: 1212427 - RNA, 15 nt, Mycobacterium bovis subsp bovis AF2122/97
cgguuucgaccacca

SEQ ID NO: 1212428 - RNA, 15 nt, Mycobacterium bovis subsp bovis AF2122/97
cgguuccgccggccc

SEQ ID NO: 1212429 - RNA, 16 nt, Mycobacterium bovis subsp bovis AF2122/97
cgguuccgccggcccc

SEQ ID NO: 1212430 - RNA, 15 nt, Mycobacterium bovis subsp bovis AF2122/97
cgguuccggccggcu

SEQ ID NO: 1212431 - RNA, 16 nt, Mycobacterium bovis subsp bovis AF2122/97
cgguuccggccggcuc

SEQ ID NO: 1212432 - RNA, 22 nt, Mycobacterium bovis subsp bovis AF2122/97
cgguucgcccgaggcgagacgc

SEQ ID NO: 1212433 - RNA, 21 nt, Mycobacterium bovis subsp bovis AF2122/97
cgguucgggcagcacccgcgc

SEQ ID NO: 1212434 - RNA, 17 nt, Mycobacterium bovis subsp bovis AF2122/97
cgguugacgccgguccc

SEQ ID NO: 1212435 - RNA, 15 nt, Mycobacterium bovis subsp bovis AF2122/97
cgguugcacccgcgc

SEQ ID NO: 1212436 - RNA, 22 nt, Mycobacterium bovis subsp bovis AF2122/97
cgguugcacccgcgcggagacc

SEQ ID NO: 1212437 - RNA, 17 nt, Mycobacterium bovis subsp bovis AF2122/97
cgguugcauaccgccgg

SEQ ID NO: 1212438 - RNA, 15 nt, Mycobacterium bovis subsp bovis AF2122/97
cguaacgccgcucau

SEQ ID NO: 1212439 - RNA, 20 nt, Mycobacterium bovis subsp bovis AF2122/97
cgguuuggaucacccgccgc

SEQ ID NO: 1212440 - RNA, 14 nt, Mycobacterium bovis subsp bovis AF2122/97
cgguuugcccgguc

SEQ ID NO: 1212441 - RNA, 13 nt, Mycobacterium bovis subsp bovis AF2122/97
cgguuugcagcgg

SEQ ID NO: 1212442 - RNA, 16 nt, Mycobacterium bovis subsp bovis AF2122/97
cgguuuucggcugccg

SEQ ID NO: 1212443 - RNA, 15 nt, Mycobacterium bovis subsp bovis AF2122/97
cgucuuccagccagg

SEQ ID NO: 1212444 - RNA, 20 nt, Mycobacterium bovis subsp bovis AF2122/97
cgugacgaccagccccgcug

SEQ ID NO: 1212445 - RNA, 16 nt, Mycobacterium bovis subsp bovis AF2122/97
cgugacgaccagcccc

SEQ ID NO: 1212446 - RNA, 22 nt, Mycobacterium bovis subsp bovis AF2122/97
cgugaccgccguugucgaccuc

SEQ ID NO: 1212447 - RNA, 14 nt, Mycobacterium bovis subsp bovis AF2122/97
cgugaccgagccgc

SEQ ID NO: 1212448 - RNA, 17 nt, Mycobacterium bovis subsp bovis AF2122/97
cgugacauucugcagcg

SEQ ID NO: 1212449 - RNA, 21 nt, Mycobacterium bovis subsp bovis AF2122/97
cgugaccagggccugaguguu

SEQ ID NO: 1212450 - RNA, 19 nt, Mycobacterium bovis subsp bovis AF2122/97
cgucgcgauccacuccggc

SEQ ID NO: 1212451 - RNA, 18 nt, Mycobacterium bovis subsp bovis AF2122/97
cgucgcgacgucggccgu

SEQ ID NO: 1212452 - RNA, 19 nt, Mycobacterium bovis subsp bovis AF2122/97
cgucgcgauugccgcgguu

SEQ ID NO: 1212453 - RNA, 13 nt, Mycobacterium bovis subsp bovis AF2122/97
cgucgcgcacggc

SEQ ID NO: 1212454 - RNA, 17 nt, Mycobacterium bovis subsp bovis AF2122/97
cgucgcgcaucgccucc

SEQ ID NO: 1212455 - RNA, 22 nt, Mycobacterium bovis subsp bovis AF2122/97
cgucgcgccgcgugguuccggc

SEQ ID NO: 1212456 - RNA, 23 nt, Mycobacterium bovis subsp bovis AF2122/97
cgucgcacccaacuccaucagcg

SEQ ID NO: 1212457 - RNA, 13 nt, Mycobacterium bovis subsp bovis AF2122/97
cgucgcaaacaga

SEQ ID NO: 1212458 - RNA, 20 nt, Mycobacterium bovis subsp bovis AF2122/97
cgucgccggucaggccgccg

SEQ ID NO: 1212459 - RNA, 18 nt, Mycobacterium bovis subsp bovis AF2122/97
cgucuuaccugaagccgc

SEQ ID NO: 1212460 - RNA, 18 nt, Mycobacterium bovis subsp bovis AF2122/97
cgucugcccgcccagccc

SEQ ID NO: 1212461 - RNA, 23 nt, Mycobacterium bovis subsp bovis AF2122/97
cgucugcgaucccgaucgcgcug

SEQ ID NO: 1212462 - RNA, 17 nt, Mycobacterium bovis subsp bovis AF2122/97
cgucugcccgcccagcc

SEQ ID NO: 1212463 - RNA, 22 nt, Mycobacterium bovis subsp bovis AF2122/97
cgucugccacgucggcgaacgg

SEQ ID NO: 1212464 - RNA, 15 nt, Mycobacterium bovis subsp bovis AF2122/97
cgucugacccaccgc

SEQ ID NO: 1212465 - RNA, 15 nt, Mycobacterium bovis subsp bovis AF2122/97
cgugcggcugccagu

SEQ ID NO: 1212466 - RNA, 12 nt, Mycobacterium bovis subsp bovis AF2122/97
cgugcggcggcu

SEQ ID NO: 1212467 - RNA, 21 nt, Mycobacterium bovis subsp bovis AF2122/97
cgugcggcgaccgucaaccug

SEQ ID NO: 1212468 - RNA, 17 nt, Mycobacterium bovis subsp bovis AF2122/97
cgugcggcgcggcgaca

SEQ ID NO: 1212469 - RNA, 19 nt, Mycobacterium bovis subsp bovis AF2122/97
cgugcgucggcccggugcu

SEQ ID NO: 1212470 - RNA, 15 nt, Mycobacterium bovis subsp bovis AF2122/97
cgugcggucgcgccc

SEQ ID NO: 1212471 - RNA, 15 nt, Mycobacterium bovis subsp bovis AF2122/97
cgugcgguggcgcgc

SEQ ID NO: 1212472 - RNA, 13 nt, Mycobacterium bovis subsp bovis AF2122/97
cgugcgggcgggc

SEQ ID NO: 1212473 - RNA, 21 nt, Mycobacterium bovis subsp bovis AF2122/97
cgugcggguaauacggcgccu

SEQ ID NO: 1212474 - RNA, 22 nt, Mycobacterium bovis subsp bovis AF2122/97
cgugcggguucacugccggcca

SEQ ID NO: 1212475 - RNA, 22 nt, Mycobacterium bovis subsp bovis AF2122/97
cgugcccaagcucagggugggc

SEQ ID NO: 1212476 - RNA, 17 nt, Mycobacterium bovis subsp bovis AF2122/97
cgugcccaagcucaggg

SEQ ID NO: 1212477 - RNA, 13 nt, Mycobacterium bovis subsp bovis AF2122/97
cgugccagcgccc

SEQ ID NO: 1212478 - RNA, 16 nt, Mycobacterium bovis subsp bovis AF2122/97
cgugcgccgacggugc

SEQ ID NO: 1212479 - RNA, 18 nt, Mycobacterium bovis subsp bovis AF2122/97
cgugcgcggccggcacga

SEQ ID NO: 1212480 - RNA, 20 nt, Mycobacterium bovis subsp bovis AF2122/97
cgugcgccggggacacagcg

SEQ ID NO: 1212481 - RNA, 17 nt, Mycobacterium bovis subsp bovis AF2122/97
cgugcacggcggccagg

SEQ ID NO: 1212482 - RNA, 14 nt, Mycobacterium bovis subsp bovis AF2122/97
cgugcaucugugag

SEQ ID NO: 1212483 - RNA, 14 nt, Mycobacterium bovis subsp bovis AF2122/97
cgugcaccgcgacc

SEQ ID NO: 1212484 - RNA, 20 nt, Mycobacterium bovis subsp bovis AF2122/97
cgugcaccgcgaccgcgcac

SEQ ID NO: 1212485 - RNA, 19 nt, Mycobacterium bovis subsp bovis AF2122/97
cgugcacaggucagcgcug

SEQ ID NO: 1212486 - RNA, 20 nt, Mycobacterium bovis subsp bovis AF2122/97
cgugcaauagcucgggcgca

SEQ ID NO: 1212487 - RNA, 20 nt, Mycobacterium bovis subsp bovis AF2122/97
cgugaucgcgguccaacagc

SEQ ID NO: 1212488 - RNA, 22 nt, Mycobacterium bovis subsp bovis AF2122/97
cgugaucaacuuccgcagcgcc

SEQ ID NO: 1212489 - RNA, 13 nt, Mycobacterium bovis subsp bovis AF2122/97
cgugaucagcagg

SEQ ID NO: 1212490 - RNA, 15 nt, Mycobacterium bovis subsp bovis AF2122/97
cgugaguuucaccac

SEQ ID NO: 1212491 - RNA, 18 nt, Mycobacterium bovis subsp bovis AF2122/97
cgugaguucgcaaucaga

SEQ ID NO: 1212492 - RNA, 18 nt, Mycobacterium bovis subsp bovis AF2122/97
cgugaggucccggcuggg

SEQ ID NO: 1212493 - RNA, 16 nt, Mycobacterium bovis subsp bovis AF2122/97
cgugagucacccggcc

SEQ ID NO: 1212494 - RNA, 20 nt, Mycobacterium bovis subsp bovis AF2122/97
cguggcggaucgcgagcgcc

SEQ ID NO: 1212495 - RNA, 20 nt, Mycobacterium bovis subsp bovis AF2122/97
cguggcggccuccuccccga

SEQ ID NO: 1212496 - RNA, 15 nt, Mycobacterium bovis subsp bovis AF2122/97
cguggcggcgggccu

SEQ ID NO: 1212497 - RNA, 15 nt, Mycobacterium bovis subsp bovis AF2122/97
cguggcgggggcuua

SEQ ID NO: 1212498 - RNA, 19 nt, Mycobacterium bovis subsp bovis AF2122/97
cguggcucggcggguauau

SEQ ID NO: 1212499 - RNA, 16 nt, Mycobacterium bovis subsp bovis AF2122/97
cguggcgucggcguca

SEQ ID NO: 1212500 - RNA, 16 nt, Mycobacterium bovis subsp bovis AF2122/97
cgugggaaccaccagc

SEQ ID NO: 1212501 - RNA, 18 nt, Mycobacterium bovis subsp bovis AF2122/97
cguggggaccggcaggcc

SEQ ID NO: 1212502 - RNA, 16 nt, Mycobacterium bovis subsp bovis AF2122/97
cguggguaccgagcag

SEQ ID NO: 1212503 - RNA, 18 nt, Mycobacterium bovis subsp bovis AF2122/97
cgugggugucggcuagca

SEQ ID NO: 1212504 - RNA, 17 nt, Mycobacterium bovis subsp bovis AF2122/97
cgugguaaccagggcag

SEQ ID NO: 1212505 - RNA, 16 nt, Mycobacterium bovis subsp bovis AF2122/97
cgugggccugcccggc

SEQ ID NO: 1212506 - RNA, 22 nt, Mycobacterium bovis subsp bovis AF2122/97
cgugggccacuugaugcucgau

SEQ ID NO: 1212507 - RNA, 13 nt, Mycobacterium bovis subsp bovis AF2122/97
cgugggccaccac

SEQ ID NO: 1212508 - RNA, 23 nt, Mycobacterium bovis subsp bovis AF2122/97
cgugggcaugcggauucgcgcug

SEQ ID NO: 1212509 - RNA, 19 nt, Mycobacterium bovis subsp bovis AF2122/97
cgugggcaccuuggccggc

SEQ ID NO: 1212510 - RNA, 20 nt, Mycobacterium bovis subsp bovis AF2122/97
cguggagauacauuucccag

SEQ ID NO: 1212511 - RNA, 22 nt, Mycobacterium bovis subsp bovis AF2122/97
cguggaucaucccgaccagcag

SEQ ID NO: 1212512 - RNA, 15 nt, Mycobacterium bovis subsp bovis AF2122/97
cguggaucuuggcca

SEQ ID NO: 1212513 - RNA, 22 nt, Mycobacterium bovis subsp bovis AF2122/97
cguggaacugcagcggcuugcc

SEQ ID NO: 1212514 - RNA, 20 nt, Mycobacterium bovis subsp bovis AF2122/97
cguggaagccgacgaccagc

SEQ ID NO: 1212515 - RNA, 22 nt, Mycobacterium bovis subsp bovis AF2122/97
cguggaagccgacgaccagcag

SEQ ID NO: 1212516 - RNA, 22 nt, Mycobacterium bovis subsp bovis AF2122/97
cguggaauggcgccggccggca

SEQ ID NO: 1212517 - RNA, 22 nt, Mycobacterium bovis subsp bovis AF2122/97
cgugcuuguugcgcgacgccgc

SEQ ID NO: 1212518 - RNA, 14 nt, Mycobacterium bovis subsp bovis AF2122/97
cguggcgcaccacc

SEQ ID NO: 1212519 - RNA, 16 nt, Mycobacterium bovis subsp bovis AF2122/97
cguggcgcaccaccgc

SEQ ID NO: 1212520 - RNA, 17 nt, Mycobacterium bovis subsp bovis AF2122/97
cguggcgcaccaccgcc

SEQ ID NO: 1212521 - RNA, 18 nt, Mycobacterium bovis subsp bovis AF2122/97
cguggcgccggccacgag

SEQ ID NO: 1212522 - RNA, 22 nt, Mycobacterium bovis subsp bovis AF2122/97
cguggcgcccgucuccagcacc

SEQ ID NO: 1212523 - RNA, 15 nt, Mycobacterium bovis subsp bovis AF2122/97
cguggcgcccgugcc

SEQ ID NO: 1212524 - RNA, 17 nt, Mycobacterium bovis subsp bovis AF2122/97
cguggcgcccgugccgc

SEQ ID NO: 1212525 - RNA, 18 nt, Mycobacterium bovis subsp bovis AF2122/97
cguggcgcccgugccgcc

SEQ ID NO: 1212526 - RNA, 15 nt, Mycobacterium bovis subsp bovis AF2122/97
cguggcccuccucgg

SEQ ID NO: 1212527 - RNA, 17 nt, Mycobacterium bovis subsp bovis AF2122/97
cguggcccgcucccugc

SEQ ID NO: 1212528 - RNA, 21 nt, Mycobacterium bovis subsp bovis AF2122/97
cguggcccgcucccugcaccc

SEQ ID NO: 1212529 - RNA, 21 nt, Mycobacterium bovis subsp bovis AF2122/97
cguggccggucacguccgcgg

SEQ ID NO: 1212530 - RNA, 21 nt, Mycobacterium bovis subsp bovis AF2122/97
cgugucacccaauggagccgc

SEQ ID NO: 1212531 - RNA, 15 nt, Mycobacterium bovis subsp bovis AF2122/97
cguguaaccccaggc

SEQ ID NO: 1212532 - RNA, 20 nt, Mycobacterium bovis subsp bovis AF2122/97
cgugguuccggcgugcagca

SEQ ID NO: 1212533 - RNA, 14 nt, Mycobacterium bovis subsp bovis AF2122/97
cguggucaguugug

SEQ ID NO: 1212534 - RNA, 20 nt, Mycobacterium bovis subsp bovis AF2122/97
cguggugauccggucuccgc

SEQ ID NO: 1212535 - RNA, 22 nt, Mycobacterium bovis subsp bovis AF2122/97
cguggucggagcgggugcgggc

SEQ ID NO: 1212536 - RNA, 15 nt, Mycobacterium bovis subsp bovis AF2122/97
cguggucgcgcggca

SEQ ID NO: 1212537 - RNA, 13 nt, Mycobacterium bovis subsp bovis AF2122/97
cguggucgagcag

SEQ ID NO: 1212538 - RNA, 18 nt, Mycobacterium bovis subsp bovis AF2122/97
cgugguagacggccugcg

SEQ ID NO: 1212539 - RNA, 14 nt, Mycobacterium bovis subsp bovis AF2122/97
cgugguagccggcg

SEQ ID NO: 1212540 - RNA, 19 nt, Mycobacterium bovis subsp bovis AF2122/97
cgugucuggcgaacaguga

SEQ ID NO: 1212541 - RNA, 17 nt, Mycobacterium bovis subsp bovis AF2122/97
cgugucggugcgcgcag

SEQ ID NO: 1212542 - RNA, 23 nt, Mycobacterium bovis subsp bovis AF2122/97
cgugucuugucgcgcagcaucuc

SEQ ID NO: 1212543 - RNA, 15 nt, Mycobacterium bovis subsp bovis AF2122/97
cgugugagggccggg

SEQ ID NO: 1212544 - RNA, 19 nt, Mycobacterium bovis subsp bovis AF2122/97
cgugugcaccaucaucacc

SEQ ID NO: 1212545 - RNA, 14 nt, Mycobacterium bovis subsp bovis AF2122/97
cguguggagcucgc

SEQ ID NO: 1212546 - RNA, 20 nt, Mycobacterium bovis subsp bovis AF2122/97
cguguggagcucgcggcgca

SEQ ID NO: 1212547 - RNA, 20 nt, Mycobacterium bovis subsp bovis AF2122/97
cgugugcaccaucaucaccu

SEQ ID NO: 1212548 - RNA, 22 nt, Mycobacterium bovis subsp bovis AF2122/97
cgugugcaccaucaucaccucu

SEQ ID NO: 1212549 - RNA, 23 nt, Mycobacterium bovis subsp bovis AF2122/97
cguguccccccagauccgcagcg

SEQ ID NO: 1212550 - RNA, 14 nt, Mycobacterium bovis subsp bovis AF2122/97
cguguccagcaugc

SEQ ID NO: 1212551 - RNA, 17 nt, Mycobacterium bovis subsp bovis AF2122/97
cgugucuugucgcgcag

SEQ ID NO: 1212552 - RNA, 18 nt, Mycobacterium bovis subsp bovis AF2122/97
cgugucuugucgcgcagc

SEQ ID NO: 1212553 - RNA, 22 nt, Mycobacterium bovis subsp bovis AF2122/97
cgugucgccgccaccagcgcac

SEQ ID NO: 1212554 - RNA, 13 nt, Mycobacterium bovis subsp bovis AF2122/97
cgugucgccgccg

SEQ ID NO: 1212555 - RNA, 19 nt, Mycobacterium bovis subsp bovis AF2122/97
cguguggugugucaccgga

SEQ ID NO: 1212556 - RNA, 15 nt, Mycobacterium bovis subsp bovis AF2122/97
cguguggcagaugug

SEQ ID NO: 1212557 - RNA, 21 nt, Mycobacterium bovis subsp bovis AF2122/97
cgugugccacggggcaggucc

SEQ ID NO: 1212558 - RNA, 12 nt, Mycobacterium bovis subsp bovis AF2122/97
cguguugaagaa

SEQ ID NO: 1212559 - RNA, 14 nt, Mycobacterium bovis subsp bovis AF2122/97
cguucggcgcacag

SEQ ID NO: 1212560 - RNA, 16 nt, Mycobacterium bovis subsp bovis AF2122/97
cguucggcaccugguu

SEQ ID NO: 1212561 - RNA, 16 nt, Mycobacterium bovis subsp bovis AF2122/97
cguucucggcacccuc

SEQ ID NO: 1212562 - RNA, 15 nt, Mycobacterium bovis subsp bovis AF2122/97
cguucggccgggccg

SEQ ID NO: 1212563 - RNA, 20 nt, Mycobacterium bovis subsp bovis AF2122/97
cguucgcgggugcgcugcag

SEQ ID NO: 1212564 - RNA, 16 nt, Mycobacterium bovis subsp bovis AF2122/97
cguucugcaccagcuc

SEQ ID NO: 1212565 - RNA, 14 nt, Mycobacterium bovis subsp bovis AF2122/97
cguugagcagcacc

SEQ ID NO: 1212566 - RNA, 22 nt, Mycobacterium bovis subsp bovis AF2122/97
cguugcccccauugccgccguc

SEQ ID NO: 1212567 - RNA, 18 nt, Mycobacterium bovis subsp bovis AF2122/97
cguugccgaucagcccgg

SEQ ID NO: 1212568 - RNA, 22 nt, Mycobacterium bovis subsp bovis AF2122/97
cguugccgaacgucgcggccag

SEQ ID NO: 1212569 - RNA, 20 nt, Mycobacterium bovis subsp bovis AF2122/97
cguugacucugcguccacca

SEQ ID NO: 1212570 - RNA, 18 nt, Mycobacterium bovis subsp bovis AF2122/97
cguugacgucgagcagcg

SEQ ID NO: 1212571 - RNA, 20 nt, Mycobacterium bovis subsp bovis AF2122/97
cguugacgguugccccggcg

SEQ ID NO: 1212572 - RNA, 17 nt, Mycobacterium bovis subsp bovis AF2122/97
cguugacguccaacagc

SEQ ID NO: 1212573 - RNA, 18 nt, Mycobacterium bovis subsp bovis AF2122/97
cguugacguccaacagcg

SEQ ID NO: 1212574 - RNA, 21 nt, Mycobacterium bovis subsp bovis AF2122/97
cguugaccgcaucgucgagcc

SEQ ID NO: 1212575 - RNA, 17 nt, Mycobacterium bovis subsp bovis AF2122/97
cguugaacggcaccagc

SEQ ID NO: 1212576 - RNA, 22 nt, Mycobacterium bovis subsp bovis AF2122/97
cguugaacugugcggcagcccc

SEQ ID NO: 1212577 - RNA, 15 nt, Mycobacterium bovis subsp bovis AF2122/97
cguucgccuggucac

SEQ ID NO: 1212578 - RNA, 14 nt, Mycobacterium bovis subsp bovis AF2122/97
cguucgcccgcccg

SEQ ID NO: 1212579 - RNA, 15 nt, Mycobacterium bovis subsp bovis AF2122/97
cguucgcccgcccgu

SEQ ID NO: 1212580 - RNA, 14 nt, Mycobacterium bovis subsp bovis AF2122/97
cguucgccgcccgg

SEQ ID NO: 1212581 - RNA, 22 nt, Mycobacterium bovis subsp bovis AF2122/97
cguuccaucagggccuuggcgg

SEQ ID NO: 1212582 - RNA, 21 nt, Mycobacterium bovis subsp bovis AF2122/97
cguuccagcaguacaccgccc

SEQ ID NO: 1212583 - RNA, 23 nt, Mycobacterium bovis subsp bovis AF2122/97
cguuccagcaguacaccgcccgg

SEQ ID NO: 1212584 - RNA, 20 nt, Mycobacterium bovis subsp bovis AF2122/97
cguuaacugcgccuaacccc

SEQ ID NO: 1212585 - RNA, 21 nt, Mycobacterium bovis subsp bovis AF2122/97
cguuggaaaagucgggcacug

SEQ ID NO: 1212586 - RNA, 13 nt, Mycobacterium bovis subsp bovis AF2122/97
cguuggccagcag

SEQ ID NO: 1212587 - RNA, 16 nt, Mycobacterium bovis subsp bovis AF2122/97
cguuggcaucggcgga

SEQ ID NO: 1212588 - RNA, 19 nt, Mycobacterium bovis subsp bovis AF2122/97
cguugcgccucuuccuggc

SEQ ID NO: 1212589 - RNA, 21 nt, Mycobacterium bovis subsp bovis AF2122/97
cguugcgccucuuccuggcgu

SEQ ID NO: 1212590 - RNA, 23 nt, Mycobacterium bovis subsp bovis AF2122/97
cguugcgggcgggaaccccggcc

SEQ ID NO: 1212591 - RNA, 18 nt, Mycobacterium bovis subsp bovis AF2122/97
cguugcguagcaggucga

SEQ ID NO: 1212592 - RNA, 16 nt, Mycobacterium bovis subsp bovis AF2122/97
cguugcugcagcagcg

SEQ ID NO: 1212593 - RNA, 19 nt, Mycobacterium bovis subsp bovis AF2122/97
cguugcuauucgccagcgc

SEQ ID NO: 1212594 - RNA, 16 nt, Mycobacterium bovis subsp bovis AF2122/97
cguugccgccggcgcc

SEQ ID NO: 1212595 - RNA, 19 nt, Mycobacterium bovis subsp bovis AF2122/97
cguugccgcccacuagcag

SEQ ID NO: 1212596 - RNA, 20 nt, Mycobacterium bovis subsp bovis AF2122/97
cguugccgccgucgccgccg

SEQ ID NO: 1212597 - RNA, 20 nt, Mycobacterium bovis subsp bovis AF2122/97
cguugccgccguugccgccg

SEQ ID NO: 1212598 - RNA, 20 nt, Mycobacterium bovis subsp bovis AF2122/97
cguugccgaucagcccggcc

SEQ ID NO: 1212599 - RNA, 17 nt, Mycobacterium bovis subsp bovis AF2122/97
cguugccggugccgccg

SEQ ID NO: 1212600 - RNA, 18 nt, Mycobacterium bovis subsp bovis AF2122/97
cguugccggugccgccgc

SEQ ID NO: 1212601 - RNA, 21 nt, Mycobacterium bovis subsp bovis AF2122/97
cguugccguuggugccgccug

SEQ ID NO: 1212602 - RNA, 21 nt, Mycobacterium bovis subsp bovis AF2122/97
cguugggguuggcauguggac

SEQ ID NO: 1212603 - RNA, 20 nt, Mycobacterium bovis subsp bovis AF2122/97
cguuggguugaaaacgcccg

SEQ ID NO: 1212604 - RNA, 15 nt, Mycobacterium bovis subsp bovis AF2122/97
cguuggcggcaaggg

SEQ ID NO: 1212605 - RNA, 20 nt, Mycobacterium bovis subsp bovis AF2122/97
cguugguggucugccaaaag

SEQ ID NO: 1212606 - RNA, 21 nt, Mycobacterium bovis subsp bovis AF2122/97
cguuggucagcguggacgccc

SEQ ID NO: 1212607 - RNA, 21 nt, Mycobacterium bovis subsp bovis AF2122/97
cguuggcggcggucggcuggg

SEQ ID NO: 1212608 - RNA, 18 nt, Mycobacterium bovis subsp bovis AF2122/97
cguuggcggccagcgcac

SEQ ID NO: 1212609 - RNA, 14 nt, Mycobacterium bovis subsp bovis AF2122/97
cguuggcgaacagc

SEQ ID NO: 1212610 - RNA, 15 nt, Mycobacterium bovis subsp bovis AF2122/97
cguuuaucagcaaga

SEQ ID NO: 1212611 - RNA, 15 nt, Mycobacterium bovis subsp bovis AF2122/97
cguuuagucuccggc

SEQ ID NO: 1212612 - RNA, 16 nt, Mycobacterium bovis subsp bovis AF2122/97
cguuugcgaagcccac

SEQ ID NO: 1212613 - RNA, 18 nt, Mycobacterium bovis subsp bovis AF2122/97
cuacugauagacccuggg

SEQ ID NO: 1212614 - RNA, 12 nt, Mycobacterium bovis subsp bovis AF2122/97
cuacucgcggcc

SEQ ID NO: 1212615 - RNA, 15 nt, Mycobacterium bovis subsp bovis AF2122/97
cuacucgcggccggc

SEQ ID NO: 1212616 - RNA, 15 nt, Mycobacterium bovis subsp bovis AF2122/97
cuacuccggucccgc

SEQ ID NO: 1212617 - RNA, 20 nt, Mycobacterium bovis subsp bovis AF2122/97
cuacuaggccccuggccgcc

SEQ ID NO: 1212618 - RNA, 15 nt, Mycobacterium bovis subsp bovis AF2122/97
cuacgcagcgcggcu

SEQ ID NO: 1212619 - RNA, 16 nt, Mycobacterium bovis subsp bovis AF2122/97
cuacgccagccgcgcu

SEQ ID NO: 1212620 - RNA, 15 nt, Mycobacterium bovis subsp bovis AF2122/97
cuacgccccacugcc

SEQ ID NO: 1212621 - RNA, 21 nt, Mycobacterium bovis subsp bovis AF2122/97
cuacgaaggccuauucagcua

SEQ ID NO: 1212622 - RNA, 20 nt, Mycobacterium bovis subsp bovis AF2122/97
cuaaccacuguuucugagcg

SEQ ID NO: 1212623 - RNA, 20 nt, Mycobacterium bovis subsp bovis AF2122/97
cuagcgccucgccggccacc

SEQ ID NO: 1212624 - RNA, 11 nt, Mycobacterium bovis subsp bovis AF2122/97
cuagcgcggcg

SEQ ID NO: 1212625 - RNA, 21 nt, Mycobacterium bovis subsp bovis AF2122/97
cuagcgguggaaaaagcccga

SEQ ID NO: 1212626 - RNA, 12 nt, Mycobacterium bovis subsp bovis AF2122/97
cuagcagcagcc

SEQ ID NO: 1212627 - RNA, 21 nt, Mycobacterium bovis subsp bovis AF2122/97
cuagcagcagcccgacagugg

SEQ ID NO: 1212628 - RNA, 19 nt, Mycobacterium bovis subsp bovis AF2122/97
cuagcacggggaccgggcu

SEQ ID NO: 1212629 - RNA, 20 nt, Mycobacterium bovis subsp bovis AF2122/97
cuagcuuggcggccagcgug

SEQ ID NO: 1212630 - RNA, 20 nt, Mycobacterium bovis subsp bovis AF2122/97
cuaggcaccagcggaucgca

SEQ ID NO: 1212631 - RNA, 15 nt, Mycobacterium bovis subsp bovis AF2122/97
cuaggcgcuccuuca

SEQ ID NO: 1212632 - RNA, 14 nt, Mycobacterium bovis subsp bovis AF2122/97
cuaggcccagcacg

SEQ ID NO: 1212633 - RNA, 14 nt, Mycobacterium bovis subsp bovis AF2122/97
cuaggccggccgga

SEQ ID NO: 1212634 - RNA, 13 nt, Mycobacterium bovis subsp bovis AF2122/97
cuaggccagcacg

SEQ ID NO: 1212635 - RNA, 16 nt, Mycobacterium bovis subsp bovis AF2122/97
cuaggccagcacggcg

SEQ ID NO: 1212636 - RNA, 16 nt, Mycobacterium bovis subsp bovis AF2122/97
cuaggcaugccacaca

SEQ ID NO: 1212637 - RNA, 14 nt, Mycobacterium bovis subsp bovis AF2122/97
cuaggccucagaac

SEQ ID NO: 1212638 - RNA, 16 nt, Mycobacterium bovis subsp bovis AF2122/97
cuaggccucagaaccg

SEQ ID NO: 1212639 - RNA, 15 nt, Mycobacterium bovis subsp bovis AF2122/97
cuacuuuuccacccg

SEQ ID NO: 1212640 - RNA, 20 nt, Mycobacterium bovis subsp bovis AF2122/97
cuagauauggaccgccgccg

SEQ ID NO: 1212641 - RNA, 23 nt, Mycobacterium bovis subsp bovis AF2122/97
cuauaucccgccccgggccacca

SEQ ID NO: 1212642 - RNA, 14 nt, Mycobacterium bovis subsp bovis AF2122/97
cuagggugagcccg

SEQ ID NO: 1212643 - RNA, 14 nt, Mycobacterium bovis subsp bovis AF2122/97
cuagggcagcagcc

SEQ ID NO: 1212644 - RNA, 15 nt, Mycobacterium bovis subsp bovis AF2122/97
cuagggcagcagccc

SEQ ID NO: 1212645 - RNA, 17 nt, Mycobacterium bovis subsp bovis AF2122/97
cuagguccgaucgugug

SEQ ID NO: 1212646 - RNA, 16 nt, Mycobacterium bovis subsp bovis AF2122/97
cuaggugacgccgcca

SEQ ID NO: 1212647 - RNA, 17 nt, Mycobacterium bovis subsp bovis AF2122/97
cuaggucgcgcugaagg

SEQ ID NO: 1212648 - RNA, 23 nt, Mycobacterium bovis subsp bovis AF2122/97
cuaucguugugcggacaucaccg

SEQ ID NO: 1212649 - RNA, 14 nt, Mycobacterium bovis subsp bovis AF2122/97
cuaucgacaacaug

SEQ ID NO: 1212650 - RNA, 16 nt, Mycobacterium bovis subsp bovis AF2122/97
cucacauccugguuga

SEQ ID NO: 1212651 - RNA, 16 nt, Mycobacterium bovis subsp bovis AF2122/97
cucacauuggccaggu

SEQ ID NO: 1212652 - RNA, 21 nt, Mycobacterium bovis subsp bovis AF2122/97
cucacccgagccaucaccgca

SEQ ID NO: 1212653 - RNA, 14 nt, Mycobacterium bovis subsp bovis AF2122/97
cucacccgcccgga

SEQ ID NO: 1212654 - RNA, 19 nt, Mycobacterium bovis subsp bovis AF2122/97
cucacccggcgucucgcag

SEQ ID NO: 1212655 - RNA, 16 nt, Mycobacterium bovis subsp bovis AF2122/97
cucaagucucccggcc

SEQ ID NO: 1212656 - RNA, 22 nt, Mycobacterium bovis subsp bovis AF2122/97
cucaccgcacaccugcgcggcg

SEQ ID NO: 1212657 - RNA, 20 nt, Mycobacterium bovis subsp bovis AF2122/97
cucaccgcgcaucaucgccc

SEQ ID NO: 1212658 - RNA, 20 nt, Mycobacterium bovis subsp bovis AF2122/97
cucaccggcgcccagcgccu

SEQ ID NO: 1212659 - RNA, 17 nt, Mycobacterium bovis subsp bovis AF2122/97
cucaccggcuggugcca

SEQ ID NO: 1212660 - RNA, 20 nt, Mycobacterium bovis subsp bovis AF2122/97
cucaccggcuggugccaacu

SEQ ID NO: 1212661 - RNA, 20 nt, Mycobacterium bovis subsp bovis AF2122/97
cucaccgugaaccgcccgcc

SEQ ID NO: 1212662 - RNA, 22 nt, Mycobacterium bovis subsp bovis AF2122/97
cucaccucggcuuugccgcugu

SEQ ID NO: 1212663 - RNA, 19 nt, Mycobacterium bovis subsp bovis AF2122/97
cucaccuuccucgaaaucg

SEQ ID NO: 1212664 - RNA, 23 nt, Mycobacterium bovis subsp bovis AF2122/97
cucacgaggcacaaucaccgccg

SEQ ID NO: 1212665 - RNA, 13 nt, Mycobacterium bovis subsp bovis AF2122/97
cucacgaccggcc

SEQ ID NO: 1212666 - RNA, 13 nt, Mycobacterium bovis subsp bovis AF2122/97
cucacgacgccgu

SEQ ID NO: 1212667 - RNA, 14 nt, Mycobacterium bovis subsp bovis AF2122/97
cucacgcagcgcca

SEQ ID NO: 1212668 - RNA, 23 nt, Mycobacterium bovis subsp bovis AF2122/97
cucacguuugaggaccuugccgg

SEQ ID NO: 1212669 - RNA, 14 nt, Mycobacterium bovis subsp bovis AF2122/97
cucaacaccagcaa

SEQ ID NO: 1212670 - RNA, 15 nt, Mycobacterium bovis subsp bovis AF2122/97
cucaacaccaggccg

SEQ ID NO: 1212671 - RNA, 14 nt, Mycobacterium bovis subsp bovis AF2122/97
cucaacacccggcc

SEQ ID NO: 1212672 - RNA, 18 nt, Mycobacterium bovis subsp bovis AF2122/97
cucaacacccggccgacc

SEQ ID NO: 1212673 - RNA, 13 nt, Mycobacterium bovis subsp bovis AF2122/97
cucaaccagcaga

SEQ ID NO: 1212674 - RNA, 18 nt, Mycobacterium bovis subsp bovis AF2122/97
cucaacgacaccauaggc

SEQ ID NO: 1212675 - RNA, 13 nt, Mycobacterium bovis subsp bovis AF2122/97
cucaacgggccgc

SEQ ID NO: 1212676 - RNA, 22 nt, Mycobacterium bovis subsp bovis AF2122/97
cucaacggcgacaucggcccga

SEQ ID NO: 1212677 - RNA, 13 nt, Mycobacterium bovis subsp bovis AF2122/97
cucaacggcggca

SEQ ID NO: 1212678 - RNA, 22 nt, Mycobacterium bovis subsp bovis AF2122/97
cucaagcaauggugcggucugg

SEQ ID NO: 1212679 - RNA, 15 nt, Mycobacterium bovis subsp bovis AF2122/97
cucaagauuuccauc

SEQ ID NO: 1212680 - RNA, 20 nt, Mycobacterium bovis subsp bovis AF2122/97
cucaagggcaucaaccaacu

SEQ ID NO: 1212681 - RNA, 19 nt, Mycobacterium bovis subsp bovis AF2122/97
cucaagggacacccgcuuu

SEQ ID NO: 1212682 - RNA, 13 nt, Mycobacterium bovis subsp bovis AF2122/97
cucaucgcagacg

SEQ ID NO: 1212683 - RNA, 22 nt, Mycobacterium bovis subsp bovis AF2122/97
cucaucccgacccuucgggcug

SEQ ID NO: 1212684 - RNA, 15 nt, Mycobacterium bovis subsp bovis AF2122/97
cucauccgccgggcc

SEQ ID NO: 1212685 - RNA, 17 nt, Mycobacterium bovis subsp bovis AF2122/97
cucaucggcgugcuugc

SEQ ID NO: 1212686 - RNA, 21 nt, Mycobacterium bovis subsp bovis AF2122/97
cucaucggccgcggucggcca

SEQ ID NO: 1212687 - RNA, 17 nt, Mycobacterium bovis subsp bovis AF2122/97
cucaucggacagcgccu

SEQ ID NO: 1212688 - RNA, 15 nt, Mycobacterium bovis subsp bovis AF2122/97
cucaucgcgcccgcc

SEQ ID NO: 1212689 - RNA, 16 nt, Mycobacterium bovis subsp bovis AF2122/97
cucaucgcggucgcca

SEQ ID NO: 1212690 - RNA, 18 nt, Mycobacterium bovis subsp bovis AF2122/97
cucaucgcggucgccacc

SEQ ID NO: 1212691 - RNA, 24 nt, Mycobacterium bovis subsp bovis AF2122/97
cucaugaugccggacgccaugccc

SEQ ID NO: 1212692 - RNA, 15 nt, Mycobacterium bovis subsp bovis AF2122/97
cucauagugcagguc

SEQ ID NO: 1212693 - RNA, 23 nt, Mycobacterium bovis subsp bovis AF2122/97
cucaucaaacccccggggcgcuc

SEQ ID NO: 1212694 - RNA, 20 nt, Mycobacterium bovis subsp bovis AF2122/97
cucagguacggcgggcggcc

SEQ ID NO: 1212695 - RNA, 18 nt, Mycobacterium bovis subsp bovis AF2122/97
cucaggucaccggccgcc

SEQ ID NO: 1212696 - RNA, 12 nt, Mycobacterium bovis subsp bovis AF2122/97
cucaggucaucg

SEQ ID NO: 1212697 - RNA, 19 nt, Mycobacterium bovis subsp bovis AF2122/97
cucaggucgacaggugcca

SEQ ID NO: 1212698 - RNA, 17 nt, Mycobacterium bovis subsp bovis AF2122/97
cucaggucgcagaccag

SEQ ID NO: 1212699 - RNA, 13 nt, Mycobacterium bovis subsp bovis AF2122/97
cucagaccggaaa

SEQ ID NO: 1212700 - RNA, 18 nt, Mycobacterium bovis subsp bovis AF2122/97
cucacuggugacccugau

SEQ ID NO: 1212701 - RNA, 22 nt, Mycobacterium bovis subsp bovis AF2122/97
cucacucgccgaaucgcugacc

SEQ ID NO: 1212702 - RNA, 23 nt, Mycobacterium bovis subsp bovis AF2122/97
cucauaccgggaggacaccagcu

SEQ ID NO: 1212703 - RNA, 16 nt, Mycobacterium bovis subsp bovis AF2122/97
cucagucacgcacucc

SEQ ID NO: 1212704 - RNA, 17 nt, Mycobacterium bovis subsp bovis AF2122/97
cucagugaugcgccccg

SEQ ID NO: 1212705 - RNA, 18 nt, Mycobacterium bovis subsp bovis AF2122/97
cuccgccguugccgccgc

SEQ ID NO: 1212706 - RNA, 13 nt, Mycobacterium bovis subsp bovis AF2122/97
cuccgccugcccc

SEQ ID NO: 1212707 - RNA, 23 nt, Mycobacterium bovis subsp bovis AF2122/97
cuccgccguugacgccguugcca

SEQ ID NO: 1212708 - RNA, 22 nt, Mycobacterium bovis subsp bovis AF2122/97
cuccgccggguuggcgccggcc

SEQ ID NO: 1212709 - RNA, 23 nt, Mycobacterium bovis subsp bovis AF2122/97
cuccgccggguuggcgccggcca

SEQ ID NO: 1212710 - RNA, 24 nt, Mycobacterium bovis subsp bovis AF2122/97
cuccgccggguuggcgccggccag

SEQ ID NO: 1212711 - RNA, 21 nt, Mycobacterium bovis subsp bovis AF2122/97
cuccgccggucccgcgugcca

SEQ ID NO: 1212712 - RNA, 21 nt, Mycobacterium bovis subsp bovis AF2122/97
cuccgccgcgaucuccuuggc

SEQ ID NO: 1212713 - RNA, 23 nt, Mycobacterium bovis subsp bovis AF2122/97
cuccgccgcgggcuccccggcaa

SEQ ID NO: 1212714 - RNA, 15 nt, Mycobacterium bovis subsp bovis AF2122/97
cuccgcggcgcagca

SEQ ID NO: 1212715 - RNA, 23 nt, Mycobacterium bovis subsp bovis AF2122/97
cuccggauaacccagcggcgcca

SEQ ID NO: 1212716 - RNA, 15 nt, Mycobacterium bovis subsp bovis AF2122/97
cuccgcgagcccggc

SEQ ID NO: 1212717 - RNA, 16 nt, Mycobacterium bovis subsp bovis AF2122/97
cuccgccaaggaggcc

SEQ ID NO: 1212718 - RNA, 18 nt, Mycobacterium bovis subsp bovis AF2122/97
cuccgaugccgacggcgc

SEQ ID NO: 1212719 - RNA, 23 nt, Mycobacterium bovis subsp bovis AF2122/97
cuccgcagcgaagaccagcggcg

SEQ ID NO: 1212720 - RNA, 12 nt, Mycobacterium bovis subsp bovis AF2122/97
cucccugggcgu

SEQ ID NO: 1212721 - RNA, 16 nt, Mycobacterium bovis subsp bovis AF2122/97
cucccuuccgcgcuuc

SEQ ID NO: 1212722 - RNA, 14 nt, Mycobacterium bovis subsp bovis AF2122/97
cucccgcgcgggcg

SEQ ID NO: 1212723 - RNA, 15 nt, Mycobacterium bovis subsp bovis AF2122/97
cucccgcgcgggcgg

SEQ ID NO: 1212724 - RNA, 14 nt, Mycobacterium bovis subsp bovis AF2122/97
cucccgcgccggcg

SEQ ID NO: 1212725 - RNA, 18 nt, Mycobacterium bovis subsp bovis AF2122/97
cucccgcgguacgggggu

SEQ ID NO: 1212726 - RNA, 21 nt, Mycobacterium bovis subsp bovis AF2122/97
cucccucgaucacggcggccc

SEQ ID NO: 1212727 - RNA, 22 nt, Mycobacterium bovis subsp bovis AF2122/97
cucccugcacccagccgugccc

SEQ ID NO: 1212728 - RNA, 15 nt, Mycobacterium bovis subsp bovis AF2122/97
cucccaagaaggaca

SEQ ID NO: 1212729 - RNA, 20 nt, Mycobacterium bovis subsp bovis AF2122/97
cuccaugacaaaccugcaug

SEQ ID NO: 1212730 - RNA, 11 nt, Mycobacterium bovis subsp bovis AF2122/97
cucccagccca

SEQ ID NO: 1212731 - RNA, 22 nt, Mycobacterium bovis subsp bovis AF2122/97
cuccagguccacauccagggug

SEQ ID NO: 1212732 - RNA, 15 nt, Mycobacterium bovis subsp bovis AF2122/97
cuccaggguccggac

SEQ ID NO: 1212733 - RNA, 15 nt, Mycobacterium bovis subsp bovis AF2122/97
cuccagggcccugcu

SEQ ID NO: 1212734 - RNA, 13 nt, Mycobacterium bovis subsp bovis AF2122/97
cuccaggcccggc

SEQ ID NO: 1212735 - RNA, 14 nt, Mycobacterium bovis subsp bovis AF2122/97
cuccaggcgcgccg

SEQ ID NO: 1212736 - RNA, 15 nt, Mycobacterium bovis subsp bovis AF2122/97
cuccaguagccggug

SEQ ID NO: 1212737 - RNA, 21 nt, Mycobacterium bovis subsp bovis AF2122/97
cuccaguagccggugccggcg

SEQ ID NO: 1212738 - RNA, 12 nt, Mycobacterium bovis subsp bovis AF2122/97
cuccagugcggc

SEQ ID NO: 1212739 - RNA, 20 nt, Mycobacterium bovis subsp bovis AF2122/97
cuccaguccuaucagugagc

SEQ ID NO: 1212740 - RNA, 20 nt, Mycobacterium bovis subsp bovis AF2122/97
cuccaguggcgccagggccu

SEQ ID NO: 1212741 - RNA, 16 nt, Mycobacterium bovis subsp bovis AF2122/97
cuccaucgucggcaac

SEQ ID NO: 1212742 - RNA, 23 nt, Mycobacterium bovis subsp bovis AF2122/97
cuccaucgcgacaucgguggcgg

SEQ ID NO: 1212743 - RNA, 13 nt, Mycobacterium bovis subsp bovis AF2122/97
cuccaucaacugc

SEQ ID NO: 1212744 - RNA, 13 nt, Mycobacterium bovis subsp bovis AF2122/97
cuccaucagcgcg

SEQ ID NO: 1212745 - RNA, 20 nt, Mycobacterium bovis subsp bovis AF2122/97
cuccagcucggccagugccg

SEQ ID NO: 1212746 - RNA, 18 nt, Mycobacterium bovis subsp bovis AF2122/97
cuccagcugcgcgggcga

SEQ ID NO: 1212747 - RNA, 23 nt, Mycobacterium bovis subsp bovis AF2122/97
cuccagcuugccgaccugcgcga

SEQ ID NO: 1212748 - RNA, 17 nt, Mycobacterium bovis subsp bovis AF2122/97
cuccagcucgaacaggu

SEQ ID NO: 1212749 - RNA, 19 nt, Mycobacterium bovis subsp bovis AF2122/97
cuccagcgcgcgccgcagc

SEQ ID NO: 1212750 - RNA, 14 nt, Mycobacterium bovis subsp bovis AF2122/97
cucaugccgagcga

SEQ ID NO: 1212751 - RNA, 19 nt, Mycobacterium bovis subsp bovis AF2122/97
cucaugucgggcaacuuca

SEQ ID NO: 1212752 - RNA, 15 nt, Mycobacterium bovis subsp bovis AF2122/97
cuccucgcgggcggc

SEQ ID NO: 1212753 - RNA, 15 nt, Mycobacterium bovis subsp bovis AF2122/97
cuccucggcaggccg

SEQ ID NO: 1212754 - RNA, 21 nt, Mycobacterium bovis subsp bovis AF2122/97
cuccucgucgguuccgggcgc

SEQ ID NO: 1212755 - RNA, 20 nt, Mycobacterium bovis subsp bovis AF2122/97
cuccucgucgcucccgguug

SEQ ID NO: 1212756 - RNA, 17 nt, Mycobacterium bovis subsp bovis AF2122/97
cuccucgugcacgcaca

SEQ ID NO: 1212757 - RNA, 21 nt, Mycobacterium bovis subsp bovis AF2122/97
cuccggccgcacgccuacgau

SEQ ID NO: 1212758 - RNA, 22 nt, Mycobacterium bovis subsp bovis AF2122/97
cuccggcaccuccagcaccacc

SEQ ID NO: 1212759 - RNA, 19 nt, Mycobacterium bovis subsp bovis AF2122/97
cuccucgauagcggcgccu

SEQ ID NO: 1212760 - RNA, 22 nt, Mycobacterium bovis subsp bovis AF2122/97
cuccucgaccagagccgcgagc

SEQ ID NO: 1212761 - RNA, 13 nt, Mycobacterium bovis subsp bovis AF2122/97
cuccggcgccacc

SEQ ID NO: 1212762 - RNA, 20 nt, Mycobacterium bovis subsp bovis AF2122/97
cuccggcgcaccugggcugc

SEQ ID NO: 1212763 - RNA, 22 nt, Mycobacterium bovis subsp bovis AF2122/97
cuccggcgcaccugggcugccg

SEQ ID NO: 1212764 - RNA, 18 nt, Mycobacterium bovis subsp bovis AF2122/97
cuccugcacacaggacuu

SEQ ID NO: 1212765 - RNA, 23 nt, Mycobacterium bovis subsp bovis AF2122/97
cuccugcagcccgggcagcacca

SEQ ID NO: 1212766 - RNA, 13 nt, Mycobacterium bovis subsp bovis AF2122/97
cuccugcccuccg

SEQ ID NO: 1212767 - RNA, 19 nt, Mycobacterium bovis subsp bovis AF2122/97
cuccugagaugcggccaug

SEQ ID NO: 1212768 - RNA, 18 nt, Mycobacterium bovis subsp bovis AF2122/97
cuccuggcgaaugucgcu

SEQ ID NO: 1212769 - RNA, 11 nt, Mycobacterium bovis subsp bovis AF2122/97
cuccugcucgu

SEQ ID NO: 1212770 - RNA, 16 nt, Mycobacterium bovis subsp bovis AF2122/97
cuccuggcaaccgaau

SEQ ID NO: 1212771 - RNA, 15 nt, Mycobacterium bovis subsp bovis AF2122/97
cuccugcggcaccgc

SEQ ID NO: 1212772 - RNA, 18 nt, Mycobacterium bovis subsp bovis AF2122/97
cuccugcguccagaucuc

SEQ ID NO: 1212773 - RNA, 18 nt, Mycobacterium bovis subsp bovis AF2122/97
cuccugcuggcccugcuc

SEQ ID NO: 1212774 - RNA, 16 nt, Mycobacterium bovis subsp bovis AF2122/97
cucgagcaugcccagc

SEQ ID NO: 1212775 - RNA, 17 nt, Mycobacterium bovis subsp bovis AF2122/97
cucgagcaggcgcacca

SEQ ID NO: 1212776 - RNA, 16 nt, Mycobacterium bovis subsp bovis AF2122/97
cucgagucgcagcacg

SEQ ID NO: 1212777 - RNA, 23 nt, Mycobacterium bovis subsp bovis AF2122/97
cucgauaucguuggcgaccaccg

SEQ ID NO: 1212778 - RNA, 21 nt, Mycobacterium bovis subsp bovis AF2122/97
cucgaguggaucauguucggc

SEQ ID NO: 1212779 - RNA, 19 nt, Mycobacterium bovis subsp bovis AF2122/97
cucgaguccaggcagcuug

SEQ ID NO: 1212780 - RNA, 14 nt, Mycobacterium bovis subsp bovis AF2122/97
cucgagucgcagca

SEQ ID NO: 1212781 - RNA, 16 nt, Mycobacterium bovis subsp bovis AF2122/97
cucgacgcgcaucgca

SEQ ID NO: 1212782 - RNA, 14 nt, Mycobacterium bovis subsp bovis AF2122/97
cucgaccagcgccg

SEQ ID NO: 1212783 - RNA, 18 nt, Mycobacterium bovis subsp bovis AF2122/97
cucgaccaaguugaccuu

SEQ ID NO: 1212784 - RNA, 17 nt, Mycobacterium bovis subsp bovis AF2122/97
cucgaccaccgccggcc

SEQ ID NO: 1212785 - RNA, 12 nt, Mycobacterium bovis subsp bovis AF2122/97
cucgacggcucc

SEQ ID NO: 1212786 - RNA, 16 nt, Mycobacterium bovis subsp bovis AF2122/97
cucgaccaggaccggc

SEQ ID NO: 1212787 - RNA, 20 nt, Mycobacterium bovis subsp bovis AF2122/97
cucgagcaagaucaccuucg

SEQ ID NO: 1212788 - RNA, 16 nt, Mycobacterium bovis subsp bovis AF2122/97
cucgagcagcgcgccg

SEQ ID NO: 1212789 - RNA, 14 nt, Mycobacterium bovis subsp bovis AF2122/97
cuccuugagccggg

SEQ ID NO: 1212790 - RNA, 15 nt, Mycobacterium bovis subsp bovis AF2122/97
cuccuugagcuucuc

SEQ ID NO: 1212791 - RNA, 22 nt, Mycobacterium bovis subsp bovis AF2122/97
cuccuugagcaaugacccgcgg

SEQ ID NO: 1212792 - RNA, 15 nt, Mycobacterium bovis subsp bovis AF2122/97
cucgaaguuggcuuu

SEQ ID NO: 1212793 - RNA, 19 nt, Mycobacterium bovis subsp bovis AF2122/97
cucgaaacgcuuacccagc

SEQ ID NO: 1212794 - RNA, 23 nt, Mycobacterium bovis subsp bovis AF2122/97
cuccuugggcgacgcggcgccgc

SEQ ID NO: 1212795 - RNA, 22 nt, Mycobacterium bovis subsp bovis AF2122/97
cucgaauugguaaugcaccagg

SEQ ID NO: 1212796 - RNA, 16 nt, Mycobacterium bovis subsp bovis AF2122/97
cuccuugugccugcug

SEQ ID NO: 1212797 - RNA, 20 nt, Mycobacterium bovis subsp bovis AF2122/97
cucgaaucgucacggacccu

SEQ ID NO: 1212798 - RNA, 23 nt, Mycobacterium bovis subsp bovis AF2122/97
cucgaucaucaugucggcgcagg

SEQ ID NO: 1212799 - RNA, 16 nt, Mycobacterium bovis subsp bovis AF2122/97
cucgaucacggcggcc

SEQ ID NO: 1212800 - RNA, 19 nt, Mycobacterium bovis subsp bovis AF2122/97
cucgaucacggcggccccg

SEQ ID NO: 1212801 - RNA, 14 nt, Mycobacterium bovis subsp bovis AF2122/97
cucgaucagcgccg

SEQ ID NO: 1212802 - RNA, 15 nt, Mycobacterium bovis subsp bovis AF2122/97
cucgauccacugccg

SEQ ID NO: 1212803 - RNA, 21 nt, Mycobacterium bovis subsp bovis AF2122/97
cucgauccgcaacaacgccgc

SEQ ID NO: 1212804 - RNA, 16 nt, Mycobacterium bovis subsp bovis AF2122/97
cucgauccgcagaaug

SEQ ID NO: 1212805 - RNA, 21 nt, Mycobacterium bovis subsp bovis AF2122/97
cucgauccggauucagaucuc

SEQ ID NO: 1212806 - RNA, 19 nt, Mycobacterium bovis subsp bovis AF2122/97
cucgaucuugggccacgcu

SEQ ID NO: 1212807 - RNA, 21 nt, Mycobacterium bovis subsp bovis AF2122/97
cucgaucuggucaagacccgc

SEQ ID NO: 1212808 - RNA, 15 nt, Mycobacterium bovis subsp bovis AF2122/97
cucgcguggccgccg

SEQ ID NO: 1212809 - RNA, 19 nt, Mycobacterium bovis subsp bovis AF2122/97
cucgcguccucggggaggu

SEQ ID NO: 1212810 - RNA, 18 nt, Mycobacterium bovis subsp bovis AF2122/97
cucgcuucaggcaccgga

SEQ ID NO: 1212811 - RNA, 17 nt, Mycobacterium bovis subsp bovis AF2122/97
cucggaaacggaccucc

SEQ ID NO: 1212812 - RNA, 20 nt, Mycobacterium bovis subsp bovis AF2122/97
cucggccagcgucagcuguu

SEQ ID NO: 1212813 - RNA, 12 nt, Mycobacterium bovis subsp bovis AF2122/97
cucggccacgaa

SEQ ID NO: 1212814 - RNA, 22 nt, Mycobacterium bovis subsp bovis AF2122/97
cucggccaccagcgcccggccc

SEQ ID NO: 1212815 - RNA, 13 nt, Mycobacterium bovis subsp bovis AF2122/97
cucggccagccag

SEQ ID NO: 1212816 - RNA, 13 nt, Mycobacterium bovis subsp bovis AF2122/97
cucggccagcacg

SEQ ID NO: 1212817 - RNA, 17 nt, Mycobacterium bovis subsp bovis AF2122/97
cucggccgugaccgagc

SEQ ID NO: 1212818 - RNA, 21 nt, Mycobacterium bovis subsp bovis AF2122/97
cucggccgugaccgagccgcg

SEQ ID NO: 1212819 - RNA, 14 nt, Mycobacterium bovis subsp bovis AF2122/97
cucggccggcggcg

SEQ ID NO: 1212820 - RNA, 16 nt, Mycobacterium bovis subsp bovis AF2122/97
cucggccgcaccagca

SEQ ID NO: 1212821 - RNA, 20 nt, Mycobacterium bovis subsp bovis AF2122/97
cucggccgccagccccaccc

SEQ ID NO: 1212822 - RNA, 22 nt, Mycobacterium bovis subsp bovis AF2122/97
cucggccaucagaaccuccucg

SEQ ID NO: 1212823 - RNA, 18 nt, Mycobacterium bovis subsp bovis AF2122/97
cucggcccggcaggacuu

SEQ ID NO: 1212824 - RNA, 17 nt, Mycobacterium bovis subsp bovis AF2122/97
cucggcccagcgcgcca

SEQ ID NO: 1212825 - RNA, 18 nt, Mycobacterium bovis subsp bovis AF2122/97
cucggccaccagcgcccg

SEQ ID NO: 1212826 - RNA, 13 nt, Mycobacterium bovis subsp bovis AF2122/97
cucggccaccagc

SEQ ID NO: 1212827 - RNA, 16 nt, Mycobacterium bovis subsp bovis AF2122/97
cucggcauccaggcug

SEQ ID NO: 1212828 - RNA, 19 nt, Mycobacterium bovis subsp bovis AF2122/97
cucggcaugcagccccacu

SEQ ID NO: 1212829 - RNA, 15 nt, Mycobacterium bovis subsp bovis AF2122/97
cucggcaaccaccuc

SEQ ID NO: 1212830 - RNA, 23 nt, Mycobacterium bovis subsp bovis AF2122/97
cucggcaaccaccucgugggcca

SEQ ID NO: 1212831 - RNA, 12 nt, Mycobacterium bovis subsp bovis AF2122/97
cucggcaccaca

SEQ ID NO: 1212832 - RNA, 15 nt, Mycobacterium bovis subsp bovis AF2122/97
cucggcacggaccgc

SEQ ID NO: 1212833 - RNA, 18 nt, Mycobacterium bovis subsp bovis AF2122/97
cucggcaggaaggacauc

SEQ ID NO: 1212834 - RNA, 18 nt, Mycobacterium bovis subsp bovis AF2122/97
cucggaucggcucgccac

SEQ ID NO: 1212835 - RNA, 19 nt, Mycobacterium bovis subsp bovis AF2122/97
cucgggcaaggccaccggc

SEQ ID NO: 1212836 - RNA, 14 nt, Mycobacterium bovis subsp bovis AF2122/97
cucgggcaaugucg

SEQ ID NO: 1212837 - RNA, 22 nt, Mycobacterium bovis subsp bovis AF2122/97
cucgggcagcgcggccagugcu

SEQ ID NO: 1212838 - RNA, 19 nt, Mycobacterium bovis subsp bovis AF2122/97
cucgggacucccgcgcggg

SEQ ID NO: 1212839 - RNA, 12 nt, Mycobacterium bovis subsp bovis AF2122/97
cucgggccagau

SEQ ID NO: 1212840 - RNA, 12 nt, Mycobacterium bovis subsp bovis AF2122/97
cucgggcagcuu

SEQ ID NO: 1212841 - RNA, 19 nt, Mycobacterium bovis subsp bovis AF2122/97
cucgggcagcuucaacacc

SEQ ID NO: 1212842 - RNA, 18 nt, Mycobacterium bovis subsp bovis AF2122/97
cucgggcaggccccacug

SEQ ID NO: 1212843 - RNA, 12 nt, Mycobacterium bovis subsp bovis AF2122/97
cucgggcggcuu

SEQ ID NO: 1212844 - RNA, 23 nt, Mycobacterium bovis subsp bovis AF2122/97
cucgggcgcugaugcgcugggcc

SEQ ID NO: 1212845 - RNA, 20 nt, Mycobacterium bovis subsp bovis AF2122/97
cucggucggcagcuccagca

SEQ ID NO: 1212846 - RNA, 22 nt, Mycobacterium bovis subsp bovis AF2122/97
cucggucgaugcucagugccaa

SEQ ID NO: 1212847 - RNA, 20 nt, Mycobacterium bovis subsp bovis AF2122/97
cucgggcaggcggccagcga

SEQ ID NO: 1212848 - RNA, 13 nt, Mycobacterium bovis subsp bovis AF2122/97
cucggucccgccg

SEQ ID NO: 1212849 - RNA, 22 nt, Mycobacterium bovis subsp bovis AF2122/97
cucggugaagauuccaugcgac

SEQ ID NO: 1212850 - RNA, 21 nt, Mycobacterium bovis subsp bovis AF2122/97
cucggugacaagcggcccgcu

SEQ ID NO: 1212851 - RNA, 15 nt, Mycobacterium bovis subsp bovis AF2122/97
cucggugaacgccgc

SEQ ID NO: 1212852 - RNA, 18 nt, Mycobacterium bovis subsp bovis AF2122/97
cucggcgaccugcucgcu

SEQ ID NO: 1212853 - RNA, 14 nt, Mycobacterium bovis subsp bovis AF2122/97
cucggcgaccuggc

SEQ ID NO: 1212854 - RNA, 14 nt, Mycobacterium bovis subsp bovis AF2122/97
cucggcgacugcgu

SEQ ID NO: 1212855 - RNA, 13 nt, Mycobacterium bovis subsp bovis AF2122/97
cucggccuggaug

SEQ ID NO: 1212856 - RNA, 14 nt, Mycobacterium bovis subsp bovis AF2122/97
cucggcgagcucag

SEQ ID NO: 1212857 - RNA, 17 nt, Mycobacterium bovis subsp bovis AF2122/97
cucggcgaguucggcag

SEQ ID NO: 1212858 - RNA, 20 nt, Mycobacterium bovis subsp bovis AF2122/97
cucggcgaguucggcagcgg

SEQ ID NO: 1212859 - RNA, 15 nt, Mycobacterium bovis subsp bovis AF2122/97
cucggcugcucgacg

SEQ ID NO: 1212860 - RNA, 23 nt, Mycobacterium bovis subsp bovis AF2122/97
cucggcugcucgacggcuccgau

SEQ ID NO: 1212861 - RNA, 17 nt, Mycobacterium bovis subsp bovis AF2122/97
cucggcuuugccgcugu

SEQ ID NO: 1212862 - RNA, 14 nt, Mycobacterium bovis subsp bovis AF2122/97
cucgucgccccguu

SEQ ID NO: 1212863 - RNA, 18 nt, Mycobacterium bovis subsp bovis AF2122/97
cucgucgagguccucguc

SEQ ID NO: 1212864 - RNA, 23 nt, Mycobacterium bovis subsp bovis AF2122/97
cucgucgaggaagaucaccuccc

SEQ ID NO: 1212865 - RNA, 18 nt, Mycobacterium bovis subsp bovis AF2122/97
cucgucgaacauggcacg

SEQ ID NO: 1212866 - RNA, 17 nt, Mycobacterium bovis subsp bovis AF2122/97
cucguccaggucggccg

SEQ ID NO: 1212867 - RNA, 15 nt, Mycobacterium bovis subsp bovis AF2122/97
cucguccagcaaccu

SEQ ID NO: 1212868 - RNA, 16 nt, Mycobacterium bovis subsp bovis AF2122/97
cucguccagcagugcg

SEQ ID NO: 1212869 - RNA, 16 nt, Mycobacterium bovis subsp bovis AF2122/97
cucguccaagccggcc

SEQ ID NO: 1212870 - RNA, 21 nt, Mycobacterium bovis subsp bovis AF2122/97
cucguccaccacaccugcggc

SEQ ID NO: 1212871 - RNA, 13 nt, Mycobacterium bovis subsp bovis AF2122/97
cucguccagcaac

SEQ ID NO: 1212872 - RNA, 14 nt, Mycobacterium bovis subsp bovis AF2122/97
cucguccagcaacc

SEQ ID NO: 1212873 - RNA, 16 nt, Mycobacterium bovis subsp bovis AF2122/97
cucggugaccaggccg

SEQ ID NO: 1212874 - RNA, 14 nt, Mycobacterium bovis subsp bovis AF2122/97
cucggugacgauga

SEQ ID NO: 1212875 - RNA, 18 nt, Mycobacterium bovis subsp bovis AF2122/97
cucguagaaucggcucag

SEQ ID NO: 1212876 - RNA, 17 nt, Mycobacterium bovis subsp bovis AF2122/97
cucguagacuugcugcu

SEQ ID NO: 1212877 - RNA, 16 nt, Mycobacterium bovis subsp bovis AF2122/97
cucguagagcaccgca

SEQ ID NO: 1212878 - RNA, 21 nt, Mycobacterium bovis subsp bovis AF2122/97
cucguaggugccgaagaugac

SEQ ID NO: 1212879 - RNA, 23 nt, Mycobacterium bovis subsp bovis AF2122/97
cucgucacccgguguccagugca

SEQ ID NO: 1212880 - RNA, 20 nt, Mycobacterium bovis subsp bovis AF2122/97
cucucagcacgguuguugua

SEQ ID NO: 1212881 - RNA, 18 nt, Mycobacterium bovis subsp bovis AF2122/97
cucuccuggaaaggacgg

SEQ ID NO: 1212882 - RNA, 14 nt, Mycobacterium bovis subsp bovis AF2122/97
cucuccccuggccc

SEQ ID NO: 1212883 - RNA, 19 nt, Mycobacterium bovis subsp bovis AF2122/97
cucuccguccucgucccag

SEQ ID NO: 1212884 - RNA, 19 nt, Mycobacterium bovis subsp bovis AF2122/97
cucuccggugaucaccgac

SEQ ID NO: 1212885 - RNA, 21 nt, Mycobacterium bovis subsp bovis AF2122/97
cucgucgccgguggcacccgc

SEQ ID NO: 1212886 - RNA, 15 nt, Mycobacterium bovis subsp bovis AF2122/97
cucgucgcgucgcca

SEQ ID NO: 1212887 - RNA, 23 nt, Mycobacterium bovis subsp bovis AF2122/97
cucgucgcgggccaccgcuguca

SEQ ID NO: 1212888 - RNA, 15 nt, Mycobacterium bovis subsp bovis AF2122/97
cucgucgcugcccau

SEQ ID NO: 1212889 - RNA, 14 nt, Mycobacterium bovis subsp bovis AF2122/97
cucgucggccaccg

SEQ ID NO: 1212890 - RNA, 14 nt, Mycobacterium bovis subsp bovis AF2122/97
cucgucggccagug

SEQ ID NO: 1212891 - RNA, 21 nt, Mycobacterium bovis subsp bovis AF2122/97
cucgucggcgauggccagcac

SEQ ID NO: 1212892 - RNA, 19 nt, Mycobacterium bovis subsp bovis AF2122/97
cucgucggcgacggccagc

SEQ ID NO: 1212893 - RNA, 14 nt, Mycobacterium bovis subsp bovis AF2122/97
cucuaugcgggcag

SEQ ID NO: 1212894 - RNA, 22 nt, Mycobacterium bovis subsp bovis AF2122/97
cucugcgagcguggacuugagu

SEQ ID NO: 1212895 - RNA, 15 nt, Mycobacterium bovis subsp bovis AF2122/97
cucugcgccacagca

SEQ ID NO: 1212896 - RNA, 22 nt, Mycobacterium bovis subsp bovis AF2122/97
cucugccacgcguuccuccagc

SEQ ID NO: 1212897 - RNA, 20 nt, Mycobacterium bovis subsp bovis AF2122/97
cucugagcgggcgggccugc

SEQ ID NO: 1212898 - RNA, 14 nt, Mycobacterium bovis subsp bovis AF2122/97
cucugaccagccgg

SEQ ID NO: 1212899 - RNA, 23 nt, Mycobacterium bovis subsp bovis AF2122/97
cucuccuggaaaggacggccggc

SEQ ID NO: 1212900 - RNA, 18 nt, Mycobacterium bovis subsp bovis AF2122/97
cucucgcuuagcgucgcu

SEQ ID NO: 1212901 - RNA, 17 nt, Mycobacterium bovis subsp bovis AF2122/97
cucucggucugcaugcg

SEQ ID NO: 1212902 - RNA, 19 nt, Mycobacterium bovis subsp bovis AF2122/97
cucucguggauggccgcca

SEQ ID NO: 1212903 - RNA, 21 nt, Mycobacterium bovis subsp bovis AF2122/97
cucucggugaacgccgccccg

SEQ ID NO: 1212904 - RNA, 14 nt, Mycobacterium bovis subsp bovis AF2122/97
cucucugcgccagg

SEQ ID NO: 1212905 - RNA, 15 nt, Mycobacterium bovis subsp bovis AF2122/97
cucucugcgccaggc

SEQ ID NO: 1212906 - RNA, 15 nt, Mycobacterium bovis subsp bovis AF2122/97
cucucuucgcgcgcu

SEQ ID NO: 1212907 - RNA, 23 nt, Mycobacterium bovis subsp bovis AF2122/97
cucucugucgcguuguggcugaa

SEQ ID NO: 1212908 - RNA, 14 nt, Mycobacterium bovis subsp bovis AF2122/97
cucuugcaaccugg

SEQ ID NO: 1212909 - RNA, 14 nt, Mycobacterium bovis subsp bovis AF2122/97
cucuugcgggcagc

SEQ ID NO: 1212910 - RNA, 16 nt, Mycobacterium bovis subsp bovis AF2122/97
cucuucgggugcagcc

SEQ ID NO: 1212911 - RNA, 23 nt, Mycobacterium bovis subsp bovis AF2122/97
cucuucgcgcgcugggcgcgcuc

SEQ ID NO: 1212912 - RNA, 13 nt, Mycobacterium bovis subsp bovis AF2122/97
cucuucgcgcgcu

SEQ ID NO: 1212913 - RNA, 20 nt, Mycobacterium bovis subsp bovis AF2122/97
cucuuccuggcgugagccga

SEQ ID NO: 1212914 - RNA, 20 nt, Mycobacterium bovis subsp bovis AF2122/97
cucuucagcuaccuccgcca

SEQ ID NO: 1212915 - RNA, 12 nt, Mycobacterium bovis subsp bovis AF2122/97
cucuucaggccc

SEQ ID NO: 1212916 - RNA, 23 nt, Mycobacterium bovis subsp bovis AF2122/97
cucugguuuuacacaccagcggu

SEQ ID NO: 1212917 - RNA, 17 nt, Mycobacterium bovis subsp bovis AF2122/97
cucugucuucagcugcg

SEQ ID NO: 1212918 - RNA, 19 nt, Mycobacterium bovis subsp bovis AF2122/97
cucugucuucagcugcgga

SEQ ID NO: 1212919 - RNA, 23 nt, Mycobacterium bovis subsp bovis AF2122/97
cucuggcgagggcuaccggcgcc

SEQ ID NO: 1212920 - RNA, 22 nt, Mycobacterium bovis subsp bovis AF2122/97
cucuggauucuucagcgcggca

SEQ ID NO: 1212921 - RNA, 20 nt, Mycobacterium bovis subsp bovis AF2122/97
cugaacaguugcacaccggc

SEQ ID NO: 1212922 - RNA, 20 nt, Mycobacterium bovis subsp bovis AF2122/97
cugaacacgaauccggccac

SEQ ID NO: 1212923 - RNA, 15 nt, Mycobacterium bovis subsp bovis AF2122/97
cugaacacgcagccg

SEQ ID NO: 1212924 - RNA, 21 nt, Mycobacterium bovis subsp bovis AF2122/97
cugaaaucgguggccaccacc

SEQ ID NO: 1212925 - RNA, 23 nt, Mycobacterium bovis subsp bovis AF2122/97
cugaaccgguugacacccgggcc

SEQ ID NO: 1212926 - RNA, 19 nt, Mycobacterium bovis subsp bovis AF2122/97
cugaaccggccgcgacgac

SEQ ID NO: 1212927 - RNA, 16 nt, Mycobacterium bovis subsp bovis AF2122/97
cugaacgguuucuuuc

SEQ ID NO: 1212928 - RNA, 13 nt, Mycobacterium bovis subsp bovis AF2122/97
cugaacugguugg

SEQ ID NO: 1212929 - RNA, 19 nt, Mycobacterium bovis subsp bovis AF2122/97
cugaagccagcgcagcacc

SEQ ID NO: 1212930 - RNA, 15 nt, Mycobacterium bovis subsp bovis AF2122/97
cugaagagcggagcc

SEQ ID NO: 1212931 - RNA, 14 nt, Mycobacterium bovis subsp bovis AF2122/97
cucuuuuagccaca

SEQ ID NO: 1212932 - RNA, 16 nt, Mycobacterium bovis subsp bovis AF2122/97
cugacgcggccgggcg

SEQ ID NO: 1212933 - RNA, 12 nt, Mycobacterium bovis subsp bovis AF2122/97
cugacgcugcag

SEQ ID NO: 1212934 - RNA, 22 nt, Mycobacterium bovis subsp bovis AF2122/97
cugacggaaguacuccauggca

SEQ ID NO: 1212935 - RNA, 19 nt, Mycobacterium bovis subsp bovis AF2122/97
cugaccuucaggcccugcc

SEQ ID NO: 1212936 - RNA, 21 nt, Mycobacterium bovis subsp bovis AF2122/97
cugacgaaggucuccggcaag

SEQ ID NO: 1212937 - RNA, 17 nt, Mycobacterium bovis subsp bovis AF2122/97
cugacgcccuccuggcg

SEQ ID NO: 1212938 - RNA, 11 nt, Mycobacterium bovis subsp bovis AF2122/97
cugacggccau

SEQ ID NO: 1212939 - RNA, 15 nt, Mycobacterium bovis subsp bovis AF2122/97
cugagcagcgcggcc

SEQ ID NO: 1212940 - RNA, 23 nt, Mycobacterium bovis subsp bovis AF2122/97
cugagcagcgcggccagagccgc

SEQ ID NO: 1212941 - RNA, 23 nt, Mycobacterium bovis subsp bovis AF2122/97
cugagcacguucaccgcgcgcuc

SEQ ID NO: 1212942 - RNA, 18 nt, Mycobacterium bovis subsp bovis AF2122/97
cugagacagaccgggccc

SEQ ID NO: 1212943 - RNA, 22 nt, Mycobacterium bovis subsp bovis AF2122/97
cugagacagaccgggcccggcg

SEQ ID NO: 1212944 - RNA, 24 nt, Mycobacterium bovis subsp bovis AF2122/97
cugaccagccuuaugcagugacag

SEQ ID NO: 1212945 - RNA, 15 nt, Mycobacterium bovis subsp bovis AF2122/97
cugaccaucacaccc

SEQ ID NO: 1212946 - RNA, 13 nt, Mycobacterium bovis subsp bovis AF2122/97
cugaccacgguag

SEQ ID NO: 1212947 - RNA, 17 nt, Mycobacterium bovis subsp bovis AF2122/97
cugaccacgucggacag

SEQ ID NO: 1212948 - RNA, 21 nt, Mycobacterium bovis subsp bovis AF2122/97
cugaccaacucguggaacucc

SEQ ID NO: 1212949 - RNA, 22 nt, Mycobacterium bovis subsp bovis AF2122/97
cugaccucgucaaucaccaccg

SEQ ID NO: 1212950 - RNA, 18 nt, Mycobacterium bovis subsp bovis AF2122/97
cugaccccgccggcugcg

SEQ ID NO: 1212951 - RNA, 15 nt, Mycobacterium bovis subsp bovis AF2122/97
cugaccccggcagcg

SEQ ID NO: 1212952 - RNA, 14 nt, Mycobacterium bovis subsp bovis AF2122/97
cugaccgugcugaa

SEQ ID NO: 1212953 - RNA, 18 nt, Mycobacterium bovis subsp bovis AF2122/97
cugacccaccgccccggc

SEQ ID NO: 1212954 - RNA, 18 nt, Mycobacterium bovis subsp bovis AF2122/97
cugacccccugacggcau

SEQ ID NO: 1212955 - RNA, 20 nt, Mycobacterium bovis subsp bovis AF2122/97
cugaagguggcgaacccggu

SEQ ID NO: 1212956 - RNA, 18 nt, Mycobacterium bovis subsp bovis AF2122/97
cugacaacgacaacaccc

SEQ ID NO: 1212957 - RNA, 17 nt, Mycobacterium bovis subsp bovis AF2122/97
cugacaccgaaccgccg

SEQ ID NO: 1212958 - RNA, 20 nt, Mycobacterium bovis subsp bovis AF2122/97
cugacaccgaaccgccgcug

SEQ ID NO: 1212959 - RNA, 17 nt, Mycobacterium bovis subsp bovis AF2122/97
cugacauuuccaccacg

SEQ ID NO: 1212960 - RNA, 18 nt, Mycobacterium bovis subsp bovis AF2122/97
cugacacgcccgcgagcu

SEQ ID NO: 1212961 - RNA, 16 nt, Mycobacterium bovis subsp bovis AF2122/97
cugacacccgcagcug

SEQ ID NO: 1212962 - RNA, 21 nt, Mycobacterium bovis subsp bovis AF2122/97
cugaaggccgguagcgcgggu

SEQ ID NO: 1212963 - RNA, 19 nt, Mycobacterium bovis subsp bovis AF2122/97
cugaagcuuguccagauau

SEQ ID NO: 1212964 - RNA, 19 nt, Mycobacterium bovis subsp bovis AF2122/97
cugaagggcaagaacccgg

SEQ ID NO: 1212965 - RNA, 22 nt, Mycobacterium bovis subsp bovis AF2122/97
cugaagcggacccgacagccgc

SEQ ID NO: 1212966 - RNA, 13 nt, Mycobacterium bovis subsp bovis AF2122/97
cugaagcccgaca

SEQ ID NO: 1212967 - RNA, 17 nt, Mycobacterium bovis subsp bovis AF2122/97
cugagccgcaucuggcc

SEQ ID NO: 1212968 - RNA, 11 nt, Mycobacterium bovis subsp bovis AF2122/97
cugagcccgcc

SEQ ID NO: 1212969 - RNA, 22 nt, Mycobacterium bovis subsp bovis AF2122/97
cugagucgguucagccacgcag

SEQ ID NO: 1212970 - RNA, 20 nt, Mycobacterium bovis subsp bovis AF2122/97
cugagccgcucaucgauccc

SEQ ID NO: 1212971 - RNA, 18 nt, Mycobacterium bovis subsp bovis AF2122/97
cugagccaccaacaccgc

SEQ ID NO: 1212972 - RNA, 18 nt, Mycobacterium bovis subsp bovis AF2122/97
cugagucugauggccucg

SEQ ID NO: 1212973 - RNA, 12 nt, Mycobacterium bovis subsp bovis AF2122/97
cugaucaaggcg

SEQ ID NO: 1212974 - RNA, 22 nt, Mycobacterium bovis subsp bovis AF2122/97
cugaucaagugccagcguggug

SEQ ID NO: 1212975 - RNA, 16 nt, Mycobacterium bovis subsp bovis AF2122/97
cugauccgccugccga

SEQ ID NO: 1212976 - RNA, 21 nt, Mycobacterium bovis subsp bovis AF2122/97
cugauccacgauaucgaugcg

SEQ ID NO: 1212977 - RNA, 15 nt, Mycobacterium bovis subsp bovis AF2122/97
cugaucggcuucuuc

SEQ ID NO: 1212978 - RNA, 23 nt, Mycobacterium bovis subsp bovis AF2122/97
cugaucgguccggcgaacugcga

SEQ ID NO: 1212979 - RNA, 20 nt, Mycobacterium bovis subsp bovis AF2122/97
cugaucgaccgccuccucga

SEQ ID NO: 1212980 - RNA, 16 nt, Mycobacterium bovis subsp bovis AF2122/97
cugaucccggccaggc

SEQ ID NO: 1212981 - RNA, 18 nt, Mycobacterium bovis subsp bovis AF2122/97
cugaucccggccaggccg

SEQ ID NO: 1212982 - RNA, 13 nt, Mycobacterium bovis subsp bovis AF2122/97
cugauugaagccc

SEQ ID NO: 1212983 - RNA, 14 nt, Mycobacterium bovis subsp bovis AF2122/97
cugauugaagcccc

SEQ ID NO: 1212984 - RNA, 16 nt, Mycobacterium bovis subsp bovis AF2122/97
cugauuggcccaccgc

SEQ ID NO: 1212985 - RNA, 23 nt, Mycobacterium bovis subsp bovis AF2122/97
cugaucuuggagaagguuucccg

SEQ ID NO: 1212986 - RNA, 14 nt, Mycobacterium bovis subsp bovis AF2122/97
cugaugcgcugggc

SEQ ID NO: 1212987 - RNA, 18 nt, Mycobacterium bovis subsp bovis AF2122/97
cugaugcgcugggccagg

SEQ ID NO: 1212988 - RNA, 12 nt, Mycobacterium bovis subsp bovis AF2122/97
cugaugccuggu

SEQ ID NO: 1212989 - RNA, 21 nt, Mycobacterium bovis subsp bovis AF2122/97
cugcaaccuucgugucuauga

SEQ ID NO: 1212990 - RNA, 23 nt, Mycobacterium bovis subsp bovis AF2122/97
cugcaacgauugaacucugguga

SEQ ID NO: 1212991 - RNA, 20 nt, Mycobacterium bovis subsp bovis AF2122/97
cugcaagcuaagcgccugau

SEQ ID NO: 1212992 - RNA, 22 nt, Mycobacterium bovis subsp bovis AF2122/97
cugcaaggaauuccggcugcuu

SEQ ID NO: 1212993 - RNA, 22 nt, Mycobacterium bovis subsp bovis AF2122/97
cugcugcuugacuccgcgcgcu

SEQ ID NO: 1212994 - RNA, 17 nt, Mycobacterium bovis subsp bovis AF2122/97
cugcuggaucucggugg

SEQ ID NO: 1212995 - RNA, 11 nt, Mycobacterium bovis subsp bovis AF2122/97
cugcuggaugu

SEQ ID NO: 1212996 - RNA, 13 nt, Mycobacterium bovis subsp bovis AF2122/97
cugcuggcccugc

SEQ ID NO: 1212997 - RNA, 18 nt, Mycobacterium bovis subsp bovis AF2122/97
cugcuggcccugcuccuc

SEQ ID NO: 1212998 - RNA, 18 nt, Mycobacterium bovis subsp bovis AF2122/97
cuggaccacagccgcgcc

SEQ ID NO: 1212999 - RNA, 23 nt, Mycobacterium bovis subsp bovis AF2122/97
cuggacaacggcggucugguugu

SEQ ID NO: 1213000 - RNA, 15 nt, Mycobacterium bovis subsp bovis AF2122/97
cuggacaagcuccuc

SEQ ID NO: 1213001 - RNA, 17 nt, Mycobacterium bovis subsp bovis AF2122/97
cuggaaagggccgccgc

SEQ ID NO: 1213002 - RNA, 15 nt, Mycobacterium bovis subsp bovis AF2122/97
cuggaaagggccgcc

SEQ ID NO: 1213003 - RNA, 23 nt, Mycobacterium bovis subsp bovis AF2122/97
cugcuuugccuuagcccggccgc

SEQ ID NO: 1213004 - RNA, 14 nt, Mycobacterium bovis subsp bovis AF2122/97
cuggacgucggcga

SEQ ID NO: 1213005 - RNA, 20 nt, Mycobacterium bovis subsp bovis AF2122/97
cuggacggucauccggccgu

SEQ ID NO: 1213006 - RNA, 15 nt, Mycobacterium bovis subsp bovis AF2122/97
cuggacggcgggccg

SEQ ID NO: 1213007 - RNA, 15 nt, Mycobacterium bovis subsp bovis AF2122/97
cuggacggggaagcc

SEQ ID NO: 1213008 - RNA, 17 nt, Mycobacterium bovis subsp bovis AF2122/97
cuggacucuucagcuac

SEQ ID NO: 1213009 - RNA, 22 nt, Mycobacterium bovis subsp bovis AF2122/97
cuggacucuucagcuaccuccg

SEQ ID NO: 1213010 - RNA, 17 nt, Mycobacterium bovis subsp bovis AF2122/97
cuggacugcagcccugc

SEQ ID NO: 1213011 - RNA, 15 nt, Mycobacterium bovis subsp bovis AF2122/97
cuggacugcagcgcc

SEQ ID NO: 1213012 - RNA, 20 nt, Mycobacterium bovis subsp bovis AF2122/97
cuggagaaaccacuggaugg

SEQ ID NO: 1213013 - RNA, 18 nt, Mycobacterium bovis subsp bovis AF2122/97
cuggacggaucuggaugu

SEQ ID NO: 1213014 - RNA, 16 nt, Mycobacterium bovis subsp bovis AF2122/97
cuggacccgcauggcg

SEQ ID NO: 1213015 - RNA, 20 nt, Mycobacterium bovis subsp bovis AF2122/97
cuggaucgcgcccugagcca

SEQ ID NO: 1213016 - RNA, 14 nt, Mycobacterium bovis subsp bovis AF2122/97
cuggaucaacccgg

SEQ ID NO: 1213017 - RNA, 15 nt, Mycobacterium bovis subsp bovis AF2122/97
cuggaucgugagcuu

SEQ ID NO: 1213018 - RNA, 21 nt, Mycobacterium bovis subsp bovis AF2122/97
cuggccacucccagccaaccc

SEQ ID NO: 1213019 - RNA, 23 nt, Mycobacterium bovis subsp bovis AF2122/97
cuggccacucacauuggccaggu

SEQ ID NO: 1213020 - RNA, 15 nt, Mycobacterium bovis subsp bovis AF2122/97
cuggccacucacauu

SEQ ID NO: 1213021 - RNA, 21 nt, Mycobacterium bovis subsp bovis AF2122/97
cuggccagguugccgucggcc

SEQ ID NO: 1213022 - RNA, 20 nt, Mycobacterium bovis subsp bovis AF2122/97
cuggcaucccgggcagucca

SEQ ID NO: 1213023 - RNA, 22 nt, Mycobacterium bovis subsp bovis AF2122/97
cuggcaaaguaucgcagcaucu

SEQ ID NO: 1213024 - RNA, 16 nt, Mycobacterium bovis subsp bovis AF2122/97
cuggcaacgccgcgcc

SEQ ID NO: 1213025 - RNA, 16 nt, Mycobacterium bovis subsp bovis AF2122/97
cugcucgucggcgccg

SEQ ID NO: 1213026 - RNA, 13 nt, Mycobacterium bovis subsp bovis AF2122/97
cugcucgucgguc

SEQ ID NO: 1213027 - RNA, 23 nt, Mycobacterium bovis subsp bovis AF2122/97
cugcucgucggucaccgaaugcg

SEQ ID NO: 1213028 - RNA, 14 nt, Mycobacterium bovis subsp bovis AF2122/97
cugcucgugagccc

SEQ ID NO: 1213029 - RNA, 14 nt, Mycobacterium bovis subsp bovis AF2122/97
cugcucgucggcca

SEQ ID NO: 1213030 - RNA, 17 nt, Mycobacterium bovis subsp bovis AF2122/97
cugcucgucggccaccg

SEQ ID NO: 1213031 - RNA, 15 nt, Mycobacterium bovis subsp bovis AF2122/97
cugcucguccacccc

SEQ ID NO: 1213032 - RNA, 18 nt, Mycobacterium bovis subsp bovis AF2122/97
cugcucgagagcaugguc

SEQ ID NO: 1213033 - RNA, 19 nt, Mycobacterium bovis subsp bovis AF2122/97
cugcuccgcagcagacucc

SEQ ID NO: 1213034 - RNA, 15 nt, Mycobacterium bovis subsp bovis AF2122/97
cugcuccgcugucac

SEQ ID NO: 1213035 - RNA, 19 nt, Mycobacterium bovis subsp bovis AF2122/97
cugcugcggcagcgcggcc

SEQ ID NO: 1213036 - RNA, 19 nt, Mycobacterium bovis subsp bovis AF2122/97
cugcugccguggcggcagc

SEQ ID NO: 1213037 - RNA, 22 nt, Mycobacterium bovis subsp bovis AF2122/97
cugcugccgaccuuccguuggc

SEQ ID NO: 1213038 - RNA, 16 nt, Mycobacterium bovis subsp bovis AF2122/97
cugcugccguggcggc

SEQ ID NO: 1213039 - RNA, 20 nt, Mycobacterium bovis subsp bovis AF2122/97
cugcugccauugccgauggu

SEQ ID NO: 1213040 - RNA, 23 nt, Mycobacterium bovis subsp bovis AF2122/97
cugcugcagggccuggccacacu

SEQ ID NO: 1213041 - RNA, 15 nt, Mycobacterium bovis subsp bovis AF2122/97
cugcugccagccgaa

SEQ ID NO: 1213042 - RNA, 13 nt, Mycobacterium bovis subsp bovis AF2122/97
cugcugcagggcc

SEQ ID NO: 1213043 - RNA, 15 nt, Mycobacterium bovis subsp bovis AF2122/97
cugcugcagcaauug

SEQ ID NO: 1213044 - RNA, 13 nt, Mycobacterium bovis subsp bovis AF2122/97
cugcugcagccug

SEQ ID NO: 1213045 - RNA, 16 nt, Mycobacterium bovis subsp bovis AF2122/97
cugcugcagcgaugcg

SEQ ID NO: 1213046 - RNA, 15 nt, Mycobacterium bovis subsp bovis AF2122/97
cugcugaacaaccag

SEQ ID NO: 1213047 - RNA, 19 nt, Mycobacterium bovis subsp bovis AF2122/97
cugcugaaauccuagggug

SEQ ID NO: 1213048 - RNA, 19 nt, Mycobacterium bovis subsp bovis AF2122/97
cugcugcacaucgcaucca

SEQ ID NO: 1213049 - RNA, 22 nt, Mycobacterium bovis subsp bovis AF2122/97
aaacucacccgagccaucaccg

SEQ ID NO: 1213050 - RNA, 19 nt, Mycobacterium bovis subsp bovis AF2122/97
cugcucuuuuagccacaau

SEQ ID NO: 1213051 - RNA, 22 nt, Mycobacterium bovis subsp bovis AF2122/97
cugcgcguuugguuuucccggc

SEQ ID NO: 1213052 - RNA, 21 nt, Mycobacterium bovis subsp bovis AF2122/97
cugcgcgugggcacagccaug

SEQ ID NO: 1213053 - RNA, 18 nt, Mycobacterium bovis subsp bovis AF2122/97
cugcggcucgcugaucug

SEQ ID NO: 1213054 - RNA, 12 nt, Mycobacterium bovis subsp bovis AF2122/97
cugcggcuuuca

SEQ ID NO: 1213055 - RNA, 13 nt, Mycobacterium bovis subsp bovis AF2122/97
cugcggugcgggc

SEQ ID NO: 1213056 - RNA, 15 nt, Mycobacterium bovis subsp bovis AF2122/97
cugcggugccacggu

SEQ ID NO: 1213057 - RNA, 12 nt, Mycobacterium bovis subsp bovis AF2122/97
cugcggcggcuu

SEQ ID NO: 1213058 - RNA, 21 nt, Mycobacterium bovis subsp bovis AF2122/97
cugcggcggcuuuggccgccg

SEQ ID NO: 1213059 - RNA, 19 nt, Mycobacterium bovis subsp bovis AF2122/97
cugcucacgcagcagugcg

SEQ ID NO: 1213060 - RNA, 20 nt, Mycobacterium bovis subsp bovis AF2122/97
cugcuauugguugaggaggu

SEQ ID NO: 1213061 - RNA, 14 nt, Mycobacterium bovis subsp bovis AF2122/97
cugcguugggaucc

SEQ ID NO: 1213062 - RNA, 22 nt, Mycobacterium bovis subsp bovis AF2122/97
cugcguugggaucccagcgcag

SEQ ID NO: 1213063 - RNA, 16 nt, Mycobacterium bovis subsp bovis AF2122/97
cugcgccacagcagcg

SEQ ID NO: 1213064 - RNA, 19 nt, Mycobacterium bovis subsp bovis AF2122/97
cugcgccgccacagcaccc

SEQ ID NO: 1213065 - RNA, 22 nt, Mycobacterium bovis subsp bovis AF2122/97
cugcgccgauacccagcggguc

SEQ ID NO: 1213066 - RNA, 22 nt, Mycobacterium bovis subsp bovis AF2122/97
cugcgccgggucuguccaaugc

SEQ ID NO: 1213067 - RNA, 17 nt, Mycobacterium bovis subsp bovis AF2122/97
cugcgcccacccgcgcc

SEQ ID NO: 1213068 - RNA, 14 nt, Mycobacterium bovis subsp bovis AF2122/97
cugcgcccauagcu

SEQ ID NO: 1213069 - RNA, 17 nt, Mycobacterium bovis subsp bovis AF2122/97
cugcgcccauagcugcc

SEQ ID NO: 1213070 - RNA, 19 nt, Mycobacterium bovis subsp bovis AF2122/97
cugcgccgaacaccacacc

SEQ ID NO: 1213071 - RNA, 18 nt, Mycobacterium bovis subsp bovis AF2122/97
cugcgccgaacgcuccag

SEQ ID NO: 1213072 - RNA, 19 nt, Mycobacterium bovis subsp bovis AF2122/97
cugcgcccguccgcgcgcc

SEQ ID NO: 1213073 - RNA, 21 nt, Mycobacterium bovis subsp bovis AF2122/97
cugcgcgcccaccgggcggcg

SEQ ID NO: 1213074 - RNA, 17 nt, Mycobacterium bovis subsp bovis AF2122/97
cugcgcgcggccgcgcu

SEQ ID NO: 1213075 - RNA, 16 nt, Mycobacterium bovis subsp bovis AF2122/97
cugcgcgucgagcagc

SEQ ID NO: 1213076 - RNA, 15 nt, Mycobacterium bovis subsp bovis AF2122/97
cugcgcgucaggcca

SEQ ID NO: 1213077 - RNA, 15 nt, Mycobacterium bovis subsp bovis AF2122/97
cugcgcggcugccgu

SEQ ID NO: 1213078 - RNA, 18 nt, Mycobacterium bovis subsp bovis AF2122/97
cugcgcgcguugcgguca

SEQ ID NO: 1213079 - RNA, 18 nt, Mycobacterium bovis subsp bovis AF2122/97
cugcgccgucgcagccag

SEQ ID NO: 1213080 - RNA, 16 nt, Mycobacterium bovis subsp bovis AF2122/97
cugcgcgaaggggacg

SEQ ID NO: 1213081 - RNA, 18 nt, Mycobacterium bovis subsp bovis AF2122/97
cugcgcgauccgcgcgca

SEQ ID NO: 1213082 - RNA, 21 nt, Mycobacterium bovis subsp bovis AF2122/97
cugcgccuucgccagcggcgc

SEQ ID NO: 1213083 - RNA, 15 nt, Mycobacterium bovis subsp bovis AF2122/97
cugcgccgucgcagc

SEQ ID NO: 1213084 - RNA, 23 nt, Mycobacterium bovis subsp bovis AF2122/97
cugcgccgucaacaccauggugg

SEQ ID NO: 1213085 - RNA, 19 nt, Mycobacterium bovis subsp bovis AF2122/97
cugcgccguucgcuccccc

SEQ ID NO: 1213086 - RNA, 21 nt, Mycobacterium bovis subsp bovis AF2122/97
cugcgccguucgcucccccgc

SEQ ID NO: 1213087 - RNA, 14 nt, Mycobacterium bovis subsp bovis AF2122/97
cugcgccuaacccc

SEQ ID NO: 1213088 - RNA, 21 nt, Mycobacterium bovis subsp bovis AF2122/97
cugcgccucggcggccagcuc

SEQ ID NO: 1213089 - RNA, 21 nt, Mycobacterium bovis subsp bovis AF2122/97
cugccgguagcacagcagcaa

SEQ ID NO: 1213090 - RNA, 14 nt, Mycobacterium bovis subsp bovis AF2122/97
cugccgguggcggc

SEQ ID NO: 1213091 - RNA, 21 nt, Mycobacterium bovis subsp bovis AF2122/97
cugccguugauucggccgccg

SEQ ID NO: 1213092 - RNA, 17 nt, Mycobacterium bovis subsp bovis AF2122/97
cugccguggcggcagcg

SEQ ID NO: 1213093 - RNA, 19 nt, Mycobacterium bovis subsp bovis AF2122/97
cugccucggggccuaucaa

SEQ ID NO: 1213094 - RNA, 22 nt, Mycobacterium bovis subsp bovis AF2122/97
cugccucgccugcacgcccggc

SEQ ID NO: 1213095 - RNA, 17 nt, Mycobacterium bovis subsp bovis AF2122/97
cugccuccggaaggcuc

SEQ ID NO: 1213096 - RNA, 16 nt, Mycobacterium bovis subsp bovis AF2122/97
cugccgggggcccgac

SEQ ID NO: 1213097 - RNA, 20 nt, Mycobacterium bovis subsp bovis AF2122/97
cugccgcagcucagcauccc

SEQ ID NO: 1213098 - RNA, 17 nt, Mycobacterium bovis subsp bovis AF2122/97
cugccgcacgggcccag

SEQ ID NO: 1213099 - RNA, 21 nt, Mycobacterium bovis subsp bovis AF2122/97
cugccgcacgggcccaggaca

SEQ ID NO: 1213100 - RNA, 18 nt, Mycobacterium bovis subsp bovis AF2122/97
cugcgcaauagcgacagc

SEQ ID NO: 1213101 - RNA, 17 nt, Mycobacterium bovis subsp bovis AF2122/97
cugcgcaaccgagcggu

SEQ ID NO: 1213102 - RNA, 18 nt, Mycobacterium bovis subsp bovis AF2122/97
cugcgcaaccgagcgguc

SEQ ID NO: 1213103 - RNA, 15 nt, Mycobacterium bovis subsp bovis AF2122/97
cugcgcaaauuugaa

SEQ ID NO: 1213104 - RNA, 16 nt, Mycobacterium bovis subsp bovis AF2122/97
cugcgaucgcgagcga

SEQ ID NO: 1213105 - RNA, 14 nt, Mycobacterium bovis subsp bovis AF2122/97
cugcgaucggccgc

SEQ ID NO: 1213106 - RNA, 16 nt, Mycobacterium bovis subsp bovis AF2122/97
cugcgaucggccgccg

SEQ ID NO: 1213107 - RNA, 21 nt, Mycobacterium bovis subsp bovis AF2122/97
cugcgcagaaucgccugcgac

SEQ ID NO: 1213108 - RNA, 22 nt, Mycobacterium bovis subsp bovis AF2122/97
cugcgcagguggucgaucaggu

SEQ ID NO: 1213109 - RNA, 20 nt, Mycobacterium bovis subsp bovis AF2122/97
cugcgcaucgguccaaagca

SEQ ID NO: 1213110 - RNA, 21 nt, Mycobacterium bovis subsp bovis AF2122/97
cugcgcagugaauugcccaag

SEQ ID NO: 1213111 - RNA, 23 nt, Mycobacterium bovis subsp bovis AF2122/97
cugcgcagugaauugcccaagcg

SEQ ID NO: 1213112 - RNA, 13 nt, Mycobacterium bovis subsp bovis AF2122/97
cugcgcaucacca

SEQ ID NO: 1213113 - RNA, 19 nt, Mycobacterium bovis subsp bovis AF2122/97
cugccuuacacgccuggcu

SEQ ID NO: 1213114 - RNA, 16 nt, Mycobacterium bovis subsp bovis AF2122/97
cugccuuaccaaccgg

SEQ ID NO: 1213115 - RNA, 15 nt, Mycobacterium bovis subsp bovis AF2122/97
cugccuuacacgccu

SEQ ID NO: 1213116 - RNA, 24 nt, Mycobacterium bovis subsp bovis AF2122/97
cugcgaucaacccuacccgcauga

SEQ ID NO: 1213117 - RNA, 15 nt, Mycobacterium bovis subsp bovis AF2122/97
cugccuucuaccgaa

SEQ ID NO: 1213118 - RNA, 15 nt, Mycobacterium bovis subsp bovis AF2122/97
cugccuucuccagag

SEQ ID NO: 1213119 - RNA, 16 nt, Mycobacterium bovis subsp bovis AF2122/97
cugccaaaagggcggc

SEQ ID NO: 1213120 - RNA, 15 nt, Mycobacterium bovis subsp bovis AF2122/97
cugcaugcccagaaa

SEQ ID NO: 1213121 - RNA, 14 nt, Mycobacterium bovis subsp bovis AF2122/97
cugcauccuccucg

SEQ ID NO: 1213122 - RNA, 23 nt, Mycobacterium bovis subsp bovis AF2122/97
cugcaucgucgccaagcccaggc

SEQ ID NO: 1213123 - RNA, 13 nt, Mycobacterium bovis subsp bovis AF2122/97
cugcauccuccuc

SEQ ID NO: 1213124 - RNA, 13 nt, Mycobacterium bovis subsp bovis AF2122/97
cugcacagcagcg

SEQ ID NO: 1213125 - RNA, 21 nt, Mycobacterium bovis subsp bovis AF2122/97
cugcacagcagcgucaucagg

SEQ ID NO: 1213126 - RNA, 12 nt, Mycobacterium bovis subsp bovis AF2122/97
cugcacaccacc

SEQ ID NO: 1213127 - RNA, 16 nt, Mycobacterium bovis subsp bovis AF2122/97
cugcacaccaccgccg

SEQ ID NO: 1213128 - RNA, 18 nt, Mycobacterium bovis subsp bovis AF2122/97
cugcagugacucgaucac

SEQ ID NO: 1213129 - RNA, 13 nt, Mycobacterium bovis subsp bovis AF2122/97
cugcagugaucgu

SEQ ID NO: 1213130 - RNA, 22 nt, Mycobacterium bovis subsp bovis AF2122/97
cugcccgaugaucugugccgcu

SEQ ID NO: 1213131 - RNA, 15 nt, Mycobacterium bovis subsp bovis AF2122/97
cugcccgccagcgcc

SEQ ID NO: 1213132 - RNA, 16 nt, Mycobacterium bovis subsp bovis AF2122/97
cugcccgccagcgccg

SEQ ID NO: 1213133 - RNA, 18 nt, Mycobacterium bovis subsp bovis AF2122/97
cugcccgccagcgccgcc

SEQ ID NO: 1213134 - RNA, 23 nt, Mycobacterium bovis subsp bovis AF2122/97
cugccgauguguggaacauccgc

SEQ ID NO: 1213135 - RNA, 14 nt, Mycobacterium bovis subsp bovis AF2122/97
cugcccagcaccac

SEQ ID NO: 1213136 - RNA, 13 nt, Mycobacterium bovis subsp bovis AF2122/97
cugcccagcaccc

SEQ ID NO: 1213137 - RNA, 16 nt, Mycobacterium bovis subsp bovis AF2122/97
cugcccacgggccggc

SEQ ID NO: 1213138 - RNA, 22 nt, Mycobacterium bovis subsp bovis AF2122/97
cugcccacgggccggccgagcg

SEQ ID NO: 1213139 - RNA, 21 nt, Mycobacterium bovis subsp bovis AF2122/97
cugccaucggcaccagcgcgc

SEQ ID NO: 1213140 - RNA, 17 nt, Mycobacterium bovis subsp bovis AF2122/97
cugcccagcagaccaag

SEQ ID NO: 1213141 - RNA, 13 nt, Mycobacterium bovis subsp bovis AF2122/97
cugccagccaugg

SEQ ID NO: 1213142 - RNA, 15 nt, Mycobacterium bovis subsp bovis AF2122/97
cugccagccauggcc

SEQ ID NO: 1213143 - RNA, 12 nt, Mycobacterium bovis subsp bovis AF2122/97
cugccagcaccc

SEQ ID NO: 1213144 - RNA, 20 nt, Mycobacterium bovis subsp bovis AF2122/97
cugccagcacccugauguga

SEQ ID NO: 1213145 - RNA, 19 nt, Mycobacterium bovis subsp bovis AF2122/97
cugccagaucggucggcca

SEQ ID NO: 1213146 - RNA, 23 nt, Mycobacterium bovis subsp bovis AF2122/97
cugccagaucggucggccaaagc

SEQ ID NO: 1213147 - RNA, 14 nt, Mycobacterium bovis subsp bovis AF2122/97
cugccaucaacagg

SEQ ID NO: 1213148 - RNA, 17 nt, Mycobacterium bovis subsp bovis AF2122/97
cugccaguucuuggcga

SEQ ID NO: 1213149 - RNA, 15 nt, Mycobacterium bovis subsp bovis AF2122/97
cugccagugccgccc

SEQ ID NO: 1213150 - RNA, 17 nt, Mycobacterium bovis subsp bovis AF2122/97
cugccagugccgcccac

SEQ ID NO: 1213151 - RNA, 15 nt, Mycobacterium bovis subsp bovis AF2122/97
cugccaaggccuuca

SEQ ID NO: 1213152 - RNA, 20 nt, Mycobacterium bovis subsp bovis AF2122/97
cugccaacgcccguguugaa

SEQ ID NO: 1213153 - RNA, 16 nt, Mycobacterium bovis subsp bovis AF2122/97
cugccaaugcugcagg

SEQ ID NO: 1213154 - RNA, 15 nt, Mycobacterium bovis subsp bovis AF2122/97
aaaaucgcccaauuc

SEQ ID NO: 1213155 - RNA, 18 nt, Mycobacterium bovis subsp bovis AF2122/97
aaacaaacccaacaccag

SEQ ID NO: 1213156 - RNA, 22 nt, Mycobacterium bovis subsp bovis AF2122/97
aaacaaacccaacaccagcagc

SEQ ID NO: 1213157 - RNA, 12 nt, Mycobacterium bovis subsp bovis AF2122/97
aaaagccagggc

SEQ ID NO: 1213158 - RNA, 17 nt, Mycobacterium bovis subsp bovis AF2122/97
aaaagcccgacacgaaa

SEQ ID NO: 1213159 - RNA, 23 nt, Mycobacterium bovis subsp bovis AF2122/97
aaaagaucuucgccgagaacgau

SEQ ID NO: 1213160 - RNA, 15 nt, Mycobacterium bovis subsp bovis AF2122/97
aaaaaccacccccac

SEQ ID NO: 1213161 - RNA, 22 nt, Mycobacterium bovis subsp bovis AF2122/97
aaacgcugcgcccggaccacug

SEQ ID NO: 1213162 - RNA, 20 nt, Mycobacterium bovis subsp bovis AF2122/97
aaacgccgucgccugcaagc

SEQ ID NO: 1213163 - RNA, 19 nt, Mycobacterium bovis subsp bovis AF2122/97
aaacgacagcccuaucagc

SEQ ID NO: 1213164 - RNA, 11 nt, Mycobacterium bovis subsp bovis AF2122/97
aaaccugggau

SEQ ID NO: 1213165 - RNA, 22 nt, Mycobacterium bovis subsp bovis AF2122/97
aaaccugcaugcccagaaaacc

SEQ ID NO: 1213166 - RNA, 23 nt, Mycobacterium bovis subsp bovis AF2122/97
aaaccucuucgggugcagccaga

SEQ ID NO: 1213167 - RNA, 16 nt, Mycobacterium bovis subsp bovis AF2122/97
aaacuccgugccgagc

SEQ ID NO: 1213168 - RNA, 18 nt, Mycobacterium bovis subsp bovis AF2122/97
aaacucaccagcaccccg

SEQ ID NO: 1213169 - RNA, 15 nt, Mycobacterium bovis subsp bovis AF2122/97
aaacuaauucuccug

SEQ ID NO: 1213170 - RNA, 17 nt, Mycobacterium bovis subsp bovis AF2122/97
aaacugccgcggcaccg

SEQ ID NO: 1213171 - RNA, 15 nt, Mycobacterium bovis subsp bovis AF2122/97
aaagagccagcggca

SEQ ID NO: 1213172 - RNA, 15 nt, Mycobacterium bovis subsp bovis AF2122/97
aaagccaacucgacc

SEQ ID NO: 1213173 - RNA, 19 nt, Mycobacterium bovis subsp bovis AF2122/97
aaagccagcgcagccaggc

SEQ ID NO: 1213174 - RNA, 17 nt, Mycobacterium bovis subsp bovis AF2122/97
aaagaucagcauggucc

SEQ ID NO: 1213175 - RNA, 15 nt, Mycobacterium bovis subsp bovis AF2122/97
aaaggacgucgaccu

SEQ ID NO: 1213176 - RNA, 16 nt, Mycobacterium bovis subsp bovis AF2122/97
aaagcccgacaugaau

SEQ ID NO: 1213177 - RNA, 16 nt, Mycobacterium bovis subsp bovis AF2122/97
aaagggccgccgcugg

SEQ ID NO: 1213178 - RNA, 22 nt, Mycobacterium bovis subsp bovis AF2122/97
aaagucaccguccacgacagca

SEQ ID NO: 1213179 - RNA, 21 nt, Mycobacterium bovis subsp bovis AF2122/97
aaaucaccucaccagucaggu

SEQ ID NO: 1213180 - RNA, 14 nt, Mycobacterium bovis subsp bovis AF2122/97
aaaucacaauucca

SEQ ID NO: 1213181 - RNA, 13 nt, Mycobacterium bovis subsp bovis AF2122/97
aaaucaagcacag

SEQ ID NO: 1213182 - RNA, 14 nt, Mycobacterium bovis subsp bovis AF2122/97
aaaucaagcacagc

SEQ ID NO: 1213183 - RNA, 15 nt, Mycobacterium bovis subsp bovis AF2122/97
aaaucaagcacagcc

SEQ ID NO: 1213184 - RNA, 21 nt, Mycobacterium bovis subsp bovis AF2122/97
aaaucaagcacagcccggcga

SEQ ID NO: 1213185 - RNA, 16 nt, Mycobacterium bovis subsp bovis AF2122/97
aaauaggccgggcagu

SEQ ID NO: 1213186 - RNA, 12 nt, Mycobacterium bovis subsp bovis AF2122/97
aaauaggacugc

SEQ ID NO: 1213187 - RNA, 15 nt, Mycobacterium bovis subsp bovis AF2122/97
aaauaggacugcgcc

SEQ ID NO: 1213188 - RNA, 22 nt, Mycobacterium bovis subsp bovis AF2122/97
aaauacuccgcgagcccggccu

SEQ ID NO: 1213189 - RNA, 18 nt, Mycobacterium bovis subsp bovis AF2122/97
aaaugccgggcccgacgu

SEQ ID NO: 1213190 - RNA, 16 nt, Mycobacterium bovis subsp bovis AF2122/97
augcaacgccaaaaug

SEQ ID NO: 1213191 - RNA, 10 nt, Mycobacterium bovis subsp bovis AF2122/97
augcaaugcu

SEQ ID NO: 1213192 - RNA, 20 nt, Mycobacterium bovis subsp bovis AF2122/97
augcaaggaaaagccuggcc

SEQ ID NO: 1213193 - RNA, 18 nt, Mycobacterium bovis subsp bovis AF2122/97
augcaagccgacaucggc

SEQ ID NO: 1213194 - RNA, 16 nt, Mycobacterium bovis subsp bovis AF2122/97
augauguccucccauc

SEQ ID NO: 1213195 - RNA, 18 nt, Mycobacterium bovis subsp bovis AF2122/97
augauggacaccagccag

SEQ ID NO: 1213196 - RNA, 16 nt, Mycobacterium bovis subsp bovis AF2122/97
augauguugaaacacc

SEQ ID NO: 1213197 - RNA, 17 nt, Mycobacterium bovis subsp bovis AF2122/97
augaugaccacauuggu

SEQ ID NO: 1213198 - RNA, 17 nt, Mycobacterium bovis subsp bovis AF2122/97
augaucucggcaaggac

SEQ ID NO: 1213199 - RNA, 14 nt, Mycobacterium bovis subsp bovis AF2122/97
augaucucaccacg

SEQ ID NO: 1213200 - RNA, 17 nt, Mycobacterium bovis subsp bovis AF2122/97
augagcaugcccagcgc

SEQ ID NO: 1213201 - RNA, 19 nt, Mycobacterium bovis subsp bovis AF2122/97
augccugcgcgaugcgauu

SEQ ID NO: 1213202 - RNA, 22 nt, Mycobacterium bovis subsp bovis AF2122/97
augccugcgaaacgcuggccac

SEQ ID NO: 1213203 - RNA, 16 nt, Mycobacterium bovis subsp bovis AF2122/97
augccugcccaccuuc

SEQ ID NO: 1213204 - RNA, 19 nt, Mycobacterium bovis subsp bovis AF2122/97
augccgcucggcaaccugc

SEQ ID NO: 1213205 - RNA, 21 nt, Mycobacterium bovis subsp bovis AF2122/97
augccgcgaucgugcagguug

SEQ ID NO: 1213206 - RNA, 10 nt, Mycobacterium bovis subsp bovis AF2122/97
augccgccgg

SEQ ID NO: 1213207 - RNA, 18 nt, Mycobacterium bovis subsp bovis AF2122/97
augcgccaggcugaagaa

SEQ ID NO: 1213208 - RNA, 14 nt, Mycobacterium bovis subsp bovis AF2122/97
augcgccaggcuga

SEQ ID NO: 1213209 - RNA, 18 nt, Mycobacterium bovis subsp bovis AF2122/97
augcgacgucaggguauc

SEQ ID NO: 1213210 - RNA, 20 nt, Mycobacterium bovis subsp bovis AF2122/97
augcgagguucagccugagc

SEQ ID NO: 1213211 - RNA, 18 nt, Mycobacterium bovis subsp bovis AF2122/97
augcgacagcgcugggcc

SEQ ID NO: 1213212 - RNA, 17 nt, Mycobacterium bovis subsp bovis AF2122/97
augcgaaccgaggugcc

SEQ ID NO: 1213213 - RNA, 19 nt, Mycobacterium bovis subsp bovis AF2122/97
augccauaaccggugggga

SEQ ID NO: 1213214 - RNA, 14 nt, Mycobacterium bovis subsp bovis AF2122/97
augccaccgagcaa

SEQ ID NO: 1213215 - RNA, 16 nt, Mycobacterium bovis subsp bovis AF2122/97
augccacccagaugca

SEQ ID NO: 1213216 - RNA, 14 nt, Mycobacterium bovis subsp bovis AF2122/97
augccgccaaccgc

SEQ ID NO: 1213217 - RNA, 17 nt, Mycobacterium bovis subsp bovis AF2122/97
augccgcccaucacccc

SEQ ID NO: 1213218 - RNA, 10 nt, Mycobacterium bovis subsp bovis AF2122/97
augccgccga

SEQ ID NO: 1213219 - RNA, 20 nt, Mycobacterium bovis subsp bovis AF2122/97
augccgagaagugggcggua

SEQ ID NO: 1213220 - RNA, 17 nt, Mycobacterium bovis subsp bovis AF2122/97
augccgacgacaacagc

SEQ ID NO: 1213221 - RNA, 16 nt, Mycobacterium bovis subsp bovis AF2122/97
augcaccccaugaccg

SEQ ID NO: 1213222 - RNA, 21 nt, Mycobacterium bovis subsp bovis AF2122/97
augcagcgguccagacaucag

SEQ ID NO: 1213223 - RNA, 12 nt, Mycobacterium bovis subsp bovis AF2122/97
augccacacacu

SEQ ID NO: 1213224 - RNA, 17 nt, Mycobacterium bovis subsp bovis AF2122/97
augccaagcuccaacca

SEQ ID NO: 1213225 - RNA, 20 nt, Mycobacterium bovis subsp bovis AF2122/97
augccaagcuccaaccaugc

SEQ ID NO: 1213226 - RNA, 16 nt, Mycobacterium bovis subsp bovis AF2122/97
augcucgucuugggcc

SEQ ID NO: 1213227 - RNA, 15 nt, Mycobacterium bovis subsp bovis AF2122/97
augcucgcuggcgcu

SEQ ID NO: 1213228 - RNA, 15 nt, Mycobacterium bovis subsp bovis AF2122/97
augcucgacaaccac

SEQ ID NO: 1213229 - RNA, 16 nt, Mycobacterium bovis subsp bovis AF2122/97
augcgcguccccagcg

SEQ ID NO: 1213230 - RNA, 21 nt, Mycobacterium bovis subsp bovis AF2122/97
augcgcguuacccaucgccac

SEQ ID NO: 1213231 - RNA, 13 nt, Mycobacterium bovis subsp bovis AF2122/97
augcugccagcca

SEQ ID NO: 1213232 - RNA, 18 nt, Mycobacterium bovis subsp bovis AF2122/97
augcugccagccauggcc

SEQ ID NO: 1213233 - RNA, 24 nt, Mycobacterium bovis subsp bovis AF2122/97
augcucugggauuugggcugcgga

SEQ ID NO: 1213234 - RNA, 13 nt, Mycobacterium bovis subsp bovis AF2122/97
augcugccgccgc

SEQ ID NO: 1213235 - RNA, 20 nt, Mycobacterium bovis subsp bovis AF2122/97
augcuuguguucgugguugu

SEQ ID NO: 1213236 - RNA, 16 nt, Mycobacterium bovis subsp bovis AF2122/97
auggacaacagcuugg

SEQ ID NO: 1213237 - RNA, 13 nt, Mycobacterium bovis subsp bovis AF2122/97
auggacaccaacc

SEQ ID NO: 1213238 - RNA, 17 nt, Mycobacterium bovis subsp bovis AF2122/97
auggacaccaacccacc

SEQ ID NO: 1213239 - RNA, 14 nt, Mycobacterium bovis subsp bovis AF2122/97
auggaaggcggcca

SEQ ID NO: 1213240 - RNA, 17 nt, Mycobacterium bovis subsp bovis AF2122/97
auggaaggcggccaggu

SEQ ID NO: 1213241 - RNA, 23 nt, Mycobacterium bovis subsp bovis AF2122/97
auggacggugcgcagggccugga

SEQ ID NO: 1213242 - RNA, 22 nt, Mycobacterium bovis subsp bovis AF2122/97
auggacgcuuggguagccugac

SEQ ID NO: 1213243 - RNA, 17 nt, Mycobacterium bovis subsp bovis AF2122/97
auggcacgcgggaagug

SEQ ID NO: 1213244 - RNA, 12 nt, Mycobacterium bovis subsp bovis AF2122/97
auggcacugccg

SEQ ID NO: 1213245 - RNA, 18 nt, Mycobacterium bovis subsp bovis AF2122/97
auggccgccuugaggccc

SEQ ID NO: 1213246 - RNA, 13 nt, Mycobacterium bovis subsp bovis AF2122/97
auggcccugggcc

SEQ ID NO: 1213247 - RNA, 19 nt, Mycobacterium bovis subsp bovis AF2122/97
auggccgaacauucccaug

SEQ ID NO: 1213248 - RNA, 21 nt, Mycobacterium bovis subsp bovis AF2122/97
auggccgaccagccgaucauc

SEQ ID NO: 1213249 - RNA, 17 nt, Mycobacterium bovis subsp bovis AF2122/97
auggccccgggcgguga

SEQ ID NO: 1213250 - RNA, 22 nt, Mycobacterium bovis subsp bovis AF2122/97
auggcccggcucacagcacagc

SEQ ID NO: 1213251 - RNA, 20 nt, Mycobacterium bovis subsp bovis AF2122/97
auggcccguuggcagcacag

SEQ ID NO: 1213252 - RNA, 18 nt, Mycobacterium bovis subsp bovis AF2122/97
auggcucaccagcuccuc

SEQ ID NO: 1213253 - RNA, 17 nt, Mycobacterium bovis subsp bovis AF2122/97
auggcucacccaggcgc

SEQ ID NO: 1213254 - RNA, 15 nt, Mycobacterium bovis subsp bovis AF2122/97
auggccgcgugcagc

SEQ ID NO: 1213255 - RNA, 15 nt, Mycobacterium bovis subsp bovis AF2122/97
auggggccaacaccu

SEQ ID NO: 1213256 - RNA, 18 nt, Mycobacterium bovis subsp bovis AF2122/97
auggggccaacaccucaa

SEQ ID NO: 1213257 - RNA, 14 nt, Mycobacterium bovis subsp bovis AF2122/97
augggcuaccgaga

SEQ ID NO: 1213258 - RNA, 21 nt, Mycobacterium bovis subsp bovis AF2122/97
augggcggguggugcggccgu

SEQ ID NO: 1213259 - RNA, 17 nt, Mycobacterium bovis subsp bovis AF2122/97
augggcgguuccacgcu

SEQ ID NO: 1213260 - RNA, 21 nt, Mycobacterium bovis subsp bovis AF2122/97
augguggugccaaccugggcc

SEQ ID NO: 1213261 - RNA, 16 nt, Mycobacterium bovis subsp bovis AF2122/97
augguguacugcugcu

SEQ ID NO: 1213262 - RNA, 16 nt, Mycobacterium bovis subsp bovis AF2122/97
auggugugcagcagca

SEQ ID NO: 1213263 - RNA, 15 nt, Mycobacterium bovis subsp bovis AF2122/97
augguggccgccacc

SEQ ID NO: 1213264 - RNA, 21 nt, Mycobacterium bovis subsp bovis AF2122/97
auggugaccagcaggccgggc

SEQ ID NO: 1213265 - RNA, 22 nt, Mycobacterium bovis subsp bovis AF2122/97
auggugaaguugccggucaggc

SEQ ID NO: 1213266 - RNA, 21 nt, Mycobacterium bovis subsp bovis AF2122/97
augguacccgcgccgcgcauc

SEQ ID NO: 1213267 - RNA, 22 nt, Mycobacterium bovis subsp bovis AF2122/97
augguugcucgagcgguggcgu

SEQ ID NO: 1213268 - RNA, 22 nt, Mycobacterium bovis subsp bovis AF2122/97
auguacaccggcuggaaucuga

SEQ ID NO: 1213269 - RNA, 17 nt, Mycobacterium bovis subsp bovis AF2122/97
augucggcugguggggg

SEQ ID NO: 1213270 - RNA, 14 nt, Mycobacterium bovis subsp bovis AF2122/97
augucgggccaggc

SEQ ID NO: 1213271 - RNA, 15 nt, Mycobacterium bovis subsp bovis AF2122/97
augucgggccaggcg

SEQ ID NO: 1213272 - RNA, 20 nt, Mycobacterium bovis subsp bovis AF2122/97
augucgccgcuuggcccggc

SEQ ID NO: 1213273 - RNA, 12 nt, Mycobacterium bovis subsp bovis AF2122/97
augucggccacc

SEQ ID NO: 1213274 - RNA, 23 nt, Mycobacterium bovis subsp bovis AF2122/97
augucgcgcgcuaggugcaacag

SEQ ID NO: 1213275 - RNA, 17 nt, Mycobacterium bovis subsp bovis AF2122/97
augucgcggucgcccgc

SEQ ID NO: 1213276 - RNA, 16 nt, Mycobacterium bovis subsp bovis AF2122/97
augucgcugccgccgc

SEQ ID NO: 1213277 - RNA, 22 nt, Mycobacterium bovis subsp bovis AF2122/97
augucgugcgggcgcaccaggg

SEQ ID NO: 1213278 - RNA, 19 nt, Mycobacterium bovis subsp bovis AF2122/97
augugaaagacaacccgcu

SEQ ID NO: 1213279 - RNA, 21 nt, Mycobacterium bovis subsp bovis AF2122/97
augucuugcaguaacuucacc

SEQ ID NO: 1213280 - RNA, 20 nt, Mycobacterium bovis subsp bovis AF2122/97
augucuugcgaugugcauuc

SEQ ID NO: 1213281 - RNA, 20 nt, Mycobacterium bovis subsp bovis AF2122/97
augugacaucgggccgccga

SEQ ID NO: 1213282 - RNA, 22 nt, Mycobacterium bovis subsp bovis AF2122/97
augugcaggacguuugagaccc

SEQ ID NO: 1213283 - RNA, 14 nt, Mycobacterium bovis subsp bovis AF2122/97
auguggucggcugu

SEQ ID NO: 1213284 - RNA, 20 nt, Mycobacterium bovis subsp bovis AF2122/97
augugccgauuggccugcca

SEQ ID NO: 1213285 - RNA, 14 nt, Mycobacterium bovis subsp bovis AF2122/97
augugcgccaccuc

SEQ ID NO: 1213286 - RNA, 15 nt, Mycobacterium bovis subsp bovis AF2122/97
augugcggcugcacc

SEQ ID NO: 1213287 - RNA, 13 nt, Mycobacterium bovis subsp bovis AF2122/97
auguggccgccgu

SEQ ID NO: 1213288 - RNA, 15 nt, Mycobacterium bovis subsp bovis AF2122/97
auguguuugaucacc

SEQ ID NO: 1213289 - RNA, 17 nt, Mycobacterium bovis subsp bovis AF2122/97
auguucaucgcagucau

SEQ ID NO: 1213290 - RNA, 20 nt, Mycobacterium bovis subsp bovis AF2122/97
auguugaucguugugcaccc

SEQ ID NO: 1213291 - RNA, 16 nt, Mycobacterium bovis subsp bovis AF2122/97
auguucugcgggggua

SEQ ID NO: 1213292 - RNA, 16 nt, Mycobacterium bovis subsp bovis AF2122/97
auuaaaaagcccagcg

SEQ ID NO: 1213293 - RNA, 22 nt, Mycobacterium bovis subsp bovis AF2122/97
aaaagcccccauuucgggcucu

SEQ ID NO: 1213294 - RNA, 23 nt, Mycobacterium bovis subsp bovis AF2122/97
aaaaggaucccgccgcugccgcc

SEQ ID NO: 1213295 - RNA, 19 nt, Mycobacterium bovis subsp bovis AF2122/97
auucauccaccccugagcu

SEQ ID NO: 1213296 - RNA, 21 nt, Mycobacterium bovis subsp bovis AF2122/97
auucaugccgguguugccgaa

SEQ ID NO: 1213297 - RNA, 13 nt, Mycobacterium bovis subsp bovis AF2122/97
auucauggcggca

SEQ ID NO: 1213298 - RNA, 18 nt, Mycobacterium bovis subsp bovis AF2122/97
auucccgcccagcagcac

SEQ ID NO: 1213299 - RNA, 17 nt, Mycobacterium bovis subsp bovis AF2122/97
auucccgcccagcagca

SEQ ID NO: 1213300 - RNA, 16 nt, Mycobacterium bovis subsp bovis AF2122/97
auucccuacgccgcca

SEQ ID NO: 1213301 - RNA, 16 nt, Mycobacterium bovis subsp bovis AF2122/97
auucccggacccacca

SEQ ID NO: 1213302 - RNA, 14 nt, Mycobacterium bovis subsp bovis AF2122/97
auuccacaggggcc

SEQ ID NO: 1213303 - RNA, 16 nt, Mycobacterium bovis subsp bovis AF2122/97
auuccacgaucggcuc

SEQ ID NO: 1213304 - RNA, 15 nt, Mycobacterium bovis subsp bovis AF2122/97
auucgcgcuggccau

SEQ ID NO: 1213305 - RNA, 23 nt, Mycobacterium bovis subsp bovis AF2122/97
auucgcucaccaccgaccucgac

SEQ ID NO: 1213306 - RNA, 13 nt, Mycobacterium bovis subsp bovis AF2122/97
auuccuugaugcc

SEQ ID NO: 1213307 - RNA, 15 nt, Mycobacterium bovis subsp bovis AF2122/97
auucgguguggccgu

SEQ ID NO: 1213308 - RNA, 19 nt, Mycobacterium bovis subsp bovis AF2122/97
auucucgagccaacgcauc

SEQ ID NO: 1213309 - RNA, 13 nt, Mycobacterium bovis subsp bovis AF2122/97
auucucggccggc

SEQ ID NO: 1213310 - RNA, 13 nt, Mycobacterium bovis subsp bovis AF2122/97
auucuggugucau

SEQ ID NO: 1213311 - RNA, 16 nt, Mycobacterium bovis subsp bovis AF2122/97
auugaugcgugguugg

SEQ ID NO: 1213312 - RNA, 22 nt, Mycobacterium bovis subsp bovis AF2122/97
auugaucgacggccagcccagc

SEQ ID NO: 1213313 - RNA, 15 nt, Mycobacterium bovis subsp bovis AF2122/97
auugccgaccgccug

SEQ ID NO: 1213314 - RNA, 16 nt, Mycobacterium bovis subsp bovis AF2122/97
auugccgcaugcucag

SEQ ID NO: 1213315 - RNA, 17 nt, Mycobacterium bovis subsp bovis AF2122/97
auugcccuugaccaugu

SEQ ID NO: 1213316 - RNA, 21 nt, Mycobacterium bovis subsp bovis AF2122/97
auugcccguguuaaagaagcc

SEQ ID NO: 1213317 - RNA, 23 nt, Mycobacterium bovis subsp bovis AF2122/97
auugcccgucagguacgucuugg

SEQ ID NO: 1213318 - RNA, 17 nt, Mycobacterium bovis subsp bovis AF2122/97
auugccgcaugcucagc

SEQ ID NO: 1213319 - RNA, 11 nt, Mycobacterium bovis subsp bovis AF2122/97
auugccgccgc

SEQ ID NO: 1213320 - RNA, 14 nt, Mycobacterium bovis subsp bovis AF2122/97
auugccggccacca

SEQ ID NO: 1213321 - RNA, 21 nt, Mycobacterium bovis subsp bovis AF2122/97
auugccgggcgcacgcccgca

SEQ ID NO: 1213322 - RNA, 9 nt, Mycobacterium bovis subsp bovis AF2122/97
auugccaua

SEQ ID NO: 1213323 - RNA, 17 nt, Mycobacterium bovis subsp bovis AF2122/97
auugcgaacucgcugcc

SEQ ID NO: 1213324 - RNA, 14 nt, Mycobacterium bovis subsp bovis AF2122/97
auugcggccgccgg

SEQ ID NO: 1213325 - RNA, 17 nt, Mycobacterium bovis subsp bovis AF2122/97
auugcugcggcuuucag

SEQ ID NO: 1213326 - RNA, 16 nt, Mycobacterium bovis subsp bovis AF2122/97
auugucgaucaccugc

SEQ ID NO: 1213327 - RNA, 14 nt, Mycobacterium bovis subsp bovis AF2122/97
auugucgaucuggu

SEQ ID NO: 1213328 - RNA, 16 nt, Mycobacterium bovis subsp bovis AF2122/97
auugugugcagcagca

SEQ ID NO: 1213329 - RNA, 14 nt, Mycobacterium bovis subsp bovis AF2122/97
auugugugcagcag

SEQ ID NO: 1213330 - RNA, 14 nt, Mycobacterium bovis subsp bovis AF2122/97
auuguugaagaaag

SEQ ID NO: 1213331 - RNA, 22 nt, Mycobacterium bovis subsp bovis AF2122/97
auugugucccauggugagcugu

SEQ ID NO: 1213332 - RNA, 18 nt, Mycobacterium bovis subsp bovis AF2122/97
aaaagggcggcagcgagg

SEQ ID NO: 1213333 - RNA, 20 nt, Mycobacterium bovis subsp bovis AF2122/97
auuggugggccagcagcaac

SEQ ID NO: 1213334 - RNA, 21 nt, Mycobacterium bovis subsp bovis AF2122/97
auuggugaguagauugcugac

SEQ ID NO: 1213335 - RNA, 18 nt, Mycobacterium bovis subsp bovis AF2122/97
auuggugggccagcagca

SEQ ID NO: 1213336 - RNA, 16 nt, Mycobacterium bovis subsp bovis AF2122/97
auuggcgucagcagca

SEQ ID NO: 1213337 - RNA, 17 nt, Mycobacterium bovis subsp bovis AF2122/97
auuggcgucagcagcaa

SEQ ID NO: 1213338 - RNA, 14 nt, Mycobacterium bovis subsp bovis AF2122/97
auuggcucgagcaa

SEQ ID NO: 1213339 - RNA, 14 nt, Mycobacterium bovis subsp bovis AF2122/97
auuggcuccgaaca

SEQ ID NO: 1213340 - RNA, 22 nt, Mycobacterium bovis subsp bovis AF2122/97
auuggcuccgaacauggccagc

SEQ ID NO: 1213341 - RNA, 16 nt, Mycobacterium bovis subsp bovis AF2122/97
auuucaccgaagccau

SEQ ID NO: 1213342 - RNA, 17 nt, Mycobacterium bovis subsp bovis AF2122/97
auuucgcgucugcucgc

SEQ ID NO: 1213343 - RNA, 14 nt, Mycobacterium bovis subsp bovis AF2122/97
auuucggaucucga

SEQ ID NO: 1213344 - RNA, 17 nt, Mycobacterium bovis subsp bovis AF2122/97
auuucgugccgaaaugg

SEQ ID NO: 1213345 - RNA, 20 nt, Mycobacterium bovis subsp bovis AF2122/97
auuucguuggauccacaccc

SEQ ID NO: 1213346 - RNA, 19 nt, Mycobacterium bovis subsp bovis AF2122/97
auuucgugucgcugcggcg

SEQ ID NO: 1213347 - RNA, 12 nt, Mycobacterium bovis subsp bovis AF2122/97
auuuuggcugca

SEQ ID NO: 1213348 - RNA, 16 nt, Mycobacterium bovis subsp bovis AF2122/97
auuuuucgaccagccc

SEQ ID NO: 1213349 - RNA, 13 nt, Mycobacterium bovis subsp bovis AF2122/97
caauuccucagcc

SEQ ID NO: 1213350 - RNA, 19 nt, Mycobacterium bovis subsp bovis AF2122/97
caauuccacgaucggcuca

SEQ ID NO: 1213351 - RNA, 15 nt, Mycobacterium bovis subsp bovis AF2122/97
caauuccgccgagcg

SEQ ID NO: 1213352 - RNA, 18 nt, Mycobacterium bovis subsp bovis AF2122/97
caauugcucguagcccag

SEQ ID NO: 1213353 - RNA, 17 nt, Mycobacterium bovis subsp bovis AF2122/97
caauugcccuuucccac

SEQ ID NO: 1213354 - RNA, 19 nt, Mycobacterium bovis subsp bovis AF2122/97
caauugcccuuucccaccu

SEQ ID NO: 1213355 - RNA, 20 nt, Mycobacterium bovis subsp bovis AF2122/97
caauggugggcgagcugcug

SEQ ID NO: 1213356 - RNA, 14 nt, Mycobacterium bovis subsp bovis AF2122/97
caauggccugcagc

SEQ ID NO: 1213357 - RNA, 17 nt, Mycobacterium bovis subsp bovis AF2122/97
caaugaccugcagcgca

SEQ ID NO: 1213358 - RNA, 20 nt, Mycobacterium bovis subsp bovis AF2122/97
caaugacucggccgcaccag

SEQ ID NO: 1213359 - RNA, 20 nt, Mycobacterium bovis subsp bovis AF2122/97
caauggacaccaacccaccc

SEQ ID NO: 1213360 - RNA, 12 nt, Mycobacterium bovis subsp bovis AF2122/97
caaucuucccac

SEQ ID NO: 1213361 - RNA, 18 nt, Mycobacterium bovis subsp bovis AF2122/97
cacacggggccgccagcu

SEQ ID NO: 1213362 - RNA, 16 nt, Mycobacterium bovis subsp bovis AF2122/97
cacacguuggcagccc

SEQ ID NO: 1213363 - RNA, 21 nt, Mycobacterium bovis subsp bovis AF2122/97
cacacgcccucgacgccgcgc

SEQ ID NO: 1213364 - RNA, 19 nt, Mycobacterium bovis subsp bovis AF2122/97
cacaccuuggccgccggcc

SEQ ID NO: 1213365 - RNA, 17 nt, Mycobacterium bovis subsp bovis AF2122/97
cacaccaaggccgagcg

SEQ ID NO: 1213366 - RNA, 15 nt, Mycobacterium bovis subsp bovis AF2122/97
cacaccaacaccgcg

SEQ ID NO: 1213367 - RNA, 16 nt, Mycobacterium bovis subsp bovis AF2122/97
cacacaauucgggcgu

SEQ ID NO: 1213368 - RNA, 13 nt, Mycobacterium bovis subsp bovis AF2122/97
cacagcacccacg

SEQ ID NO: 1213369 - RNA, 15 nt, Mycobacterium bovis subsp bovis AF2122/97
cacagcacagcgcag

SEQ ID NO: 1213370 - RNA, 16 nt, Mycobacterium bovis subsp bovis AF2122/97
cacagcacagcgcagc

SEQ ID NO: 1213371 - RNA, 22 nt, Mycobacterium bovis subsp bovis AF2122/97
cacacguuggcagcccucuggu

SEQ ID NO: 1213372 - RNA, 15 nt, Mycobacterium bovis subsp bovis AF2122/97
cacacuguucccaca

SEQ ID NO: 1213373 - RNA, 22 nt, Mycobacterium bovis subsp bovis AF2122/97
cacagaacucaccgacggauga

SEQ ID NO: 1213374 - RNA, 22 nt, Mycobacterium bovis subsp bovis AF2122/97
cacaaggcgugagcuaugcugg

SEQ ID NO: 1213375 - RNA, 13 nt, Mycobacterium bovis subsp bovis AF2122/97
cacaagcgauggc

SEQ ID NO: 1213376 - RNA, 13 nt, Mycobacterium bovis subsp bovis AF2122/97
cacaagccgugca

SEQ ID NO: 1213377 - RNA, 18 nt, Mycobacterium bovis subsp bovis AF2122/97
cacaagauccgccacgcu

SEQ ID NO: 1213378 - RNA, 18 nt, Mycobacterium bovis subsp bovis AF2122/97
cacaauaggcuccagcgc

SEQ ID NO: 1213379 - RNA, 20 nt, Mycobacterium bovis subsp bovis AF2122/97
cacaauccacgucgcggcgu

SEQ ID NO: 1213380 - RNA, 21 nt, Mycobacterium bovis subsp bovis AF2122/97
cacaacccgucgagccgugcc

SEQ ID NO: 1213381 - RNA, 17 nt, Mycobacterium bovis subsp bovis AF2122/97
cacaaccgugagcacca

SEQ ID NO: 1213382 - RNA, 20 nt, Mycobacterium bovis subsp bovis AF2122/97
cacaaccgugagcaccagca

SEQ ID NO: 1213383 - RNA, 14 nt, Mycobacterium bovis subsp bovis AF2122/97
cacaaccaacgaca

SEQ ID NO: 1213384 - RNA, 15 nt, Mycobacterium bovis subsp bovis AF2122/97
cacaacguugcaccg

SEQ ID NO: 1213385 - RNA, 14 nt, Mycobacterium bovis subsp bovis AF2122/97
cacaacgucuucac

SEQ ID NO: 1213386 - RNA, 21 nt, Mycobacterium bovis subsp bovis AF2122/97
cacaacucggcauucaccgcg

SEQ ID NO: 1213387 - RNA, 23 nt, Mycobacterium bovis subsp bovis AF2122/97
cacaacgcgugaccagggccuga

SEQ ID NO: 1213388 - RNA, 22 nt, Mycobacterium bovis subsp bovis AF2122/97
cacaacggauaucagcaacagc

SEQ ID NO: 1213389 - RNA, 23 nt, Mycobacterium bovis subsp bovis AF2122/97
cacaacgccucgauggcgguggc

SEQ ID NO: 1213390 - RNA, 15 nt, Mycobacterium bovis subsp bovis AF2122/97
cacaacggcggcgca

SEQ ID NO: 1213391 - RNA, 19 nt, Mycobacterium bovis subsp bovis AF2122/97
cacaaccggauugagcacg

SEQ ID NO: 1213392 - RNA, 15 nt, Mycobacterium bovis subsp bovis AF2122/97
cacauccggucagau

SEQ ID NO: 1213393 - RNA, 19 nt, Mycobacterium bovis subsp bovis AF2122/97
cacauccgcuugcggggcc

SEQ ID NO: 1213394 - RNA, 19 nt, Mycobacterium bovis subsp bovis AF2122/97
cacaucaugggcgcugcca

SEQ ID NO: 1213395 - RNA, 13 nt, Mycobacterium bovis subsp bovis AF2122/97
cacagcuugcccg

SEQ ID NO: 1213396 - RNA, 17 nt, Mycobacterium bovis subsp bovis AF2122/97
cacagcuugcccgagcc

SEQ ID NO: 1213397 - RNA, 15 nt, Mycobacterium bovis subsp bovis AF2122/97
cacauagccggucag

SEQ ID NO: 1213398 - RNA, 22 nt, Mycobacterium bovis subsp bovis AF2122/97
cacagccaguaaaaaggcagga

SEQ ID NO: 1213399 - RNA, 13 nt, Mycobacterium bovis subsp bovis AF2122/97
cacagccaccagc

SEQ ID NO: 1213400 - RNA, 15 nt, Mycobacterium bovis subsp bovis AF2122/97
cacagccaccagccg

SEQ ID NO: 1213401 - RNA, 22 nt, Mycobacterium bovis subsp bovis AF2122/97
cacagcugauucugguucagcc

SEQ ID NO: 1213402 - RNA, 22 nt, Mycobacterium bovis subsp bovis AF2122/97
cacaucggccucugaccagccg

SEQ ID NO: 1213403 - RNA, 20 nt, Mycobacterium bovis subsp bovis AF2122/97
cacaucgcucaucgucaccu

SEQ ID NO: 1213404 - RNA, 17 nt, Mycobacterium bovis subsp bovis AF2122/97
cacaucgcauccacuuc

SEQ ID NO: 1213405 - RNA, 15 nt, Mycobacterium bovis subsp bovis AF2122/97
caccacaugggagcc

SEQ ID NO: 1213406 - RNA, 13 nt, Mycobacterium bovis subsp bovis AF2122/97
caccacagugcca

SEQ ID NO: 1213407 - RNA, 12 nt, Mycobacterium bovis subsp bovis AF2122/97
caccacauccau

SEQ ID NO: 1213408 - RNA, 16 nt, Mycobacterium bovis subsp bovis AF2122/97
caccacauccaucucc

SEQ ID NO: 1213409 - RNA, 17 nt, Mycobacterium bovis subsp bovis AF2122/97
caccacauccaucucca

SEQ ID NO: 1213410 - RNA, 14 nt, Mycobacterium bovis subsp bovis AF2122/97
caccacaccggcag

SEQ ID NO: 1213411 - RNA, 19 nt, Mycobacterium bovis subsp bovis AF2122/97
caccacaccugcggcugcu

SEQ ID NO: 1213412 - RNA, 15 nt, Mycobacterium bovis subsp bovis AF2122/97
caccacaauccacgc

SEQ ID NO: 1213413 - RNA, 14 nt, Mycobacterium bovis subsp bovis AF2122/97
caccacaacgccag

SEQ ID NO: 1213414 - RNA, 21 nt, Mycobacterium bovis subsp bovis AF2122/97
caccacaaacaccccacacag

SEQ ID NO: 1213415 - RNA, 17 nt, Mycobacterium bovis subsp bovis AF2122/97
caccaacaccgcggcgc

SEQ ID NO: 1213416 - RNA, 18 nt, Mycobacterium bovis subsp bovis AF2122/97
caccaacaccgcggcgcu

SEQ ID NO: 1213417 - RNA, 17 nt, Mycobacterium bovis subsp bovis AF2122/97
caccaacccacccccca

SEQ ID NO: 1213418 - RNA, 15 nt, Mycobacterium bovis subsp bovis AF2122/97
caccaacgaacuggg

SEQ ID NO: 1213419 - RNA, 14 nt, Mycobacterium bovis subsp bovis AF2122/97
caccaaaugccccg

SEQ ID NO: 1213420 - RNA, 23 nt, Mycobacterium bovis subsp bovis AF2122/97
caccaaaugccccgaaccgcgcu

SEQ ID NO: 1213421 - RNA, 16 nt, Mycobacterium bovis subsp bovis AF2122/97
caccagcucacccgga

SEQ ID NO: 1213422 - RNA, 21 nt, Mycobacterium bovis subsp bovis AF2122/97
caccagcgucgcacgcgcgca

SEQ ID NO: 1213423 - RNA, 15 nt, Mycobacterium bovis subsp bovis AF2122/97
caccagcgucgcggc

SEQ ID NO: 1213424 - RNA, 15 nt, Mycobacterium bovis subsp bovis AF2122/97
caccagcgcgcgccg

SEQ ID NO: 1213425 - RNA, 13 nt, Mycobacterium bovis subsp bovis AF2122/97
caccagcggcggc

SEQ ID NO: 1213426 - RNA, 19 nt, Mycobacterium bovis subsp bovis AF2122/97
caccagcgcuccagcaccc

SEQ ID NO: 1213427 - RNA, 21 nt, Mycobacterium bovis subsp bovis AF2122/97
caccagcgcuccagcacccgc

SEQ ID NO: 1213428 - RNA, 19 nt, Mycobacterium bovis subsp bovis AF2122/97
caccagcggcaccgcggcc

SEQ ID NO: 1213429 - RNA, 23 nt, Mycobacterium bovis subsp bovis AF2122/97
caccagguugccgagguugcgga

SEQ ID NO: 1213430 - RNA, 21 nt, Mycobacterium bovis subsp bovis AF2122/97
caccagguugugauccugggu

SEQ ID NO: 1213431 - RNA, 13 nt, Mycobacterium bovis subsp bovis AF2122/97
caccagcaggcgg

SEQ ID NO: 1213432 - RNA, 13 nt, Mycobacterium bovis subsp bovis AF2122/97
caccagccacccc

SEQ ID NO: 1213433 - RNA, 15 nt, Mycobacterium bovis subsp bovis AF2122/97
caccagccacgccag

SEQ ID NO: 1213434 - RNA, 17 nt, Mycobacterium bovis subsp bovis AF2122/97
caccagcgcgagcccga

SEQ ID NO: 1213435 - RNA, 16 nt, Mycobacterium bovis subsp bovis AF2122/97
caccagcgcccggccc

SEQ ID NO: 1213436 - RNA, 21 nt, Mycobacterium bovis subsp bovis AF2122/97
caccaccagguccaccccgcc

SEQ ID NO: 1213437 - RNA, 18 nt, Mycobacterium bovis subsp bovis AF2122/97
caccaccuuggaugcccu

SEQ ID NO: 1213438 - RNA, 16 nt, Mycobacterium bovis subsp bovis AF2122/97
caccaccuggugcaac

SEQ ID NO: 1213439 - RNA, 18 nt, Mycobacterium bovis subsp bovis AF2122/97
caccaccuggugcaaccg

SEQ ID NO: 1213440 - RNA, 21 nt, Mycobacterium bovis subsp bovis AF2122/97
caccaccuggugcaaccgugc

SEQ ID NO: 1213441 - RNA, 20 nt, Mycobacterium bovis subsp bovis AF2122/97
caccaccaagcucggccagc

SEQ ID NO: 1213442 - RNA, 14 nt, Mycobacterium bovis subsp bovis AF2122/97
caccaccaccgccg

SEQ ID NO: 1213443 - RNA, 13 nt, Mycobacterium bovis subsp bovis AF2122/97
caccacgcggcgg

SEQ ID NO: 1213444 - RNA, 17 nt, Mycobacterium bovis subsp bovis AF2122/97
caccacgcgccgcacau

SEQ ID NO: 1213445 - RNA, 15 nt, Mycobacterium bovis subsp bovis AF2122/97
caccacggaccagcg

SEQ ID NO: 1213446 - RNA, 18 nt, Mycobacterium bovis subsp bovis AF2122/97
caccacggaccagcgccg

SEQ ID NO: 1213447 - RNA, 13 nt, Mycobacterium bovis subsp bovis AF2122/97
caccacgcuggcc

SEQ ID NO: 1213448 - RNA, 21 nt, Mycobacterium bovis subsp bovis AF2122/97
caccacgcgcguuuagucucc

SEQ ID NO: 1213449 - RNA, 17 nt, Mycobacterium bovis subsp bovis AF2122/97
caccacgauggcggcca

SEQ ID NO: 1213450 - RNA, 19 nt, Mycobacterium bovis subsp bovis AF2122/97
caccacgaccgacaccccg

SEQ ID NO: 1213451 - RNA, 16 nt, Mycobacterium bovis subsp bovis AF2122/97
caccacgaacucggcc

SEQ ID NO: 1213452 - RNA, 20 nt, Mycobacterium bovis subsp bovis AF2122/97
caccagaucgcacaccaaca

SEQ ID NO: 1213453 - RNA, 13 nt, Mycobacterium bovis subsp bovis AF2122/97
caccagcaacagc

SEQ ID NO: 1213454 - RNA, 21 nt, Mycobacterium bovis subsp bovis AF2122/97
caccagcaacagcccgaggcc

SEQ ID NO: 1213455 - RNA, 24 nt, Mycobacterium bovis subsp bovis AF2122/97
caccagcacggcaaccagcgagcc

SEQ ID NO: 1213456 - RNA, 14 nt, Mycobacterium bovis subsp bovis AF2122/97
caccagcagcacca

SEQ ID NO: 1213457 - RNA, 16 nt, Mycobacterium bovis subsp bovis AF2122/97
caccagcaccgccgcu

SEQ ID NO: 1213458 - RNA, 14 nt, Mycobacterium bovis subsp bovis AF2122/97
caccagcaagugug

SEQ ID NO: 1213459 - RNA, 21 nt, Mycobacterium bovis subsp bovis AF2122/97
caccagcaagugugagcagac

SEQ ID NO: 1213460 - RNA, 12 nt, Mycobacterium bovis subsp bovis AF2122/97
caccacggccag

SEQ ID NO: 1213461 - RNA, 20 nt, Mycobacterium bovis subsp bovis AF2122/97
caccacggaccagcgccgga

SEQ ID NO: 1213462 - RNA, 14 nt, Mycobacterium bovis subsp bovis AF2122/97
caccacggccagaa

SEQ ID NO: 1213463 - RNA, 15 nt, Mycobacterium bovis subsp bovis AF2122/97
caccacggccagcgg

SEQ ID NO: 1213464 - RNA, 16 nt, Mycobacterium bovis subsp bovis AF2122/97
caccacgucgacgaug

SEQ ID NO: 1213465 - RNA, 16 nt, Mycobacterium bovis subsp bovis AF2122/97
caccacgugcgccacu

SEQ ID NO: 1213466 - RNA, 20 nt, Mycobacterium bovis subsp bovis AF2122/97
caccacuaggucgccggcca

SEQ ID NO: 1213467 - RNA, 18 nt, Mycobacterium bovis subsp bovis AF2122/97
caccgacaucgucaucca

SEQ ID NO: 1213468 - RNA, 21 nt, Mycobacterium bovis subsp bovis AF2122/97
caccgacaucgucauccaggg

SEQ ID NO: 1213469 - RNA, 14 nt, Mycobacterium bovis subsp bovis AF2122/97
caccgacaccgugu

SEQ ID NO: 1213470 - RNA, 21 nt, Mycobacterium bovis subsp bovis AF2122/97
caccgacagcaguuucaccuu

SEQ ID NO: 1213471 - RNA, 22 nt, Mycobacterium bovis subsp bovis AF2122/97
caccgacagccccaucaccacc

SEQ ID NO: 1213472 - RNA, 20 nt, Mycobacterium bovis subsp bovis AF2122/97
cacccuugcccacggcgacc

SEQ ID NO: 1213473 - RNA, 13 nt, Mycobacterium bovis subsp bovis AF2122/97
cacccuuggcccg

SEQ ID NO: 1213474 - RNA, 22 nt, Mycobacterium bovis subsp bovis AF2122/97
cacccugcgaauagccaccaag

SEQ ID NO: 1213475 - RNA, 19 nt, Mycobacterium bovis subsp bovis AF2122/97
cacccguguugagggugcc

SEQ ID NO: 1213476 - RNA, 22 nt, Mycobacterium bovis subsp bovis AF2122/97
caccgacauguguggcagcccc

SEQ ID NO: 1213477 - RNA, 17 nt, Mycobacterium bovis subsp bovis AF2122/97
caccgacauuggugugg

SEQ ID NO: 1213478 - RNA, 14 nt, Mycobacterium bovis subsp bovis AF2122/97
caccgaccagggcc

SEQ ID NO: 1213479 - RNA, 19 nt, Mycobacterium bovis subsp bovis AF2122/97
caccgaccagggccgccgc

SEQ ID NO: 1213480 - RNA, 20 nt, Mycobacterium bovis subsp bovis AF2122/97
caccgaccagggccgccgcu

SEQ ID NO: 1213481 - RNA, 14 nt, Mycobacterium bovis subsp bovis AF2122/97
caccgaccgcauga

SEQ ID NO: 1213482 - RNA, 16 nt, Mycobacterium bovis subsp bovis AF2122/97
caccgacgcugaccaa

SEQ ID NO: 1213483 - RNA, 22 nt, Mycobacterium bovis subsp bovis AF2122/97
caccgacccgcugccacccauc

SEQ ID NO: 1213484 - RNA, 20 nt, Mycobacterium bovis subsp bovis AF2122/97
caccgacgacaccagagcga

SEQ ID NO: 1213485 - RNA, 17 nt, Mycobacterium bovis subsp bovis AF2122/97
caccgaggaccucguca

SEQ ID NO: 1213486 - RNA, 14 nt, Mycobacterium bovis subsp bovis AF2122/97
caccgaggccgccg

SEQ ID NO: 1213487 - RNA, 20 nt, Mycobacterium bovis subsp bovis AF2122/97
caccgaggccgccgagauga

SEQ ID NO: 1213488 - RNA, 15 nt, Mycobacterium bovis subsp bovis AF2122/97
caccgacugcacaua

SEQ ID NO: 1213489 - RNA, 17 nt, Mycobacterium bovis subsp bovis AF2122/97
caccgagaaagugcagu

SEQ ID NO: 1213490 - RNA, 19 nt, Mycobacterium bovis subsp bovis AF2122/97
caccgagaagcugugccuu

SEQ ID NO: 1213491 - RNA, 15 nt, Mycobacterium bovis subsp bovis AF2122/97
caccgagcaucucgu

SEQ ID NO: 1213492 - RNA, 16 nt, Mycobacterium bovis subsp bovis AF2122/97
caccccggcggcgucc

SEQ ID NO: 1213493 - RNA, 22 nt, Mycobacterium bovis subsp bovis AF2122/97
caccccggcggccaucccgcgu

SEQ ID NO: 1213494 - RNA, 14 nt, Mycobacterium bovis subsp bovis AF2122/97
caccccgcgcgcca

SEQ ID NO: 1213495 - RNA, 20 nt, Mycobacterium bovis subsp bovis AF2122/97
caccccggaauccccaagcc

SEQ ID NO: 1213496 - RNA, 14 nt, Mycobacterium bovis subsp bovis AF2122/97
caccccgccaugcg

SEQ ID NO: 1213497 - RNA, 16 nt, Mycobacterium bovis subsp bovis AF2122/97
caccccgccaugcggc

SEQ ID NO: 1213498 - RNA, 21 nt, Mycobacterium bovis subsp bovis AF2122/97
cacccgccggucaaacugcca

SEQ ID NO: 1213499 - RNA, 23 nt, Mycobacterium bovis subsp bovis AF2122/97
cacccgccggucaaacugccauc

SEQ ID NO: 1213500 - RNA, 16 nt, Mycobacterium bovis subsp bovis AF2122/97
cacccgccgugccccc

SEQ ID NO: 1213501 - RNA, 15 nt, Mycobacterium bovis subsp bovis AF2122/97
cacccgccgccgccc

SEQ ID NO: 1213502 - RNA, 18 nt, Mycobacterium bovis subsp bovis AF2122/97
cacccgccgccgcccggg

SEQ ID NO: 1213503 - RNA, 14 nt, Mycobacterium bovis subsp bovis AF2122/97
cacccgccaggccg

SEQ ID NO: 1213504 - RNA, 21 nt, Mycobacterium bovis subsp bovis AF2122/97
cacccgccaggccgcgcgaca

SEQ ID NO: 1213505 - RNA, 20 nt, Mycobacterium bovis subsp bovis AF2122/97
cacccgcaggucgcaccaca

SEQ ID NO: 1213506 - RNA, 23 nt, Mycobacterium bovis subsp bovis AF2122/97
cacccgcaggucgaucugcgcca

SEQ ID NO: 1213507 - RNA, 13 nt, Mycobacterium bovis subsp bovis AF2122/97
cacccgcacucca

SEQ ID NO: 1213508 - RNA, 15 nt, Mycobacterium bovis subsp bovis AF2122/97
caccccggucggccc

SEQ ID NO: 1213509 - RNA, 18 nt, Mycobacterium bovis subsp bovis AF2122/97
cacccggggugcccggcc

SEQ ID NO: 1213510 - RNA, 21 nt, Mycobacterium bovis subsp bovis AF2122/97
cacccggcgggcggugggcag

SEQ ID NO: 1213511 - RNA, 19 nt, Mycobacterium bovis subsp bovis AF2122/97
cacccggcugaaacguccu

SEQ ID NO: 1213512 - RNA, 21 nt, Mycobacterium bovis subsp bovis AF2122/97
cacccgccggauucgcccggg

SEQ ID NO: 1213513 - RNA, 19 nt, Mycobacterium bovis subsp bovis AF2122/97
cacccgccucaucuccugu

SEQ ID NO: 1213514 - RNA, 21 nt, Mycobacterium bovis subsp bovis AF2122/97
cacccgguugugcgcgcgccc

SEQ ID NO: 1213515 - RNA, 18 nt, Mycobacterium bovis subsp bovis AF2122/97
cacccgggccucggcgcc

SEQ ID NO: 1213516 - RNA, 19 nt, Mycobacterium bovis subsp bovis AF2122/97
cacccggguggcacgcacg

SEQ ID NO: 1213517 - RNA, 19 nt, Mycobacterium bovis subsp bovis AF2122/97
cacccggugagaagaagcc

SEQ ID NO: 1213518 - RNA, 18 nt, Mycobacterium bovis subsp bovis AF2122/97
cacccggugccgcagcag

SEQ ID NO: 1213519 - RNA, 17 nt, Mycobacterium bovis subsp bovis AF2122/97
caccccgaccaccagag

SEQ ID NO: 1213520 - RNA, 16 nt, Mycobacterium bovis subsp bovis AF2122/97
caccccgauccgccac

SEQ ID NO: 1213521 - RNA, 17 nt, Mycobacterium bovis subsp bovis AF2122/97
caccccgauccgccacg

SEQ ID NO: 1213522 - RNA, 13 nt, Mycobacterium bovis subsp bovis AF2122/97
cacccccuggacu

SEQ ID NO: 1213523 - RNA, 16 nt, Mycobacterium bovis subsp bovis AF2122/97
cacccccccccccacc

SEQ ID NO: 1213524 - RNA, 21 nt, Mycobacterium bovis subsp bovis AF2122/97
cacccccccccccacccacca

SEQ ID NO: 1213525 - RNA, 17 nt, Mycobacterium bovis subsp bovis AF2122/97
cacccccgucgccaccg

SEQ ID NO: 1213526 - RNA, 14 nt, Mycobacterium bovis subsp bovis AF2122/97
cacccccugcaccg

SEQ ID NO: 1213527 - RNA, 14 nt, Mycobacterium bovis subsp bovis AF2122/97
caccccccagcgcc

SEQ ID NO: 1213528 - RNA, 20 nt, Mycobacterium bovis subsp bovis AF2122/97
caccccccagcgccgccgcg

SEQ ID NO: 1213529 - RNA, 13 nt, Mycobacterium bovis subsp bovis AF2122/97
cacccccggccag

SEQ ID NO: 1213530 - RNA, 17 nt, Mycobacterium bovis subsp bovis AF2122/97
caccccaacagggcggc

SEQ ID NO: 1213531 - RNA, 14 nt, Mycobacterium bovis subsp bovis AF2122/97
caccccacacaguc

SEQ ID NO: 1213532 - RNA, 19 nt, Mycobacterium bovis subsp bovis AF2122/97
caccccaucgauaaccgaa

SEQ ID NO: 1213533 - RNA, 17 nt, Mycobacterium bovis subsp bovis AF2122/97
cacccaucgaccgcccg

SEQ ID NO: 1213534 - RNA, 15 nt, Mycobacterium bovis subsp bovis AF2122/97
cacccaucaucgcca

SEQ ID NO: 1213535 - RNA, 15 nt, Mycobacterium bovis subsp bovis AF2122/97
cacccauggccuccc

SEQ ID NO: 1213536 - RNA, 22 nt, Mycobacterium bovis subsp bovis AF2122/97
cacccaucguuucgaagugccg

SEQ ID NO: 1213537 - RNA, 12 nt, Mycobacterium bovis subsp bovis AF2122/97
cacccaucucga

SEQ ID NO: 1213538 - RNA, 18 nt, Mycobacterium bovis subsp bovis AF2122/97
cacccauucgucgguacc

SEQ ID NO: 1213539 - RNA, 18 nt, Mycobacterium bovis subsp bovis AF2122/97
cacccaggugucgcugcu

SEQ ID NO: 1213540 - RNA, 12 nt, Mycobacterium bovis subsp bovis AF2122/97
cacccaggccau

SEQ ID NO: 1213541 - RNA, 18 nt, Mycobacterium bovis subsp bovis AF2122/97
cacccagggcguuggcgg

SEQ ID NO: 1213542 - RNA, 23 nt, Mycobacterium bovis subsp bovis AF2122/97
cacccagucggcgccgccgucca

SEQ ID NO: 1213543 - RNA, 17 nt, Mycobacterium bovis subsp bovis AF2122/97
cacccaguuccacccgg

SEQ ID NO: 1213544 - RNA, 18 nt, Mycobacterium bovis subsp bovis AF2122/97
cacccaguuccacccggu

SEQ ID NO: 1213545 - RNA, 15 nt, Mycobacterium bovis subsp bovis AF2122/97
cacccagugccacgc

SEQ ID NO: 1213546 - RNA, 16 nt, Mycobacterium bovis subsp bovis AF2122/97
cacccagugccacgcc

SEQ ID NO: 1213547 - RNA, 19 nt, Mycobacterium bovis subsp bovis AF2122/97
cacccagugccacgccuga

SEQ ID NO: 1213548 - RNA, 17 nt, Mycobacterium bovis subsp bovis AF2122/97
cacccagcgacucggcc

SEQ ID NO: 1213549 - RNA, 16 nt, Mycobacterium bovis subsp bovis AF2122/97
cacccaggccgaugug

SEQ ID NO: 1213550 - RNA, 22 nt, Mycobacterium bovis subsp bovis AF2122/97
cacccagcucgcgcacccagcc

SEQ ID NO: 1213551 - RNA, 23 nt, Mycobacterium bovis subsp bovis AF2122/97
cacccagcucgcgcacccagccc

SEQ ID NO: 1213552 - RNA, 13 nt, Mycobacterium bovis subsp bovis AF2122/97
cacccagcgcgcu

SEQ ID NO: 1213553 - RNA, 18 nt, Mycobacterium bovis subsp bovis AF2122/97
cacccagacgauggccag

SEQ ID NO: 1213554 - RNA, 15 nt, Mycobacterium bovis subsp bovis AF2122/97
cacccagacaccggc

SEQ ID NO: 1213555 - RNA, 17 nt, Mycobacterium bovis subsp bovis AF2122/97
cacccagauugccuggg

SEQ ID NO: 1213556 - RNA, 13 nt, Mycobacterium bovis subsp bovis AF2122/97
cacccagccgcag

SEQ ID NO: 1213557 - RNA, 13 nt, Mycobacterium bovis subsp bovis AF2122/97
cacccagcccagc

SEQ ID NO: 1213558 - RNA, 14 nt, Mycobacterium bovis subsp bovis AF2122/97
caccagugccccgc

SEQ ID NO: 1213559 - RNA, 14 nt, Mycobacterium bovis subsp bovis AF2122/97
caccaguccagcgg

SEQ ID NO: 1213560 - RNA, 13 nt, Mycobacterium bovis subsp bovis AF2122/97
caccaguccagcg

SEQ ID NO: 1213561 - RNA, 21 nt, Mycobacterium bovis subsp bovis AF2122/97
cacccaccggaccaccgccga

SEQ ID NO: 1213562 - RNA, 19 nt, Mycobacterium bovis subsp bovis AF2122/97
cacccaccggccaccaggg

SEQ ID NO: 1213563 - RNA, 15 nt, Mycobacterium bovis subsp bovis AF2122/97
caccagugccccgcc

SEQ ID NO: 1213564 - RNA, 15 nt, Mycobacterium bovis subsp bovis AF2122/97
caccaguggcgccca

SEQ ID NO: 1213565 - RNA, 15 nt, Mycobacterium bovis subsp bovis AF2122/97
cacccacuccgccga

SEQ ID NO: 1213566 - RNA, 20 nt, Mycobacterium bovis subsp bovis AF2122/97
caccgcguaguccaggccgu

SEQ ID NO: 1213567 - RNA, 12 nt, Mycobacterium bovis subsp bovis AF2122/97
caccgcgggcag

SEQ ID NO: 1213568 - RNA, 13 nt, Mycobacterium bovis subsp bovis AF2122/97
caccgcguccagg

SEQ ID NO: 1213569 - RNA, 21 nt, Mycobacterium bovis subsp bovis AF2122/97
caccgcggcggcgcguggugc

SEQ ID NO: 1213570 - RNA, 16 nt, Mycobacterium bovis subsp bovis AF2122/97
caccgcggccgaggga

SEQ ID NO: 1213571 - RNA, 13 nt, Mycobacterium bovis subsp bovis AF2122/97
caccgcggccgcg

SEQ ID NO: 1213572 - RNA, 14 nt, Mycobacterium bovis subsp bovis AF2122/97
caccgcggccgcgg

SEQ ID NO: 1213573 - RNA, 15 nt, Mycobacterium bovis subsp bovis AF2122/97
caccgcggccagcgg

SEQ ID NO: 1213574 - RNA, 16 nt, Mycobacterium bovis subsp bovis AF2122/97
caccgcugcggcacca

SEQ ID NO: 1213575 - RNA, 14 nt, Mycobacterium bovis subsp bovis AF2122/97
caccgcugccggca

SEQ ID NO: 1213576 - RNA, 14 nt, Mycobacterium bovis subsp bovis AF2122/97
caccgcguuggcca

SEQ ID NO: 1213577 - RNA, 23 nt, Mycobacterium bovis subsp bovis AF2122/97
caccgcguugaugaccgccgccg

SEQ ID NO: 1213578 - RNA, 13 nt, Mycobacterium bovis subsp bovis AF2122/97
caccgcuugcugg

SEQ ID NO: 1213579 - RNA, 17 nt, Mycobacterium bovis subsp bovis AF2122/97
caccgcuugaccccugg

SEQ ID NO: 1213580 - RNA, 19 nt, Mycobacterium bovis subsp bovis AF2122/97
caccgcuucaggcgccacu

SEQ ID NO: 1213581 - RNA, 18 nt, Mycobacterium bovis subsp bovis AF2122/97
caccgcgucguagccacg

SEQ ID NO: 1213582 - RNA, 24 nt, Mycobacterium bovis subsp bovis AF2122/97
caccgccuuugccgccggcaccgc

SEQ ID NO: 1213583 - RNA, 17 nt, Mycobacterium bovis subsp bovis AF2122/97
caccgcgaccaucgcga

SEQ ID NO: 1213584 - RNA, 22 nt, Mycobacterium bovis subsp bovis AF2122/97
caccgcgcggcgcagcaccguc

SEQ ID NO: 1213585 - RNA, 17 nt, Mycobacterium bovis subsp bovis AF2122/97
caccgccuuugccgccg

SEQ ID NO: 1213586 - RNA, 19 nt, Mycobacterium bovis subsp bovis AF2122/97
caccgccugcucggcgacc

SEQ ID NO: 1213587 - RNA, 16 nt, Mycobacterium bovis subsp bovis AF2122/97
caccgccugcgccgcc

SEQ ID NO: 1213588 - RNA, 17 nt, Mycobacterium bovis subsp bovis AF2122/97
caccgccugcgccgccc

SEQ ID NO: 1213589 - RNA, 13 nt, Mycobacterium bovis subsp bovis AF2122/97
caccgccaccacc

SEQ ID NO: 1213590 - RNA, 16 nt, Mycobacterium bovis subsp bovis AF2122/97
caccgccaccacccag

SEQ ID NO: 1213591 - RNA, 15 nt, Mycobacterium bovis subsp bovis AF2122/97
caccgccaccacggu

SEQ ID NO: 1213592 - RNA, 13 nt, Mycobacterium bovis subsp bovis AF2122/97
caccgaguuccuc

SEQ ID NO: 1213593 - RNA, 14 nt, Mycobacterium bovis subsp bovis AF2122/97
caccgaguuccucu

SEQ ID NO: 1213594 - RNA, 22 nt, Mycobacterium bovis subsp bovis AF2122/97
caccgaggucgagcgaccccac

SEQ ID NO: 1213595 - RNA, 16 nt, Mycobacterium bovis subsp bovis AF2122/97
caccgaggugccgcgc

SEQ ID NO: 1213596 - RNA, 20 nt, Mycobacterium bovis subsp bovis AF2122/97
caccgaggugccgcgcagcu

SEQ ID NO: 1213597 - RNA, 14 nt, Mycobacterium bovis subsp bovis AF2122/97
caccgagguugcgc

SEQ ID NO: 1213598 - RNA, 22 nt, Mycobacterium bovis subsp bovis AF2122/97
caccgauaccgucagcgccgcu

SEQ ID NO: 1213599 - RNA, 20 nt, Mycobacterium bovis subsp bovis AF2122/97
caccgcauuguugaagaaag

SEQ ID NO: 1213600 - RNA, 16 nt, Mycobacterium bovis subsp bovis AF2122/97
caccgcagccaacguc

SEQ ID NO: 1213601 - RNA, 22 nt, Mycobacterium bovis subsp bovis AF2122/97
caccgcagccaacgucaccaag

SEQ ID NO: 1213602 - RNA, 20 nt, Mycobacterium bovis subsp bovis AF2122/97
caccgcauaacgccaguccc

SEQ ID NO: 1213603 - RNA, 14 nt, Mycobacterium bovis subsp bovis AF2122/97
caccggcaggcggg

SEQ ID NO: 1213604 - RNA, 17 nt, Mycobacterium bovis subsp bovis AF2122/97
caccggaacccccagcu

SEQ ID NO: 1213605 - RNA, 20 nt, Mycobacterium bovis subsp bovis AF2122/97
caccggaacccccagcugca

SEQ ID NO: 1213606 - RNA, 21 nt, Mycobacterium bovis subsp bovis AF2122/97
caccggaauccuggccgccgc

SEQ ID NO: 1213607 - RNA, 20 nt, Mycobacterium bovis subsp bovis AF2122/97
caccggcuucuccuccagag

SEQ ID NO: 1213608 - RNA, 14 nt, Mycobacterium bovis subsp bovis AF2122/97
caccggcgugcugu

SEQ ID NO: 1213609 - RNA, 21 nt, Mycobacterium bovis subsp bovis AF2122/97
caccggcgucguaggagccgu

SEQ ID NO: 1213610 - RNA, 19 nt, Mycobacterium bovis subsp bovis AF2122/97
caccggcggucugcagugc

SEQ ID NO: 1213611 - RNA, 13 nt, Mycobacterium bovis subsp bovis AF2122/97
caccggcgucgcu

SEQ ID NO: 1213612 - RNA, 20 nt, Mycobacterium bovis subsp bovis AF2122/97
caccggcuaugcuggcgcag

SEQ ID NO: 1213613 - RNA, 20 nt, Mycobacterium bovis subsp bovis AF2122/97
caccgucguacucggcggcc

SEQ ID NO: 1213614 - RNA, 21 nt, Mycobacterium bovis subsp bovis AF2122/97
caccgucggaacugaccacgu

SEQ ID NO: 1213615 - RNA, 17 nt, Mycobacterium bovis subsp bovis AF2122/97
caccgucggcaccagca

SEQ ID NO: 1213616 - RNA, 13 nt, Mycobacterium bovis subsp bovis AF2122/97
caccgucgggccc

SEQ ID NO: 1213617 - RNA, 17 nt, Mycobacterium bovis subsp bovis AF2122/97
caccgucgggcccagcc

SEQ ID NO: 1213618 - RNA, 14 nt, Mycobacterium bovis subsp bovis AF2122/97
caccgucgcaccca

SEQ ID NO: 1213619 - RNA, 20 nt, Mycobacterium bovis subsp bovis AF2122/97
caccgucgcauacgcccacu

SEQ ID NO: 1213620 - RNA, 18 nt, Mycobacterium bovis subsp bovis AF2122/97
caccgucgcugcccgcgc

SEQ ID NO: 1213621 - RNA, 23 nt, Mycobacterium bovis subsp bovis AF2122/97
caccgucgcugcccgcgcggcca

SEQ ID NO: 1213622 - RNA, 15 nt, Mycobacterium bovis subsp bovis AF2122/97
caccgucaccgagcc

SEQ ID NO: 1213623 - RNA, 22 nt, Mycobacterium bovis subsp bovis AF2122/97
caccguugcguuggcgccacca

SEQ ID NO: 1213624 - RNA, 16 nt, Mycobacterium bovis subsp bovis AF2122/97
caccgucucgccgcgc

SEQ ID NO: 1213625 - RNA, 17 nt, Mycobacterium bovis subsp bovis AF2122/97
caccguuggccgcgcuc

SEQ ID NO: 1213626 - RNA, 22 nt, Mycobacterium bovis subsp bovis AF2122/97
caccuaccgagaucaccgccac

SEQ ID NO: 1213627 - RNA, 18 nt, Mycobacterium bovis subsp bovis AF2122/97
caccucaaacgccugguc

SEQ ID NO: 1213628 - RNA, 18 nt, Mycobacterium bovis subsp bovis AF2122/97
caccucagaaaguccccg

SEQ ID NO: 1213629 - RNA, 23 nt, Mycobacterium bovis subsp bovis AF2122/97
cacggcgauccggucggccaggc

SEQ ID NO: 1213630 - RNA, 18 nt, Mycobacterium bovis subsp bovis AF2122/97
cacggcgacgaucucggc

SEQ ID NO: 1213631 - RNA, 22 nt, Mycobacterium bovis subsp bovis AF2122/97
cacggccuugccgaucagcugg

SEQ ID NO: 1213632 - RNA, 16 nt, Mycobacterium bovis subsp bovis AF2122/97
cacggcgcgcgcgccg

SEQ ID NO: 1213633 - RNA, 13 nt, Mycobacterium bovis subsp bovis AF2122/97
cacggcgccgcca

SEQ ID NO: 1213634 - RNA, 23 nt, Mycobacterium bovis subsp bovis AF2122/97
cacggcgccuacaccggcgcuca

SEQ ID NO: 1213635 - RNA, 23 nt, Mycobacterium bovis subsp bovis AF2122/97
cacggcggaagaagugcacugcg

SEQ ID NO: 1213636 - RNA, 18 nt, Mycobacterium bovis subsp bovis AF2122/97
cacggcgcguugggacca

SEQ ID NO: 1213637 - RNA, 18 nt, Mycobacterium bovis subsp bovis AF2122/97
cacgggaucgaucugcgg

SEQ ID NO: 1213638 - RNA, 21 nt, Mycobacterium bovis subsp bovis AF2122/97
cacggcggcaucaccuggcgu

SEQ ID NO: 1213639 - RNA, 16 nt, Mycobacterium bovis subsp bovis AF2122/97
cacgggccguccagga

SEQ ID NO: 1213640 - RNA, 12 nt, Mycobacterium bovis subsp bovis AF2122/97
cacgggcggcca

SEQ ID NO: 1213641 - RNA, 12 nt, Mycobacterium bovis subsp bovis AF2122/97
cacgggcccagg

SEQ ID NO: 1213642 - RNA, 13 nt, Mycobacterium bovis subsp bovis AF2122/97
cacgggcagcuuc

SEQ ID NO: 1213643 - RNA, 14 nt, Mycobacterium bovis subsp bovis AF2122/97
cacgggccaccagc

SEQ ID NO: 1213644 - RNA, 17 nt, Mycobacterium bovis subsp bovis AF2122/97
cacgggaugcaugucuu

SEQ ID NO: 1213645 - RNA, 15 nt, Mycobacterium bovis subsp bovis AF2122/97
cacgggcggccaugg

SEQ ID NO: 1213646 - RNA, 17 nt, Mycobacterium bovis subsp bovis AF2122/97
cacgggcggccauggca

SEQ ID NO: 1213647 - RNA, 20 nt, Mycobacterium bovis subsp bovis AF2122/97
cacgggcggggacggcggca

SEQ ID NO: 1213648 - RNA, 20 nt, Mycobacterium bovis subsp bovis AF2122/97
cacgggcucgcugcaccagc

SEQ ID NO: 1213649 - RNA, 21 nt, Mycobacterium bovis subsp bovis AF2122/97
cacggggcgugacagggcggc

SEQ ID NO: 1213650 - RNA, 18 nt, Mycobacterium bovis subsp bovis AF2122/97
cacgggucgucaugccag

SEQ ID NO: 1213651 - RNA, 18 nt, Mycobacterium bovis subsp bovis AF2122/97
cacgggugagcaccacgu

SEQ ID NO: 1213652 - RNA, 20 nt, Mycobacterium bovis subsp bovis AF2122/97
cacggauacccuucgucaca

SEQ ID NO: 1213653 - RNA, 14 nt, Mycobacterium bovis subsp bovis AF2122/97
cacggagaccgugg

SEQ ID NO: 1213654 - RNA, 17 nt, Mycobacterium bovis subsp bovis AF2122/97
cacggagccgccggcgg

SEQ ID NO: 1213655 - RNA, 20 nt, Mycobacterium bovis subsp bovis AF2122/97
cacggcaaaggcgcucugcu

SEQ ID NO: 1213656 - RNA, 23 nt, Mycobacterium bovis subsp bovis AF2122/97
cacggcagacacgcugcaggcgg

SEQ ID NO: 1213657 - RNA, 18 nt, Mycobacterium bovis subsp bovis AF2122/97
cacgcuccagcucggcca

SEQ ID NO: 1213658 - RNA, 17 nt, Mycobacterium bovis subsp bovis AF2122/97
cacgcguuccuccagca

SEQ ID NO: 1213659 - RNA, 20 nt, Mycobacterium bovis subsp bovis AF2122/97
cacgcguuccuccagcagcg

SEQ ID NO: 1213660 - RNA, 21 nt, Mycobacterium bovis subsp bovis AF2122/97
cacgcgcccgcaccaccggcc

SEQ ID NO: 1213661 - RNA, 23 nt, Mycobacterium bovis subsp bovis AF2122/97
cacgcgcguuuagucuccggcgu

SEQ ID NO: 1213662 - RNA, 14 nt, Mycobacterium bovis subsp bovis AF2122/97
cacgcgggaagugc

SEQ ID NO: 1213663 - RNA, 23 nt, Mycobacterium bovis subsp bovis AF2122/97
cacgcguacgucgguccacccaa

SEQ ID NO: 1213664 - RNA, 13 nt, Mycobacterium bovis subsp bovis AF2122/97
cacgcgugcacca

SEQ ID NO: 1213665 - RNA, 13 nt, Mycobacterium bovis subsp bovis AF2122/97
cacgcggucccac

SEQ ID NO: 1213666 - RNA, 19 nt, Mycobacterium bovis subsp bovis AF2122/97
cacgcgacuugcaccccgu

SEQ ID NO: 1213667 - RNA, 16 nt, Mycobacterium bovis subsp bovis AF2122/97
cacgcgacgcggggcu

SEQ ID NO: 1213668 - RNA, 17 nt, Mycobacterium bovis subsp bovis AF2122/97
cacgccuugagccgagg

SEQ ID NO: 1213669 - RNA, 14 nt, Mycobacterium bovis subsp bovis AF2122/97
cacgccucgccgaa

SEQ ID NO: 1213670 - RNA, 21 nt, Mycobacterium bovis subsp bovis AF2122/97
cacgccuggcuacgcgcgccc

SEQ ID NO: 1213671 - RNA, 20 nt, Mycobacterium bovis subsp bovis AF2122/97
cacgccgaugauggacacca

SEQ ID NO: 1213672 - RNA, 16 nt, Mycobacterium bovis subsp bovis AF2122/97
cacgccguagcgcagc

SEQ ID NO: 1213673 - RNA, 23 nt, Mycobacterium bovis subsp bovis AF2122/97
cacgccguagcgcagcgccuccu

SEQ ID NO: 1213674 - RNA, 17 nt, Mycobacterium bovis subsp bovis AF2122/97
cacgccgaccagcaccc

SEQ ID NO: 1213675 - RNA, 15 nt, Mycobacterium bovis subsp bovis AF2122/97
cacgccgaucaacau

SEQ ID NO: 1213676 - RNA, 18 nt, Mycobacterium bovis subsp bovis AF2122/97
cacgcaacaccgccaacu

SEQ ID NO: 1213677 - RNA, 20 nt, Mycobacterium bovis subsp bovis AF2122/97
caccuggaaggucagcgccc

SEQ ID NO: 1213678 - RNA, 15 nt, Mycobacterium bovis subsp bovis AF2122/97
caccuggccgcccgc

SEQ ID NO: 1213679 - RNA, 17 nt, Mycobacterium bovis subsp bovis AF2122/97
caccugcuggaagccgu

SEQ ID NO: 1213680 - RNA, 16 nt, Mycobacterium bovis subsp bovis AF2122/97
caccuggucggccgca

SEQ ID NO: 1213681 - RNA, 19 nt, Mycobacterium bovis subsp bovis AF2122/97
caccuggcgugucgccgcc

SEQ ID NO: 1213682 - RNA, 15 nt, Mycobacterium bovis subsp bovis AF2122/97
caccuggcgcgcgca

SEQ ID NO: 1213683 - RNA, 23 nt, Mycobacterium bovis subsp bovis AF2122/97
caccuggcgugucgccgccacca

SEQ ID NO: 1213684 - RNA, 21 nt, Mycobacterium bovis subsp bovis AF2122/97
caccugggcugccggccagac

SEQ ID NO: 1213685 - RNA, 16 nt, Mycobacterium bovis subsp bovis AF2122/97
caccuccgacggccgc

SEQ ID NO: 1213686 - RNA, 13 nt, Mycobacterium bovis subsp bovis AF2122/97
caccucccacgcc

SEQ ID NO: 1213687 - RNA, 19 nt, Mycobacterium bovis subsp bovis AF2122/97
caccuccgaggccgccauc

SEQ ID NO: 1213688 - RNA, 18 nt, Mycobacterium bovis subsp bovis AF2122/97
caccuccgacggccgcgg

SEQ ID NO: 1213689 - RNA, 21 nt, Mycobacterium bovis subsp bovis AF2122/97
caccuccgacggccgcggcgu

SEQ ID NO: 1213690 - RNA, 16 nt, Mycobacterium bovis subsp bovis AF2122/97
caccuccagcaccacc

SEQ ID NO: 1213691 - RNA, 16 nt, Mycobacterium bovis subsp bovis AF2122/97
caccuccaccgcgccg

SEQ ID NO: 1213692 - RNA, 22 nt, Mycobacterium bovis subsp bovis AF2122/97
caccuccaauugcgaaccggcc

SEQ ID NO: 1213693 - RNA, 22 nt, Mycobacterium bovis subsp bovis AF2122/97
caccuuagcgcuugccgcugag

SEQ ID NO: 1213694 - RNA, 20 nt, Mycobacterium bovis subsp bovis AF2122/97
caccuguuggcaugccgccc

SEQ ID NO: 1213695 - RNA, 23 nt, Mycobacterium bovis subsp bovis AF2122/97
cacgaucucguggaucugccucu

SEQ ID NO: 1213696 - RNA, 22 nt, Mycobacterium bovis subsp bovis AF2122/97
cacgaucgcggugauggugaau

SEQ ID NO: 1213697 - RNA, 23 nt, Mycobacterium bovis subsp bovis AF2122/97
cacgaucggcggggguggaauca

SEQ ID NO: 1213698 - RNA, 22 nt, Mycobacterium bovis subsp bovis AF2122/97
cacgauccgcgguagcagcagc

SEQ ID NO: 1213699 - RNA, 20 nt, Mycobacterium bovis subsp bovis AF2122/97
cacgaguccgcggaucacca

SEQ ID NO: 1213700 - RNA, 23 nt, Mycobacterium bovis subsp bovis AF2122/97
cacgaucugcaggcccaggcugu

SEQ ID NO: 1213701 - RNA, 16 nt, Mycobacterium bovis subsp bovis AF2122/97
cacgaucugcgcguca

SEQ ID NO: 1213702 - RNA, 18 nt, Mycobacterium bovis subsp bovis AF2122/97
cacgaugcgguucucgag

SEQ ID NO: 1213703 - RNA, 23 nt, Mycobacterium bovis subsp bovis AF2122/97
cacgaugcgguucucgagcucgg

SEQ ID NO: 1213704 - RNA, 15 nt, Mycobacterium bovis subsp bovis AF2122/97
cacgacaggucgccc

SEQ ID NO: 1213705 - RNA, 15 nt, Mycobacterium bovis subsp bovis AF2122/97
cacgacucccccggc

SEQ ID NO: 1213706 - RNA, 17 nt, Mycobacterium bovis subsp bovis AF2122/97
cacgagcagccgaugcu

SEQ ID NO: 1213707 - RNA, 21 nt, Mycobacterium bovis subsp bovis AF2122/97
cacgaggcaucguccacgcag

SEQ ID NO: 1213708 - RNA, 22 nt, Mycobacterium bovis subsp bovis AF2122/97
cacgaggcaucguccacgcaga

SEQ ID NO: 1213709 - RNA, 17 nt, Mycobacterium bovis subsp bovis AF2122/97
cacgacugugcgccgca

SEQ ID NO: 1213710 - RNA, 14 nt, Mycobacterium bovis subsp bovis AF2122/97
cacgaaaccgcagc

SEQ ID NO: 1213711 - RNA, 22 nt, Mycobacterium bovis subsp bovis AF2122/97
cacgaacccucagccgcgccgg

SEQ ID NO: 1213712 - RNA, 23 nt, Mycobacterium bovis subsp bovis AF2122/97
cacgaacgccugcucgucggcca

SEQ ID NO: 1213713 - RNA, 16 nt, Mycobacterium bovis subsp bovis AF2122/97
caaguccaacgacugu

SEQ ID NO: 1213714 - RNA, 20 nt, Mycobacterium bovis subsp bovis AF2122/97
caagucaccauagcucaggg

SEQ ID NO: 1213715 - RNA, 17 nt, Mycobacterium bovis subsp bovis AF2122/97
caagucacagcucacca

SEQ ID NO: 1213716 - RNA, 12 nt, Mycobacterium bovis subsp bovis AF2122/97
caaggccaccgg

SEQ ID NO: 1213717 - RNA, 14 nt, Mycobacterium bovis subsp bovis AF2122/97
caaggauggucgcc

SEQ ID NO: 1213718 - RNA, 23 nt, Mycobacterium bovis subsp bovis AF2122/97
caaggaugucggggcgaagcuug

SEQ ID NO: 1213719 - RNA, 18 nt, Mycobacterium bovis subsp bovis AF2122/97
caagcugggcguaaaccg

SEQ ID NO: 1213720 - RNA, 16 nt, Mycobacterium bovis subsp bovis AF2122/97
caagucggcgcuggcc

SEQ ID NO: 1213721 - RNA, 18 nt, Mycobacterium bovis subsp bovis AF2122/97
caagucugcccgacugcc

SEQ ID NO: 1213722 - RNA, 15 nt, Mycobacterium bovis subsp bovis AF2122/97
caagucugucuggcc

SEQ ID NO: 1213723 - RNA, 12 nt, Mycobacterium bovis subsp bovis AF2122/97
caagucugugcu

SEQ ID NO: 1213724 - RNA, 13 nt, Mycobacterium bovis subsp bovis AF2122/97
caaguccagcagc

SEQ ID NO: 1213725 - RNA, 15 nt, Mycobacterium bovis subsp bovis AF2122/97
caaguccuucacugc

SEQ ID NO: 1213726 - RNA, 20 nt, Mycobacterium bovis subsp bovis AF2122/97
caagucgccgaggcaaccga

SEQ ID NO: 1213727 - RNA, 21 nt, Mycobacterium bovis subsp bovis AF2122/97
caagucgauguacaccgugcg

SEQ ID NO: 1213728 - RNA, 23 nt, Mycobacterium bovis subsp bovis AF2122/97
caagugccggcgcggagugccca

SEQ ID NO: 1213729 - RNA, 18 nt, Mycobacterium bovis subsp bovis AF2122/97
caagugcuggccgaagaa

SEQ ID NO: 1213730 - RNA, 19 nt, Mycobacterium bovis subsp bovis AF2122/97
caagugcuuccggccauug

SEQ ID NO: 1213731 - RNA, 16 nt, Mycobacterium bovis subsp bovis AF2122/97
caagugugagcagacc

SEQ ID NO: 1213732 - RNA, 15 nt, Mycobacterium bovis subsp bovis AF2122/97
caagugggugagaaa

SEQ ID NO: 1213733 - RNA, 19 nt, Mycobacterium bovis subsp bovis AF2122/97
caagugucuccggcaacag

SEQ ID NO: 1213734 - RNA, 21 nt, Mycobacterium bovis subsp bovis AF2122/97
caagugucuccggcaacagca

SEQ ID NO: 1213735 - RNA, 13 nt, Mycobacterium bovis subsp bovis AF2122/97
caaguggcgcucg

SEQ ID NO: 1213736 - RNA, 20 nt, Mycobacterium bovis subsp bovis AF2122/97
caaguggcgcucgcaaacaa

SEQ ID NO: 1213737 - RNA, 16 nt, Mycobacterium bovis subsp bovis AF2122/97
caaguucgccagcaac

SEQ ID NO: 1213738 - RNA, 21 nt, Mycobacterium bovis subsp bovis AF2122/97
caaguucgccagcaacgucgg

SEQ ID NO: 1213739 - RNA, 20 nt, Mycobacterium bovis subsp bovis AF2122/97
caaguucagcacgugggcca

SEQ ID NO: 1213740 - RNA, 18 nt, Mycobacterium bovis subsp bovis AF2122/97
caauacacccaacucaug

SEQ ID NO: 1213741 - RNA, 19 nt, Mycobacterium bovis subsp bovis AF2122/97
caauccaccgaagccccuc

SEQ ID NO: 1213742 - RNA, 15 nt, Mycobacterium bovis subsp bovis AF2122/97
caauccaccgauucg

SEQ ID NO: 1213743 - RNA, 19 nt, Mycobacterium bovis subsp bovis AF2122/97
caaucagcccgacaccguc

SEQ ID NO: 1213744 - RNA, 18 nt, Mycobacterium bovis subsp bovis AF2122/97
caaucgagaacgcccgcu

SEQ ID NO: 1213745 - RNA, 13 nt, Mycobacterium bovis subsp bovis AF2122/97
caaucgaggaagg

SEQ ID NO: 1213746 - RNA, 17 nt, Mycobacterium bovis subsp bovis AF2122/97
caaucccggccaggggc

SEQ ID NO: 1213747 - RNA, 21 nt, Mycobacterium bovis subsp bovis AF2122/97
caaucguccacccgagcucuu

SEQ ID NO: 1213748 - RNA, 16 nt, Mycobacterium bovis subsp bovis AF2122/97
caaucgucggccagca

SEQ ID NO: 1213749 - RNA, 17 nt, Mycobacterium bovis subsp bovis AF2122/97
caaucaacgucaccccc

SEQ ID NO: 1213750 - RNA, 12 nt, Mycobacterium bovis subsp bovis AF2122/97
caaucaccaccg

SEQ ID NO: 1213751 - RNA, 19 nt, Mycobacterium bovis subsp bovis AF2122/97
caauacggucagcagacug

SEQ ID NO: 1213752 - RNA, 16 nt, Mycobacterium bovis subsp bovis AF2122/97
caagaucggcgccccu

SEQ ID NO: 1213753 - RNA, 17 nt, Mycobacterium bovis subsp bovis AF2122/97
caagaaguacagcuggc

SEQ ID NO: 1213754 - RNA, 16 nt, Mycobacterium bovis subsp bovis AF2122/97
caacuucaccacccug

SEQ ID NO: 1213755 - RNA, 14 nt, Mycobacterium bovis subsp bovis AF2122/97
caagaauucaccac

SEQ ID NO: 1213756 - RNA, 17 nt, Mycobacterium bovis subsp bovis AF2122/97
caagaauucaccacucc

SEQ ID NO: 1213757 - RNA, 17 nt, Mycobacterium bovis subsp bovis AF2122/97
caagaccaagugucgcc

SEQ ID NO: 1213758 - RNA, 12 nt, Mycobacterium bovis subsp bovis AF2122/97
caagacagccug

SEQ ID NO: 1213759 - RNA, 17 nt, Mycobacterium bovis subsp bovis AF2122/97
caagaaucaccggcaau

SEQ ID NO: 1213760 - RNA, 16 nt, Mycobacterium bovis subsp bovis AF2122/97
caagaaucagcagcag

SEQ ID NO: 1213761 - RNA, 18 nt, Mycobacterium bovis subsp bovis AF2122/97
caagaauggccgccuuga

SEQ ID NO: 1213762 - RNA, 14 nt, Mycobacterium bovis subsp bovis AF2122/97
caagcucggccacc

SEQ ID NO: 1213763 - RNA, 21 nt, Mycobacterium bovis subsp bovis AF2122/97
caagcucggccaccagcgccc

SEQ ID NO: 1213764 - RNA, 22 nt, Mycobacterium bovis subsp bovis AF2122/97
caagcugacacgacgaacuagg

SEQ ID NO: 1213765 - RNA, 21 nt, Mycobacterium bovis subsp bovis AF2122/97
caagcucggcccagcgcgcca

SEQ ID NO: 1213766 - RNA, 13 nt, Mycobacterium bovis subsp bovis AF2122/97
caagcgcagccug

SEQ ID NO: 1213767 - RNA, 18 nt, Mycobacterium bovis subsp bovis AF2122/97
caagcgccaacaacccaa

SEQ ID NO: 1213768 - RNA, 13 nt, Mycobacterium bovis subsp bovis AF2122/97
caagccugcgcug

SEQ ID NO: 1213769 - RNA, 15 nt, Mycobacterium bovis subsp bovis AF2122/97
caagccuuaccccgc

SEQ ID NO: 1213770 - RNA, 24 nt, Mycobacterium bovis subsp bovis AF2122/97
caagccuuaccccgcagcucaccu

SEQ ID NO: 1213771 - RNA, 14 nt, Mycobacterium bovis subsp bovis AF2122/97
caagauggcgcgcu

SEQ ID NO: 1213772 - RNA, 13 nt, Mycobacterium bovis subsp bovis AF2122/97
caagauguccggu

SEQ ID NO: 1213773 - RNA, 13 nt, Mycobacterium bovis subsp bovis AF2122/97
caagccggacaga

SEQ ID NO: 1213774 - RNA, 22 nt, Mycobacterium bovis subsp bovis AF2122/97
caagccgcugauguacccggcg

SEQ ID NO: 1213775 - RNA, 20 nt, Mycobacterium bovis subsp bovis AF2122/97
caagccgcggcuaggccagc

SEQ ID NO: 1213776 - RNA, 14 nt, Mycobacterium bovis subsp bovis AF2122/97
caagccgugcagcu

SEQ ID NO: 1213777 - RNA, 18 nt, Mycobacterium bovis subsp bovis AF2122/97
caagccguagaccaggcc

SEQ ID NO: 1213778 - RNA, 19 nt, Mycobacterium bovis subsp bovis AF2122/97
caagccguagaccaggccc

SEQ ID NO: 1213779 - RNA, 21 nt, Mycobacterium bovis subsp bovis AF2122/97
caagccguaguaguggccgcc

SEQ ID NO: 1213780 - RNA, 17 nt, Mycobacterium bovis subsp bovis AF2122/97
caagccguucugucccg

SEQ ID NO: 1213781 - RNA, 18 nt, Mycobacterium bovis subsp bovis AF2122/97
caagccggcgcccgccgc

SEQ ID NO: 1213782 - RNA, 18 nt, Mycobacterium bovis subsp bovis AF2122/97
caagccgugcugcccauc

SEQ ID NO: 1213783 - RNA, 17 nt, Mycobacterium bovis subsp bovis AF2122/97
caacucguccagcagug

SEQ ID NO: 1213784 - RNA, 20 nt, Mycobacterium bovis subsp bovis AF2122/97
caacuccaagaugccgcccc

SEQ ID NO: 1213785 - RNA, 16 nt, Mycobacterium bovis subsp bovis AF2122/97
caacucgggcagcuuc

SEQ ID NO: 1213786 - RNA, 20 nt, Mycobacterium bovis subsp bovis AF2122/97
caacucgggcagcuucaaca

SEQ ID NO: 1213787 - RNA, 22 nt, Mycobacterium bovis subsp bovis AF2122/97
caacucgggcagcuucaacacc

SEQ ID NO: 1213788 - RNA, 16 nt, Mycobacterium bovis subsp bovis AF2122/97
caacucuucagcaagc

SEQ ID NO: 1213789 - RNA, 18 nt, Mycobacterium bovis subsp bovis AF2122/97
caacugccgcacccgguc

SEQ ID NO: 1213790 - RNA, 14 nt, Mycobacterium bovis subsp bovis AF2122/97
caacugcgccguuc

SEQ ID NO: 1213791 - RNA, 22 nt, Mycobacterium bovis subsp bovis AF2122/97
caacugcgccguucgcuccccc

SEQ ID NO: 1213792 - RNA, 23 nt, Mycobacterium bovis subsp bovis AF2122/97
caacugcgccguucgcucccccg

SEQ ID NO: 1213793 - RNA, 21 nt, Mycobacterium bovis subsp bovis AF2122/97
caacguugguccgcugcagca

SEQ ID NO: 1213794 - RNA, 16 nt, Mycobacterium bovis subsp bovis AF2122/97
caacguuguagcccaa

SEQ ID NO: 1213795 - RNA, 22 nt, Mycobacterium bovis subsp bovis AF2122/97
caacuaucgucgugucgccgcc

SEQ ID NO: 1213796 - RNA, 23 nt, Mycobacterium bovis subsp bovis AF2122/97
caacuaucgucgugucgccgccg

SEQ ID NO: 1213797 - RNA, 19 nt, Mycobacterium bovis subsp bovis AF2122/97
caacgguuggucgaacaga

SEQ ID NO: 1213798 - RNA, 16 nt, Mycobacterium bovis subsp bovis AF2122/97
caacguagccagcagc

SEQ ID NO: 1213799 - RNA, 20 nt, Mycobacterium bovis subsp bovis AF2122/97
caacgucgcguucuccggca

SEQ ID NO: 1213800 - RNA, 23 nt, Mycobacterium bovis subsp bovis AF2122/97
caacgucgcguucuccggcaccg

SEQ ID NO: 1213801 - RNA, 13 nt, Mycobacterium bovis subsp bovis AF2122/97
caacgucaccccc

SEQ ID NO: 1213802 - RNA, 17 nt, Mycobacterium bovis subsp bovis AF2122/97
caacgucacgucgacgg

SEQ ID NO: 1213803 - RNA, 17 nt, Mycobacterium bovis subsp bovis AF2122/97
caacgcguugcacagca

SEQ ID NO: 1213804 - RNA, 14 nt, Mycobacterium bovis subsp bovis AF2122/97
caacgcuucugccu

SEQ ID NO: 1213805 - RNA, 17 nt, Mycobacterium bovis subsp bovis AF2122/97
caacggacgggaucgcc

SEQ ID NO: 1213806 - RNA, 22 nt, Mycobacterium bovis subsp bovis AF2122/97
caacggacgggaucgcccaggc

SEQ ID NO: 1213807 - RNA, 21 nt, Mycobacterium bovis subsp bovis AF2122/97
caacggaagaagcaguagcug

SEQ ID NO: 1213808 - RNA, 13 nt, Mycobacterium bovis subsp bovis AF2122/97
caacggcgcggca

SEQ ID NO: 1213809 - RNA, 16 nt, Mycobacterium bovis subsp bovis AF2122/97
caacggcgcgccgacc

SEQ ID NO: 1213810 - RNA, 20 nt, Mycobacterium bovis subsp bovis AF2122/97
caacggaggugccggcgcca

SEQ ID NO: 1213811 - RNA, 18 nt, Mycobacterium bovis subsp bovis AF2122/97
caacggauaucagcaaca

SEQ ID NO: 1213812 - RNA, 17 nt, Mycobacterium bovis subsp bovis AF2122/97
caacggccacaugccac

SEQ ID NO: 1213813 - RNA, 20 nt, Mycobacterium bovis subsp bovis AF2122/97
caacgggccuucagcucacc

SEQ ID NO: 1213814 - RNA, 19 nt, Mycobacterium bovis subsp bovis AF2122/97
caacgguaguugcgcggca

SEQ ID NO: 1213815 - RNA, 15 nt, Mycobacterium bovis subsp bovis AF2122/97
caaccgggaucugcu

SEQ ID NO: 1213816 - RNA, 18 nt, Mycobacterium bovis subsp bovis AF2122/97
caaccgggaggccaccgc

SEQ ID NO: 1213817 - RNA, 18 nt, Mycobacterium bovis subsp bovis AF2122/97
caaccgggacaaccccuu

SEQ ID NO: 1213818 - RNA, 21 nt, Mycobacterium bovis subsp bovis AF2122/97
caaccgguagccaggcgcgcu

SEQ ID NO: 1213819 - RNA, 17 nt, Mycobacterium bovis subsp bovis AF2122/97
caaccgguaucgccgcu

SEQ ID NO: 1213820 - RNA, 16 nt, Mycobacterium bovis subsp bovis AF2122/97
caaccgugagcaccag

SEQ ID NO: 1213821 - RNA, 18 nt, Mycobacterium bovis subsp bovis AF2122/97
caaccgugagcaccagca

SEQ ID NO: 1213822 - RNA, 20 nt, Mycobacterium bovis subsp bovis AF2122/97
caaccgucccaaugcaacaa

SEQ ID NO: 1213823 - RNA, 15 nt, Mycobacterium bovis subsp bovis AF2122/97
caaccgucgaaaaau

SEQ ID NO: 1213824 - RNA, 19 nt, Mycobacterium bovis subsp bovis AF2122/97
caaccguuguaccccagca

SEQ ID NO: 1213825 - RNA, 18 nt, Mycobacterium bovis subsp bovis AF2122/97
caaccuaaauugccgggc

SEQ ID NO: 1213826 - RNA, 11 nt, Mycobacterium bovis subsp bovis AF2122/97
caacgcggcga

SEQ ID NO: 1213827 - RNA, 15 nt, Mycobacterium bovis subsp bovis AF2122/97
caacgcggucugcuc

SEQ ID NO: 1213828 - RNA, 15 nt, Mycobacterium bovis subsp bovis AF2122/97
caacgcggugggcac

SEQ ID NO: 1213829 - RNA, 19 nt, Mycobacterium bovis subsp bovis AF2122/97
caacgcggugggcacagcc

SEQ ID NO: 1213830 - RNA, 22 nt, Mycobacterium bovis subsp bovis AF2122/97
caacgcgcaccuggcgcgcgca

SEQ ID NO: 1213831 - RNA, 17 nt, Mycobacterium bovis subsp bovis AF2122/97
caacgcgaugccgucca

SEQ ID NO: 1213832 - RNA, 22 nt, Mycobacterium bovis subsp bovis AF2122/97
caacgcgauguccagguggcgc

SEQ ID NO: 1213833 - RNA, 20 nt, Mycobacterium bovis subsp bovis AF2122/97
caacgccucugcucagccgu

SEQ ID NO: 1213834 - RNA, 15 nt, Mycobacterium bovis subsp bovis AF2122/97
caaaucccagagcau

SEQ ID NO: 1213835 - RNA, 17 nt, Mycobacterium bovis subsp bovis AF2122/97
caaaucgaugaccgucg

SEQ ID NO: 1213836 - RNA, 14 nt, Mycobacterium bovis subsp bovis AF2122/97
caaaucccagagca

SEQ ID NO: 1213837 - RNA, 18 nt, Mycobacterium bovis subsp bovis AF2122/97
caaaucagaugcgaaggc

SEQ ID NO: 1213838 - RNA, 14 nt, Mycobacterium bovis subsp bovis AF2122/97
caaagggaguguuu

SEQ ID NO: 1213839 - RNA, 22 nt, Mycobacterium bovis subsp bovis AF2122/97
caaagucggcgucacgguggac

SEQ ID NO: 1213840 - RNA, 19 nt, Mycobacterium bovis subsp bovis AF2122/97
caaaugugcgagaagcagg

SEQ ID NO: 1213841 - RNA, 15 nt, Mycobacterium bovis subsp bovis AF2122/97
caacccugcggugca

SEQ ID NO: 1213842 - RNA, 23 nt, Mycobacterium bovis subsp bovis AF2122/97
caacccggugauggugugcagca

SEQ ID NO: 1213843 - RNA, 22 nt, Mycobacterium bovis subsp bovis AF2122/97
caacccgggcagcaucaacacc

SEQ ID NO: 1213844 - RNA, 15 nt, Mycobacterium bovis subsp bovis AF2122/97
caacccugccgcgau

SEQ ID NO: 1213845 - RNA, 11 nt, Mycobacterium bovis subsp bovis AF2122/97
caacccuaggg

SEQ ID NO: 1213846 - RNA, 17 nt, Mycobacterium bovis subsp bovis AF2122/97
caacccuaaaccagcca

SEQ ID NO: 1213847 - RNA, 19 nt, Mycobacterium bovis subsp bovis AF2122/97
caaccauguuaacgcgcgu

SEQ ID NO: 1213848 - RNA, 18 nt, Mycobacterium bovis subsp bovis AF2122/97
caacccaacaaaaggcca

SEQ ID NO: 1213849 - RNA, 21 nt, Mycobacterium bovis subsp bovis AF2122/97
caacccaccccccagcgccgc

SEQ ID NO: 1213850 - RNA, 11 nt, Mycobacterium bovis subsp bovis AF2122/97
caacccacccc

SEQ ID NO: 1213851 - RNA, 18 nt, Mycobacterium bovis subsp bovis AF2122/97
caaccagcuucucagcac

SEQ ID NO: 1213852 - RNA, 19 nt, Mycobacterium bovis subsp bovis AF2122/97
caaccaggaugguugcgac

SEQ ID NO: 1213853 - RNA, 18 nt, Mycobacterium bovis subsp bovis AF2122/97
caaccagcccggccgccg

SEQ ID NO: 1213854 - RNA, 22 nt, Mycobacterium bovis subsp bovis AF2122/97
caaccagcccggccgccgagga

SEQ ID NO: 1213855 - RNA, 22 nt, Mycobacterium bovis subsp bovis AF2122/97
caacauuggugagguggucagc

SEQ ID NO: 1213856 - RNA, 11 nt, Mycobacterium bovis subsp bovis AF2122/97
caaccagcagc

SEQ ID NO: 1213857 - RNA, 15 nt, Mycobacterium bovis subsp bovis AF2122/97
caacaugggugaugc

SEQ ID NO: 1213858 - RNA, 14 nt, Mycobacterium bovis subsp bovis AF2122/97
caacaugcuggaga

SEQ ID NO: 1213859 - RNA, 17 nt, Mycobacterium bovis subsp bovis AF2122/97
caacaucuugccgucgg

SEQ ID NO: 1213860 - RNA, 20 nt, Mycobacterium bovis subsp bovis AF2122/97
caacaucggcccgcugacca

SEQ ID NO: 1213861 - RNA, 21 nt, Mycobacterium bovis subsp bovis AF2122/97
caacaucggguucuucaacuc

SEQ ID NO: 1213862 - RNA, 15 nt, Mycobacterium bovis subsp bovis AF2122/97
caacaucagcgacag

SEQ ID NO: 1213863 - RNA, 16 nt, Mycobacterium bovis subsp bovis AF2122/97
caacagcguggagcgc

SEQ ID NO: 1213864 - RNA, 19 nt, Mycobacterium bovis subsp bovis AF2122/97
caacagccgcagccagguc

SEQ ID NO: 1213865 - RNA, 14 nt, Mycobacterium bovis subsp bovis AF2122/97
caacagccgcagcc

SEQ ID NO: 1213866 - RNA, 12 nt, Mycobacterium bovis subsp bovis AF2122/97
caacagcaccag

SEQ ID NO: 1213867 - RNA, 17 nt, Mycobacterium bovis subsp bovis AF2122/97
caacagcacguacugcu

SEQ ID NO: 1213868 - RNA, 13 nt, Mycobacterium bovis subsp bovis AF2122/97
caacaccagguca

SEQ ID NO: 1213869 - RNA, 17 nt, Mycobacterium bovis subsp bovis AF2122/97
caacaccagaugcaccu

SEQ ID NO: 1213870 - RNA, 21 nt, Mycobacterium bovis subsp bovis AF2122/97
caacacccccccccccaccca

SEQ ID NO: 1213871 - RNA, 18 nt, Mycobacterium bovis subsp bovis AF2122/97
caacaccgaguuccucug

SEQ ID NO: 1213872 - RNA, 18 nt, Mycobacterium bovis subsp bovis AF2122/97
caacaccaccagcacgcu

SEQ ID NO: 1213873 - RNA, 17 nt, Mycobacterium bovis subsp bovis AF2122/97
caacacauugccggcca

SEQ ID NO: 1213874 - RNA, 20 nt, Mycobacterium bovis subsp bovis AF2122/97
caacacauugccggccacca

SEQ ID NO: 1213875 - RNA, 23 nt, Mycobacterium bovis subsp bovis AF2122/97
caacacauuucuuugggcggccc

SEQ ID NO: 1213876 - RNA, 17 nt, Mycobacterium bovis subsp bovis AF2122/97
caacaccaacgaacugg

SEQ ID NO: 1213877 - RNA, 18 nt, Mycobacterium bovis subsp bovis AF2122/97
caaaccacccgcaacaca

SEQ ID NO: 1213878 - RNA, 14 nt, Mycobacterium bovis subsp bovis AF2122/97
caaacaacgacucc

SEQ ID NO: 1213879 - RNA, 21 nt, Mycobacterium bovis subsp bovis AF2122/97
caaacgcugcgcccggaccac

SEQ ID NO: 1213880 - RNA, 19 nt, Mycobacterium bovis subsp bovis AF2122/97
caaacgggcgugggccgcu

SEQ ID NO: 1213881 - RNA, 19 nt, Mycobacterium bovis subsp bovis AF2122/97
caaacguaccgucauggcg

SEQ ID NO: 1213882 - RNA, 14 nt, Mycobacterium bovis subsp bovis AF2122/97
caaacggcgaccca

SEQ ID NO: 1213883 - RNA, 16 nt, Mycobacterium bovis subsp bovis AF2122/97
caaaggccuugacgua

SEQ ID NO: 1213884 - RNA, 22 nt, Mycobacterium bovis subsp bovis AF2122/97
caaagacccgacgccacgcguc

SEQ ID NO: 1213885 - RNA, 15 nt, Mycobacterium bovis subsp bovis AF2122/97
caaaacgagcuucca

SEQ ID NO: 1213886 - RNA, 14 nt, Mycobacterium bovis subsp bovis AF2122/97
caaaaccugggaug

SEQ ID NO: 1213887 - RNA, 18 nt, Mycobacterium bovis subsp bovis AF2122/97
caaaaucgcccaauucgg

SEQ ID NO: 1213888 - RNA, 20 nt, Mycobacterium bovis subsp bovis AF2122/97
caaaaucgcccaauucggca

SEQ ID NO: 1213889 - RNA, 17 nt, Mycobacterium bovis subsp bovis AF2122/97
caaaaggaucaacgugc

SEQ ID NO: 1213890 - RNA, 14 nt, Mycobacterium bovis subsp bovis AF2122/97
caaaaggaagaccu

SEQ ID NO: 1213891 - RNA, 18 nt, Mycobacterium bovis subsp bovis AF2122/97
aucaucuuggugggaagc

SEQ ID NO: 1213892 - RNA, 14 nt, Mycobacterium bovis subsp bovis AF2122/97
aucauagacagggc

SEQ ID NO: 1213893 - RNA, 14 nt, Mycobacterium bovis subsp bovis AF2122/97
aucaugucgaagaa

SEQ ID NO: 1213894 - RNA, 13 nt, Mycobacterium bovis subsp bovis AF2122/97
aucaugucggccg

SEQ ID NO: 1213895 - RNA, 18 nt, Mycobacterium bovis subsp bovis AF2122/97
aucaugucgaagaaccgg

SEQ ID NO: 1213896 - RNA, 12 nt, Mycobacterium bovis subsp bovis AF2122/97
aucauguggugg

SEQ ID NO: 1213897 - RNA, 21 nt, Mycobacterium bovis subsp bovis AF2122/97
auccacggcgaugcagccaca

SEQ ID NO: 1213898 - RNA, 14 nt, Mycobacterium bovis subsp bovis AF2122/97
auccacaaucacau

SEQ ID NO: 1213899 - RNA, 21 nt, Mycobacterium bovis subsp bovis AF2122/97
auccacaggcugaagacgaau

SEQ ID NO: 1213900 - RNA, 23 nt, Mycobacterium bovis subsp bovis AF2122/97
auccacgacaucguaggccggca

SEQ ID NO: 1213901 - RNA, 21 nt, Mycobacterium bovis subsp bovis AF2122/97
auccaaaccuuugauucuaac

SEQ ID NO: 1213902 - RNA, 23 nt, Mycobacterium bovis subsp bovis AF2122/97
auccagcugucguugaucggcac

SEQ ID NO: 1213903 - RNA, 15 nt, Mycobacterium bovis subsp bovis AF2122/97
aucccaucggggcua

SEQ ID NO: 1213904 - RNA, 16 nt, Mycobacterium bovis subsp bovis AF2122/97
aucccacggugguggg

SEQ ID NO: 1213905 - RNA, 13 nt, Mycobacterium bovis subsp bovis AF2122/97
auccccagcacca

SEQ ID NO: 1213906 - RNA, 21 nt, Mycobacterium bovis subsp bovis AF2122/97
aucccaagcguccgcugcagg

SEQ ID NO: 1213907 - RNA, 15 nt, Mycobacterium bovis subsp bovis AF2122/97
aucccaacgcccggg

SEQ ID NO: 1213908 - RNA, 12 nt, Mycobacterium bovis subsp bovis AF2122/97
auccauccugcc

SEQ ID NO: 1213909 - RNA, 23 nt, Mycobacterium bovis subsp bovis AF2122/97
auccggccgccaacuucaccacc

SEQ ID NO: 1213910 - RNA, 12 nt, Mycobacterium bovis subsp bovis AF2122/97
auccggccacca

SEQ ID NO: 1213911 - RNA, 15 nt, Mycobacterium bovis subsp bovis AF2122/97
auccccuggccagca

SEQ ID NO: 1213912 - RNA, 13 nt, Mycobacterium bovis subsp bovis AF2122/97
auccccuggccag

SEQ ID NO: 1213913 - RNA, 19 nt, Mycobacterium bovis subsp bovis AF2122/97
auccccaguugugcggcca

SEQ ID NO: 1213914 - RNA, 17 nt, Mycobacterium bovis subsp bovis AF2122/97
auccccauugcgcccca

SEQ ID NO: 1213915 - RNA, 23 nt, Mycobacterium bovis subsp bovis AF2122/97
aucccgaggggagugucagcgcc

SEQ ID NO: 1213916 - RNA, 17 nt, Mycobacterium bovis subsp bovis AF2122/97
aucccgaucccggccag

SEQ ID NO: 1213917 - RNA, 18 nt, Mycobacterium bovis subsp bovis AF2122/97
aucccgauccugcccacc

SEQ ID NO: 1213918 - RNA, 19 nt, Mycobacterium bovis subsp bovis AF2122/97
aucccgauccugcccacca

SEQ ID NO: 1213919 - RNA, 19 nt, Mycobacterium bovis subsp bovis AF2122/97
aucccgaucgaucagcaac

SEQ ID NO: 1213920 - RNA, 21 nt, Mycobacterium bovis subsp bovis AF2122/97
aucccgaaguagaagcccagg

SEQ ID NO: 1213921 - RNA, 15 nt, Mycobacterium bovis subsp bovis AF2122/97
aucccgaccagcaga

SEQ ID NO: 1213922 - RNA, 16 nt, Mycobacterium bovis subsp bovis AF2122/97
auccggucggccaggc

SEQ ID NO: 1213923 - RNA, 15 nt, Mycobacterium bovis subsp bovis AF2122/97
auccggucgaugacc

SEQ ID NO: 1213924 - RNA, 13 nt, Mycobacterium bovis subsp bovis AF2122/97
auccgguguugag

SEQ ID NO: 1213925 - RNA, 16 nt, Mycobacterium bovis subsp bovis AF2122/97
auccgguucugggccu

SEQ ID NO: 1213926 - RNA, 21 nt, Mycobacterium bovis subsp bovis AF2122/97
auccgugaauggcagcacgac

SEQ ID NO: 1213927 - RNA, 15 nt, Mycobacterium bovis subsp bovis AF2122/97
auccguacaguccac

SEQ ID NO: 1213928 - RNA, 18 nt, Mycobacterium bovis subsp bovis AF2122/97
auccgugugucuugaccu

SEQ ID NO: 1213929 - RNA, 18 nt, Mycobacterium bovis subsp bovis AF2122/97
auccuccugcgccgcagu

SEQ ID NO: 1213930 - RNA, 19 nt, Mycobacterium bovis subsp bovis AF2122/97
aucgccucggcgcugcgca

SEQ ID NO: 1213931 - RNA, 12 nt, Mycobacterium bovis subsp bovis AF2122/97
aucgccuccucg

SEQ ID NO: 1213932 - RNA, 17 nt, Mycobacterium bovis subsp bovis AF2122/97
aucgccguccagcaaua

SEQ ID NO: 1213933 - RNA, 11 nt, Mycobacterium bovis subsp bovis AF2122/97
aucgccgccgg

SEQ ID NO: 1213934 - RNA, 21 nt, Mycobacterium bovis subsp bovis AF2122/97
aucgcccgaguugaagaagcc

SEQ ID NO: 1213935 - RNA, 15 nt, Mycobacterium bovis subsp bovis AF2122/97
aucgccggagucgac

SEQ ID NO: 1213936 - RNA, 21 nt, Mycobacterium bovis subsp bovis AF2122/97
aucgccgcuugacgcagcucg

SEQ ID NO: 1213937 - RNA, 13 nt, Mycobacterium bovis subsp bovis AF2122/97
aucgccgcgggcg

SEQ ID NO: 1213938 - RNA, 13 nt, Mycobacterium bovis subsp bovis AF2122/97
aucgcugccagcg

SEQ ID NO: 1213939 - RNA, 22 nt, Mycobacterium bovis subsp bovis AF2122/97
aucgcugaccgcguagaccagu

SEQ ID NO: 1213940 - RNA, 13 nt, Mycobacterium bovis subsp bovis AF2122/97
aucgcuguaggca

SEQ ID NO: 1213941 - RNA, 14 nt, Mycobacterium bovis subsp bovis AF2122/97
aucgcugccgccga

SEQ ID NO: 1213942 - RNA, 19 nt, Mycobacterium bovis subsp bovis AF2122/97
aucgcguuguaggcuucca

SEQ ID NO: 1213943 - RNA, 13 nt, Mycobacterium bovis subsp bovis AF2122/97
aucgcgugcugga

SEQ ID NO: 1213944 - RNA, 14 nt, Mycobacterium bovis subsp bovis AF2122/97
aucgcguggaucgc

SEQ ID NO: 1213945 - RNA, 19 nt, Mycobacterium bovis subsp bovis AF2122/97
aucgcguggcgcaccaccg

SEQ ID NO: 1213946 - RNA, 20 nt, Mycobacterium bovis subsp bovis AF2122/97
aucgcguggcgcaccaccgc

SEQ ID NO: 1213947 - RNA, 18 nt, Mycobacterium bovis subsp bovis AF2122/97
aucgcgggcgugccgacc

SEQ ID NO: 1213948 - RNA, 23 nt, Mycobacterium bovis subsp bovis AF2122/97
aucgcgggcgugccgaccagcau

SEQ ID NO: 1213949 - RNA, 20 nt, Mycobacterium bovis subsp bovis AF2122/97
aucgcgggugaucuccaccg

SEQ ID NO: 1213950 - RNA, 22 nt, Mycobacterium bovis subsp bovis AF2122/97
aucgcgaaacagcuugcugcgc

SEQ ID NO: 1213951 - RNA, 19 nt, Mycobacterium bovis subsp bovis AF2122/97
aucgagauauugcgcgccu

SEQ ID NO: 1213952 - RNA, 17 nt, Mycobacterium bovis subsp bovis AF2122/97
aucgagcaggccgccca

SEQ ID NO: 1213953 - RNA, 15 nt, Mycobacterium bovis subsp bovis AF2122/97
aucgagcaguggccg

SEQ ID NO: 1213954 - RNA, 21 nt, Mycobacterium bovis subsp bovis AF2122/97
aucgagaguugaauccgggaa

SEQ ID NO: 1213955 - RNA, 19 nt, Mycobacterium bovis subsp bovis AF2122/97
aucgauugcguagcggguc

SEQ ID NO: 1213956 - RNA, 13 nt, Mycobacterium bovis subsp bovis AF2122/97
aucgcacccacca

SEQ ID NO: 1213957 - RNA, 20 nt, Mycobacterium bovis subsp bovis AF2122/97
aucgcacgaaaucagcccgc

SEQ ID NO: 1213958 - RNA, 18 nt, Mycobacterium bovis subsp bovis AF2122/97
aucgcaaugaccugcagc

SEQ ID NO: 1213959 - RNA, 18 nt, Mycobacterium bovis subsp bovis AF2122/97
aucgcagacggcugccac

SEQ ID NO: 1213960 - RNA, 11 nt, Mycobacterium bovis subsp bovis AF2122/97
aucgcaggcac

SEQ ID NO: 1213961 - RNA, 21 nt, Mycobacterium bovis subsp bovis AF2122/97
aucgcccaauuucgugccgaa

SEQ ID NO: 1213962 - RNA, 20 nt, Mycobacterium bovis subsp bovis AF2122/97
aucgccaucguuucacccgg

SEQ ID NO: 1213963 - RNA, 21 nt, Mycobacterium bovis subsp bovis AF2122/97
aucgcagggaucaccccggcc

SEQ ID NO: 1213964 - RNA, 16 nt, Mycobacterium bovis subsp bovis AF2122/97
aucguguacugcuccu

SEQ ID NO: 1213965 - RNA, 21 nt, Mycobacterium bovis subsp bovis AF2122/97
aucgugcggaaccugcucggc

SEQ ID NO: 1213966 - RNA, 15 nt, Mycobacterium bovis subsp bovis AF2122/97
aucgucucggccacg

SEQ ID NO: 1213967 - RNA, 22 nt, Mycobacterium bovis subsp bovis AF2122/97
aucgucugacgaaauccgccgg

SEQ ID NO: 1213968 - RNA, 18 nt, Mycobacterium bovis subsp bovis AF2122/97
aucgugggugccggcuca

SEQ ID NO: 1213969 - RNA, 16 nt, Mycobacterium bovis subsp bovis AF2122/97
aucguguugucaggac

SEQ ID NO: 1213970 - RNA, 18 nt, Mycobacterium bovis subsp bovis AF2122/97
aucguucaugaucggcag

SEQ ID NO: 1213971 - RNA, 22 nt, Mycobacterium bovis subsp bovis AF2122/97
aucguucaugaucggcagaauc

SEQ ID NO: 1213972 - RNA, 13 nt, Mycobacterium bovis subsp bovis AF2122/97
aucggcagcagcg

SEQ ID NO: 1213973 - RNA, 19 nt, Mycobacterium bovis subsp bovis AF2122/97
aucgucgaacagcaccgcc

SEQ ID NO: 1213974 - RNA, 14 nt, Mycobacterium bovis subsp bovis AF2122/97
aucgucgccacgau

SEQ ID NO: 1213975 - RNA, 21 nt, Mycobacterium bovis subsp bovis AF2122/97
aucgucggguaccagcaccga

SEQ ID NO: 1213976 - RNA, 21 nt, Mycobacterium bovis subsp bovis AF2122/97
aucgucgccgaucaugaccau

SEQ ID NO: 1213977 - RNA, 13 nt, Mycobacterium bovis subsp bovis AF2122/97
aucggagucuuca

SEQ ID NO: 1213978 - RNA, 12 nt, Mycobacterium bovis subsp bovis AF2122/97
aucggaggcccg

SEQ ID NO: 1213979 - RNA, 18 nt, Mycobacterium bovis subsp bovis AF2122/97
aucggauugcagaauccg

SEQ ID NO: 1213980 - RNA, 17 nt, Mycobacterium bovis subsp bovis AF2122/97
aucggauggcggccaca

SEQ ID NO: 1213981 - RNA, 17 nt, Mycobacterium bovis subsp bovis AF2122/97
aucggauuuuccgccug

SEQ ID NO: 1213982 - RNA, 21 nt, Mycobacterium bovis subsp bovis AF2122/97
aucggcaccccacgccugccg

SEQ ID NO: 1213983 - RNA, 14 nt, Mycobacterium bovis subsp bovis AF2122/97
aucggcaccgugcg

SEQ ID NO: 1213984 - RNA, 18 nt, Mycobacterium bovis subsp bovis AF2122/97
aucguuguugaccaccac

SEQ ID NO: 1213985 - RNA, 19 nt, Mycobacterium bovis subsp bovis AF2122/97
aucguugccucgucgccgc

SEQ ID NO: 1213986 - RNA, 18 nt, Mycobacterium bovis subsp bovis AF2122/97
aucguucgggguggugga

SEQ ID NO: 1213987 - RNA, 16 nt, Mycobacterium bovis subsp bovis AF2122/97
aucucguacuccccgc

SEQ ID NO: 1213988 - RNA, 23 nt, Mycobacterium bovis subsp bovis AF2122/97
aucucuaccagccgccccggcuu

SEQ ID NO: 1213989 - RNA, 13 nt, Mycobacterium bovis subsp bovis AF2122/97
aucucggccagga

SEQ ID NO: 1213990 - RNA, 21 nt, Mycobacterium bovis subsp bovis AF2122/97
aucuccgcgucggucagcugu

SEQ ID NO: 1213991 - RNA, 21 nt, Mycobacterium bovis subsp bovis AF2122/97
aucugccgccgcggccacaac

SEQ ID NO: 1213992 - RNA, 16 nt, Mycobacterium bovis subsp bovis AF2122/97
aucugcccggugaucc

SEQ ID NO: 1213993 - RNA, 14 nt, Mycobacterium bovis subsp bovis AF2122/97
aucugguccagugg

SEQ ID NO: 1213994 - RNA, 12 nt, Mycobacterium bovis subsp bovis AF2122/97
aucuggguuccc

SEQ ID NO: 1213995 - RNA, 17 nt, Mycobacterium bovis subsp bovis AF2122/97
aucugguccagugggau

SEQ ID NO: 1213996 - RNA, 18 nt, Mycobacterium bovis subsp bovis AF2122/97
aucuggugcgcggagagc

SEQ ID NO: 1213997 - RNA, 14 nt, Mycobacterium bovis subsp bovis AF2122/97
aucugcaggcccag

SEQ ID NO: 1213998 - RNA, 18 nt, Mycobacterium bovis subsp bovis AF2122/97
aucugcaggcccaggcug

SEQ ID NO: 1213999 - RNA, 23 nt, Mycobacterium bovis subsp bovis AF2122/97
aucugcacgagugcggcgaccag

SEQ ID NO: 1214000 - RNA, 22 nt, Mycobacterium bovis subsp bovis AF2122/97
aucugaugacgguguggaaacc

SEQ ID NO: 1214001 - RNA, 22 nt, Mycobacterium bovis subsp bovis AF2122/97
aucuugcgacgcccgccuucga

SEQ ID NO: 1214002 - RNA, 12 nt, Mycobacterium bovis subsp bovis AF2122/97
aucuugcgcaug

SEQ ID NO: 1214003 - RNA, 17 nt, Mycobacterium bovis subsp bovis AF2122/97
aucuugcggcagcgaaa

SEQ ID NO: 1214004 - RNA, 21 nt, Mycobacterium bovis subsp bovis AF2122/97
aucuuggagaagguuucccgc

SEQ ID NO: 1214005 - RNA, 20 nt, Mycobacterium bovis subsp bovis AF2122/97
aucugguugaaccgguacaa

SEQ ID NO: 1214006 - RNA, 13 nt, Mycobacterium bovis subsp bovis AF2122/97
aucugguggaccu

SEQ ID NO: 1214007 - RNA, 19 nt, Mycobacterium bovis subsp bovis AF2122/97
aucuucucgagccgccgga

SEQ ID NO: 1214008 - RNA, 15 nt, Mycobacterium bovis subsp bovis AF2122/97
aucuuuggcggccgc

SEQ ID NO: 1214009 - RNA, 19 nt, Mycobacterium bovis subsp bovis AF2122/97
aucuuggugaagaucgaca

SEQ ID NO: 1214010 - RNA, 14 nt, Mycobacterium bovis subsp bovis AF2122/97
aucuugggccacgc

SEQ ID NO: 1214011 - RNA, 12 nt, Mycobacterium bovis subsp bovis AF2122/97
aucuugguguug

SEQ ID NO: 1214012 - RNA, 16 nt, Mycobacterium bovis subsp bovis AF2122/97
aucuugguguuggugg

SEQ ID NO: 1214013 - RNA, 12 nt, Mycobacterium bovis subsp bovis AF2122/97
aucuuggccacc

SEQ ID NO: 1214014 - RNA, 14 nt, Mycobacterium bovis subsp bovis AF2122/97
aucuugugccaggc

SEQ ID NO: 1214015 - RNA, 17 nt, Mycobacterium bovis subsp bovis AF2122/97
aucuugucgaucugccc

SEQ ID NO: 1214016 - RNA, 13 nt, Mycobacterium bovis subsp bovis AF2122/97
augaagaacuggc

SEQ ID NO: 1214017 - RNA, 13 nt, Mycobacterium bovis subsp bovis AF2122/97
augaagauccaga

SEQ ID NO: 1214018 - RNA, 15 nt, Mycobacterium bovis subsp bovis AF2122/97
augacaaagaagugg

SEQ ID NO: 1214019 - RNA, 17 nt, Mycobacterium bovis subsp bovis AF2122/97
augaccagggucugcuc

SEQ ID NO: 1214020 - RNA, 20 nt, Mycobacterium bovis subsp bovis AF2122/97
augaccagggucugcucauc

SEQ ID NO: 1214021 - RNA, 19 nt, Mycobacterium bovis subsp bovis AF2122/97
augaccaccgaaauaccca

SEQ ID NO: 1214022 - RNA, 14 nt, Mycobacterium bovis subsp bovis AF2122/97
augaccgccagcag

SEQ ID NO: 1214023 - RNA, 14 nt, Mycobacterium bovis subsp bovis AF2122/97
augacccacacacc

SEQ ID NO: 1214024 - RNA, 14 nt, Mycobacterium bovis subsp bovis AF2122/97
augaccgacaggug

SEQ ID NO: 1214025 - RNA, 16 nt, Mycobacterium bovis subsp bovis AF2122/97
augaccgacaggugcu

SEQ ID NO: 1214026 - RNA, 17 nt, Mycobacterium bovis subsp bovis AF2122/97
augaccacauuggugau

SEQ ID NO: 1214027 - RNA, 19 nt, Mycobacterium bovis subsp bovis AF2122/97
augacgccggcggguggcc

SEQ ID NO: 1214028 - RNA, 17 nt, Mycobacterium bovis subsp bovis AF2122/97
augacgcccagggcguc

SEQ ID NO: 1214029 - RNA, 20 nt, Mycobacterium bovis subsp bovis AF2122/97
augacgugaguuucaccacu

SEQ ID NO: 1214030 - RNA, 14 nt, Mycobacterium bovis subsp bovis AF2122/97
aucaaagccagcac

SEQ ID NO: 1214031 - RNA, 15 nt, Mycobacterium bovis subsp bovis AF2122/97
aucaaagccagcacc

SEQ ID NO: 1214032 - RNA, 16 nt, Mycobacterium bovis subsp bovis AF2122/97
auauucgcugggcgca

SEQ ID NO: 1214033 - RNA, 13 nt, Mycobacterium bovis subsp bovis AF2122/97
auauggaucaacg

SEQ ID NO: 1214034 - RNA, 21 nt, Mycobacterium bovis subsp bovis AF2122/97
auaugcgugagcugcucgagc

SEQ ID NO: 1214035 - RNA, 18 nt, Mycobacterium bovis subsp bovis AF2122/97
auauggugcgccauuccc

SEQ ID NO: 1214036 - RNA, 18 nt, Mycobacterium bovis subsp bovis AF2122/97
auauggcagugucguggu

SEQ ID NO: 1214037 - RNA, 20 nt, Mycobacterium bovis subsp bovis AF2122/97
auaugggugugcuccagcga

SEQ ID NO: 1214038 - RNA, 17 nt, Mycobacterium bovis subsp bovis AF2122/97
aucagcggauccagaaa

SEQ ID NO: 1214039 - RNA, 15 nt, Mycobacterium bovis subsp bovis AF2122/97
aucagcgacuugcug

SEQ ID NO: 1214040 - RNA, 22 nt, Mycobacterium bovis subsp bovis AF2122/97
aucagcccggccuugccgccgg

SEQ ID NO: 1214041 - RNA, 22 nt, Mycobacterium bovis subsp bovis AF2122/97
aucagcccuucagcgaagccgg

SEQ ID NO: 1214042 - RNA, 13 nt, Mycobacterium bovis subsp bovis AF2122/97
aucagcccgccca

SEQ ID NO: 1214043 - RNA, 15 nt, Mycobacterium bovis subsp bovis AF2122/97
aucagccgcugcgua

SEQ ID NO: 1214044 - RNA, 14 nt, Mycobacterium bovis subsp bovis AF2122/97
aucagaaucaggcu

SEQ ID NO: 1214045 - RNA, 13 nt, Mycobacterium bovis subsp bovis AF2122/97
aucagaacgugac

SEQ ID NO: 1214046 - RNA, 17 nt, Mycobacterium bovis subsp bovis AF2122/97
aucaggucgucacgccc

SEQ ID NO: 1214047 - RNA, 18 nt, Mycobacterium bovis subsp bovis AF2122/97
aucagguucgucaggucc

SEQ ID NO: 1214048 - RNA, 20 nt, Mycobacterium bovis subsp bovis AF2122/97
aucaguccggcguucccgcc

SEQ ID NO: 1214049 - RNA, 16 nt, Mycobacterium bovis subsp bovis AF2122/97
aucaguucccgaaccc

SEQ ID NO: 1214050 - RNA, 19 nt, Mycobacterium bovis subsp bovis AF2122/97
aucaguucgugacgugcau

SEQ ID NO: 1214051 - RNA, 21 nt, Mycobacterium bovis subsp bovis AF2122/97
aaaacgggguggcacgcauga

SEQ ID NO: 1214052 - RNA, 12 nt, Mycobacterium bovis subsp bovis AF2122/97
aucaccagaaau

SEQ ID NO: 1214053 - RNA, 14 nt, Mycobacterium bovis subsp bovis AF2122/97
aucaccagcagugg

SEQ ID NO: 1214054 - RNA, 22 nt, Mycobacterium bovis subsp bovis AF2122/97
aucaccaggguuggcaccguca

SEQ ID NO: 1214055 - RNA, 13 nt, Mycobacterium bovis subsp bovis AF2122/97
aucaccauccagc

SEQ ID NO: 1214056 - RNA, 19 nt, Mycobacterium bovis subsp bovis AF2122/97
aucaccacccgaccgccau

SEQ ID NO: 1214057 - RNA, 19 nt, Mycobacterium bovis subsp bovis AF2122/97
aucacccuguuugcccaac

SEQ ID NO: 1214058 - RNA, 13 nt, Mycobacterium bovis subsp bovis AF2122/97
aucacccagcgcc

SEQ ID NO: 1214059 - RNA, 17 nt, Mycobacterium bovis subsp bovis AF2122/97
aucacaugcaagccgac

SEQ ID NO: 1214060 - RNA, 13 nt, Mycobacterium bovis subsp bovis AF2122/97
aucacauccacgc

SEQ ID NO: 1214061 - RNA, 14 nt, Mycobacterium bovis subsp bovis AF2122/97
aucacaucaaaguc

SEQ ID NO: 1214062 - RNA, 16 nt, Mycobacterium bovis subsp bovis AF2122/97
aucacaccauuggcca

SEQ ID NO: 1214063 - RNA, 17 nt, Mycobacterium bovis subsp bovis AF2122/97
aucacacccaucacccu

SEQ ID NO: 1214064 - RNA, 12 nt, Mycobacterium bovis subsp bovis AF2122/97
aucacaccgcug

SEQ ID NO: 1214065 - RNA, 12 nt, Mycobacterium bovis subsp bovis AF2122/97
aucacaauucca

SEQ ID NO: 1214066 - RNA, 22 nt, Mycobacterium bovis subsp bovis AF2122/97
auaccacuuugcguucccaucc

SEQ ID NO: 1214067 - RNA, 19 nt, Mycobacterium bovis subsp bovis AF2122/97
auacccaucaacaucggcc

SEQ ID NO: 1214068 - RNA, 18 nt, Mycobacterium bovis subsp bovis AF2122/97
auacccagcgcagcagcg

SEQ ID NO: 1214069 - RNA, 17 nt, Mycobacterium bovis subsp bovis AF2122/97
auaccagggcaucagca

SEQ ID NO: 1214070 - RNA, 21 nt, Mycobacterium bovis subsp bovis AF2122/97
auaccagcguuugaacgcaug

SEQ ID NO: 1214071 - RNA, 24 nt, Mycobacterium bovis subsp bovis AF2122/97
auaccaguccggcggacgugacca

SEQ ID NO: 1214072 - RNA, 23 nt, Mycobacterium bovis subsp bovis AF2122/97
auacauuucgucgucgcagugca

SEQ ID NO: 1214073 - RNA, 16 nt, Mycobacterium bovis subsp bovis AF2122/97
auacggguguggccgu

SEQ ID NO: 1214074 - RNA, 23 nt, Mycobacterium bovis subsp bovis AF2122/97
auaccgguugcggucaucggcgc

SEQ ID NO: 1214075 - RNA, 19 nt, Mycobacterium bovis subsp bovis AF2122/97
auagaacucgccgcuggca

SEQ ID NO: 1214076 - RNA, 20 nt, Mycobacterium bovis subsp bovis AF2122/97
auagacagggccgcucgccu

SEQ ID NO: 1214077 - RNA, 14 nt, Mycobacterium bovis subsp bovis AF2122/97
auagcccaagccga

SEQ ID NO: 1214078 - RNA, 18 nt, Mycobacterium bovis subsp bovis AF2122/97
auagccaucacgacuccc

SEQ ID NO: 1214079 - RNA, 13 nt, Mycobacterium bovis subsp bovis AF2122/97
auagccgaacagc

SEQ ID NO: 1214080 - RNA, 14 nt, Mycobacterium bovis subsp bovis AF2122/97
auagccgaacagcg

SEQ ID NO: 1214081 - RNA, 14 nt, Mycobacterium bovis subsp bovis AF2122/97
auagcgcacugccg

SEQ ID NO: 1214082 - RNA, 16 nt, Mycobacterium bovis subsp bovis AF2122/97
auagcgcggcaccagc

SEQ ID NO: 1214083 - RNA, 19 nt, Mycobacterium bovis subsp bovis AF2122/97
auagcgcggcaccagcacc

SEQ ID NO: 1214084 - RNA, 17 nt, Mycobacterium bovis subsp bovis AF2122/97
auaggaccacgggaugc

SEQ ID NO: 1214085 - RNA, 16 nt, Mycobacterium bovis subsp bovis AF2122/97
auaggcaaggucaacc

SEQ ID NO: 1214086 - RNA, 16 nt, Mycobacterium bovis subsp bovis AF2122/97
auaggccgggcagugc

SEQ ID NO: 1214087 - RNA, 13 nt, Mycobacterium bovis subsp bovis AF2122/97
auagggcugguau

SEQ ID NO: 1214088 - RNA, 14 nt, Mycobacterium bovis subsp bovis AF2122/97
auaggugaacgcug

SEQ ID NO: 1214089 - RNA, 18 nt, Mycobacterium bovis subsp bovis AF2122/97
auaggucgggcaugacga

SEQ ID NO: 1214090 - RNA, 13 nt, Mycobacterium bovis subsp bovis AF2122/97
auaucacaacugc

SEQ ID NO: 1214091 - RNA, 23 nt, Mycobacterium bovis subsp bovis AF2122/97
auauccggacuugaccagagcac

SEQ ID NO: 1214092 - RNA, 18 nt, Mycobacterium bovis subsp bovis AF2122/97
auaguguguuuggugguu

SEQ ID NO: 1214093 - RNA, 14 nt, Mycobacterium bovis subsp bovis AF2122/97
aguacuccagccgc

SEQ ID NO: 1214094 - RNA, 14 nt, Mycobacterium bovis subsp bovis AF2122/97
aguacuggaauggc

SEQ ID NO: 1214095 - RNA, 20 nt, Mycobacterium bovis subsp bovis AF2122/97
aguacuggaauggcucacgc

SEQ ID NO: 1214096 - RNA, 15 nt, Mycobacterium bovis subsp bovis AF2122/97
aguacuucgcggcgg

SEQ ID NO: 1214097 - RNA, 18 nt, Mycobacterium bovis subsp bovis AF2122/97
agucaacaccgcggccga

SEQ ID NO: 1214098 - RNA, 19 nt, Mycobacterium bovis subsp bovis AF2122/97
agucaacagggccaggaca

SEQ ID NO: 1214099 - RNA, 15 nt, Mycobacterium bovis subsp bovis AF2122/97
agucacgcacccggc

SEQ ID NO: 1214100 - RNA, 18 nt, Mycobacterium bovis subsp bovis AF2122/97
agucacggucguggugca

SEQ ID NO: 1214101 - RNA, 14 nt, Mycobacterium bovis subsp bovis AF2122/97
agucacagcucacc

SEQ ID NO: 1214102 - RNA, 16 nt, Mycobacterium bovis subsp bovis AF2122/97
agucagcuccgcgcag

SEQ ID NO: 1214103 - RNA, 22 nt, Mycobacterium bovis subsp bovis AF2122/97
agucagacgacgaugaugccgu

SEQ ID NO: 1214104 - RNA, 16 nt, Mycobacterium bovis subsp bovis AF2122/97
agucauguccauagcc

SEQ ID NO: 1214105 - RNA, 20 nt, Mycobacterium bovis subsp bovis AF2122/97
agucauguccauagccggca

SEQ ID NO: 1214106 - RNA, 13 nt, Mycobacterium bovis subsp bovis AF2122/97
aguccaagauguc

SEQ ID NO: 1214107 - RNA, 15 nt, Mycobacterium bovis subsp bovis AF2122/97
agucccagcgccgca

SEQ ID NO: 1214108 - RNA, 15 nt, Mycobacterium bovis subsp bovis AF2122/97
agucccacugccacu

SEQ ID NO: 1214109 - RNA, 18 nt, Mycobacterium bovis subsp bovis AF2122/97
agucccacugccacuccu

SEQ ID NO: 1214110 - RNA, 15 nt, Mycobacterium bovis subsp bovis AF2122/97
agucccacugggccg

SEQ ID NO: 1214111 - RNA, 18 nt, Mycobacterium bovis subsp bovis AF2122/97
aguccagcucgcugcgcg

SEQ ID NO: 1214112 - RNA, 16 nt, Mycobacterium bovis subsp bovis AF2122/97
aguccaggcagcuugc

SEQ ID NO: 1214113 - RNA, 18 nt, Mycobacterium bovis subsp bovis AF2122/97
aguccaggcagcuugcca

SEQ ID NO: 1214114 - RNA, 14 nt, Mycobacterium bovis subsp bovis AF2122/97
agucauccuugagg

SEQ ID NO: 1214115 - RNA, 21 nt, Mycobacterium bovis subsp bovis AF2122/97
agucauccaggucgccuuccc

SEQ ID NO: 1214116 - RNA, 13 nt, Mycobacterium bovis subsp bovis AF2122/97
agugacgccucga

SEQ ID NO: 1214117 - RNA, 14 nt, Mycobacterium bovis subsp bovis AF2122/97
agugaccacgcugc

SEQ ID NO: 1214118 - RNA, 13 nt, Mycobacterium bovis subsp bovis AF2122/97
agugaccugggcg

SEQ ID NO: 1214119 - RNA, 18 nt, Mycobacterium bovis subsp bovis AF2122/97
agugaccgcagucccagc

SEQ ID NO: 1214120 - RNA, 21 nt, Mycobacterium bovis subsp bovis AF2122/97
agugaccgcagucccagcaca

SEQ ID NO: 1214121 - RNA, 18 nt, Mycobacterium bovis subsp bovis AF2122/97
agugaaaguucaugccau

SEQ ID NO: 1214122 - RNA, 21 nt, Mycobacterium bovis subsp bovis AF2122/97
agucugggcgaucgcuucgca

SEQ ID NO: 1214123 - RNA, 17 nt, Mycobacterium bovis subsp bovis AF2122/97
agucuucgucgucggaa

SEQ ID NO: 1214124 - RNA, 21 nt, Mycobacterium bovis subsp bovis AF2122/97
aguccgaucacccgcacucca

SEQ ID NO: 1214125 - RNA, 18 nt, Mycobacterium bovis subsp bovis AF2122/97
aguccgaugccggaaugc

SEQ ID NO: 1214126 - RNA, 18 nt, Mycobacterium bovis subsp bovis AF2122/97
aguccgaugggaaucagu

SEQ ID NO: 1214127 - RNA, 13 nt, Mycobacterium bovis subsp bovis AF2122/97
agucgcacugcgc

SEQ ID NO: 1214128 - RNA, 21 nt, Mycobacterium bovis subsp bovis AF2122/97
agucgaagaaccugagcacca

SEQ ID NO: 1214129 - RNA, 15 nt, Mycobacterium bovis subsp bovis AF2122/97
aguccgacaccacgg

SEQ ID NO: 1214130 - RNA, 17 nt, Mycobacterium bovis subsp bovis AF2122/97
aguccgacaccacggac

SEQ ID NO: 1214131 - RNA, 20 nt, Mycobacterium bovis subsp bovis AF2122/97
aguccccgcuuggcgagcca

SEQ ID NO: 1214132 - RNA, 18 nt, Mycobacterium bovis subsp bovis AF2122/97
aguccccaggugggcagc

SEQ ID NO: 1214133 - RNA, 19 nt, Mycobacterium bovis subsp bovis AF2122/97
agucgucgacuugcaggcg

SEQ ID NO: 1214134 - RNA, 15 nt, Mycobacterium bovis subsp bovis AF2122/97
agucgucggcgcuga

SEQ ID NO: 1214135 - RNA, 20 nt, Mycobacterium bovis subsp bovis AF2122/97
agucgucggcaugggccggc

SEQ ID NO: 1214136 - RNA, 14 nt, Mycobacterium bovis subsp bovis AF2122/97
agucgccggccggc

SEQ ID NO: 1214137 - RNA, 15 nt, Mycobacterium bovis subsp bovis AF2122/97
agucgccagaccgca

SEQ ID NO: 1214138 - RNA, 12 nt, Mycobacterium bovis subsp bovis AF2122/97
agucgcaggauc

SEQ ID NO: 1214139 - RNA, 16 nt, Mycobacterium bovis subsp bovis AF2122/97
agucgccgaucgagac

SEQ ID NO: 1214140 - RNA, 11 nt, Mycobacterium bovis subsp bovis AF2122/97
agucgccgagg

SEQ ID NO: 1214141 - RNA, 18 nt, Mycobacterium bovis subsp bovis AF2122/97
agucgugcuugcccgguu

SEQ ID NO: 1214142 - RNA, 18 nt, Mycobacterium bovis subsp bovis AF2122/97
agugcgguggcaggugau

SEQ ID NO: 1214143 - RNA, 20 nt, Mycobacterium bovis subsp bovis AF2122/97
agugcggugugugcaagccg

SEQ ID NO: 1214144 - RNA, 18 nt, Mycobacterium bovis subsp bovis AF2122/97
agugaggccgaccagcac

SEQ ID NO: 1214145 - RNA, 18 nt, Mycobacterium bovis subsp bovis AF2122/97
agugaggcugugccccag

SEQ ID NO: 1214146 - RNA, 14 nt, Mycobacterium bovis subsp bovis AF2122/97
agugagggucccac

SEQ ID NO: 1214147 - RNA, 16 nt, Mycobacterium bovis subsp bovis AF2122/97
aguggcucgcucugcg

SEQ ID NO: 1214148 - RNA, 19 nt, Mycobacterium bovis subsp bovis AF2122/97
agugggcaauccggucagc

SEQ ID NO: 1214149 - RNA, 23 nt, Mycobacterium bovis subsp bovis AF2122/97
aguggggauucguugucgagcac

SEQ ID NO: 1214150 - RNA, 15 nt, Mycobacterium bovis subsp bovis AF2122/97
agugguugcggccgu

SEQ ID NO: 1214151 - RNA, 14 nt, Mycobacterium bovis subsp bovis AF2122/97
aguggcgaguggcu

SEQ ID NO: 1214152 - RNA, 16 nt, Mycobacterium bovis subsp bovis AF2122/97
aguggcgaucugcugc

SEQ ID NO: 1214153 - RNA, 15 nt, Mycobacterium bovis subsp bovis AF2122/97
aguggcgcaccaccu

SEQ ID NO: 1214154 - RNA, 21 nt, Mycobacterium bovis subsp bovis AF2122/97
aguggcgcaccaccuccccga

SEQ ID NO: 1214155 - RNA, 17 nt, Mycobacterium bovis subsp bovis AF2122/97
agugcuugggccgcuga

SEQ ID NO: 1214156 - RNA, 19 nt, Mycobacterium bovis subsp bovis AF2122/97
agugcuuuggguccgggcg

SEQ ID NO: 1214157 - RNA, 17 nt, Mycobacterium bovis subsp bovis AF2122/97
aguggaagccgaccacc

SEQ ID NO: 1214158 - RNA, 16 nt, Mycobacterium bovis subsp bovis AF2122/97
agugugauuccggguc

SEQ ID NO: 1214159 - RNA, 18 nt, Mycobacterium bovis subsp bovis AF2122/97
agugucuuagccagcagc

SEQ ID NO: 1214160 - RNA, 17 nt, Mycobacterium bovis subsp bovis AF2122/97
agugucuuagccagcag

SEQ ID NO: 1214161 - RNA, 14 nt, Mycobacterium bovis subsp bovis AF2122/97
aguguguuuggugg

SEQ ID NO: 1214162 - RNA, 13 nt, Mycobacterium bovis subsp bovis AF2122/97
agugugcccugcu

SEQ ID NO: 1214163 - RNA, 18 nt, Mycobacterium bovis subsp bovis AF2122/97
aguguggcgaugaccacg

SEQ ID NO: 1214164 - RNA, 17 nt, Mycobacterium bovis subsp bovis AF2122/97
agugugggggucagggg

SEQ ID NO: 1214165 - RNA, 20 nt, Mycobacterium bovis subsp bovis AF2122/97
aguguuuggguuuuguuugg

SEQ ID NO: 1214166 - RNA, 20 nt, Mycobacterium bovis subsp bovis AF2122/97
aguguugcgcugcggccagc

SEQ ID NO: 1214167 - RNA, 22 nt, Mycobacterium bovis subsp bovis AF2122/97
aguguugcgcugcggccagcgc

SEQ ID NO: 1214168 - RNA, 21 nt, Mycobacterium bovis subsp bovis AF2122/97
aguucgcaugcuugaaaccca

SEQ ID NO: 1214169 - RNA, 15 nt, Mycobacterium bovis subsp bovis AF2122/97
aguucgagcugccag

SEQ ID NO: 1214170 - RNA, 22 nt, Mycobacterium bovis subsp bovis AF2122/97
aguucuuggucaggcuggaggu

SEQ ID NO: 1214171 - RNA, 19 nt, Mycobacterium bovis subsp bovis AF2122/97
aguugaccuucaccuggaa

SEQ ID NO: 1214172 - RNA, 18 nt, Mycobacterium bovis subsp bovis AF2122/97
aguugaaggugccggcgu

SEQ ID NO: 1214173 - RNA, 16 nt, Mycobacterium bovis subsp bovis AF2122/97
aguugcgcggcagugg

SEQ ID NO: 1214174 - RNA, 13 nt, Mycobacterium bovis subsp bovis AF2122/97
aguugcgcggcau

SEQ ID NO: 1214175 - RNA, 14 nt, Mycobacterium bovis subsp bovis AF2122/97
aguugagcagcuug

SEQ ID NO: 1214176 - RNA, 21 nt, Mycobacterium bovis subsp bovis AF2122/97
aguugagggugugagguaguc

SEQ ID NO: 1214177 - RNA, 22 nt, Mycobacterium bovis subsp bovis AF2122/97
aguugcucggcuucccuaggcu

SEQ ID NO: 1214178 - RNA, 13 nt, Mycobacterium bovis subsp bovis AF2122/97
aguuggcaccagc

SEQ ID NO: 1214179 - RNA, 20 nt, Mycobacterium bovis subsp bovis AF2122/97
aguuccggucgacuccagca

SEQ ID NO: 1214180 - RNA, 17 nt, Mycobacterium bovis subsp bovis AF2122/97
aguuccucguggguccg

SEQ ID NO: 1214181 - RNA, 17 nt, Mycobacterium bovis subsp bovis AF2122/97
aguucaacgaggccgac

SEQ ID NO: 1214182 - RNA, 17 nt, Mycobacterium bovis subsp bovis AF2122/97
aguuaggccgccagccg

SEQ ID NO: 1214183 - RNA, 19 nt, Mycobacterium bovis subsp bovis AF2122/97
aguuggccaguaugcggug

SEQ ID NO: 1214184 - RNA, 23 nt, Mycobacterium bovis subsp bovis AF2122/97
aguuggcgcccgaagccgggccc

SEQ ID NO: 1214185 - RNA, 13 nt, Mycobacterium bovis subsp bovis AF2122/97
aguuuucggccgc

SEQ ID NO: 1214186 - RNA, 20 nt, Mycobacterium bovis subsp bovis AF2122/97
aguuuuucgggguggcggca

SEQ ID NO: 1214187 - RNA, 18 nt, Mycobacterium bovis subsp bovis AF2122/97
auaaggaccgcgcccaga

SEQ ID NO: 1214188 - RNA, 23 nt, Mycobacterium bovis subsp bovis AF2122/97
auaacuaauuuggugguguucau

SEQ ID NO: 1214189 - RNA, 18 nt, Mycobacterium bovis subsp bovis AF2122/97
agcucgccggcacgcagc

SEQ ID NO: 1214190 - RNA, 22 nt, Mycobacterium bovis subsp bovis AF2122/97
agcucgcgcacccagcccagcc

SEQ ID NO: 1214191 - RNA, 15 nt, Mycobacterium bovis subsp bovis AF2122/97
agcucgccgcagcgu

SEQ ID NO: 1214192 - RNA, 15 nt, Mycobacterium bovis subsp bovis AF2122/97
agcucgcggcgcagg

SEQ ID NO: 1214193 - RNA, 16 nt, Mycobacterium bovis subsp bovis AF2122/97
agcucggcccuguucg

SEQ ID NO: 1214194 - RNA, 19 nt, Mycobacterium bovis subsp bovis AF2122/97
agcucggccaggcuggcca

SEQ ID NO: 1214195 - RNA, 23 nt, Mycobacterium bovis subsp bovis AF2122/97
agcucggccaccagcgcccggcc

SEQ ID NO: 1214196 - RNA, 20 nt, Mycobacterium bovis subsp bovis AF2122/97
agcucgcugacggcaaacga

SEQ ID NO: 1214197 - RNA, 16 nt, Mycobacterium bovis subsp bovis AF2122/97
agcucgaggaccaccu

SEQ ID NO: 1214198 - RNA, 24 nt, Mycobacterium bovis subsp bovis AF2122/97
agcucgaggcccgggugcuacugg

SEQ ID NO: 1214199 - RNA, 20 nt, Mycobacterium bovis subsp bovis AF2122/97
agcucgaccugaggcaccuc

SEQ ID NO: 1214200 - RNA, 17 nt, Mycobacterium bovis subsp bovis AF2122/97
agcucgaccgcccggcu

SEQ ID NO: 1214201 - RNA, 16 nt, Mycobacterium bovis subsp bovis AF2122/97
agcucgagcgccucgg

SEQ ID NO: 1214202 - RNA, 13 nt, Mycobacterium bovis subsp bovis AF2122/97
agcucgaggacca

SEQ ID NO: 1214203 - RNA, 20 nt, Mycobacterium bovis subsp bovis AF2122/97
agcuccuguaacugcuccug

SEQ ID NO: 1214204 - RNA, 14 nt, Mycobacterium bovis subsp bovis AF2122/97
agcucgaccgcccg

SEQ ID NO: 1214205 - RNA, 18 nt, Mycobacterium bovis subsp bovis AF2122/97
agcucgacaacugcccga

SEQ ID NO: 1214206 - RNA, 14 nt, Mycobacterium bovis subsp bovis AF2122/97
agcucgaagcccgg

SEQ ID NO: 1214207 - RNA, 15 nt, Mycobacterium bovis subsp bovis AF2122/97
agcucgaagcccgga

SEQ ID NO: 1214208 - RNA, 15 nt, Mycobacterium bovis subsp bovis AF2122/97
agcuccgucgcggcc

SEQ ID NO: 1214209 - RNA, 23 nt, Mycobacterium bovis subsp bovis AF2122/97
agcuccguggugcuagcgccgcc

SEQ ID NO: 1214210 - RNA, 20 nt, Mycobacterium bovis subsp bovis AF2122/97
agcuccucgcgcucgccggu

SEQ ID NO: 1214211 - RNA, 22 nt, Mycobacterium bovis subsp bovis AF2122/97
agcuccgugucggacaaggacu

SEQ ID NO: 1214212 - RNA, 13 nt, Mycobacterium bovis subsp bovis AF2122/97
agcuccucagcca

SEQ ID NO: 1214213 - RNA, 15 nt, Mycobacterium bovis subsp bovis AF2122/97
agcgucggugccacc

SEQ ID NO: 1214214 - RNA, 15 nt, Mycobacterium bovis subsp bovis AF2122/97
agcgucgcggccacg

SEQ ID NO: 1214215 - RNA, 20 nt, Mycobacterium bovis subsp bovis AF2122/97
agcgucgcuaucgugcgccg

SEQ ID NO: 1214216 - RNA, 14 nt, Mycobacterium bovis subsp bovis AF2122/97
agcgucgccauucc

SEQ ID NO: 1214217 - RNA, 19 nt, Mycobacterium bovis subsp bovis AF2122/97
agcgucucgccgggaaaca

SEQ ID NO: 1214218 - RNA, 20 nt, Mycobacterium bovis subsp bovis AF2122/97
agcgucaggccuccaaaauc

SEQ ID NO: 1214219 - RNA, 17 nt, Mycobacterium bovis subsp bovis AF2122/97
agcucggcgcccagcuc

SEQ ID NO: 1214220 - RNA, 13 nt, Mycobacterium bovis subsp bovis AF2122/97
agcucgggcaggg

SEQ ID NO: 1214221 - RNA, 18 nt, Mycobacterium bovis subsp bovis AF2122/97
agcucgggcagggaccgc

SEQ ID NO: 1214222 - RNA, 20 nt, Mycobacterium bovis subsp bovis AF2122/97
agcucgggugcgaacaacgc

SEQ ID NO: 1214223 - RNA, 16 nt, Mycobacterium bovis subsp bovis AF2122/97
agcucggcggcagcgg

SEQ ID NO: 1214224 - RNA, 15 nt, Mycobacterium bovis subsp bovis AF2122/97
agcucggucagcguc

SEQ ID NO: 1214225 - RNA, 18 nt, Mycobacterium bovis subsp bovis AF2122/97
agcucguaggugaagagc

SEQ ID NO: 1214226 - RNA, 21 nt, Mycobacterium bovis subsp bovis AF2122/97
agcucguugcuggcggccagc

SEQ ID NO: 1214227 - RNA, 19 nt, Mycobacterium bovis subsp bovis AF2122/97
agcucucggcacccggcag

SEQ ID NO: 1214228 - RNA, 20 nt, Mycobacterium bovis subsp bovis AF2122/97
agcucugcgucgugcccgua

SEQ ID NO: 1214229 - RNA, 17 nt, Mycobacterium bovis subsp bovis AF2122/97
agcugaccacgguagac

SEQ ID NO: 1214230 - RNA, 13 nt, Mycobacterium bovis subsp bovis AF2122/97
agcugaccgccag

SEQ ID NO: 1214231 - RNA, 24 nt, Mycobacterium bovis subsp bovis AF2122/97
agcugacaccgaaccgccgcugcc

SEQ ID NO: 1214232 - RNA, 15 nt, Mycobacterium bovis subsp bovis AF2122/97
agcugagcggccggc

SEQ ID NO: 1214233 - RNA, 23 nt, Mycobacterium bovis subsp bovis AF2122/97
agcugaacacgaauccggccacu

SEQ ID NO: 1214234 - RNA, 19 nt, Mycobacterium bovis subsp bovis AF2122/97
agcugaaaauaggccgggc

SEQ ID NO: 1214235 - RNA, 18 nt, Mycobacterium bovis subsp bovis AF2122/97
agcucuucggacacagcc

SEQ ID NO: 1214236 - RNA, 17 nt, Mycobacterium bovis subsp bovis AF2122/97
agcuggcguucccgcuc

SEQ ID NO: 1214237 - RNA, 12 nt, Mycobacterium bovis subsp bovis AF2122/97
agcuggccaggu

SEQ ID NO: 1214238 - RNA, 14 nt, Mycobacterium bovis subsp bovis AF2122/97
agcugggcugaugg

SEQ ID NO: 1214239 - RNA, 15 nt, Mycobacterium bovis subsp bovis AF2122/97
agcugggcaccccgu

SEQ ID NO: 1214240 - RNA, 13 nt, Mycobacterium bovis subsp bovis AF2122/97
agcugggcagcca

SEQ ID NO: 1214241 - RNA, 12 nt, Mycobacterium bovis subsp bovis AF2122/97
agcugugguggu

SEQ ID NO: 1214242 - RNA, 19 nt, Mycobacterium bovis subsp bovis AF2122/97
agcuggcgcgcgggguggc

SEQ ID NO: 1214243 - RNA, 18 nt, Mycobacterium bovis subsp bovis AF2122/97
agcugguaaacgggugga

SEQ ID NO: 1214244 - RNA, 17 nt, Mycobacterium bovis subsp bovis AF2122/97
agcugguagcgcaccac

SEQ ID NO: 1214245 - RNA, 12 nt, Mycobacterium bovis subsp bovis AF2122/97
agcugggucccg

SEQ ID NO: 1214246 - RNA, 22 nt, Mycobacterium bovis subsp bovis AF2122/97
agcuguuggcguggaucuuggc

SEQ ID NO: 1214247 - RNA, 21 nt, Mycobacterium bovis subsp bovis AF2122/97
agcuguugaccguguggccgu

SEQ ID NO: 1214248 - RNA, 14 nt, Mycobacterium bovis subsp bovis AF2122/97
agcugcgcgggcga

SEQ ID NO: 1214249 - RNA, 19 nt, Mycobacterium bovis subsp bovis AF2122/97
agcugcgcgaagccaccag

SEQ ID NO: 1214250 - RNA, 23 nt, Mycobacterium bovis subsp bovis AF2122/97
agcugcgcagcgcaaacaucuug

SEQ ID NO: 1214251 - RNA, 22 nt, Mycobacterium bovis subsp bovis AF2122/97
agcugcgcaucgccaccaucac

SEQ ID NO: 1214252 - RNA, 23 nt, Mycobacterium bovis subsp bovis AF2122/97
agcugcgggucgugccccggcgc

SEQ ID NO: 1214253 - RNA, 13 nt, Mycobacterium bovis subsp bovis AF2122/97
agcugaugccugg

SEQ ID NO: 1214254 - RNA, 21 nt, Mycobacterium bovis subsp bovis AF2122/97
agcugauuguguuccaccagc

SEQ ID NO: 1214255 - RNA, 18 nt, Mycobacterium bovis subsp bovis AF2122/97
agcuucaacaccggcauc

SEQ ID NO: 1214256 - RNA, 17 nt, Mycobacterium bovis subsp bovis AF2122/97
agcuugaccgaccacgc

SEQ ID NO: 1214257 - RNA, 15 nt, Mycobacterium bovis subsp bovis AF2122/97
agcuugacaacccug

SEQ ID NO: 1214258 - RNA, 22 nt, Mycobacterium bovis subsp bovis AF2122/97
agcuuggagaggcggugcagcu

SEQ ID NO: 1214259 - RNA, 12 nt, Mycobacterium bovis subsp bovis AF2122/97
agcuuggccagc

SEQ ID NO: 1214260 - RNA, 14 nt, Mycobacterium bovis subsp bovis AF2122/97
agcuuggccagcca

SEQ ID NO: 1214261 - RNA, 14 nt, Mycobacterium bovis subsp bovis AF2122/97
agcuuggccgccgc

SEQ ID NO: 1214262 - RNA, 22 nt, Mycobacterium bovis subsp bovis AF2122/97
agcuuggccgguucaggggugg

SEQ ID NO: 1214263 - RNA, 15 nt, Mycobacterium bovis subsp bovis AF2122/97
agcuuggacucaucg

SEQ ID NO: 1214264 - RNA, 14 nt, Mycobacterium bovis subsp bovis AF2122/97
agcuuggagaggcg

SEQ ID NO: 1214265 - RNA, 13 nt, Mycobacterium bovis subsp bovis AF2122/97
agcuuguuuucca

SEQ ID NO: 1214266 - RNA, 18 nt, Mycobacterium bovis subsp bovis AF2122/97
agcuuggccucagccacc

SEQ ID NO: 1214267 - RNA, 23 nt, Mycobacterium bovis subsp bovis AF2122/97
agcuuggcggccagcguguccca

SEQ ID NO: 1214268 - RNA, 15 nt, Mycobacterium bovis subsp bovis AF2122/97
aggacggagcccaaa

SEQ ID NO: 1214269 - RNA, 16 nt, Mycobacterium bovis subsp bovis AF2122/97
aggacgccagcaaugc

SEQ ID NO: 1214270 - RNA, 13 nt, Mycobacterium bovis subsp bovis AF2122/97
aggacggcugccg

SEQ ID NO: 1214271 - RNA, 19 nt, Mycobacterium bovis subsp bovis AF2122/97
aggacggcuugagccgcag

SEQ ID NO: 1214272 - RNA, 20 nt, Mycobacterium bovis subsp bovis AF2122/97
aggaccuucugucccugcag

SEQ ID NO: 1214273 - RNA, 23 nt, Mycobacterium bovis subsp bovis AF2122/97
aggaccgggaucgucaggcccau

SEQ ID NO: 1214274 - RNA, 21 nt, Mycobacterium bovis subsp bovis AF2122/97
aggaccgcgccgaucaccacc

SEQ ID NO: 1214275 - RNA, 21 nt, Mycobacterium bovis subsp bovis AF2122/97
aggaccggugggucugcucag

SEQ ID NO: 1214276 - RNA, 16 nt, Mycobacterium bovis subsp bovis AF2122/97
aggaaugccgcgggga

SEQ ID NO: 1214277 - RNA, 22 nt, Mycobacterium bovis subsp bovis AF2122/97
aggaaucguucgggguggugga

SEQ ID NO: 1214278 - RNA, 20 nt, Mycobacterium bovis subsp bovis AF2122/97
aggaaucccucggccgcagg

SEQ ID NO: 1214279 - RNA, 21 nt, Mycobacterium bovis subsp bovis AF2122/97
aggaaucccucggccgcaggc

SEQ ID NO: 1214280 - RNA, 20 nt, Mycobacterium bovis subsp bovis AF2122/97
aggaaacgagcgaaggugaa

SEQ ID NO: 1214281 - RNA, 13 nt, Mycobacterium bovis subsp bovis AF2122/97
aggacucacgcag

SEQ ID NO: 1214282 - RNA, 17 nt, Mycobacterium bovis subsp bovis AF2122/97
aggagguuguagucaga

SEQ ID NO: 1214283 - RNA, 19 nt, Mycobacterium bovis subsp bovis AF2122/97
aggaucuguuugggcaucu

SEQ ID NO: 1214284 - RNA, 21 nt, Mycobacterium bovis subsp bovis AF2122/97
aggaucgaggcgucggcaacc

SEQ ID NO: 1214285 - RNA, 20 nt, Mycobacterium bovis subsp bovis AF2122/97
aggaucggcuugggaaaccc

SEQ ID NO: 1214286 - RNA, 14 nt, Mycobacterium bovis subsp bovis AF2122/97
aggccgcugccagc

SEQ ID NO: 1214287 - RNA, 19 nt, Mycobacterium bovis subsp bovis AF2122/97
aggccgcugacacccgcca

SEQ ID NO: 1214288 - RNA, 22 nt, Mycobacterium bovis subsp bovis AF2122/97
aggccgcuugccccgccuuggc

SEQ ID NO: 1214289 - RNA, 22 nt, Mycobacterium bovis subsp bovis AF2122/97
aggccggacuuuaaaccgaacc

SEQ ID NO: 1214290 - RNA, 22 nt, Mycobacterium bovis subsp bovis AF2122/97
aggccgcggcaccuggcuugag

SEQ ID NO: 1214291 - RNA, 15 nt, Mycobacterium bovis subsp bovis AF2122/97
aggccgcgcgcaggg

SEQ ID NO: 1214292 - RNA, 17 nt, Mycobacterium bovis subsp bovis AF2122/97
aggccgcgcggacccag

SEQ ID NO: 1214293 - RNA, 12 nt, Mycobacterium bovis subsp bovis AF2122/97
aggccgcgucga

SEQ ID NO: 1214294 - RNA, 17 nt, Mycobacterium bovis subsp bovis AF2122/97
aggcccuggccacccag

SEQ ID NO: 1214295 - RNA, 20 nt, Mycobacterium bovis subsp bovis AF2122/97
aggccgaacagccgagccag

SEQ ID NO: 1214296 - RNA, 15 nt, Mycobacterium bovis subsp bovis AF2122/97
aggccgaaauccaga

SEQ ID NO: 1214297 - RNA, 10 nt, Mycobacterium bovis subsp bovis AF2122/97
aggccgccgc

SEQ ID NO: 1214298 - RNA, 15 nt, Mycobacterium bovis subsp bovis AF2122/97
aggcccuggccaccc

SEQ ID NO: 1214299 - RNA, 16 nt, Mycobacterium bovis subsp bovis AF2122/97
aggcccuggccaccca

SEQ ID NO: 1214300 - RNA, 15 nt, Mycobacterium bovis subsp bovis AF2122/97
aggcccucgacggcg

SEQ ID NO: 1214301 - RNA, 16 nt, Mycobacterium bovis subsp bovis AF2122/97
aggcccucgacggcgu

SEQ ID NO: 1214302 - RNA, 13 nt, Mycobacterium bovis subsp bovis AF2122/97
aggcccuggccag

SEQ ID NO: 1214303 - RNA, 22 nt, Mycobacterium bovis subsp bovis AF2122/97
aggcccgggcggccagcugcag

SEQ ID NO: 1214304 - RNA, 13 nt, Mycobacterium bovis subsp bovis AF2122/97
aggccagcccggc

SEQ ID NO: 1214305 - RNA, 15 nt, Mycobacterium bovis subsp bovis AF2122/97
aggccaggaucuccc

SEQ ID NO: 1214306 - RNA, 17 nt, Mycobacterium bovis subsp bovis AF2122/97
aggcaauggcgugcggu

SEQ ID NO: 1214307 - RNA, 22 nt, Mycobacterium bovis subsp bovis AF2122/97
aggcaaugcccgaccggucugg

SEQ ID NO: 1214308 - RNA, 22 nt, Mycobacterium bovis subsp bovis AF2122/97
aggaugcugagcgccaggccgc

SEQ ID NO: 1214309 - RNA, 13 nt, Mycobacterium bovis subsp bovis AF2122/97
aggaugcggcccc

SEQ ID NO: 1214310 - RNA, 20 nt, Mycobacterium bovis subsp bovis AF2122/97
aggaugugguuggugcuggc

SEQ ID NO: 1214311 - RNA, 13 nt, Mycobacterium bovis subsp bovis AF2122/97
aggcaaacaccag

SEQ ID NO: 1214312 - RNA, 14 nt, Mycobacterium bovis subsp bovis AF2122/97
aggcugcagugccg

SEQ ID NO: 1214313 - RNA, 20 nt, Mycobacterium bovis subsp bovis AF2122/97
aggcugccgaaguugaagaa

SEQ ID NO: 1214314 - RNA, 17 nt, Mycobacterium bovis subsp bovis AF2122/97
aggcugguuucggccgc

SEQ ID NO: 1214315 - RNA, 14 nt, Mycobacterium bovis subsp bovis AF2122/97
aggcugguccgggu

SEQ ID NO: 1214316 - RNA, 16 nt, Mycobacterium bovis subsp bovis AF2122/97
aggcuggucugcaggc

SEQ ID NO: 1214317 - RNA, 14 nt, Mycobacterium bovis subsp bovis AF2122/97
aggcuguaacaccc

SEQ ID NO: 1214318 - RNA, 15 nt, Mycobacterium bovis subsp bovis AF2122/97
aggcucauccgccgg

SEQ ID NO: 1214319 - RNA, 22 nt, Mycobacterium bovis subsp bovis AF2122/97
aggcuccaagcaauuccaccgc

SEQ ID NO: 1214320 - RNA, 23 nt, Mycobacterium bovis subsp bovis AF2122/97
aggcucauccgccgggccaggcc

SEQ ID NO: 1214321 - RNA, 18 nt, Mycobacterium bovis subsp bovis AF2122/97
aggcucacacucggccgg

SEQ ID NO: 1214322 - RNA, 12 nt, Mycobacterium bovis subsp bovis AF2122/97
aggcucgcagga

SEQ ID NO: 1214323 - RNA, 23 nt, Mycobacterium bovis subsp bovis AF2122/97
aggcucgugcguguaccugccca

SEQ ID NO: 1214324 - RNA, 15 nt, Mycobacterium bovis subsp bovis AF2122/97
aggcugaccguggcg

SEQ ID NO: 1214325 - RNA, 18 nt, Mycobacterium bovis subsp bovis AF2122/97
aggcguuggaucccagcc

SEQ ID NO: 1214326 - RNA, 19 nt, Mycobacterium bovis subsp bovis AF2122/97
aggcguuguagcgguccag

SEQ ID NO: 1214327 - RNA, 14 nt, Mycobacterium bovis subsp bovis AF2122/97
aggcguuuccgcug

SEQ ID NO: 1214328 - RNA, 13 nt, Mycobacterium bovis subsp bovis AF2122/97
aggcgugcacagg

SEQ ID NO: 1214329 - RNA, 18 nt, Mycobacterium bovis subsp bovis AF2122/97
aggcgugucgucgcggcc

SEQ ID NO: 1214330 - RNA, 12 nt, Mycobacterium bovis subsp bovis AF2122/97
aggccggccacc

SEQ ID NO: 1214331 - RNA, 20 nt, Mycobacterium bovis subsp bovis AF2122/97
aggccggcagcuugcagugc

SEQ ID NO: 1214332 - RNA, 20 nt, Mycobacterium bovis subsp bovis AF2122/97
aggccggccaccaccgcgcc

SEQ ID NO: 1214333 - RNA, 17 nt, Mycobacterium bovis subsp bovis AF2122/97
aggccggcccgcaacgc

SEQ ID NO: 1214334 - RNA, 20 nt, Mycobacterium bovis subsp bovis AF2122/97
aggccggcggcggcgcucgg

SEQ ID NO: 1214335 - RNA, 17 nt, Mycobacterium bovis subsp bovis AF2122/97
aggcggccaggugcagg

SEQ ID NO: 1214336 - RNA, 22 nt, Mycobacterium bovis subsp bovis AF2122/97
aggccggcgaccgggcccccag

SEQ ID NO: 1214337 - RNA, 20 nt, Mycobacterium bovis subsp bovis AF2122/97
aggcggcugaacggcagccg

SEQ ID NO: 1214338 - RNA, 12 nt, Mycobacterium bovis subsp bovis AF2122/97
aggcggcggccc

SEQ ID NO: 1214339 - RNA, 14 nt, Mycobacterium bovis subsp bovis AF2122/97
aggcggcggccagc

SEQ ID NO: 1214340 - RNA, 14 nt, Mycobacterium bovis subsp bovis AF2122/97
aggcgggcggcacc

SEQ ID NO: 1214341 - RNA, 18 nt, Mycobacterium bovis subsp bovis AF2122/97
aggcggucuuguccagga

SEQ ID NO: 1214342 - RNA, 18 nt, Mycobacterium bovis subsp bovis AF2122/97
aggcguaaucaagcagcg

SEQ ID NO: 1214343 - RNA, 22 nt, Mycobacterium bovis subsp bovis AF2122/97
agggcgcgagcagacgcagaau

SEQ ID NO: 1214344 - RNA, 19 nt, Mycobacterium bovis subsp bovis AF2122/97
agggcuugucgccggcaua

SEQ ID NO: 1214345 - RNA, 21 nt, Mycobacterium bovis subsp bovis AF2122/97
agggcuuucgcuuccugggca

SEQ ID NO: 1214346 - RNA, 20 nt, Mycobacterium bovis subsp bovis AF2122/97
agggcuuugucaccggcuuc

SEQ ID NO: 1214347 - RNA, 14 nt, Mycobacterium bovis subsp bovis AF2122/97
aggggacgggcggc

SEQ ID NO: 1214348 - RNA, 19 nt, Mycobacterium bovis subsp bovis AF2122/97
aggggguggugucgcggcc

SEQ ID NO: 1214349 - RNA, 16 nt, Mycobacterium bovis subsp bovis AF2122/97
agggggcaagcuccag

SEQ ID NO: 1214350 - RNA, 15 nt, Mycobacterium bovis subsp bovis AF2122/97
aggggcaacagggga

SEQ ID NO: 1214351 - RNA, 21 nt, Mycobacterium bovis subsp bovis AF2122/97
aggggcuuuugcgucugcucg

SEQ ID NO: 1214352 - RNA, 20 nt, Mycobacterium bovis subsp bovis AF2122/97
aggggaucguccggccgggg

SEQ ID NO: 1214353 - RNA, 15 nt, Mycobacterium bovis subsp bovis AF2122/97
aggguggggccggcg

SEQ ID NO: 1214354 - RNA, 20 nt, Mycobacterium bovis subsp bovis AF2122/97
aggguucggacggcugguag

SEQ ID NO: 1214355 - RNA, 20 nt, Mycobacterium bovis subsp bovis AF2122/97
aggguguugcggcugaccuc

SEQ ID NO: 1214356 - RNA, 18 nt, Mycobacterium bovis subsp bovis AF2122/97
aggggugcccggcggcca

SEQ ID NO: 1214357 - RNA, 19 nt, Mycobacterium bovis subsp bovis AF2122/97
agggucugcgccgccggcg

SEQ ID NO: 1214358 - RNA, 22 nt, Mycobacterium bovis subsp bovis AF2122/97
agggucugcucauccgggugcu

SEQ ID NO: 1214359 - RNA, 15 nt, Mycobacterium bovis subsp bovis AF2122/97
aggcuguggccagca

SEQ ID NO: 1214360 - RNA, 20 nt, Mycobacterium bovis subsp bovis AF2122/97
aggcugugccccagggcagu

SEQ ID NO: 1214361 - RNA, 19 nt, Mycobacterium bovis subsp bovis AF2122/97
aggcugucgcgggccacca

SEQ ID NO: 1214362 - RNA, 11 nt, Mycobacterium bovis subsp bovis AF2122/97
aggcuguccag

SEQ ID NO: 1214363 - RNA, 14 nt, Mycobacterium bovis subsp bovis AF2122/97
agggaucgcaggga

SEQ ID NO: 1214364 - RNA, 17 nt, Mycobacterium bovis subsp bovis AF2122/97
agggaucgcagggauca

SEQ ID NO: 1214365 - RNA, 19 nt, Mycobacterium bovis subsp bovis AF2122/97
agggauccgaagagccagc

SEQ ID NO: 1214366 - RNA, 19 nt, Mycobacterium bovis subsp bovis AF2122/97
agggaucuagaggcggccc

SEQ ID NO: 1214367 - RNA, 14 nt, Mycobacterium bovis subsp bovis AF2122/97
agggauagcagugc

SEQ ID NO: 1214368 - RNA, 16 nt, Mycobacterium bovis subsp bovis AF2122/97
agggauagcagugcag

SEQ ID NO: 1214369 - RNA, 17 nt, Mycobacterium bovis subsp bovis AF2122/97
agggauagcagugcagc

SEQ ID NO: 1214370 - RNA, 15 nt, Mycobacterium bovis subsp bovis AF2122/97
aggcuugacugcaca

SEQ ID NO: 1214371 - RNA, 18 nt, Mycobacterium bovis subsp bovis AF2122/97
aggcuugacugcacacca

SEQ ID NO: 1214372 - RNA, 20 nt, Mycobacterium bovis subsp bovis AF2122/97
aggcuucggugacccgggcg

SEQ ID NO: 1214373 - RNA, 22 nt, Mycobacterium bovis subsp bovis AF2122/97
aggcuucggugacccgggcggc

SEQ ID NO: 1214374 - RNA, 14 nt, Mycobacterium bovis subsp bovis AF2122/97
agggccuggccaca

SEQ ID NO: 1214375 - RNA, 16 nt, Mycobacterium bovis subsp bovis AF2122/97
agggccuguuuaccuu

SEQ ID NO: 1214376 - RNA, 13 nt, Mycobacterium bovis subsp bovis AF2122/97
agggcaucgagac

SEQ ID NO: 1214377 - RNA, 14 nt, Mycobacterium bovis subsp bovis AF2122/97
agggcauccgagcg

SEQ ID NO: 1214378 - RNA, 16 nt, Mycobacterium bovis subsp bovis AF2122/97
agggcauacagcaugu

SEQ ID NO: 1214379 - RNA, 16 nt, Mycobacterium bovis subsp bovis AF2122/97
agggcagcgccaggcc

SEQ ID NO: 1214380 - RNA, 23 nt, Mycobacterium bovis subsp bovis AF2122/97
agggaucuagaggcggcccccgg

SEQ ID NO: 1214381 - RNA, 16 nt, Mycobacterium bovis subsp bovis AF2122/97
agggcacugaaccggu

SEQ ID NO: 1214382 - RNA, 16 nt, Mycobacterium bovis subsp bovis AF2122/97
aggugccggggcccca

SEQ ID NO: 1214383 - RNA, 16 nt, Mycobacterium bovis subsp bovis AF2122/97
aggugcccaagcaguc

SEQ ID NO: 1214384 - RNA, 18 nt, Mycobacterium bovis subsp bovis AF2122/97
aggugcccaaggccagga

SEQ ID NO: 1214385 - RNA, 13 nt, Mycobacterium bovis subsp bovis AF2122/97
aggugccagacca

SEQ ID NO: 1214386 - RNA, 18 nt, Mycobacterium bovis subsp bovis AF2122/97
aggugacguucgaugccc

SEQ ID NO: 1214387 - RNA, 20 nt, Mycobacterium bovis subsp bovis AF2122/97
aggugacgcccgcuccgcgg

SEQ ID NO: 1214388 - RNA, 15 nt, Mycobacterium bovis subsp bovis AF2122/97
aggugacgccgccag

SEQ ID NO: 1214389 - RNA, 19 nt, Mycobacterium bovis subsp bovis AF2122/97
aggugacgccgccagcacc

SEQ ID NO: 1214390 - RNA, 20 nt, Mycobacterium bovis subsp bovis AF2122/97
agguggcgcggggccgccgc

SEQ ID NO: 1214391 - RNA, 11 nt, Mycobacterium bovis subsp bovis AF2122/97
aggugggcucg

SEQ ID NO: 1214392 - RNA, 15 nt, Mycobacterium bovis subsp bovis AF2122/97
aggugggcagcaggc

SEQ ID NO: 1214393 - RNA, 22 nt, Mycobacterium bovis subsp bovis AF2122/97
agguggcuggcugugccgagcu

SEQ ID NO: 1214394 - RNA, 23 nt, Mycobacterium bovis subsp bovis AF2122/97
aggugggauugaagcuggccacc

SEQ ID NO: 1214395 - RNA, 15 nt, Mycobacterium bovis subsp bovis AF2122/97
agguggggugguggu

SEQ ID NO: 1214396 - RNA, 23 nt, Mycobacterium bovis subsp bovis AF2122/97
agguggugacacgacgugcagga

SEQ ID NO: 1214397 - RNA, 13 nt, Mycobacterium bovis subsp bovis AF2122/97
aggugucaacgcg

SEQ ID NO: 1214398 - RNA, 15 nt, Mycobacterium bovis subsp bovis AF2122/97
aggugucgggcucgc

SEQ ID NO: 1214399 - RNA, 19 nt, Mycobacterium bovis subsp bovis AF2122/97
aggugugcgucuccagcug

SEQ ID NO: 1214400 - RNA, 22 nt, Mycobacterium bovis subsp bovis AF2122/97
agguguguggcgccggggacca

SEQ ID NO: 1214401 - RNA, 15 nt, Mycobacterium bovis subsp bovis AF2122/97
agguguguggcggcg

SEQ ID NO: 1214402 - RNA, 17 nt, Mycobacterium bovis subsp bovis AF2122/97
agguguuggugcggggu

SEQ ID NO: 1214403 - RNA, 15 nt, Mycobacterium bovis subsp bovis AF2122/97
agguguugcgguggg

SEQ ID NO: 1214404 - RNA, 18 nt, Mycobacterium bovis subsp bovis AF2122/97
aggugaaccccgccggca

SEQ ID NO: 1214405 - RNA, 18 nt, Mycobacterium bovis subsp bovis AF2122/97
aggugaacgacaugggca

SEQ ID NO: 1214406 - RNA, 21 nt, Mycobacterium bovis subsp bovis AF2122/97
aggugaacgacaugggcaggc

SEQ ID NO: 1214407 - RNA, 22 nt, Mycobacterium bovis subsp bovis AF2122/97
aggugaacgccggugcgcugga

SEQ ID NO: 1214408 - RNA, 17 nt, Mycobacterium bovis subsp bovis AF2122/97
aggugaaucgacugauc

SEQ ID NO: 1214409 - RNA, 14 nt, Mycobacterium bovis subsp bovis AF2122/97
aggucuggcgcgga

SEQ ID NO: 1214410 - RNA, 18 nt, Mycobacterium bovis subsp bovis AF2122/97
aggucuucgaccacgguc

SEQ ID NO: 1214411 - RNA, 14 nt, Mycobacterium bovis subsp bovis AF2122/97
aggucgacauaggc

SEQ ID NO: 1214412 - RNA, 20 nt, Mycobacterium bovis subsp bovis AF2122/97
agguccucgagguccucguc

SEQ ID NO: 1214413 - RNA, 18 nt, Mycobacterium bovis subsp bovis AF2122/97
aggucgacgccgaccacc

SEQ ID NO: 1214414 - RNA, 24 nt, Mycobacterium bovis subsp bovis AF2122/97
aggucgacaccgcggugccccgga

SEQ ID NO: 1214415 - RNA, 20 nt, Mycobacterium bovis subsp bovis AF2122/97
aggucgaccacccgcagggc

SEQ ID NO: 1214416 - RNA, 17 nt, Mycobacterium bovis subsp bovis AF2122/97
aggucgagcgaccccac

SEQ ID NO: 1214417 - RNA, 18 nt, Mycobacterium bovis subsp bovis AF2122/97
aggucgacgggcacgcgg

SEQ ID NO: 1214418 - RNA, 23 nt, Mycobacterium bovis subsp bovis AF2122/97
aggucuccggcaagccgauugcu

SEQ ID NO: 1214419 - RNA, 15 nt, Mycobacterium bovis subsp bovis AF2122/97
aggucagcgcugcca

SEQ ID NO: 1214420 - RNA, 21 nt, Mycobacterium bovis subsp bovis AF2122/97
aggucaauggucuuuguccac

SEQ ID NO: 1214421 - RNA, 21 nt, Mycobacterium bovis subsp bovis AF2122/97
aggucacacguuggcagcccu

SEQ ID NO: 1214422 - RNA, 24 nt, Mycobacterium bovis subsp bovis AF2122/97
aggucacacguuggcagcccucug

SEQ ID NO: 1214423 - RNA, 11 nt, Mycobacterium bovis subsp bovis AF2122/97
aggucacccau

SEQ ID NO: 1214424 - RNA, 19 nt, Mycobacterium bovis subsp bovis AF2122/97
agguucccgcauugacgaa

SEQ ID NO: 1214425 - RNA, 16 nt, Mycobacterium bovis subsp bovis AF2122/97
agguucuucuccacca

SEQ ID NO: 1214426 - RNA, 19 nt, Mycobacterium bovis subsp bovis AF2122/97
agguucuucuccaccaccg

SEQ ID NO: 1214427 - RNA, 13 nt, Mycobacterium bovis subsp bovis AF2122/97
agguucgggugga

SEQ ID NO: 1214428 - RNA, 14 nt, Mycobacterium bovis subsp bovis AF2122/97
agguugaccaccag

SEQ ID NO: 1214429 - RNA, 21 nt, Mycobacterium bovis subsp bovis AF2122/97
aguaccgucaucgcggugugc

SEQ ID NO: 1214430 - RNA, 13 nt, Mycobacterium bovis subsp bovis AF2122/97
aguaccggccagc

SEQ ID NO: 1214431 - RNA, 20 nt, Mycobacterium bovis subsp bovis AF2122/97
aguaccggccagccgcggcc

SEQ ID NO: 1214432 - RNA, 18 nt, Mycobacterium bovis subsp bovis AF2122/97
aguaccgcacgcaauuca

SEQ ID NO: 1214433 - RNA, 12 nt, Mycobacterium bovis subsp bovis AF2122/97
aguacggcaggc

SEQ ID NO: 1214434 - RNA, 19 nt, Mycobacterium bovis subsp bovis AF2122/97
aguaaugcccaugcuucgg

SEQ ID NO: 1214435 - RNA, 15 nt, Mycobacterium bovis subsp bovis AF2122/97
aguacacggcggccc

SEQ ID NO: 1214436 - RNA, 21 nt, Mycobacterium bovis subsp bovis AF2122/97
accagcgcgccguagaccagc

SEQ ID NO: 1214437 - RNA, 17 nt, Mycobacterium bovis subsp bovis AF2122/97
accagcggcacaucaug

SEQ ID NO: 1214438 - RNA, 21 nt, Mycobacterium bovis subsp bovis AF2122/97
accagcgccgauaccagccaa

SEQ ID NO: 1214439 - RNA, 19 nt, Mycobacterium bovis subsp bovis AF2122/97
accagcgccgcacccgcuc

SEQ ID NO: 1214440 - RNA, 21 nt, Mycobacterium bovis subsp bovis AF2122/97
accagcgccuugaccagcagc

SEQ ID NO: 1214441 - RNA, 18 nt, Mycobacterium bovis subsp bovis AF2122/97
accagcguggggccgcca

SEQ ID NO: 1214442 - RNA, 16 nt, Mycobacterium bovis subsp bovis AF2122/97
accagcguccagccgc

SEQ ID NO: 1214443 - RNA, 14 nt, Mycobacterium bovis subsp bovis AF2122/97
accagcggcggccc

SEQ ID NO: 1214444 - RNA, 15 nt, Mycobacterium bovis subsp bovis AF2122/97
accagcggucagccg

SEQ ID NO: 1214445 - RNA, 23 nt, Mycobacterium bovis subsp bovis AF2122/97
accagcggucggcgaccaccagc

SEQ ID NO: 1214446 - RNA, 14 nt, Mycobacterium bovis subsp bovis AF2122/97
accagcgcccggcc

SEQ ID NO: 1214447 - RNA, 14 nt, Mycobacterium bovis subsp bovis AF2122/97
accagcgccccggc

SEQ ID NO: 1214448 - RNA, 20 nt, Mycobacterium bovis subsp bovis AF2122/97
accagcgcaucggccagcag

SEQ ID NO: 1214449 - RNA, 17 nt, Mycobacterium bovis subsp bovis AF2122/97
accagcgaggccagcgg

SEQ ID NO: 1214450 - RNA, 15 nt, Mycobacterium bovis subsp bovis AF2122/97
accagcgaccagguc

SEQ ID NO: 1214451 - RNA, 20 nt, Mycobacterium bovis subsp bovis AF2122/97
accagccuuaugcagugaca

SEQ ID NO: 1214452 - RNA, 20 nt, Mycobacterium bovis subsp bovis AF2122/97
accagccucgaggguuucca

SEQ ID NO: 1214453 - RNA, 14 nt, Mycobacterium bovis subsp bovis AF2122/97
accagccggugagc

SEQ ID NO: 1214454 - RNA, 18 nt, Mycobacterium bovis subsp bovis AF2122/97
accagccaaaacgagcag

SEQ ID NO: 1214455 - RNA, 15 nt, Mycobacterium bovis subsp bovis AF2122/97
accagccaccaccag

SEQ ID NO: 1214456 - RNA, 18 nt, Mycobacterium bovis subsp bovis AF2122/97
accagccaccaccagguc

SEQ ID NO: 1214457 - RNA, 19 nt, Mycobacterium bovis subsp bovis AF2122/97
accagcauggcuuuugcgc

SEQ ID NO: 1214458 - RNA, 14 nt, Mycobacterium bovis subsp bovis AF2122/97
accagcaggcggcu

SEQ ID NO: 1214459 - RNA, 14 nt, Mycobacterium bovis subsp bovis AF2122/97
accagccagccugc

SEQ ID NO: 1214460 - RNA, 15 nt, Mycobacterium bovis subsp bovis AF2122/97
accagccagcgagga

SEQ ID NO: 1214461 - RNA, 12 nt, Mycobacterium bovis subsp bovis AF2122/97
accagccgcccc

SEQ ID NO: 1214462 - RNA, 23 nt, Mycobacterium bovis subsp bovis AF2122/97
accagccggucuuggacagcagc

SEQ ID NO: 1214463 - RNA, 15 nt, Mycobacterium bovis subsp bovis AF2122/97
accagccgaucauca

SEQ ID NO: 1214464 - RNA, 22 nt, Mycobacterium bovis subsp bovis AF2122/97
accagcccgaugaucccgccac

SEQ ID NO: 1214465 - RNA, 19 nt, Mycobacterium bovis subsp bovis AF2122/97
accagcagaccaagcccua

SEQ ID NO: 1214466 - RNA, 14 nt, Mycobacterium bovis subsp bovis AF2122/97
accagcacggcaac

SEQ ID NO: 1214467 - RNA, 14 nt, Mycobacterium bovis subsp bovis AF2122/97
accagcacacccgu

SEQ ID NO: 1214468 - RNA, 14 nt, Mycobacterium bovis subsp bovis AF2122/97
accagaugcaccuc

SEQ ID NO: 1214469 - RNA, 18 nt, Mycobacterium bovis subsp bovis AF2122/97
accagaucgacgcauucc

SEQ ID NO: 1214470 - RNA, 19 nt, Mycobacterium bovis subsp bovis AF2122/97
accagaucgacgcauuccu

SEQ ID NO: 1214471 - RNA, 24 nt, Mycobacterium bovis subsp bovis AF2122/97
accagaggcgugucgacuccgauc

SEQ ID NO: 1214472 - RNA, 17 nt, Mycobacterium bovis subsp bovis AF2122/97
accagaggucacgcagc

SEQ ID NO: 1214473 - RNA, 22 nt, Mycobacterium bovis subsp bovis AF2122/97
accagaucaacaucaucacugu

SEQ ID NO: 1214474 - RNA, 17 nt, Mycobacterium bovis subsp bovis AF2122/97
accaacccaccccccag

SEQ ID NO: 1214475 - RNA, 13 nt, Mycobacterium bovis subsp bovis AF2122/97
accaacccggcuc

SEQ ID NO: 1214476 - RNA, 23 nt, Mycobacterium bovis subsp bovis AF2122/97
accaacucucgcgggauggacag

SEQ ID NO: 1214477 - RNA, 16 nt, Mycobacterium bovis subsp bovis AF2122/97
accaagacaccggccu

SEQ ID NO: 1214478 - RNA, 15 nt, Mycobacterium bovis subsp bovis AF2122/97
accagguacgggagc

SEQ ID NO: 1214479 - RNA, 22 nt, Mycobacterium bovis subsp bovis AF2122/97
accagguacgggagcccgagcu

SEQ ID NO: 1214480 - RNA, 18 nt, Mycobacterium bovis subsp bovis AF2122/97
accaggguguauggccac

SEQ ID NO: 1214481 - RNA, 18 nt, Mycobacterium bovis subsp bovis AF2122/97
accagguaaucaccuggc

SEQ ID NO: 1214482 - RNA, 16 nt, Mycobacterium bovis subsp bovis AF2122/97
accaggguggcaucga

SEQ ID NO: 1214483 - RNA, 20 nt, Mycobacterium bovis subsp bovis AF2122/97
accaggggucgcugugcagc

SEQ ID NO: 1214484 - RNA, 16 nt, Mycobacterium bovis subsp bovis AF2122/97
accagggcagcggcca

SEQ ID NO: 1214485 - RNA, 17 nt, Mycobacterium bovis subsp bovis AF2122/97
accagggccgccgcugc

SEQ ID NO: 1214486 - RNA, 23 nt, Mycobacterium bovis subsp bovis AF2122/97
accagggccgccgcugccgccug

SEQ ID NO: 1214487 - RNA, 12 nt, Mycobacterium bovis subsp bovis AF2122/97
accagggccucg

SEQ ID NO: 1214488 - RNA, 17 nt, Mycobacterium bovis subsp bovis AF2122/97
accaggucggucagguc

SEQ ID NO: 1214489 - RNA, 19 nt, Mycobacterium bovis subsp bovis AF2122/97
accaggucgugcccgggac

SEQ ID NO: 1214490 - RNA, 22 nt, Mycobacterium bovis subsp bovis AF2122/97
accagguggaccggccuggcuc

SEQ ID NO: 1214491 - RNA, 20 nt, Mycobacterium bovis subsp bovis AF2122/97
accagcuguccucgcgggcu

SEQ ID NO: 1214492 - RNA, 17 nt, Mycobacterium bovis subsp bovis AF2122/97
accagcucagcugcgga

SEQ ID NO: 1214493 - RNA, 15 nt, Mycobacterium bovis subsp bovis AF2122/97
accagcucagcugcg

SEQ ID NO: 1214494 - RNA, 20 nt, Mycobacterium bovis subsp bovis AF2122/97
accagcguggggccgccacc

SEQ ID NO: 1214495 - RNA, 23 nt, Mycobacterium bovis subsp bovis AF2122/97
accagcguggggccgccaccagc

SEQ ID NO: 1214496 - RNA, 21 nt, Mycobacterium bovis subsp bovis AF2122/97
accaggaccggcugcaggugc

SEQ ID NO: 1214497 - RNA, 22 nt, Mycobacterium bovis subsp bovis AF2122/97
accaggaccggcugcaggugcu

SEQ ID NO: 1214498 - RNA, 18 nt, Mycobacterium bovis subsp bovis AF2122/97
accaggagccuccagcgc

SEQ ID NO: 1214499 - RNA, 20 nt, Mycobacterium bovis subsp bovis AF2122/97
accaggccaacggcgcugcc

SEQ ID NO: 1214500 - RNA, 20 nt, Mycobacterium bovis subsp bovis AF2122/97
accaggccguccucggucag

SEQ ID NO: 1214501 - RNA, 13 nt, Mycobacterium bovis subsp bovis AF2122/97
accaggccggccc

SEQ ID NO: 1214502 - RNA, 15 nt, Mycobacterium bovis subsp bovis AF2122/97
accaggccgcgcgca

SEQ ID NO: 1214503 - RNA, 11 nt, Mycobacterium bovis subsp bovis AF2122/97
accagugcccc

SEQ ID NO: 1214504 - RNA, 13 nt, Mycobacterium bovis subsp bovis AF2122/97
accagucgaagaa

SEQ ID NO: 1214505 - RNA, 21 nt, Mycobacterium bovis subsp bovis AF2122/97
accaguccucgggcaggcggc

SEQ ID NO: 1214506 - RNA, 15 nt, Mycobacterium bovis subsp bovis AF2122/97
accaucgccaggccc

SEQ ID NO: 1214507 - RNA, 17 nt, Mycobacterium bovis subsp bovis AF2122/97
acccgcccuugccgccg

SEQ ID NO: 1214508 - RNA, 20 nt, Mycobacterium bovis subsp bovis AF2122/97
acccgcccaggcguccauca

SEQ ID NO: 1214509 - RNA, 20 nt, Mycobacterium bovis subsp bovis AF2122/97
acccgccgugcccccggcuu

SEQ ID NO: 1214510 - RNA, 22 nt, Mycobacterium bovis subsp bovis AF2122/97
acccgccuaaagcgugucgccc

SEQ ID NO: 1214511 - RNA, 16 nt, Mycobacterium bovis subsp bovis AF2122/97
acccgccucaucuccu

SEQ ID NO: 1214512 - RNA, 22 nt, Mycobacterium bovis subsp bovis AF2122/97
acccggucaaagaugucgcugg

SEQ ID NO: 1214513 - RNA, 21 nt, Mycobacterium bovis subsp bovis AF2122/97
acccgccggcgacugcagcga

SEQ ID NO: 1214514 - RNA, 22 nt, Mycobacterium bovis subsp bovis AF2122/97
acccgguaccucaacaccaggc

SEQ ID NO: 1214515 - RNA, 15 nt, Mycobacterium bovis subsp bovis AF2122/97
acccgcagcugcgga

SEQ ID NO: 1214516 - RNA, 12 nt, Mycobacterium bovis subsp bovis AF2122/97
acccgcagggca

SEQ ID NO: 1214517 - RNA, 20 nt, Mycobacterium bovis subsp bovis AF2122/97
acccgcaggucgaucugcgc

SEQ ID NO: 1214518 - RNA, 22 nt, Mycobacterium bovis subsp bovis AF2122/97
acccgccagaugaugccacccu

SEQ ID NO: 1214519 - RNA, 15 nt, Mycobacterium bovis subsp bovis AF2122/97
acccgcccacggcac

SEQ ID NO: 1214520 - RNA, 18 nt, Mycobacterium bovis subsp bovis AF2122/97
acccggugaccagcaacc

SEQ ID NO: 1214521 - RNA, 19 nt, Mycobacterium bovis subsp bovis AF2122/97
acccggugaugguggcggu

SEQ ID NO: 1214522 - RNA, 16 nt, Mycobacterium bovis subsp bovis AF2122/97
acccggucgacggguc

SEQ ID NO: 1214523 - RNA, 20 nt, Mycobacterium bovis subsp bovis AF2122/97
acccgguccggcccggggac

SEQ ID NO: 1214524 - RNA, 14 nt, Mycobacterium bovis subsp bovis AF2122/97
acccggucggccau

SEQ ID NO: 1214525 - RNA, 14 nt, Mycobacterium bovis subsp bovis AF2122/97
acccguaccagccc

SEQ ID NO: 1214526 - RNA, 13 nt, Mycobacterium bovis subsp bovis AF2122/97
acccguacccacg

SEQ ID NO: 1214527 - RNA, 22 nt, Mycobacterium bovis subsp bovis AF2122/97
acccuagauaugcacccgcacc

SEQ ID NO: 1214528 - RNA, 20 nt, Mycobacterium bovis subsp bovis AF2122/97
acccucagccgcgccggguc

SEQ ID NO: 1214529 - RNA, 17 nt, Mycobacterium bovis subsp bovis AF2122/97
acccuggcggaacagcu

SEQ ID NO: 1214530 - RNA, 19 nt, Mycobacterium bovis subsp bovis AF2122/97
acccugcgccgccacagca

SEQ ID NO: 1214531 - RNA, 15 nt, Mycobacterium bovis subsp bovis AF2122/97
acccugucgcgcacc

SEQ ID NO: 1214532 - RNA, 18 nt, Mycobacterium bovis subsp bovis AF2122/97
accgacaccguguugcug

SEQ ID NO: 1214533 - RNA, 17 nt, Mycobacterium bovis subsp bovis AF2122/97
accgaauggccgccgca

SEQ ID NO: 1214534 - RNA, 14 nt, Mycobacterium bovis subsp bovis AF2122/97
accgaauugaacug

SEQ ID NO: 1214535 - RNA, 16 nt, Mycobacterium bovis subsp bovis AF2122/97
accgaauuacgcaccg

SEQ ID NO: 1214536 - RNA, 12 nt, Mycobacterium bovis subsp bovis AF2122/97
accgaagaagcc

SEQ ID NO: 1214537 - RNA, 15 nt, Mycobacterium bovis subsp bovis AF2122/97
accgaagcgaacggc

SEQ ID NO: 1214538 - RNA, 18 nt, Mycobacterium bovis subsp bovis AF2122/97
accgaagcgaacggcaca

SEQ ID NO: 1214539 - RNA, 18 nt, Mycobacterium bovis subsp bovis AF2122/97
accgaaagccgcaccaga

SEQ ID NO: 1214540 - RNA, 23 nt, Mycobacterium bovis subsp bovis AF2122/97
accgaacccgccaccgcgacacc

SEQ ID NO: 1214541 - RNA, 23 nt, Mycobacterium bovis subsp bovis AF2122/97
accgaaccgguguagcagcgcca

SEQ ID NO: 1214542 - RNA, 19 nt, Mycobacterium bovis subsp bovis AF2122/97
accgaaccgucagcggcaa

SEQ ID NO: 1214543 - RNA, 18 nt, Mycobacterium bovis subsp bovis AF2122/97
accgacccgcugccaccc

SEQ ID NO: 1214544 - RNA, 15 nt, Mycobacterium bovis subsp bovis AF2122/97
accgacccggccgcu

SEQ ID NO: 1214545 - RNA, 12 nt, Mycobacterium bovis subsp bovis AF2122/97
accgaccagccg

SEQ ID NO: 1214546 - RNA, 15 nt, Mycobacterium bovis subsp bovis AF2122/97
accgaccagccgugg

SEQ ID NO: 1214547 - RNA, 19 nt, Mycobacterium bovis subsp bovis AF2122/97
accgacaucgucauccagg

SEQ ID NO: 1214548 - RNA, 14 nt, Mycobacterium bovis subsp bovis AF2122/97
accgacagcaccca

SEQ ID NO: 1214549 - RNA, 15 nt, Mycobacterium bovis subsp bovis AF2122/97
accgacagcacccgg

SEQ ID NO: 1214550 - RNA, 21 nt, Mycobacterium bovis subsp bovis AF2122/97
accgacgcguccggugcacca

SEQ ID NO: 1214551 - RNA, 14 nt, Mycobacterium bovis subsp bovis AF2122/97
accgaccgcaugau

SEQ ID NO: 1214552 - RNA, 15 nt, Mycobacterium bovis subsp bovis AF2122/97
accgacgccauuggc

SEQ ID NO: 1214553 - RNA, 15 nt, Mycobacterium bovis subsp bovis AF2122/97
accgacgacgcgcgc

SEQ ID NO: 1214554 - RNA, 11 nt, Mycobacterium bovis subsp bovis AF2122/97
accgacgagga

SEQ ID NO: 1214555 - RNA, 23 nt, Mycobacterium bovis subsp bovis AF2122/97
accgacgaggacgucaccgucag

SEQ ID NO: 1214556 - RNA, 22 nt, Mycobacterium bovis subsp bovis AF2122/97
accgacugcugucaccgcaacc

SEQ ID NO: 1214557 - RNA, 17 nt, Mycobacterium bovis subsp bovis AF2122/97
accgaggucgagcgacc

SEQ ID NO: 1214558 - RNA, 20 nt, Mycobacterium bovis subsp bovis AF2122/97
accgaggugccgcgcagcug

SEQ ID NO: 1214559 - RNA, 18 nt, Mycobacterium bovis subsp bovis AF2122/97
accgagggauggccguug

SEQ ID NO: 1214560 - RNA, 21 nt, Mycobacterium bovis subsp bovis AF2122/97
accgagggcaaggacaagccg

SEQ ID NO: 1214561 - RNA, 19 nt, Mycobacterium bovis subsp bovis AF2122/97
accgaggccugacugaauu

SEQ ID NO: 1214562 - RNA, 14 nt, Mycobacterium bovis subsp bovis AF2122/97
accgaguuccucug

SEQ ID NO: 1214563 - RNA, 22 nt, Mycobacterium bovis subsp bovis AF2122/97
accgaugguggugccaaccugg

SEQ ID NO: 1214564 - RNA, 23 nt, Mycobacterium bovis subsp bovis AF2122/97
accgaugcgccggaccagcuccu

SEQ ID NO: 1214565 - RNA, 23 nt, Mycobacterium bovis subsp bovis AF2122/97
accccgucagcgggcagcaggcg

SEQ ID NO: 1214566 - RNA, 13 nt, Mycobacterium bovis subsp bovis AF2122/97
accccgguggaca

SEQ ID NO: 1214567 - RNA, 18 nt, Mycobacterium bovis subsp bovis AF2122/97
accccgucagcgggcagc

SEQ ID NO: 1214568 - RNA, 18 nt, Mycobacterium bovis subsp bovis AF2122/97
acccgacaacgcugggcg

SEQ ID NO: 1214569 - RNA, 17 nt, Mycobacterium bovis subsp bovis AF2122/97
acccgacaugguccgac

SEQ ID NO: 1214570 - RNA, 14 nt, Mycobacterium bovis subsp bovis AF2122/97
acccgcaaugaccg

SEQ ID NO: 1214571 - RNA, 12 nt, Mycobacterium bovis subsp bovis AF2122/97
acccgcaaugcg

SEQ ID NO: 1214572 - RNA, 13 nt, Mycobacterium bovis subsp bovis AF2122/97
acccgcaaugcgc

SEQ ID NO: 1214573 - RNA, 15 nt, Mycobacterium bovis subsp bovis AF2122/97
acccgcaccccggcc

SEQ ID NO: 1214574 - RNA, 15 nt, Mycobacterium bovis subsp bovis AF2122/97
acccgaucagguacg

SEQ ID NO: 1214575 - RNA, 19 nt, Mycobacterium bovis subsp bovis AF2122/97
acccgaucagguacgccag

SEQ ID NO: 1214576 - RNA, 16 nt, Mycobacterium bovis subsp bovis AF2122/97
acccgaugacccacug

SEQ ID NO: 1214577 - RNA, 17 nt, Mycobacterium bovis subsp bovis AF2122/97
acccgauuggccaaccc

SEQ ID NO: 1214578 - RNA, 22 nt, Mycobacterium bovis subsp bovis AF2122/97
acccccggcauuccguaggcca

SEQ ID NO: 1214579 - RNA, 16 nt, Mycobacterium bovis subsp bovis AF2122/97
accccaaguccagcag

SEQ ID NO: 1214580 - RNA, 17 nt, Mycobacterium bovis subsp bovis AF2122/97
accccaaguccagcagc

SEQ ID NO: 1214581 - RNA, 22 nt, Mycobacterium bovis subsp bovis AF2122/97
acccauuggaccgagacuugcu

SEQ ID NO: 1214582 - RNA, 14 nt, Mycobacterium bovis subsp bovis AF2122/97
accccggccuugcc

SEQ ID NO: 1214583 - RNA, 23 nt, Mycobacterium bovis subsp bovis AF2122/97
accccguaggcgccgaaccagcg

SEQ ID NO: 1214584 - RNA, 19 nt, Mycobacterium bovis subsp bovis AF2122/97
accccgaagaccuggccug

SEQ ID NO: 1214585 - RNA, 23 nt, Mycobacterium bovis subsp bovis AF2122/97
accccgaucuggcguagugcucg

SEQ ID NO: 1214586 - RNA, 12 nt, Mycobacterium bovis subsp bovis AF2122/97
accccgagcugc

SEQ ID NO: 1214587 - RNA, 17 nt, Mycobacterium bovis subsp bovis AF2122/97
accccgaauagucggca

SEQ ID NO: 1214588 - RNA, 14 nt, Mycobacterium bovis subsp bovis AF2122/97
accccgaccaccag

SEQ ID NO: 1214589 - RNA, 15 nt, Mycobacterium bovis subsp bovis AF2122/97
accccgaagaugccu

SEQ ID NO: 1214590 - RNA, 19 nt, Mycobacterium bovis subsp bovis AF2122/97
acccccuuuacacccccaa

SEQ ID NO: 1214591 - RNA, 13 nt, Mycobacterium bovis subsp bovis AF2122/97
acccagcaccaca

SEQ ID NO: 1214592 - RNA, 15 nt, Mycobacterium bovis subsp bovis AF2122/97
acccagaaugacauc

SEQ ID NO: 1214593 - RNA, 15 nt, Mycobacterium bovis subsp bovis AF2122/97
acccacgucgagcag

SEQ ID NO: 1214594 - RNA, 16 nt, Mycobacterium bovis subsp bovis AF2122/97
acccacgagagcgcug

SEQ ID NO: 1214595 - RNA, 16 nt, Mycobacterium bovis subsp bovis AF2122/97
accaugaccaccaagg

SEQ ID NO: 1214596 - RNA, 23 nt, Mycobacterium bovis subsp bovis AF2122/97
acccacgagagcgcugucccgaa

SEQ ID NO: 1214597 - RNA, 17 nt, Mycobacterium bovis subsp bovis AF2122/97
acccagcccagccguuc

SEQ ID NO: 1214598 - RNA, 16 nt, Mycobacterium bovis subsp bovis AF2122/97
acccagcgcagcagcg

SEQ ID NO: 1214599 - RNA, 19 nt, Mycobacterium bovis subsp bovis AF2122/97
acccagcgcagcagcggca

SEQ ID NO: 1214600 - RNA, 17 nt, Mycobacterium bovis subsp bovis AF2122/97
acccaggaucagcccgg

SEQ ID NO: 1214601 - RNA, 16 nt, Mycobacterium bovis subsp bovis AF2122/97
acccagcgugcccgcc

SEQ ID NO: 1214602 - RNA, 18 nt, Mycobacterium bovis subsp bovis AF2122/97
acccagcgugcccgccac

SEQ ID NO: 1214603 - RNA, 19 nt, Mycobacterium bovis subsp bovis AF2122/97
acccagcgugcccgccacc

SEQ ID NO: 1214604 - RNA, 23 nt, Mycobacterium bovis subsp bovis AF2122/97
acccagcgguaucccccagccgc

SEQ ID NO: 1214605 - RNA, 19 nt, Mycobacterium bovis subsp bovis AF2122/97
acccagcgguaucccccag

SEQ ID NO: 1214606 - RNA, 21 nt, Mycobacterium bovis subsp bovis AF2122/97
acccagcgguaucccccagcc

SEQ ID NO: 1214607 - RNA, 22 nt, Mycobacterium bovis subsp bovis AF2122/97
acccagcgguaucccccagccg

SEQ ID NO: 1214608 - RNA, 22 nt, Mycobacterium bovis subsp bovis AF2122/97
acccaguuccacccggugccgc

SEQ ID NO: 1214609 - RNA, 15 nt, Mycobacterium bovis subsp bovis AF2122/97
acccagugccacgcc

SEQ ID NO: 1214610 - RNA, 20 nt, Mycobacterium bovis subsp bovis AF2122/97
acccagggcguuggcggcuu

SEQ ID NO: 1214611 - RNA, 18 nt, Mycobacterium bovis subsp bovis AF2122/97
accgcguuaugccaggcg

SEQ ID NO: 1214612 - RNA, 13 nt, Mycobacterium bovis subsp bovis AF2122/97
accgcgugcgccg

SEQ ID NO: 1214613 - RNA, 18 nt, Mycobacterium bovis subsp bovis AF2122/97
accgcgugcgccggggac

SEQ ID NO: 1214614 - RNA, 16 nt, Mycobacterium bovis subsp bovis AF2122/97
accgcguugaugaccg

SEQ ID NO: 1214615 - RNA, 19 nt, Mycobacterium bovis subsp bovis AF2122/97
accgcguuguccgcggcca

SEQ ID NO: 1214616 - RNA, 18 nt, Mycobacterium bovis subsp bovis AF2122/97
accgcucagggugcgccg

SEQ ID NO: 1214617 - RNA, 15 nt, Mycobacterium bovis subsp bovis AF2122/97
accgauugucggcaa

SEQ ID NO: 1214618 - RNA, 14 nt, Mycobacterium bovis subsp bovis AF2122/97
accgcaaacccgcc

SEQ ID NO: 1214619 - RNA, 19 nt, Mycobacterium bovis subsp bovis AF2122/97
accgcaaacccgccgacaa

SEQ ID NO: 1214620 - RNA, 19 nt, Mycobacterium bovis subsp bovis AF2122/97
accgauucgggcuucucca

SEQ ID NO: 1214621 - RNA, 20 nt, Mycobacterium bovis subsp bovis AF2122/97
accgauucgggcuucuccau

SEQ ID NO: 1214622 - RNA, 17 nt, Mycobacterium bovis subsp bovis AF2122/97
accgcguagagcagcag

SEQ ID NO: 1214623 - RNA, 15 nt, Mycobacterium bovis subsp bovis AF2122/97
accgcaaaggagaag

SEQ ID NO: 1214624 - RNA, 22 nt, Mycobacterium bovis subsp bovis AF2122/97
accgcaaaggagaagacaugcc

SEQ ID NO: 1214625 - RNA, 22 nt, Mycobacterium bovis subsp bovis AF2122/97
accggaauccuggccgccgccc

SEQ ID NO: 1214626 - RNA, 17 nt, Mycobacterium bovis subsp bovis AF2122/97
accggaaaugucuccuc

SEQ ID NO: 1214627 - RNA, 16 nt, Mycobacterium bovis subsp bovis AF2122/97
accggcacccgcacgg

SEQ ID NO: 1214628 - RNA, 19 nt, Mycobacterium bovis subsp bovis AF2122/97
accggcacccgcuggcggu

SEQ ID NO: 1214629 - RNA, 18 nt, Mycobacterium bovis subsp bovis AF2122/97
accggacacuccugcaca

SEQ ID NO: 1214630 - RNA, 21 nt, Mycobacterium bovis subsp bovis AF2122/97
accggaccgaagaccuccucg

SEQ ID NO: 1214631 - RNA, 11 nt, Mycobacterium bovis subsp bovis AF2122/97
accggaccugg

SEQ ID NO: 1214632 - RNA, 22 nt, Mycobacterium bovis subsp bovis AF2122/97
accggacgaucagggugucgaa

SEQ ID NO: 1214633 - RNA, 16 nt, Mycobacterium bovis subsp bovis AF2122/97
accgcuugcccgcgca

SEQ ID NO: 1214634 - RNA, 13 nt, Mycobacterium bovis subsp bovis AF2122/97
accgcuucccccg

SEQ ID NO: 1214635 - RNA, 14 nt, Mycobacterium bovis subsp bovis AF2122/97
accgcuucccccgg

SEQ ID NO: 1214636 - RNA, 18 nt, Mycobacterium bovis subsp bovis AF2122/97
accgcugaccccggcagc

SEQ ID NO: 1214637 - RNA, 15 nt, Mycobacterium bovis subsp bovis AF2122/97
accgcucugcggcca

SEQ ID NO: 1214638 - RNA, 13 nt, Mycobacterium bovis subsp bovis AF2122/97
accggcagcugcu

SEQ ID NO: 1214639 - RNA, 14 nt, Mycobacterium bovis subsp bovis AF2122/97
accggcaucgauca

SEQ ID NO: 1214640 - RNA, 16 nt, Mycobacterium bovis subsp bovis AF2122/97
accggccaccagcccg

SEQ ID NO: 1214641 - RNA, 17 nt, Mycobacterium bovis subsp bovis AF2122/97
accggccaccagggcca

SEQ ID NO: 1214642 - RNA, 18 nt, Mycobacterium bovis subsp bovis AF2122/97
accggccaccagggccac

SEQ ID NO: 1214643 - RNA, 16 nt, Mycobacterium bovis subsp bovis AF2122/97
accggcuucuccucca

SEQ ID NO: 1214644 - RNA, 21 nt, Mycobacterium bovis subsp bovis AF2122/97
accggcuucgucggccagcag

SEQ ID NO: 1214645 - RNA, 20 nt, Mycobacterium bovis subsp bovis AF2122/97
accggcuugcccuccgggua

SEQ ID NO: 1214646 - RNA, 14 nt, Mycobacterium bovis subsp bovis AF2122/97
accgggacaaucuc

SEQ ID NO: 1214647 - RNA, 17 nt, Mycobacterium bovis subsp bovis AF2122/97
accggcuuugcuugccg

SEQ ID NO: 1214648 - RNA, 18 nt, Mycobacterium bovis subsp bovis AF2122/97
accgggcaaaucaagcac

SEQ ID NO: 1214649 - RNA, 15 nt, Mycobacterium bovis subsp bovis AF2122/97
accgggcaaaucaag

SEQ ID NO: 1214650 - RNA, 14 nt, Mycobacterium bovis subsp bovis AF2122/97
accgguauguucgg

SEQ ID NO: 1214651 - RNA, 17 nt, Mycobacterium bovis subsp bovis AF2122/97
accggucaaacgcgcgc

SEQ ID NO: 1214652 - RNA, 13 nt, Mycobacterium bovis subsp bovis AF2122/97
accgguaccggcg

SEQ ID NO: 1214653 - RNA, 20 nt, Mycobacterium bovis subsp bovis AF2122/97
accgggcccggcgaacaggc

SEQ ID NO: 1214654 - RNA, 14 nt, Mycobacterium bovis subsp bovis AF2122/97
accgguacaacccc

SEQ ID NO: 1214655 - RNA, 20 nt, Mycobacterium bovis subsp bovis AF2122/97
accgguaacgccaacaccgg

SEQ ID NO: 1214656 - RNA, 16 nt, Mycobacterium bovis subsp bovis AF2122/97
accgguuuucgccggc

SEQ ID NO: 1214657 - RNA, 19 nt, Mycobacterium bovis subsp bovis AF2122/97
accgguuuucgccggcucc

SEQ ID NO: 1214658 - RNA, 21 nt, Mycobacterium bovis subsp bovis AF2122/97
accguagagcaugccgcccgc

SEQ ID NO: 1214659 - RNA, 15 nt, Mycobacterium bovis subsp bovis AF2122/97
accguaauuucuuca

SEQ ID NO: 1214660 - RNA, 15 nt, Mycobacterium bovis subsp bovis AF2122/97
accguagccagcagg

SEQ ID NO: 1214661 - RNA, 16 nt, Mycobacterium bovis subsp bovis AF2122/97
accguagugaacggcu

SEQ ID NO: 1214662 - RNA, 13 nt, Mycobacterium bovis subsp bovis AF2122/97
accgucaccgccg

SEQ ID NO: 1214663 - RNA, 15 nt, Mycobacterium bovis subsp bovis AF2122/97
accgucacgccaccg

SEQ ID NO: 1214664 - RNA, 22 nt, Mycobacterium bovis subsp bovis AF2122/97
accguguugcugaacugguugg

SEQ ID NO: 1214665 - RNA, 14 nt, Mycobacterium bovis subsp bovis AF2122/97
accguguugcugcc

SEQ ID NO: 1214666 - RNA, 20 nt, Mycobacterium bovis subsp bovis AF2122/97
accgugucacgcgaccaccg

SEQ ID NO: 1214667 - RNA, 20 nt, Mycobacterium bovis subsp bovis AF2122/97
accgugggccugcccggcgc

SEQ ID NO: 1214668 - RNA, 21 nt, Mycobacterium bovis subsp bovis AF2122/97
accgugggguaucgccagcca

SEQ ID NO: 1214669 - RNA, 14 nt, Mycobacterium bovis subsp bovis AF2122/97
accguggucggagg

SEQ ID NO: 1214670 - RNA, 18 nt, Mycobacterium bovis subsp bovis AF2122/97
accgugcccugggugaug

SEQ ID NO: 1214671 - RNA, 13 nt, Mycobacterium bovis subsp bovis AF2122/97
accgugccgggcg

SEQ ID NO: 1214672 - RNA, 17 nt, Mycobacterium bovis subsp bovis AF2122/97
accguggcggccuccuc

SEQ ID NO: 1214673 - RNA, 23 nt, Mycobacterium bovis subsp bovis AF2122/97
accguggcggggaaaccggccag

SEQ ID NO: 1214674 - RNA, 18 nt, Mycobacterium bovis subsp bovis AF2122/97
accguggcagcugcucuc

SEQ ID NO: 1214675 - RNA, 15 nt, Mycobacterium bovis subsp bovis AF2122/97
accguugaccucuuc

SEQ ID NO: 1214676 - RNA, 14 nt, Mycobacterium bovis subsp bovis AF2122/97
accguugccgccgu

SEQ ID NO: 1214677 - RNA, 20 nt, Mycobacterium bovis subsp bovis AF2122/97
accguugcgaagaagaaggc

SEQ ID NO: 1214678 - RNA, 21 nt, Mycobacterium bovis subsp bovis AF2122/97
accguugcgaagaagaaggcg

SEQ ID NO: 1214679 - RNA, 19 nt, Mycobacterium bovis subsp bovis AF2122/97
accguuguaccccagcauc

SEQ ID NO: 1214680 - RNA, 18 nt, Mycobacterium bovis subsp bovis AF2122/97
accgucgccggugacgac

SEQ ID NO: 1214681 - RNA, 16 nt, Mycobacterium bovis subsp bovis AF2122/97
accgucggcagcagcg

SEQ ID NO: 1214682 - RNA, 13 nt, Mycobacterium bovis subsp bovis AF2122/97
accgugccgcccg

SEQ ID NO: 1214683 - RNA, 22 nt, Mycobacterium bovis subsp bovis AF2122/97
accgugacguagggcagcgcca

SEQ ID NO: 1214684 - RNA, 17 nt, Mycobacterium bovis subsp bovis AF2122/97
accgucgggcccagccg

SEQ ID NO: 1214685 - RNA, 14 nt, Mycobacterium bovis subsp bovis AF2122/97
accgucguccagac

SEQ ID NO: 1214686 - RNA, 22 nt, Mycobacterium bovis subsp bovis AF2122/97
accgucccaaugcaacaaggca

SEQ ID NO: 1214687 - RNA, 17 nt, Mycobacterium bovis subsp bovis AF2122/97
accgucccagcgccgca

SEQ ID NO: 1214688 - RNA, 13 nt, Mycobacterium bovis subsp bovis AF2122/97
accguccagcaac

SEQ ID NO: 1214689 - RNA, 22 nt, Mycobacterium bovis subsp bovis AF2122/97
accguccacgacagcagagugg

SEQ ID NO: 1214690 - RNA, 15 nt, Mycobacterium bovis subsp bovis AF2122/97
accguccaauuggcg

SEQ ID NO: 1214691 - RNA, 16 nt, Mycobacterium bovis subsp bovis AF2122/97
accgucaugggcggcu

SEQ ID NO: 1214692 - RNA, 19 nt, Mycobacterium bovis subsp bovis AF2122/97
accgucaguagccacgccc

SEQ ID NO: 1214693 - RNA, 23 nt, Mycobacterium bovis subsp bovis AF2122/97
accgucaguucggugugcggcgc

SEQ ID NO: 1214694 - RNA, 19 nt, Mycobacterium bovis subsp bovis AF2122/97
accgucagcgccgcugacu

SEQ ID NO: 1214695 - RNA, 24 nt, Mycobacterium bovis subsp bovis AF2122/97
accgucagcgcgaccgucaggguc

SEQ ID NO: 1214696 - RNA, 15 nt, Mycobacterium bovis subsp bovis AF2122/97
accgucagcgcgccg

SEQ ID NO: 1214697 - RNA, 18 nt, Mycobacterium bovis subsp bovis AF2122/97
accguuugcgcaccgguc

SEQ ID NO: 1214698 - RNA, 19 nt, Mycobacterium bovis subsp bovis AF2122/97
accguuucgaucucgagca

SEQ ID NO: 1214699 - RNA, 16 nt, Mycobacterium bovis subsp bovis AF2122/97
accguuucgaucucga

SEQ ID NO: 1214700 - RNA, 20 nt, Mycobacterium bovis subsp bovis AF2122/97
accguuucgaucucgagcag

SEQ ID NO: 1214701 - RNA, 23 nt, Mycobacterium bovis subsp bovis AF2122/97
accucaacaccaggccguccucg

SEQ ID NO: 1214702 - RNA, 18 nt, Mycobacterium bovis subsp bovis AF2122/97
accucauguccgccgugu

SEQ ID NO: 1214703 - RNA, 23 nt, Mycobacterium bovis subsp bovis AF2122/97
accuaccgagaucaccgccacca

SEQ ID NO: 1214704 - RNA, 21 nt, Mycobacterium bovis subsp bovis AF2122/97
accuggccgcccgcugcggcg

SEQ ID NO: 1214705 - RNA, 17 nt, Mycobacterium bovis subsp bovis AF2122/97
accugcuggaagccguc

SEQ ID NO: 1214706 - RNA, 16 nt, Mycobacterium bovis subsp bovis AF2122/97
accugcugcaccguca

SEQ ID NO: 1214707 - RNA, 17 nt, Mycobacterium bovis subsp bovis AF2122/97
accugcucggcgcgccg

SEQ ID NO: 1214708 - RNA, 18 nt, Mycobacterium bovis subsp bovis AF2122/97
accugcgucggcccgcgg

SEQ ID NO: 1214709 - RNA, 19 nt, Mycobacterium bovis subsp bovis AF2122/97
accugcuccgcugucaccc

SEQ ID NO: 1214710 - RNA, 16 nt, Mycobacterium bovis subsp bovis AF2122/97
accugccgggccacgg

SEQ ID NO: 1214711 - RNA, 16 nt, Mycobacterium bovis subsp bovis AF2122/97
accugccggaccgcgg

SEQ ID NO: 1214712 - RNA, 20 nt, Mycobacterium bovis subsp bovis AF2122/97
accugcgccaccugaaagcu

SEQ ID NO: 1214713 - RNA, 18 nt, Mycobacterium bovis subsp bovis AF2122/97
accugcgaccaggcgcgg

SEQ ID NO: 1214714 - RNA, 15 nt, Mycobacterium bovis subsp bovis AF2122/97
accugcaugcccaga

SEQ ID NO: 1214715 - RNA, 16 nt, Mycobacterium bovis subsp bovis AF2122/97
accuccagcaccaccg

SEQ ID NO: 1214716 - RNA, 15 nt, Mycobacterium bovis subsp bovis AF2122/97
accuccagugcggcc

SEQ ID NO: 1214717 - RNA, 21 nt, Mycobacterium bovis subsp bovis AF2122/97
accugguugcugacgacuggg

SEQ ID NO: 1214718 - RNA, 16 nt, Mycobacterium bovis subsp bovis AF2122/97
accuucucgaugcuga

SEQ ID NO: 1214719 - RNA, 18 nt, Mycobacterium bovis subsp bovis AF2122/97
accuuguggacccgccag

SEQ ID NO: 1214720 - RNA, 14 nt, Mycobacterium bovis subsp bovis AF2122/97
accuuggccgugcc

SEQ ID NO: 1214721 - RNA, 14 nt, Mycobacterium bovis subsp bovis AF2122/97
accuuggucgccaa

SEQ ID NO: 1214722 - RNA, 18 nt, Mycobacterium bovis subsp bovis AF2122/97
accuugguguggggcggc

SEQ ID NO: 1214723 - RNA, 13 nt, Mycobacterium bovis subsp bovis AF2122/97
acgacucccccgg

SEQ ID NO: 1214724 - RNA, 22 nt, Mycobacterium bovis subsp bovis AF2122/97
acgagauucggagucaccagca

SEQ ID NO: 1214725 - RNA, 22 nt, Mycobacterium bovis subsp bovis AF2122/97
acgagccgguggcgugggcacu

SEQ ID NO: 1214726 - RNA, 14 nt, Mycobacterium bovis subsp bovis AF2122/97
acgagccaccaccg

SEQ ID NO: 1214727 - RNA, 23 nt, Mycobacterium bovis subsp bovis AF2122/97
acgagcgucagauccggccguug

SEQ ID NO: 1214728 - RNA, 17 nt, Mycobacterium bovis subsp bovis AF2122/97
acgagcggccgcgcgca

SEQ ID NO: 1214729 - RNA, 19 nt, Mycobacterium bovis subsp bovis AF2122/97
acgaguugcgaaccaugac

SEQ ID NO: 1214730 - RNA, 16 nt, Mycobacterium bovis subsp bovis AF2122/97
acgacgggaaccagcg

SEQ ID NO: 1214731 - RNA, 18 nt, Mycobacterium bovis subsp bovis AF2122/97
acgacgacaaccggccag

SEQ ID NO: 1214732 - RNA, 17 nt, Mycobacterium bovis subsp bovis AF2122/97
acgacgacaagugcccg

SEQ ID NO: 1214733 - RNA, 16 nt, Mycobacterium bovis subsp bovis AF2122/97
acgacggguccgggcc

SEQ ID NO: 1214734 - RNA, 18 nt, Mycobacterium bovis subsp bovis AF2122/97
acgaccgucggcuccagg

SEQ ID NO: 1214735 - RNA, 19 nt, Mycobacterium bovis subsp bovis AF2122/97
acgaccugcucauccaccu

SEQ ID NO: 1214736 - RNA, 23 nt, Mycobacterium bovis subsp bovis AF2122/97
acgacccgggaaggaaccgggca

SEQ ID NO: 1214737 - RNA, 22 nt, Mycobacterium bovis subsp bovis AF2122/97
acgacccgggaaggaaccgggc

SEQ ID NO: 1214738 - RNA, 14 nt, Mycobacterium bovis subsp bovis AF2122/97
acgacccgggaagg

SEQ ID NO: 1214739 - RNA, 13 nt, Mycobacterium bovis subsp bovis AF2122/97
acgacccuccgca

SEQ ID NO: 1214740 - RNA, 14 nt, Mycobacterium bovis subsp bovis AF2122/97
acgacccagcaugg

SEQ ID NO: 1214741 - RNA, 20 nt, Mycobacterium bovis subsp bovis AF2122/97
acgaccagcugagcuggcag

SEQ ID NO: 1214742 - RNA, 19 nt, Mycobacterium bovis subsp bovis AF2122/97
acgacauuggugcugacau

SEQ ID NO: 1214743 - RNA, 14 nt, Mycobacterium bovis subsp bovis AF2122/97
acgaccacaccacg

SEQ ID NO: 1214744 - RNA, 22 nt, Mycobacterium bovis subsp bovis AF2122/97
acgacauacgagcagugaccgc

SEQ ID NO: 1214745 - RNA, 20 nt, Mycobacterium bovis subsp bovis AF2122/97
acgacaugaccgacaggugc

SEQ ID NO: 1214746 - RNA, 14 nt, Mycobacterium bovis subsp bovis AF2122/97
acgacaccagagcg

SEQ ID NO: 1214747 - RNA, 22 nt, Mycobacterium bovis subsp bovis AF2122/97
acgacaaaccgggcgugccauc

SEQ ID NO: 1214748 - RNA, 14 nt, Mycobacterium bovis subsp bovis AF2122/97
acgacaacagccag

SEQ ID NO: 1214749 - RNA, 20 nt, Mycobacterium bovis subsp bovis AF2122/97
acgacaagguguggugacag

SEQ ID NO: 1214750 - RNA, 16 nt, Mycobacterium bovis subsp bovis AF2122/97
acgacaagugcccggc

SEQ ID NO: 1214751 - RNA, 19 nt, Mycobacterium bovis subsp bovis AF2122/97
acgccgaccgcgccgcauc

SEQ ID NO: 1214752 - RNA, 22 nt, Mycobacterium bovis subsp bovis AF2122/97
acgcccucgguagcauccagcg

SEQ ID NO: 1214753 - RNA, 19 nt, Mycobacterium bovis subsp bovis AF2122/97
acgccgagaugcugcaccc

SEQ ID NO: 1214754 - RNA, 22 nt, Mycobacterium bovis subsp bovis AF2122/97
acgccgaauacggcugccucca

SEQ ID NO: 1214755 - RNA, 14 nt, Mycobacterium bovis subsp bovis AF2122/97
acgccgccagcacc

SEQ ID NO: 1214756 - RNA, 11 nt, Mycobacterium bovis subsp bovis AF2122/97
acgcccggcac

SEQ ID NO: 1214757 - RNA, 14 nt, Mycobacterium bovis subsp bovis AF2122/97
acgcccggcacccc

SEQ ID NO: 1214758 - RNA, 14 nt, Mycobacterium bovis subsp bovis AF2122/97
acgcccgcaucgcc

SEQ ID NO: 1214759 - RNA, 22 nt, Mycobacterium bovis subsp bovis AF2122/97
acgcccgaguuaaacgcagcgg

SEQ ID NO: 1214760 - RNA, 21 nt, Mycobacterium bovis subsp bovis AF2122/97
acgcccgugcggcucgccggc

SEQ ID NO: 1214761 - RNA, 15 nt, Mycobacterium bovis subsp bovis AF2122/97
acgccgaaaaugccg

SEQ ID NO: 1214762 - RNA, 16 nt, Mycobacterium bovis subsp bovis AF2122/97
acgccgaaaaugccgc

SEQ ID NO: 1214763 - RNA, 22 nt, Mycobacterium bovis subsp bovis AF2122/97
acgcccuggaaugccgccacaa

SEQ ID NO: 1214764 - RNA, 17 nt, Mycobacterium bovis subsp bovis AF2122/97
acgcccacuccagcagc

SEQ ID NO: 1214765 - RNA, 21 nt, Mycobacterium bovis subsp bovis AF2122/97
acgcccaauguccaggcgcgc

SEQ ID NO: 1214766 - RNA, 15 nt, Mycobacterium bovis subsp bovis AF2122/97
acgcccacaaugacu

SEQ ID NO: 1214767 - RNA, 17 nt, Mycobacterium bovis subsp bovis AF2122/97
acgcccacaugcucagg

SEQ ID NO: 1214768 - RNA, 22 nt, Mycobacterium bovis subsp bovis AF2122/97
acgcccagcgcccgcgcggcca

SEQ ID NO: 1214769 - RNA, 16 nt, Mycobacterium bovis subsp bovis AF2122/97
acgccccgaucggcca

SEQ ID NO: 1214770 - RNA, 14 nt, Mycobacterium bovis subsp bovis AF2122/97
acgccccacugccg

SEQ ID NO: 1214771 - RNA, 18 nt, Mycobacterium bovis subsp bovis AF2122/97
acgccccggcgcggccag

SEQ ID NO: 1214772 - RNA, 14 nt, Mycobacterium bovis subsp bovis AF2122/97
acgccccgccacaa

SEQ ID NO: 1214773 - RNA, 15 nt, Mycobacterium bovis subsp bovis AF2122/97
acgaucaacccgguc

SEQ ID NO: 1214774 - RNA, 13 nt, Mycobacterium bovis subsp bovis AF2122/97
acgaucagcagcg

SEQ ID NO: 1214775 - RNA, 23 nt, Mycobacterium bovis subsp bovis AF2122/97
acgccauucaucggcaucgacug

SEQ ID NO: 1214776 - RNA, 14 nt, Mycobacterium bovis subsp bovis AF2122/97
acgccaugcccgca

SEQ ID NO: 1214777 - RNA, 14 nt, Mycobacterium bovis subsp bovis AF2122/97
acgccaugccggga

SEQ ID NO: 1214778 - RNA, 16 nt, Mycobacterium bovis subsp bovis AF2122/97
acgccgucggcgcgca

SEQ ID NO: 1214779 - RNA, 14 nt, Mycobacterium bovis subsp bovis AF2122/97
acgccgucgagcau

SEQ ID NO: 1214780 - RNA, 23 nt, Mycobacterium bovis subsp bovis AF2122/97
acgccguagcaucgggcgagcuc

SEQ ID NO: 1214781 - RNA, 19 nt, Mycobacterium bovis subsp bovis AF2122/97
acgccguagcgcagcgccu

SEQ ID NO: 1214782 - RNA, 18 nt, Mycobacterium bovis subsp bovis AF2122/97
acgccggggaaccuugac

SEQ ID NO: 1214783 - RNA, 14 nt, Mycobacterium bovis subsp bovis AF2122/97
acgccggcgccgcc

SEQ ID NO: 1214784 - RNA, 19 nt, Mycobacterium bovis subsp bovis AF2122/97
acgccggugccggccagac

SEQ ID NO: 1214785 - RNA, 19 nt, Mycobacterium bovis subsp bovis AF2122/97
acgccgggaauuucgacac

SEQ ID NO: 1214786 - RNA, 18 nt, Mycobacterium bovis subsp bovis AF2122/97
acgccggcggguggcccc

SEQ ID NO: 1214787 - RNA, 14 nt, Mycobacterium bovis subsp bovis AF2122/97
acgccgccagcaga

SEQ ID NO: 1214788 - RNA, 17 nt, Mycobacterium bovis subsp bovis AF2122/97
acgccgccggccccgcc

SEQ ID NO: 1214789 - RNA, 13 nt, Mycobacterium bovis subsp bovis AF2122/97
acgccggcaccga

SEQ ID NO: 1214790 - RNA, 11 nt, Mycobacterium bovis subsp bovis AF2122/97
acgccggcauc

SEQ ID NO: 1214791 - RNA, 15 nt, Mycobacterium bovis subsp bovis AF2122/97
acgccgcgcagccgg

SEQ ID NO: 1214792 - RNA, 20 nt, Mycobacterium bovis subsp bovis AF2122/97
acgccgcgguuuucgccgga

SEQ ID NO: 1214793 - RNA, 16 nt, Mycobacterium bovis subsp bovis AF2122/97
acgcgaauaccagacc

SEQ ID NO: 1214794 - RNA, 14 nt, Mycobacterium bovis subsp bovis AF2122/97
acgcgaacccauac

SEQ ID NO: 1214795 - RNA, 14 nt, Mycobacterium bovis subsp bovis AF2122/97
acgccuugcacaag

SEQ ID NO: 1214796 - RNA, 22 nt, Mycobacterium bovis subsp bovis AF2122/97
acgccuuguuggcgcccgggcc

SEQ ID NO: 1214797 - RNA, 15 nt, Mycobacterium bovis subsp bovis AF2122/97
acgccucugcucagc

SEQ ID NO: 1214798 - RNA, 15 nt, Mycobacterium bovis subsp bovis AF2122/97
acgccugagccacca

SEQ ID NO: 1214799 - RNA, 20 nt, Mycobacterium bovis subsp bovis AF2122/97
acgccugagccaccaacacc

SEQ ID NO: 1214800 - RNA, 19 nt, Mycobacterium bovis subsp bovis AF2122/97
acgccucgccggccaccag

SEQ ID NO: 1214801 - RNA, 14 nt, Mycobacterium bovis subsp bovis AF2122/97
acgcucggcgggga

SEQ ID NO: 1214802 - RNA, 23 nt, Mycobacterium bovis subsp bovis AF2122/97
acgcucggcguccgcccagcacc

SEQ ID NO: 1214803 - RNA, 19 nt, Mycobacterium bovis subsp bovis AF2122/97
acgcugcccacgggccggc

SEQ ID NO: 1214804 - RNA, 13 nt, Mycobacterium bovis subsp bovis AF2122/97
acgcucgcgcacc

SEQ ID NO: 1214805 - RNA, 16 nt, Mycobacterium bovis subsp bovis AF2122/97
acgcuccccagcgaau

SEQ ID NO: 1214806 - RNA, 15 nt, Mycobacterium bovis subsp bovis AF2122/97
acgcuggucggcggc

SEQ ID NO: 1214807 - RNA, 17 nt, Mycobacterium bovis subsp bovis AF2122/97
acgcuguaagcaugccg

SEQ ID NO: 1214808 - RNA, 21 nt, Mycobacterium bovis subsp bovis AF2122/97
acgcugggcgguagcuuccgc

SEQ ID NO: 1214809 - RNA, 13 nt, Mycobacterium bovis subsp bovis AF2122/97
acgcuggcgggca

SEQ ID NO: 1214810 - RNA, 17 nt, Mycobacterium bovis subsp bovis AF2122/97
acgcuccagcucggcca

SEQ ID NO: 1214811 - RNA, 18 nt, Mycobacterium bovis subsp bovis AF2122/97
acgcguggcauccagcag

SEQ ID NO: 1214812 - RNA, 18 nt, Mycobacterium bovis subsp bovis AF2122/97
acgcguuccuccagcagc

SEQ ID NO: 1214813 - RNA, 19 nt, Mycobacterium bovis subsp bovis AF2122/97
acgcggucugcuccaggcg

SEQ ID NO: 1214814 - RNA, 22 nt, Mycobacterium bovis subsp bovis AF2122/97
acgcggucgacgacgcccucac

SEQ ID NO: 1214815 - RNA, 13 nt, Mycobacterium bovis subsp bovis AF2122/97
acgcggucugcuc

SEQ ID NO: 1214816 - RNA, 22 nt, Mycobacterium bovis subsp bovis AF2122/97
acgcggucugcuccaggcgcgc

SEQ ID NO: 1214817 - RNA, 19 nt, Mycobacterium bovis subsp bovis AF2122/97
acgcgucggucgcggacag

SEQ ID NO: 1214818 - RNA, 21 nt, Mycobacterium bovis subsp bovis AF2122/97
acgcgucggucgcggacaggu

SEQ ID NO: 1214819 - RNA, 18 nt, Mycobacterium bovis subsp bovis AF2122/97
acgcgucguggucggcga

SEQ ID NO: 1214820 - RNA, 18 nt, Mycobacterium bovis subsp bovis AF2122/97
acgcggaucgggcacccc

SEQ ID NO: 1214821 - RNA, 18 nt, Mycobacterium bovis subsp bovis AF2122/97
acgcgggcguuggccagc

SEQ ID NO: 1214822 - RNA, 23 nt, Mycobacterium bovis subsp bovis AF2122/97
acgcgggcguuggccagcagguu

SEQ ID NO: 1214823 - RNA, 18 nt, Mycobacterium bovis subsp bovis AF2122/97
acgcggggucaaagcccg

SEQ ID NO: 1214824 - RNA, 20 nt, Mycobacterium bovis subsp bovis AF2122/97
acgcggccgaggucacccgg

SEQ ID NO: 1214825 - RNA, 18 nt, Mycobacterium bovis subsp bovis AF2122/97
acgcggaaaggcuuccgc

SEQ ID NO: 1214826 - RNA, 21 nt, Mycobacterium bovis subsp bovis AF2122/97
acgcggaaaccaucgccagcc

SEQ ID NO: 1214827 - RNA, 22 nt, Mycobacterium bovis subsp bovis AF2122/97
acgcgccgucucgaagcucagc

SEQ ID NO: 1214828 - RNA, 18 nt, Mycobacterium bovis subsp bovis AF2122/97
acgcgcacucgaccagga

SEQ ID NO: 1214829 - RNA, 23 nt, Mycobacterium bovis subsp bovis AF2122/97
acgcgcaucgcacgggccaccag

SEQ ID NO: 1214830 - RNA, 18 nt, Mycobacterium bovis subsp bovis AF2122/97
acgcgcauucgccgggcg

SEQ ID NO: 1214831 - RNA, 17 nt, Mycobacterium bovis subsp bovis AF2122/97
acgcgcaccuggcgcgc

SEQ ID NO: 1214832 - RNA, 15 nt, Mycobacterium bovis subsp bovis AF2122/97
acgcgcaaccagccu

SEQ ID NO: 1214833 - RNA, 21 nt, Mycobacterium bovis subsp bovis AF2122/97
acgcgcaacgccgccagccug

SEQ ID NO: 1214834 - RNA, 20 nt, Mycobacterium bovis subsp bovis AF2122/97
acgcgcaacucgccacgguc

SEQ ID NO: 1214835 - RNA, 14 nt, Mycobacterium bovis subsp bovis AF2122/97
acgcgaucaggcgc

SEQ ID NO: 1214836 - RNA, 13 nt, Mycobacterium bovis subsp bovis AF2122/97
acgcgaggcgcuc

SEQ ID NO: 1214837 - RNA, 21 nt, Mycobacterium bovis subsp bovis AF2122/97
acgcgagcgcuaucaccgccu

SEQ ID NO: 1214838 - RNA, 18 nt, Mycobacterium bovis subsp bovis AF2122/97
acgucgucagccaccgca

SEQ ID NO: 1214839 - RNA, 15 nt, Mycobacterium bovis subsp bovis AF2122/97
acgucgguccaccca

SEQ ID NO: 1214840 - RNA, 17 nt, Mycobacterium bovis subsp bovis AF2122/97
acgucggugaccucggc

SEQ ID NO: 1214841 - RNA, 17 nt, Mycobacterium bovis subsp bovis AF2122/97
acgucguagaccuccag

SEQ ID NO: 1214842 - RNA, 18 nt, Mycobacterium bovis subsp bovis AF2122/97
acgucgggaucgccaugu

SEQ ID NO: 1214843 - RNA, 17 nt, Mycobacterium bovis subsp bovis AF2122/97
acgugaguuucaccacu

SEQ ID NO: 1214844 - RNA, 16 nt, Mycobacterium bovis subsp bovis AF2122/97
acgucgcauugugcaa

SEQ ID NO: 1214845 - RNA, 13 nt, Mycobacterium bovis subsp bovis AF2122/97
acgucgccagguc

SEQ ID NO: 1214846 - RNA, 15 nt, Mycobacterium bovis subsp bovis AF2122/97
acgucgcccccggcc

SEQ ID NO: 1214847 - RNA, 20 nt, Mycobacterium bovis subsp bovis AF2122/97
acgucgcuguaggccagccc

SEQ ID NO: 1214848 - RNA, 19 nt, Mycobacterium bovis subsp bovis AF2122/97
acgucgcguucuccggcac

SEQ ID NO: 1214849 - RNA, 24 nt, Mycobacterium bovis subsp bovis AF2122/97
acgucgcguucuccggcaccgguc

SEQ ID NO: 1214850 - RNA, 14 nt, Mycobacterium bovis subsp bovis AF2122/97
acgucgagguugau

SEQ ID NO: 1214851 - RNA, 15 nt, Mycobacterium bovis subsp bovis AF2122/97
acgucgacuucgccc

SEQ ID NO: 1214852 - RNA, 16 nt, Mycobacterium bovis subsp bovis AF2122/97
acgucgagcagcgcca

SEQ ID NO: 1214853 - RNA, 20 nt, Mycobacterium bovis subsp bovis AF2122/97
acgucgacaccgaggaccuc

SEQ ID NO: 1214854 - RNA, 21 nt, Mycobacterium bovis subsp bovis AF2122/97
acguccugcccgucgucggca

SEQ ID NO: 1214855 - RNA, 22 nt, Mycobacterium bovis subsp bovis AF2122/97
acguccugcccgucgucggcaa

SEQ ID NO: 1214856 - RNA, 18 nt, Mycobacterium bovis subsp bovis AF2122/97
acgugcacgaaaaccggu

SEQ ID NO: 1214857 - RNA, 16 nt, Mycobacterium bovis subsp bovis AF2122/97
acgugcaccagguugc

SEQ ID NO: 1214858 - RNA, 19 nt, Mycobacterium bovis subsp bovis AF2122/97
acguggacugaccucguca

SEQ ID NO: 1214859 - RNA, 19 nt, Mycobacterium bovis subsp bovis AF2122/97
acgugcaaccauggcggcu

SEQ ID NO: 1214860 - RNA, 21 nt, Mycobacterium bovis subsp bovis AF2122/97
acgugaucgcgguccaacagc

SEQ ID NO: 1214861 - RNA, 15 nt, Mycobacterium bovis subsp bovis AF2122/97
acguggcccuccucg

SEQ ID NO: 1214862 - RNA, 18 nt, Mycobacterium bovis subsp bovis AF2122/97
acguggcgaccggcgacc

SEQ ID NO: 1214863 - RNA, 19 nt, Mycobacterium bovis subsp bovis AF2122/97
acguggguacgcaucucga

SEQ ID NO: 1214864 - RNA, 14 nt, Mycobacterium bovis subsp bovis AF2122/97
acguggucggccac

SEQ ID NO: 1214865 - RNA, 15 nt, Mycobacterium bovis subsp bovis AF2122/97
acguggucggccacc

SEQ ID NO: 1214866 - RNA, 21 nt, Mycobacterium bovis subsp bovis AF2122/97
acgugguccaaccgggccggc

SEQ ID NO: 1214867 - RNA, 18 nt, Mycobacterium bovis subsp bovis AF2122/97
acgugguggaccucacug

SEQ ID NO: 1214868 - RNA, 18 nt, Mycobacterium bovis subsp bovis AF2122/97
acgugugcaccaucauca

SEQ ID NO: 1214869 - RNA, 14 nt, Mycobacterium bovis subsp bovis AF2122/97
acgugucggcugcu

SEQ ID NO: 1214870 - RNA, 14 nt, Mycobacterium bovis subsp bovis AF2122/97
acgugucccgcaug

SEQ ID NO: 1214871 - RNA, 15 nt, Mycobacterium bovis subsp bovis AF2122/97
acguccagggccacg

SEQ ID NO: 1214872 - RNA, 20 nt, Mycobacterium bovis subsp bovis AF2122/97
acguccaucaccggcggccc

SEQ ID NO: 1214873 - RNA, 22 nt, Mycobacterium bovis subsp bovis AF2122/97
acguccaucaccggcggcccca

SEQ ID NO: 1214874 - RNA, 18 nt, Mycobacterium bovis subsp bovis AF2122/97
acgucccgguaauccacu

SEQ ID NO: 1214875 - RNA, 22 nt, Mycobacterium bovis subsp bovis AF2122/97
acguccgcgggggaccgcccga

SEQ ID NO: 1214876 - RNA, 14 nt, Mycobacterium bovis subsp bovis AF2122/97
acgucagugccccg

SEQ ID NO: 1214877 - RNA, 15 nt, Mycobacterium bovis subsp bovis AF2122/97
acgucagcaccaucc

SEQ ID NO: 1214878 - RNA, 18 nt, Mycobacterium bovis subsp bovis AF2122/97
acgucaucuggcgcugcu

SEQ ID NO: 1214879 - RNA, 20 nt, Mycobacterium bovis subsp bovis AF2122/97
acgucaucuggcgcugcugg

SEQ ID NO: 1214880 - RNA, 22 nt, Mycobacterium bovis subsp bovis AF2122/97
acgguggugggcuaggucgcgc

SEQ ID NO: 1214881 - RNA, 16 nt, Mycobacterium bovis subsp bovis AF2122/97
acgguguagccgccgg

SEQ ID NO: 1214882 - RNA, 15 nt, Mycobacterium bovis subsp bovis AF2122/97
acgguguggaaaccg

SEQ ID NO: 1214883 - RNA, 20 nt, Mycobacterium bovis subsp bovis AF2122/97
acgguugccgucagggucag

SEQ ID NO: 1214884 - RNA, 17 nt, Mycobacterium bovis subsp bovis AF2122/97
acgguugccccggcgac

SEQ ID NO: 1214885 - RNA, 21 nt, Mycobacterium bovis subsp bovis AF2122/97
acgguugaugaucuuggugaa

SEQ ID NO: 1214886 - RNA, 15 nt, Mycobacterium bovis subsp bovis AF2122/97
acgguucggccgggg

SEQ ID NO: 1214887 - RNA, 16 nt, Mycobacterium bovis subsp bovis AF2122/97
acgucaagaagaacuc

SEQ ID NO: 1214888 - RNA, 19 nt, Mycobacterium bovis subsp bovis AF2122/97
acgucacccccuucacccu

SEQ ID NO: 1214889 - RNA, 12 nt, Mycobacterium bovis subsp bovis AF2122/97
acggccagccca

SEQ ID NO: 1214890 - RNA, 19 nt, Mycobacterium bovis subsp bovis AF2122/97
acggccagugcgcagaaca

SEQ ID NO: 1214891 - RNA, 16 nt, Mycobacterium bovis subsp bovis AF2122/97
acggccagcaggauga

SEQ ID NO: 1214892 - RNA, 15 nt, Mycobacterium bovis subsp bovis AF2122/97
acggccacgguggag

SEQ ID NO: 1214893 - RNA, 23 nt, Mycobacterium bovis subsp bovis AF2122/97
acggccgacaacccggccgggcc

SEQ ID NO: 1214894 - RNA, 19 nt, Mycobacterium bovis subsp bovis AF2122/97
acggccgcauaaaacucgc

SEQ ID NO: 1214895 - RNA, 18 nt, Mycobacterium bovis subsp bovis AF2122/97
acggccggccgcugccac

SEQ ID NO: 1214896 - RNA, 16 nt, Mycobacterium bovis subsp bovis AF2122/97
acggccuggccaccug

SEQ ID NO: 1214897 - RNA, 14 nt, Mycobacterium bovis subsp bovis AF2122/97
acggcgaccgccau

SEQ ID NO: 1214898 - RNA, 22 nt, Mycobacterium bovis subsp bovis AF2122/97
acggcgacgaucucggcggccg

SEQ ID NO: 1214899 - RNA, 14 nt, Mycobacterium bovis subsp bovis AF2122/97
acggcgacgauguc

SEQ ID NO: 1214900 - RNA, 17 nt, Mycobacterium bovis subsp bovis AF2122/97
acggcgaccaggagccu

SEQ ID NO: 1214901 - RNA, 22 nt, Mycobacterium bovis subsp bovis AF2122/97
acggcgacaucggcccgaucac

SEQ ID NO: 1214902 - RNA, 21 nt, Mycobacterium bovis subsp bovis AF2122/97
acggcgaccaccgcggcugcu

SEQ ID NO: 1214903 - RNA, 15 nt, Mycobacterium bovis subsp bovis AF2122/97
acggcgaccacgccg

SEQ ID NO: 1214904 - RNA, 15 nt, Mycobacterium bovis subsp bovis AF2122/97
acggcaggcagggca

SEQ ID NO: 1214905 - RNA, 22 nt, Mycobacterium bovis subsp bovis AF2122/97
acggcaggcagggcagcccggc

SEQ ID NO: 1214906 - RNA, 11 nt, Mycobacterium bovis subsp bovis AF2122/97
acggcaggcgg

SEQ ID NO: 1214907 - RNA, 20 nt, Mycobacterium bovis subsp bovis AF2122/97
acggccaagaucggcgcccc

SEQ ID NO: 1214908 - RNA, 21 nt, Mycobacterium bovis subsp bovis AF2122/97
acggcacccugcggcaccuca

SEQ ID NO: 1214909 - RNA, 20 nt, Mycobacterium bovis subsp bovis AF2122/97
acggcaccaccaagcucggc

SEQ ID NO: 1214910 - RNA, 18 nt, Mycobacterium bovis subsp bovis AF2122/97
acggcacccacccguucg

SEQ ID NO: 1214911 - RNA, 21 nt, Mycobacterium bovis subsp bovis AF2122/97
acggcacccccgacgagauac

SEQ ID NO: 1214912 - RNA, 14 nt, Mycobacterium bovis subsp bovis AF2122/97
acggcagcacgguc

SEQ ID NO: 1214913 - RNA, 22 nt, Mycobacterium bovis subsp bovis AF2122/97
acggcagcccaaagcgccagca

SEQ ID NO: 1214914 - RNA, 17 nt, Mycobacterium bovis subsp bovis AF2122/97
acggcagccgggcggca

SEQ ID NO: 1214915 - RNA, 18 nt, Mycobacterium bovis subsp bovis AF2122/97
acgggcacccgagccgca

SEQ ID NO: 1214916 - RNA, 11 nt, Mycobacterium bovis subsp bovis AF2122/97
acgggcaguga

SEQ ID NO: 1214917 - RNA, 17 nt, Mycobacterium bovis subsp bovis AF2122/97
acgggcuuccgacauga

SEQ ID NO: 1214918 - RNA, 20 nt, Mycobacterium bovis subsp bovis AF2122/97
acgggcuuccgacaugaacc

SEQ ID NO: 1214919 - RNA, 21 nt, Mycobacterium bovis subsp bovis AF2122/97
acgggaucugcggaggcgacc

SEQ ID NO: 1214920 - RNA, 17 nt, Mycobacterium bovis subsp bovis AF2122/97
acgggacgccgugugca

SEQ ID NO: 1214921 - RNA, 11 nt, Mycobacterium bovis subsp bovis AF2122/97
acgggcaaacc

SEQ ID NO: 1214922 - RNA, 12 nt, Mycobacterium bovis subsp bovis AF2122/97
acgggcaggagc

SEQ ID NO: 1214923 - RNA, 18 nt, Mycobacterium bovis subsp bovis AF2122/97
acggcgggaugcagcugc

SEQ ID NO: 1214924 - RNA, 12 nt, Mycobacterium bovis subsp bovis AF2122/97
acggcggcgccg

SEQ ID NO: 1214925 - RNA, 16 nt, Mycobacterium bovis subsp bovis AF2122/97
acggcggcgccgccca

SEQ ID NO: 1214926 - RNA, 19 nt, Mycobacterium bovis subsp bovis AF2122/97
acggcggcaggccggccac

SEQ ID NO: 1214927 - RNA, 17 nt, Mycobacterium bovis subsp bovis AF2122/97
acggcgaugcagccaca

SEQ ID NO: 1214928 - RNA, 16 nt, Mycobacterium bovis subsp bovis AF2122/97
acggcgauggcgcgca

SEQ ID NO: 1214929 - RNA, 22 nt, Mycobacterium bovis subsp bovis AF2122/97
acggcggcccacgcgcacucga

SEQ ID NO: 1214930 - RNA, 14 nt, Mycobacterium bovis subsp bovis AF2122/97
acggcguccccgac

SEQ ID NO: 1214931 - RNA, 14 nt, Mycobacterium bovis subsp bovis AF2122/97
acggcgucacccgc

SEQ ID NO: 1214932 - RNA, 21 nt, Mycobacterium bovis subsp bovis AF2122/97
acgggauagccguucggcauc

SEQ ID NO: 1214933 - RNA, 18 nt, Mycobacterium bovis subsp bovis AF2122/97
acggcggggccggcggcu

SEQ ID NO: 1214934 - RNA, 22 nt, Mycobacterium bovis subsp bovis AF2122/97
acggguagacccacaucagguc

SEQ ID NO: 1214935 - RNA, 14 nt, Mycobacterium bovis subsp bovis AF2122/97
acggggccgucucg

SEQ ID NO: 1214936 - RNA, 17 nt, Mycobacterium bovis subsp bovis AF2122/97
acgggguugaccgccac

SEQ ID NO: 1214937 - RNA, 14 nt, Mycobacterium bovis subsp bovis AF2122/97
acgguagcacgguc

SEQ ID NO: 1214938 - RNA, 18 nt, Mycobacterium bovis subsp bovis AF2122/97
acggucacacgccagccg

SEQ ID NO: 1214939 - RNA, 14 nt, Mycobacterium bovis subsp bovis AF2122/97
acggucaccggcac

SEQ ID NO: 1214940 - RNA, 19 nt, Mycobacterium bovis subsp bovis AF2122/97
acggucaaggugcgccgcc

SEQ ID NO: 1214941 - RNA, 22 nt, Mycobacterium bovis subsp bovis AF2122/97
acggucaaggugcgccgccauc

SEQ ID NO: 1214942 - RNA, 21 nt, Mycobacterium bovis subsp bovis AF2122/97
acggucagcacgcugaccaca

SEQ ID NO: 1214943 - RNA, 23 nt, Mycobacterium bovis subsp bovis AF2122/97
acggucagcacgcugaccacaac

SEQ ID NO: 1214944 - RNA, 16 nt, Mycobacterium bovis subsp bovis AF2122/97
acggucagcagacugc

SEQ ID NO: 1214945 - RNA, 13 nt, Mycobacterium bovis subsp bovis AF2122/97
acggucagccagg

SEQ ID NO: 1214946 - RNA, 16 nt, Mycobacterium bovis subsp bovis AF2122/97
acggucugggucuugg

SEQ ID NO: 1214947 - RNA, 14 nt, Mycobacterium bovis subsp bovis AF2122/97
acggucuugauguu

SEQ ID NO: 1214948 - RNA, 20 nt, Mycobacterium bovis subsp bovis AF2122/97
acggugaaucgaagcccggc

SEQ ID NO: 1214949 - RNA, 14 nt, Mycobacterium bovis subsp bovis AF2122/97
acggugaauucacg

SEQ ID NO: 1214950 - RNA, 22 nt, Mycobacterium bovis subsp bovis AF2122/97
acguuacgccgagaugcugcac

SEQ ID NO: 1214951 - RNA, 20 nt, Mycobacterium bovis subsp bovis AF2122/97
acuacggccucgcugggcuc

SEQ ID NO: 1214952 - RNA, 23 nt, Mycobacterium bovis subsp bovis AF2122/97
acuaucgcaccuccggcguggcu

SEQ ID NO: 1214953 - RNA, 20 nt, Mycobacterium bovis subsp bovis AF2122/97
acucacccgggcagccugcu

SEQ ID NO: 1214954 - RNA, 23 nt, Mycobacterium bovis subsp bovis AF2122/97
acucacccgggcagccugcugca

SEQ ID NO: 1214955 - RNA, 18 nt, Mycobacterium bovis subsp bovis AF2122/97
acucacgggugcuggcag

SEQ ID NO: 1214956 - RNA, 18 nt, Mycobacterium bovis subsp bovis AF2122/97
acucacuaccgaucacau

SEQ ID NO: 1214957 - RNA, 23 nt, Mycobacterium bovis subsp bovis AF2122/97
acucacgcaggaaaaccccggcc

SEQ ID NO: 1214958 - RNA, 23 nt, Mycobacterium bovis subsp bovis AF2122/97
acucacauuggccaggucggcca

SEQ ID NO: 1214959 - RNA, 12 nt, Mycobacterium bovis subsp bovis AF2122/97
acucaccagcac

SEQ ID NO: 1214960 - RNA, 20 nt, Mycobacterium bovis subsp bovis AF2122/97
acucacccacccgcaccgcg

SEQ ID NO: 1214961 - RNA, 12 nt, Mycobacterium bovis subsp bovis AF2122/97
acucaccccaac

SEQ ID NO: 1214962 - RNA, 23 nt, Mycobacterium bovis subsp bovis AF2122/97
acucacccgagccaucaccgcaa

SEQ ID NO: 1214963 - RNA, 18 nt, Mycobacterium bovis subsp bovis AF2122/97
acucacccgggcagccug

SEQ ID NO: 1214964 - RNA, 15 nt, Mycobacterium bovis subsp bovis AF2122/97
acucaacaccagcaa

SEQ ID NO: 1214965 - RNA, 19 nt, Mycobacterium bovis subsp bovis AF2122/97
acucaagauuuccaucgca

SEQ ID NO: 1214966 - RNA, 14 nt, Mycobacterium bovis subsp bovis AF2122/97
acucaaagacccga

SEQ ID NO: 1214967 - RNA, 21 nt, Mycobacterium bovis subsp bovis AF2122/97
acucaggaucccgguggcagc

SEQ ID NO: 1214968 - RNA, 14 nt, Mycobacterium bovis subsp bovis AF2122/97
acuccaccgcgccg

SEQ ID NO: 1214969 - RNA, 13 nt, Mycobacterium bovis subsp bovis AF2122/97
acuccaccgcgcc

SEQ ID NO: 1214970 - RNA, 22 nt, Mycobacterium bovis subsp bovis AF2122/97
acuccacgaucggcccagcccu

SEQ ID NO: 1214971 - RNA, 21 nt, Mycobacterium bovis subsp bovis AF2122/97
acuccacgaucggcccagccc

SEQ ID NO: 1214972 - RNA, 14 nt, Mycobacterium bovis subsp bovis AF2122/97
acuccaagucacag

SEQ ID NO: 1214973 - RNA, 21 nt, Mycobacterium bovis subsp bovis AF2122/97
acucaucgacguuccagcagu

SEQ ID NO: 1214974 - RNA, 22 nt, Mycobacterium bovis subsp bovis AF2122/97
acucaucggccgcggucggcca

SEQ ID NO: 1214975 - RNA, 11 nt, Mycobacterium bovis subsp bovis AF2122/97
acuccagcagc

SEQ ID NO: 1214976 - RNA, 14 nt, Mycobacterium bovis subsp bovis AF2122/97
acuccagccgcaac

SEQ ID NO: 1214977 - RNA, 22 nt, Mycobacterium bovis subsp bovis AF2122/97
acuccagccgcaacaccccccg

SEQ ID NO: 1214978 - RNA, 12 nt, Mycobacterium bovis subsp bovis AF2122/97
acuccagcgaac

SEQ ID NO: 1214979 - RNA, 14 nt, Mycobacterium bovis subsp bovis AF2122/97
acuccagcuugccg

SEQ ID NO: 1214980 - RNA, 16 nt, Mycobacterium bovis subsp bovis AF2122/97
acuccaucaccacacc

SEQ ID NO: 1214981 - RNA, 22 nt, Mycobacterium bovis subsp bovis AF2122/97
acuccgccaccaucgccucggc

SEQ ID NO: 1214982 - RNA, 22 nt, Mycobacterium bovis subsp bovis AF2122/97
acuccugagaugcggccaugaa

SEQ ID NO: 1214983 - RNA, 15 nt, Mycobacterium bovis subsp bovis AF2122/97
acuccggcaagcaca

SEQ ID NO: 1214984 - RNA, 15 nt, Mycobacterium bovis subsp bovis AF2122/97
acuccggcaccggca

SEQ ID NO: 1214985 - RNA, 20 nt, Mycobacterium bovis subsp bovis AF2122/97
acuccuggguuugccgaugg

SEQ ID NO: 1214986 - RNA, 17 nt, Mycobacterium bovis subsp bovis AF2122/97
acuccugcggcaccgcu

SEQ ID NO: 1214987 - RNA, 21 nt, Mycobacterium bovis subsp bovis AF2122/97
acucgccgucauagcaggccu

SEQ ID NO: 1214988 - RNA, 21 nt, Mycobacterium bovis subsp bovis AF2122/97
acucgccacucagcccgacac

SEQ ID NO: 1214989 - RNA, 16 nt, Mycobacterium bovis subsp bovis AF2122/97
acucgcguggcaccga

SEQ ID NO: 1214990 - RNA, 19 nt, Mycobacterium bovis subsp bovis AF2122/97
acucgcguggcaccgacag

SEQ ID NO: 1214991 - RNA, 19 nt, Mycobacterium bovis subsp bovis AF2122/97
acucgggggcugcacgcuc

SEQ ID NO: 1214992 - RNA, 20 nt, Mycobacterium bovis subsp bovis AF2122/97
acucggucucauagugcagg

SEQ ID NO: 1214993 - RNA, 22 nt, Mycobacterium bovis subsp bovis AF2122/97
acucggugauguagggcugcuc

SEQ ID NO: 1214994 - RNA, 14 nt, Mycobacterium bovis subsp bovis AF2122/97
acugcuggucaggu

SEQ ID NO: 1214995 - RNA, 23 nt, Mycobacterium bovis subsp bovis AF2122/97
acugccggccaacuucugcacga

SEQ ID NO: 1214996 - RNA, 22 nt, Mycobacterium bovis subsp bovis AF2122/97
acugccggcagcgcccccggac

SEQ ID NO: 1214997 - RNA, 17 nt, Mycobacterium bovis subsp bovis AF2122/97
acugccgcggcaccgcc

SEQ ID NO: 1214998 - RNA, 16 nt, Mycobacterium bovis subsp bovis AF2122/97
acugccguugccgccg

SEQ ID NO: 1214999 - RNA, 17 nt, Mycobacterium bovis subsp bovis AF2122/97
acugccguugccgccgg

SEQ ID NO: 1215000 - RNA, 15 nt, Mycobacterium bovis subsp bovis AF2122/97
acugcgugccgcacc

SEQ ID NO: 1215001 - RNA, 13 nt, Mycobacterium bovis subsp bovis AF2122/97
acugccccagcac

SEQ ID NO: 1215002 - RNA, 23 nt, Mycobacterium bovis subsp bovis AF2122/97
acugcccucgcuaauugcggccg

SEQ ID NO: 1215003 - RNA, 14 nt, Mycobacterium bovis subsp bovis AF2122/97
acugccgcaggaag

SEQ ID NO: 1215004 - RNA, 13 nt, Mycobacterium bovis subsp bovis AF2122/97
acugcaccuggcc

SEQ ID NO: 1215005 - RNA, 21 nt, Mycobacterium bovis subsp bovis AF2122/97
acugcaccuggccgcccgcuc

SEQ ID NO: 1215006 - RNA, 14 nt, Mycobacterium bovis subsp bovis AF2122/97
acugacccugaucg

SEQ ID NO: 1215007 - RNA, 22 nt, Mycobacterium bovis subsp bovis AF2122/97
acugaccccgccgccacgggug

SEQ ID NO: 1215008 - RNA, 17 nt, Mycobacterium bovis subsp bovis AF2122/97
acugaccucgucaauca

SEQ ID NO: 1215009 - RNA, 23 nt, Mycobacterium bovis subsp bovis AF2122/97
acugaccucgucaaucaccaccg

SEQ ID NO: 1215010 - RNA, 15 nt, Mycobacterium bovis subsp bovis AF2122/97
acugaauuuggugaa

SEQ ID NO: 1215011 - RNA, 21 nt, Mycobacterium bovis subsp bovis AF2122/97
acugaugaaccacggcaggca

SEQ ID NO: 1215012 - RNA, 15 nt, Mycobacterium bovis subsp bovis AF2122/97
acucgucgucgguca

SEQ ID NO: 1215013 - RNA, 20 nt, Mycobacterium bovis subsp bovis AF2122/97
acucguggcgccacggcagc

SEQ ID NO: 1215014 - RNA, 23 nt, Mycobacterium bovis subsp bovis AF2122/97
acucgguguuucgugccaugguu

SEQ ID NO: 1215015 - RNA, 20 nt, Mycobacterium bovis subsp bovis AF2122/97
acugaaucgaccggaacugu

SEQ ID NO: 1215016 - RNA, 21 nt, Mycobacterium bovis subsp bovis AF2122/97
acuggcgguguaacccggaac

SEQ ID NO: 1215017 - RNA, 19 nt, Mycobacterium bovis subsp bovis AF2122/97
acuggcauuucagcuggug

SEQ ID NO: 1215018 - RNA, 21 nt, Mycobacterium bovis subsp bovis AF2122/97
acuggccccgguggugcugcc

SEQ ID NO: 1215019 - RNA, 17 nt, Mycobacterium bovis subsp bovis AF2122/97
acuggcccggacaugcg

SEQ ID NO: 1215020 - RNA, 13 nt, Mycobacterium bovis subsp bovis AF2122/97
acugguauuuccc

SEQ ID NO: 1215021 - RNA, 21 nt, Mycobacterium bovis subsp bovis AF2122/97
acugggcgaucgacaccguga

SEQ ID NO: 1215022 - RNA, 23 nt, Mycobacterium bovis subsp bovis AF2122/97
acuggggcgccaccacccggcgc

SEQ ID NO: 1215023 - RNA, 15 nt, Mycobacterium bovis subsp bovis AF2122/97
acugggcuggccagc

SEQ ID NO: 1215024 - RNA, 14 nt, Mycobacterium bovis subsp bovis AF2122/97
acuggggugcugcg

SEQ ID NO: 1215025 - RNA, 19 nt, Mycobacterium bovis subsp bovis AF2122/97
acuggucgcggcgcuggcu

SEQ ID NO: 1215026 - RNA, 20 nt, Mycobacterium bovis subsp bovis AF2122/97
acugguggcgauccguagga

SEQ ID NO: 1215027 - RNA, 20 nt, Mycobacterium bovis subsp bovis AF2122/97
acuguccccguugagauacc

SEQ ID NO: 1215028 - RNA, 19 nt, Mycobacterium bovis subsp bovis AF2122/97
acugugcgagcugcggguc

SEQ ID NO: 1215029 - RNA, 19 nt, Mycobacterium bovis subsp bovis AF2122/97
acugugccgcccccggcac

SEQ ID NO: 1215030 - RNA, 15 nt, Mycobacterium bovis subsp bovis AF2122/97
acuguuacggccaca

SEQ ID NO: 1215031 - RNA, 13 nt, Mycobacterium bovis subsp bovis AF2122/97
agcaacgucggua

SEQ ID NO: 1215032 - RNA, 15 nt, Mycobacterium bovis subsp bovis AF2122/97
agcaacucggccacg

SEQ ID NO: 1215033 - RNA, 24 nt, Mycobacterium bovis subsp bovis AF2122/97
agcaacugggcggccuggucggcc

SEQ ID NO: 1215034 - RNA, 16 nt, Mycobacterium bovis subsp bovis AF2122/97
agcaacucguccagca

SEQ ID NO: 1215035 - RNA, 20 nt, Mycobacterium bovis subsp bovis AF2122/97
agcaacucguccagcagugc

SEQ ID NO: 1215036 - RNA, 21 nt, Mycobacterium bovis subsp bovis AF2122/97
agcaacucguccagcagugcg

SEQ ID NO: 1215037 - RNA, 15 nt, Mycobacterium bovis subsp bovis AF2122/97
agcaacgccacgccg

SEQ ID NO: 1215038 - RNA, 16 nt, Mycobacterium bovis subsp bovis AF2122/97
agcaacgcugcggcag

SEQ ID NO: 1215039 - RNA, 13 nt, Mycobacterium bovis subsp bovis AF2122/97
agcaacgcccaac

SEQ ID NO: 1215040 - RNA, 14 nt, Mycobacterium bovis subsp bovis AF2122/97
agcaaguccaccgg

SEQ ID NO: 1215041 - RNA, 13 nt, Mycobacterium bovis subsp bovis AF2122/97
agcaaguccugca

SEQ ID NO: 1215042 - RNA, 18 nt, Mycobacterium bovis subsp bovis AF2122/97
agcaagugggugccggca

SEQ ID NO: 1215043 - RNA, 16 nt, Mycobacterium bovis subsp bovis AF2122/97
agcaagagccgcagcc

SEQ ID NO: 1215044 - RNA, 20 nt, Mycobacterium bovis subsp bovis AF2122/97
agcaagaaguacgugcacag

SEQ ID NO: 1215045 - RNA, 14 nt, Mycobacterium bovis subsp bovis AF2122/97
agcaagaucggcag

SEQ ID NO: 1215046 - RNA, 19 nt, Mycobacterium bovis subsp bovis AF2122/97
agcaagaucggcagcgugg

SEQ ID NO: 1215047 - RNA, 17 nt, Mycobacterium bovis subsp bovis AF2122/97
agcacacaacacccaac

SEQ ID NO: 1215048 - RNA, 24 nt, Mycobacterium bovis subsp bovis AF2122/97
agcaaugcgguaccaaccugcgcg

SEQ ID NO: 1215049 - RNA, 14 nt, Mycobacterium bovis subsp bovis AF2122/97
agcaaugacccgcg

SEQ ID NO: 1215050 - RNA, 22 nt, Mycobacterium bovis subsp bovis AF2122/97
agcacccaaugccaccgcggcc

SEQ ID NO: 1215051 - RNA, 14 nt, Mycobacterium bovis subsp bovis AF2122/97
agcaccccgagguc

SEQ ID NO: 1215052 - RNA, 14 nt, Mycobacterium bovis subsp bovis AF2122/97
agcacccgcaaugc

SEQ ID NO: 1215053 - RNA, 17 nt, Mycobacterium bovis subsp bovis AF2122/97
agcacccgaaccgggga

SEQ ID NO: 1215054 - RNA, 17 nt, Mycobacterium bovis subsp bovis AF2122/97
agcacccgauaguucug

SEQ ID NO: 1215055 - RNA, 23 nt, Mycobacterium bovis subsp bovis AF2122/97
agcacccgcuggucgagcagugc

SEQ ID NO: 1215056 - RNA, 15 nt, Mycobacterium bovis subsp bovis AF2122/97
agcacccggccaccg

SEQ ID NO: 1215057 - RNA, 15 nt, Mycobacterium bovis subsp bovis AF2122/97
agcacccugauguga

SEQ ID NO: 1215058 - RNA, 14 nt, Mycobacterium bovis subsp bovis AF2122/97
agcacccugcgggc

SEQ ID NO: 1215059 - RNA, 19 nt, Mycobacterium bovis subsp bovis AF2122/97
agcacccugaugugagucc

SEQ ID NO: 1215060 - RNA, 20 nt, Mycobacterium bovis subsp bovis AF2122/97
agcacccugaugugagucca

SEQ ID NO: 1215061 - RNA, 14 nt, Mycobacterium bovis subsp bovis AF2122/97
agcaccacggccag

SEQ ID NO: 1215062 - RNA, 18 nt, Mycobacterium bovis subsp bovis AF2122/97
agcaccagcgucgcggcc

SEQ ID NO: 1215063 - RNA, 21 nt, Mycobacterium bovis subsp bovis AF2122/97
agcaccagggcgcggaucugc

SEQ ID NO: 1215064 - RNA, 21 nt, Mycobacterium bovis subsp bovis AF2122/97
agcaccagcgucgcggccacg

SEQ ID NO: 1215065 - RNA, 18 nt, Mycobacterium bovis subsp bovis AF2122/97
agcaccaccgcggugugc

SEQ ID NO: 1215066 - RNA, 13 nt, Mycobacterium bovis subsp bovis AF2122/97
agcaccaccccag

SEQ ID NO: 1215067 - RNA, 21 nt, Mycobacterium bovis subsp bovis AF2122/97
agcaccaccccagcggccacc

SEQ ID NO: 1215068 - RNA, 22 nt, Mycobacterium bovis subsp bovis AF2122/97
agcaccaccccagcggccaccg

SEQ ID NO: 1215069 - RNA, 23 nt, Mycobacterium bovis subsp bovis AF2122/97
agcaccaccccagcggccaccga

SEQ ID NO: 1215070 - RNA, 19 nt, Mycobacterium bovis subsp bovis AF2122/97
agcaccacccgcaccucac

SEQ ID NO: 1215071 - RNA, 16 nt, Mycobacterium bovis subsp bovis AF2122/97
agcaccacccgggccu

SEQ ID NO: 1215072 - RNA, 14 nt, Mycobacterium bovis subsp bovis AF2122/97
agcaccaccagcag

SEQ ID NO: 1215073 - RNA, 15 nt, Mycobacterium bovis subsp bovis AF2122/97
agcaccaaggucuuc

SEQ ID NO: 1215074 - RNA, 14 nt, Mycobacterium bovis subsp bovis AF2122/97
agcacaucgccgga

SEQ ID NO: 1215075 - RNA, 18 nt, Mycobacterium bovis subsp bovis AF2122/97
agcacaugguccaaccag

SEQ ID NO: 1215076 - RNA, 12 nt, Mycobacterium bovis subsp bovis AF2122/97
agcacacccaga

SEQ ID NO: 1215077 - RNA, 18 nt, Mycobacterium bovis subsp bovis AF2122/97
agcacacuccuagccaac

SEQ ID NO: 1215078 - RNA, 18 nt, Mycobacterium bovis subsp bovis AF2122/97
agcacacuggccacaauc

SEQ ID NO: 1215079 - RNA, 12 nt, Mycobacterium bovis subsp bovis AF2122/97
agcacagcagca

SEQ ID NO: 1215080 - RNA, 14 nt, Mycobacterium bovis subsp bovis AF2122/97
agcacagcccggcg

SEQ ID NO: 1215081 - RNA, 14 nt, Mycobacterium bovis subsp bovis AF2122/97
agcacagcccggcu

SEQ ID NO: 1215082 - RNA, 15 nt, Mycobacterium bovis subsp bovis AF2122/97
agcaccgacagcccg

SEQ ID NO: 1215083 - RNA, 19 nt, Mycobacterium bovis subsp bovis AF2122/97
agcaccgaccagggccgcc

SEQ ID NO: 1215084 - RNA, 14 nt, Mycobacterium bovis subsp bovis AF2122/97
agcaccgacgugau

SEQ ID NO: 1215085 - RNA, 14 nt, Mycobacterium bovis subsp bovis AF2122/97
agcaccgaugcuga

SEQ ID NO: 1215086 - RNA, 18 nt, Mycobacterium bovis subsp bovis AF2122/97
agcaccgccggugcggcc

SEQ ID NO: 1215087 - RNA, 13 nt, Mycobacterium bovis subsp bovis AF2122/97
agcaccgcgccga

SEQ ID NO: 1215088 - RNA, 18 nt, Mycobacterium bovis subsp bovis AF2122/97
agcaccggauacagccac

SEQ ID NO: 1215089 - RNA, 15 nt, Mycobacterium bovis subsp bovis AF2122/97
agcacgcugaccaca

SEQ ID NO: 1215090 - RNA, 18 nt, Mycobacterium bovis subsp bovis AF2122/97
agcacgcugaccacaacc

SEQ ID NO: 1215091 - RNA, 16 nt, Mycobacterium bovis subsp bovis AF2122/97
agcacgcgugguucgg

SEQ ID NO: 1215092 - RNA, 20 nt, Mycobacterium bovis subsp bovis AF2122/97
agcacggcgccgccacggau

SEQ ID NO: 1215093 - RNA, 20 nt, Mycobacterium bovis subsp bovis AF2122/97
agcacggcgcggcggagugc

SEQ ID NO: 1215094 - RNA, 13 nt, Mycobacterium bovis subsp bovis AF2122/97
agcacgcccucga

SEQ ID NO: 1215095 - RNA, 16 nt, Mycobacterium bovis subsp bovis AF2122/97
agcacgcgggcacugg

SEQ ID NO: 1215096 - RNA, 22 nt, Mycobacterium bovis subsp bovis AF2122/97
agcacggcgcggcggagugcau

SEQ ID NO: 1215097 - RNA, 16 nt, Mycobacterium bovis subsp bovis AF2122/97
agcacggcggccacgu

SEQ ID NO: 1215098 - RNA, 15 nt, Mycobacterium bovis subsp bovis AF2122/97
agcacgggugagcac

SEQ ID NO: 1215099 - RNA, 17 nt, Mycobacterium bovis subsp bovis AF2122/97
agcagaccacaacgccu

SEQ ID NO: 1215100 - RNA, 20 nt, Mycobacterium bovis subsp bovis AF2122/97
agcagaauccugcgcugcac

SEQ ID NO: 1215101 - RNA, 17 nt, Mycobacterium bovis subsp bovis AF2122/97
agcagcgcaacggccag

SEQ ID NO: 1215102 - RNA, 12 nt, Mycobacterium bovis subsp bovis AF2122/97
agcagcccggcg

SEQ ID NO: 1215103 - RNA, 20 nt, Mycobacterium bovis subsp bovis AF2122/97
agcagcgacgcugccgccag

SEQ ID NO: 1215104 - RNA, 12 nt, Mycobacterium bovis subsp bovis AF2122/97
agcagccgaacc

SEQ ID NO: 1215105 - RNA, 13 nt, Mycobacterium bovis subsp bovis AF2122/97
agcagccgaaccg

SEQ ID NO: 1215106 - RNA, 14 nt, Mycobacterium bovis subsp bovis AF2122/97
agcagacugcccuc

SEQ ID NO: 1215107 - RNA, 22 nt, Mycobacterium bovis subsp bovis AF2122/97
aaaaccucgacgcccgcccugg

SEQ ID NO: 1215108 - RNA, 22 nt, Mycobacterium bovis subsp bovis AF2122/97
agcagacgcauaagcccccgca

SEQ ID NO: 1215109 - RNA, 16 nt, Mycobacterium bovis subsp bovis AF2122/97
agcagacgcaaaagaa

SEQ ID NO: 1215110 - RNA, 12 nt, Mycobacterium bovis subsp bovis AF2122/97
agcagcuggucg

SEQ ID NO: 1215111 - RNA, 23 nt, Mycobacterium bovis subsp bovis AF2122/97
agcagcugaaaauaggccgggca

SEQ ID NO: 1215112 - RNA, 13 nt, Mycobacterium bovis subsp bovis AF2122/97
agcagggccacca

SEQ ID NO: 1215113 - RNA, 14 nt, Mycobacterium bovis subsp bovis AF2122/97
agcagggccaccac

SEQ ID NO: 1215114 - RNA, 17 nt, Mycobacterium bovis subsp bovis AF2122/97
agcagggccaccaccac

SEQ ID NO: 1215115 - RNA, 16 nt, Mycobacterium bovis subsp bovis AF2122/97
agcagggauucuggau

SEQ ID NO: 1215116 - RNA, 17 nt, Mycobacterium bovis subsp bovis AF2122/97
agcagggccagaccgaa

SEQ ID NO: 1215117 - RNA, 23 nt, Mycobacterium bovis subsp bovis AF2122/97
agcaguucggcgaugcgcgggug

SEQ ID NO: 1215118 - RNA, 19 nt, Mycobacterium bovis subsp bovis AF2122/97
agcaggugcccgaggugcu

SEQ ID NO: 1215119 - RNA, 17 nt, Mycobacterium bovis subsp bovis AF2122/97
agcaggugauguucagc

SEQ ID NO: 1215120 - RNA, 21 nt, Mycobacterium bovis subsp bovis AF2122/97
agcauccgcccgagccgggga

SEQ ID NO: 1215121 - RNA, 20 nt, Mycobacterium bovis subsp bovis AF2122/97
agcauccucgacuugcuugg

SEQ ID NO: 1215122 - RNA, 14 nt, Mycobacterium bovis subsp bovis AF2122/97
agcaucaacaccgg

SEQ ID NO: 1215123 - RNA, 14 nt, Mycobacterium bovis subsp bovis AF2122/97
agcaucaaagcggu

SEQ ID NO: 1215124 - RNA, 22 nt, Mycobacterium bovis subsp bovis AF2122/97
agccagccaccggggaagaucu

SEQ ID NO: 1215125 - RNA, 20 nt, Mycobacterium bovis subsp bovis AF2122/97
agccagcaucggcagcagcg

SEQ ID NO: 1215126 - RNA, 14 nt, Mycobacterium bovis subsp bovis AF2122/97
agccacucggcccg

SEQ ID NO: 1215127 - RNA, 23 nt, Mycobacterium bovis subsp bovis AF2122/97
agccacggguagcugccgcggcc

SEQ ID NO: 1215128 - RNA, 14 nt, Mycobacterium bovis subsp bovis AF2122/97
agccaccaccgccg

SEQ ID NO: 1215129 - RNA, 16 nt, Mycobacterium bovis subsp bovis AF2122/97
agccacagggaagcaa

SEQ ID NO: 1215130 - RNA, 23 nt, Mycobacterium bovis subsp bovis AF2122/97
agccaaaugcgcugucgcccucg

SEQ ID NO: 1215131 - RNA, 14 nt, Mycobacterium bovis subsp bovis AF2122/97
agccaaaggcggcu

SEQ ID NO: 1215132 - RNA, 18 nt, Mycobacterium bovis subsp bovis AF2122/97
agccaaacuacccgccca

SEQ ID NO: 1215133 - RNA, 21 nt, Mycobacterium bovis subsp bovis AF2122/97
agcaucuccgucggccaggcc

SEQ ID NO: 1215134 - RNA, 20 nt, Mycobacterium bovis subsp bovis AF2122/97
agcaucuccucgccugcccg

SEQ ID NO: 1215135 - RNA, 22 nt, Mycobacterium bovis subsp bovis AF2122/97
agcaucucggcggccaacagca

SEQ ID NO: 1215136 - RNA, 14 nt, Mycobacterium bovis subsp bovis AF2122/97
agcaugguccacag

SEQ ID NO: 1215137 - RNA, 13 nt, Mycobacterium bovis subsp bovis AF2122/97
agcauucaccaaa

SEQ ID NO: 1215138 - RNA, 15 nt, Mycobacterium bovis subsp bovis AF2122/97
agcauugucgccgga

SEQ ID NO: 1215139 - RNA, 15 nt, Mycobacterium bovis subsp bovis AF2122/97
agcauugaagaagcc

SEQ ID NO: 1215140 - RNA, 20 nt, Mycobacterium bovis subsp bovis AF2122/97
agcauugaguucggccacca

SEQ ID NO: 1215141 - RNA, 22 nt, Mycobacterium bovis subsp bovis AF2122/97
agccaguaaaaaggcaggacug

SEQ ID NO: 1215142 - RNA, 23 nt, Mycobacterium bovis subsp bovis AF2122/97
agcccgcguucaggaugccagga

SEQ ID NO: 1215143 - RNA, 16 nt, Mycobacterium bovis subsp bovis AF2122/97
agcccgcuggccuccu

SEQ ID NO: 1215144 - RNA, 21 nt, Mycobacterium bovis subsp bovis AF2122/97
agccaguaccagguacgggag

SEQ ID NO: 1215145 - RNA, 23 nt, Mycobacterium bovis subsp bovis AF2122/97
agccagggccgcauacacgaggu

SEQ ID NO: 1215146 - RNA, 13 nt, Mycobacterium bovis subsp bovis AF2122/97
agccagccugcug

SEQ ID NO: 1215147 - RNA, 23 nt, Mycobacterium bovis subsp bovis AF2122/97
agccagccugcuggccgcggccu

SEQ ID NO: 1215148 - RNA, 20 nt, Mycobacterium bovis subsp bovis AF2122/97
agccaggccuuggugcggcc

SEQ ID NO: 1215149 - RNA, 22 nt, Mycobacterium bovis subsp bovis AF2122/97
agccaggcgcgcuaccagcuca

SEQ ID NO: 1215150 - RNA, 17 nt, Mycobacterium bovis subsp bovis AF2122/97
agccaggcggcaaggac

SEQ ID NO: 1215151 - RNA, 15 nt, Mycobacterium bovis subsp bovis AF2122/97
agcccggccgcgccc

SEQ ID NO: 1215152 - RNA, 17 nt, Mycobacterium bovis subsp bovis AF2122/97
agcccggccgcgcccca

SEQ ID NO: 1215153 - RNA, 20 nt, Mycobacterium bovis subsp bovis AF2122/97
agcccggccucggcgagcac

SEQ ID NO: 1215154 - RNA, 23 nt, Mycobacterium bovis subsp bovis AF2122/97
agcccggacgcgcggauggccuc

SEQ ID NO: 1215155 - RNA, 21 nt, Mycobacterium bovis subsp bovis AF2122/97
agcccggacguaggcaccccg

SEQ ID NO: 1215156 - RNA, 15 nt, Mycobacterium bovis subsp bovis AF2122/97
agcccggagcgguca

SEQ ID NO: 1215157 - RNA, 15 nt, Mycobacterium bovis subsp bovis AF2122/97
agcccguugggcucu

SEQ ID NO: 1215158 - RNA, 14 nt, Mycobacterium bovis subsp bovis AF2122/97
agcccggccuugcc

SEQ ID NO: 1215159 - RNA, 18 nt, Mycobacterium bovis subsp bovis AF2122/97
agcccggccuugccgccg

SEQ ID NO: 1215160 - RNA, 14 nt, Mycobacterium bovis subsp bovis AF2122/97
agcccuaucagccg

SEQ ID NO: 1215161 - RNA, 20 nt, Mycobacterium bovis subsp bovis AF2122/97
agccgaucgucucggccacg

SEQ ID NO: 1215162 - RNA, 15 nt, Mycobacterium bovis subsp bovis AF2122/97
agccgauccagcagg

SEQ ID NO: 1215163 - RNA, 20 nt, Mycobacterium bovis subsp bovis AF2122/97
agccgaccaggaccaccgca

SEQ ID NO: 1215164 - RNA, 14 nt, Mycobacterium bovis subsp bovis AF2122/97
agccgaucgagcag

SEQ ID NO: 1215165 - RNA, 21 nt, Mycobacterium bovis subsp bovis AF2122/97
agccgacccgcccgaagaugc

SEQ ID NO: 1215166 - RNA, 14 nt, Mycobacterium bovis subsp bovis AF2122/97
agccgauccagcag

SEQ ID NO: 1215167 - RNA, 18 nt, Mycobacterium bovis subsp bovis AF2122/97
agccgcaccagaucgucg

SEQ ID NO: 1215168 - RNA, 23 nt, Mycobacterium bovis subsp bovis AF2122/97
agccgauuuuuccacaccagcuu

SEQ ID NO: 1215169 - RNA, 14 nt, Mycobacterium bovis subsp bovis AF2122/97
agcccuccgagcac

SEQ ID NO: 1215170 - RNA, 13 nt, Mycobacterium bovis subsp bovis AF2122/97
agcccuccagggc

SEQ ID NO: 1215171 - RNA, 15 nt, Mycobacterium bovis subsp bovis AF2122/97
agcccuccgagcaca

SEQ ID NO: 1215172 - RNA, 17 nt, Mycobacterium bovis subsp bovis AF2122/97
agccgacaucggcggcc

SEQ ID NO: 1215173 - RNA, 18 nt, Mycobacterium bovis subsp bovis AF2122/97
agccgacaucggcggccc

SEQ ID NO: 1215174 - RNA, 13 nt, Mycobacterium bovis subsp bovis AF2122/97
agccgaccaggac

SEQ ID NO: 1215175 - RNA, 12 nt, Mycobacterium bovis subsp bovis AF2122/97
agccgaccagcg

SEQ ID NO: 1215176 - RNA, 14 nt, Mycobacterium bovis subsp bovis AF2122/97
agccgaccagcgcu

SEQ ID NO: 1215177 - RNA, 14 nt, Mycobacterium bovis subsp bovis AF2122/97
agccgaacccaagg

SEQ ID NO: 1215178 - RNA, 14 nt, Mycobacterium bovis subsp bovis AF2122/97
agccgaacgacagc

SEQ ID NO: 1215179 - RNA, 17 nt, Mycobacterium bovis subsp bovis AF2122/97
agccgccgacucggcac

SEQ ID NO: 1215180 - RNA, 17 nt, Mycobacterium bovis subsp bovis AF2122/97
agccgcccgcccaccuc

SEQ ID NO: 1215181 - RNA, 15 nt, Mycobacterium bovis subsp bovis AF2122/97
agccgcccgcccacc

SEQ ID NO: 1215182 - RNA, 21 nt, Mycobacterium bovis subsp bovis AF2122/97
agccgccauugagcucccgca

SEQ ID NO: 1215183 - RNA, 18 nt, Mycobacterium bovis subsp bovis AF2122/97
agccgcccaagccgccgg

SEQ ID NO: 1215184 - RNA, 15 nt, Mycobacterium bovis subsp bovis AF2122/97
agccgccgcgccccg

SEQ ID NO: 1215185 - RNA, 22 nt, Mycobacterium bovis subsp bovis AF2122/97
agccgccgcgccccgcggcaga

SEQ ID NO: 1215186 - RNA, 23 nt, Mycobacterium bovis subsp bovis AF2122/97
agccgccgcuucaccccacuggc

SEQ ID NO: 1215187 - RNA, 13 nt, Mycobacterium bovis subsp bovis AF2122/97
agccgccggcccc

SEQ ID NO: 1215188 - RNA, 17 nt, Mycobacterium bovis subsp bovis AF2122/97
agccgccguugccgccg

SEQ ID NO: 1215189 - RNA, 21 nt, Mycobacterium bovis subsp bovis AF2122/97
agccgcgcgccaucgccucca

SEQ ID NO: 1215190 - RNA, 20 nt, Mycobacterium bovis subsp bovis AF2122/97
agccgcgcgguacugcgcag

SEQ ID NO: 1215191 - RNA, 21 nt, Mycobacterium bovis subsp bovis AF2122/97
agccgcggcuaggccagcacg

SEQ ID NO: 1215192 - RNA, 22 nt, Mycobacterium bovis subsp bovis AF2122/97
agccgcggggcgaaguggaucu

SEQ ID NO: 1215193 - RNA, 17 nt, Mycobacterium bovis subsp bovis AF2122/97
agccgcggucggcgugc

SEQ ID NO: 1215194 - RNA, 17 nt, Mycobacterium bovis subsp bovis AF2122/97
agccgcggccacaugau

SEQ ID NO: 1215195 - RNA, 13 nt, Mycobacterium bovis subsp bovis AF2122/97
agccgcggccacg

SEQ ID NO: 1215196 - RNA, 14 nt, Mycobacterium bovis subsp bovis AF2122/97
agccgcggccacgg

SEQ ID NO: 1215197 - RNA, 21 nt, Mycobacterium bovis subsp bovis AF2122/97
agccggcauagcggcccaucg

SEQ ID NO: 1215198 - RNA, 14 nt, Mycobacterium bovis subsp bovis AF2122/97
agccggcagcagcg

SEQ ID NO: 1215199 - RNA, 18 nt, Mycobacterium bovis subsp bovis AF2122/97
agccggccauacgcgcgc

SEQ ID NO: 1215200 - RNA, 14 nt, Mycobacterium bovis subsp bovis AF2122/97
agccggcgcccgcc

SEQ ID NO: 1215201 - RNA, 21 nt, Mycobacterium bovis subsp bovis AF2122/97
agccggccaauggccugcagc

SEQ ID NO: 1215202 - RNA, 12 nt, Mycobacterium bovis subsp bovis AF2122/97
agccggccaccu

SEQ ID NO: 1215203 - RNA, 14 nt, Mycobacterium bovis subsp bovis AF2122/97
agccggccgcgacc

SEQ ID NO: 1215204 - RNA, 16 nt, Mycobacterium bovis subsp bovis AF2122/97
agccggccacgcauuc

SEQ ID NO: 1215205 - RNA, 22 nt, Mycobacterium bovis subsp bovis AF2122/97
agccggccacgcauuccagcag

SEQ ID NO: 1215206 - RNA, 17 nt, Mycobacterium bovis subsp bovis AF2122/97
agccgcugaucugccgc

SEQ ID NO: 1215207 - RNA, 20 nt, Mycobacterium bovis subsp bovis AF2122/97
agccgcugccuggccgggac

SEQ ID NO: 1215208 - RNA, 17 nt, Mycobacterium bovis subsp bovis AF2122/97
agccgcucgauggccug

SEQ ID NO: 1215209 - RNA, 21 nt, Mycobacterium bovis subsp bovis AF2122/97
agccgcuacguuacgccgaga

SEQ ID NO: 1215210 - RNA, 20 nt, Mycobacterium bovis subsp bovis AF2122/97
agccucgcgcgugugccuga

SEQ ID NO: 1215211 - RNA, 15 nt, Mycobacterium bovis subsp bovis AF2122/97
agccucgcgggcagg

SEQ ID NO: 1215212 - RNA, 20 nt, Mycobacterium bovis subsp bovis AF2122/97
agccucgcgggcagggccuc

SEQ ID NO: 1215213 - RNA, 13 nt, Mycobacterium bovis subsp bovis AF2122/97
agccucagccgcu

SEQ ID NO: 1215214 - RNA, 13 nt, Mycobacterium bovis subsp bovis AF2122/97
agccucaucugag

SEQ ID NO: 1215215 - RNA, 23 nt, Mycobacterium bovis subsp bovis AF2122/97
agccuuacgcgggugaccaacac

SEQ ID NO: 1215216 - RNA, 14 nt, Mycobacterium bovis subsp bovis AF2122/97
agccucucuuccca

SEQ ID NO: 1215217 - RNA, 13 nt, Mycobacterium bovis subsp bovis AF2122/97
agccucuugguca

SEQ ID NO: 1215218 - RNA, 17 nt, Mycobacterium bovis subsp bovis AF2122/97
agccucggcaugcagcc

SEQ ID NO: 1215219 - RNA, 18 nt, Mycobacterium bovis subsp bovis AF2122/97
agccucggcaugcagccc

SEQ ID NO: 1215220 - RNA, 20 nt, Mycobacterium bovis subsp bovis AF2122/97
agccucggcaugcagcccca

SEQ ID NO: 1215221 - RNA, 21 nt, Mycobacterium bovis subsp bovis AF2122/97
agccucggcaugcagccccac

SEQ ID NO: 1215222 - RNA, 12 nt, Mycobacterium bovis subsp bovis AF2122/97
agccuugcagcg

SEQ ID NO: 1215223 - RNA, 15 nt, Mycobacterium bovis subsp bovis AF2122/97
agccuugcagcgccc

SEQ ID NO: 1215224 - RNA, 17 nt, Mycobacterium bovis subsp bovis AF2122/97
agccuugcagcgccccc

SEQ ID NO: 1215225 - RNA, 14 nt, Mycobacterium bovis subsp bovis AF2122/97
agccuugaucucgu

SEQ ID NO: 1215226 - RNA, 23 nt, Mycobacterium bovis subsp bovis AF2122/97
agcgaacccgcguugaaggcgcc

SEQ ID NO: 1215227 - RNA, 20 nt, Mycobacterium bovis subsp bovis AF2122/97
agcgaaccgccggcaccgcc

SEQ ID NO: 1215228 - RNA, 19 nt, Mycobacterium bovis subsp bovis AF2122/97
agcgaaaugcccaucacca

SEQ ID NO: 1215229 - RNA, 23 nt, Mycobacterium bovis subsp bovis AF2122/97
agcgacacguuggcggaugcccg

SEQ ID NO: 1215230 - RNA, 19 nt, Mycobacterium bovis subsp bovis AF2122/97
agccggcgcgccccaccgc

SEQ ID NO: 1215231 - RNA, 23 nt, Mycobacterium bovis subsp bovis AF2122/97
agccgggagucgucggcaugggc

SEQ ID NO: 1215232 - RNA, 22 nt, Mycobacterium bovis subsp bovis AF2122/97
agccgggcaaccagcagcaggu

SEQ ID NO: 1215233 - RNA, 20 nt, Mycobacterium bovis subsp bovis AF2122/97
agccgggcaccacccuugcc

SEQ ID NO: 1215234 - RNA, 22 nt, Mycobacterium bovis subsp bovis AF2122/97
agccgggccccacaucgccccc

SEQ ID NO: 1215235 - RNA, 15 nt, Mycobacterium bovis subsp bovis AF2122/97
agccgggcucgucga

SEQ ID NO: 1215236 - RNA, 17 nt, Mycobacterium bovis subsp bovis AF2122/97
agccgggugccacaacc

SEQ ID NO: 1215237 - RNA, 19 nt, Mycobacterium bovis subsp bovis AF2122/97
agccgggugggagcagccg

SEQ ID NO: 1215238 - RNA, 21 nt, Mycobacterium bovis subsp bovis AF2122/97
agccggucuugcaucgccaau

SEQ ID NO: 1215239 - RNA, 19 nt, Mycobacterium bovis subsp bovis AF2122/97
agccggugagcgagcgcgc

SEQ ID NO: 1215240 - RNA, 19 nt, Mycobacterium bovis subsp bovis AF2122/97
agccggugccgacggcgcc

SEQ ID NO: 1215241 - RNA, 19 nt, Mycobacterium bovis subsp bovis AF2122/97
agccguagccgccguggau

SEQ ID NO: 1215242 - RNA, 16 nt, Mycobacterium bovis subsp bovis AF2122/97
agccguaguaguggcc

SEQ ID NO: 1215243 - RNA, 19 nt, Mycobacterium bovis subsp bovis AF2122/97
agccguccaauuccgcaga

SEQ ID NO: 1215244 - RNA, 21 nt, Mycobacterium bovis subsp bovis AF2122/97
agccgucgcgacgucggccgu

SEQ ID NO: 1215245 - RNA, 18 nt, Mycobacterium bovis subsp bovis AF2122/97
agccguccgggcggccuc

SEQ ID NO: 1215246 - RNA, 20 nt, Mycobacterium bovis subsp bovis AF2122/97
agccgucaccgcgaccccug

SEQ ID NO: 1215247 - RNA, 14 nt, Mycobacterium bovis subsp bovis AF2122/97
agccgugcagcucg

SEQ ID NO: 1215248 - RNA, 18 nt, Mycobacterium bovis subsp bovis AF2122/97
agccgugcccaggccacc

SEQ ID NO: 1215249 - RNA, 12 nt, Mycobacterium bovis subsp bovis AF2122/97
agccgugguggu

SEQ ID NO: 1215250 - RNA, 16 nt, Mycobacterium bovis subsp bovis AF2122/97
agccgugcggcggcug

SEQ ID NO: 1215251 - RNA, 19 nt, Mycobacterium bovis subsp bovis AF2122/97
agccgugcggucgcgcccu

SEQ ID NO: 1215252 - RNA, 14 nt, Mycobacterium bovis subsp bovis AF2122/97
agccgugccguggu

SEQ ID NO: 1215253 - RNA, 16 nt, Mycobacterium bovis subsp bovis AF2122/97
agccgugccgugguga

SEQ ID NO: 1215254 - RNA, 21 nt, Mycobacterium bovis subsp bovis AF2122/97
agccguugcgggccaggcccu

SEQ ID NO: 1215255 - RNA, 17 nt, Mycobacterium bovis subsp bovis AF2122/97
agccguucggcaucugg

SEQ ID NO: 1215256 - RNA, 22 nt, Mycobacterium bovis subsp bovis AF2122/97
agccguucucgcccacccgcug

SEQ ID NO: 1215257 - RNA, 15 nt, Mycobacterium bovis subsp bovis AF2122/97
agccguuugcgcugg

SEQ ID NO: 1215258 - RNA, 13 nt, Mycobacterium bovis subsp bovis AF2122/97
agcgggugccauc

SEQ ID NO: 1215259 - RNA, 21 nt, Mycobacterium bovis subsp bovis AF2122/97
agcgggugccaucgguggugg

SEQ ID NO: 1215260 - RNA, 22 nt, Mycobacterium bovis subsp bovis AF2122/97
agcgggugccaucggugguggc

SEQ ID NO: 1215261 - RNA, 17 nt, Mycobacterium bovis subsp bovis AF2122/97
agcggguccccggucag

SEQ ID NO: 1215262 - RNA, 20 nt, Mycobacterium bovis subsp bovis AF2122/97
agcggcgcgaccgucuggag

SEQ ID NO: 1215263 - RNA, 14 nt, Mycobacterium bovis subsp bovis AF2122/97
agcggcgccgcccu

SEQ ID NO: 1215264 - RNA, 15 nt, Mycobacterium bovis subsp bovis AF2122/97
agcggcgcgggggug

SEQ ID NO: 1215265 - RNA, 17 nt, Mycobacterium bovis subsp bovis AF2122/97
agcggguuugccgggcg

SEQ ID NO: 1215266 - RNA, 14 nt, Mycobacterium bovis subsp bovis AF2122/97
agcgggugcgggcg

SEQ ID NO: 1215267 - RNA, 15 nt, Mycobacterium bovis subsp bovis AF2122/97
agcggguggccggga

SEQ ID NO: 1215268 - RNA, 23 nt, Mycobacterium bovis subsp bovis AF2122/97
agcgguaucccccagccgcggcg

SEQ ID NO: 1215269 - RNA, 14 nt, Mycobacterium bovis subsp bovis AF2122/97
agcgguaaugccag

SEQ ID NO: 1215270 - RNA, 24 nt, Mycobacterium bovis subsp bovis AF2122/97
agcggccugcucgggggccgacca

SEQ ID NO: 1215271 - RNA, 14 nt, Mycobacterium bovis subsp bovis AF2122/97
agcggccuccagca

SEQ ID NO: 1215272 - RNA, 15 nt, Mycobacterium bovis subsp bovis AF2122/97
agcggccuccagcac

SEQ ID NO: 1215273 - RNA, 16 nt, Mycobacterium bovis subsp bovis AF2122/97
agcggccuccagcacc

SEQ ID NO: 1215274 - RNA, 23 nt, Mycobacterium bovis subsp bovis AF2122/97
agcggccuccgggccaugugggg

SEQ ID NO: 1215275 - RNA, 17 nt, Mycobacterium bovis subsp bovis AF2122/97
agcggcgcauaggcggc

SEQ ID NO: 1215276 - RNA, 21 nt, Mycobacterium bovis subsp bovis AF2122/97
agcggcaucgcgggcggcgcu

SEQ ID NO: 1215277 - RNA, 16 nt, Mycobacterium bovis subsp bovis AF2122/97
agcggcaucggccagc

SEQ ID NO: 1215278 - RNA, 22 nt, Mycobacterium bovis subsp bovis AF2122/97
agcggcaucggccagccguucu

SEQ ID NO: 1215279 - RNA, 10 nt, Mycobacterium bovis subsp bovis AF2122/97
agcggccacc

SEQ ID NO: 1215280 - RNA, 13 nt, Mycobacterium bovis subsp bovis AF2122/97
agcggccaccgcc

SEQ ID NO: 1215281 - RNA, 18 nt, Mycobacterium bovis subsp bovis AF2122/97
agcggccaccgccgccgc

SEQ ID NO: 1215282 - RNA, 19 nt, Mycobacterium bovis subsp bovis AF2122/97
agcggcaugcagaucucac

SEQ ID NO: 1215283 - RNA, 12 nt, Mycobacterium bovis subsp bovis AF2122/97
agcggugcuggu

SEQ ID NO: 1215284 - RNA, 12 nt, Mycobacterium bovis subsp bovis AF2122/97
agcgguggacga

SEQ ID NO: 1215285 - RNA, 17 nt, Mycobacterium bovis subsp bovis AF2122/97
agcgguguugccggaga

SEQ ID NO: 1215286 - RNA, 17 nt, Mycobacterium bovis subsp bovis AF2122/97
agcggugccauuguaaa

SEQ ID NO: 1215287 - RNA, 17 nt, Mycobacterium bovis subsp bovis AF2122/97
agcggugaggugaccaa

SEQ ID NO: 1215288 - RNA, 15 nt, Mycobacterium bovis subsp bovis AF2122/97
agcggugaugggggu

SEQ ID NO: 1215289 - RNA, 13 nt, Mycobacterium bovis subsp bovis AF2122/97
agcggucggcggu

SEQ ID NO: 1215290 - RNA, 19 nt, Mycobacterium bovis subsp bovis AF2122/97
agcguacccaacggagugu

SEQ ID NO: 1215291 - RNA, 14 nt, Mycobacterium bovis subsp bovis AF2122/97
agcguaggccagcg

SEQ ID NO: 1215292 - RNA, 16 nt, Mycobacterium bovis subsp bovis AF2122/97
agcggcaccgcgccgg

SEQ ID NO: 1215293 - RNA, 22 nt, Mycobacterium bovis subsp bovis AF2122/97
agcggcagaugaauugccgggc

SEQ ID NO: 1215294 - RNA, 15 nt, Mycobacterium bovis subsp bovis AF2122/97
agcggcagcaccgca

SEQ ID NO: 1215295 - RNA, 18 nt, Mycobacterium bovis subsp bovis AF2122/97
agcggcagcaccgcacgg

SEQ ID NO: 1215296 - RNA, 17 nt, Mycobacterium bovis subsp bovis AF2122/97
agcggcacacccaucac

SEQ ID NO: 1215297 - RNA, 24 nt, Mycobacterium bovis subsp bovis AF2122/97
agcggcacaucaugggcgcugcca

SEQ ID NO: 1215298 - RNA, 18 nt, Mycobacterium bovis subsp bovis AF2122/97
agcggcacgaucggcagu

SEQ ID NO: 1215299 - RNA, 17 nt, Mycobacterium bovis subsp bovis AF2122/97
agcggcaaucgggucug

SEQ ID NO: 1215300 - RNA, 19 nt, Mycobacterium bovis subsp bovis AF2122/97
agcggcaauggccagcacc

SEQ ID NO: 1215301 - RNA, 12 nt, Mycobacterium bovis subsp bovis AF2122/97
agcggcacaccc

SEQ ID NO: 1215302 - RNA, 14 nt, Mycobacterium bovis subsp bovis AF2122/97
agcggcaaucgggu

SEQ ID NO: 1215303 - RNA, 19 nt, Mycobacterium bovis subsp bovis AF2122/97
agcggauucagcgucgcca

SEQ ID NO: 1215304 - RNA, 19 nt, Mycobacterium bovis subsp bovis AF2122/97
agcggauccgugucgcaga

SEQ ID NO: 1215305 - RNA, 16 nt, Mycobacterium bovis subsp bovis AF2122/97
agcggaucgcggucag

SEQ ID NO: 1215306 - RNA, 19 nt, Mycobacterium bovis subsp bovis AF2122/97
agcggaccaccgcucgcca

SEQ ID NO: 1215307 - RNA, 21 nt, Mycobacterium bovis subsp bovis AF2122/97
agcggacucgagucugcgcag

SEQ ID NO: 1215308 - RNA, 15 nt, Mycobacterium bovis subsp bovis AF2122/97
agcggagacugguug

SEQ ID NO: 1215309 - RNA, 23 nt, Mycobacterium bovis subsp bovis AF2122/97
agcggagccggcgcauaacacaa

SEQ ID NO: 1215310 - RNA, 16 nt, Mycobacterium bovis subsp bovis AF2122/97
agcggauccaggccuc

SEQ ID NO: 1215311 - RNA, 23 nt, Mycobacterium bovis subsp bovis AF2122/97
agcggaguaaacaaacccaacac

SEQ ID NO: 1215312 - RNA, 23 nt, Mycobacterium bovis subsp bovis AF2122/97
agcgcuuggucaaaaagcucggc

SEQ ID NO: 1215313 - RNA, 14 nt, Mycobacterium bovis subsp bovis AF2122/97
agcggaauggcgcc

SEQ ID NO: 1215314 - RNA, 15 nt, Mycobacterium bovis subsp bovis AF2122/97
agcggaagcgguuga

SEQ ID NO: 1215315 - RNA, 22 nt, Mycobacterium bovis subsp bovis AF2122/97
agcggaaaacccagaucggcga

SEQ ID NO: 1215316 - RNA, 18 nt, Mycobacterium bovis subsp bovis AF2122/97
agcgcuggcaggccgggc

SEQ ID NO: 1215317 - RNA, 21 nt, Mycobacterium bovis subsp bovis AF2122/97
agcgcuggcaggccgggcacc

SEQ ID NO: 1215318 - RNA, 13 nt, Mycobacterium bovis subsp bovis AF2122/97
agcgcugcucccg

SEQ ID NO: 1215319 - RNA, 16 nt, Mycobacterium bovis subsp bovis AF2122/97
agcgcucgugaccgaa

SEQ ID NO: 1215320 - RNA, 12 nt, Mycobacterium bovis subsp bovis AF2122/97
agcgcgaucacc

SEQ ID NO: 1215321 - RNA, 20 nt, Mycobacterium bovis subsp bovis AF2122/97
agcgcgcaacguacgcacgc

SEQ ID NO: 1215322 - RNA, 14 nt, Mycobacterium bovis subsp bovis AF2122/97
agcgcgaugaccuc

SEQ ID NO: 1215323 - RNA, 17 nt, Mycobacterium bovis subsp bovis AF2122/97
agcgcgaugcagugcga

SEQ ID NO: 1215324 - RNA, 21 nt, Mycobacterium bovis subsp bovis AF2122/97
agcgcgaucugcucgccccau

SEQ ID NO: 1215325 - RNA, 18 nt, Mycobacterium bovis subsp bovis AF2122/97
agcgcgaccgucaggguc

SEQ ID NO: 1215326 - RNA, 17 nt, Mycobacterium bovis subsp bovis AF2122/97
agcgcgaccgucagggu

SEQ ID NO: 1215327 - RNA, 14 nt, Mycobacterium bovis subsp bovis AF2122/97
agcgccggccaggc

SEQ ID NO: 1215328 - RNA, 22 nt, Mycobacterium bovis subsp bovis AF2122/97
agcgccggauggguggccagca

SEQ ID NO: 1215329 - RNA, 16 nt, Mycobacterium bovis subsp bovis AF2122/97
agcgccgcugacuccu

SEQ ID NO: 1215330 - RNA, 11 nt, Mycobacterium bovis subsp bovis AF2122/97
agcgccgccga

SEQ ID NO: 1215331 - RNA, 11 nt, Mycobacterium bovis subsp bovis AF2122/97
agcgccgccgc

SEQ ID NO: 1215332 - RNA, 15 nt, Mycobacterium bovis subsp bovis AF2122/97
agcgccgccgcgagc

SEQ ID NO: 1215333 - RNA, 19 nt, Mycobacterium bovis subsp bovis AF2122/97
agcgcguauggcucacccc

SEQ ID NO: 1215334 - RNA, 20 nt, Mycobacterium bovis subsp bovis AF2122/97
agcgcucgaucacggcggga

SEQ ID NO: 1215335 - RNA, 17 nt, Mycobacterium bovis subsp bovis AF2122/97
agcgcggugccgccacc

SEQ ID NO: 1215336 - RNA, 16 nt, Mycobacterium bovis subsp bovis AF2122/97
agcgcggugccgccac

SEQ ID NO: 1215337 - RNA, 16 nt, Mycobacterium bovis subsp bovis AF2122/97
agcgcgggccuggccc

SEQ ID NO: 1215338 - RNA, 14 nt, Mycobacterium bovis subsp bovis AF2122/97
agcgcggcaaccgu

SEQ ID NO: 1215339 - RNA, 18 nt, Mycobacterium bovis subsp bovis AF2122/97
agcgcgcuggccagcccg

SEQ ID NO: 1215340 - RNA, 22 nt, Mycobacterium bovis subsp bovis AF2122/97
agcgcgcuggcuacccaccggc

SEQ ID NO: 1215341 - RNA, 19 nt, Mycobacterium bovis subsp bovis AF2122/97
agcgcgccaaucgcccagu

SEQ ID NO: 1215342 - RNA, 17 nt, Mycobacterium bovis subsp bovis AF2122/97
agcgcgcgcgugaagaa

SEQ ID NO: 1215343 - RNA, 15 nt, Mycobacterium bovis subsp bovis AF2122/97
agcgcgccacccagc

SEQ ID NO: 1215344 - RNA, 17 nt, Mycobacterium bovis subsp bovis AF2122/97
agcgcgcguagcggggg

SEQ ID NO: 1215345 - RNA, 18 nt, Mycobacterium bovis subsp bovis AF2122/97
agcgcgcguagcggggga

SEQ ID NO: 1215346 - RNA, 16 nt, Mycobacterium bovis subsp bovis AF2122/97
agcgcgcuacgcggcc

SEQ ID NO: 1215347 - RNA, 14 nt, Mycobacterium bovis subsp bovis AF2122/97
agcgcgcucagguc

SEQ ID NO: 1215348 - RNA, 21 nt, Mycobacterium bovis subsp bovis AF2122/97
agcgcagucugauuccacauc

SEQ ID NO: 1215349 - RNA, 17 nt, Mycobacterium bovis subsp bovis AF2122/97
agcgcauguugcaggcg

SEQ ID NO: 1215350 - RNA, 22 nt, Mycobacterium bovis subsp bovis AF2122/97
agcgcauuuguugcugcugccg

SEQ ID NO: 1215351 - RNA, 13 nt, Mycobacterium bovis subsp bovis AF2122/97
agcgccaaggcga

SEQ ID NO: 1215352 - RNA, 19 nt, Mycobacterium bovis subsp bovis AF2122/97
agcgccaacgcccccaucc

SEQ ID NO: 1215353 - RNA, 15 nt, Mycobacterium bovis subsp bovis AF2122/97
agcgcccggucacgc

SEQ ID NO: 1215354 - RNA, 19 nt, Mycobacterium bovis subsp bovis AF2122/97
agcgcccggccacuccagu

SEQ ID NO: 1215355 - RNA, 23 nt, Mycobacterium bovis subsp bovis AF2122/97
agcgcccggauguccgccgacgu

SEQ ID NO: 1215356 - RNA, 16 nt, Mycobacterium bovis subsp bovis AF2122/97
agcgccccuggcaccu

SEQ ID NO: 1215357 - RNA, 17 nt, Mycobacterium bovis subsp bovis AF2122/97
agcgccacgccgaggcg

SEQ ID NO: 1215358 - RNA, 19 nt, Mycobacterium bovis subsp bovis AF2122/97
agcgcaggguucgucggga

SEQ ID NO: 1215359 - RNA, 14 nt, Mycobacterium bovis subsp bovis AF2122/97
agcgcaggaccuga

SEQ ID NO: 1215360 - RNA, 21 nt, Mycobacterium bovis subsp bovis AF2122/97
agcgcagcaucgucgccacga

SEQ ID NO: 1215361 - RNA, 21 nt, Mycobacterium bovis subsp bovis AF2122/97
agcgcagcauugaccaaucca

SEQ ID NO: 1215362 - RNA, 12 nt, Mycobacterium bovis subsp bovis AF2122/97
agcgcagcagcg

SEQ ID NO: 1215363 - RNA, 14 nt, Mycobacterium bovis subsp bovis AF2122/97
agcgcagccaggcu

SEQ ID NO: 1215364 - RNA, 15 nt, Mycobacterium bovis subsp bovis AF2122/97
agcgcacugccgggu

SEQ ID NO: 1215365 - RNA, 21 nt, Mycobacterium bovis subsp bovis AF2122/97
agcgcagcaacugggcggccu

SEQ ID NO: 1215366 - RNA, 14 nt, Mycobacterium bovis subsp bovis AF2122/97
agcgaccgcugcag

SEQ ID NO: 1215367 - RNA, 21 nt, Mycobacterium bovis subsp bovis AF2122/97
agcgaccuagcagcgcugcga

SEQ ID NO: 1215368 - RNA, 23 nt, Mycobacterium bovis subsp bovis AF2122/97
agcgaccgucccagcgccgcagu

SEQ ID NO: 1215369 - RNA, 18 nt, Mycobacterium bovis subsp bovis AF2122/97
agcgaccgucguccagac

SEQ ID NO: 1215370 - RNA, 23 nt, Mycobacterium bovis subsp bovis AF2122/97
agcgacgaccacaccacgauggc

SEQ ID NO: 1215371 - RNA, 23 nt, Mycobacterium bovis subsp bovis AF2122/97
agcgacgcauaaccggcgcgccc

SEQ ID NO: 1215372 - RNA, 23 nt, Mycobacterium bovis subsp bovis AF2122/97
agcgcacggaccaucgccaggcc

SEQ ID NO: 1215373 - RNA, 22 nt, Mycobacterium bovis subsp bovis AF2122/97
agaauucguucagcgccagcgc

SEQ ID NO: 1215374 - RNA, 22 nt, Mycobacterium bovis subsp bovis AF2122/97
agacccaccaccgcaaccaaag

SEQ ID NO: 1215375 - RNA, 19 nt, Mycobacterium bovis subsp bovis AF2122/97
agaccggcgggcagauggu

SEQ ID NO: 1215376 - RNA, 16 nt, Mycobacterium bovis subsp bovis AF2122/97
agaccgggcaccagaa

SEQ ID NO: 1215377 - RNA, 21 nt, Mycobacterium bovis subsp bovis AF2122/97
agaccgguuucuucggccagc

SEQ ID NO: 1215378 - RNA, 14 nt, Mycobacterium bovis subsp bovis AF2122/97
agaccguccagcaa

SEQ ID NO: 1215379 - RNA, 19 nt, Mycobacterium bovis subsp bovis AF2122/97
agaccguccagcaacagcg

SEQ ID NO: 1215380 - RNA, 19 nt, Mycobacterium bovis subsp bovis AF2122/97
agacccgaauccaccagcu

SEQ ID NO: 1215381 - RNA, 23 nt, Mycobacterium bovis subsp bovis AF2122/97
agacccuggccgucccaccagcc

SEQ ID NO: 1215382 - RNA, 21 nt, Mycobacterium bovis subsp bovis AF2122/97
agacccugggguccagcgucc

SEQ ID NO: 1215383 - RNA, 16 nt, Mycobacterium bovis subsp bovis AF2122/97
agacgaucgccaggcc

SEQ ID NO: 1215384 - RNA, 19 nt, Mycobacterium bovis subsp bovis AF2122/97
agacgcugcccaaaagcgc

SEQ ID NO: 1215385 - RNA, 18 nt, Mycobacterium bovis subsp bovis AF2122/97
agacgcucuugaauagga

SEQ ID NO: 1215386 - RNA, 22 nt, Mycobacterium bovis subsp bovis AF2122/97
agacgcgggucuuggcacacag

SEQ ID NO: 1215387 - RNA, 16 nt, Mycobacterium bovis subsp bovis AF2122/97
agacgcucgaccugcc

SEQ ID NO: 1215388 - RNA, 15 nt, Mycobacterium bovis subsp bovis AF2122/97
agacgacgaucagcc

SEQ ID NO: 1215389 - RNA, 17 nt, Mycobacterium bovis subsp bovis AF2122/97
agaccuagcaccgcgcc

SEQ ID NO: 1215390 - RNA, 21 nt, Mycobacterium bovis subsp bovis AF2122/97
agaccucggcgugucugcccg

SEQ ID NO: 1215391 - RNA, 11 nt, Mycobacterium bovis subsp bovis AF2122/97
agaccuucuug

SEQ ID NO: 1215392 - RNA, 12 nt, Mycobacterium bovis subsp bovis AF2122/97
agacuccagcaa

SEQ ID NO: 1215393 - RNA, 17 nt, Mycobacterium bovis subsp bovis AF2122/97
agacuccguugccaccu

SEQ ID NO: 1215394 - RNA, 19 nt, Mycobacterium bovis subsp bovis AF2122/97
agacuagccgauccagcag

SEQ ID NO: 1215395 - RNA, 13 nt, Mycobacterium bovis subsp bovis AF2122/97
agacggcaccccc

SEQ ID NO: 1215396 - RNA, 18 nt, Mycobacterium bovis subsp bovis AF2122/97
agacgcuguccaggucug

SEQ ID NO: 1215397 - RNA, 22 nt, Mycobacterium bovis subsp bovis AF2122/97
agacugggcgcuggaggccacc

SEQ ID NO: 1215398 - RNA, 14 nt, Mycobacterium bovis subsp bovis AF2122/97
agacucgcggucga

SEQ ID NO: 1215399 - RNA, 14 nt, Mycobacterium bovis subsp bovis AF2122/97
agagcgucgaacac

SEQ ID NO: 1215400 - RNA, 14 nt, Mycobacterium bovis subsp bovis AF2122/97
agagccgcugcggc

SEQ ID NO: 1215401 - RNA, 23 nt, Mycobacterium bovis subsp bovis AF2122/97
agagcucgaaguuggcuuucggu

SEQ ID NO: 1215402 - RNA, 21 nt, Mycobacterium bovis subsp bovis AF2122/97
agagcucugguuuuacacacc

SEQ ID NO: 1215403 - RNA, 14 nt, Mycobacterium bovis subsp bovis AF2122/97
agagccccgaccag

SEQ ID NO: 1215404 - RNA, 17 nt, Mycobacterium bovis subsp bovis AF2122/97
agagccccgaccagcag

SEQ ID NO: 1215405 - RNA, 18 nt, Mycobacterium bovis subsp bovis AF2122/97
agagccccgaccagcaga

SEQ ID NO: 1215406 - RNA, 18 nt, Mycobacterium bovis subsp bovis AF2122/97
agagcaugguccagcaca

SEQ ID NO: 1215407 - RNA, 21 nt, Mycobacterium bovis subsp bovis AF2122/97
agagcaugguccagcacaucg

SEQ ID NO: 1215408 - RNA, 15 nt, Mycobacterium bovis subsp bovis AF2122/97
agacuugcugcuccu

SEQ ID NO: 1215409 - RNA, 18 nt, Mycobacterium bovis subsp bovis AF2122/97
agagacguacugggcgau

SEQ ID NO: 1215410 - RNA, 18 nt, Mycobacterium bovis subsp bovis AF2122/97
agagacaugucgcugccg

SEQ ID NO: 1215411 - RNA, 11 nt, Mycobacterium bovis subsp bovis AF2122/97
agagaccaagg

SEQ ID NO: 1215412 - RNA, 19 nt, Mycobacterium bovis subsp bovis AF2122/97
agaucuccccgaccgcgcc

SEQ ID NO: 1215413 - RNA, 20 nt, Mycobacterium bovis subsp bovis AF2122/97
agaucucacgugcccgcgcg

SEQ ID NO: 1215414 - RNA, 22 nt, Mycobacterium bovis subsp bovis AF2122/97
agaucucugagcgggcgggccu

SEQ ID NO: 1215415 - RNA, 15 nt, Mycobacterium bovis subsp bovis AF2122/97
agaucuucgccgaga

SEQ ID NO: 1215416 - RNA, 16 nt, Mycobacterium bovis subsp bovis AF2122/97
agaucugggcuggcag

SEQ ID NO: 1215417 - RNA, 23 nt, Mycobacterium bovis subsp bovis AF2122/97
agaucuucaccggccggugccag

SEQ ID NO: 1215418 - RNA, 21 nt, Mycobacterium bovis subsp bovis AF2122/97
agaucggccggauacgggcug

SEQ ID NO: 1215419 - RNA, 19 nt, Mycobacterium bovis subsp bovis AF2122/97
agaucgcgugccacagcau

SEQ ID NO: 1215420 - RNA, 21 nt, Mycobacterium bovis subsp bovis AF2122/97
agaucgcguggaucgcgcuca

SEQ ID NO: 1215421 - RNA, 21 nt, Mycobacterium bovis subsp bovis AF2122/97
agaucgucgacccaccaugug

SEQ ID NO: 1215422 - RNA, 12 nt, Mycobacterium bovis subsp bovis AF2122/97
agaucgccgagc

SEQ ID NO: 1215423 - RNA, 17 nt, Mycobacterium bovis subsp bovis AF2122/97
agaucgcccgaguugaa

SEQ ID NO: 1215424 - RNA, 20 nt, Mycobacterium bovis subsp bovis AF2122/97
agaucgcccgaguugaagaa

SEQ ID NO: 1215425 - RNA, 12 nt, Mycobacterium bovis subsp bovis AF2122/97
agaucgccccag

SEQ ID NO: 1215426 - RNA, 16 nt, Mycobacterium bovis subsp bovis AF2122/97
agaucgccugggggua

SEQ ID NO: 1215427 - RNA, 24 nt, Mycobacterium bovis subsp bovis AF2122/97
agaucgacuucauagcgccggagu

SEQ ID NO: 1215428 - RNA, 16 nt, Mycobacterium bovis subsp bovis AF2122/97
agaucgagaucaccuu

SEQ ID NO: 1215429 - RNA, 17 nt, Mycobacterium bovis subsp bovis AF2122/97
agaucccaguccgaugg

SEQ ID NO: 1215430 - RNA, 14 nt, Mycobacterium bovis subsp bovis AF2122/97
agauccccaaaucg

SEQ ID NO: 1215431 - RNA, 14 nt, Mycobacterium bovis subsp bovis AF2122/97
agaucaccgccagc

SEQ ID NO: 1215432 - RNA, 19 nt, Mycobacterium bovis subsp bovis AF2122/97
agauccuuaucgcucucgg

SEQ ID NO: 1215433 - RNA, 18 nt, Mycobacterium bovis subsp bovis AF2122/97
agauccguccgcuggugg

SEQ ID NO: 1215434 - RNA, 19 nt, Mycobacterium bovis subsp bovis AF2122/97
agauccgcagcgucuugau

SEQ ID NO: 1215435 - RNA, 17 nt, Mycobacterium bovis subsp bovis AF2122/97
agaugauuucgccgagc

SEQ ID NO: 1215436 - RNA, 19 nt, Mycobacterium bovis subsp bovis AF2122/97
agaugcacgucgagcaggc

SEQ ID NO: 1215437 - RNA, 20 nt, Mycobacterium bovis subsp bovis AF2122/97
agaugcaccugcgaggugcc

SEQ ID NO: 1215438 - RNA, 14 nt, Mycobacterium bovis subsp bovis AF2122/97
agaugcgugcggca

SEQ ID NO: 1215439 - RNA, 18 nt, Mycobacterium bovis subsp bovis AF2122/97
agaugcgugcggcagugc

SEQ ID NO: 1215440 - RNA, 18 nt, Mycobacterium bovis subsp bovis AF2122/97
agaucuuuucaccaccuc

SEQ ID NO: 1215441 - RNA, 22 nt, Mycobacterium bovis subsp bovis AF2122/97
agaugaacuucccacccggccu

SEQ ID NO: 1215442 - RNA, 20 nt, Mycobacterium bovis subsp bovis AF2122/97
agaugaucgcgaacaucgcc

SEQ ID NO: 1215443 - RNA, 13 nt, Mycobacterium bovis subsp bovis AF2122/97
agaugaaggugac

SEQ ID NO: 1215444 - RNA, 14 nt, Mycobacterium bovis subsp bovis AF2122/97
agaugaaggugacg

SEQ ID NO: 1215445 - RNA, 14 nt, Mycobacterium bovis subsp bovis AF2122/97
agaugggccuccac

SEQ ID NO: 1215446 - RNA, 23 nt, Mycobacterium bovis subsp bovis AF2122/97
agaugggauaccccuccgaucac

SEQ ID NO: 1215447 - RNA, 18 nt, Mycobacterium bovis subsp bovis AF2122/97
agauggggugacgcaccc

SEQ ID NO: 1215448 - RNA, 19 nt, Mycobacterium bovis subsp bovis AF2122/97
agauguugcgacggccggc

SEQ ID NO: 1215449 - RNA, 15 nt, Mycobacterium bovis subsp bovis AF2122/97
aaaaccacccccacc

SEQ ID NO: 1215450 - RNA, 17 nt, Mycobacterium bovis subsp bovis AF2122/97
agauacccgcggcagca

SEQ ID NO: 1215451 - RNA, 20 nt, Mycobacterium bovis subsp bovis AF2122/97
agaacgucaaacccagcgac

SEQ ID NO: 1215452 - RNA, 18 nt, Mycobacterium bovis subsp bovis AF2122/97
agaacggcguugcggaau

SEQ ID NO: 1215453 - RNA, 18 nt, Mycobacterium bovis subsp bovis AF2122/97
agaacguggccguuaauu

SEQ ID NO: 1215454 - RNA, 15 nt, Mycobacterium bovis subsp bovis AF2122/97
agaagacaccgcgcu

SEQ ID NO: 1215455 - RNA, 15 nt, Mycobacterium bovis subsp bovis AF2122/97
agaagaagcccagga

SEQ ID NO: 1215456 - RNA, 22 nt, Mycobacterium bovis subsp bovis AF2122/97
agaacgcaucggucccacugcc

SEQ ID NO: 1215457 - RNA, 15 nt, Mycobacterium bovis subsp bovis AF2122/97
agaaaucaaauccuu

SEQ ID NO: 1215458 - RNA, 16 nt, Mycobacterium bovis subsp bovis AF2122/97
agaaacggcgacucga

SEQ ID NO: 1215459 - RNA, 17 nt, Mycobacterium bovis subsp bovis AF2122/97
agaagucgcagcgagga

SEQ ID NO: 1215460 - RNA, 21 nt, Mycobacterium bovis subsp bovis AF2122/97
agaagucgaucgccgaggcag

SEQ ID NO: 1215461 - RNA, 19 nt, Mycobacterium bovis subsp bovis AF2122/97
agaagugcucacauccggu

SEQ ID NO: 1215462 - RNA, 18 nt, Mycobacterium bovis subsp bovis AF2122/97
agaaguucuucgcgaaga

SEQ ID NO: 1215463 - RNA, 14 nt, Mycobacterium bovis subsp bovis AF2122/97
agaagcccaggacg

SEQ ID NO: 1215464 - RNA, 15 nt, Mycobacterium bovis subsp bovis AF2122/97
agaagccggccacua

SEQ ID NO: 1215465 - RNA, 14 nt, Mycobacterium bovis subsp bovis AF2122/97
agaaucagcagcag

SEQ ID NO: 1215466 - RNA, 15 nt, Mycobacterium bovis subsp bovis AF2122/97
acuuugggucggcga

SEQ ID NO: 1215467 - RNA, 19 nt, Mycobacterium bovis subsp bovis AF2122/97
acuuucgcccagucgccgc

SEQ ID NO: 1215468 - RNA, 19 nt, Mycobacterium bovis subsp bovis AF2122/97
acuuuucgagugugaacug

SEQ ID NO: 1215469 - RNA, 22 nt, Mycobacterium bovis subsp bovis AF2122/97
acuuuucgguggcggcagcagc

SEQ ID NO: 1215470 - RNA, 19 nt, Mycobacterium bovis subsp bovis AF2122/97
acuugugccacuucuucac

SEQ ID NO: 1215471 - RNA, 17 nt, Mycobacterium bovis subsp bovis AF2122/97
acuuguugaccuccucc

SEQ ID NO: 1215472 - RNA, 21 nt, Mycobacterium bovis subsp bovis AF2122/97
acuugccgggcaaucgcucug

SEQ ID NO: 1215473 - RNA, 23 nt, Mycobacterium bovis subsp bovis AF2122/97
acuugccggugcgcaccagcaca

SEQ ID NO: 1215474 - RNA, 13 nt, Mycobacterium bovis subsp bovis AF2122/97
acuugcacgcugu

SEQ ID NO: 1215475 - RNA, 21 nt, Mycobacterium bovis subsp bovis AF2122/97
acuuggcugcgagagcaccga

SEQ ID NO: 1215476 - RNA, 13 nt, Mycobacterium bovis subsp bovis AF2122/97
accaaacgcugcu

SEQ ID NO: 1215477 - RNA, 20 nt, Mycobacterium bovis subsp bovis AF2122/97
accaaagcgacgagcagcaa

SEQ ID NO: 1215478 - RNA, 20 nt, Mycobacterium bovis subsp bovis AF2122/97
accaacacccccccccccac

SEQ ID NO: 1215479 - RNA, 17 nt, Mycobacterium bovis subsp bovis AF2122/97
accaacauacagcaauc

SEQ ID NO: 1215480 - RNA, 14 nt, Mycobacterium bovis subsp bovis AF2122/97
accaacaccgcccg

SEQ ID NO: 1215481 - RNA, 13 nt, Mycobacterium bovis subsp bovis AF2122/97
acaucggugccac

SEQ ID NO: 1215482 - RNA, 19 nt, Mycobacterium bovis subsp bovis AF2122/97
acaucggcccgaucaccau

SEQ ID NO: 1215483 - RNA, 14 nt, Mycobacterium bovis subsp bovis AF2122/97
acaucgggccgccg

SEQ ID NO: 1215484 - RNA, 15 nt, Mycobacterium bovis subsp bovis AF2122/97
acauccuggcggcug

SEQ ID NO: 1215485 - RNA, 19 nt, Mycobacterium bovis subsp bovis AF2122/97
acaucgcgggcgugccgac

SEQ ID NO: 1215486 - RNA, 16 nt, Mycobacterium bovis subsp bovis AF2122/97
acauccugcagcucgg

SEQ ID NO: 1215487 - RNA, 22 nt, Mycobacterium bovis subsp bovis AF2122/97
acauccugcagcucgggcaggg

SEQ ID NO: 1215488 - RNA, 13 nt, Mycobacterium bovis subsp bovis AF2122/97
acauccgcacugg

SEQ ID NO: 1215489 - RNA, 21 nt, Mycobacterium bovis subsp bovis AF2122/97
acauccaacgaccuccacgcc

SEQ ID NO: 1215490 - RNA, 14 nt, Mycobacterium bovis subsp bovis AF2122/97
acaucaccaaaaac

SEQ ID NO: 1215491 - RNA, 23 nt, Mycobacterium bovis subsp bovis AF2122/97
acaucuccgcgucggucagcugu

SEQ ID NO: 1215492 - RNA, 12 nt, Mycobacterium bovis subsp bovis AF2122/97
acaucuggucac

SEQ ID NO: 1215493 - RNA, 17 nt, Mycobacterium bovis subsp bovis AF2122/97
acaucugacagcugggu

SEQ ID NO: 1215494 - RNA, 13 nt, Mycobacterium bovis subsp bovis AF2122/97
acaugcgccgaga

SEQ ID NO: 1215495 - RNA, 13 nt, Mycobacterium bovis subsp bovis AF2122/97
acaugaccgacag

SEQ ID NO: 1215496 - RNA, 18 nt, Mycobacterium bovis subsp bovis AF2122/97
acaugaccgacaggugcu

SEQ ID NO: 1215497 - RNA, 16 nt, Mycobacterium bovis subsp bovis AF2122/97
acauggugaccauggc

SEQ ID NO: 1215498 - RNA, 18 nt, Mycobacterium bovis subsp bovis AF2122/97
acauggugaccauggccg

SEQ ID NO: 1215499 - RNA, 15 nt, Mycobacterium bovis subsp bovis AF2122/97
acaugucacacccac

SEQ ID NO: 1215500 - RNA, 16 nt, Mycobacterium bovis subsp bovis AF2122/97
acaugugggugaacac

SEQ ID NO: 1215501 - RNA, 14 nt, Mycobacterium bovis subsp bovis AF2122/97
acaugucacaccca

SEQ ID NO: 1215502 - RNA, 21 nt, Mycobacterium bovis subsp bovis AF2122/97
acagguguuggacgccuugca

SEQ ID NO: 1215503 - RNA, 21 nt, Mycobacterium bovis subsp bovis AF2122/97
acaggugccagaccagggcag

SEQ ID NO: 1215504 - RNA, 22 nt, Mycobacterium bovis subsp bovis AF2122/97
acaggugcaggucgugcuccca

SEQ ID NO: 1215505 - RNA, 16 nt, Mycobacterium bovis subsp bovis AF2122/97
acaggucagcgcugcc

SEQ ID NO: 1215506 - RNA, 16 nt, Mycobacterium bovis subsp bovis AF2122/97
acaggggccagcgcgc

SEQ ID NO: 1215507 - RNA, 21 nt, Mycobacterium bovis subsp bovis AF2122/97
acagguaagcagccagcaaca

SEQ ID NO: 1215508 - RNA, 19 nt, Mycobacterium bovis subsp bovis AF2122/97
acaguaggccuccgcugcc

SEQ ID NO: 1215509 - RNA, 15 nt, Mycobacterium bovis subsp bovis AF2122/97
acagucggugcagcg

SEQ ID NO: 1215510 - RNA, 14 nt, Mycobacterium bovis subsp bovis AF2122/97
acagugucugccau

SEQ ID NO: 1215511 - RNA, 14 nt, Mycobacterium bovis subsp bovis AF2122/97
acaguucugccuua

SEQ ID NO: 1215512 - RNA, 20 nt, Mycobacterium bovis subsp bovis AF2122/97
acaguugcccgacgccgguc

SEQ ID NO: 1215513 - RNA, 17 nt, Mycobacterium bovis subsp bovis AF2122/97
acagugacgccacgacc

SEQ ID NO: 1215514 - RNA, 21 nt, Mycobacterium bovis subsp bovis AF2122/97
acagugcgcggaucaacaggc

SEQ ID NO: 1215515 - RNA, 16 nt, Mycobacterium bovis subsp bovis AF2122/97
acaguggugggcguga

SEQ ID NO: 1215516 - RNA, 21 nt, Mycobacterium bovis subsp bovis AF2122/97
acagugucgauagcccgccac

SEQ ID NO: 1215517 - RNA, 20 nt, Mycobacterium bovis subsp bovis AF2122/97
acaggcuggcgauggccguc

SEQ ID NO: 1215518 - RNA, 13 nt, Mycobacterium bovis subsp bovis AF2122/97
acaggcugcugcg

SEQ ID NO: 1215519 - RNA, 20 nt, Mycobacterium bovis subsp bovis AF2122/97
acaggcugccauuccagauc

SEQ ID NO: 1215520 - RNA, 15 nt, Mycobacterium bovis subsp bovis AF2122/97
acaggcgacacauug

SEQ ID NO: 1215521 - RNA, 16 nt, Mycobacterium bovis subsp bovis AF2122/97
acaggcgcccacaaau

SEQ ID NO: 1215522 - RNA, 15 nt, Mycobacterium bovis subsp bovis AF2122/97
acagcgaguucugga

SEQ ID NO: 1215523 - RNA, 14 nt, Mycobacterium bovis subsp bovis AF2122/97
acagcgaaccgccg

SEQ ID NO: 1215524 - RNA, 14 nt, Mycobacterium bovis subsp bovis AF2122/97
acagcgacgagauc

SEQ ID NO: 1215525 - RNA, 15 nt, Mycobacterium bovis subsp bovis AF2122/97
acagcgccaugcccu

SEQ ID NO: 1215526 - RNA, 17 nt, Mycobacterium bovis subsp bovis AF2122/97
acagcgccuuguuggcg

SEQ ID NO: 1215527 - RNA, 18 nt, Mycobacterium bovis subsp bovis AF2122/97
acagcgcagccugcagcg

SEQ ID NO: 1215528 - RNA, 21 nt, Mycobacterium bovis subsp bovis AF2122/97
acagcuaucccaggggcaccg

SEQ ID NO: 1215529 - RNA, 22 nt, Mycobacterium bovis subsp bovis AF2122/97
acagcucacgcugaagccgcug

SEQ ID NO: 1215530 - RNA, 22 nt, Mycobacterium bovis subsp bovis AF2122/97
acagcucgccgugaccaggugc

SEQ ID NO: 1215531 - RNA, 23 nt, Mycobacterium bovis subsp bovis AF2122/97
acagcuuggacgugguguaucga

SEQ ID NO: 1215532 - RNA, 15 nt, Mycobacterium bovis subsp bovis AF2122/97
acagccaguguugca

SEQ ID NO: 1215533 - RNA, 22 nt, Mycobacterium bovis subsp bovis AF2122/97
acagcacagcgcagccugcagc

SEQ ID NO: 1215534 - RNA, 14 nt, Mycobacterium bovis subsp bovis AF2122/97
acacgugggugauc

SEQ ID NO: 1215535 - RNA, 14 nt, Mycobacterium bovis subsp bovis AF2122/97
acacguaccgacag

SEQ ID NO: 1215536 - RNA, 13 nt, Mycobacterium bovis subsp bovis AF2122/97
acacgucgagcag

SEQ ID NO: 1215537 - RNA, 15 nt, Mycobacterium bovis subsp bovis AF2122/97
acacguccaguggca

SEQ ID NO: 1215538 - RNA, 18 nt, Mycobacterium bovis subsp bovis AF2122/97
acacggcucgccggcucg

SEQ ID NO: 1215539 - RNA, 18 nt, Mycobacterium bovis subsp bovis AF2122/97
acaaucacauagccgguc

SEQ ID NO: 1215540 - RNA, 13 nt, Mycobacterium bovis subsp bovis AF2122/97
acaaucaccgccg

SEQ ID NO: 1215541 - RNA, 14 nt, Mycobacterium bovis subsp bovis AF2122/97
acaacgacaacacc

SEQ ID NO: 1215542 - RNA, 13 nt, Mycobacterium bovis subsp bovis AF2122/97
acaacgacacgcc

SEQ ID NO: 1215543 - RNA, 15 nt, Mycobacterium bovis subsp bovis AF2122/97
acaacgccaggaacc

SEQ ID NO: 1215544 - RNA, 13 nt, Mycobacterium bovis subsp bovis AF2122/97
acaacgcccacca

SEQ ID NO: 1215545 - RNA, 17 nt, Mycobacterium bovis subsp bovis AF2122/97
acaacgcccaccacgcg

SEQ ID NO: 1215546 - RNA, 17 nt, Mycobacterium bovis subsp bovis AF2122/97
acaaggggcagcacguc

SEQ ID NO: 1215547 - RNA, 13 nt, Mycobacterium bovis subsp bovis AF2122/97
acaccuccugccu

SEQ ID NO: 1215548 - RNA, 15 nt, Mycobacterium bovis subsp bovis AF2122/97
acaccuccugccuuu

SEQ ID NO: 1215549 - RNA, 19 nt, Mycobacterium bovis subsp bovis AF2122/97
acaccucgaaggcacugcg

SEQ ID NO: 1215550 - RNA, 23 nt, Mycobacterium bovis subsp bovis AF2122/97
acaccuguaguucgaugacugaa

SEQ ID NO: 1215551 - RNA, 18 nt, Mycobacterium bovis subsp bovis AF2122/97
acaccuuggcggucggca

SEQ ID NO: 1215552 - RNA, 23 nt, Mycobacterium bovis subsp bovis AF2122/97
acaccuuggccgccggccgcgca

SEQ ID NO: 1215553 - RNA, 21 nt, Mycobacterium bovis subsp bovis AF2122/97
acaccggcaagccacgccggu

SEQ ID NO: 1215554 - RNA, 18 nt, Mycobacterium bovis subsp bovis AF2122/97
acaccggcuuugcuugcc

SEQ ID NO: 1215555 - RNA, 16 nt, Mycobacterium bovis subsp bovis AF2122/97
acaccggugucggcca

SEQ ID NO: 1215556 - RNA, 22 nt, Mycobacterium bovis subsp bovis AF2122/97
acaccggugucggccagcaacu

SEQ ID NO: 1215557 - RNA, 21 nt, Mycobacterium bovis subsp bovis AF2122/97
acaccggcacugcccagcaga

SEQ ID NO: 1215558 - RNA, 22 nt, Mycobacterium bovis subsp bovis AF2122/97
acaccgucgcgcucgcaccacc

SEQ ID NO: 1215559 - RNA, 19 nt, Mycobacterium bovis subsp bovis AF2122/97
acaccguccgucggcgcuc

SEQ ID NO: 1215560 - RNA, 18 nt, Mycobacterium bovis subsp bovis AF2122/97
acaccgugcaccagcuca

SEQ ID NO: 1215561 - RNA, 19 nt, Mycobacterium bovis subsp bovis AF2122/97
acaccgugaccgccgcgcc

SEQ ID NO: 1215562 - RNA, 16 nt, Mycobacterium bovis subsp bovis AF2122/97
acaccgugucgccggc

SEQ ID NO: 1215563 - RNA, 17 nt, Mycobacterium bovis subsp bovis AF2122/97
acacggcggcccgcucg

SEQ ID NO: 1215564 - RNA, 14 nt, Mycobacterium bovis subsp bovis AF2122/97
acacggcagcugca

SEQ ID NO: 1215565 - RNA, 16 nt, Mycobacterium bovis subsp bovis AF2122/97
acacgccguuggggcc

SEQ ID NO: 1215566 - RNA, 13 nt, Mycobacterium bovis subsp bovis AF2122/97
acacgccagguga

SEQ ID NO: 1215567 - RNA, 18 nt, Mycobacterium bovis subsp bovis AF2122/97
acacgccgaacgugcaac

SEQ ID NO: 1215568 - RNA, 17 nt, Mycobacterium bovis subsp bovis AF2122/97
acacgaucuugcggaag

SEQ ID NO: 1215569 - RNA, 18 nt, Mycobacterium bovis subsp bovis AF2122/97
acacgaauccggccacuc

SEQ ID NO: 1215570 - RNA, 14 nt, Mycobacterium bovis subsp bovis AF2122/97
acacaugccgcagg

SEQ ID NO: 1215571 - RNA, 13 nt, Mycobacterium bovis subsp bovis AF2122/97
acacauugaccag

SEQ ID NO: 1215572 - RNA, 11 nt, Mycobacterium bovis subsp bovis AF2122/97
acaccaacacc

SEQ ID NO: 1215573 - RNA, 23 nt, Mycobacterium bovis subsp bovis AF2122/97
acacaacgacgaauaaguacucu

SEQ ID NO: 1215574 - RNA, 17 nt, Mycobacterium bovis subsp bovis AF2122/97
acaccgcggcggcgcgu

SEQ ID NO: 1215575 - RNA, 21 nt, Mycobacterium bovis subsp bovis AF2122/97
acaccgcgccgacgaaaucgu

SEQ ID NO: 1215576 - RNA, 22 nt, Mycobacterium bovis subsp bovis AF2122/97
acaccgcggacccgcagcugcg

SEQ ID NO: 1215577 - RNA, 16 nt, Mycobacterium bovis subsp bovis AF2122/97
acaccgcggcaagagu

SEQ ID NO: 1215578 - RNA, 17 nt, Mycobacterium bovis subsp bovis AF2122/97
acaccgcgcccgccgau

SEQ ID NO: 1215579 - RNA, 19 nt, Mycobacterium bovis subsp bovis AF2122/97
acaccgcgcccgccgaucc

SEQ ID NO: 1215580 - RNA, 13 nt, Mycobacterium bovis subsp bovis AF2122/97
acaccgcaggugc

SEQ ID NO: 1215581 - RNA, 17 nt, Mycobacterium bovis subsp bovis AF2122/97
acaccgcauaaggccca

SEQ ID NO: 1215582 - RNA, 13 nt, Mycobacterium bovis subsp bovis AF2122/97
acaccgcccggcc

SEQ ID NO: 1215583 - RNA, 23 nt, Mycobacterium bovis subsp bovis AF2122/97
acacccgcgaacgcgacagccac

SEQ ID NO: 1215584 - RNA, 13 nt, Mycobacterium bovis subsp bovis AF2122/97
acaccgagcaccu

SEQ ID NO: 1215585 - RNA, 18 nt, Mycobacterium bovis subsp bovis AF2122/97
acaccgaucggacgucgu

SEQ ID NO: 1215586 - RNA, 16 nt, Mycobacterium bovis subsp bovis AF2122/97
acaccaccagcacgcu

SEQ ID NO: 1215587 - RNA, 13 nt, Mycobacterium bovis subsp bovis AF2122/97
acaccaccgccag

SEQ ID NO: 1215588 - RNA, 19 nt, Mycobacterium bovis subsp bovis AF2122/97
acacccaaaccggcccgca

SEQ ID NO: 1215589 - RNA, 21 nt, Mycobacterium bovis subsp bovis AF2122/97
acaacagccgcucgcacagcc

SEQ ID NO: 1215590 - RNA, 12 nt, Mycobacterium bovis subsp bovis AF2122/97
acaacaacacgg

SEQ ID NO: 1215591 - RNA, 16 nt, Mycobacterium bovis subsp bovis AF2122/97
acaacccaacaaaagg

SEQ ID NO: 1215592 - RNA, 16 nt, Mycobacterium bovis subsp bovis AF2122/97
acaaccgcugcugcug

SEQ ID NO: 1215593 - RNA, 19 nt, Mycobacterium bovis subsp bovis AF2122/97
acaaccgcugcugcugccc

SEQ ID NO: 1215594 - RNA, 18 nt, Mycobacterium bovis subsp bovis AF2122/97
acaaccgugagcaccagc

SEQ ID NO: 1215595 - RNA, 19 nt, Mycobacterium bovis subsp bovis AF2122/97
acaaccgugagcaccagca

SEQ ID NO: 1215596 - RNA, 22 nt, Mycobacterium bovis subsp bovis AF2122/97
acaaccgugagcaccagcagca

SEQ ID NO: 1215597 - RNA, 15 nt, Mycobacterium bovis subsp bovis AF2122/97
acaacaucacugccu

SEQ ID NO: 1215598 - RNA, 14 nt, Mycobacterium bovis subsp bovis AF2122/97
acaaccacccaccc

SEQ ID NO: 1215599 - RNA, 21 nt, Mycobacterium bovis subsp bovis AF2122/97
acaaagguaccgcuggaaaau

SEQ ID NO: 1215600 - RNA, 21 nt, Mycobacterium bovis subsp bovis AF2122/97
acaaaguucgacgagaagaca

SEQ ID NO: 1215601 - RNA, 14 nt, Mycobacterium bovis subsp bovis AF2122/97
acaaagcugcucgu

SEQ ID NO: 1215602 - RNA, 11 nt, Mycobacterium bovis subsp bovis AF2122/97
acaaagccacg

SEQ ID NO: 1215603 - RNA, 18 nt, Mycobacterium bovis subsp bovis AF2122/97
acaaagccacgcagaaca

SEQ ID NO: 1215604 - RNA, 17 nt, Mycobacterium bovis subsp bovis AF2122/97
acaaacggcgacccagc

SEQ ID NO: 1215605 - RNA, 15 nt, Mycobacterium bovis subsp bovis AF2122/97
acaaacccaacacca

SEQ ID NO: 1215606 - RNA, 22 nt, Mycobacterium bovis subsp bovis AF2122/97
acaaaccgucggggaugccgaa

SEQ ID NO: 1215607 - RNA, 12 nt, Mycobacterium bovis subsp bovis AF2122/97
acaaaagccagg

SEQ ID NO: 1215608 - RNA, 12 nt, Mycobacterium bovis subsp bovis AF2122/97
acaaaaggccau

SEQ ID NO: 1215609 - RNA, 13 nt, Mycobacterium bovis subsp bovis AF2122/97
aauggaaugaucg

SEQ ID NO: 1215610 - RNA, 15 nt, Mycobacterium bovis subsp bovis AF2122/97
aauggacaccaaccc

SEQ ID NO: 1215611 - RNA, 16 nt, Mycobacterium bovis subsp bovis AF2122/97
aauggacugaacacca

SEQ ID NO: 1215612 - RNA, 15 nt, Mycobacterium bovis subsp bovis AF2122/97
aauggacugaacacc

SEQ ID NO: 1215613 - RNA, 14 nt, Mycobacterium bovis subsp bovis AF2122/97
aauggccugcagcg

SEQ ID NO: 1215614 - RNA, 15 nt, Mycobacterium bovis subsp bovis AF2122/97
aauggccgccgcagc

SEQ ID NO: 1215615 - RNA, 13 nt, Mycobacterium bovis subsp bovis AF2122/97
aauggccagcacc

SEQ ID NO: 1215616 - RNA, 23 nt, Mycobacterium bovis subsp bovis AF2122/97
aaugcuguggcccgucauacucg

SEQ ID NO: 1215617 - RNA, 14 nt, Mycobacterium bovis subsp bovis AF2122/97
aaugccagcggcac

SEQ ID NO: 1215618 - RNA, 16 nt, Mycobacterium bovis subsp bovis AF2122/97
aaugucgcucaaaccc

SEQ ID NO: 1215619 - RNA, 14 nt, Mycobacterium bovis subsp bovis AF2122/97
aaugucggcagggc

SEQ ID NO: 1215620 - RNA, 16 nt, Mycobacterium bovis subsp bovis AF2122/97
aauguauugcggugag

SEQ ID NO: 1215621 - RNA, 19 nt, Mycobacterium bovis subsp bovis AF2122/97
aauuggucgaacagcgaac

SEQ ID NO: 1215622 - RNA, 23 nt, Mycobacterium bovis subsp bovis AF2122/97
aauugcccaagcgcguuguuguc

SEQ ID NO: 1215623 - RNA, 18 nt, Mycobacterium bovis subsp bovis AF2122/97
aauucuggugucaucaau

SEQ ID NO: 1215624 - RNA, 18 nt, Mycobacterium bovis subsp bovis AF2122/97
aauugugugcagcagcau

SEQ ID NO: 1215625 - RNA, 13 nt, Mycobacterium bovis subsp bovis AF2122/97
aauuccagccagc

SEQ ID NO: 1215626 - RNA, 14 nt, Mycobacterium bovis subsp bovis AF2122/97
aauuccagccagcc

SEQ ID NO: 1215627 - RNA, 15 nt, Mycobacterium bovis subsp bovis AF2122/97
aauuccacugcgcca

SEQ ID NO: 1215628 - RNA, 23 nt, Mycobacterium bovis subsp bovis AF2122/97
aauucaugccgguguugccgaag

SEQ ID NO: 1215629 - RNA, 17 nt, Mycobacterium bovis subsp bovis AF2122/97
aauucucgcccugacgu

SEQ ID NO: 1215630 - RNA, 15 nt, Mycobacterium bovis subsp bovis AF2122/97
aauucacgcaccaca

SEQ ID NO: 1215631 - RNA, 14 nt, Mycobacterium bovis subsp bovis AF2122/97
aaucacggucaucu

SEQ ID NO: 1215632 - RNA, 16 nt, Mycobacterium bovis subsp bovis AF2122/97
aaucacaauuccacaa

SEQ ID NO: 1215633 - RNA, 12 nt, Mycobacterium bovis subsp bovis AF2122/97
aaucaagcagcg

SEQ ID NO: 1215634 - RNA, 21 nt, Mycobacterium bovis subsp bovis AF2122/97
aaucaaggugaucagcaggau

SEQ ID NO: 1215635 - RNA, 17 nt, Mycobacterium bovis subsp bovis AF2122/97
aaucgcaucuagguuca

SEQ ID NO: 1215636 - RNA, 21 nt, Mycobacterium bovis subsp bovis AF2122/97
aaucgcacagcgcgaucaacg

SEQ ID NO: 1215637 - RNA, 16 nt, Mycobacterium bovis subsp bovis AF2122/97
aaucgcggagccagga

SEQ ID NO: 1215638 - RNA, 13 nt, Mycobacterium bovis subsp bovis AF2122/97
aaucgugcgggua

SEQ ID NO: 1215639 - RNA, 15 nt, Mycobacterium bovis subsp bovis AF2122/97
aauccggcugcggua

SEQ ID NO: 1215640 - RNA, 22 nt, Mycobacterium bovis subsp bovis AF2122/97
aauccgcccuugccgccuuggc

SEQ ID NO: 1215641 - RNA, 13 nt, Mycobacterium bovis subsp bovis AF2122/97
aauccgacgugga

SEQ ID NO: 1215642 - RNA, 16 nt, Mycobacterium bovis subsp bovis AF2122/97
aauccgacguggaacu

SEQ ID NO: 1215643 - RNA, 23 nt, Mycobacterium bovis subsp bovis AF2122/97
aaucgacugaucgccacccgguc

SEQ ID NO: 1215644 - RNA, 12 nt, Mycobacterium bovis subsp bovis AF2122/97
aauccagcgccg

SEQ ID NO: 1215645 - RNA, 19 nt, Mycobacterium bovis subsp bovis AF2122/97
aauccaaaccuuugauucu

SEQ ID NO: 1215646 - RNA, 20 nt, Mycobacterium bovis subsp bovis AF2122/97
aacaccagggccuccacccg

SEQ ID NO: 1215647 - RNA, 21 nt, Mycobacterium bovis subsp bovis AF2122/97
aacaccagcaggcggcucaac

SEQ ID NO: 1215648 - RNA, 19 nt, Mycobacterium bovis subsp bovis AF2122/97
aacaccagaugcaccucgc

SEQ ID NO: 1215649 - RNA, 10 nt, Mycobacterium bovis subsp bovis AF2122/97
aacaccacac

SEQ ID NO: 1215650 - RNA, 20 nt, Mycobacterium bovis subsp bovis AF2122/97
aacacauugccggccaccag

SEQ ID NO: 1215651 - RNA, 19 nt, Mycobacterium bovis subsp bovis AF2122/97
aacacaugccgcaggcucu

SEQ ID NO: 1215652 - RNA, 18 nt, Mycobacterium bovis subsp bovis AF2122/97
aacaauuucgaccuugca

SEQ ID NO: 1215653 - RNA, 22 nt, Mycobacterium bovis subsp bovis AF2122/97
aacaccgcccggcccggcucgg

SEQ ID NO: 1215654 - RNA, 19 nt, Mycobacterium bovis subsp bovis AF2122/97
aacaccgguggcuucaacc

SEQ ID NO: 1215655 - RNA, 22 nt, Mycobacterium bovis subsp bovis AF2122/97
aacaccggugucggccagcaac

SEQ ID NO: 1215656 - RNA, 16 nt, Mycobacterium bovis subsp bovis AF2122/97
aacaccggccagcggc

SEQ ID NO: 1215657 - RNA, 19 nt, Mycobacterium bovis subsp bovis AF2122/97
aacaccggcugguucaaca

SEQ ID NO: 1215658 - RNA, 20 nt, Mycobacterium bovis subsp bovis AF2122/97
aacaccgugcaccagcucac

SEQ ID NO: 1215659 - RNA, 16 nt, Mycobacterium bovis subsp bovis AF2122/97
aacaccguccaauugg

SEQ ID NO: 1215660 - RNA, 17 nt, Mycobacterium bovis subsp bovis AF2122/97
aacaccccgggcgccga

SEQ ID NO: 1215661 - RNA, 19 nt, Mycobacterium bovis subsp bovis AF2122/97
aacaccuaugggaccggca

SEQ ID NO: 1215662 - RNA, 14 nt, Mycobacterium bovis subsp bovis AF2122/97
aacacgaccucuug

SEQ ID NO: 1215663 - RNA, 14 nt, Mycobacterium bovis subsp bovis AF2122/97
aacacgacagccag

SEQ ID NO: 1215664 - RNA, 15 nt, Mycobacterium bovis subsp bovis AF2122/97
aacacgccucgccga

SEQ ID NO: 1215665 - RNA, 22 nt, Mycobacterium bovis subsp bovis AF2122/97
aacacgcugaauuccacugcgc

SEQ ID NO: 1215666 - RNA, 18 nt, Mycobacterium bovis subsp bovis AF2122/97
aacagcagguuggcgagc

SEQ ID NO: 1215667 - RNA, 21 nt, Mycobacterium bovis subsp bovis AF2122/97
aacagauucggugccagcagg

SEQ ID NO: 1215668 - RNA, 17 nt, Mycobacterium bovis subsp bovis AF2122/97
aacagacauuugucaac

SEQ ID NO: 1215669 - RNA, 18 nt, Mycobacterium bovis subsp bovis AF2122/97
aacagccgagccagcagc

SEQ ID NO: 1215670 - RNA, 15 nt, Mycobacterium bovis subsp bovis AF2122/97
aacauacgaaacaug

SEQ ID NO: 1215671 - RNA, 19 nt, Mycobacterium bovis subsp bovis AF2122/97
aaccaaccucggaucgcca

SEQ ID NO: 1215672 - RNA, 18 nt, Mycobacterium bovis subsp bovis AF2122/97
aaccaagaaucaccggca

SEQ ID NO: 1215673 - RNA, 22 nt, Mycobacterium bovis subsp bovis AF2122/97
aacccugccacgcgugacucgg

SEQ ID NO: 1215674 - RNA, 22 nt, Mycobacterium bovis subsp bovis AF2122/97
aacccugcggugcaggauucgg

SEQ ID NO: 1215675 - RNA, 12 nt, Mycobacterium bovis subsp bovis AF2122/97
aacccucgccac

SEQ ID NO: 1215676 - RNA, 18 nt, Mycobacterium bovis subsp bovis AF2122/97
aacccucagccgcgccgg

SEQ ID NO: 1215677 - RNA, 19 nt, Mycobacterium bovis subsp bovis AF2122/97
aacccguuuugggugaucg

SEQ ID NO: 1215678 - RNA, 23 nt, Mycobacterium bovis subsp bovis AF2122/97
aaccgccaucgucgaagaccuca

SEQ ID NO: 1215679 - RNA, 19 nt, Mycobacterium bovis subsp bovis AF2122/97
aaccgcguuaugccaggcg

SEQ ID NO: 1215680 - RNA, 17 nt, Mycobacterium bovis subsp bovis AF2122/97
aaccgcaccgucccagu

SEQ ID NO: 1215681 - RNA, 13 nt, Mycobacterium bovis subsp bovis AF2122/97
aacccggugacca

SEQ ID NO: 1215682 - RNA, 19 nt, Mycobacterium bovis subsp bovis AF2122/97
aacccggugaccagcaacc

SEQ ID NO: 1215683 - RNA, 23 nt, Mycobacterium bovis subsp bovis AF2122/97
aacccgguguuccggucgcccga

SEQ ID NO: 1215684 - RNA, 14 nt, Mycobacterium bovis subsp bovis AF2122/97
aacccgggccgcca

SEQ ID NO: 1215685 - RNA, 15 nt, Mycobacterium bovis subsp bovis AF2122/97
aacccguaagacaga

SEQ ID NO: 1215686 - RNA, 21 nt, Mycobacterium bovis subsp bovis AF2122/97
aacccguauugccaaagcccg

SEQ ID NO: 1215687 - RNA, 22 nt, Mycobacterium bovis subsp bovis AF2122/97
aacccguauugccaaagcccga

SEQ ID NO: 1215688 - RNA, 21 nt, Mycobacterium bovis subsp bovis AF2122/97
aacccgucgagccgugccucg

SEQ ID NO: 1215689 - RNA, 14 nt, Mycobacterium bovis subsp bovis AF2122/97
aacccagucccaac

SEQ ID NO: 1215690 - RNA, 23 nt, Mycobacterium bovis subsp bovis AF2122/97
aacccagcgacgcggccagcggc

SEQ ID NO: 1215691 - RNA, 15 nt, Mycobacterium bovis subsp bovis AF2122/97
aacccagcaccacaa

SEQ ID NO: 1215692 - RNA, 12 nt, Mycobacterium bovis subsp bovis AF2122/97
aacccagcacug

SEQ ID NO: 1215693 - RNA, 18 nt, Mycobacterium bovis subsp bovis AF2122/97
aacccaacaccagcagca

SEQ ID NO: 1215694 - RNA, 20 nt, Mycobacterium bovis subsp bovis AF2122/97
aacccaaccgcgccaccucc

SEQ ID NO: 1215695 - RNA, 17 nt, Mycobacterium bovis subsp bovis AF2122/97
aaccacggucagcacgc

SEQ ID NO: 1215696 - RNA, 19 nt, Mycobacterium bovis subsp bovis AF2122/97
aaccacuggauggcucgcc

SEQ ID NO: 1215697 - RNA, 19 nt, Mycobacterium bovis subsp bovis AF2122/97
aaccacucgcucaggaaca

SEQ ID NO: 1215698 - RNA, 23 nt, Mycobacterium bovis subsp bovis AF2122/97
aaccacucgcucaggaacaauga

SEQ ID NO: 1215699 - RNA, 22 nt, Mycobacterium bovis subsp bovis AF2122/97
aaccaucguuguugaccaccac

SEQ ID NO: 1215700 - RNA, 18 nt, Mycobacterium bovis subsp bovis AF2122/97
aacgcccguguugaagaa

SEQ ID NO: 1215701 - RNA, 13 nt, Mycobacterium bovis subsp bovis AF2122/97
aacgcccgcuuca

SEQ ID NO: 1215702 - RNA, 11 nt, Mycobacterium bovis subsp bovis AF2122/97
aacgcccggca

SEQ ID NO: 1215703 - RNA, 19 nt, Mycobacterium bovis subsp bovis AF2122/97
aacgcccaacgucgccagg

SEQ ID NO: 1215704 - RNA, 22 nt, Mycobacterium bovis subsp bovis AF2122/97
aacgcacccaucgugcugaagc

SEQ ID NO: 1215705 - RNA, 17 nt, Mycobacterium bovis subsp bovis AF2122/97
aaccggcgugucgaggg

SEQ ID NO: 1215706 - RNA, 23 nt, Mycobacterium bovis subsp bovis AF2122/97
aaccggcgguuuuggggugcuuu

SEQ ID NO: 1215707 - RNA, 15 nt, Mycobacterium bovis subsp bovis AF2122/97
aaccgggcaaaucaa

SEQ ID NO: 1215708 - RNA, 19 nt, Mycobacterium bovis subsp bovis AF2122/97
aaccgggcaaaucaagcac

SEQ ID NO: 1215709 - RNA, 20 nt, Mycobacterium bovis subsp bovis AF2122/97
aaccgggcaaaucaagcaca

SEQ ID NO: 1215710 - RNA, 18 nt, Mycobacterium bovis subsp bovis AF2122/97
aaccgggcaaaucaagca

SEQ ID NO: 1215711 - RNA, 23 nt, Mycobacterium bovis subsp bovis AF2122/97
aacgauggggcaagcccaaaaag

SEQ ID NO: 1215712 - RNA, 18 nt, Mycobacterium bovis subsp bovis AF2122/97
aacgcugucccagcccgg

SEQ ID NO: 1215713 - RNA, 20 nt, Mycobacterium bovis subsp bovis AF2122/97
aacgcuggccacucacauug

SEQ ID NO: 1215714 - RNA, 18 nt, Mycobacterium bovis subsp bovis AF2122/97
aacgcugggcggcuaccc

SEQ ID NO: 1215715 - RNA, 15 nt, Mycobacterium bovis subsp bovis AF2122/97
aacggaaacucaagu

SEQ ID NO: 1215716 - RNA, 20 nt, Mycobacterium bovis subsp bovis AF2122/97
aacgccgggucguacaacac

SEQ ID NO: 1215717 - RNA, 18 nt, Mycobacterium bovis subsp bovis AF2122/97
aacgccggguucgccgga

SEQ ID NO: 1215718 - RNA, 15 nt, Mycobacterium bovis subsp bovis AF2122/97
aacgccgccagcaga

SEQ ID NO: 1215719 - RNA, 13 nt, Mycobacterium bovis subsp bovis AF2122/97
aacgccgccagcg

SEQ ID NO: 1215720 - RNA, 16 nt, Mycobacterium bovis subsp bovis AF2122/97
aacgccgcgacgugga

SEQ ID NO: 1215721 - RNA, 21 nt, Mycobacterium bovis subsp bovis AF2122/97
aacgccgcccgccggugaucg

SEQ ID NO: 1215722 - RNA, 19 nt, Mycobacterium bovis subsp bovis AF2122/97
aacgcugacgugaagcaga

SEQ ID NO: 1215723 - RNA, 18 nt, Mycobacterium bovis subsp bovis AF2122/97
aacgggucggcgaccacc

SEQ ID NO: 1215724 - RNA, 13 nt, Mycobacterium bovis subsp bovis AF2122/97
aacgggguggcac

SEQ ID NO: 1215725 - RNA, 19 nt, Mycobacterium bovis subsp bovis AF2122/97
aacgggguggcacgcauga

SEQ ID NO: 1215726 - RNA, 15 nt, Mycobacterium bovis subsp bovis AF2122/97
aacuacccgccagca

SEQ ID NO: 1215727 - RNA, 18 nt, Mycobacterium bovis subsp bovis AF2122/97
aacuaacggcagccaccg

SEQ ID NO: 1215728 - RNA, 19 nt, Mycobacterium bovis subsp bovis AF2122/97
aacgucagugccccgcagc

SEQ ID NO: 1215729 - RNA, 14 nt, Mycobacterium bovis subsp bovis AF2122/97
aacgugccucucuc

SEQ ID NO: 1215730 - RNA, 14 nt, Mycobacterium bovis subsp bovis AF2122/97
aacguguugaccag

SEQ ID NO: 1215731 - RNA, 17 nt, Mycobacterium bovis subsp bovis AF2122/97
aacguucggcacaacca

SEQ ID NO: 1215732 - RNA, 15 nt, Mycobacterium bovis subsp bovis AF2122/97
aacugcagcauggcc

SEQ ID NO: 1215733 - RNA, 15 nt, Mycobacterium bovis subsp bovis AF2122/97
aacugcucgccgagg

SEQ ID NO: 1215734 - RNA, 21 nt, Mycobacterium bovis subsp bovis AF2122/97
aacugcggcccaugaucucgg

SEQ ID NO: 1215735 - RNA, 19 nt, Mycobacterium bovis subsp bovis AF2122/97
aacuggacggggaagcccg

SEQ ID NO: 1215736 - RNA, 18 nt, Mycobacterium bovis subsp bovis AF2122/97
aacuggcggugcagugcc

SEQ ID NO: 1215737 - RNA, 21 nt, Mycobacterium bovis subsp bovis AF2122/97
aacugaugaaccacggcaggc

SEQ ID NO: 1215738 - RNA, 23 nt, Mycobacterium bovis subsp bovis AF2122/97
aacugaauggcaccgaggccaag

SEQ ID NO: 1215739 - RNA, 16 nt, Mycobacterium bovis subsp bovis AF2122/97
aacucaacgacaccau

SEQ ID NO: 1215740 - RNA, 14 nt, Mycobacterium bovis subsp bovis AF2122/97
aacugggcggccug

SEQ ID NO: 1215741 - RNA, 20 nt, Mycobacterium bovis subsp bovis AF2122/97
aacugggcaccggcggucug

SEQ ID NO: 1215742 - RNA, 19 nt, Mycobacterium bovis subsp bovis AF2122/97
aagaaccugagcaccaaga

SEQ ID NO: 1215743 - RNA, 21 nt, Mycobacterium bovis subsp bovis AF2122/97
aagaacaugcucacgaucacc

SEQ ID NO: 1215744 - RNA, 13 nt, Mycobacterium bovis subsp bovis AF2122/97
aacuugcugacga

SEQ ID NO: 1215745 - RNA, 15 nt, Mycobacterium bovis subsp bovis AF2122/97
aacuugcugacgaau

SEQ ID NO: 1215746 - RNA, 12 nt, Mycobacterium bovis subsp bovis AF2122/97
aacuuggcggcc

SEQ ID NO: 1215747 - RNA, 18 nt, Mycobacterium bovis subsp bovis AF2122/97
aagaagcccgaguuguuc

SEQ ID NO: 1215748 - RNA, 20 nt, Mycobacterium bovis subsp bovis AF2122/97
aagaagaugaucgcgaacau

SEQ ID NO: 1215749 - RNA, 20 nt, Mycobacterium bovis subsp bovis AF2122/97
aaguggugcccuugaagaaa

SEQ ID NO: 1215750 - RNA, 16 nt, Mycobacterium bovis subsp bovis AF2122/97
aaguuggcugagcagc

SEQ ID NO: 1215751 - RNA, 17 nt, Mycobacterium bovis subsp bovis AF2122/97
aaguuggcugagcagcg

SEQ ID NO: 1215752 - RNA, 13 nt, Mycobacterium bovis subsp bovis AF2122/97
aaguuggcuuucg

SEQ ID NO: 1215753 - RNA, 23 nt, Mycobacterium bovis subsp bovis AF2122/97
aaguaauagcuguuggccagccg

SEQ ID NO: 1215754 - RNA, 13 nt, Mycobacterium bovis subsp bovis AF2122/97
aagugcagggcug

SEQ ID NO: 1215755 - RNA, 18 nt, Mycobacterium bovis subsp bovis AF2122/97
aaguggcgucagugcaga

SEQ ID NO: 1215756 - RNA, 23 nt, Mycobacterium bovis subsp bovis AF2122/97
aagugcacccgguugugcgcgcg

SEQ ID NO: 1215757 - RNA, 13 nt, Mycobacterium bovis subsp bovis AF2122/97
aagugcacugcga

SEQ ID NO: 1215758 - RNA, 15 nt, Mycobacterium bovis subsp bovis AF2122/97
aauacccgcuggccc

SEQ ID NO: 1215759 - RNA, 20 nt, Mycobacterium bovis subsp bovis AF2122/97
aauacgcugcuggucuugcc

SEQ ID NO: 1215760 - RNA, 15 nt, Mycobacterium bovis subsp bovis AF2122/97
aauaacgcgggaucc

SEQ ID NO: 1215761 - RNA, 13 nt, Mycobacterium bovis subsp bovis AF2122/97
aauacagcuugau

SEQ ID NO: 1215762 - RNA, 18 nt, Mycobacterium bovis subsp bovis AF2122/97
aagaucucggccaggaug

SEQ ID NO: 1215763 - RNA, 15 nt, Mycobacterium bovis subsp bovis AF2122/97
aagaaucagcagcag

SEQ ID NO: 1215764 - RNA, 16 nt, Mycobacterium bovis subsp bovis AF2122/97
aagcacaccgccagcg

SEQ ID NO: 1215765 - RNA, 20 nt, Mycobacterium bovis subsp bovis AF2122/97
aagcacaccgccagcggcaa

SEQ ID NO: 1215766 - RNA, 16 nt, Mycobacterium bovis subsp bovis AF2122/97
aagcacacuggccaca

SEQ ID NO: 1215767 - RNA, 21 nt, Mycobacterium bovis subsp bovis AF2122/97
aagcaauuccaccgccgagau

SEQ ID NO: 1215768 - RNA, 14 nt, Mycobacterium bovis subsp bovis AF2122/97
aagcaccagccagc

SEQ ID NO: 1215769 - RNA, 17 nt, Mycobacterium bovis subsp bovis AF2122/97
aagcaccagccagccug

SEQ ID NO: 1215770 - RNA, 13 nt, Mycobacterium bovis subsp bovis AF2122/97
aagcacagcccgg

SEQ ID NO: 1215771 - RNA, 15 nt, Mycobacterium bovis subsp bovis AF2122/97
aagcacagcccggcg

SEQ ID NO: 1215772 - RNA, 17 nt, Mycobacterium bovis subsp bovis AF2122/97
aagcacagcgaacagac

SEQ ID NO: 1215773 - RNA, 19 nt, Mycobacterium bovis subsp bovis AF2122/97
aagcaagggcgauggucgg

SEQ ID NO: 1215774 - RNA, 19 nt, Mycobacterium bovis subsp bovis AF2122/97
aagcacgguggccgagccg

SEQ ID NO: 1215775 - RNA, 12 nt, Mycobacterium bovis subsp bovis AF2122/97
aagcagccagca

SEQ ID NO: 1215776 - RNA, 21 nt, Mycobacterium bovis subsp bovis AF2122/97
aagcagccagcaacaccagau

SEQ ID NO: 1215777 - RNA, 20 nt, Mycobacterium bovis subsp bovis AF2122/97
aagcaucgcguuguaggcuu

SEQ ID NO: 1215778 - RNA, 18 nt, Mycobacterium bovis subsp bovis AF2122/97
aagccacucgcgcacaua

SEQ ID NO: 1215779 - RNA, 15 nt, Mycobacterium bovis subsp bovis AF2122/97
aagccagcacugcca

SEQ ID NO: 1215780 - RNA, 17 nt, Mycobacterium bovis subsp bovis AF2122/97
aagcccgaagacggggu

SEQ ID NO: 1215781 - RNA, 20 nt, Mycobacterium bovis subsp bovis AF2122/97
aagcccacguuuagggugcc

SEQ ID NO: 1215782 - RNA, 20 nt, Mycobacterium bovis subsp bovis AF2122/97
aagcccagcgauucagccug

SEQ ID NO: 1215783 - RNA, 17 nt, Mycobacterium bovis subsp bovis AF2122/97
aaggugcgcugggugau

SEQ ID NO: 1215784 - RNA, 11 nt, Mycobacterium bovis subsp bovis AF2122/97
aaggugcugcg

SEQ ID NO: 1215785 - RNA, 13 nt, Mycobacterium bovis subsp bovis AF2122/97
aaggugcacugcc

SEQ ID NO: 1215786 - RNA, 17 nt, Mycobacterium bovis subsp bovis AF2122/97
aaggugaucagcaggau

SEQ ID NO: 1215787 - RNA, 19 nt, Mycobacterium bovis subsp bovis AF2122/97
aagguguccuccagcugcg

SEQ ID NO: 1215788 - RNA, 20 nt, Mycobacterium bovis subsp bovis AF2122/97
aagguguggugacagagcgg

SEQ ID NO: 1215789 - RNA, 21 nt, Mycobacterium bovis subsp bovis AF2122/97
aaggugucgacggugucuugg

SEQ ID NO: 1215790 - RNA, 17 nt, Mycobacterium bovis subsp bovis AF2122/97
aaggugaugaacaccgg

SEQ ID NO: 1215791 - RNA, 22 nt, Mycobacterium bovis subsp bovis AF2122/97
aaggucgacaugggucggcugu

SEQ ID NO: 1215792 - RNA, 15 nt, Mycobacterium bovis subsp bovis AF2122/97
aaggcggucaccacc

SEQ ID NO: 1215793 - RNA, 14 nt, Mycobacterium bovis subsp bovis AF2122/97
aaggcggccaggug

SEQ ID NO: 1215794 - RNA, 21 nt, Mycobacterium bovis subsp bovis AF2122/97
aaggcgacgccgaaaaugccg

SEQ ID NO: 1215795 - RNA, 14 nt, Mycobacterium bovis subsp bovis AF2122/97
aaggcaaacaccag

SEQ ID NO: 1215796 - RNA, 21 nt, Mycobacterium bovis subsp bovis AF2122/97
aaggcaaacaccagcccggcg

SEQ ID NO: 1215797 - RNA, 17 nt, Mycobacterium bovis subsp bovis AF2122/97
aagcguacucgugauga

SEQ ID NO: 1215798 - RNA, 18 nt, Mycobacterium bovis subsp bovis AF2122/97
aagcggaucuggccuugg

SEQ ID NO: 1215799 - RNA, 14 nt, Mycobacterium bovis subsp bovis AF2122/97
aagccgagcaucag

SEQ ID NO: 1215800 - RNA, 16 nt, Mycobacterium bovis subsp bovis AF2122/97
aagccgacgaccagca

SEQ ID NO: 1215801 - RNA, 19 nt, Mycobacterium bovis subsp bovis AF2122/97
aagccgacgaccagcagau

SEQ ID NO: 1215802 - RNA, 14 nt, Mycobacterium bovis subsp bovis AF2122/97
aagccgcaccagau

SEQ ID NO: 1215803 - RNA, 15 nt, Mycobacterium bovis subsp bovis AF2122/97
aagccgcaccgcugu

SEQ ID NO: 1215804 - RNA, 18 nt, Mycobacterium bovis subsp bovis AF2122/97
aagccgcccgaguugugg

SEQ ID NO: 1215805 - RNA, 12 nt, Mycobacterium bovis subsp bovis AF2122/97
aagccgcugaac

SEQ ID NO: 1215806 - RNA, 14 nt, Mycobacterium bovis subsp bovis AF2122/97
aagcucggccacca

SEQ ID NO: 1215807 - RNA, 18 nt, Mycobacterium bovis subsp bovis AF2122/97
aagcucugcgucgugccc

SEQ ID NO: 1215808 - RNA, 16 nt, Mycobacterium bovis subsp bovis AF2122/97
aagcgugcgccgacuu

SEQ ID NO: 1215809 - RNA, 22 nt, Mycobacterium bovis subsp bovis AF2122/97
aagcugcucgucggcgccggcg

SEQ ID NO: 1215810 - RNA, 21 nt, Mycobacterium bovis subsp bovis AF2122/97
aaggagccgggccguccgggu

SEQ ID NO: 1215811 - RNA, 13 nt, Mycobacterium bovis subsp bovis AF2122/97
aaggaaaagccug

SEQ ID NO: 1215812 - RNA, 14 nt, Mycobacterium bovis subsp bovis AF2122/97
cggcgccgagcagc

SEQ ID NO: 1215813 - RNA, 23 nt, Mycobacterium bovis subsp bovis AF2122/97
cggcgccgccacugccggcagcg

SEQ ID NO: 1215814 - RNA, 19 nt, Mycobacterium bovis subsp bovis AF2122/97
cggcgccgcccaacgcgag

SEQ ID NO: 1215815 - RNA, 20 nt, Mycobacterium bovis subsp bovis AF2122/97
cggcgccgcccaacgcgagc

SEQ ID NO: 1215816 - RNA, 18 nt, Mycobacterium bovis subsp bovis AF2122/97
cggcgacgaacugaagcc

SEQ ID NO: 1215817 - RNA, 19 nt, Mycobacterium bovis subsp bovis AF2122/97
cggcgacgaccgucggcuc

SEQ ID NO: 1215818 - RNA, 20 nt, Mycobacterium bovis subsp bovis AF2122/97
cggcgacgaucucgccgcca

SEQ ID NO: 1215819 - RNA, 15 nt, Mycobacterium bovis subsp bovis AF2122/97
cggcgacgccgcugg

SEQ ID NO: 1215820 - RNA, 15 nt, Mycobacterium bovis subsp bovis AF2122/97
cggcgacggcgccca

SEQ ID NO: 1215821 - RNA, 17 nt, Mycobacterium bovis subsp bovis AF2122/97
cggcgacggccagcgcg

SEQ ID NO: 1215822 - RNA, 15 nt, Mycobacterium bovis subsp bovis AF2122/97
cggcgacggcggcac

SEQ ID NO: 1215823 - RNA, 15 nt, Mycobacterium bovis subsp bovis AF2122/97
cggcgaugcggucgg

SEQ ID NO: 1215824 - RNA, 18 nt, Mycobacterium bovis subsp bovis AF2122/97
cggcgaugcggucggcca

SEQ ID NO: 1215825 - RNA, 22 nt, Mycobacterium bovis subsp bovis AF2122/97
cggcgaugcggucggccacauc

SEQ ID NO: 1215826 - RNA, 22 nt, Mycobacterium bovis subsp bovis AF2122/97
cggcgaugggccgguccggggc

SEQ ID NO: 1215827 - RNA, 17 nt, Mycobacterium bovis subsp bovis AF2122/97
cggcgauuacggccagu

SEQ ID NO: 1215828 - RNA, 16 nt, Mycobacterium bovis subsp bovis AF2122/97
cggcgaugcguccgcc

SEQ ID NO: 1215829 - RNA, 20 nt, Mycobacterium bovis subsp bovis AF2122/97
cggcgaugcguccgcccagc

SEQ ID NO: 1215830 - RNA, 15 nt, Mycobacterium bovis subsp bovis AF2122/97
cggcgaugcugagcc

SEQ ID NO: 1215831 - RNA, 12 nt, Mycobacterium bovis subsp bovis AF2122/97
cggcgccaccgu

SEQ ID NO: 1215832 - RNA, 18 nt, Mycobacterium bovis subsp bovis AF2122/97
cggcgccaccguggugga

SEQ ID NO: 1215833 - RNA, 20 nt, Mycobacterium bovis subsp bovis AF2122/97
cggcgccacccgcgccgccc

SEQ ID NO: 1215834 - RNA, 18 nt, Mycobacterium bovis subsp bovis AF2122/97
cggcgcaagcgccgcgcu

SEQ ID NO: 1215835 - RNA, 19 nt, Mycobacterium bovis subsp bovis AF2122/97
cggcgccacccgcgccgcc

SEQ ID NO: 1215836 - RNA, 19 nt, Mycobacterium bovis subsp bovis AF2122/97
cggcgauuuugcgucgcgc

SEQ ID NO: 1215837 - RNA, 14 nt, Mycobacterium bovis subsp bovis AF2122/97
cggcgccagcgccg

SEQ ID NO: 1215838 - RNA, 19 nt, Mycobacterium bovis subsp bovis AF2122/97
cggcgccaguauggccgcc

SEQ ID NO: 1215839 - RNA, 21 nt, Mycobacterium bovis subsp bovis AF2122/97
cggcgccaguauggccgccac

SEQ ID NO: 1215840 - RNA, 17 nt, Mycobacterium bovis subsp bovis AF2122/97
cggcgcccuccuuggcg

SEQ ID NO: 1215841 - RNA, 17 nt, Mycobacterium bovis subsp bovis AF2122/97
cggcgccauuggcgucc

SEQ ID NO: 1215842 - RNA, 14 nt, Mycobacterium bovis subsp bovis AF2122/97
cggcgcccggggcg

SEQ ID NO: 1215843 - RNA, 22 nt, Mycobacterium bovis subsp bovis AF2122/97
cggccacaccuuggccgccggc

SEQ ID NO: 1215844 - RNA, 18 nt, Mycobacterium bovis subsp bovis AF2122/97
cggcauuggcgucgucgc

SEQ ID NO: 1215845 - RNA, 20 nt, Mycobacterium bovis subsp bovis AF2122/97
cggcauucucgagcacccgc

SEQ ID NO: 1215846 - RNA, 20 nt, Mycobacterium bovis subsp bovis AF2122/97
cggcauugcccgagcccagc

SEQ ID NO: 1215847 - RNA, 14 nt, Mycobacterium bovis subsp bovis AF2122/97
cggcagcagcggug

SEQ ID NO: 1215848 - RNA, 21 nt, Mycobacterium bovis subsp bovis AF2122/97
cggcagcaucggcaccccggc

SEQ ID NO: 1215849 - RNA, 23 nt, Mycobacterium bovis subsp bovis AF2122/97
cggcagcaucggcaccccggcca

SEQ ID NO: 1215850 - RNA, 17 nt, Mycobacterium bovis subsp bovis AF2122/97
cggcagcagcgggcgcg

SEQ ID NO: 1215851 - RNA, 19 nt, Mycobacterium bovis subsp bovis AF2122/97
cggcacugcccagcagacc

SEQ ID NO: 1215852 - RNA, 20 nt, Mycobacterium bovis subsp bovis AF2122/97
cggcagauguguccggcauc

SEQ ID NO: 1215853 - RNA, 20 nt, Mycobacterium bovis subsp bovis AF2122/97
cggcacugcgaaucuccgcg

SEQ ID NO: 1215854 - RNA, 14 nt, Mycobacterium bovis subsp bovis AF2122/97
cggcacuggccccg

SEQ ID NO: 1215855 - RNA, 12 nt, Mycobacterium bovis subsp bovis AF2122/97
cggccaccaccg

SEQ ID NO: 1215856 - RNA, 17 nt, Mycobacterium bovis subsp bovis AF2122/97
cggccaccaccgcgccg

SEQ ID NO: 1215857 - RNA, 14 nt, Mycobacterium bovis subsp bovis AF2122/97
cggccaccucggug

SEQ ID NO: 1215858 - RNA, 13 nt, Mycobacterium bovis subsp bovis AF2122/97
cggccaccggcgu

SEQ ID NO: 1215859 - RNA, 15 nt, Mycobacterium bovis subsp bovis AF2122/97
cggccaccaccgccg

SEQ ID NO: 1215860 - RNA, 20 nt, Mycobacterium bovis subsp bovis AF2122/97
cggccaccaccaggcugacg

SEQ ID NO: 1215861 - RNA, 13 nt, Mycobacterium bovis subsp bovis AF2122/97
cggccaccaacuc

SEQ ID NO: 1215862 - RNA, 14 nt, Mycobacterium bovis subsp bovis AF2122/97
cggccaccacaacg

SEQ ID NO: 1215863 - RNA, 12 nt, Mycobacterium bovis subsp bovis AF2122/97
cggccaccaacc

SEQ ID NO: 1215864 - RNA, 13 nt, Mycobacterium bovis subsp bovis AF2122/97
cggccaccaaccu

SEQ ID NO: 1215865 - RNA, 14 nt, Mycobacterium bovis subsp bovis AF2122/97
cggccaccaaccuc

SEQ ID NO: 1215866 - RNA, 21 nt, Mycobacterium bovis subsp bovis AF2122/97
cggccacaugccacagcggcg

SEQ ID NO: 1215867 - RNA, 18 nt, Mycobacterium bovis subsp bovis AF2122/97
cggccacauaccaccacg

SEQ ID NO: 1215868 - RNA, 18 nt, Mycobacterium bovis subsp bovis AF2122/97
cggccacauccagcgcuu

SEQ ID NO: 1215869 - RNA, 13 nt, Mycobacterium bovis subsp bovis AF2122/97
cggccacggccau

SEQ ID NO: 1215870 - RNA, 15 nt, Mycobacterium bovis subsp bovis AF2122/97
cggccacgguccggc

SEQ ID NO: 1215871 - RNA, 21 nt, Mycobacterium bovis subsp bovis AF2122/97
cggccacgguggagcgcgccu

SEQ ID NO: 1215872 - RNA, 13 nt, Mycobacterium bovis subsp bovis AF2122/97
cggccacgcgcac

SEQ ID NO: 1215873 - RNA, 13 nt, Mycobacterium bovis subsp bovis AF2122/97
cggccagagccgc

SEQ ID NO: 1215874 - RNA, 17 nt, Mycobacterium bovis subsp bovis AF2122/97
cggccagagccgcgcgc

SEQ ID NO: 1215875 - RNA, 17 nt, Mycobacterium bovis subsp bovis AF2122/97
cggccagaaacccggcg

SEQ ID NO: 1215876 - RNA, 16 nt, Mycobacterium bovis subsp bovis AF2122/97
cggccacucaacgacc

SEQ ID NO: 1215877 - RNA, 17 nt, Mycobacterium bovis subsp bovis AF2122/97
cggccagcgcccgcagg

SEQ ID NO: 1215878 - RNA, 16 nt, Mycobacterium bovis subsp bovis AF2122/97
cggccagcgcaccgcc

SEQ ID NO: 1215879 - RNA, 19 nt, Mycobacterium bovis subsp bovis AF2122/97
cggccacugauucgcaggc

SEQ ID NO: 1215880 - RNA, 15 nt, Mycobacterium bovis subsp bovis AF2122/97
cggccagcaacuuug

SEQ ID NO: 1215881 - RNA, 15 nt, Mycobacterium bovis subsp bovis AF2122/97
cggccagcgcgcgcg

SEQ ID NO: 1215882 - RNA, 15 nt, Mycobacterium bovis subsp bovis AF2122/97
cggccagcgcggcgc

SEQ ID NO: 1215883 - RNA, 24 nt, Mycobacterium bovis subsp bovis AF2122/97
cggccaggucgacaccgcggugcc

SEQ ID NO: 1215884 - RNA, 21 nt, Mycobacterium bovis subsp bovis AF2122/97
cggccaggucgagcaccggcu

SEQ ID NO: 1215885 - RNA, 24 nt, Mycobacterium bovis subsp bovis AF2122/97
cggccaggucgcgauagccgccgc

SEQ ID NO: 1215886 - RNA, 13 nt, Mycobacterium bovis subsp bovis AF2122/97
cggccaggucggc

SEQ ID NO: 1215887 - RNA, 21 nt, Mycobacterium bovis subsp bovis AF2122/97
cggccaggucggcguugaucg

SEQ ID NO: 1215888 - RNA, 14 nt, Mycobacterium bovis subsp bovis AF2122/97
cggcccacgcgcac

SEQ ID NO: 1215889 - RNA, 15 nt, Mycobacterium bovis subsp bovis AF2122/97
cggcccaccaggccc

SEQ ID NO: 1215890 - RNA, 21 nt, Mycobacterium bovis subsp bovis AF2122/97
cggcccacaccagcgcagcau

SEQ ID NO: 1215891 - RNA, 20 nt, Mycobacterium bovis subsp bovis AF2122/97
cggcccacacuaggccccac

SEQ ID NO: 1215892 - RNA, 15 nt, Mycobacterium bovis subsp bovis AF2122/97
cggcccacaccagcg

SEQ ID NO: 1215893 - RNA, 15 nt, Mycobacterium bovis subsp bovis AF2122/97
cggccaguccgggga

SEQ ID NO: 1215894 - RNA, 16 nt, Mycobacterium bovis subsp bovis AF2122/97
cggccagugccaucgc

SEQ ID NO: 1215895 - RNA, 16 nt, Mycobacterium bovis subsp bovis AF2122/97
cggccagugcgcgcgu

SEQ ID NO: 1215896 - RNA, 18 nt, Mycobacterium bovis subsp bovis AF2122/97
cggccagugcgcgcguca

SEQ ID NO: 1215897 - RNA, 12 nt, Mycobacterium bovis subsp bovis AF2122/97
cggccagugaca

SEQ ID NO: 1215898 - RNA, 19 nt, Mycobacterium bovis subsp bovis AF2122/97
cggcccgcagcccgccggg

SEQ ID NO: 1215899 - RNA, 18 nt, Mycobacterium bovis subsp bovis AF2122/97
cggcccgaucaccagccc

SEQ ID NO: 1215900 - RNA, 16 nt, Mycobacterium bovis subsp bovis AF2122/97
cggcccgauccagugg

SEQ ID NO: 1215901 - RNA, 16 nt, Mycobacterium bovis subsp bovis AF2122/97
cggcccgagccgcuag

SEQ ID NO: 1215902 - RNA, 20 nt, Mycobacterium bovis subsp bovis AF2122/97
cggcccgacccggccgaugg

SEQ ID NO: 1215903 - RNA, 13 nt, Mycobacterium bovis subsp bovis AF2122/97
cggccccugccac

SEQ ID NO: 1215904 - RNA, 15 nt, Mycobacterium bovis subsp bovis AF2122/97
cggcccagcgccccc

SEQ ID NO: 1215905 - RNA, 18 nt, Mycobacterium bovis subsp bovis AF2122/97
cggcccagcgcccccagc

SEQ ID NO: 1215906 - RNA, 17 nt, Mycobacterium bovis subsp bovis AF2122/97
cggcccacggugucccg

SEQ ID NO: 1215907 - RNA, 16 nt, Mycobacterium bovis subsp bovis AF2122/97
cggcccccgaggcugg

SEQ ID NO: 1215908 - RNA, 16 nt, Mycobacterium bovis subsp bovis AF2122/97
cggcccccggucgagc

SEQ ID NO: 1215909 - RNA, 20 nt, Mycobacterium bovis subsp bovis AF2122/97
cggccccgccgaugccgccg

SEQ ID NO: 1215910 - RNA, 22 nt, Mycobacterium bovis subsp bovis AF2122/97
cggccccgccgaugccgccggc

SEQ ID NO: 1215911 - RNA, 17 nt, Mycobacterium bovis subsp bovis AF2122/97
cggccccgcgccaccuc

SEQ ID NO: 1215912 - RNA, 13 nt, Mycobacterium bovis subsp bovis AF2122/97
cggccccgccagc

SEQ ID NO: 1215913 - RNA, 19 nt, Mycobacterium bovis subsp bovis AF2122/97
cggccccgccagcgccgcc

SEQ ID NO: 1215914 - RNA, 19 nt, Mycobacterium bovis subsp bovis AF2122/97
cggccccgccggcgccgcc

SEQ ID NO: 1215915 - RNA, 14 nt, Mycobacterium bovis subsp bovis AF2122/97
cggccccgcgcagc

SEQ ID NO: 1215916 - RNA, 14 nt, Mycobacterium bovis subsp bovis AF2122/97
cggccgcaggcuug

SEQ ID NO: 1215917 - RNA, 21 nt, Mycobacterium bovis subsp bovis AF2122/97
cggccgcaucgcccaacaacg

SEQ ID NO: 1215918 - RNA, 14 nt, Mycobacterium bovis subsp bovis AF2122/97
cggccgcgcugcag

SEQ ID NO: 1215919 - RNA, 15 nt, Mycobacterium bovis subsp bovis AF2122/97
cggccgcggcggccc

SEQ ID NO: 1215920 - RNA, 17 nt, Mycobacterium bovis subsp bovis AF2122/97
cggccgcggccucccgc

SEQ ID NO: 1215921 - RNA, 16 nt, Mycobacterium bovis subsp bovis AF2122/97
cggccgcgcugcagca

SEQ ID NO: 1215922 - RNA, 18 nt, Mycobacterium bovis subsp bovis AF2122/97
cggccgcgggcgcgcagg

SEQ ID NO: 1215923 - RNA, 17 nt, Mycobacterium bovis subsp bovis AF2122/97
cggccgcgggucccggc

SEQ ID NO: 1215924 - RNA, 22 nt, Mycobacterium bovis subsp bovis AF2122/97
cggccgcggucggccaccaacu

SEQ ID NO: 1215925 - RNA, 22 nt, Mycobacterium bovis subsp bovis AF2122/97
cggccgcguaaaccggcugacc

SEQ ID NO: 1215926 - RNA, 18 nt, Mycobacterium bovis subsp bovis AF2122/97
cggccgcggucggccacc

SEQ ID NO: 1215927 - RNA, 21 nt, Mycobacterium bovis subsp bovis AF2122/97
cggccgcgucacggaccugga

SEQ ID NO: 1215928 - RNA, 19 nt, Mycobacterium bovis subsp bovis AF2122/97
cggccgcuauggcccgggc

SEQ ID NO: 1215929 - RNA, 18 nt, Mycobacterium bovis subsp bovis AF2122/97
cggccgcucacauacagc

SEQ ID NO: 1215930 - RNA, 13 nt, Mycobacterium bovis subsp bovis AF2122/97
cggccgcgugcuc

SEQ ID NO: 1215931 - RNA, 16 nt, Mycobacterium bovis subsp bovis AF2122/97
cggccgcucaccccgc

SEQ ID NO: 1215932 - RNA, 17 nt, Mycobacterium bovis subsp bovis AF2122/97
cggccggcgccggcgcg

SEQ ID NO: 1215933 - RNA, 13 nt, Mycobacterium bovis subsp bovis AF2122/97
cggccggccgcug

SEQ ID NO: 1215934 - RNA, 20 nt, Mycobacterium bovis subsp bovis AF2122/97
cggccggccgcccgcucgau

SEQ ID NO: 1215935 - RNA, 14 nt, Mycobacterium bovis subsp bovis AF2122/97
cggccggcggccgc

SEQ ID NO: 1215936 - RNA, 16 nt, Mycobacterium bovis subsp bovis AF2122/97
cggccggcggccgccc

SEQ ID NO: 1215937 - RNA, 13 nt, Mycobacterium bovis subsp bovis AF2122/97
cggccggcuccgg

SEQ ID NO: 1215938 - RNA, 15 nt, Mycobacterium bovis subsp bovis AF2122/97
cggccgggccugcac

SEQ ID NO: 1215939 - RNA, 13 nt, Mycobacterium bovis subsp bovis AF2122/97
cggccgaaggcgc

SEQ ID NO: 1215940 - RNA, 16 nt, Mycobacterium bovis subsp bovis AF2122/97
cggccgaacgccucgc

SEQ ID NO: 1215941 - RNA, 21 nt, Mycobacterium bovis subsp bovis AF2122/97
cggccgaaacuucgcccgggc

SEQ ID NO: 1215942 - RNA, 22 nt, Mycobacterium bovis subsp bovis AF2122/97
cggcccuuguggaguacggcga

SEQ ID NO: 1215943 - RNA, 16 nt, Mycobacterium bovis subsp bovis AF2122/97
cggccgacaccgccac

SEQ ID NO: 1215944 - RNA, 19 nt, Mycobacterium bovis subsp bovis AF2122/97
cggccgacaacccggccgg

SEQ ID NO: 1215945 - RNA, 21 nt, Mycobacterium bovis subsp bovis AF2122/97
cggccgacaacccggccgggc

SEQ ID NO: 1215946 - RNA, 22 nt, Mycobacterium bovis subsp bovis AF2122/97
cggccgagggauugccgugcuc

SEQ ID NO: 1215947 - RNA, 17 nt, Mycobacterium bovis subsp bovis AF2122/97
cggccgaguaccagccc

SEQ ID NO: 1215948 - RNA, 21 nt, Mycobacterium bovis subsp bovis AF2122/97
cggccgaugcgacccgcagac

SEQ ID NO: 1215949 - RNA, 14 nt, Mycobacterium bovis subsp bovis AF2122/97
cggccgaugcgcag

SEQ ID NO: 1215950 - RNA, 13 nt, Mycobacterium bovis subsp bovis AF2122/97
cggcccggggacg

SEQ ID NO: 1215951 - RNA, 18 nt, Mycobacterium bovis subsp bovis AF2122/97
cggcccgggucagcgacc

SEQ ID NO: 1215952 - RNA, 16 nt, Mycobacterium bovis subsp bovis AF2122/97
cggcccguagcugcgc

SEQ ID NO: 1215953 - RNA, 19 nt, Mycobacterium bovis subsp bovis AF2122/97
cggcccguagcugcgcagc

SEQ ID NO: 1215954 - RNA, 18 nt, Mycobacterium bovis subsp bovis AF2122/97
cggcccgucaccgcgggc

SEQ ID NO: 1215955 - RNA, 15 nt, Mycobacterium bovis subsp bovis AF2122/97
cggcccggcucggug

SEQ ID NO: 1215956 - RNA, 22 nt, Mycobacterium bovis subsp bovis AF2122/97
cggcccggcucggugcgccaga

SEQ ID NO: 1215957 - RNA, 20 nt, Mycobacterium bovis subsp bovis AF2122/97
cggcccggcacccggugaga

SEQ ID NO: 1215958 - RNA, 13 nt, Mycobacterium bovis subsp bovis AF2122/97
cggcccugccgcc

SEQ ID NO: 1215959 - RNA, 18 nt, Mycobacterium bovis subsp bovis AF2122/97
cggcccugaccucauguc

SEQ ID NO: 1215960 - RNA, 24 nt, Mycobacterium bovis subsp bovis AF2122/97
cggcccucgaugccgcguagcugg

SEQ ID NO: 1215961 - RNA, 19 nt, Mycobacterium bovis subsp bovis AF2122/97
cggcccgggucagcgaccu

SEQ ID NO: 1215962 - RNA, 21 nt, Mycobacterium bovis subsp bovis AF2122/97
cggcccucgaugccgcguagc

SEQ ID NO: 1215963 - RNA, 12 nt, Mycobacterium bovis subsp bovis AF2122/97
cggcccuggaca

SEQ ID NO: 1215964 - RNA, 21 nt, Mycobacterium bovis subsp bovis AF2122/97
cggcccuggacauaccggccc

SEQ ID NO: 1215965 - RNA, 20 nt, Mycobacterium bovis subsp bovis AF2122/97
cggccuggucggccaggucg

SEQ ID NO: 1215966 - RNA, 16 nt, Mycobacterium bovis subsp bovis AF2122/97
cggccuugccgccggc

SEQ ID NO: 1215967 - RNA, 17 nt, Mycobacterium bovis subsp bovis AF2122/97
cggccuugccgccggcc

SEQ ID NO: 1215968 - RNA, 20 nt, Mycobacterium bovis subsp bovis AF2122/97
cggccuugccgccggccccg

SEQ ID NO: 1215969 - RNA, 22 nt, Mycobacterium bovis subsp bovis AF2122/97
cggccuugccgccggcgccgcc

SEQ ID NO: 1215970 - RNA, 20 nt, Mycobacterium bovis subsp bovis AF2122/97
cggccuugcgggcucucggc

SEQ ID NO: 1215971 - RNA, 19 nt, Mycobacterium bovis subsp bovis AF2122/97
cggccuugaucaccgugcg

SEQ ID NO: 1215972 - RNA, 19 nt, Mycobacterium bovis subsp bovis AF2122/97
cggccuuugucgccuucuu

SEQ ID NO: 1215973 - RNA, 20 nt, Mycobacterium bovis subsp bovis AF2122/97
cggcgaaggccgcgcgcagg

SEQ ID NO: 1215974 - RNA, 20 nt, Mycobacterium bovis subsp bovis AF2122/97
cggcgaagucacgcacccgg

SEQ ID NO: 1215975 - RNA, 14 nt, Mycobacterium bovis subsp bovis AF2122/97
cggcgaagcgggcg

SEQ ID NO: 1215976 - RNA, 15 nt, Mycobacterium bovis subsp bovis AF2122/97
cggcgaagcgggcgu

SEQ ID NO: 1215977 - RNA, 21 nt, Mycobacterium bovis subsp bovis AF2122/97
cggcgaacggauucccgccca

SEQ ID NO: 1215978 - RNA, 17 nt, Mycobacterium bovis subsp bovis AF2122/97
cggcgacaacagcacgu

SEQ ID NO: 1215979 - RNA, 14 nt, Mycobacterium bovis subsp bovis AF2122/97
cggcgaauacgacc

SEQ ID NO: 1215980 - RNA, 14 nt, Mycobacterium bovis subsp bovis AF2122/97
cggcgaccgucggg

SEQ ID NO: 1215981 - RNA, 19 nt, Mycobacterium bovis subsp bovis AF2122/97
cggcgaccucggcggcggc

SEQ ID NO: 1215982 - RNA, 16 nt, Mycobacterium bovis subsp bovis AF2122/97
cggccggggcgaacgg

SEQ ID NO: 1215983 - RNA, 22 nt, Mycobacterium bovis subsp bovis AF2122/97
cggccgguagaucuucggccgc

SEQ ID NO: 1215984 - RNA, 23 nt, Mycobacterium bovis subsp bovis AF2122/97
cggccgguagaucuucggccgca

SEQ ID NO: 1215985 - RNA, 19 nt, Mycobacterium bovis subsp bovis AF2122/97
cggccgguaguagcugacc

SEQ ID NO: 1215986 - RNA, 15 nt, Mycobacterium bovis subsp bovis AF2122/97
cggccggugcccggg

SEQ ID NO: 1215987 - RNA, 20 nt, Mycobacterium bovis subsp bovis AF2122/97
cggccucaacacccggccga

SEQ ID NO: 1215988 - RNA, 11 nt, Mycobacterium bovis subsp bovis AF2122/97
cggccuggggc

SEQ ID NO: 1215989 - RNA, 14 nt, Mycobacterium bovis subsp bovis AF2122/97
cggccuggggcagc

SEQ ID NO: 1215990 - RNA, 19 nt, Mycobacterium bovis subsp bovis AF2122/97
cggccuggggcagccgggc

SEQ ID NO: 1215991 - RNA, 15 nt, Mycobacterium bovis subsp bovis AF2122/97
cggccuccccgaccu

SEQ ID NO: 1215992 - RNA, 19 nt, Mycobacterium bovis subsp bovis AF2122/97
cggccucccgggccgccgc

SEQ ID NO: 1215993 - RNA, 18 nt, Mycobacterium bovis subsp bovis AF2122/97
cggccuccgggccaugug

SEQ ID NO: 1215994 - RNA, 15 nt, Mycobacterium bovis subsp bovis AF2122/97
cggccuccuccccga

SEQ ID NO: 1215995 - RNA, 16 nt, Mycobacterium bovis subsp bovis AF2122/97
cggccuggcacccggg

SEQ ID NO: 1215996 - RNA, 22 nt, Mycobacterium bovis subsp bovis AF2122/97
cgcuuguugaccucacgggcgc

SEQ ID NO: 1215997 - RNA, 23 nt, Mycobacterium bovis subsp bovis AF2122/97
cgcuaccgaacaguaggccuccg

SEQ ID NO: 1215998 - RNA, 15 nt, Mycobacterium bovis subsp bovis AF2122/97
cgcuaccccagccgg

SEQ ID NO: 1215999 - RNA, 19 nt, Mycobacterium bovis subsp bovis AF2122/97
cgcuaccccagccggcagc

SEQ ID NO: 1216000 - RNA, 17 nt, Mycobacterium bovis subsp bovis AF2122/97
cgcuacaucagaaucag

SEQ ID NO: 1216001 - RNA, 23 nt, Mycobacterium bovis subsp bovis AF2122/97
cgcuaaaacgccagucgagcacc

SEQ ID NO: 1216002 - RNA, 20 nt, Mycobacterium bovis subsp bovis AF2122/97
cgcuaauggauccagcccga

SEQ ID NO: 1216003 - RNA, 13 nt, Mycobacterium bovis subsp bovis AF2122/97
cgcuuucuuggcg

SEQ ID NO: 1216004 - RNA, 16 nt, Mycobacterium bovis subsp bovis AF2122/97
cggaaggcccggcgcg

SEQ ID NO: 1216005 - RNA, 13 nt, Mycobacterium bovis subsp bovis AF2122/97
cggaaggccagcu

SEQ ID NO: 1216006 - RNA, 18 nt, Mycobacterium bovis subsp bovis AF2122/97
cggaagcuucgggaacca

SEQ ID NO: 1216007 - RNA, 17 nt, Mycobacterium bovis subsp bovis AF2122/97
cggaaggacggcagcca

SEQ ID NO: 1216008 - RNA, 12 nt, Mycobacterium bovis subsp bovis AF2122/97
cggaagcgccgg

SEQ ID NO: 1216009 - RNA, 16 nt, Mycobacterium bovis subsp bovis AF2122/97
cggaauacccgcuggc

SEQ ID NO: 1216010 - RNA, 19 nt, Mycobacterium bovis subsp bovis AF2122/97
cggaaggcccggcgcggcc

SEQ ID NO: 1216011 - RNA, 20 nt, Mycobacterium bovis subsp bovis AF2122/97
cggaacuguaggucacagcu

SEQ ID NO: 1216012 - RNA, 13 nt, Mycobacterium bovis subsp bovis AF2122/97
cggaacgggcagu

SEQ ID NO: 1216013 - RNA, 23 nt, Mycobacterium bovis subsp bovis AF2122/97
cggaacgaaugucaccccgccca

SEQ ID NO: 1216014 - RNA, 18 nt, Mycobacterium bovis subsp bovis AF2122/97
cggaacgccgccagcgcg

SEQ ID NO: 1216015 - RNA, 15 nt, Mycobacterium bovis subsp bovis AF2122/97
cggaaacaagcaagc

SEQ ID NO: 1216016 - RNA, 14 nt, Mycobacterium bovis subsp bovis AF2122/97
cggaacccagcacu

SEQ ID NO: 1216017 - RNA, 23 nt, Mycobacterium bovis subsp bovis AF2122/97
cggaacagccuugugcaacggug

SEQ ID NO: 1216018 - RNA, 12 nt, Mycobacterium bovis subsp bovis AF2122/97
cggaacaccagc

SEQ ID NO: 1216019 - RNA, 16 nt, Mycobacterium bovis subsp bovis AF2122/97
cggagccgucgagcag

SEQ ID NO: 1216020 - RNA, 17 nt, Mycobacterium bovis subsp bovis AF2122/97
cggagccgucgagcagc

SEQ ID NO: 1216021 - RNA, 18 nt, Mycobacterium bovis subsp bovis AF2122/97
cggagccgucgagcagcc

SEQ ID NO: 1216022 - RNA, 12 nt, Mycobacterium bovis subsp bovis AF2122/97
cggagccgucgc

SEQ ID NO: 1216023 - RNA, 13 nt, Mycobacterium bovis subsp bovis AF2122/97
cggagccgaugac

SEQ ID NO: 1216024 - RNA, 15 nt, Mycobacterium bovis subsp bovis AF2122/97
cggagccgcccaagc

SEQ ID NO: 1216025 - RNA, 17 nt, Mycobacterium bovis subsp bovis AF2122/97
cggagccgaacccaagg

SEQ ID NO: 1216026 - RNA, 17 nt, Mycobacterium bovis subsp bovis AF2122/97
cggagccgccggccccg

SEQ ID NO: 1216027 - RNA, 19 nt, Mycobacterium bovis subsp bovis AF2122/97
cggagccgccggccccgcc

SEQ ID NO: 1216028 - RNA, 14 nt, Mycobacterium bovis subsp bovis AF2122/97
cggagccgccggcg

SEQ ID NO: 1216029 - RNA, 23 nt, Mycobacterium bovis subsp bovis AF2122/97
cggagcggggaaguuggcugagc

SEQ ID NO: 1216030 - RNA, 18 nt, Mycobacterium bovis subsp bovis AF2122/97
cggagcgggccagcaccc

SEQ ID NO: 1216031 - RNA, 10 nt, Mycobacterium bovis subsp bovis AF2122/97
cggagcuggg

SEQ ID NO: 1216032 - RNA, 12 nt, Mycobacterium bovis subsp bovis AF2122/97
cggagcugggcu

SEQ ID NO: 1216033 - RNA, 21 nt, Mycobacterium bovis subsp bovis AF2122/97
cggagcucuugcgggcagccg

SEQ ID NO: 1216034 - RNA, 19 nt, Mycobacterium bovis subsp bovis AF2122/97
cggagcucuugcgggcagc

SEQ ID NO: 1216035 - RNA, 23 nt, Mycobacterium bovis subsp bovis AF2122/97
cggagaugccauuucgucgucgc

SEQ ID NO: 1216036 - RNA, 15 nt, Mycobacterium bovis subsp bovis AF2122/97
cggagccaggacgac

SEQ ID NO: 1216037 - RNA, 24 nt, Mycobacterium bovis subsp bovis AF2122/97
cggagcaauuccacgaucggcuca

SEQ ID NO: 1216038 - RNA, 12 nt, Mycobacterium bovis subsp bovis AF2122/97
cggagccaggac

SEQ ID NO: 1216039 - RNA, 13 nt, Mycobacterium bovis subsp bovis AF2122/97
cggagccaggacg

SEQ ID NO: 1216040 - RNA, 19 nt, Mycobacterium bovis subsp bovis AF2122/97
cggacggcugagacagacc

SEQ ID NO: 1216041 - RNA, 23 nt, Mycobacterium bovis subsp bovis AF2122/97
cggacggcagccgggcggcagcg

SEQ ID NO: 1216042 - RNA, 14 nt, Mycobacterium bovis subsp bovis AF2122/97
cggacggcaggcug

SEQ ID NO: 1216043 - RNA, 17 nt, Mycobacterium bovis subsp bovis AF2122/97
cggacguucuggaucgu

SEQ ID NO: 1216044 - RNA, 22 nt, Mycobacterium bovis subsp bovis AF2122/97
cggagaccgccucgucgaugcc

SEQ ID NO: 1216045 - RNA, 22 nt, Mycobacterium bovis subsp bovis AF2122/97
cggagaccgaaucgggucggcc

SEQ ID NO: 1216046 - RNA, 15 nt, Mycobacterium bovis subsp bovis AF2122/97
cggagacacccgcca

SEQ ID NO: 1216047 - RNA, 20 nt, Mycobacterium bovis subsp bovis AF2122/97
cggacuggcauccgccccgc

SEQ ID NO: 1216048 - RNA, 17 nt, Mycobacterium bovis subsp bovis AF2122/97
cggacugcagcgcggcc

SEQ ID NO: 1216049 - RNA, 21 nt, Mycobacterium bovis subsp bovis AF2122/97
cggacuggccucggggaucgc

SEQ ID NO: 1216050 - RNA, 17 nt, Mycobacterium bovis subsp bovis AF2122/97
cggacuugaccagagca

SEQ ID NO: 1216051 - RNA, 21 nt, Mycobacterium bovis subsp bovis AF2122/97
cggacuugcgagccguagacc

SEQ ID NO: 1216052 - RNA, 17 nt, Mycobacterium bovis subsp bovis AF2122/97
cggaaucggagccgucg

SEQ ID NO: 1216053 - RNA, 15 nt, Mycobacterium bovis subsp bovis AF2122/97
cggaaucgucggcgc

SEQ ID NO: 1216054 - RNA, 21 nt, Mycobacterium bovis subsp bovis AF2122/97
cggaaucgcaccgugugggcc

SEQ ID NO: 1216055 - RNA, 14 nt, Mycobacterium bovis subsp bovis AF2122/97
cggaaucgcccggg

SEQ ID NO: 1216056 - RNA, 16 nt, Mycobacterium bovis subsp bovis AF2122/97
cggaauauggcggccg

SEQ ID NO: 1216057 - RNA, 14 nt, Mycobacterium bovis subsp bovis AF2122/97
cggaauaucggccg

SEQ ID NO: 1216058 - RNA, 20 nt, Mycobacterium bovis subsp bovis AF2122/97
cggacagcgcauccacaauc

SEQ ID NO: 1216059 - RNA, 16 nt, Mycobacterium bovis subsp bovis AF2122/97
cggacagcgccuggcc

SEQ ID NO: 1216060 - RNA, 15 nt, Mycobacterium bovis subsp bovis AF2122/97
cggacaccgcggcga

SEQ ID NO: 1216061 - RNA, 14 nt, Mycobacterium bovis subsp bovis AF2122/97
cggacaccucgggc

SEQ ID NO: 1216062 - RNA, 14 nt, Mycobacterium bovis subsp bovis AF2122/97
cggacacacaggcg

SEQ ID NO: 1216063 - RNA, 12 nt, Mycobacterium bovis subsp bovis AF2122/97
cggacaaccugg

SEQ ID NO: 1216064 - RNA, 14 nt, Mycobacterium bovis subsp bovis AF2122/97
cggacaaccugggg

SEQ ID NO: 1216065 - RNA, 12 nt, Mycobacterium bovis subsp bovis AF2122/97
cggaccaccagg

SEQ ID NO: 1216066 - RNA, 13 nt, Mycobacterium bovis subsp bovis AF2122/97
cggaccaccgccg

SEQ ID NO: 1216067 - RNA, 17 nt, Mycobacterium bovis subsp bovis AF2122/97
cggacagggcggcaacg

SEQ ID NO: 1216068 - RNA, 15 nt, Mycobacterium bovis subsp bovis AF2122/97
cggacaguucccggc

SEQ ID NO: 1216069 - RNA, 18 nt, Mycobacterium bovis subsp bovis AF2122/97
cggaccaucgccaggccc

SEQ ID NO: 1216070 - RNA, 17 nt, Mycobacterium bovis subsp bovis AF2122/97
cggacccaaagcacuuc

SEQ ID NO: 1216071 - RNA, 22 nt, Mycobacterium bovis subsp bovis AF2122/97
cggacgauggcgucggccagga

SEQ ID NO: 1216072 - RNA, 20 nt, Mycobacterium bovis subsp bovis AF2122/97
cggacgcaacacccgggcga

SEQ ID NO: 1216073 - RNA, 21 nt, Mycobacterium bovis subsp bovis AF2122/97
cggacgccaugcccgcacgcu

SEQ ID NO: 1216074 - RNA, 12 nt, Mycobacterium bovis subsp bovis AF2122/97
cggaccgcagcg

SEQ ID NO: 1216075 - RNA, 13 nt, Mycobacterium bovis subsp bovis AF2122/97
cggaccgauuucu

SEQ ID NO: 1216076 - RNA, 18 nt, Mycobacterium bovis subsp bovis AF2122/97
cggaccgccaccuuggcg

SEQ ID NO: 1216077 - RNA, 20 nt, Mycobacterium bovis subsp bovis AF2122/97
cggaccggcuuccccagcag

SEQ ID NO: 1216078 - RNA, 23 nt, Mycobacterium bovis subsp bovis AF2122/97
cggaccugaccgguggccaucgc

SEQ ID NO: 1216079 - RNA, 16 nt, Mycobacterium bovis subsp bovis AF2122/97
cggaccucgaagccca

SEQ ID NO: 1216080 - RNA, 19 nt, Mycobacterium bovis subsp bovis AF2122/97
cggaccucgaagcccagca

SEQ ID NO: 1216081 - RNA, 15 nt, Mycobacterium bovis subsp bovis AF2122/97
cggaugugucggcga

SEQ ID NO: 1216082 - RNA, 14 nt, Mycobacterium bovis subsp bovis AF2122/97
cggauucgcccggg

SEQ ID NO: 1216083 - RNA, 17 nt, Mycobacterium bovis subsp bovis AF2122/97
cggauucccgcccagca

SEQ ID NO: 1216084 - RNA, 18 nt, Mycobacterium bovis subsp bovis AF2122/97
cggauuccucgucaccgc

SEQ ID NO: 1216085 - RNA, 20 nt, Mycobacterium bovis subsp bovis AF2122/97
cggauucgggcgaagcuagc

SEQ ID NO: 1216086 - RNA, 14 nt, Mycobacterium bovis subsp bovis AF2122/97
cggauucuccgccc

SEQ ID NO: 1216087 - RNA, 17 nt, Mycobacterium bovis subsp bovis AF2122/97
cggauggaaggcggcca

SEQ ID NO: 1216088 - RNA, 19 nt, Mycobacterium bovis subsp bovis AF2122/97
cggaugcgcaaccgcggcc

SEQ ID NO: 1216089 - RNA, 13 nt, Mycobacterium bovis subsp bovis AF2122/97
cggauggccucgg

SEQ ID NO: 1216090 - RNA, 13 nt, Mycobacterium bovis subsp bovis AF2122/97
cggauggcggcca

SEQ ID NO: 1216091 - RNA, 15 nt, Mycobacterium bovis subsp bovis AF2122/97
cggaugcugucagca

SEQ ID NO: 1216092 - RNA, 14 nt, Mycobacterium bovis subsp bovis AF2122/97
cggauggccccgcc

SEQ ID NO: 1216093 - RNA, 14 nt, Mycobacterium bovis subsp bovis AF2122/97
cggaugcgauggcc

SEQ ID NO: 1216094 - RNA, 14 nt, Mycobacterium bovis subsp bovis AF2122/97
cggaucugcagcac

SEQ ID NO: 1216095 - RNA, 23 nt, Mycobacterium bovis subsp bovis AF2122/97
cggaucgggcaccccgaccacca

SEQ ID NO: 1216096 - RNA, 19 nt, Mycobacterium bovis subsp bovis AF2122/97
cggaucgaaguccacauau

SEQ ID NO: 1216097 - RNA, 24 nt, Mycobacterium bovis subsp bovis AF2122/97
cggauccgucgcguugagcgcagc

SEQ ID NO: 1216098 - RNA, 22 nt, Mycobacterium bovis subsp bovis AF2122/97
cggauccgauccgcacagcaac

SEQ ID NO: 1216099 - RNA, 15 nt, Mycobacterium bovis subsp bovis AF2122/97
cggaucccgaggcgc

SEQ ID NO: 1216100 - RNA, 19 nt, Mycobacterium bovis subsp bovis AF2122/97
cggauccaccacgcuggcc

SEQ ID NO: 1216101 - RNA, 22 nt, Mycobacterium bovis subsp bovis AF2122/97
cggauccaccacgcuggccucg

SEQ ID NO: 1216102 - RNA, 18 nt, Mycobacterium bovis subsp bovis AF2122/97
cggaucgccaggccgucg

SEQ ID NO: 1216103 - RNA, 15 nt, Mycobacterium bovis subsp bovis AF2122/97
cggaucggcuaccua

SEQ ID NO: 1216104 - RNA, 18 nt, Mycobacterium bovis subsp bovis AF2122/97
cggaucggcucgccaccu

SEQ ID NO: 1216105 - RNA, 14 nt, Mycobacterium bovis subsp bovis AF2122/97
cggaucgcggucag

SEQ ID NO: 1216106 - RNA, 18 nt, Mycobacterium bovis subsp bovis AF2122/97
cggaucgcgagcgccgcu

SEQ ID NO: 1216107 - RNA, 16 nt, Mycobacterium bovis subsp bovis AF2122/97
cggaucgcgcugcggg

SEQ ID NO: 1216108 - RNA, 12 nt, Mycobacterium bovis subsp bovis AF2122/97
cggaggcggcca

SEQ ID NO: 1216109 - RNA, 17 nt, Mycobacterium bovis subsp bovis AF2122/97
cggaggcgggugcggca

SEQ ID NO: 1216110 - RNA, 15 nt, Mycobacterium bovis subsp bovis AF2122/97
cggaggaaccccgcg

SEQ ID NO: 1216111 - RNA, 16 nt, Mycobacterium bovis subsp bovis AF2122/97
cggaggcugggcugag

SEQ ID NO: 1216112 - RNA, 14 nt, Mycobacterium bovis subsp bovis AF2122/97
cggaggugccggcg

SEQ ID NO: 1216113 - RNA, 16 nt, Mycobacterium bovis subsp bovis AF2122/97
cggagguggggugggg

SEQ ID NO: 1216114 - RNA, 19 nt, Mycobacterium bovis subsp bovis AF2122/97
cggaggccgccgcgccggu

SEQ ID NO: 1216115 - RNA, 21 nt, Mycobacterium bovis subsp bovis AF2122/97
cggaggucggagcgggcuccg

SEQ ID NO: 1216116 - RNA, 15 nt, Mycobacterium bovis subsp bovis AF2122/97
cggaguacuccagcc

SEQ ID NO: 1216117 - RNA, 16 nt, Mycobacterium bovis subsp bovis AF2122/97
cggagucgcgcagggc

SEQ ID NO: 1216118 - RNA, 19 nt, Mycobacterium bovis subsp bovis AF2122/97
cggagugucgaugcgcgcc

SEQ ID NO: 1216119 - RNA, 14 nt, Mycobacterium bovis subsp bovis AF2122/97
cggagucacgcagc

SEQ ID NO: 1216120 - RNA, 18 nt, Mycobacterium bovis subsp bovis AF2122/97
cggagucacgcagccgcg

SEQ ID NO: 1216121 - RNA, 20 nt, Mycobacterium bovis subsp bovis AF2122/97
cggagucacgcagccgcgcg

SEQ ID NO: 1216122 - RNA, 19 nt, Mycobacterium bovis subsp bovis AF2122/97
cggaguccgucgacaccgc

SEQ ID NO: 1216123 - RNA, 23 nt, Mycobacterium bovis subsp bovis AF2122/97
cggagucgagcacaccgaggucg

SEQ ID NO: 1216124 - RNA, 23 nt, Mycobacterium bovis subsp bovis AF2122/97
cggaguuaauuccucaaagccuc

SEQ ID NO: 1216125 - RNA, 18 nt, Mycobacterium bovis subsp bovis AF2122/97
cggaguucuucgaaggcg

SEQ ID NO: 1216126 - RNA, 21 nt, Mycobacterium bovis subsp bovis AF2122/97
cggaguugucgacggccaccc

SEQ ID NO: 1216127 - RNA, 14 nt, Mycobacterium bovis subsp bovis AF2122/97
cggaucaaaaacca

SEQ ID NO: 1216128 - RNA, 22 nt, Mycobacterium bovis subsp bovis AF2122/97
cggaucagcccgcgcagcagug

SEQ ID NO: 1216129 - RNA, 15 nt, Mycobacterium bovis subsp bovis AF2122/97
cggaucaggcccggg

SEQ ID NO: 1216130 - RNA, 22 nt, Mycobacterium bovis subsp bovis AF2122/97
cggaucaucgccgcggccaggu

SEQ ID NO: 1216131 - RNA, 22 nt, Mycobacterium bovis subsp bovis AF2122/97
cggauagugguugcggccgucg

SEQ ID NO: 1216132 - RNA, 16 nt, Mycobacterium bovis subsp bovis AF2122/97
cggauaguucaccaca

SEQ ID NO: 1216133 - RNA, 20 nt, Mycobacterium bovis subsp bovis AF2122/97
cggauaggacgaacaacgcg

SEQ ID NO: 1216134 - RNA, 16 nt, Mycobacterium bovis subsp bovis AF2122/97
cggauaucgaccaccg

SEQ ID NO: 1216135 - RNA, 14 nt, Mycobacterium bovis subsp bovis AF2122/97
cggauacgccccug

SEQ ID NO: 1216136 - RNA, 19 nt, Mycobacterium bovis subsp bovis AF2122/97
cggauacagccgccgccgg

SEQ ID NO: 1216137 - RNA, 23 nt, Mycobacterium bovis subsp bovis AF2122/97
cggauacagccgccgccggcaac

SEQ ID NO: 1216138 - RNA, 20 nt, Mycobacterium bovis subsp bovis AF2122/97
cggauacaugguccggccgc

SEQ ID NO: 1216139 - RNA, 15 nt, Mycobacterium bovis subsp bovis AF2122/97
cggauagcaccggca

SEQ ID NO: 1216140 - RNA, 16 nt, Mycobacterium bovis subsp bovis AF2122/97
cggauagcaccggcac

SEQ ID NO: 1216141 - RNA, 16 nt, Mycobacterium bovis subsp bovis AF2122/97
cggcaccgccgccccc

SEQ ID NO: 1216142 - RNA, 19 nt, Mycobacterium bovis subsp bovis AF2122/97
cggcaccgccggcuccgcc

SEQ ID NO: 1216143 - RNA, 11 nt, Mycobacterium bovis subsp bovis AF2122/97
cggcaccgccu

SEQ ID NO: 1216144 - RNA, 20 nt, Mycobacterium bovis subsp bovis AF2122/97
cggcaccgccggcaccgccg

SEQ ID NO: 1216145 - RNA, 17 nt, Mycobacterium bovis subsp bovis AF2122/97
cggcaccgccggcgccc

SEQ ID NO: 1216146 - RNA, 17 nt, Mycobacterium bovis subsp bovis AF2122/97
cggcaccgcuucaggcg

SEQ ID NO: 1216147 - RNA, 15 nt, Mycobacterium bovis subsp bovis AF2122/97
cggcaccgccugcgc

SEQ ID NO: 1216148 - RNA, 20 nt, Mycobacterium bovis subsp bovis AF2122/97
cggcaccgccugcgccgccc

SEQ ID NO: 1216149 - RNA, 15 nt, Mycobacterium bovis subsp bovis AF2122/97
cggcaccgcgccggc

SEQ ID NO: 1216150 - RNA, 17 nt, Mycobacterium bovis subsp bovis AF2122/97
cggcaccgcgccggcgg

SEQ ID NO: 1216151 - RNA, 16 nt, Mycobacterium bovis subsp bovis AF2122/97
cggcaccgcuucaggc

SEQ ID NO: 1216152 - RNA, 17 nt, Mycobacterium bovis subsp bovis AF2122/97
cggcacccggucggcca

SEQ ID NO: 1216153 - RNA, 21 nt, Mycobacterium bovis subsp bovis AF2122/97
cggcacccggugagaagaagc

SEQ ID NO: 1216154 - RNA, 17 nt, Mycobacterium bovis subsp bovis AF2122/97
cggcacccgcacggccu

SEQ ID NO: 1216155 - RNA, 16 nt, Mycobacterium bovis subsp bovis AF2122/97
cggcacccugcggcac

SEQ ID NO: 1216156 - RNA, 13 nt, Mycobacterium bovis subsp bovis AF2122/97
cggcaccgcagcg

SEQ ID NO: 1216157 - RNA, 22 nt, Mycobacterium bovis subsp bovis AF2122/97
cggcaccgcagcggaacugggc

SEQ ID NO: 1216158 - RNA, 11 nt, Mycobacterium bovis subsp bovis AF2122/97
cggcaccgcca

SEQ ID NO: 1216159 - RNA, 11 nt, Mycobacterium bovis subsp bovis AF2122/97
cggcaccgccg

SEQ ID NO: 1216160 - RNA, 14 nt, Mycobacterium bovis subsp bovis AF2122/97
cggcacucccuggg

SEQ ID NO: 1216161 - RNA, 18 nt, Mycobacterium bovis subsp bovis AF2122/97
cggcaccgugcggggggc

SEQ ID NO: 1216162 - RNA, 13 nt, Mycobacterium bovis subsp bovis AF2122/97
cggcaccggggcu

SEQ ID NO: 1216163 - RNA, 16 nt, Mycobacterium bovis subsp bovis AF2122/97
cggcaccggggcugcc

SEQ ID NO: 1216164 - RNA, 21 nt, Mycobacterium bovis subsp bovis AF2122/97
cggcaccggggcugcccgcgg

SEQ ID NO: 1216165 - RNA, 15 nt, Mycobacterium bovis subsp bovis AF2122/97
cggcaccggcucagg

SEQ ID NO: 1216166 - RNA, 16 nt, Mycobacterium bovis subsp bovis AF2122/97
cggcaccggcucaggg

SEQ ID NO: 1216167 - RNA, 19 nt, Mycobacterium bovis subsp bovis AF2122/97
cggcaccgauggcgcaccg

SEQ ID NO: 1216168 - RNA, 19 nt, Mycobacterium bovis subsp bovis AF2122/97
cggcaccuucggcccaugc

SEQ ID NO: 1216169 - RNA, 14 nt, Mycobacterium bovis subsp bovis AF2122/97
cggcaccauagcug

SEQ ID NO: 1216170 - RNA, 15 nt, Mycobacterium bovis subsp bovis AF2122/97
cggcaccagcggcac

SEQ ID NO: 1216171 - RNA, 17 nt, Mycobacterium bovis subsp bovis AF2122/97
cggcaccccggccacuu

SEQ ID NO: 1216172 - RNA, 20 nt, Mycobacterium bovis subsp bovis AF2122/97
cggcaccccacgccugccga

SEQ ID NO: 1216173 - RNA, 19 nt, Mycobacterium bovis subsp bovis AF2122/97
cggcaccagguugccgagg

SEQ ID NO: 1216174 - RNA, 14 nt, Mycobacterium bovis subsp bovis AF2122/97
cggcacccaccagu

SEQ ID NO: 1216175 - RNA, 17 nt, Mycobacterium bovis subsp bovis AF2122/97
cggcacccagucggcgc

SEQ ID NO: 1216176 - RNA, 14 nt, Mycobacterium bovis subsp bovis AF2122/97
cggcaccaccgcga

SEQ ID NO: 1216177 - RNA, 11 nt, Mycobacterium bovis subsp bovis AF2122/97
cggcaccacca

SEQ ID NO: 1216178 - RNA, 20 nt, Mycobacterium bovis subsp bovis AF2122/97
cggcacaggcggccagcauc

SEQ ID NO: 1216179 - RNA, 21 nt, Mycobacterium bovis subsp bovis AF2122/97
cggcacauugaucgacggcca

SEQ ID NO: 1216180 - RNA, 22 nt, Mycobacterium bovis subsp bovis AF2122/97
cggcacauugaucgacggccag

SEQ ID NO: 1216181 - RNA, 16 nt, Mycobacterium bovis subsp bovis AF2122/97
cggcacaucaugggcg

SEQ ID NO: 1216182 - RNA, 22 nt, Mycobacterium bovis subsp bovis AF2122/97
cggcaauucgggauaggacacc

SEQ ID NO: 1216183 - RNA, 15 nt, Mycobacterium bovis subsp bovis AF2122/97
cggcaagggcggcaa

SEQ ID NO: 1216184 - RNA, 21 nt, Mycobacterium bovis subsp bovis AF2122/97
cggcaaggguggggccggcgg

SEQ ID NO: 1216185 - RNA, 22 nt, Mycobacterium bovis subsp bovis AF2122/97
cggcaaggguggggccggcggu

SEQ ID NO: 1216186 - RNA, 13 nt, Mycobacterium bovis subsp bovis AF2122/97
cggcaaggguggu

SEQ ID NO: 1216187 - RNA, 17 nt, Mycobacterium bovis subsp bovis AF2122/97
cggcaaggucgcggcca

SEQ ID NO: 1216188 - RNA, 18 nt, Mycobacterium bovis subsp bovis AF2122/97
cggcaaugaggccgucug

SEQ ID NO: 1216189 - RNA, 19 nt, Mycobacterium bovis subsp bovis AF2122/97
cggcaaucucaugcccggg

SEQ ID NO: 1216190 - RNA, 21 nt, Mycobacterium bovis subsp bovis AF2122/97
cggcaaucgacucagcccggc

SEQ ID NO: 1216191 - RNA, 18 nt, Mycobacterium bovis subsp bovis AF2122/97
cggcaacgacugcaugaa

SEQ ID NO: 1216192 - RNA, 15 nt, Mycobacterium bovis subsp bovis AF2122/97
cggcaaccgccgcca

SEQ ID NO: 1216193 - RNA, 14 nt, Mycobacterium bovis subsp bovis AF2122/97
cggcaaccgggauc

SEQ ID NO: 1216194 - RNA, 15 nt, Mycobacterium bovis subsp bovis AF2122/97
cggcaacgguggcaa

SEQ ID NO: 1216195 - RNA, 20 nt, Mycobacterium bovis subsp bovis AF2122/97
cggcaacggcgcgccgacca

SEQ ID NO: 1216196 - RNA, 16 nt, Mycobacterium bovis subsp bovis AF2122/97
cggcaacggcggcauc

SEQ ID NO: 1216197 - RNA, 17 nt, Mycobacterium bovis subsp bovis AF2122/97
cggcaaggacggagccc

SEQ ID NO: 1216198 - RNA, 18 nt, Mycobacterium bovis subsp bovis AF2122/97
cggcaaggacguggcgcu

SEQ ID NO: 1216199 - RNA, 14 nt, Mycobacterium bovis subsp bovis AF2122/97
cggcaagccgggga

SEQ ID NO: 1216200 - RNA, 23 nt, Mycobacterium bovis subsp bovis AF2122/97
cggcaacagcgccaagacgucgg

SEQ ID NO: 1216201 - RNA, 14 nt, Mycobacterium bovis subsp bovis AF2122/97
cggcaacagcacca

SEQ ID NO: 1216202 - RNA, 14 nt, Mycobacterium bovis subsp bovis AF2122/97
cggcaacaccaccu

SEQ ID NO: 1216203 - RNA, 14 nt, Mycobacterium bovis subsp bovis AF2122/97
cggcaaccaaccgc

SEQ ID NO: 1216204 - RNA, 14 nt, Mycobacterium bovis subsp bovis AF2122/97
cggcaaccccgagc

SEQ ID NO: 1216205 - RNA, 12 nt, Mycobacterium bovis subsp bovis AF2122/97
cggcaaaggcgc

SEQ ID NO: 1216206 - RNA, 21 nt, Mycobacterium bovis subsp bovis AF2122/97
cggcaaaccugaguccggcac

SEQ ID NO: 1216207 - RNA, 23 nt, Mycobacterium bovis subsp bovis AF2122/97
cggauuggugggccagcagcaac

SEQ ID NO: 1216208 - RNA, 21 nt, Mycobacterium bovis subsp bovis AF2122/97
cggauuggugggccagcagca

SEQ ID NO: 1216209 - RNA, 19 nt, Mycobacterium bovis subsp bovis AF2122/97
cggauuggccuugugcaga

SEQ ID NO: 1216210 - RNA, 23 nt, Mycobacterium bovis subsp bovis AF2122/97
cggauuggccuugugcagaucag

SEQ ID NO: 1216211 - RNA, 16 nt, Mycobacterium bovis subsp bovis AF2122/97
cgcgaucaccgagucg

SEQ ID NO: 1216212 - RNA, 14 nt, Mycobacterium bovis subsp bovis AF2122/97
cgcgaucagcgcgc

SEQ ID NO: 1216213 - RNA, 15 nt, Mycobacterium bovis subsp bovis AF2122/97
cgcgaucagcgcgca

SEQ ID NO: 1216214 - RNA, 20 nt, Mycobacterium bovis subsp bovis AF2122/97
cgcgaucaccucgccacacu

SEQ ID NO: 1216215 - RNA, 18 nt, Mycobacterium bovis subsp bovis AF2122/97
cgcgaucagguaccggcg

SEQ ID NO: 1216216 - RNA, 18 nt, Mycobacterium bovis subsp bovis AF2122/97
cgcgauccacccggcauu

SEQ ID NO: 1216217 - RNA, 23 nt, Mycobacterium bovis subsp bovis AF2122/97
cgcgagcccggccucggcgagca

SEQ ID NO: 1216218 - RNA, 17 nt, Mycobacterium bovis subsp bovis AF2122/97
cgcgagaaggugcugcg

SEQ ID NO: 1216219 - RNA, 18 nt, Mycobacterium bovis subsp bovis AF2122/97
cgcgagcagacgcagaag

SEQ ID NO: 1216220 - RNA, 15 nt, Mycobacterium bovis subsp bovis AF2122/97
cgcgagcaacaccag

SEQ ID NO: 1216221 - RNA, 23 nt, Mycobacterium bovis subsp bovis AF2122/97
cgcgagaucgggccggccgccgc

SEQ ID NO: 1216222 - RNA, 18 nt, Mycobacterium bovis subsp bovis AF2122/97
cgcgagcaacaccagggc

SEQ ID NO: 1216223 - RNA, 15 nt, Mycobacterium bovis subsp bovis AF2122/97
cgcgaccccaggcgc

SEQ ID NO: 1216224 - RNA, 16 nt, Mycobacterium bovis subsp bovis AF2122/97
cgcgacccgaucgcgc

SEQ ID NO: 1216225 - RNA, 17 nt, Mycobacterium bovis subsp bovis AF2122/97
cgcgacccggcccagcg

SEQ ID NO: 1216226 - RNA, 23 nt, Mycobacterium bovis subsp bovis AF2122/97
cgcgaagugcuugggccgcugau

SEQ ID NO: 1216227 - RNA, 23 nt, Mycobacterium bovis subsp bovis AF2122/97
cgcgaccccugguagcacccacg

SEQ ID NO: 1216228 - RNA, 13 nt, Mycobacterium bovis subsp bovis AF2122/97
cgcgaagcugugc

SEQ ID NO: 1216229 - RNA, 18 nt, Mycobacterium bovis subsp bovis AF2122/97
cgcgaagcggaccgagcc

SEQ ID NO: 1216230 - RNA, 22 nt, Mycobacterium bovis subsp bovis AF2122/97
cgcgaagcgcucggcagccggc

SEQ ID NO: 1216231 - RNA, 16 nt, Mycobacterium bovis subsp bovis AF2122/97
cgcgaagccaccaggu

SEQ ID NO: 1216232 - RNA, 20 nt, Mycobacterium bovis subsp bovis AF2122/97
cgcgaagaacgacgccaccg

SEQ ID NO: 1216233 - RNA, 14 nt, Mycobacterium bovis subsp bovis AF2122/97
cgcgaaaccgccgu

SEQ ID NO: 1216234 - RNA, 14 nt, Mycobacterium bovis subsp bovis AF2122/97
cgcgaaacaccaga

SEQ ID NO: 1216235 - RNA, 21 nt, Mycobacterium bovis subsp bovis AF2122/97
cgccuuugccgccggcaccgc

SEQ ID NO: 1216236 - RNA, 18 nt, Mycobacterium bovis subsp bovis AF2122/97
cgccuuuuuucgccgccu

SEQ ID NO: 1216237 - RNA, 16 nt, Mycobacterium bovis subsp bovis AF2122/97
cgccgucucgcggugc

SEQ ID NO: 1216238 - RNA, 16 nt, Mycobacterium bovis subsp bovis AF2122/97
cgccgucucugccacg

SEQ ID NO: 1216239 - RNA, 16 nt, Mycobacterium bovis subsp bovis AF2122/97
cgccgucgucgcgcag

SEQ ID NO: 1216240 - RNA, 19 nt, Mycobacterium bovis subsp bovis AF2122/97
cgccgucggguuccuccuc

SEQ ID NO: 1216241 - RNA, 18 nt, Mycobacterium bovis subsp bovis AF2122/97
cgccgucggugccgccgc

SEQ ID NO: 1216242 - RNA, 23 nt, Mycobacterium bovis subsp bovis AF2122/97
cgccgucguacucgaccgcgagc

SEQ ID NO: 1216243 - RNA, 12 nt, Mycobacterium bovis subsp bovis AF2122/97
cgccgucggcga

SEQ ID NO: 1216244 - RNA, 17 nt, Mycobacterium bovis subsp bovis AF2122/97
cgccgucggcgacuccu

SEQ ID NO: 1216245 - RNA, 20 nt, Mycobacterium bovis subsp bovis AF2122/97
cgccgucggcgacuccucuc

SEQ ID NO: 1216246 - RNA, 12 nt, Mycobacterium bovis subsp bovis AF2122/97
cgccgucggcgc
